United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 188

SEQ ID NO: 7830073 - DNA, 21 bp, Homo sapiens
aattacagatggaattacaga

SEQ ID NO: 7830074 - DNA, 22 bp, Homo sapiens
aattacagtcggagcagcactg

SEQ ID NO: 7830075 - DNA, 22 bp, Homo sapiens
aattacagtcggagcagcactg

SEQ ID NO: 7830076 - DNA, 22 bp, Homo sapiens
aattacagtcggagcagcactg

SEQ ID NO: 7830077 - DNA, 22 bp, Homo sapiens
aattacagtcggagcagcactg

SEQ ID NO: 7830078 - DNA, 22 bp, Homo sapiens
aattacagtcggagcagcactg

SEQ ID NO: 7830079 - DNA, 22 bp, Homo sapiens
aattaactaaaattcactttat

SEQ ID NO: 7830080 - DNA, 22 bp, Homo sapiens
aattaacagagggcttattact

SEQ ID NO: 7830081 - DNA, 22 bp, Homo sapiens
agagcacagccaccatttacaa

SEQ ID NO: 7830082 - DNA, 22 bp, Homo sapiens
agagcacagaagttatatgtta

SEQ ID NO: 7830083 - DNA, 22 bp, Homo sapiens
agagcacagcagatctctgatg

SEQ ID NO: 7830084 - DNA, 22 bp, Homo sapiens
agagcacagaagttatatgtta

SEQ ID NO: 7830085 - DNA, 22 bp, Homo sapiens
agagcacagaagaataggtgct

SEQ ID NO: 7830086 - DNA, 22 bp, Homo sapiens
agagcacactgacgtcagtctg

SEQ ID NO: 7830087 - DNA, 22 bp, Homo sapiens
agagcacaaattttaaggaggc

SEQ ID NO: 7830088 - DNA, 22 bp, Homo sapiens
agagcacactgacgtcagtctg

SEQ ID NO: 7830089 - DNA, 22 bp, Homo sapiens
agagcacaaattagttggtctt

SEQ ID NO: 7830090 - DNA, 22 bp, Homo sapiens
aattaatatttgtggaattaat

SEQ ID NO: 7830091 - DNA, 22 bp, Homo sapiens
aattaatatttgtggaattaat

SEQ ID NO: 7830092 - DNA, 22 bp, Homo sapiens
aattaatggaaagtaaggaagg

SEQ ID NO: 7830093 - DNA, 22 bp, Homo sapiens
aattaattcagtttttaaggga

SEQ ID NO: 7830094 - DNA, 22 bp, Homo sapiens
aattaatggaaagtaaggaagg

SEQ ID NO: 7830095 - DNA, 22 bp, Homo sapiens
aattaactaatttggtacaaga

SEQ ID NO: 7830096 - DNA, 22 bp, Homo sapiens
aattaactaatttggtacaaga

SEQ ID NO: 7830097 - DNA, 22 bp, Homo sapiens
aattaagtcacacacctaaacc

SEQ ID NO: 7830098 - DNA, 22 bp, Homo sapiens
aattaagtcacacacctaaacc

SEQ ID NO: 7830099 - DNA, 22 bp, Homo sapiens
aattcattgccagaatctatga

SEQ ID NO: 7830100 - DNA, 22 bp, Homo sapiens
aattcattgccagaatctatga

SEQ ID NO: 7830101 - DNA, 22 bp, Homo sapiens
aattcattgccagaatctatga

SEQ ID NO: 7830102 - DNA, 22 bp, Homo sapiens
aattccaaatcaactagtctag

SEQ ID NO: 7830103 - DNA, 22 bp, Homo sapiens
aattcattgccagaatctatga

SEQ ID NO: 7830104 - DNA, 22 bp, Homo sapiens
aattcattgccagaatctatga

SEQ ID NO: 7830105 - DNA, 22 bp, Homo sapiens
aattcattaagaaagagctaaa

SEQ ID NO: 7830106 - DNA, 22 bp, Homo sapiens
aattcattaagaaagagctaaa

SEQ ID NO: 7830107 - DNA, 22 bp, Homo sapiens
aattcatcattttatagctagt

SEQ ID NO: 7830108 - DNA, 22 bp, Homo sapiens
aattcatagcaacaaagaccca

SEQ ID NO: 7830109 - DNA, 22 bp, Homo sapiens
aattcatagcaacaaagaccca

SEQ ID NO: 7830110 - DNA, 22 bp, Homo sapiens
aattcatactctatattgcttt

SEQ ID NO: 7830111 - DNA, 22 bp, Homo sapiens
aattcatatggatatgctagta

SEQ ID NO: 7830112 - DNA, 22 bp, Homo sapiens
aattcatagcaacaaagaccca

SEQ ID NO: 7830113 - DNA, 22 bp, Homo sapiens
aattcatatggatatgctagta

SEQ ID NO: 7830114 - DNA, 22 bp, Homo sapiens
aattcatatggatatgctagta

SEQ ID NO: 7830115 - DNA, 22 bp, Homo sapiens
aattcatatggatatgctagta

SEQ ID NO: 7830116 - DNA, 22 bp, Homo sapiens
aattcatatggatatgctagta

SEQ ID NO: 7830117 - DNA, 22 bp, Homo sapiens
agagctggaagctgctcttaga

SEQ ID NO: 7830118 - DNA, 22 bp, Homo sapiens
agagctggaagctgctcttaga

SEQ ID NO: 7830119 - DNA, 22 bp, Homo sapiens
agagctggaagctgctcttaga

SEQ ID NO: 7830120 - DNA, 22 bp, Homo sapiens
agagctggaatcagacctcagg

SEQ ID NO: 7830121 - DNA, 22 bp, Homo sapiens
agagctggaatcagacctcagg

SEQ ID NO: 7830122 - DNA, 22 bp, Homo sapiens
agagctggaagctgctcttaga

SEQ ID NO: 7830123 - DNA, 22 bp, Homo sapiens
agagctggaagctgctcttaga

SEQ ID NO: 7830124 - DNA, 22 bp, Homo sapiens
agagctggaaaagttgttttaa

SEQ ID NO: 7830125 - DNA, 22 bp, Homo sapiens
agagctggaaaagttgttttaa

SEQ ID NO: 7830126 - DNA, 22 bp, Homo sapiens
agagctgctcagatgtcactgc

SEQ ID NO: 7830127 - DNA, 22 bp, Homo sapiens
agagctgctcagatgtcactgc

SEQ ID NO: 7830128 - DNA, 22 bp, Homo sapiens
agagctgctcagatgtcactgc

SEQ ID NO: 7830129 - DNA, 22 bp, Homo sapiens
agagctgccgagctggggccat

SEQ ID NO: 7830130 - DNA, 22 bp, Homo sapiens
agagctgccctgccagttctaa

SEQ ID NO: 7830131 - DNA, 22 bp, Homo sapiens
agagctgcagggtggacccagg

SEQ ID NO: 7830132 - DNA, 22 bp, Homo sapiens
agagctgccctgccagttctaa

SEQ ID NO: 7830133 - DNA, 22 bp, Homo sapiens
agagctgcagggtggacccagg

SEQ ID NO: 7830134 - DNA, 22 bp, Homo sapiens
agagctgcaatttcatgtggtg

SEQ ID NO: 7830135 - DNA, 22 bp, Homo sapiens
agagctgatttgattacagtgc

SEQ ID NO: 7830136 - DNA, 22 bp, Homo sapiens
agagctgaggatccagctgagc

SEQ ID NO: 7830137 - DNA, 22 bp, Homo sapiens
agagctgaggatccagctgagc

SEQ ID NO: 7830138 - DNA, 22 bp, Homo sapiens
agagctgatttgattacagtgc

SEQ ID NO: 7830139 - DNA, 22 bp, Homo sapiens
agagctgcaatttcatgtggtg

SEQ ID NO: 7830140 - DNA, 22 bp, Homo sapiens
agagctgaggatccagctgagc

SEQ ID NO: 7830141 - DNA, 22 bp, Homo sapiens
agagctgaggatccagctgagc

SEQ ID NO: 7830142 - DNA, 22 bp, Homo sapiens
agagctgagcaccaagcatggt

SEQ ID NO: 7830143 - DNA, 22 bp, Homo sapiens
agagctgaatttgggtggtgga

SEQ ID NO: 7830144 - DNA, 22 bp, Homo sapiens
agagctgaggatccagctgagc

SEQ ID NO: 7830145 - DNA, 22 bp, Homo sapiens
agagctgagcaccaagcatggt

SEQ ID NO: 7830146 - DNA, 22 bp, Homo sapiens
aatttgattttcttaaaccata

SEQ ID NO: 7830147 - DNA, 22 bp, Homo sapiens
aatttgattccctgcacctgtt

SEQ ID NO: 7830148 - DNA, 22 bp, Homo sapiens
aatttgcatgatgagaacaata

SEQ ID NO: 7830149 - DNA, 22 bp, Homo sapiens
aatttgccttaccttcttccaa

SEQ ID NO: 7830150 - DNA, 23 bp, Homo sapiens
aatttggaaatgaggctaccaag

SEQ ID NO: 7830151 - DNA, 22 bp, Homo sapiens
aatttggaagatgttgtttatc

SEQ ID NO: 7830152 - DNA, 22 bp, Homo sapiens
aatttggacttgggtgctagag

SEQ ID NO: 7830153 - DNA, 22 bp, Homo sapiens
aatttggagagaaacaagtagg

SEQ ID NO: 7830154 - DNA, 22 bp, Homo sapiens
aatttggagagagattaatgtt

SEQ ID NO: 7830155 - DNA, 22 bp, Homo sapiens
aatttggagagaaacaagtagg

SEQ ID NO: 7830156 - DNA, 22 bp, Homo sapiens
aatttggagagagattaatgtt

SEQ ID NO: 7830157 - DNA, 22 bp, Homo sapiens
aatttggaggtatttagctgtc

SEQ ID NO: 7830158 - DNA, 22 bp, Homo sapiens
aatttggagagagattaatgtt

SEQ ID NO: 7830159 - DNA, 22 bp, Homo sapiens
aatttggagctttgtttctaga

SEQ ID NO: 7830160 - DNA, 22 bp, Homo sapiens
aatttgacccatcttggaattt

SEQ ID NO: 7830161 - DNA, 22 bp, Homo sapiens
aatttgacagcaatagaagatt

SEQ ID NO: 7830162 - DNA, 22 bp, Homo sapiens
aatttgattcagcaaatgttca

SEQ ID NO: 7830163 - DNA, 22 bp, Homo sapiens
aatttgattcagcaaatgttca

SEQ ID NO: 7830164 - DNA, 18 bp, Homo sapiens
aatttctttgacaactta

SEQ ID NO: 7830165 - DNA, 18 bp, Homo sapiens
aatttctttgacaactta

SEQ ID NO: 7830166 - DNA, 18 bp, Homo sapiens
aatttctttgacaactta

SEQ ID NO: 7830167 - DNA, 22 bp, Homo sapiens
aatttcttcagctctaaaatgg

SEQ ID NO: 7830168 - DNA, 22 bp, Homo sapiens
aatttcttgggagctcagagaa

SEQ ID NO: 7830169 - DNA, 22 bp, Homo sapiens
aatttcttgggagctcagagaa

SEQ ID NO: 7830170 - DNA, 22 bp, Homo sapiens
aatttcttcagctctaaaatgg

SEQ ID NO: 7830171 - DNA, 22 bp, Homo sapiens
aatttctgtatgaatagagaaa

SEQ ID NO: 7830172 - DNA, 22 bp, Homo sapiens
aatttctgtatgaatagagaaa

SEQ ID NO: 7830173 - DNA, 22 bp, Homo sapiens
aatttctgtatgaatagagaaa

SEQ ID NO: 7830174 - DNA, 22 bp, Homo sapiens
aatttctctctcatgcttcatg

SEQ ID NO: 7830175 - DNA, 22 bp, Homo sapiens
aatttctgtatgaatagagaaa

SEQ ID NO: 7830176 - DNA, 22 bp, Homo sapiens
aatttcttcagctctaaaatgg

SEQ ID NO: 7830177 - DNA, 22 bp, Homo sapiens
aatttcttcagctctaaaatgg

SEQ ID NO: 7830178 - DNA, 22 bp, Homo sapiens
aatttcttcagctctaaaatgg

SEQ ID NO: 7830179 - DNA, 22 bp, Homo sapiens
aatttctcggttttgatattgt

SEQ ID NO: 7830180 - DNA, 22 bp, Homo sapiens
aatttctcatggattcagttat

SEQ ID NO: 7830181 - DNA, 22 bp, Homo sapiens
aatttctaattgaatctctctt

SEQ ID NO: 7830182 - DNA, 22 bp, Homo sapiens
agagttaagtgaaatgtaataa

SEQ ID NO: 7830183 - DNA, 22 bp, Homo sapiens
agagttaaatgaaatggtatgt

SEQ ID NO: 7830184 - DNA, 22 bp, Homo sapiens
agagttaggtccagaatgttgc

SEQ ID NO: 7830185 - DNA, 22 bp, Homo sapiens
agagttagtggcctcagcaggg

SEQ ID NO: 7830186 - DNA, 22 bp, Homo sapiens
agagttatggacttaatgcagg

SEQ ID NO: 7830187 - DNA, 22 bp, Homo sapiens
agagttatattggttgagaatt

SEQ ID NO: 7830188 - DNA, 22 bp, Homo sapiens
agagttatcactccatgcagct

SEQ ID NO: 7830189 - DNA, 22 bp, Homo sapiens
agagttatcactccatgcagct

SEQ ID NO: 7830190 - DNA, 22 bp, Homo sapiens
agagtgtggaaatgttcagagt

SEQ ID NO: 7830191 - DNA, 22 bp, Homo sapiens
agagtgtcagccccagagtatg

SEQ ID NO: 7830192 - DNA, 22 bp, Homo sapiens
agagtgtgtctatggaaggggt

SEQ ID NO: 7830193 - DNA, 22 bp, Homo sapiens
agagtgtttcagtcttcctaga

SEQ ID NO: 7830194 - DNA, 22 bp, Homo sapiens
agagtgtttcagtcttcctaga

SEQ ID NO: 7830195 - DNA, 22 bp, Homo sapiens
agagtgggttataggcagactt

SEQ ID NO: 7830196 - DNA, 22 bp, Homo sapiens
agagtgggttataggcagactt

SEQ ID NO: 7830197 - DNA, 20 bp, Homo sapiens
agagtgggtgtcacaggctg

SEQ ID NO: 7830198 - DNA, 20 bp, Homo sapiens
agagtgggtgtcacaggctg

SEQ ID NO: 7830199 - DNA, 20 bp, Homo sapiens
agagtgggtgtcacaggctg

SEQ ID NO: 7830200 - DNA, 22 bp, Homo sapiens
agagtgaagtttttgaaagtga

SEQ ID NO: 7830201 - DNA, 22 bp, Homo sapiens
agagtgaagttcatcgtgcagc

SEQ ID NO: 7830202 - DNA, 22 bp, Homo sapiens
agagtgaagtaattgttaggat

SEQ ID NO: 7830203 - DNA, 22 bp, Homo sapiens
agagtgaagtaattgttaggat

SEQ ID NO: 7830204 - DNA, 22 bp, Homo sapiens
aatttgtatacatgttacattt

SEQ ID NO: 7830205 - DNA, 22 bp, Homo sapiens
agagtgaaggttgacacttcac

SEQ ID NO: 7830206 - DNA, 22 bp, Homo sapiens
aatttgtatacatgttacattt

SEQ ID NO: 7830207 - DNA, 22 bp, Homo sapiens
aatttgtataaaatggtgtttt

SEQ ID NO: 7830208 - DNA, 22 bp, Homo sapiens
aatttgtacaaaatgtttataa

SEQ ID NO: 7830209 - DNA, 22 bp, Homo sapiens
aatttgtacaaaatgtttataa

SEQ ID NO: 7830210 - DNA, 22 bp, Homo sapiens
aatttgtacaaaatgtttataa

SEQ ID NO: 7830211 - DNA, 22 bp, Homo sapiens
aatttgtacaaaatgtttataa

SEQ ID NO: 7830212 - DNA, 22 bp, Homo sapiens
aatttggttttaagagcatcag

SEQ ID NO: 7830213 - DNA, 22 bp, Homo sapiens
aatttggcagtgtcttgaagta

SEQ ID NO: 7830214 - DNA, 22 bp, Homo sapiens
acaacagtaggaaaacatgtct

SEQ ID NO: 7830215 - DNA, 22 bp, Homo sapiens
acaacagtaggaaaacatgtct

SEQ ID NO: 7830216 - DNA, 22 bp, Homo sapiens
acaacagtaggaaaacatgtct

SEQ ID NO: 7830217 - DNA, 22 bp, Homo sapiens
acaacagtagcctttacaaggc

SEQ ID NO: 7830218 - DNA, 22 bp, Homo sapiens
acaacagggtaaggcaggccat

SEQ ID NO: 7830219 - DNA, 22 bp, Homo sapiens
acaacagggtaaggcaggccat

SEQ ID NO: 7830220 - DNA, 23 bp, Homo sapiens
acaacaggaaatcagacctgaac

SEQ ID NO: 7830221 - DNA, 22 bp, Homo sapiens
agatgctggatggaaaatgatc

SEQ ID NO: 7830222 - DNA, 22 bp, Homo sapiens
agatgctgctccacaggccagg

SEQ ID NO: 7830223 - DNA, 22 bp, Homo sapiens
agatgctgcagcctggactgga

SEQ ID NO: 7830224 - DNA, 22 bp, Homo sapiens
agatgctgattgaatagatttc

SEQ ID NO: 7830225 - DNA, 21 bp, Homo sapiens
agatgctgatgctgcaggtcc

SEQ ID NO: 7830226 - DNA, 22 bp, Homo sapiens
agatgctgaattattgtgcttt

SEQ ID NO: 7830227 - DNA, 22 bp, Homo sapiens
agatgctcttgccaaagaagtc

SEQ ID NO: 7830228 - DNA, 22 bp, Homo sapiens
agatgctgaagctgaggcaaca

SEQ ID NO: 7830229 - DNA, 22 bp, Homo sapiens
agatgctgaattattgtgcttt

SEQ ID NO: 7830230 - DNA, 22 bp, Homo sapiens
agatgctgctccacaggccagg

SEQ ID NO: 7830231 - DNA, 22 bp, Homo sapiens
agatgctgctccacaggccagg

SEQ ID NO: 7830232 - DNA, 22 bp, Homo sapiens
agatgctgctccacaggccagg

SEQ ID NO: 7830233 - DNA, 22 bp, Homo sapiens
agatgctgccaggcccctcagt

SEQ ID NO: 7830234 - DNA, 22 bp, Homo sapiens
agatgctgcagcctggactgga

SEQ ID NO: 7830235 - DNA, 22 bp, Homo sapiens
agatgctgccaggcccctcagt

SEQ ID NO: 7830236 - DNA, 22 bp, Homo sapiens
agatgctgccaggcccctcagt

SEQ ID NO: 7830237 - DNA, 22 bp, Homo sapiens
agatgctgcctctcctcacaag

SEQ ID NO: 7830238 - DNA, 22 bp, Homo sapiens
agatgcagtggttaacaataca

SEQ ID NO: 7830239 - DNA, 22 bp, Homo sapiens
agatgcagtggttaacaataca

SEQ ID NO: 7830240 - DNA, 22 bp, Homo sapiens
agatgcagtggttaacaataca

SEQ ID NO: 7830241 - DNA, 21 bp, Homo sapiens
agatgcagttatgagatgcag

SEQ ID NO: 7830242 - DNA, 22 bp, Homo sapiens
agatgcagatttggattcagga

SEQ ID NO: 7830243 - DNA, 22 bp, Homo sapiens
agatgcagatttggattcagga

SEQ ID NO: 7830244 - DNA, 21 bp, Homo sapiens
agatgcagtgacccactgggg

SEQ ID NO: 7830245 - DNA, 22 bp, Homo sapiens
agatgcagatttggattcagga

SEQ ID NO: 7830246 - DNA, 22 bp, Homo sapiens
agatgcagagtttgctgtggac

SEQ ID NO: 7830247 - DNA, 22 bp, Homo sapiens
agatgcagagttgcttaagcat

SEQ ID NO: 7830248 - DNA, 22 bp, Homo sapiens
agatgcagagtttgctgtggac

SEQ ID NO: 7830249 - DNA, 22 bp, Homo sapiens
agatgcagacttggttcaggca

SEQ ID NO: 7830250 - DNA, 22 bp, Homo sapiens
agatgcagacttggttcaggca

SEQ ID NO: 7830251 - DNA, 20 bp, Homo sapiens
agatcttttctatagaagtg

SEQ ID NO: 7830252 - DNA, 21 bp, Homo sapiens
agatgcagtttgcaggtgggt

SEQ ID NO: 7830253 - DNA, 22 bp, Homo sapiens
agatgcagtggttaacaataca

SEQ ID NO: 7830254 - DNA, 22 bp, Homo sapiens
agatgctatacattgtaagaca

SEQ ID NO: 7830255 - DNA, 22 bp, Homo sapiens
agatgcctgccagttatttagc

SEQ ID NO: 7830256 - DNA, 22 bp, Homo sapiens
agatgccttttatttattgtca

SEQ ID NO: 7830257 - DNA, 22 bp, Homo sapiens
agatgcgtgcagcctgacaatt

SEQ ID NO: 7830258 - DNA, 22 bp, Homo sapiens
agatgcctgccagttatttagc

SEQ ID NO: 7830259 - DNA, 22 bp, Homo sapiens
agatgcctaaatctgggcaagg

SEQ ID NO: 7830260 - DNA, 19 bp, Homo sapiens
acaaagtgcgtgctctttt

SEQ ID NO: 7830261 - DNA, 22 bp, Homo sapiens
acaaagtgcacaagatgagaac

SEQ ID NO: 7830262 - DNA, 22 bp, Homo sapiens
acaaagtgcacaagatgagaac

SEQ ID NO: 7830263 - DNA, 22 bp, Homo sapiens
acaaagtgctgacattacaggc

SEQ ID NO: 7830264 - DNA, 22 bp, Homo sapiens
acaaagtgctgacattacaggc

SEQ ID NO: 7830265 - DNA, 22 bp, Homo sapiens
acaaagtgctgacattacaggc

SEQ ID NO: 7830266 - DNA, 22 bp, Homo sapiens
acaaagtgctgacattacaggc

SEQ ID NO: 7830267 - DNA, 22 bp, Homo sapiens
acaaagtctctaataatcttct

SEQ ID NO: 7830268 - DNA, 22 bp, Homo sapiens
acaaagtgaattgcatcgagtt

SEQ ID NO: 7830269 - DNA, 22 bp, Homo sapiens
acaaagtgaaaagcatcgaatt

SEQ ID NO: 7830270 - DNA, 22 bp, Homo sapiens
acaaagtgaaaagcatcgaatt

SEQ ID NO: 7830271 - DNA, 20 bp, Homo sapiens
acaaagtattgaggacaagt

SEQ ID NO: 7830272 - DNA, 22 bp, Homo sapiens
agagttctctctcatttgagct

SEQ ID NO: 7830273 - DNA, 22 bp, Homo sapiens
acaaagtcctggtgtatggcca

SEQ ID NO: 7830274 - DNA, 22 bp, Homo sapiens
agagttcagttgtagccatatt

SEQ ID NO: 7830275 - DNA, 22 bp, Homo sapiens
agagttcacactcagtgcaccc

SEQ ID NO: 7830276 - DNA, 22 bp, Homo sapiens
agagttcagaaagtgcaggttt

SEQ ID NO: 7830277 - DNA, 22 bp, Homo sapiens
agagttcagaaagtgcaggttt

SEQ ID NO: 7830278 - DNA, 22 bp, Homo sapiens
agagttcagctactgcaaatgt

SEQ ID NO: 7830279 - DNA, 22 bp, Homo sapiens
acaaataggtagatttgcaaca

SEQ ID NO: 7830280 - DNA, 22 bp, Homo sapiens
acaaataggtagatttgcaaca

SEQ ID NO: 7830281 - DNA, 22 bp, Homo sapiens
acaaataggtagatttgcaaca

SEQ ID NO: 7830282 - DNA, 22 bp, Homo sapiens
acaaatagagattcaaataaag

SEQ ID NO: 7830283 - DNA, 22 bp, Homo sapiens
acaaatagagattcaaataaag

SEQ ID NO: 7830284 - DNA, 22 bp, Homo sapiens
acaaagtttgtggtattccaag

SEQ ID NO: 7830285 - DNA, 16 bp, Homo sapiens
acaaatacaactgctg

SEQ ID NO: 7830286 - DNA, 22 bp, Homo sapiens
acaaatagaaaatctggattgg

SEQ ID NO: 7830287 - DNA, 22 bp, Homo sapiens
acaaatagaaaatctggattgg

SEQ ID NO: 7830288 - DNA, 20 bp, Homo sapiens
agatcttttctatagaagtg

SEQ ID NO: 7830289 - DNA, 20 bp, Homo sapiens
agatcttttctatagaagtg

SEQ ID NO: 7830290 - DNA, 22 bp, Homo sapiens
agatctttagtgaagctaaatc

SEQ ID NO: 7830291 - DNA, 20 bp, Homo sapiens
agatctttgggttgtcatat

SEQ ID NO: 7830292 - DNA, 20 bp, Homo sapiens
agatctttgggttgtcatat

SEQ ID NO: 7830293 - DNA, 22 bp, Homo sapiens
agatctttagaagatagaatca

SEQ ID NO: 7830294 - DNA, 22 bp, Homo sapiens
agatctttagaagatagaatca

SEQ ID NO: 7830295 - DNA, 22 bp, Homo sapiens
agatctttagaagatagaatca

SEQ ID NO: 7830296 - DNA, 22 bp, Homo sapiens
agatctttagtgaagctaaatc

SEQ ID NO: 7830297 - DNA, 22 bp, Homo sapiens
agatctttagtgaagctaaatc

SEQ ID NO: 7830298 - DNA, 22 bp, Homo sapiens
agatctttagtgaagctaaatc

SEQ ID NO: 7830299 - DNA, 22 bp, Homo sapiens
agatctttagtgaagctaaatc

SEQ ID NO: 7830300 - DNA, 22 bp, Homo sapiens
acaaagtgtgcggagcccaggg

SEQ ID NO: 7830301 - DNA, 22 bp, Homo sapiens
acaaagtgttttctgaaggcct

SEQ ID NO: 7830302 - DNA, 22 bp, Homo sapiens
acaaagtgttttctgaaggcct

SEQ ID NO: 7830303 - DNA, 22 bp, Homo sapiens
acaaagtgttttctgaaggcct

SEQ ID NO: 7830304 - DNA, 22 bp, Homo sapiens
acaaagtttcttctaacatctg

SEQ ID NO: 7830305 - DNA, 22 bp, Homo sapiens
acaaagtttgtggtattccaag

SEQ ID NO: 7830306 - DNA, 22 bp, Homo sapiens
acaaagtttcttctaacatctg

SEQ ID NO: 7830307 - DNA, 22 bp, Homo sapiens
acaaagtttgtggtattccaag

SEQ ID NO: 7830308 - DNA, 22 bp, Homo sapiens
acaacattcttaaatacactga

SEQ ID NO: 7830309 - DNA, 22 bp, Homo sapiens
acaacattcttaaatacactga

SEQ ID NO: 7830310 - DNA, 22 bp, Homo sapiens
acaacattcttaaatacactga

SEQ ID NO: 7830311 - DNA, 22 bp, Homo sapiens
acaacattcttaaatacactga

SEQ ID NO: 7830312 - DNA, 22 bp, Homo sapiens
acaacattcttaaatacactga

SEQ ID NO: 7830313 - DNA, 22 bp, Homo sapiens
acaacattcttaaatacactga

SEQ ID NO: 7830314 - DNA, 22 bp, Homo sapiens
agcaaaagatagattaacaaga

SEQ ID NO: 7830315 - DNA, 22 bp, Homo sapiens
agcaaaagatagattaacaaga

SEQ ID NO: 7830316 - DNA, 22 bp, Homo sapiens
agcaaaagatagattaacaaga

SEQ ID NO: 7830317 - DNA, 18 bp, Homo sapiens
agattttgagaaatacaa

SEQ ID NO: 7830318 - DNA, 22 bp, Homo sapiens
acaacatttccatttccttggt

SEQ ID NO: 7830319 - DNA, 22 bp, Homo sapiens
acaacatcagctgagaccttca

SEQ ID NO: 7830320 - DNA, 22 bp, Homo sapiens
acaacagtttaggtatttgtag

SEQ ID NO: 7830321 - DNA, 22 bp, Homo sapiens
acaacagtttaggtatttgtag

SEQ ID NO: 7830322 - DNA, 22 bp, Homo sapiens
acaacagtccagtatagactgt

SEQ ID NO: 7830323 - DNA, 22 bp, Homo sapiens
acaacagtccagtatagactgt

SEQ ID NO: 7830324 - DNA, 22 bp, Homo sapiens
acaacagtccagtatagactgt

SEQ ID NO: 7830325 - DNA, 22 bp, Homo sapiens
acaacagtccagtatagactgt

SEQ ID NO: 7830326 - DNA, 22 bp, Homo sapiens
agcaaagtagctgctgttctta

SEQ ID NO: 7830327 - DNA, 21 bp, Homo sapiens
agcaaaggcaggagaggtttc

SEQ ID NO: 7830328 - DNA, 22 bp, Homo sapiens
agcaaagctgattaagagcaca

SEQ ID NO: 7830329 - DNA, 22 bp, Homo sapiens
agcaaagctgctcccttttgtc

SEQ ID NO: 7830330 - DNA, 22 bp, Homo sapiens
agcaaagctgctcccttttgtc

SEQ ID NO: 7830331 - DNA, 22 bp, Homo sapiens
agcaaagtcagtggaaccatcc

SEQ ID NO: 7830332 - DNA, 22 bp, Homo sapiens
agcaaagtatgtgctgggagct

SEQ ID NO: 7830333 - DNA, 22 bp, Homo sapiens
agcaaagtatgtgctgggagct

SEQ ID NO: 7830334 - DNA, 22 bp, Homo sapiens
agcaaagtccagtctgtgtaca

SEQ ID NO: 7830335 - DNA, 22 bp, Homo sapiens
agcaaataaagacaattatgtc

SEQ ID NO: 7830336 - DNA, 23 bp, Homo sapiens
agcaaagttgttgctaacctcat

SEQ ID NO: 7830337 - DNA, 22 bp, Homo sapiens
agcaaagtggctttccaaacca

SEQ ID NO: 7830338 - DNA, 22 bp, Homo sapiens
agcaaagtccagtctgtgtaca

SEQ ID NO: 7830339 - DNA, 23 bp, Homo sapiens
agcaaataatctgcttgcttttt

SEQ ID NO: 7830340 - DNA, 22 bp, Homo sapiens
agcaaataaagacaattatgtc

SEQ ID NO: 7830341 - DNA, 22 bp, Homo sapiens
agcaaataaagacaattatgtc

SEQ ID NO: 7830342 - DNA, 22 bp, Homo sapiens
agcaaataaagacaattatgtc

SEQ ID NO: 7830343 - DNA, 22 bp, Homo sapiens
agcaaataaagacaattatgtc

SEQ ID NO: 7830344 - DNA, 22 bp, Homo sapiens
agcaaataaagacaattatgtc

SEQ ID NO: 7830345 - DNA, 22 bp, Homo sapiens
agcaaataaagacaattatgtc

SEQ ID NO: 7830346 - DNA, 22 bp, Homo sapiens
agcaaataattgtctttgaggg

SEQ ID NO: 7830347 - DNA, 22 bp, Homo sapiens
agcaaataattgtctttgaggg

SEQ ID NO: 7830348 - DNA, 19 bp, Homo sapiens
agcaaatacatcaaaattg

SEQ ID NO: 7830349 - DNA, 19 bp, Homo sapiens
agcaaatacatcaaaattg

SEQ ID NO: 7830350 - DNA, 19 bp, Homo sapiens
agcaaatacatcaaaattg

SEQ ID NO: 7830351 - DNA, 19 bp, Homo sapiens
agcaaatacatcaaaattg

SEQ ID NO: 7830352 - DNA, 19 bp, Homo sapiens
agcaaatacatcaaaattg

SEQ ID NO: 7830353 - DNA, 19 bp, Homo sapiens
agcaaatacatcaaaattg

SEQ ID NO: 7830354 - DNA, 22 bp, Homo sapiens
agcaaatacatttttagcataa

SEQ ID NO: 7830355 - DNA, 22 bp, Homo sapiens
agcaaatacatttttagcataa

SEQ ID NO: 7830356 - DNA, 22 bp, Homo sapiens
acaatagaaggaaactgacata

SEQ ID NO: 7830357 - DNA, 22 bp, Homo sapiens
acaatagaaggaaactgacata

SEQ ID NO: 7830358 - DNA, 22 bp, Homo sapiens
acaatagaaggaaactgacata

SEQ ID NO: 7830359 - DNA, 22 bp, Homo sapiens
agcaaggcagtcagctggctgg

SEQ ID NO: 7830360 - DNA, 22 bp, Homo sapiens
acaatactcatgctctttttct

SEQ ID NO: 7830361 - DNA, 22 bp, Homo sapiens
acaatacttaccaatgtttttg

SEQ ID NO: 7830362 - DNA, 22 bp, Homo sapiens
acaatacttaccaatgtttttg

SEQ ID NO: 7830363 - DNA, 22 bp, Homo sapiens
acaatacttaccaatgtttttg

SEQ ID NO: 7830364 - DNA, 22 bp, Homo sapiens
acaatacttaccaatgtttttg

SEQ ID NO: 7830365 - DNA, 22 bp, Homo sapiens
acaatagaaataattaagcaca

SEQ ID NO: 7830366 - DNA, 22 bp, Homo sapiens
acaatagaaataattaagcaca

SEQ ID NO: 7830367 - DNA, 20 bp, Homo sapiens
acaatacaggttgtgtctga

SEQ ID NO: 7830368 - DNA, 22 bp, Homo sapiens
acaatactagccaaggttatta

SEQ ID NO: 7830369 - DNA, 18 bp, Homo sapiens
agcaaatattaagtgcat

SEQ ID NO: 7830370 - DNA, 22 bp, Homo sapiens
acaatactattttcagtatcct

SEQ ID NO: 7830371 - DNA, 22 bp, Homo sapiens
acaatactattttcagtatcct

SEQ ID NO: 7830372 - DNA, 20 bp, Homo sapiens
acaatacaggttgtgtctga

SEQ ID NO: 7830373 - DNA, 22 bp, Homo sapiens
acaatacaggcttctggactta

SEQ ID NO: 7830374 - DNA, 22 bp, Homo sapiens
acaataagtattgggcttttga

SEQ ID NO: 7830375 - DNA, 22 bp, Homo sapiens
acaataatgtattgccaaaagt

SEQ ID NO: 7830376 - DNA, 19 bp, Homo sapiens
acaataactcattgattgc

SEQ ID NO: 7830377 - DNA, 19 bp, Homo sapiens
acaataactcattgattgc

SEQ ID NO: 7830378 - DNA, 22 bp, Homo sapiens
acaataacttctgtttccttgc

SEQ ID NO: 7830379 - DNA, 22 bp, Homo sapiens
acaagttttggaagtcttaagg

SEQ ID NO: 7830380 - DNA, 22 bp, Homo sapiens
acaagttttggaagtcttaagg

SEQ ID NO: 7830381 - DNA, 22 bp, Homo sapiens
acaagtttttgatagactagaa

SEQ ID NO: 7830382 - DNA, 18 bp, Homo sapiens
agcaaatattaagtgcat

SEQ ID NO: 7830383 - DNA, 22 bp, Homo sapiens
acaagtttcattgtttagaacc

SEQ ID NO: 7830384 - DNA, 19 bp, Homo sapiens
agcaaatataatagtgttc

SEQ ID NO: 7830385 - DNA, 19 bp, Homo sapiens
agcaaatataatagtgttc

SEQ ID NO: 7830386 - DNA, 19 bp, Homo sapiens
agcaaatataatagtgttc

SEQ ID NO: 7830387 - DNA, 18 bp, Homo sapiens
agcaaatattaagtgcat

SEQ ID NO: 7830388 - DNA, 22 bp, Homo sapiens
agcaaatacttgaataaaaaga

SEQ ID NO: 7830389 - DNA, 22 bp, Homo sapiens
agcaaatacttgaataaaaaga

SEQ ID NO: 7830390 - DNA, 22 bp, Homo sapiens
agcaaatacttgaataaaaaga

SEQ ID NO: 7830391 - DNA, 22 bp, Homo sapiens
agcaaatacttttcactgagcc

SEQ ID NO: 7830392 - DNA, 22 bp, Homo sapiens
agcaaatacttttcactgagcc

SEQ ID NO: 7830393 - DNA, 22 bp, Homo sapiens
agcaaatacttgaataaaaaga

SEQ ID NO: 7830394 - DNA, 19 bp, Homo sapiens
agcaaatataatagtgttc

SEQ ID NO: 7830395 - DNA, 19 bp, Homo sapiens
agcaaatataatagtgttc

SEQ ID NO: 7830396 - DNA, 22 bp, Homo sapiens
agcaaatacttgaataaaaaga

SEQ ID NO: 7830397 - DNA, 22 bp, Homo sapiens
agcaaatacttgaataaaaaga

SEQ ID NO: 7830398 - DNA, 22 bp, Homo sapiens
agcaaatacttgaataaaaaga

SEQ ID NO: 7830399 - DNA, 22 bp, Homo sapiens
agcaaatacttgaataaaaaga

SEQ ID NO: 7830400 - DNA, 22 bp, Homo sapiens
agcaaatacatttttagcataa

SEQ ID NO: 7830401 - DNA, 22 bp, Homo sapiens
agcaaatacatttttagcataa

SEQ ID NO: 7830402 - DNA, 22 bp, Homo sapiens
agcaaataccaaaggctgatgt

SEQ ID NO: 7830403 - DNA, 22 bp, Homo sapiens
agcaaatacatttttagcataa

SEQ ID NO: 7830404 - DNA, 22 bp, Homo sapiens
agcaaatacatttttagcataa

SEQ ID NO: 7830405 - DNA, 22 bp, Homo sapiens
agcaaggccgagaggatgctat

SEQ ID NO: 7830406 - DNA, 22 bp, Homo sapiens
agcaaggccgagaggatgctat

SEQ ID NO: 7830407 - DNA, 22 bp, Homo sapiens
agcaaggccgagaggatgctat

SEQ ID NO: 7830408 - DNA, 22 bp, Homo sapiens
agcaaggcagtcagctggctgg

SEQ ID NO: 7830409 - DNA, 23 bp, Homo sapiens
agcacaaagtgttttccttgtag

SEQ ID NO: 7830410 - DNA, 22 bp, Homo sapiens
agcacaaaagcagccacagatg

SEQ ID NO: 7830411 - DNA, 22 bp, Homo sapiens
agcacaaaagcagccacagatg

SEQ ID NO: 7830412 - DNA, 22 bp, Homo sapiens
agcacaaatataaaaatgtctg

SEQ ID NO: 7830413 - DNA, 22 bp, Homo sapiens
agcacaaatataaaaatgtctg

SEQ ID NO: 7830414 - DNA, 22 bp, Homo sapiens
agcacaaatataaaaatgtctg

SEQ ID NO: 7830415 - DNA, 22 bp, Homo sapiens
agcacaaatataaaaatgtctg

SEQ ID NO: 7830416 - DNA, 22 bp, Homo sapiens
agcacaatagagcagttaaaaa

SEQ ID NO: 7830417 - DNA, 22 bp, Homo sapiens
agcacaatataaagtgaacgca

SEQ ID NO: 7830418 - DNA, 22 bp, Homo sapiens
agcacaaatataaaaatgtctg

SEQ ID NO: 7830419 - DNA, 22 bp, Homo sapiens
agcacacaggccacctccactt

SEQ ID NO: 7830420 - DNA, 22 bp, Homo sapiens
agcacacagtattagccattgt

SEQ ID NO: 7830421 - DNA, 22 bp, Homo sapiens
agcacacagtattagccattgt

SEQ ID NO: 7830422 - DNA, 22 bp, Homo sapiens
agcacacagtattagccattgt

SEQ ID NO: 7830423 - DNA, 22 bp, Homo sapiens
agcacacaggacttgattcatg

SEQ ID NO: 7830424 - DNA, 22 bp, Homo sapiens
agcacacaggacttgattcatg

SEQ ID NO: 7830425 - DNA, 22 bp, Homo sapiens
agcacacaggacttgattcatg

SEQ ID NO: 7830426 - DNA, 22 bp, Homo sapiens
agcacaatgtgaaaagagctct

SEQ ID NO: 7830427 - DNA, 22 bp, Homo sapiens
agcacaggaacatggagatggg

SEQ ID NO: 7830428 - DNA, 22 bp, Homo sapiens
agcacaggaacatggagatggg

SEQ ID NO: 7830429 - DNA, 22 bp, Homo sapiens
agcacaggaacatggagatggg

SEQ ID NO: 7830430 - DNA, 22 bp, Homo sapiens
agcacaggaccaaggaagctgt

SEQ ID NO: 7830431 - DNA, 22 bp, Homo sapiens
agcacaggaccaaggaagctgt

SEQ ID NO: 7830432 - DNA, 22 bp, Homo sapiens
agcacaggaacatggagatggg

SEQ ID NO: 7830433 - DNA, 22 bp, Homo sapiens
agcacagaatggcttggaagcc

SEQ ID NO: 7830434 - DNA, 22 bp, Homo sapiens
agcacagaatggcttggaagcc

SEQ ID NO: 7830435 - DNA, 19 bp, Homo sapiens
agcacagacaagaccagca

SEQ ID NO: 7830436 - DNA, 21 bp, Homo sapiens
agcacagctttaagccatgtg

SEQ ID NO: 7830437 - DNA, 19 bp, Homo sapiens
agcacagacaagaccagca

SEQ ID NO: 7830438 - DNA, 19 bp, Homo sapiens
agcacagacaagaccagca

SEQ ID NO: 7830439 - DNA, 22 bp, Homo sapiens
agcacacatcacttctgctcat

SEQ ID NO: 7830440 - DNA, 23 bp, Homo sapiens
agcacacttgtacaatgccctag

SEQ ID NO: 7830441 - DNA, 21 bp, Homo sapiens
agcacacttacctgttctaag

SEQ ID NO: 7830442 - DNA, 22 bp, Homo sapiens
agcacacatcacttctgctcat

SEQ ID NO: 7830443 - DNA, 22 bp, Homo sapiens
agcacacatcacttctgctcat

SEQ ID NO: 7830444 - DNA, 22 bp, Homo sapiens
agcacacctattacataaatgg

SEQ ID NO: 7830445 - DNA, 22 bp, Homo sapiens
agcacagaatgaggtggaagtg

SEQ ID NO: 7830446 - DNA, 22 bp, Homo sapiens
agcacagaatgaggtggaagtg

SEQ ID NO: 7830447 - DNA, 22 bp, Homo sapiens
agcacagaaagtattgactgaa

SEQ ID NO: 7830448 - DNA, 22 bp, Homo sapiens
agcacagaaagtattgactgaa

SEQ ID NO: 7830449 - DNA, 22 bp, Homo sapiens
agcacagaatgaggtggaagtg

SEQ ID NO: 7830450 - DNA, 23 bp, Homo sapiens
agcacacttgtacaatgccctag

SEQ ID NO: 7830451 - DNA, 22 bp, Homo sapiens
agcacagaaagcacatttgaaa

SEQ ID NO: 7830452 - DNA, 22 bp, Homo sapiens
agcacagggacaatgccaggtg

SEQ ID NO: 7830453 - DNA, 22 bp, Homo sapiens
agcacagggacaatgccaggtg

SEQ ID NO: 7830454 - DNA, 22 bp, Homo sapiens
agcacagggacaatgccaggtg

SEQ ID NO: 7830455 - DNA, 22 bp, Homo sapiens
agcacagggacaatgccaggtg

SEQ ID NO: 7830456 - DNA, 22 bp, Homo sapiens
agcacagggcccagcctaggcc

SEQ ID NO: 7830457 - DNA, 22 bp, Homo sapiens
agcacagggcccagcctaggcc

SEQ ID NO: 7830458 - DNA, 22 bp, Homo sapiens
agcacagggcccagcctaggcc

SEQ ID NO: 7830459 - DNA, 22 bp, Homo sapiens
agcacagggcccagcctaggcc

SEQ ID NO: 7830460 - DNA, 22 bp, Homo sapiens
agcacagggcccagcctaggcc

SEQ ID NO: 7830461 - DNA, 22 bp, Homo sapiens
agcacagggcccagcctaggcc

SEQ ID NO: 7830462 - DNA, 22 bp, Homo sapiens
agcacaggaccaaggaagctgt

SEQ ID NO: 7830463 - DNA, 22 bp, Homo sapiens
agcacaggaccaaggaagctgt

SEQ ID NO: 7830464 - DNA, 22 bp, Homo sapiens
agcacaggaccaaggaagctgt

SEQ ID NO: 7830465 - DNA, 22 bp, Homo sapiens
agcacaggaccaaggaagctgt

SEQ ID NO: 7830466 - DNA, 22 bp, Homo sapiens
agcacaggacgtagagcttgga

SEQ ID NO: 7830467 - DNA, 22 bp, Homo sapiens
agcacaggacgtagagcttgga

SEQ ID NO: 7830468 - DNA, 22 bp, Homo sapiens
agcacaggacgtagagcttgga

SEQ ID NO: 7830469 - DNA, 22 bp, Homo sapiens
agcacaggacgtagagcttgga

SEQ ID NO: 7830470 - DNA, 22 bp, Homo sapiens
agcacaggctttggtgtgaggg

SEQ ID NO: 7830471 - DNA, 22 bp, Homo sapiens
agcacaggctttggtgtgaggg

SEQ ID NO: 7830472 - DNA, 22 bp, Homo sapiens
agcacaggctttggtgtgaggg

SEQ ID NO: 7830473 - DNA, 22 bp, Homo sapiens
agcacaggctttggtgtgaggg

SEQ ID NO: 7830474 - DNA, 22 bp, Homo sapiens
agcacaggctttggtgtgaggg

SEQ ID NO: 7830475 - DNA, 22 bp, Homo sapiens
agcacaggctttggtgtgaggg

SEQ ID NO: 7830476 - DNA, 22 bp, Homo sapiens
agcacaggctttggtgtgaggg

SEQ ID NO: 7830477 - DNA, 22 bp, Homo sapiens
agcacaggacgtagagcttgga

SEQ ID NO: 7830478 - DNA, 22 bp, Homo sapiens
agcacaggacgtagagcttgga

SEQ ID NO: 7830479 - DNA, 22 bp, Homo sapiens
acacaaattgtaggataattgc

SEQ ID NO: 7830480 - DNA, 22 bp, Homo sapiens
acacaaaatcaaagtcctaggc

SEQ ID NO: 7830481 - DNA, 22 bp, Homo sapiens
acacaaattgtaggataattgc

SEQ ID NO: 7830482 - DNA, 22 bp, Homo sapiens
acacaaattgtaggataattgc

SEQ ID NO: 7830483 - DNA, 22 bp, Homo sapiens
acacaaattgtaggataattgc

SEQ ID NO: 7830484 - DNA, 22 bp, Homo sapiens
acacaaattgtaggataattgc

SEQ ID NO: 7830485 - DNA, 22 bp, Homo sapiens
acacaaattgtaggataattgc

SEQ ID NO: 7830486 - DNA, 22 bp, Homo sapiens
acaatttttcaaagaagcttat

SEQ ID NO: 7830487 - DNA, 22 bp, Homo sapiens
agcacagggcccagcctaggcc

SEQ ID NO: 7830488 - DNA, 22 bp, Homo sapiens
agcacaggtaatacagagtaac

SEQ ID NO: 7830489 - DNA, 22 bp, Homo sapiens
agcacaggtaatacagagtaac

SEQ ID NO: 7830490 - DNA, 22 bp, Homo sapiens
agcacaggtaatacagagtaac

SEQ ID NO: 7830491 - DNA, 22 bp, Homo sapiens
agcacaggtaatacagagtaac

SEQ ID NO: 7830492 - DNA, 21 bp, Homo sapiens
acacaacaggcagtcattttc

SEQ ID NO: 7830493 - DNA, 22 bp, Homo sapiens
acacaagaagttaatgggcaaa

SEQ ID NO: 7830494 - DNA, 22 bp, Homo sapiens
acacaagaagttaatgggcaaa

SEQ ID NO: 7830495 - DNA, 22 bp, Homo sapiens
acacaagaagttaatgggcaaa

SEQ ID NO: 7830496 - DNA, 22 bp, Homo sapiens
acacaagaataatgatgaaggt

SEQ ID NO: 7830497 - DNA, 21 bp, Homo sapiens
acacaacaggcagtcattttc

SEQ ID NO: 7830498 - DNA, 21 bp, Homo sapiens
acacaacaggcagtcattttc

SEQ ID NO: 7830499 - DNA, 22 bp, Homo sapiens
acacaacagaagagcaattgca

SEQ ID NO: 7830500 - DNA, 22 bp, Homo sapiens
acacaaattgtaggataattgc

SEQ ID NO: 7830501 - DNA, 22 bp, Homo sapiens
acacaaattgtaggataattgc

SEQ ID NO: 7830502 - DNA, 22 bp, Homo sapiens
acacaaattgtaggataattgc

SEQ ID NO: 7830503 - DNA, 22 bp, Homo sapiens
acacaaattgtaggataattgc

SEQ ID NO: 7830504 - DNA, 23 bp, Homo sapiens
agctaacagatcgacaaagtata

SEQ ID NO: 7830505 - DNA, 22 bp, Homo sapiens
acagataattagcataaatgct

SEQ ID NO: 7830506 - DNA, 22 bp, Homo sapiens
acagataattagcataaatgct

SEQ ID NO: 7830507 - DNA, 22 bp, Homo sapiens
agctaaatgcatttcaagactg

SEQ ID NO: 7830508 - DNA, 22 bp, Homo sapiens
agctaaatgcatttcaagactg

SEQ ID NO: 7830509 - DNA, 22 bp, Homo sapiens
agctaaatgtgaaatgtcaacc

SEQ ID NO: 7830510 - DNA, 22 bp, Homo sapiens
agcgtgaattagttggtacaca

SEQ ID NO: 7830511 - DNA, 22 bp, Homo sapiens
agcgtgaattagttggtacaca

SEQ ID NO: 7830512 - DNA, 22 bp, Homo sapiens
agcgtgaattagttggtacaca

SEQ ID NO: 7830513 - DNA, 22 bp, Homo sapiens
agcgtggatgtggggcgcggct

SEQ ID NO: 7830514 - DNA, 22 bp, Homo sapiens
agcgtgtgcctcggggtacacg

SEQ ID NO: 7830515 - DNA, 22 bp, Homo sapiens
agcgtgggtccaaggctctggt

SEQ ID NO: 7830516 - DNA, 22 bp, Homo sapiens
agcgtgtgtgcgggtcttcttt

SEQ ID NO: 7830517 - DNA, 22 bp, Homo sapiens
agcgtgtggagaactaagcaga

SEQ ID NO: 7830518 - DNA, 20 bp, Homo sapiens
agcggcagcttcctgcttcg

SEQ ID NO: 7830519 - DNA, 22 bp, Homo sapiens
agccttcagcagttcaggtgcc

SEQ ID NO: 7830520 - DNA, 22 bp, Homo sapiens
agcggcgccgagcttggccagg

SEQ ID NO: 7830521 - DNA, 20 bp, Homo sapiens
agcggcagcttcctgcttcg

SEQ ID NO: 7830522 - DNA, 22 bp, Homo sapiens
agcggctgctccgcaggctggc

SEQ ID NO: 7830523 - DNA, 22 bp, Homo sapiens
agcggctgctccgcaggctggc

SEQ ID NO: 7830524 - DNA, 22 bp, Homo sapiens
agcggctggaccagcgttcaag

SEQ ID NO: 7830525 - DNA, 22 bp, Homo sapiens
agcggctgctcttttcagatcc

SEQ ID NO: 7830526 - DNA, 22 bp, Homo sapiens
agccttcactgggaccttggat

SEQ ID NO: 7830527 - DNA, 22 bp, Homo sapiens
agccttcactgggaccttggat

SEQ ID NO: 7830528 - DNA, 22 bp, Homo sapiens
agccttcaacctagctagagca

SEQ ID NO: 7830529 - DNA, 22 bp, Homo sapiens
agccttcaacctagctagagca

SEQ ID NO: 7830530 - DNA, 22 bp, Homo sapiens
agccttcaacctagctagagca

SEQ ID NO: 7830531 - DNA, 22 bp, Homo sapiens
agccttagggattgaggttgct

SEQ ID NO: 7830532 - DNA, 22 bp, Homo sapiens
acagaggtcatggagagttctc

SEQ ID NO: 7830533 - DNA, 16 bp, Homo sapiens
agccttaggaacagcc

SEQ ID NO: 7830534 - DNA, 22 bp, Homo sapiens
agcggtggtgtcggcagcggct

SEQ ID NO: 7830535 - DNA, 22 bp, Homo sapiens
agcggtggtgtcggcagcggct

SEQ ID NO: 7830536 - DNA, 22 bp, Homo sapiens
agcggggtgttttgggtggcct

SEQ ID NO: 7830537 - DNA, 22 bp, Homo sapiens
agcgggtctgcaagccttccct

SEQ ID NO: 7830538 - DNA, 22 bp, Homo sapiens
agcgggtctgcaagccttccct

SEQ ID NO: 7830539 - DNA, 22 bp, Homo sapiens
agcgggctcaagtggccagcag

SEQ ID NO: 7830540 - DNA, 22 bp, Homo sapiens
agcgggctcacccggttgttgt

SEQ ID NO: 7830541 - DNA, 22 bp, Homo sapiens
agcggctgtcggccagccggag

SEQ ID NO: 7830542 - DNA, 22 bp, Homo sapiens
agcgggctcaagtggccagcag

SEQ ID NO: 7830543 - DNA, 20 bp, Homo sapiens
agcggctggcggaggacacg

SEQ ID NO: 7830544 - DNA, 22 bp, Homo sapiens
agcggctgctccgcaggctggc

SEQ ID NO: 7830545 - DNA, 22 bp, Homo sapiens
acagaggccgcctctctcacgg

SEQ ID NO: 7830546 - DNA, 22 bp, Homo sapiens
acagaggccgcctctctcacgg

SEQ ID NO: 7830547 - DNA, 22 bp, Homo sapiens
acagaggccgcctctctcacgg

SEQ ID NO: 7830548 - DNA, 22 bp, Homo sapiens
acagaggccccgtgggagagcc

SEQ ID NO: 7830549 - DNA, 22 bp, Homo sapiens
acagaggccccgtgggagagcc

SEQ ID NO: 7830550 - DNA, 22 bp, Homo sapiens
acagaggccccgtgggagagcc

SEQ ID NO: 7830551 - DNA, 22 bp, Homo sapiens
acagaggccccgtgggagagcc

SEQ ID NO: 7830552 - DNA, 22 bp, Homo sapiens
acagaggcctcggcctgcccag

SEQ ID NO: 7830553 - DNA, 22 bp, Homo sapiens
acagaggcctcggcctgcccag

SEQ ID NO: 7830554 - DNA, 22 bp, Homo sapiens
acagaggcctcgtaggtacaac

SEQ ID NO: 7830555 - DNA, 22 bp, Homo sapiens
acagaggcctcgtaggtacaac

SEQ ID NO: 7830556 - DNA, 22 bp, Homo sapiens
acagaggcctcgtaggtacaac

SEQ ID NO: 7830557 - DNA, 22 bp, Homo sapiens
acagaggcctcgtaggtacaac

SEQ ID NO: 7830558 - DNA, 23 bp, Homo sapiens
acagaggcttaaatgagtggcag

SEQ ID NO: 7830559 - DNA, 23 bp, Homo sapiens
acagaggcttaaatgagtggcag

SEQ ID NO: 7830560 - DNA, 23 bp, Homo sapiens
acagaggcttaaatgagtggcag

SEQ ID NO: 7830561 - DNA, 23 bp, Homo sapiens
acagaggcttaaatgagtggcag

SEQ ID NO: 7830562 - DNA, 23 bp, Homo sapiens
acagaggcttaaatgagtggcag

SEQ ID NO: 7830563 - DNA, 23 bp, Homo sapiens
acagaggcttaaatgagtggcag

SEQ ID NO: 7830564 - DNA, 19 bp, Homo sapiens
acagagggcaactgagaaa

SEQ ID NO: 7830565 - DNA, 22 bp, Homo sapiens
acagaggctgcgcttgggaacg

SEQ ID NO: 7830566 - DNA, 22 bp, Homo sapiens
acagaggctgcgcttgggaacg

SEQ ID NO: 7830567 - DNA, 22 bp, Homo sapiens
acagaggctgatcttcaagccc

SEQ ID NO: 7830568 - DNA, 22 bp, Homo sapiens
acagaggctgcgcttgggaacg

SEQ ID NO: 7830569 - DNA, 22 bp, Homo sapiens
acagaggctgcgcttgggaacg

SEQ ID NO: 7830570 - DNA, 22 bp, Homo sapiens
acagaggctgcgcttgggaacg

SEQ ID NO: 7830571 - DNA, 22 bp, Homo sapiens
acagaggcctcgtaggtacaac

SEQ ID NO: 7830572 - DNA, 22 bp, Homo sapiens
acagaggctgatcttcaagccc

SEQ ID NO: 7830573 - DNA, 22 bp, Homo sapiens
acagagggtttctaaggatttg

SEQ ID NO: 7830574 - DNA, 22 bp, Homo sapiens
acagagggtgtggaggaagacg

SEQ ID NO: 7830575 - DNA, 22 bp, Homo sapiens
acagagggtgtggaggaagacg

SEQ ID NO: 7830576 - DNA, 22 bp, Homo sapiens
acagaggtaggacatgagatat

SEQ ID NO: 7830577 - DNA, 22 bp, Homo sapiens
acagaggtaggacatgagatat

SEQ ID NO: 7830578 - DNA, 22 bp, Homo sapiens
acagaggtcacctttgtatctt

SEQ ID NO: 7830579 - DNA, 22 bp, Homo sapiens
acagagggtttctaaggatttg

SEQ ID NO: 7830580 - DNA, 22 bp, Homo sapiens
acagaggggtcacagcctgaag

SEQ ID NO: 7830581 - DNA, 22 bp, Homo sapiens
acagaggggtcacagcctgaag

SEQ ID NO: 7830582 - DNA, 22 bp, Homo sapiens
acagagggtctgggcacaggac

SEQ ID NO: 7830583 - DNA, 22 bp, Homo sapiens
acagagggggccttggagtgca

SEQ ID NO: 7830584 - DNA, 22 bp, Homo sapiens
acagagggggccttggagtgca

SEQ ID NO: 7830585 - DNA, 22 bp, Homo sapiens
acagagggggccttggagtgca

SEQ ID NO: 7830586 - DNA, 22 bp, Homo sapiens
acagagggggccttggagtgca

SEQ ID NO: 7830587 - DNA, 22 bp, Homo sapiens
acagagggggccttggagtgca

SEQ ID NO: 7830588 - DNA, 22 bp, Homo sapiens
acagaattaacatttgatgaat

SEQ ID NO: 7830589 - DNA, 22 bp, Homo sapiens
acagagctgtacatgtgccatg

SEQ ID NO: 7830590 - DNA, 22 bp, Homo sapiens
acagaatgggatttgaatattt

SEQ ID NO: 7830591 - DNA, 17 bp, Homo sapiens
acagaggcaggagtgga

SEQ ID NO: 7830592 - DNA, 17 bp, Homo sapiens
acagaggcaggagtgga

SEQ ID NO: 7830593 - DNA, 22 bp, Homo sapiens
acagagctgtacatgtgccatg

SEQ ID NO: 7830594 - DNA, 22 bp, Homo sapiens
acagaattaacatttgatgaat

SEQ ID NO: 7830595 - DNA, 22 bp, Homo sapiens
acagaattaaagtgtttgtgga

SEQ ID NO: 7830596 - DNA, 22 bp, Homo sapiens
acagaattaacatttgatgaat

SEQ ID NO: 7830597 - DNA, 22 bp, Homo sapiens
acagaatgggatttgaatattt

SEQ ID NO: 7830598 - DNA, 22 bp, Homo sapiens
acagaatgggatttgaatattt

SEQ ID NO: 7830599 - DNA, 22 bp, Homo sapiens
acagaatgggatttgaatattt

SEQ ID NO: 7830600 - DNA, 22 bp, Homo sapiens
acagaatgggatttgaatattt

SEQ ID NO: 7830601 - DNA, 22 bp, Homo sapiens
acagaggcagtgtgagatactg

SEQ ID NO: 7830602 - DNA, 22 bp, Homo sapiens
acagaggcagtgtgagatactg

SEQ ID NO: 7830603 - DNA, 17 bp, Homo sapiens
acagaggcaggagtgga

SEQ ID NO: 7830604 - DNA, 17 bp, Homo sapiens
acagaggcaggagtgga

SEQ ID NO: 7830605 - DNA, 17 bp, Homo sapiens
acagaggcaggagtgga

SEQ ID NO: 7830606 - DNA, 22 bp, Homo sapiens
acagaggccatgagctgccacc

SEQ ID NO: 7830607 - DNA, 22 bp, Homo sapiens
acagaggccatgagctgccacc

SEQ ID NO: 7830608 - DNA, 22 bp, Homo sapiens
acagaggccatgagctgccacc

SEQ ID NO: 7830609 - DNA, 21 bp, Homo sapiens
acagaggcatacagcttaagg

SEQ ID NO: 7830610 - DNA, 22 bp, Homo sapiens
acagaggccatgagctgccacc

SEQ ID NO: 7830611 - DNA, 22 bp, Homo sapiens
acagaggccatgagctgccacc

SEQ ID NO: 7830612 - DNA, 22 bp, Homo sapiens
acagaggccatgagctgccacc

SEQ ID NO: 7830613 - DNA, 22 bp, Homo sapiens
acagaggccatgagctgccacc

SEQ ID NO: 7830614 - DNA, 22 bp, Homo sapiens
acagaatagtagcttaaagtca

SEQ ID NO: 7830615 - DNA, 22 bp, Homo sapiens
acagaatagtagcttaaagtca

SEQ ID NO: 7830616 - DNA, 22 bp, Homo sapiens
acagaataggtacagtcagtca

SEQ ID NO: 7830617 - DNA, 22 bp, Homo sapiens
acagaataggtacagtcagtca

SEQ ID NO: 7830618 - DNA, 22 bp, Homo sapiens
acagaatactcataagaagggg

SEQ ID NO: 7830619 - DNA, 22 bp, Homo sapiens
acagaatactcataagaagggg

SEQ ID NO: 7830620 - DNA, 22 bp, Homo sapiens
acagaatagtagcttaaagtca

SEQ ID NO: 7830621 - DNA, 22 bp, Homo sapiens
acagaatagtagcttaaagtca

SEQ ID NO: 7830622 - DNA, 22 bp, Homo sapiens
acagaatattggttactgttgc

SEQ ID NO: 7830623 - DNA, 22 bp, Homo sapiens
acagaatattggttactgttgc

SEQ ID NO: 7830624 - DNA, 22 bp, Homo sapiens
acagaatattggttactgttgc

SEQ ID NO: 7830625 - DNA, 22 bp, Homo sapiens
acagaatattgtaagtgccact

SEQ ID NO: 7830626 - DNA, 22 bp, Homo sapiens
acagaatattgtaagtgccact

SEQ ID NO: 7830627 - DNA, 22 bp, Homo sapiens
acagaatattttatttagatca

SEQ ID NO: 7830628 - DNA, 22 bp, Homo sapiens
acagaatatttggcatgcgtct

SEQ ID NO: 7830629 - DNA, 22 bp, Homo sapiens
acagaatgcattgacgtacgat

SEQ ID NO: 7830630 - DNA, 22 bp, Homo sapiens
acagaatgcgtagtgcatgttg

SEQ ID NO: 7830631 - DNA, 22 bp, Homo sapiens
acagaatgcgtagtgcatgttg

SEQ ID NO: 7830632 - DNA, 22 bp, Homo sapiens
acagaagtccccatgaagaagc

SEQ ID NO: 7830633 - DNA, 22 bp, Homo sapiens
acagaagtccccatgaagaagc

SEQ ID NO: 7830634 - DNA, 22 bp, Homo sapiens
acagaagtgacaatttcttggg

SEQ ID NO: 7830635 - DNA, 22 bp, Homo sapiens
acagaagtgacaatttcttggg

SEQ ID NO: 7830636 - DNA, 22 bp, Homo sapiens
acagaagtgacaatttcttggg

SEQ ID NO: 7830637 - DNA, 22 bp, Homo sapiens
acagaagtgacaatttcttggg

SEQ ID NO: 7830638 - DNA, 22 bp, Homo sapiens
acagaaggcggggacaaggcgg

SEQ ID NO: 7830639 - DNA, 22 bp, Homo sapiens
acagaagctcaagagagcagtg

SEQ ID NO: 7830640 - DNA, 22 bp, Homo sapiens
acagaaggcggggacaaggcgg

SEQ ID NO: 7830641 - DNA, 22 bp, Homo sapiens
acagaaggacttgagaaagaca

SEQ ID NO: 7830642 - DNA, 22 bp, Homo sapiens
acagaaggacttgagaaagaca

SEQ ID NO: 7830643 - DNA, 22 bp, Homo sapiens
acagaaggacttgagaaagaca

SEQ ID NO: 7830644 - DNA, 22 bp, Homo sapiens
acagaagctcaagagagcagtg

SEQ ID NO: 7830645 - DNA, 23 bp, Homo sapiens
acagaagccaggagccgctgggc

SEQ ID NO: 7830646 - DNA, 19 bp, Homo sapiens
acagaagcatagaaaagga

SEQ ID NO: 7830647 - DNA, 21 bp, Homo sapiens
acagaagcggcgagtggcccc

SEQ ID NO: 7830648 - DNA, 22 bp, Homo sapiens
acagaacttggaacttttcaca

SEQ ID NO: 7830649 - DNA, 22 bp, Homo sapiens
acagaacttccagggaacatac

SEQ ID NO: 7830650 - DNA, 22 bp, Homo sapiens
acagaacttccagggaacatac

SEQ ID NO: 7830651 - DNA, 22 bp, Homo sapiens
acagaagtggcttcaaagagca

SEQ ID NO: 7830652 - DNA, 22 bp, Homo sapiens
acagaagtggcttcaaagagca

SEQ ID NO: 7830653 - DNA, 22 bp, Homo sapiens
acagaagtgagtggcaagaact

SEQ ID NO: 7830654 - DNA, 21 bp, Homo sapiens
acagaagtggcttggtctcag

SEQ ID NO: 7830655 - DNA, 21 bp, Homo sapiens
acagaagtggcttggtctcag

SEQ ID NO: 7830656 - DNA, 22 bp, Homo sapiens
acagaagtgtctttttcattca

SEQ ID NO: 7830657 - DNA, 22 bp, Homo sapiens
acagaagtgtgtgtgtaggaat

SEQ ID NO: 7830658 - DNA, 22 bp, Homo sapiens
acagaagtgttgaagttttcat

SEQ ID NO: 7830659 - DNA, 22 bp, Homo sapiens
acagaagtgttgaagttttcat

SEQ ID NO: 7830660 - DNA, 22 bp, Homo sapiens
acagaagtgtgtgtgtaggaat

SEQ ID NO: 7830661 - DNA, 22 bp, Homo sapiens
acagaagtgtgtgtgtaggaat

SEQ ID NO: 7830662 - DNA, 22 bp, Homo sapiens
acagaataaggtttatctctcc

SEQ ID NO: 7830663 - DNA, 23 bp, Homo sapiens
acagaataccattgactaggtgt

SEQ ID NO: 7830664 - DNA, 23 bp, Homo sapiens
acagaataccattgactaggtgt

SEQ ID NO: 7830665 - DNA, 22 bp, Homo sapiens
acagaatactcataagaagggg

SEQ ID NO: 7830666 - DNA, 22 bp, Homo sapiens
acagaatactcataagaagggg

SEQ ID NO: 7830667 - DNA, 22 bp, Homo sapiens
acagaatactacagactggtta

SEQ ID NO: 7830668 - DNA, 22 bp, Homo sapiens
acagaagtttcaagtaagaagt

SEQ ID NO: 7830669 - DNA, 22 bp, Homo sapiens
acagaataactcttgcttgagt

SEQ ID NO: 7830670 - DNA, 22 bp, Homo sapiens
acagaagtttcaagtaagaagt

SEQ ID NO: 7830671 - DNA, 22 bp, Homo sapiens
acagaataactcttgcttgagt

SEQ ID NO: 7830672 - DNA, 22 bp, Homo sapiens
acagaataactcttgcttgagt

SEQ ID NO: 7830673 - DNA, 22 bp, Homo sapiens
acagaataaggtttatctctcc

SEQ ID NO: 7830674 - DNA, 22 bp, Homo sapiens
acagaataaggtttatctctcc

SEQ ID NO: 7830675 - DNA, 22 bp, Homo sapiens
acagcagtgcacagagaaccct

SEQ ID NO: 7830676 - DNA, 22 bp, Homo sapiens
acagcagtgcacagagaaccct

SEQ ID NO: 7830677 - DNA, 22 bp, Homo sapiens
acagcagtggattagaggatgg

SEQ ID NO: 7830678 - DNA, 22 bp, Homo sapiens
acagcagtggattagaggatgg

SEQ ID NO: 7830679 - DNA, 22 bp, Homo sapiens
acagcagtggattagaggatgg

SEQ ID NO: 7830680 - DNA, 22 bp, Homo sapiens
acagcagtcagtgaatatttaa

SEQ ID NO: 7830681 - DNA, 22 bp, Homo sapiens
acagcagtcagtgaatatttaa

SEQ ID NO: 7830682 - DNA, 22 bp, Homo sapiens
acagcaggttttaactttgaag

SEQ ID NO: 7830683 - DNA, 22 bp, Homo sapiens
acagcagtcttaacacattgca

SEQ ID NO: 7830684 - DNA, 22 bp, Homo sapiens
acagcagggaatatgggaattg

SEQ ID NO: 7830685 - DNA, 22 bp, Homo sapiens
acagcagtcttaacacattgca

SEQ ID NO: 7830686 - DNA, 22 bp, Homo sapiens
acagcaggttttaactttgaag

SEQ ID NO: 7830687 - DNA, 22 bp, Homo sapiens
acagcaggttttaactttgaag

SEQ ID NO: 7830688 - DNA, 22 bp, Homo sapiens
acagcaggttttaactttgaag

SEQ ID NO: 7830689 - DNA, 22 bp, Homo sapiens
acagcaggttttaactttgaag

SEQ ID NO: 7830690 - DNA, 22 bp, Homo sapiens
acagcaggttattgttatggca

SEQ ID NO: 7830691 - DNA, 21 bp, Homo sapiens
acagcagggctggcatgacag

SEQ ID NO: 7830692 - DNA, 21 bp, Homo sapiens
acagcagggctggcatgacag

SEQ ID NO: 7830693 - DNA, 21 bp, Homo sapiens
acagcagggctggcatgacag

SEQ ID NO: 7830694 - DNA, 21 bp, Homo sapiens
acagcagggctggcatgacag

SEQ ID NO: 7830695 - DNA, 21 bp, Homo sapiens
acagcagggctggcatgacag

SEQ ID NO: 7830696 - DNA, 18 bp, Homo sapiens
acagcaggtttcattctt

SEQ ID NO: 7830697 - DNA, 18 bp, Homo sapiens
acagcaggtttcattctt

SEQ ID NO: 7830698 - DNA, 18 bp, Homo sapiens
acagcaggtttcattctt

SEQ ID NO: 7830699 - DNA, 22 bp, Homo sapiens
acagcaggttattgttatggca

SEQ ID NO: 7830700 - DNA, 22 bp, Homo sapiens
acagcaggttattgttatggca

SEQ ID NO: 7830701 - DNA, 22 bp, Homo sapiens
acagcaggcccatactggaagg

SEQ ID NO: 7830702 - DNA, 22 bp, Homo sapiens
acagcaggcccatactggaagg

SEQ ID NO: 7830703 - DNA, 22 bp, Homo sapiens
acagcaggcccatactggaagg

SEQ ID NO: 7830704 - DNA, 22 bp, Homo sapiens
acagcaggcccatactggaagg

SEQ ID NO: 7830705 - DNA, 22 bp, Homo sapiens
acagcaggcccatactggaagg

SEQ ID NO: 7830706 - DNA, 22 bp, Homo sapiens
acagcaggcccatactggaagg

SEQ ID NO: 7830707 - DNA, 22 bp, Homo sapiens
acagcaggcatgaatgacactg

SEQ ID NO: 7830708 - DNA, 17 bp, Homo sapiens
acagcaggcccggaggg

SEQ ID NO: 7830709 - DNA, 17 bp, Homo sapiens
acagcaggcccggaggg

SEQ ID NO: 7830710 - DNA, 17 bp, Homo sapiens
acagcaggcccggaggg

SEQ ID NO: 7830711 - DNA, 17 bp, Homo sapiens
acagcaggcccggaggg

SEQ ID NO: 7830712 - DNA, 17 bp, Homo sapiens
acagcaggcccggaggg

SEQ ID NO: 7830713 - DNA, 17 bp, Homo sapiens
acagcaggcccggaggg

SEQ ID NO: 7830714 - DNA, 17 bp, Homo sapiens
acagcagggaagtgttg

SEQ ID NO: 7830715 - DNA, 17 bp, Homo sapiens
acagcagggaagtgttg

SEQ ID NO: 7830716 - DNA, 17 bp, Homo sapiens
acagcagggaagtgttg

SEQ ID NO: 7830717 - DNA, 17 bp, Homo sapiens
acagcagggaagtgttg

SEQ ID NO: 7830718 - DNA, 17 bp, Homo sapiens
acagcagggaagtgttg

SEQ ID NO: 7830719 - DNA, 22 bp, Homo sapiens
acagcagggaatatgggaattg

SEQ ID NO: 7830720 - DNA, 22 bp, Homo sapiens
acagcagggaatatgggaattg

SEQ ID NO: 7830721 - DNA, 22 bp, Homo sapiens
acagcagggaatatgggaattg

SEQ ID NO: 7830722 - DNA, 22 bp, Homo sapiens
acagcagggaatatgggaattg

SEQ ID NO: 7830723 - DNA, 22 bp, Homo sapiens
acagcagggaatatgggaattg

SEQ ID NO: 7830724 - DNA, 19 bp, Homo sapiens
acagcagggatttttggag

SEQ ID NO: 7830725 - DNA, 19 bp, Homo sapiens
acagcagggatttttggag

SEQ ID NO: 7830726 - DNA, 19 bp, Homo sapiens
acagcagggatttttggag

SEQ ID NO: 7830727 - DNA, 21 bp, Homo sapiens
agctgaggtaaggcaagagag

SEQ ID NO: 7830728 - DNA, 23 bp, Homo sapiens
agctgaggtgcagatccaaagaa

SEQ ID NO: 7830729 - DNA, 21 bp, Homo sapiens
agctgaggtaaggcaagagag

SEQ ID NO: 7830730 - DNA, 23 bp, Homo sapiens
agctgaggtgcagatccaaagaa

SEQ ID NO: 7830731 - DNA, 23 bp, Homo sapiens
agctgaggtgcagatccaaagaa

SEQ ID NO: 7830732 - DNA, 22 bp, Homo sapiens
agctgaggttagtataaatgtg

SEQ ID NO: 7830733 - DNA, 22 bp, Homo sapiens
agctgataggtgtaggatacac

SEQ ID NO: 7830734 - DNA, 22 bp, Homo sapiens
agctgatgccatgtggaacagt

SEQ ID NO: 7830735 - DNA, 22 bp, Homo sapiens
agctgatgccatgtggaacagt

SEQ ID NO: 7830736 - DNA, 22 bp, Homo sapiens
acagcaggcatgaatgacactg

SEQ ID NO: 7830737 - DNA, 22 bp, Homo sapiens
agctgatgtgtccggagcagct

SEQ ID NO: 7830738 - DNA, 22 bp, Homo sapiens
agctgatgtgtccggagcagct

SEQ ID NO: 7830739 - DNA, 22 bp, Homo sapiens
agctgaggttgaagagtgaacg

SEQ ID NO: 7830740 - DNA, 22 bp, Homo sapiens
agctgaggttgaagagtgaacg

SEQ ID NO: 7830741 - DNA, 22 bp, Homo sapiens
agctgagttaattcatcactta

SEQ ID NO: 7830742 - DNA, 18 bp, Homo sapiens
agctgaggggactgaaga

SEQ ID NO: 7830743 - DNA, 22 bp, Homo sapiens
agctgagggttcggtgtccaca

SEQ ID NO: 7830744 - DNA, 22 bp, Homo sapiens
agctgagggcaggatggggtga

SEQ ID NO: 7830745 - DNA, 22 bp, Homo sapiens
agctgagggcaggatggggtga

SEQ ID NO: 7830746 - DNA, 22 bp, Homo sapiens
agctgagggttcggtgtccaca

SEQ ID NO: 7830747 - DNA, 22 bp, Homo sapiens
agctgagggttcggtgtccaca

SEQ ID NO: 7830748 - DNA, 22 bp, Homo sapiens
agctgagggttcggtgtccaca

SEQ ID NO: 7830749 - DNA, 22 bp, Homo sapiens
agctgagggttcggtgtccaca

SEQ ID NO: 7830750 - DNA, 21 bp, Homo sapiens
agctgaggtaaggcaagagag

SEQ ID NO: 7830751 - DNA, 21 bp, Homo sapiens
agctgaggtaaggcaagagag

SEQ ID NO: 7830752 - DNA, 22 bp, Homo sapiens
agctgagcatttgatccacctc

SEQ ID NO: 7830753 - DNA, 22 bp, Homo sapiens
acagcagcgtgaagtgtgttat

SEQ ID NO: 7830754 - DNA, 22 bp, Homo sapiens
agctgagattgtttccatttct

SEQ ID NO: 7830755 - DNA, 22 bp, Homo sapiens
agctgagattatgctcttctca

SEQ ID NO: 7830756 - DNA, 22 bp, Homo sapiens
acagcagccttgttggtttcga

SEQ ID NO: 7830757 - DNA, 22 bp, Homo sapiens
acagcagccttgttggtttcga

SEQ ID NO: 7830758 - DNA, 22 bp, Homo sapiens
acagcagccttgttggtttcga

SEQ ID NO: 7830759 - DNA, 22 bp, Homo sapiens
acagcagcgtcaacttaaaatt

SEQ ID NO: 7830760 - DNA, 22 bp, Homo sapiens
acagcagcgtcaacttaaaatt

SEQ ID NO: 7830761 - DNA, 22 bp, Homo sapiens
acagcagcgtcaacttaaaatt

SEQ ID NO: 7830762 - DNA, 20 bp, Homo sapiens
acagataccagggacatggg

SEQ ID NO: 7830763 - DNA, 22 bp, Homo sapiens
acagatacaaatatacaaatac

SEQ ID NO: 7830764 - DNA, 22 bp, Homo sapiens
acagatacaaatatacaaatac

SEQ ID NO: 7830765 - DNA, 22 bp, Homo sapiens
acagatacaaatatacaaatac

SEQ ID NO: 7830766 - DNA, 22 bp, Homo sapiens
acagataattagcataaatgct

SEQ ID NO: 7830767 - DNA, 22 bp, Homo sapiens
acagataatttaattaatgcat

SEQ ID NO: 7830768 - DNA, 23 bp, Homo sapiens
acagatagggaaggcagagtttc

SEQ ID NO: 7830769 - DNA, 22 bp, Homo sapiens
acagatagtatgtaaattaagc

SEQ ID NO: 7830770 - DNA, 22 bp, Homo sapiens
acagatagcactaagggatctg

SEQ ID NO: 7830771 - DNA, 22 bp, Homo sapiens
acagatactcagctctatgctt

SEQ ID NO: 7830772 - DNA, 22 bp, Homo sapiens
acagatactataatgtaaagtg

SEQ ID NO: 7830773 - DNA, 22 bp, Homo sapiens
acagatattatggtttctcctt

SEQ ID NO: 7830774 - DNA, 22 bp, Homo sapiens
acagatatgcaaagcaaatgga

SEQ ID NO: 7830775 - DNA, 22 bp, Homo sapiens
acagatatatgattgtgtaaat

SEQ ID NO: 7830776 - DNA, 22 bp, Homo sapiens
acagatatatgattgtgtaaat

SEQ ID NO: 7830777 - DNA, 22 bp, Homo sapiens
acagatatatgattgtgtaaat

SEQ ID NO: 7830778 - DNA, 22 bp, Homo sapiens
acagatagtatgtaaattaagc

SEQ ID NO: 7830779 - DNA, 22 bp, Homo sapiens
acagatagtatgtaaattaagc

SEQ ID NO: 7830780 - DNA, 22 bp, Homo sapiens
acagatagatttgagggaggct

SEQ ID NO: 7830781 - DNA, 17 bp, Homo sapiens
acagataggagccccat

SEQ ID NO: 7830782 - DNA, 22 bp, Homo sapiens
acagatataaactatagtagtg

SEQ ID NO: 7830783 - DNA, 22 bp, Homo sapiens
acagatataaactatagtagtg

SEQ ID NO: 7830784 - DNA, 22 bp, Homo sapiens
acagatataaactatagtagtg

SEQ ID NO: 7830785 - DNA, 22 bp, Homo sapiens
acagatataaactatagtagtg

SEQ ID NO: 7830786 - DNA, 22 bp, Homo sapiens
acagatataaactatagtagtg

SEQ ID NO: 7830787 - DNA, 20 bp, Homo sapiens
acagcagataccacaactat

SEQ ID NO: 7830788 - DNA, 22 bp, Homo sapiens
acagcagatctggctacaggtt

SEQ ID NO: 7830789 - DNA, 22 bp, Homo sapiens
acagcagatctggctacaggtt

SEQ ID NO: 7830790 - DNA, 22 bp, Homo sapiens
acagcagatctggctacaggtt

SEQ ID NO: 7830791 - DNA, 22 bp, Homo sapiens
acagcagatctggctacaggtt

SEQ ID NO: 7830792 - DNA, 20 bp, Homo sapiens
acagcagataccacaactat

SEQ ID NO: 7830793 - DNA, 22 bp, Homo sapiens
acagcagagttgagtagttgca

SEQ ID NO: 7830794 - DNA, 22 bp, Homo sapiens
acagcagagtgtgagatagcca

SEQ ID NO: 7830795 - DNA, 22 bp, Homo sapiens
acagcagaccactactagtagg

SEQ ID NO: 7830796 - DNA, 22 bp, Homo sapiens
acagcagaccactactagtagg

SEQ ID NO: 7830797 - DNA, 21 bp, Homo sapiens
acagatatttcattgaacatt

SEQ ID NO: 7830798 - DNA, 21 bp, Homo sapiens
acagatatttcattgaacatt

SEQ ID NO: 7830799 - DNA, 22 bp, Homo sapiens
acagcagaccccagtgccatgg

SEQ ID NO: 7830800 - DNA, 21 bp, Homo sapiens
acagatatttcattgaacatt

SEQ ID NO: 7830801 - DNA, 22 bp, Homo sapiens
acagcagaccccagtgccatgg

SEQ ID NO: 7830802 - DNA, 22 bp, Homo sapiens
acagcagaccactactagtagg

SEQ ID NO: 7830803 - DNA, 22 bp, Homo sapiens
acagcagagtgtgagatagcca

SEQ ID NO: 7830804 - DNA, 22 bp, Homo sapiens
acagcagagtgtgagatagcca

SEQ ID NO: 7830805 - DNA, 22 bp, Homo sapiens
acagcagagtgtgagatagcca

SEQ ID NO: 7830806 - DNA, 22 bp, Homo sapiens
acagcagagtgtgagatagcca

SEQ ID NO: 7830807 - DNA, 22 bp, Homo sapiens
acagcagagtgtgagatagcca

SEQ ID NO: 7830808 - DNA, 22 bp, Homo sapiens
acagcagagtgtgagatagcca

SEQ ID NO: 7830809 - DNA, 22 bp, Homo sapiens
acagcagagtggagatgagcac

SEQ ID NO: 7830810 - DNA, 22 bp, Homo sapiens
acagcagatgacaactatttat

SEQ ID NO: 7830811 - DNA, 22 bp, Homo sapiens
acagcagatgacaactatttat

SEQ ID NO: 7830812 - DNA, 22 bp, Homo sapiens
acagcagatgacaactatttat

SEQ ID NO: 7830813 - DNA, 22 bp, Homo sapiens
acagcagattacattctgctat

SEQ ID NO: 7830814 - DNA, 22 bp, Homo sapiens
acagcagatttccctgggctcc

SEQ ID NO: 7830815 - DNA, 22 bp, Homo sapiens
acagcagatttccctgggctcc

SEQ ID NO: 7830816 - DNA, 22 bp, Homo sapiens
acagcagatttccctgggctcc

SEQ ID NO: 7830817 - DNA, 22 bp, Homo sapiens
acagcagattacattctgctat

SEQ ID NO: 7830818 - DNA, 22 bp, Homo sapiens
acagcagattacattctgctat

SEQ ID NO: 7830819 - DNA, 22 bp, Homo sapiens
acagcagattacattctgctat

SEQ ID NO: 7830820 - DNA, 22 bp, Homo sapiens
acagcagatctggctacaggtt

SEQ ID NO: 7830821 - DNA, 22 bp, Homo sapiens
acagcagatctggctacaggtt

SEQ ID NO: 7830822 - DNA, 22 bp, Homo sapiens
acagcagatgacaactatttat

SEQ ID NO: 7830823 - DNA, 22 bp, Homo sapiens
acagcagatctgtggagcttat

SEQ ID NO: 7830824 - DNA, 22 bp, Homo sapiens
acagcagcaatagcagtgacat

SEQ ID NO: 7830825 - DNA, 22 bp, Homo sapiens
acagcagcaatagcagtgacat

SEQ ID NO: 7830826 - DNA, 22 bp, Homo sapiens
acagcagatttccctgggctcc

SEQ ID NO: 7830827 - DNA, 22 bp, Homo sapiens
acagcagcaatagcagtgacat

SEQ ID NO: 7830828 - DNA, 21 bp, Homo sapiens
acagcagcaatctgtctttcc

SEQ ID NO: 7830829 - DNA, 21 bp, Homo sapiens
acagcagcaatctgtctttcc

SEQ ID NO: 7830830 - DNA, 21 bp, Homo sapiens
acagcagcaatctgtctttcc

SEQ ID NO: 7830831 - DNA, 22 bp, Homo sapiens
acagcagcactattgacatttt

SEQ ID NO: 7830832 - DNA, 21 bp, Homo sapiens
acagcagcaatctgtctttcc

SEQ ID NO: 7830833 - DNA, 22 bp, Homo sapiens
acagcagcaatagcagtgacat

SEQ ID NO: 7830834 - DNA, 22 bp, Homo sapiens
acagcagcaatagcagtgacat

SEQ ID NO: 7830835 - DNA, 22 bp, Homo sapiens
acagcagcactattgacatttt

SEQ ID NO: 7830836 - DNA, 22 bp, Homo sapiens
acagcagcactattgacatttt

SEQ ID NO: 7830837 - DNA, 22 bp, Homo sapiens
acagcagcactattgacatttt

SEQ ID NO: 7830838 - DNA, 22 bp, Homo sapiens
acagcagcagaccagcatatgt

SEQ ID NO: 7830839 - DNA, 22 bp, Homo sapiens
acagcagcagaccagcatatgt

SEQ ID NO: 7830840 - DNA, 22 bp, Homo sapiens
acagcagcagaccagcatatgt

SEQ ID NO: 7830841 - DNA, 22 bp, Homo sapiens
acagcagcagaccagcatatgt

SEQ ID NO: 7830842 - DNA, 22 bp, Homo sapiens
acagcagcatcctatttcactc

SEQ ID NO: 7830843 - DNA, 22 bp, Homo sapiens
acagcagccagccactgtgagc

SEQ ID NO: 7830844 - DNA, 22 bp, Homo sapiens
acagcagcatcctatttcactc

SEQ ID NO: 7830845 - DNA, 22 bp, Homo sapiens
acagcagcatcctatttcactc

SEQ ID NO: 7830846 - DNA, 22 bp, Homo sapiens
acagcagcatcctatttcactc

SEQ ID NO: 7830847 - DNA, 22 bp, Homo sapiens
acagcagcataaactgactaag

SEQ ID NO: 7830848 - DNA, 22 bp, Homo sapiens
acagcagcataaactgactaag

SEQ ID NO: 7830849 - DNA, 22 bp, Homo sapiens
acagcagcataaactgactaag

SEQ ID NO: 7830850 - DNA, 22 bp, Homo sapiens
acagcagcataaactgactaag

SEQ ID NO: 7830851 - DNA, 22 bp, Homo sapiens
acagcagcctgcagccctgtgt

SEQ ID NO: 7830852 - DNA, 22 bp, Homo sapiens
acagcagcctgcagccctgtgt

SEQ ID NO: 7830853 - DNA, 22 bp, Homo sapiens
acagcagccagccactgtgagc

SEQ ID NO: 7830854 - DNA, 22 bp, Homo sapiens
acagcagccagccactgtgagc

SEQ ID NO: 7830855 - DNA, 22 bp, Homo sapiens
acagcagccagccactgtgagc

SEQ ID NO: 7830856 - DNA, 22 bp, Homo sapiens
acagcagccagccactgtgagc

SEQ ID NO: 7830857 - DNA, 22 bp, Homo sapiens
acagcagcctgcagccctgtgt

SEQ ID NO: 7830858 - DNA, 22 bp, Homo sapiens
acagcagcctgcagccctgtgt

SEQ ID NO: 7830859 - DNA, 20 bp, Homo sapiens
acagcagccttgctagaaac

SEQ ID NO: 7830860 - DNA, 20 bp, Homo sapiens
acagcagccttgctagaaac

SEQ ID NO: 7830861 - DNA, 20 bp, Homo sapiens
acagcagccttgctagaaac

SEQ ID NO: 7830862 - DNA, 22 bp, Homo sapiens
acagcagccttgttggtttcga

SEQ ID NO: 7830863 - DNA, 22 bp, Homo sapiens
agcagggaatagcggaaagaat

SEQ ID NO: 7830864 - DNA, 22 bp, Homo sapiens
agcagggaatagcggaaagaat

SEQ ID NO: 7830865 - DNA, 22 bp, Homo sapiens
agcagggaagcctccagaacct

SEQ ID NO: 7830866 - DNA, 22 bp, Homo sapiens
agcagggaagcctccagaacct

SEQ ID NO: 7830867 - DNA, 19 bp, Homo sapiens
agcagggacatggaacttt

SEQ ID NO: 7830868 - DNA, 19 bp, Homo sapiens
agcagggacatggaacttt

SEQ ID NO: 7830869 - DNA, 22 bp, Homo sapiens
agcagggacatggcatctctcc

SEQ ID NO: 7830870 - DNA, 22 bp, Homo sapiens
agcagggacatggcatctctcc

SEQ ID NO: 7830871 - DNA, 22 bp, Homo sapiens
agcagggacatggcatctctcc

SEQ ID NO: 7830872 - DNA, 22 bp, Homo sapiens
agcagggactgagccagtggga

SEQ ID NO: 7830873 - DNA, 22 bp, Homo sapiens
agcagggactgagccagtggga

SEQ ID NO: 7830874 - DNA, 22 bp, Homo sapiens
acacatatgtcattgaaaaatc

SEQ ID NO: 7830875 - DNA, 22 bp, Homo sapiens
acacatatgtcattgaaaaatc

SEQ ID NO: 7830876 - DNA, 22 bp, Homo sapiens
acacatatgtcattgaaaaatc

SEQ ID NO: 7830877 - DNA, 22 bp, Homo sapiens
agcagggactgagccagtggga

SEQ ID NO: 7830878 - DNA, 22 bp, Homo sapiens
agcagggactgagccagtggga

SEQ ID NO: 7830879 - DNA, 22 bp, Homo sapiens
agcagggactgagccagtggga

SEQ ID NO: 7830880 - DNA, 22 bp, Homo sapiens
agcagggactacgtgaaagtga

SEQ ID NO: 7830881 - DNA, 22 bp, Homo sapiens
acacatatgtggcaactgtaga

SEQ ID NO: 7830882 - DNA, 22 bp, Homo sapiens
acacatatgtggcaactgtaga

SEQ ID NO: 7830883 - DNA, 22 bp, Homo sapiens
acacatatgtggcaactgtaga

SEQ ID NO: 7830884 - DNA, 22 bp, Homo sapiens
acacatatgtggcaactgtaga

SEQ ID NO: 7830885 - DNA, 22 bp, Homo sapiens
acacatattcatatgtacttac

SEQ ID NO: 7830886 - DNA, 22 bp, Homo sapiens
acacatatgtggcaactgtaga

SEQ ID NO: 7830887 - DNA, 22 bp, Homo sapiens
acacatcagaaatatgaatgag

SEQ ID NO: 7830888 - DNA, 22 bp, Homo sapiens
acacatcagcctcagctttggg

SEQ ID NO: 7830889 - DNA, 22 bp, Homo sapiens
acacatcagaaatatgaatgag

SEQ ID NO: 7830890 - DNA, 22 bp, Homo sapiens
acacatcagaaatatgaatgag

SEQ ID NO: 7830891 - DNA, 22 bp, Homo sapiens
agcaggtgagcacagccaggct

SEQ ID NO: 7830892 - DNA, 22 bp, Homo sapiens
agcaggtgagcacagccaggct

SEQ ID NO: 7830893 - DNA, 22 bp, Homo sapiens
acacatctcaggggacactctc

SEQ ID NO: 7830894 - DNA, 22 bp, Homo sapiens
acacatctatctctacacaagg

SEQ ID NO: 7830895 - DNA, 22 bp, Homo sapiens
acacatctcaggggacactctc

SEQ ID NO: 7830896 - DNA, 22 bp, Homo sapiens
acacatctatattgcatctgca

SEQ ID NO: 7830897 - DNA, 22 bp, Homo sapiens
acacatctatattgcatctgca

SEQ ID NO: 7830898 - DNA, 22 bp, Homo sapiens
acacatcctgaccaagttcagg

SEQ ID NO: 7830899 - DNA, 22 bp, Homo sapiens
acacatctatctctacacaagg

SEQ ID NO: 7830900 - DNA, 22 bp, Homo sapiens
acacatctatattgcatctgca

SEQ ID NO: 7830901 - DNA, 22 bp, Homo sapiens
acacatcatgccaagtttcacc

SEQ ID NO: 7830902 - DNA, 22 bp, Homo sapiens
acacatcatgccaagtttcacc

SEQ ID NO: 7830903 - DNA, 22 bp, Homo sapiens
acacatcatgccaagtttcacc

SEQ ID NO: 7830904 - DNA, 22 bp, Homo sapiens
acacatctatattgcatctgca

SEQ ID NO: 7830905 - DNA, 22 bp, Homo sapiens
acacagttggtggctcagtctg

SEQ ID NO: 7830906 - DNA, 22 bp, Homo sapiens
acacagtttaaacgattagtac

SEQ ID NO: 7830907 - DNA, 22 bp, Homo sapiens
acacagtttatggtattctgtt

SEQ ID NO: 7830908 - DNA, 22 bp, Homo sapiens
acacagtttaaacgattagtac

SEQ ID NO: 7830909 - DNA, 22 bp, Homo sapiens
acacagtttatggtattctgtt

SEQ ID NO: 7830910 - DNA, 16 bp, Homo sapiens
acacagttttaaggca

SEQ ID NO: 7830911 - DNA, 22 bp, Homo sapiens
acacagttctttcactgttggt

SEQ ID NO: 7830912 - DNA, 22 bp, Homo sapiens
acacagttgattgtcactcagg

SEQ ID NO: 7830913 - DNA, 22 bp, Homo sapiens
acacagttgattgtcactcagg

SEQ ID NO: 7830914 - DNA, 22 bp, Homo sapiens
acacagttggtggctcagtctg

SEQ ID NO: 7830915 - DNA, 22 bp, Homo sapiens
acacagttggtggctcagtctg

SEQ ID NO: 7830916 - DNA, 22 bp, Homo sapiens
acacagttcaggatcaaatagc

SEQ ID NO: 7830917 - DNA, 22 bp, Homo sapiens
acacagttcatgcatgaggtct

SEQ ID NO: 7830918 - DNA, 22 bp, Homo sapiens
acacagttcttagcaggtgtct

SEQ ID NO: 7830919 - DNA, 22 bp, Homo sapiens
acacagttctttcactgttggt

SEQ ID NO: 7830920 - DNA, 22 bp, Homo sapiens
acacagttcgttgttttctact

SEQ ID NO: 7830921 - DNA, 22 bp, Homo sapiens
acacagttcgtgcttttctatt

SEQ ID NO: 7830922 - DNA, 22 bp, Homo sapiens
acacataagaaactacaaagag

SEQ ID NO: 7830923 - DNA, 22 bp, Homo sapiens
acacagtttttcagacagagat

SEQ ID NO: 7830924 - DNA, 16 bp, Homo sapiens
acacagttttaaggca

SEQ ID NO: 7830925 - DNA, 22 bp, Homo sapiens
acacataagaaactacaaagag

SEQ ID NO: 7830926 - DNA, 19 bp, Homo sapiens
agcaggccacagggccagc

SEQ ID NO: 7830927 - DNA, 19 bp, Homo sapiens
agcaggccacagggccagc

SEQ ID NO: 7830928 - DNA, 19 bp, Homo sapiens
agcaggccacagggccagc

SEQ ID NO: 7830929 - DNA, 22 bp, Homo sapiens
agcaggcttggtccccagcctc

SEQ ID NO: 7830930 - DNA, 22 bp, Homo sapiens
agcaggcttgttatgtctgaga

SEQ ID NO: 7830931 - DNA, 22 bp, Homo sapiens
agcagggaagcctccagaacct

SEQ ID NO: 7830932 - DNA, 22 bp, Homo sapiens
agcagggaagcctccagaacct

SEQ ID NO: 7830933 - DNA, 21 bp, Homo sapiens
agcaggctttggagtggggct

SEQ ID NO: 7830934 - DNA, 21 bp, Homo sapiens
agcaggctttggagtggggct

SEQ ID NO: 7830935 - DNA, 21 bp, Homo sapiens
agcaggctttggagtggggct

SEQ ID NO: 7830936 - DNA, 22 bp, Homo sapiens
agcaggctttccacagaaggag

SEQ ID NO: 7830937 - DNA, 22 bp, Homo sapiens
agcaggctttcaagagtcttct

SEQ ID NO: 7830938 - DNA, 22 bp, Homo sapiens
agcaggctttccacagaaggag

SEQ ID NO: 7830939 - DNA, 22 bp, Homo sapiens
acacacaactcattgtgtaata

SEQ ID NO: 7830940 - DNA, 22 bp, Homo sapiens
acacacaactcattgtgtaata

SEQ ID NO: 7830941 - DNA, 22 bp, Homo sapiens
acacacaactcattgtgtaata

SEQ ID NO: 7830942 - DNA, 22 bp, Homo sapiens
acacacaattagttttatgctt

SEQ ID NO: 7830943 - DNA, 22 bp, Homo sapiens
acacacaattagttttatgctt

SEQ ID NO: 7830944 - DNA, 22 bp, Homo sapiens
acacacacaagcaggttgtgga

SEQ ID NO: 7830945 - DNA, 22 bp, Homo sapiens
acacacaattagttttatgctt

SEQ ID NO: 7830946 - DNA, 22 bp, Homo sapiens
acacaatttcctgtccatatgt

SEQ ID NO: 7830947 - DNA, 22 bp, Homo sapiens
acacaatttcctgtccatatgt

SEQ ID NO: 7830948 - DNA, 22 bp, Homo sapiens
acacaatttcctgtccatatgt

SEQ ID NO: 7830949 - DNA, 22 bp, Homo sapiens
acacacaaatctattagtgaat

SEQ ID NO: 7830950 - DNA, 22 bp, Homo sapiens
acacacaaatctattagtgaat

SEQ ID NO: 7830951 - DNA, 22 bp, Homo sapiens
acacacaaatctattagtgaat

SEQ ID NO: 7830952 - DNA, 22 bp, Homo sapiens
acacacaactcattgtgtaata

SEQ ID NO: 7830953 - DNA, 22 bp, Homo sapiens
acacacaactcattgtgtaata

SEQ ID NO: 7830954 - DNA, 19 bp, Homo sapiens
acacaatgacacatatata

SEQ ID NO: 7830955 - DNA, 19 bp, Homo sapiens
acacaatgacacatatata

SEQ ID NO: 7830956 - DNA, 19 bp, Homo sapiens
acacaatgacacatatata

SEQ ID NO: 7830957 - DNA, 19 bp, Homo sapiens
acacaatgacacatatata

SEQ ID NO: 7830958 - DNA, 19 bp, Homo sapiens
acacaatgacacatatata

SEQ ID NO: 7830959 - DNA, 22 bp, Homo sapiens
acacaatgattcacaagcagca

SEQ ID NO: 7830960 - DNA, 22 bp, Homo sapiens
acacaatggcgtgtgccacaga

SEQ ID NO: 7830961 - DNA, 22 bp, Homo sapiens
acacaatgtcatcataatgtca

SEQ ID NO: 7830962 - DNA, 22 bp, Homo sapiens
acacaagattgtgtattgaatt

SEQ ID NO: 7830963 - DNA, 22 bp, Homo sapiens
acacaagattgtgtattgaatt

SEQ ID NO: 7830964 - DNA, 22 bp, Homo sapiens
acacaagattgtgtattgaatt

SEQ ID NO: 7830965 - DNA, 22 bp, Homo sapiens
acacaagattgtgtattgaatt

SEQ ID NO: 7830966 - DNA, 22 bp, Homo sapiens
acacaagaataatgatgaaggt

SEQ ID NO: 7830967 - DNA, 22 bp, Homo sapiens
acacaagaataatgatgaaggt

SEQ ID NO: 7830968 - DNA, 21 bp, Homo sapiens
acacaagcactcgtacatacg

SEQ ID NO: 7830969 - DNA, 22 bp, Homo sapiens
acacaagattgtgtattgaatt

SEQ ID NO: 7830970 - DNA, 22 bp, Homo sapiens
acacaagattgtgtattgaatt

SEQ ID NO: 7830971 - DNA, 22 bp, Homo sapiens
acacaataaatttatcctttga

SEQ ID NO: 7830972 - DNA, 22 bp, Homo sapiens
acacaataaatttatcctttga

SEQ ID NO: 7830973 - DNA, 22 bp, Homo sapiens
acacaagtccctccatactctc

SEQ ID NO: 7830974 - DNA, 22 bp, Homo sapiens
acacaatacagggctcaaaata

SEQ ID NO: 7830975 - DNA, 22 bp, Homo sapiens
acacaatacagggctcaaaata

SEQ ID NO: 7830976 - DNA, 19 bp, Homo sapiens
acacaatgacacatatata

SEQ ID NO: 7830977 - DNA, 23 bp, Homo sapiens
acacaatagagtactattcagcc

SEQ ID NO: 7830978 - DNA, 22 bp, Homo sapiens
acacagttcaggatcaaatagc

SEQ ID NO: 7830979 - DNA, 22 bp, Homo sapiens
acacagttcaggatcaaatagc

SEQ ID NO: 7830980 - DNA, 22 bp, Homo sapiens
acacagtgtgtgcagtcggacg

SEQ ID NO: 7830981 - DNA, 22 bp, Homo sapiens
acacagtgtccttctacttgcc

SEQ ID NO: 7830982 - DNA, 22 bp, Homo sapiens
acacagtgtcttaggtagtgtc

SEQ ID NO: 7830983 - DNA, 22 bp, Homo sapiens
acacagtgtgtgcagtcggacg

SEQ ID NO: 7830984 - DNA, 22 bp, Homo sapiens
acacagtgtcttaggtagtgtc

SEQ ID NO: 7830985 - DNA, 22 bp, Homo sapiens
acacagtggtgtttacaaaatt

SEQ ID NO: 7830986 - DNA, 22 bp, Homo sapiens
acacagtgtcagggcaggggcc

SEQ ID NO: 7830987 - DNA, 22 bp, Homo sapiens
acacagtggtgtttacaaaatt

SEQ ID NO: 7830988 - DNA, 22 bp, Homo sapiens
acacagtgtcagggcaggggcc

SEQ ID NO: 7830989 - DNA, 22 bp, Homo sapiens
acacagtgtcagggcaggggcc

SEQ ID NO: 7830990 - DNA, 22 bp, Homo sapiens
acacagtattgtgactataact

SEQ ID NO: 7830991 - DNA, 22 bp, Homo sapiens
acacagtattgtgactataact

SEQ ID NO: 7830992 - DNA, 22 bp, Homo sapiens
acacagtattgtgactataact

SEQ ID NO: 7830993 - DNA, 22 bp, Homo sapiens
acacagtatgcatctagaaatt

SEQ ID NO: 7830994 - DNA, 22 bp, Homo sapiens
acacagtattgtgactataact

SEQ ID NO: 7830995 - DNA, 22 bp, Homo sapiens
acacagtattgtgactataact

SEQ ID NO: 7830996 - DNA, 22 bp, Homo sapiens
acacagtattgtgactataact

SEQ ID NO: 7830997 - DNA, 22 bp, Homo sapiens
acacagtattgtgactataact

SEQ ID NO: 7830998 - DNA, 22 bp, Homo sapiens
acacagtgccaaattgcagtta

SEQ ID NO: 7830999 - DNA, 18 bp, Homo sapiens
acacagtggatgcctggt

SEQ ID NO: 7831000 - DNA, 22 bp, Homo sapiens
acacagtatgcatctagaaatt

SEQ ID NO: 7831001 - DNA, 22 bp, Homo sapiens
acacagtatgcatctagaaatt

SEQ ID NO: 7831002 - DNA, 22 bp, Homo sapiens
acacagtatgacattggcagag

SEQ ID NO: 7831003 - DNA, 22 bp, Homo sapiens
acacagtatgcatctagaaatt

SEQ ID NO: 7831004 - DNA, 22 bp, Homo sapiens
acacagtattacaataggtgct

SEQ ID NO: 7831005 - DNA, 22 bp, Homo sapiens
acacagtatgaaaagtctagtt

SEQ ID NO: 7831006 - DNA, 22 bp, Homo sapiens
acacagtatgaaaagtctagtt

SEQ ID NO: 7831007 - DNA, 22 bp, Homo sapiens
acacagtatcaaatttcatctt

SEQ ID NO: 7831008 - DNA, 19 bp, Homo sapiens
acacagggctagagttaca

SEQ ID NO: 7831009 - DNA, 22 bp, Homo sapiens
acacagtatcaaatttcatctt

SEQ ID NO: 7831010 - DNA, 22 bp, Homo sapiens
acacagtatcaaatttcatctt

SEQ ID NO: 7831011 - DNA, 22 bp, Homo sapiens
acacagtatcaaatttcatctt

SEQ ID NO: 7831012 - DNA, 22 bp, Homo sapiens
acacacacaagcaggttgtgga

SEQ ID NO: 7831013 - DNA, 18 bp, Homo sapiens
acacacacacctgtgtat

SEQ ID NO: 7831014 - DNA, 18 bp, Homo sapiens
acacacacacctgtgtat

SEQ ID NO: 7831015 - DNA, 22 bp, Homo sapiens
acacacacaagcaggttgtgga

SEQ ID NO: 7831016 - DNA, 22 bp, Homo sapiens
acacacacaagcaggttgtgga

SEQ ID NO: 7831017 - DNA, 22 bp, Homo sapiens
acacacacaagcaggttgtgga

SEQ ID NO: 7831018 - DNA, 18 bp, Homo sapiens
acacacacacctgtgtat

SEQ ID NO: 7831019 - DNA, 18 bp, Homo sapiens
acacacacacctgtgtat

SEQ ID NO: 7831020 - DNA, 18 bp, Homo sapiens
acacacacacctgtgtat

SEQ ID NO: 7831021 - DNA, 19 bp, Homo sapiens
acacagggctagagttaca

SEQ ID NO: 7831022 - DNA, 19 bp, Homo sapiens
acacagggctagagttaca

SEQ ID NO: 7831023 - DNA, 19 bp, Homo sapiens
acacagggctagagttaca

SEQ ID NO: 7831024 - DNA, 19 bp, Homo sapiens
acacagggctagagttaca

SEQ ID NO: 7831025 - DNA, 21 bp, Homo sapiens
agcaggtgtaaaggaggaaat

SEQ ID NO: 7831026 - DNA, 22 bp, Homo sapiens
agcaggtggtgggccagatttg

SEQ ID NO: 7831027 - DNA, 22 bp, Homo sapiens
agcaggtggtaggcagtcagca

SEQ ID NO: 7831028 - DNA, 22 bp, Homo sapiens
agcaggtggtaggcagtcagca

SEQ ID NO: 7831029 - DNA, 22 bp, Homo sapiens
agcaggtgagcacagccaggct

SEQ ID NO: 7831030 - DNA, 22 bp, Homo sapiens
agcaggtgagcacagccaggct

SEQ ID NO: 7831031 - DNA, 19 bp, Homo sapiens
agcaggtgggtaagaaaat

SEQ ID NO: 7831032 - DNA, 21 bp, Homo sapiens
agcaggtgtaaaggaggaaat

SEQ ID NO: 7831033 - DNA, 21 bp, Homo sapiens
agcaggtgtaaaggaggaaat

SEQ ID NO: 7831034 - DNA, 21 bp, Homo sapiens
agcaggtgtaaaggaggaaat

SEQ ID NO: 7831035 - DNA, 21 bp, Homo sapiens
agcaggtgtaaaggaggaaat

SEQ ID NO: 7831036 - DNA, 22 bp, Homo sapiens
agcaggtgtagggctctttgta

SEQ ID NO: 7831037 - DNA, 22 bp, Homo sapiens
agcaggtgtagggctctttgta

SEQ ID NO: 7831038 - DNA, 22 bp, Homo sapiens
agcaggtgtatcggtcacctac

SEQ ID NO: 7831039 - DNA, 22 bp, Homo sapiens
agcaggtgtatataaggctgag

SEQ ID NO: 7831040 - DNA, 22 bp, Homo sapiens
agcaggtgtatataaggctgag

SEQ ID NO: 7831041 - DNA, 22 bp, Homo sapiens
acaccaggtcccgtctgtacct

SEQ ID NO: 7831042 - DNA, 22 bp, Homo sapiens
acaccagggcctagccagggcg

SEQ ID NO: 7831043 - DNA, 22 bp, Homo sapiens
acaccagggcctagccagggcg

SEQ ID NO: 7831044 - DNA, 22 bp, Homo sapiens
acaccaggtcccgtctgtacct

SEQ ID NO: 7831045 - DNA, 22 bp, Homo sapiens
acaccatactcatgttggttcc

SEQ ID NO: 7831046 - DNA, 22 bp, Homo sapiens
acaccatactcatgttggttcc

SEQ ID NO: 7831047 - DNA, 22 bp, Homo sapiens
acaccatgatgagtgatgtagc

SEQ ID NO: 7831048 - DNA, 22 bp, Homo sapiens
acaccatactcatgttggttcc

SEQ ID NO: 7831049 - DNA, 22 bp, Homo sapiens
acaccagtccttactcattttt

SEQ ID NO: 7831050 - DNA, 22 bp, Homo sapiens
acaccagtttcttaagaatatt

SEQ ID NO: 7831051 - DNA, 22 bp, Homo sapiens
acaccagtttcttaagaatatt

SEQ ID NO: 7831052 - DNA, 22 bp, Homo sapiens
acaccagtttcttaagaatatt

SEQ ID NO: 7831053 - DNA, 22 bp, Homo sapiens
acaccagggcctagccagggcg

SEQ ID NO: 7831054 - DNA, 22 bp, Homo sapiens
acaccagggcctagccagggcg

SEQ ID NO: 7831055 - DNA, 22 bp, Homo sapiens
agcaggtgtatcggtcacctac

SEQ ID NO: 7831056 - DNA, 22 bp, Homo sapiens
agcaggtgtcactttcactcca

SEQ ID NO: 7831057 - DNA, 22 bp, Homo sapiens
agcaggtgtcactttcactcca

SEQ ID NO: 7831058 - DNA, 22 bp, Homo sapiens
acacccagattatgcacacaaa

SEQ ID NO: 7831059 - DNA, 22 bp, Homo sapiens
acacccagattatgcacacaaa

SEQ ID NO: 7831060 - DNA, 22 bp, Homo sapiens
acacccagattatgcacacaaa

SEQ ID NO: 7831061 - DNA, 22 bp, Homo sapiens
acacccagattatgcacacaaa

SEQ ID NO: 7831062 - DNA, 22 bp, Homo sapiens
acacccagagcgccagtgccga

SEQ ID NO: 7831063 - DNA, 22 bp, Homo sapiens
acaccatggttcccaaactgtg

SEQ ID NO: 7831064 - DNA, 22 bp, Homo sapiens
acaccatggttcccaaactgtg

SEQ ID NO: 7831065 - DNA, 22 bp, Homo sapiens
acacccagagcgccagtgccga

SEQ ID NO: 7831066 - DNA, 22 bp, Homo sapiens
acacccagagcgccagtgccga

SEQ ID NO: 7831067 - DNA, 22 bp, Homo sapiens
acacccacctctttaggccatg

SEQ ID NO: 7831068 - DNA, 22 bp, Homo sapiens
agccaatgcgtaaaaagatcta

SEQ ID NO: 7831069 - DNA, 22 bp, Homo sapiens
agccaatgcgtaaaaagatcta

SEQ ID NO: 7831070 - DNA, 22 bp, Homo sapiens
agccaatgagacttttggagtg

SEQ ID NO: 7831071 - DNA, 22 bp, Homo sapiens
acactgtgtgacttctgagact

SEQ ID NO: 7831072 - DNA, 22 bp, Homo sapiens
acactgtgtggtctctctcgga

SEQ ID NO: 7831073 - DNA, 22 bp, Homo sapiens
agccaatctacaacaaaggata

SEQ ID NO: 7831074 - DNA, 23 bp, Homo sapiens
agccaatctatgctgggttcaaa

SEQ ID NO: 7831075 - DNA, 22 bp, Homo sapiens
agccaatctcctgttgatgcca

SEQ ID NO: 7831076 - DNA, 22 bp, Homo sapiens
agccaatctggggagacgggag

SEQ ID NO: 7831077 - DNA, 22 bp, Homo sapiens
agccaatcatcctcagactctc

SEQ ID NO: 7831078 - DNA, 22 bp, Homo sapiens
agccaatctacaacaaaggata

SEQ ID NO: 7831079 - DNA, 22 bp, Homo sapiens
agccaatcatcctcagactctc

SEQ ID NO: 7831080 - DNA, 22 bp, Homo sapiens
agccaaggtcgccccagggcaa

SEQ ID NO: 7831081 - DNA, 22 bp, Homo sapiens
agccaatacactgaagatctaa

SEQ ID NO: 7831082 - DNA, 22 bp, Homo sapiens
agccaaggtcgccccagggcaa

SEQ ID NO: 7831083 - DNA, 22 bp, Homo sapiens
agccaaggtcgccccagggcaa

SEQ ID NO: 7831084 - DNA, 22 bp, Homo sapiens
agccaaggtcgccccagggcaa

SEQ ID NO: 7831085 - DNA, 22 bp, Homo sapiens
agccaaggtatcatgagaggca

SEQ ID NO: 7831086 - DNA, 22 bp, Homo sapiens
agccaaggtatcatgagaggca

SEQ ID NO: 7831087 - DNA, 22 bp, Homo sapiens
agccaagggtcagctgcacaga

SEQ ID NO: 7831088 - DNA, 22 bp, Homo sapiens
agccaaggtatcatgagaggca

SEQ ID NO: 7831089 - DNA, 22 bp, Homo sapiens
agccaagggtcagctgcacaga

SEQ ID NO: 7831090 - DNA, 22 bp, Homo sapiens
agccaaggcagctagagctctg

SEQ ID NO: 7831091 - DNA, 22 bp, Homo sapiens
agccaaggcagctagagctctg

SEQ ID NO: 7831092 - DNA, 22 bp, Homo sapiens
agccaaggcagctagagctctg

SEQ ID NO: 7831093 - DNA, 22 bp, Homo sapiens
agccaaggcagctagagctctg

SEQ ID NO: 7831094 - DNA, 22 bp, Homo sapiens
agccaaggcagctagagctctg

SEQ ID NO: 7831095 - DNA, 22 bp, Homo sapiens
agccaaggcagctagagctctg

SEQ ID NO: 7831096 - DNA, 22 bp, Homo sapiens
agccaaggagtgcaggtggctt

SEQ ID NO: 7831097 - DNA, 22 bp, Homo sapiens
agccaaggagtgcaggtggctt

SEQ ID NO: 7831098 - DNA, 22 bp, Homo sapiens
agccaaggactcagtggtaggc

SEQ ID NO: 7831099 - DNA, 18 bp, Homo sapiens
agccaaggaggaggagga

SEQ ID NO: 7831100 - DNA, 18 bp, Homo sapiens
agccaaggaggaggagga

SEQ ID NO: 7831101 - DNA, 22 bp, Homo sapiens
agccaaggagtgcaggtggctt

SEQ ID NO: 7831102 - DNA, 22 bp, Homo sapiens
acacccagctgggccacctcca

SEQ ID NO: 7831103 - DNA, 22 bp, Homo sapiens
acacccagctgggccacctcca

SEQ ID NO: 7831104 - DNA, 22 bp, Homo sapiens
acacccagcttttgaatgccct

SEQ ID NO: 7831105 - DNA, 22 bp, Homo sapiens
acacccagctgggccacctcca

SEQ ID NO: 7831106 - DNA, 22 bp, Homo sapiens
acacccagcttttgaatgccct

SEQ ID NO: 7831107 - DNA, 22 bp, Homo sapiens
acacccagcttttgaatgccct

SEQ ID NO: 7831108 - DNA, 22 bp, Homo sapiens
acacccagcttttgaatgccct

SEQ ID NO: 7831109 - DNA, 22 bp, Homo sapiens
agccaaggacacggagcctcct

SEQ ID NO: 7831110 - DNA, 22 bp, Homo sapiens
agccaaggactcagtggtaggc

SEQ ID NO: 7831111 - DNA, 22 bp, Homo sapiens
acacttatttttgtccacttcc

SEQ ID NO: 7831112 - DNA, 22 bp, Homo sapiens
acacttaacttctgagaataaa

SEQ ID NO: 7831113 - DNA, 22 bp, Homo sapiens
acacttcaaagggtgacttgat

SEQ ID NO: 7831114 - DNA, 22 bp, Homo sapiens
acacttcaaatggttggaaaat

SEQ ID NO: 7831115 - DNA, 22 bp, Homo sapiens
acacttatacaaagaatgtctg

SEQ ID NO: 7831116 - DNA, 22 bp, Homo sapiens
acacttacggttccttcatcca

SEQ ID NO: 7831117 - DNA, 22 bp, Homo sapiens
acacttacggttccttcatcca

SEQ ID NO: 7831118 - DNA, 22 bp, Homo sapiens
acacttaagcatgaagtataaa

SEQ ID NO: 7831119 - DNA, 22 bp, Homo sapiens
acactgttgcttacagttttgg

SEQ ID NO: 7831120 - DNA, 22 bp, Homo sapiens
acactgttgcttacagttttgg

SEQ ID NO: 7831121 - DNA, 22 bp, Homo sapiens
acactgttgctggcacagacag

SEQ ID NO: 7831122 - DNA, 22 bp, Homo sapiens
acactgttgctggcacagacag

SEQ ID NO: 7831123 - DNA, 22 bp, Homo sapiens
acactgttccacactaagaagg

SEQ ID NO: 7831124 - DNA, 22 bp, Homo sapiens
acactgttccacactaagaagg

SEQ ID NO: 7831125 - DNA, 22 bp, Homo sapiens
acactgttccacactaagaagg

SEQ ID NO: 7831126 - DNA, 22 bp, Homo sapiens
acactgttccacactaagaagg

SEQ ID NO: 7831127 - DNA, 22 bp, Homo sapiens
acactgttccacactaagaagg

SEQ ID NO: 7831128 - DNA, 22 bp, Homo sapiens
acactgtgtttacatagagaat

SEQ ID NO: 7831129 - DNA, 22 bp, Homo sapiens
acactgtgtttacatagagaat

SEQ ID NO: 7831130 - DNA, 14 bp, Homo sapiens
acactgtgtttaga

SEQ ID NO: 7831131 - DNA, 20 bp, Homo sapiens
acactgttcttcacacattt

SEQ ID NO: 7831132 - DNA, 20 bp, Homo sapiens
acactgttcttcacacattt

SEQ ID NO: 7831133 - DNA, 20 bp, Homo sapiens
acactgttcttcacacattt

SEQ ID NO: 7831134 - DNA, 22 bp, Homo sapiens
acactgttgctggcacagacag

SEQ ID NO: 7831135 - DNA, 22 bp, Homo sapiens
acactgttctttgcactgagaa

SEQ ID NO: 7831136 - DNA, 22 bp, Homo sapiens
acactgttctttgcactgagaa

SEQ ID NO: 7831137 - DNA, 20 bp, Homo sapiens
acactgttcttcacacattt

SEQ ID NO: 7831138 - DNA, 22 bp, Homo sapiens
agccacagtctgtagccagctt

SEQ ID NO: 7831139 - DNA, 22 bp, Homo sapiens
agccacagtctgatgcctgaga

SEQ ID NO: 7831140 - DNA, 22 bp, Homo sapiens
agccacagtctgatgcctgaga

SEQ ID NO: 7831141 - DNA, 23 bp, Homo sapiens
acacttcacccattgtgatagga

SEQ ID NO: 7831142 - DNA, 23 bp, Homo sapiens
acacttcacccattgtgatagga

SEQ ID NO: 7831143 - DNA, 22 bp, Homo sapiens
agccacagtctgatgcctgaga

SEQ ID NO: 7831144 - DNA, 22 bp, Homo sapiens
agccagagattgagatgcaggc

SEQ ID NO: 7831145 - DNA, 22 bp, Homo sapiens
agccagagattgagatgcaggc

SEQ ID NO: 7831146 - DNA, 22 bp, Homo sapiens
agccagagattgagatgcaggc

SEQ ID NO: 7831147 - DNA, 22 bp, Homo sapiens
agccagagattgagatgcaggc

SEQ ID NO: 7831148 - DNA, 22 bp, Homo sapiens
agccagagattgagatgcaggc

SEQ ID NO: 7831149 - DNA, 22 bp, Homo sapiens
agccacagtctgtagccagctt

SEQ ID NO: 7831150 - DNA, 22 bp, Homo sapiens
agccacagtctgtagccagctt

SEQ ID NO: 7831151 - DNA, 22 bp, Homo sapiens
agccacagtctgtagccagctt

SEQ ID NO: 7831152 - DNA, 22 bp, Homo sapiens
agccagagattgagatgcaggc

SEQ ID NO: 7831153 - DNA, 22 bp, Homo sapiens
agccagagattgagatgcaggc

SEQ ID NO: 7831154 - DNA, 22 bp, Homo sapiens
agccagagattgagatgcaggc

SEQ ID NO: 7831155 - DNA, 22 bp, Homo sapiens
agccagagcagggaattggaca

SEQ ID NO: 7831156 - DNA, 22 bp, Homo sapiens
agccagaggaacttgatgactg

SEQ ID NO: 7831157 - DNA, 22 bp, Homo sapiens
agccagaggaacttgatgactg

SEQ ID NO: 7831158 - DNA, 22 bp, Homo sapiens
agccagaggaagcctggccctc

SEQ ID NO: 7831159 - DNA, 22 bp, Homo sapiens
agccagaggaagcctggccctc

SEQ ID NO: 7831160 - DNA, 22 bp, Homo sapiens
agccagaggaagcctggccctc

SEQ ID NO: 7831161 - DNA, 22 bp, Homo sapiens
agccagaggaagcctggccctc

SEQ ID NO: 7831162 - DNA, 22 bp, Homo sapiens
agccaggaagaaggtcacacca

SEQ ID NO: 7831163 - DNA, 22 bp, Homo sapiens
agccaggaagaaggtcacacca

SEQ ID NO: 7831164 - DNA, 22 bp, Homo sapiens
agccaggaagagaggcctcacc

SEQ ID NO: 7831165 - DNA, 22 bp, Homo sapiens
agccaggaagagaggcctcacc

SEQ ID NO: 7831166 - DNA, 22 bp, Homo sapiens
agccaggaagagaggcctcacc

SEQ ID NO: 7831167 - DNA, 22 bp, Homo sapiens
agccaggaagagaggcctcacc

SEQ ID NO: 7831168 - DNA, 22 bp, Homo sapiens
agccaggaagagaggcctcacc

SEQ ID NO: 7831169 - DNA, 22 bp, Homo sapiens
agccagctttcacaaatgaaga

SEQ ID NO: 7831170 - DNA, 22 bp, Homo sapiens
agccagctttcacaaatgaaga

SEQ ID NO: 7831171 - DNA, 22 bp, Homo sapiens
agccagcttctttacggtggca

SEQ ID NO: 7831172 - DNA, 22 bp, Homo sapiens
agccaggaaccagctacagtct

SEQ ID NO: 7831173 - DNA, 22 bp, Homo sapiens
agccaggaaccagctacagtct

SEQ ID NO: 7831174 - DNA, 22 bp, Homo sapiens
agccaggaaccagctacagtct

SEQ ID NO: 7831175 - DNA, 22 bp, Homo sapiens
agccagcttctttacggtggca

SEQ ID NO: 7831176 - DNA, 22 bp, Homo sapiens
agccagctgttctggggcagca

SEQ ID NO: 7831177 - DNA, 22 bp, Homo sapiens
agccagctgttctggggcagca

SEQ ID NO: 7831178 - DNA, 22 bp, Homo sapiens
agccagctgtactgcctgctca

SEQ ID NO: 7831179 - DNA, 22 bp, Homo sapiens
agccagctgtactgcctgctca

SEQ ID NO: 7831180 - DNA, 22 bp, Homo sapiens
agccagctggtgggtcagctgg

SEQ ID NO: 7831181 - DNA, 22 bp, Homo sapiens
agccagctggtgggtcagctgg

SEQ ID NO: 7831182 - DNA, 22 bp, Homo sapiens
agccagctgtggctatggctcc

SEQ ID NO: 7831183 - DNA, 22 bp, Homo sapiens
agccagctgtcctccctttcct

SEQ ID NO: 7831184 - DNA, 22 bp, Homo sapiens
agccagctgtcctccctttcct

SEQ ID NO: 7831185 - DNA, 22 bp, Homo sapiens
agccagctgtactgcctgctca

SEQ ID NO: 7831186 - DNA, 22 bp, Homo sapiens
agccagctgtcctccctttcct

SEQ ID NO: 7831187 - DNA, 22 bp, Homo sapiens
agccagctgttctggggcagca

SEQ ID NO: 7831188 - DNA, 22 bp, Homo sapiens
agccagctgtgtggtcaggcaa

SEQ ID NO: 7831189 - DNA, 22 bp, Homo sapiens
agccagctgtgtggtcaggcaa

SEQ ID NO: 7831190 - DNA, 22 bp, Homo sapiens
agccagctgtgtggtcaggcaa

SEQ ID NO: 7831191 - DNA, 22 bp, Homo sapiens
agccagctgtgtggtcaggcaa

SEQ ID NO: 7831192 - DNA, 22 bp, Homo sapiens
agccagctgtggctatggctcc

SEQ ID NO: 7831193 - DNA, 22 bp, Homo sapiens
agccagctgtgggctcaggcgg

SEQ ID NO: 7831194 - DNA, 22 bp, Homo sapiens
agccagctgtgggctcaggcgg

SEQ ID NO: 7831195 - DNA, 22 bp, Homo sapiens
agccagctgtgggctcaggcgg

SEQ ID NO: 7831196 - DNA, 22 bp, Homo sapiens
agccagaggtcatgagcacagg

SEQ ID NO: 7831197 - DNA, 22 bp, Homo sapiens
agccagaggtcatgagcacagg

SEQ ID NO: 7831198 - DNA, 22 bp, Homo sapiens
agccagaggtcatgagcacagg

SEQ ID NO: 7831199 - DNA, 22 bp, Homo sapiens
agccagaggtcatgagcacagg

SEQ ID NO: 7831200 - DNA, 22 bp, Homo sapiens
agccagaggtcatgagcacagg

SEQ ID NO: 7831201 - DNA, 22 bp, Homo sapiens
agccagaggtcatgagcacagg

SEQ ID NO: 7831202 - DNA, 22 bp, Homo sapiens
agccagaggtcatgagcacagg

SEQ ID NO: 7831203 - DNA, 22 bp, Homo sapiens
agccagagggaatctttgggga

SEQ ID NO: 7831204 - DNA, 22 bp, Homo sapiens
agccagaggccagcctgcctca

SEQ ID NO: 7831205 - DNA, 22 bp, Homo sapiens
agccagaggccagcctgcctca

SEQ ID NO: 7831206 - DNA, 22 bp, Homo sapiens
agccagaggccagcctgcctca

SEQ ID NO: 7831207 - DNA, 22 bp, Homo sapiens
agccagctgctcgggggaaaca

SEQ ID NO: 7831208 - DNA, 22 bp, Homo sapiens
agccagctgcctttcacatctg

SEQ ID NO: 7831209 - DNA, 22 bp, Homo sapiens
agccagctggagaccactgttt

SEQ ID NO: 7831210 - DNA, 22 bp, Homo sapiens
agccagctggtgggtcagctgg

SEQ ID NO: 7831211 - DNA, 22 bp, Homo sapiens
agccagctggagaccactgttt

SEQ ID NO: 7831212 - DNA, 22 bp, Homo sapiens
agccagctggagaccactgttt

SEQ ID NO: 7831213 - DNA, 19 bp, Homo sapiens
agccagagtggcccagggg

SEQ ID NO: 7831214 - DNA, 19 bp, Homo sapiens
agccagagtggcccagggg

SEQ ID NO: 7831215 - DNA, 22 bp, Homo sapiens
agccagaggtcatgagcacagg

SEQ ID NO: 7831216 - DNA, 19 bp, Homo sapiens
agccagagtggcccagggg

SEQ ID NO: 7831217 - DNA, 19 bp, Homo sapiens
agccagagtggcccagggg

SEQ ID NO: 7831218 - DNA, 19 bp, Homo sapiens
agccagagtggcccagggg

SEQ ID NO: 7831219 - DNA, 22 bp, Homo sapiens
acacttgtaatggagaacacta

SEQ ID NO: 7831220 - DNA, 22 bp, Homo sapiens
acacttggctctgagtcactac

SEQ ID NO: 7831221 - DNA, 22 bp, Homo sapiens
acacttggagcaacacttatgg

SEQ ID NO: 7831222 - DNA, 22 bp, Homo sapiens
acacttggagcaacacttatgg

SEQ ID NO: 7831223 - DNA, 22 bp, Homo sapiens
acacttgccatgctgcacactg

SEQ ID NO: 7831224 - DNA, 22 bp, Homo sapiens
acacttgataggtcaaatcagt

SEQ ID NO: 7831225 - DNA, 22 bp, Homo sapiens
acacttgccatgctgcacactg

SEQ ID NO: 7831226 - DNA, 20 bp, Homo sapiens
acagaaagctgccttgtccc

SEQ ID NO: 7831227 - DNA, 23 bp, Homo sapiens
acagaaagttctgctggacagag

SEQ ID NO: 7831228 - DNA, 23 bp, Homo sapiens
acagaaagttctgctggacagag

SEQ ID NO: 7831229 - DNA, 23 bp, Homo sapiens
acagaaagttctgctggacagag

SEQ ID NO: 7831230 - DNA, 20 bp, Homo sapiens
acagaaagctgccttgtccc

SEQ ID NO: 7831231 - DNA, 20 bp, Homo sapiens
acagaaagctgccttgtccc

SEQ ID NO: 7831232 - DNA, 20 bp, Homo sapiens
acagaaagctgccttgtccc

SEQ ID NO: 7831233 - DNA, 22 bp, Homo sapiens
acagaaagatgatttgaaatgg

SEQ ID NO: 7831234 - DNA, 22 bp, Homo sapiens
acagaaagatgatttgaaatgg

SEQ ID NO: 7831235 - DNA, 22 bp, Homo sapiens
acactttacagaatgttttgat

SEQ ID NO: 7831236 - DNA, 22 bp, Homo sapiens
acactttaagcatttcacactg

SEQ ID NO: 7831237 - DNA, 22 bp, Homo sapiens
acactttaagcatttcacactg

SEQ ID NO: 7831238 - DNA, 22 bp, Homo sapiens
acacttctcatttgatactaac

SEQ ID NO: 7831239 - DNA, 22 bp, Homo sapiens
acacttctctttgaagaacaat

SEQ ID NO: 7831240 - DNA, 22 bp, Homo sapiens
acacttctctttgaagaacaat

SEQ ID NO: 7831241 - DNA, 22 bp, Homo sapiens
acacttctctttgaagaacaat

SEQ ID NO: 7831242 - DNA, 18 bp, Homo sapiens
acacttcctggtggtgtg

SEQ ID NO: 7831243 - DNA, 18 bp, Homo sapiens
acacttcctggtggtgtg

SEQ ID NO: 7831244 - DNA, 18 bp, Homo sapiens
acacttcctggtggtgtg

SEQ ID NO: 7831245 - DNA, 22 bp, Homo sapiens
acacttctattccctgcacaaa

SEQ ID NO: 7831246 - DNA, 22 bp, Homo sapiens
acacttctattccctgcacaaa

SEQ ID NO: 7831247 - DNA, 19 bp, Homo sapiens
acactggttgttcaagggc

SEQ ID NO: 7831248 - DNA, 23 bp, Homo sapiens
acactggttttaaagcagttaat

SEQ ID NO: 7831249 - DNA, 22 bp, Homo sapiens
acactggttgttaatagtaaca

SEQ ID NO: 7831250 - DNA, 22 bp, Homo sapiens
acactggttgaattgtataact

SEQ ID NO: 7831251 - DNA, 22 bp, Homo sapiens
acactggttggttgaatttact

SEQ ID NO: 7831252 - DNA, 19 bp, Homo sapiens
acactggttgttcaagggc

SEQ ID NO: 7831253 - DNA, 22 bp, Homo sapiens
acacttcatttacattataggc

SEQ ID NO: 7831254 - DNA, 20 bp, Homo sapiens
acacatatagcagcataaac

SEQ ID NO: 7831255 - DNA, 20 bp, Homo sapiens
acacatatagcagcataaac

SEQ ID NO: 7831256 - DNA, 20 bp, Homo sapiens
acacatatagcagcataaac

SEQ ID NO: 7831257 - DNA, 20 bp, Homo sapiens
acacatatagcagcataaac

SEQ ID NO: 7831258 - DNA, 20 bp, Homo sapiens
acacatatagcagcataaac

SEQ ID NO: 7831259 - DNA, 20 bp, Homo sapiens
acacatatagcagcataaac

SEQ ID NO: 7831260 - DNA, 22 bp, Homo sapiens
acacatataccactgtaaatga

SEQ ID NO: 7831261 - DNA, 20 bp, Homo sapiens
acacatatagcagcataaac

SEQ ID NO: 7831262 - DNA, 22 bp, Homo sapiens
acacatatatacatatttgtgc

SEQ ID NO: 7831263 - DNA, 22 bp, Homo sapiens
acactggtgtagttttctgcag

SEQ ID NO: 7831264 - DNA, 22 bp, Homo sapiens
acactggtgtagttttctgcag

SEQ ID NO: 7831265 - DNA, 22 bp, Homo sapiens
acactggttctcttaaccctat

SEQ ID NO: 7831266 - DNA, 22 bp, Homo sapiens
acactggttctcaagactaggt

SEQ ID NO: 7831267 - DNA, 22 bp, Homo sapiens
acactggtgttaacttttggtt

SEQ ID NO: 7831268 - DNA, 22 bp, Homo sapiens
acactggttaaacacctctaaa

SEQ ID NO: 7831269 - DNA, 23 bp, Homo sapiens
acactggttagctaaagttagag

SEQ ID NO: 7831270 - DNA, 20 bp, Homo sapiens
acacatatagcagcataaac

SEQ ID NO: 7831271 - DNA, 22 bp, Homo sapiens
acacatatatacatatttgtgc

SEQ ID NO: 7831272 - DNA, 22 bp, Homo sapiens
acacatataccactgtaaatga

SEQ ID NO: 7831273 - DNA, 22 bp, Homo sapiens
acacatataccactgtaaatga

SEQ ID NO: 7831274 - DNA, 22 bp, Homo sapiens
acacatataccactgtaaatga

SEQ ID NO: 7831275 - DNA, 22 bp, Homo sapiens
acacatataccactgtaaatga

SEQ ID NO: 7831276 - DNA, 20 bp, Homo sapiens
acacatagataagaagctga

SEQ ID NO: 7831277 - DNA, 20 bp, Homo sapiens
acacatagataagaagctga

SEQ ID NO: 7831278 - DNA, 22 bp, Homo sapiens
acacatataccactgtaaatga

SEQ ID NO: 7831279 - DNA, 22 bp, Homo sapiens
acacatacatggggaagatgag

SEQ ID NO: 7831280 - DNA, 22 bp, Homo sapiens
acacatagaaaataaatagtta

SEQ ID NO: 7831281 - DNA, 22 bp, Homo sapiens
acacataagcctaatcatctcc

SEQ ID NO: 7831282 - DNA, 22 bp, Homo sapiens
acacataagcctaatcatctcc

SEQ ID NO: 7831283 - DNA, 22 bp, Homo sapiens
acacataagcctaatcatctcc

SEQ ID NO: 7831284 - DNA, 22 bp, Homo sapiens
acacataagcctaatcatctcc

SEQ ID NO: 7831285 - DNA, 22 bp, Homo sapiens
acacataagcctaatcatctcc

SEQ ID NO: 7831286 - DNA, 22 bp, Homo sapiens
acacataagcctaatcatctcc

SEQ ID NO: 7831287 - DNA, 22 bp, Homo sapiens
aagatacatcaaagcaaattgg

SEQ ID NO: 7831288 - DNA, 22 bp, Homo sapiens
aagatacatatttgttctagtg

SEQ ID NO: 7831289 - DNA, 22 bp, Homo sapiens
aagatacatatttgttctagtg

SEQ ID NO: 7831290 - DNA, 22 bp, Homo sapiens
aagatacatatttgttctagtg

SEQ ID NO: 7831291 - DNA, 22 bp, Homo sapiens
aagatacatatttgttctagtg

SEQ ID NO: 7831292 - DNA, 22 bp, Homo sapiens
aagatacatcaaagcaaattgg

SEQ ID NO: 7831293 - DNA, 22 bp, Homo sapiens
aagatacacgttgtattgaata

SEQ ID NO: 7831294 - DNA, 22 bp, Homo sapiens
aagatacacgttgtattgaata

SEQ ID NO: 7831295 - DNA, 22 bp, Homo sapiens
aagatacacgttgtattgaata

SEQ ID NO: 7831296 - DNA, 22 bp, Homo sapiens
aagatacacgttgtattgaata

SEQ ID NO: 7831297 - DNA, 22 bp, Homo sapiens
aagatacacgttgtattgaata

SEQ ID NO: 7831298 - DNA, 22 bp, Homo sapiens
aagatacacgttgtattgaata

SEQ ID NO: 7831299 - DNA, 22 bp, Homo sapiens
aagatacacgttgtattgaata

SEQ ID NO: 7831300 - DNA, 22 bp, Homo sapiens
aagatacagacagagccaaaat

SEQ ID NO: 7831301 - DNA, 22 bp, Homo sapiens
aagatacagacagagccaaaat

SEQ ID NO: 7831302 - DNA, 23 bp, Homo sapiens
aagatacaggtgtggaatggttt

SEQ ID NO: 7831303 - DNA, 22 bp, Homo sapiens
aagataatgtgtctgtctttgc

SEQ ID NO: 7831304 - DNA, 22 bp, Homo sapiens
acagacattttaagacacttta

SEQ ID NO: 7831305 - DNA, 22 bp, Homo sapiens
acagacattttaagacacttta

SEQ ID NO: 7831306 - DNA, 22 bp, Homo sapiens
acagacattttctgtattgcct

SEQ ID NO: 7831307 - DNA, 19 bp, Homo sapiens
acagacatttgcaattagc

SEQ ID NO: 7831308 - DNA, 19 bp, Homo sapiens
acagacatttgcaattagc

SEQ ID NO: 7831309 - DNA, 22 bp, Homo sapiens
acagacattttaagacacttta

SEQ ID NO: 7831310 - DNA, 22 bp, Homo sapiens
acagacattttaagacacttta

SEQ ID NO: 7831311 - DNA, 22 bp, Homo sapiens
acagacattttaagacacttta

SEQ ID NO: 7831312 - DNA, 22 bp, Homo sapiens
acagacatttaataaatgctga

SEQ ID NO: 7831313 - DNA, 23 bp, Homo sapiens
acagacattccataatgtacacc

SEQ ID NO: 7831314 - DNA, 23 bp, Homo sapiens
acagacattgtacatcttgtttt

SEQ ID NO: 7831315 - DNA, 22 bp, Homo sapiens
acagacatttaataaatgctga

SEQ ID NO: 7831316 - DNA, 23 bp, Homo sapiens
acagacattgtacatcttgtttt

SEQ ID NO: 7831317 - DNA, 23 bp, Homo sapiens
acagacattgtacatcttgtttt

SEQ ID NO: 7831318 - DNA, 23 bp, Homo sapiens
acagacattccataatgtacacc

SEQ ID NO: 7831319 - DNA, 23 bp, Homo sapiens
acagacattccataatgtacacc

SEQ ID NO: 7831320 - DNA, 23 bp, Homo sapiens
acagacattccataatgtacacc

SEQ ID NO: 7831321 - DNA, 23 bp, Homo sapiens
acagacattccataatgtacacc

SEQ ID NO: 7831322 - DNA, 23 bp, Homo sapiens
acagacaacactgatgagagaaa

SEQ ID NO: 7831323 - DNA, 23 bp, Homo sapiens
acagacaacactgatgagagaaa

SEQ ID NO: 7831324 - DNA, 23 bp, Homo sapiens
acagacaacactgatgagagaaa

SEQ ID NO: 7831325 - DNA, 22 bp, Homo sapiens
acagaaatgatgtttggcaata

SEQ ID NO: 7831326 - DNA, 23 bp, Homo sapiens
acagaaatcatttgtaaggtacc

SEQ ID NO: 7831327 - DNA, 23 bp, Homo sapiens
acagaaatcatttgtaaggtacc

SEQ ID NO: 7831328 - DNA, 23 bp, Homo sapiens
acagaaatcatttgtaaggtacc

SEQ ID NO: 7831329 - DNA, 23 bp, Homo sapiens
acagaaatcatttgtaaggtacc

SEQ ID NO: 7831330 - DNA, 23 bp, Homo sapiens
acagaaatcatttgtaaggtacc

SEQ ID NO: 7831331 - DNA, 23 bp, Homo sapiens
acagaaatcatttgtaaggtacc

SEQ ID NO: 7831332 - DNA, 22 bp, Homo sapiens
acagaaatattcgtggtgcttg

SEQ ID NO: 7831333 - DNA, 18 bp, Homo sapiens
acagaaatagctgtgcct

SEQ ID NO: 7831334 - DNA, 22 bp, Homo sapiens
acagaaataactttttatgttt

SEQ ID NO: 7831335 - DNA, 22 bp, Homo sapiens
acagaaataactttttatgttt

SEQ ID NO: 7831336 - DNA, 22 bp, Homo sapiens
acagaaataactttttatgttt

SEQ ID NO: 7831337 - DNA, 23 bp, Homo sapiens
acagaaagttctgctggacagag

SEQ ID NO: 7831338 - DNA, 23 bp, Homo sapiens
acagaaagttctgctggacagag

SEQ ID NO: 7831339 - DNA, 23 bp, Homo sapiens
acagaaagttctgctggacagag

SEQ ID NO: 7831340 - DNA, 18 bp, Homo sapiens
acagaaatagctgtgcct

SEQ ID NO: 7831341 - DNA, 22 bp, Homo sapiens
acagaaatatagaaggtaggaa

SEQ ID NO: 7831342 - DNA, 22 bp, Homo sapiens
acagaaatatagaaggtaggaa

SEQ ID NO: 7831343 - DNA, 22 bp, Homo sapiens
acagaaatatagaaggtaggaa

SEQ ID NO: 7831344 - DNA, 23 bp, Homo sapiens
acagactgtattcaaagtaggac

SEQ ID NO: 7831345 - DNA, 23 bp, Homo sapiens
acagactgtattcaaagtaggac

SEQ ID NO: 7831346 - DNA, 23 bp, Homo sapiens
acagactgtattcaaagtaggac

SEQ ID NO: 7831347 - DNA, 23 bp, Homo sapiens
acagactgtattcaaagtaggac

SEQ ID NO: 7831348 - DNA, 22 bp, Homo sapiens
acagactggggtggggaatagg

SEQ ID NO: 7831349 - DNA, 22 bp, Homo sapiens
acagactggggtggggaatagg

SEQ ID NO: 7831350 - DNA, 22 bp, Homo sapiens
acagactggcctgtctcgcacc

SEQ ID NO: 7831351 - DNA, 22 bp, Homo sapiens
acagactggaggagaatagttt

SEQ ID NO: 7831352 - DNA, 22 bp, Homo sapiens
acagactggcctgtctcgcacc

SEQ ID NO: 7831353 - DNA, 22 bp, Homo sapiens
acagactggagtgagagaaata

SEQ ID NO: 7831354 - DNA, 22 bp, Homo sapiens
acagactggagtgagagaaata

SEQ ID NO: 7831355 - DNA, 22 bp, Homo sapiens
acagactggagtgagagaaata

SEQ ID NO: 7831356 - DNA, 20 bp, Homo sapiens
acagagatcctctctttatc

SEQ ID NO: 7831357 - DNA, 23 bp, Homo sapiens
acagagatcttgacttgtatgga

SEQ ID NO: 7831358 - DNA, 22 bp, Homo sapiens
acagagatgaataatacaggtg

SEQ ID NO: 7831359 - DNA, 22 bp, Homo sapiens
acagagatgaattagacagggt

SEQ ID NO: 7831360 - DNA, 22 bp, Homo sapiens
acagactaaaattgcacagtgg

SEQ ID NO: 7831361 - DNA, 22 bp, Homo sapiens
acagactaaaattgcacagtgg

SEQ ID NO: 7831362 - DNA, 22 bp, Homo sapiens
acagacgggacaacgtgcagct

SEQ ID NO: 7831363 - DNA, 22 bp, Homo sapiens
acagaccaagtttccagcaggt

SEQ ID NO: 7831364 - DNA, 22 bp, Homo sapiens
acagaccagctttcattccctt

SEQ ID NO: 7831365 - DNA, 22 bp, Homo sapiens
acagactgattcattgctcagg

SEQ ID NO: 7831366 - DNA, 22 bp, Homo sapiens
acagactggagcccttttgccc

SEQ ID NO: 7831367 - DNA, 22 bp, Homo sapiens
acagactggagtgagagaaata

SEQ ID NO: 7831368 - DNA, 22 bp, Homo sapiens
acagactggaggagaatagttt

SEQ ID NO: 7831369 - DNA, 22 bp, Homo sapiens
acagactggaggagaatagttt

SEQ ID NO: 7831370 - DNA, 22 bp, Homo sapiens
acagactaaaattgcacagtgg

SEQ ID NO: 7831371 - DNA, 22 bp, Homo sapiens
acagactgattcattgctcagg

SEQ ID NO: 7831372 - DNA, 22 bp, Homo sapiens
acagagatggcacagagaaggt

SEQ ID NO: 7831373 - DNA, 22 bp, Homo sapiens
acagagatgagtcaacacagct

SEQ ID NO: 7831374 - DNA, 22 bp, Homo sapiens
acagagatgcaagtgtgtattt

SEQ ID NO: 7831375 - DNA, 22 bp, Homo sapiens
acagagatgagtcaacacagct

SEQ ID NO: 7831376 - DNA, 22 bp, Homo sapiens
acagagatgagtcaacacagct

SEQ ID NO: 7831377 - DNA, 22 bp, Homo sapiens
acagagatgagtcaacacagct

SEQ ID NO: 7831378 - DNA, 22 bp, Homo sapiens
acagagatggcttttcagaggc

SEQ ID NO: 7831379 - DNA, 22 bp, Homo sapiens
acagagatgggaacattcaggt

SEQ ID NO: 7831380 - DNA, 22 bp, Homo sapiens
acagagatgggaacattcaggt

SEQ ID NO: 7831381 - DNA, 22 bp, Homo sapiens
acagagatgggaacattcaggt

SEQ ID NO: 7831382 - DNA, 22 bp, Homo sapiens
acagagatgtcagattggcagc

SEQ ID NO: 7831383 - DNA, 22 bp, Homo sapiens
acagagatgtcagattggcagc

SEQ ID NO: 7831384 - DNA, 22 bp, Homo sapiens
acagagcaacttgagtatcctc

SEQ ID NO: 7831385 - DNA, 22 bp, Homo sapiens
acagagcaactttatttcatgg

SEQ ID NO: 7831386 - DNA, 22 bp, Homo sapiens
acagagcaacttgagtatcctc

SEQ ID NO: 7831387 - DNA, 22 bp, Homo sapiens
acagagcaactttatttcatgg

SEQ ID NO: 7831388 - DNA, 22 bp, Homo sapiens
acagagcaataacagggagagg

SEQ ID NO: 7831389 - DNA, 22 bp, Homo sapiens
acagagcaataacagggagagg

SEQ ID NO: 7831390 - DNA, 22 bp, Homo sapiens
acagagcaataacagggagagg

SEQ ID NO: 7831391 - DNA, 22 bp, Homo sapiens
acagagcaatgcgtgttctcta

SEQ ID NO: 7831392 - DNA, 22 bp, Homo sapiens
acagagcaatgcgtgttctcta

SEQ ID NO: 7831393 - DNA, 22 bp, Homo sapiens
acagctggacaggggagagttt

SEQ ID NO: 7831394 - DNA, 21 bp, Homo sapiens
acagctggaaattacttgccc

SEQ ID NO: 7831395 - DNA, 22 bp, Homo sapiens
acagctgctttctcttactatg

SEQ ID NO: 7831396 - DNA, 22 bp, Homo sapiens
acagctgctttctcttactatg

SEQ ID NO: 7831397 - DNA, 22 bp, Homo sapiens
acagctgctttctcttactatg

SEQ ID NO: 7831398 - DNA, 22 bp, Homo sapiens
acagctgctttctcttactatg

SEQ ID NO: 7831399 - DNA, 22 bp, Homo sapiens
acagctgctgtttttgaaggac

SEQ ID NO: 7831400 - DNA, 22 bp, Homo sapiens
acagctgctgtttttgaaggac

SEQ ID NO: 7831401 - DNA, 22 bp, Homo sapiens
acagctgctgtttttgaaggac

SEQ ID NO: 7831402 - DNA, 22 bp, Homo sapiens
acagctgctgtggaggttttca

SEQ ID NO: 7831403 - DNA, 22 bp, Homo sapiens
acagctgctgtggaggttttca

SEQ ID NO: 7831404 - DNA, 22 bp, Homo sapiens
acagctgctgtggaggttttca

SEQ ID NO: 7831405 - DNA, 22 bp, Homo sapiens
acagctgctgtggaggttttca

SEQ ID NO: 7831406 - DNA, 22 bp, Homo sapiens
acagctgctgcttctcactggg

SEQ ID NO: 7831407 - DNA, 22 bp, Homo sapiens
acagctgctgcttctcactggg

SEQ ID NO: 7831408 - DNA, 22 bp, Homo sapiens
acagctgctgcttctcactggg

SEQ ID NO: 7831409 - DNA, 22 bp, Homo sapiens
acagctgctgcttctcactggg

SEQ ID NO: 7831410 - DNA, 22 bp, Homo sapiens
acagctgctctatatctcagcc

SEQ ID NO: 7831411 - DNA, 22 bp, Homo sapiens
acagctgctctatatctcagcc

SEQ ID NO: 7831412 - DNA, 22 bp, Homo sapiens
acagctgctctatatctcagcc

SEQ ID NO: 7831413 - DNA, 22 bp, Homo sapiens
acagctgctgcttctcactggg

SEQ ID NO: 7831414 - DNA, 22 bp, Homo sapiens
acagctgctctatatctcagcc

SEQ ID NO: 7831415 - DNA, 23 bp, Homo sapiens
aagccccaaggaacttcctggga

SEQ ID NO: 7831416 - DNA, 22 bp, Homo sapiens
aagcccctcgggtgcgcacgcg

SEQ ID NO: 7831417 - DNA, 22 bp, Homo sapiens
aagccctcatccccatgggcgt

SEQ ID NO: 7831418 - DNA, 22 bp, Homo sapiens
aagccctcagagcctctttgac

SEQ ID NO: 7831419 - DNA, 21 bp, Homo sapiens
aagcccgtagagccaggactc

SEQ ID NO: 7831420 - DNA, 22 bp, Homo sapiens
aagcccagtttcacactgagac

SEQ ID NO: 7831421 - DNA, 22 bp, Homo sapiens
aagccctgacctgagagtccgt

SEQ ID NO: 7831422 - DNA, 22 bp, Homo sapiens
aagccctgacctgagagtccgt

SEQ ID NO: 7831423 - DNA, 22 bp, Homo sapiens
aagccctgacctgagagtccgt

SEQ ID NO: 7831424 - DNA, 22 bp, Homo sapiens
aagccctcattagccatagccc

SEQ ID NO: 7831425 - DNA, 22 bp, Homo sapiens
aagccctcattagccatagccc

SEQ ID NO: 7831426 - DNA, 22 bp, Homo sapiens
aagccctccgtacgtgctagct

SEQ ID NO: 7831427 - DNA, 23 bp, Homo sapiens
aagccctgaaggtttcaggccct

SEQ ID NO: 7831428 - DNA, 22 bp, Homo sapiens
aagcccagctctgcctgctctg

SEQ ID NO: 7831429 - DNA, 22 bp, Homo sapiens
aagcccagctctgcctgctctg

SEQ ID NO: 7831430 - DNA, 22 bp, Homo sapiens
aagcccagctctgcctgctctg

SEQ ID NO: 7831431 - DNA, 22 bp, Homo sapiens
aagcccagctgaaagcattttt

SEQ ID NO: 7831432 - DNA, 22 bp, Homo sapiens
aagcccagctgaaagcattttt

SEQ ID NO: 7831433 - DNA, 22 bp, Homo sapiens
aagcccagctgaaagcattttt

SEQ ID NO: 7831434 - DNA, 22 bp, Homo sapiens
aagcccagctgaaagcattttt

SEQ ID NO: 7831435 - DNA, 22 bp, Homo sapiens
aagcccagggaatggtcgggag

SEQ ID NO: 7831436 - DNA, 22 bp, Homo sapiens
aagcccagctgaaagcattttt

SEQ ID NO: 7831437 - DNA, 22 bp, Homo sapiens
aagcccaggtaagtggctcatg

SEQ ID NO: 7831438 - DNA, 22 bp, Homo sapiens
aagcccaggtaagtggctcatg

SEQ ID NO: 7831439 - DNA, 22 bp, Homo sapiens
aagcccagggaatggtcgggag

SEQ ID NO: 7831440 - DNA, 22 bp, Homo sapiens
aagcccagggaatggtcgggag

SEQ ID NO: 7831441 - DNA, 19 bp, Homo sapiens
aagcccagtgtatgctctt

SEQ ID NO: 7831442 - DNA, 19 bp, Homo sapiens
aagcccagtgtatgctctt

SEQ ID NO: 7831443 - DNA, 22 bp, Homo sapiens
aagcccagtaccttcagtgagg

SEQ ID NO: 7831444 - DNA, 22 bp, Homo sapiens
aagcccagtaccttcagtgagg

SEQ ID NO: 7831445 - DNA, 22 bp, Homo sapiens
aagcccagtaccttcagtgagg

SEQ ID NO: 7831446 - DNA, 22 bp, Homo sapiens
aagcccagtaccttcagtgagg

SEQ ID NO: 7831447 - DNA, 22 bp, Homo sapiens
aagcccataaaaagaggtccct

SEQ ID NO: 7831448 - DNA, 22 bp, Homo sapiens
aagcccagtttcacactgagac

SEQ ID NO: 7831449 - DNA, 20 bp, Homo sapiens
aagcccattaccatgcttgg

SEQ ID NO: 7831450 - DNA, 22 bp, Homo sapiens
aagcccatgaaatggcctcaat

SEQ ID NO: 7831451 - DNA, 22 bp, Homo sapiens
aagcccattcggctgccctgca

SEQ ID NO: 7831452 - DNA, 23 bp, Homo sapiens
aagccccaaggaacttcctggga

SEQ ID NO: 7831453 - DNA, 22 bp, Homo sapiens
aagcccagtttcacactgagac

SEQ ID NO: 7831454 - DNA, 22 bp, Homo sapiens
aagcccagtttcacactgagac

SEQ ID NO: 7831455 - DNA, 22 bp, Homo sapiens
aagcccagtttcacactgagac

SEQ ID NO: 7831456 - DNA, 22 bp, Homo sapiens
aagccaggttccatggaggagc

SEQ ID NO: 7831457 - DNA, 22 bp, Homo sapiens
aagccaggttccatggaggagc

SEQ ID NO: 7831458 - DNA, 22 bp, Homo sapiens
aagccaggttccatggaggagc

SEQ ID NO: 7831459 - DNA, 22 bp, Homo sapiens
acagccagggacatacaatggt

SEQ ID NO: 7831460 - DNA, 22 bp, Homo sapiens
acagccagggacatacaatggt

SEQ ID NO: 7831461 - DNA, 22 bp, Homo sapiens
acagccagggacatacaatggt

SEQ ID NO: 7831462 - DNA, 22 bp, Homo sapiens
aagccaggtttgaaatatccca

SEQ ID NO: 7831463 - DNA, 22 bp, Homo sapiens
aagccaggttccatggaggagc

SEQ ID NO: 7831464 - DNA, 22 bp, Homo sapiens
aagccaggtttgaaatatccca

SEQ ID NO: 7831465 - DNA, 22 bp, Homo sapiens
aagcccagcatccctgcaccag

SEQ ID NO: 7831466 - DNA, 22 bp, Homo sapiens
aagcccagcatccctgcaccag

SEQ ID NO: 7831467 - DNA, 22 bp, Homo sapiens
acagccaggaggaactcagtga

SEQ ID NO: 7831468 - DNA, 22 bp, Homo sapiens
acagccaggaggaactcagtga

SEQ ID NO: 7831469 - DNA, 22 bp, Homo sapiens
acagccaggaggaactcagtga

SEQ ID NO: 7831470 - DNA, 22 bp, Homo sapiens
acagccaggaggaactcagtga

SEQ ID NO: 7831471 - DNA, 22 bp, Homo sapiens
acagccaggagccatgggcagg

SEQ ID NO: 7831472 - DNA, 22 bp, Homo sapiens
acagccaggagccatgggcagg

SEQ ID NO: 7831473 - DNA, 22 bp, Homo sapiens
acagccaggagccatgggcagg

SEQ ID NO: 7831474 - DNA, 22 bp, Homo sapiens
acagccaggcccagcacgcagg

SEQ ID NO: 7831475 - DNA, 22 bp, Homo sapiens
acagccaggcccagcacgcagg

SEQ ID NO: 7831476 - DNA, 22 bp, Homo sapiens
acagccaggcccagcacgcagg

SEQ ID NO: 7831477 - DNA, 23 bp, Homo sapiens
acagccaggatgggagcagaagc

SEQ ID NO: 7831478 - DNA, 22 bp, Homo sapiens
acagccaggcccagcacgcagg

SEQ ID NO: 7831479 - DNA, 23 bp, Homo sapiens
acagccaggatgggagcagaagc

SEQ ID NO: 7831480 - DNA, 23 bp, Homo sapiens
acagccaggatgggagcagaagc

SEQ ID NO: 7831481 - DNA, 23 bp, Homo sapiens
acagccaggatgggagcagaagc

SEQ ID NO: 7831482 - DNA, 23 bp, Homo sapiens
acagccaggatgggagcagaagc

SEQ ID NO: 7831483 - DNA, 22 bp, Homo sapiens
acagcaggttacagtggcacag

SEQ ID NO: 7831484 - DNA, 22 bp, Homo sapiens
acagcaggttacagtggcacag

SEQ ID NO: 7831485 - DNA, 22 bp, Homo sapiens
acagcaggttacagtggcacag

SEQ ID NO: 7831486 - DNA, 19 bp, Homo sapiens
acagcaggtgtggggataa

SEQ ID NO: 7831487 - DNA, 22 bp, Homo sapiens
acagccagatctgagagatctt

SEQ ID NO: 7831488 - DNA, 22 bp, Homo sapiens
acagccagatctgagagatctt

SEQ ID NO: 7831489 - DNA, 22 bp, Homo sapiens
acagcaggttacagtggcacag

SEQ ID NO: 7831490 - DNA, 22 bp, Homo sapiens
acagccagatctgagagatctt

SEQ ID NO: 7831491 - DNA, 22 bp, Homo sapiens
acagccagatctgagagatctt

SEQ ID NO: 7831492 - DNA, 22 bp, Homo sapiens
acagccagatctgagagatctt

SEQ ID NO: 7831493 - DNA, 22 bp, Homo sapiens
acagcaggttacagtggcacag

SEQ ID NO: 7831494 - DNA, 22 bp, Homo sapiens
acagccaggacttggccctctt

SEQ ID NO: 7831495 - DNA, 22 bp, Homo sapiens
acagccaggacttggccctctt

SEQ ID NO: 7831496 - DNA, 22 bp, Homo sapiens
acagccaggagccatgggcagg

SEQ ID NO: 7831497 - DNA, 22 bp, Homo sapiens
acagccaggaattctggagaag

SEQ ID NO: 7831498 - DNA, 22 bp, Homo sapiens
acagccaggacttggccctctt

SEQ ID NO: 7831499 - DNA, 22 bp, Homo sapiens
acagccaggacttggccctctt

SEQ ID NO: 7831500 - DNA, 22 bp, Homo sapiens
acagccagcttgatgggatccg

SEQ ID NO: 7831501 - DNA, 22 bp, Homo sapiens
acagccagcagagctgtttcct

SEQ ID NO: 7831502 - DNA, 21 bp, Homo sapiens
acagccaggaacatgaggggc

SEQ ID NO: 7831503 - DNA, 22 bp, Homo sapiens
acagccagcttgatgggatccg

SEQ ID NO: 7831504 - DNA, 21 bp, Homo sapiens
acagccaggaacatgaggggc

SEQ ID NO: 7831505 - DNA, 22 bp, Homo sapiens
acagccaggaattctggagaag

SEQ ID NO: 7831506 - DNA, 22 bp, Homo sapiens
acagcagggggagctgttggac

SEQ ID NO: 7831507 - DNA, 22 bp, Homo sapiens
acagcagggggagctgttggac

SEQ ID NO: 7831508 - DNA, 22 bp, Homo sapiens
acagcagggggagctgttggac

SEQ ID NO: 7831509 - DNA, 22 bp, Homo sapiens
acagcagggggagctgttggac

SEQ ID NO: 7831510 - DNA, 22 bp, Homo sapiens
acagcaggggtggaataaacgt

SEQ ID NO: 7831511 - DNA, 22 bp, Homo sapiens
acagcagggggagctgttggac

SEQ ID NO: 7831512 - DNA, 22 bp, Homo sapiens
acagcagggggagctgttggac

SEQ ID NO: 7831513 - DNA, 21 bp, Homo sapiens
acagcagggctggcatgacag

SEQ ID NO: 7831514 - DNA, 22 bp, Homo sapiens
acagcagggggagctgttggac

SEQ ID NO: 7831515 - DNA, 21 bp, Homo sapiens
acagcagggctggcatgacag

SEQ ID NO: 7831516 - DNA, 22 bp, Homo sapiens
acagcagggggagctgttggac

SEQ ID NO: 7831517 - DNA, 22 bp, Homo sapiens
acagcagggggagctgttggac

SEQ ID NO: 7831518 - DNA, 19 bp, Homo sapiens
acagcaggtgtggggataa

SEQ ID NO: 7831519 - DNA, 19 bp, Homo sapiens
acagcaggtgtggggataa

SEQ ID NO: 7831520 - DNA, 19 bp, Homo sapiens
acagcaggtgtggggataa

SEQ ID NO: 7831521 - DNA, 19 bp, Homo sapiens
acagcaggtgtggggataa

SEQ ID NO: 7831522 - DNA, 19 bp, Homo sapiens
acagcaggtgtggggataa

SEQ ID NO: 7831523 - DNA, 22 bp, Homo sapiens
acagcaggtagctttgtgcctc

SEQ ID NO: 7831524 - DNA, 22 bp, Homo sapiens
acagcaggtagctttgtgcctc

SEQ ID NO: 7831525 - DNA, 22 bp, Homo sapiens
acagcaggtagctttgtgcctc

SEQ ID NO: 7831526 - DNA, 22 bp, Homo sapiens
acagcagggtcacattccctct

SEQ ID NO: 7831527 - DNA, 22 bp, Homo sapiens
acagcaggggtggaataaacgt

SEQ ID NO: 7831528 - DNA, 22 bp, Homo sapiens
acagcaggggtggaataaacgt

SEQ ID NO: 7831529 - DNA, 22 bp, Homo sapiens
acagcaggggtggaataaacgt

SEQ ID NO: 7831530 - DNA, 22 bp, Homo sapiens
acagcagggtcacattccctct

SEQ ID NO: 7831531 - DNA, 22 bp, Homo sapiens
acagcagggtcacattccctct

SEQ ID NO: 7831532 - DNA, 22 bp, Homo sapiens
aagcagtgttcccagctggccc

SEQ ID NO: 7831533 - DNA, 22 bp, Homo sapiens
aagcagttactatttactatta

SEQ ID NO: 7831534 - DNA, 22 bp, Homo sapiens
aagcagtgataagagctaccat

SEQ ID NO: 7831535 - DNA, 22 bp, Homo sapiens
aagcagtgatgcatacagctgt

SEQ ID NO: 7831536 - DNA, 22 bp, Homo sapiens
aagcagtgatgcatacagctgt

SEQ ID NO: 7831537 - DNA, 22 bp, Homo sapiens
aagcagtgactctcagaggcag

SEQ ID NO: 7831538 - DNA, 20 bp, Homo sapiens
aagcagtgaggtgaggagtg

SEQ ID NO: 7831539 - DNA, 22 bp, Homo sapiens
aagcagtgataagagctaccat

SEQ ID NO: 7831540 - DNA, 22 bp, Homo sapiens
acagcaggaagctggagggaaa

SEQ ID NO: 7831541 - DNA, 22 bp, Homo sapiens
acagcaggaagctggagggaaa

SEQ ID NO: 7831542 - DNA, 22 bp, Homo sapiens
acagcaggaagctggagggaaa

SEQ ID NO: 7831543 - DNA, 22 bp, Homo sapiens
aagcataacttgctgcacatag

SEQ ID NO: 7831544 - DNA, 22 bp, Homo sapiens
aagcataaaacgttacaacatg

SEQ ID NO: 7831545 - DNA, 22 bp, Homo sapiens
aagcataaaacgttacaacatg

SEQ ID NO: 7831546 - DNA, 22 bp, Homo sapiens
aagcagtttttcaactgtttag

SEQ ID NO: 7831547 - DNA, 22 bp, Homo sapiens
aagcagtttttcaactgtttag

SEQ ID NO: 7831548 - DNA, 22 bp, Homo sapiens
aagcagtttagataggcaaagg

SEQ ID NO: 7831549 - DNA, 22 bp, Homo sapiens
aagcagtttagataggcaaagg

SEQ ID NO: 7831550 - DNA, 22 bp, Homo sapiens
aagcagtttagataggcaaagg

SEQ ID NO: 7831551 - DNA, 22 bp, Homo sapiens
aagcaggttatgaaatatagaa

SEQ ID NO: 7831552 - DNA, 22 bp, Homo sapiens
aagcaggttatgaaatatagaa

SEQ ID NO: 7831553 - DNA, 22 bp, Homo sapiens
aagcaggttacatacattatct

SEQ ID NO: 7831554 - DNA, 22 bp, Homo sapiens
aagcaggtgtgagccagtgggc

SEQ ID NO: 7831555 - DNA, 22 bp, Homo sapiens
aagcagtaatgaggtactattt

SEQ ID NO: 7831556 - DNA, 22 bp, Homo sapiens
aagcagtagaatgcattgcttt

SEQ ID NO: 7831557 - DNA, 22 bp, Homo sapiens
aagcagtagggccaacttgcag

SEQ ID NO: 7831558 - DNA, 22 bp, Homo sapiens
aagcagggtttttccaccgcag

SEQ ID NO: 7831559 - DNA, 22 bp, Homo sapiens
aagcaggtaaatatgtttccct

SEQ ID NO: 7831560 - DNA, 22 bp, Homo sapiens
aagcagggtgtcttgacccatg

SEQ ID NO: 7831561 - DNA, 22 bp, Homo sapiens
aagcagggtcttcctcagttgg

SEQ ID NO: 7831562 - DNA, 22 bp, Homo sapiens
aagcagggctagaccaagaaga

SEQ ID NO: 7831563 - DNA, 22 bp, Homo sapiens
aagcagggctagaccaagaaga

SEQ ID NO: 7831564 - DNA, 22 bp, Homo sapiens
aagcagggctccctggggactc

SEQ ID NO: 7831565 - DNA, 22 bp, Homo sapiens
aagcagggtcttcctcagttgg

SEQ ID NO: 7831566 - DNA, 18 bp, Homo sapiens
aagcagggtccattgtgc

SEQ ID NO: 7831567 - DNA, 18 bp, Homo sapiens
aagcagggtccattgtgc

SEQ ID NO: 7831568 - DNA, 22 bp, Homo sapiens
aagcagggctttaagcggtttt

SEQ ID NO: 7831569 - DNA, 21 bp, Homo sapiens
aagcagggactgcccaggtcc

SEQ ID NO: 7831570 - DNA, 21 bp, Homo sapiens
aagcagggactgcccaggtcc

SEQ ID NO: 7831571 - DNA, 21 bp, Homo sapiens
aagcagggactgcccaggtcc

SEQ ID NO: 7831572 - DNA, 23 bp, Homo sapiens
aagcagggagattcttagctgag

SEQ ID NO: 7831573 - DNA, 23 bp, Homo sapiens
aagcagggagattcttagctgag

SEQ ID NO: 7831574 - DNA, 22 bp, Homo sapiens
aagcagggagaaatttttcttc

SEQ ID NO: 7831575 - DNA, 22 bp, Homo sapiens
aagcaggcttggtgtggccgct

SEQ ID NO: 7831576 - DNA, 22 bp, Homo sapiens
aagcaggcttggtgtggccgct

SEQ ID NO: 7831577 - DNA, 22 bp, Homo sapiens
aagcaggctcacgccaggcagt

SEQ ID NO: 7831578 - DNA, 22 bp, Homo sapiens
aagcaggcttggtgtggccgct

SEQ ID NO: 7831579 - DNA, 21 bp, Homo sapiens
aagcaggctgtaatcatgtgg

SEQ ID NO: 7831580 - DNA, 22 bp, Homo sapiens
aagcaggctagattgaagggct

SEQ ID NO: 7831581 - DNA, 22 bp, Homo sapiens
aagcaggctcacgccaggcagt

SEQ ID NO: 7831582 - DNA, 22 bp, Homo sapiens
aagcaggcgagggcctggagca

SEQ ID NO: 7831583 - DNA, 21 bp, Homo sapiens
aagcaggacatatgatgccct

SEQ ID NO: 7831584 - DNA, 22 bp, Homo sapiens
aagcaggacgtatttctatcct

SEQ ID NO: 7831585 - DNA, 22 bp, Homo sapiens
aagcaggagagcctgggcgagc

SEQ ID NO: 7831586 - DNA, 22 bp, Homo sapiens
aagcaggagagcctgggcgagc

SEQ ID NO: 7831587 - DNA, 22 bp, Homo sapiens
aagcaggcgagggcctggagca

SEQ ID NO: 7831588 - DNA, 22 bp, Homo sapiens
aagcaggacgtatttctatcct

SEQ ID NO: 7831589 - DNA, 21 bp, Homo sapiens
aagcaggacatatgatgccct

SEQ ID NO: 7831590 - DNA, 21 bp, Homo sapiens
aagcaggacatatgatgccct

SEQ ID NO: 7831591 - DNA, 22 bp, Homo sapiens
aagcaggaaggagcccagggca

SEQ ID NO: 7831592 - DNA, 22 bp, Homo sapiens
acagagcacagtcgggatggga

SEQ ID NO: 7831593 - DNA, 22 bp, Homo sapiens
acagagcacagtcgggatggga

SEQ ID NO: 7831594 - DNA, 22 bp, Homo sapiens
acagagcacagtcgggatggga

SEQ ID NO: 7831595 - DNA, 22 bp, Homo sapiens
acagagcaattcttgggtgttt

SEQ ID NO: 7831596 - DNA, 22 bp, Homo sapiens
acagagcacagtcgggatggga

SEQ ID NO: 7831597 - DNA, 22 bp, Homo sapiens
aagaatatctgttttatttagg

SEQ ID NO: 7831598 - DNA, 22 bp, Homo sapiens
aagaatatctgttttatttagg

SEQ ID NO: 7831599 - DNA, 22 bp, Homo sapiens
aagaatatctgttttatttagg

SEQ ID NO: 7831600 - DNA, 22 bp, Homo sapiens
aagaatatctgttttatttagg

SEQ ID NO: 7831601 - DNA, 22 bp, Homo sapiens
aagaatatctgttttatttagg

SEQ ID NO: 7831602 - DNA, 22 bp, Homo sapiens
aagaatatctgttttatttagg

SEQ ID NO: 7831603 - DNA, 22 bp, Homo sapiens
aagaatatagattttttgaagt

SEQ ID NO: 7831604 - DNA, 22 bp, Homo sapiens
aagaatatagattttttgaagt

SEQ ID NO: 7831605 - DNA, 22 bp, Homo sapiens
acaaaatagagttctcccctgg

SEQ ID NO: 7831606 - DNA, 22 bp, Homo sapiens
acaaaatagagttctcccctgg

SEQ ID NO: 7831607 - DNA, 22 bp, Homo sapiens
acaaaatagagttctcccctgg

SEQ ID NO: 7831608 - DNA, 22 bp, Homo sapiens
aagaatcatcctgcaagagtct

SEQ ID NO: 7831609 - DNA, 22 bp, Homo sapiens
aagaatcatcctgcaagagtct

SEQ ID NO: 7831610 - DNA, 22 bp, Homo sapiens
aagaatcatcctgcaagagtct

SEQ ID NO: 7831611 - DNA, 22 bp, Homo sapiens
aagaatcatagagccactgata

SEQ ID NO: 7831612 - DNA, 23 bp, Homo sapiens
aagaatcagtaagtaaggagacc

SEQ ID NO: 7831613 - DNA, 17 bp, Homo sapiens
aagaatcattagagaag

SEQ ID NO: 7831614 - DNA, 17 bp, Homo sapiens
aagaatcattagagaag

SEQ ID NO: 7831615 - DNA, 22 bp, Homo sapiens
aagaatcattgtaaagttctgt

SEQ ID NO: 7831616 - DNA, 22 bp, Homo sapiens
aagaatcatcctgcaagagtct

SEQ ID NO: 7831617 - DNA, 22 bp, Homo sapiens
acaaaagtgtaggaattcctta

SEQ ID NO: 7831618 - DNA, 22 bp, Homo sapiens
acaaaagtgtaggaattcctta

SEQ ID NO: 7831619 - DNA, 22 bp, Homo sapiens
acaaaagtgtaggaattcctta

SEQ ID NO: 7831620 - DNA, 22 bp, Homo sapiens
acaaaagtgtaggaattcctta

SEQ ID NO: 7831621 - DNA, 22 bp, Homo sapiens
acaaaagtgagtgtgtctcaga

SEQ ID NO: 7831622 - DNA, 22 bp, Homo sapiens
acaaaagtgagtgtgtctcaga

SEQ ID NO: 7831623 - DNA, 22 bp, Homo sapiens
acaaaagtagttgcggtttttg

SEQ ID NO: 7831624 - DNA, 22 bp, Homo sapiens
acaaaagtgagtgtgtctcaga

SEQ ID NO: 7831625 - DNA, 22 bp, Homo sapiens
acaaaagcactgcagagtaagc

SEQ ID NO: 7831626 - DNA, 22 bp, Homo sapiens
acaaaagcactgcagagtaagc

SEQ ID NO: 7831627 - DNA, 22 bp, Homo sapiens
acaaaagcttttggagggttgt

SEQ ID NO: 7831628 - DNA, 22 bp, Homo sapiens
acaaaagtagttgcggtttttg

SEQ ID NO: 7831629 - DNA, 22 bp, Homo sapiens
acaaaaccagaaaatctctacc

SEQ ID NO: 7831630 - DNA, 21 bp, Homo sapiens
acaaaagaagctgccttttaa

SEQ ID NO: 7831631 - DNA, 21 bp, Homo sapiens
acaaaagaagctgccttttaa

SEQ ID NO: 7831632 - DNA, 22 bp, Homo sapiens
acaaaagaataagatgagtcat

SEQ ID NO: 7831633 - DNA, 22 bp, Homo sapiens
acaaaagaataagatgagtcat

SEQ ID NO: 7831634 - DNA, 22 bp, Homo sapiens
acaaaagaataagatgagtcat

SEQ ID NO: 7831635 - DNA, 22 bp, Homo sapiens
acaaaagaataagatgagtcat

SEQ ID NO: 7831636 - DNA, 22 bp, Homo sapiens
acaaaagaataagatgagtcat

SEQ ID NO: 7831637 - DNA, 22 bp, Homo sapiens
acaaaagaataagatgagtcat

SEQ ID NO: 7831638 - DNA, 22 bp, Homo sapiens
acaaaagaataagatgagtcat

SEQ ID NO: 7831639 - DNA, 22 bp, Homo sapiens
acaaaagcactgcagagtaagc

SEQ ID NO: 7831640 - DNA, 22 bp, Homo sapiens
acaaaacagtgttcctgcccct

SEQ ID NO: 7831641 - DNA, 22 bp, Homo sapiens
acaaaagcactgcagagtaagc

SEQ ID NO: 7831642 - DNA, 22 bp, Homo sapiens
acaaaagaataagatgagtcat

SEQ ID NO: 7831643 - DNA, 22 bp, Homo sapiens
acaaaagaataagatgagtcat

SEQ ID NO: 7831644 - DNA, 22 bp, Homo sapiens
acaaaagaataagatgagtcat

SEQ ID NO: 7831645 - DNA, 22 bp, Homo sapiens
acaaaagaataagatgagtcat

SEQ ID NO: 7831646 - DNA, 22 bp, Homo sapiens
acaaatgaatcatacataatgt

SEQ ID NO: 7831647 - DNA, 22 bp, Homo sapiens
acaaatgaatcatacataatgt

SEQ ID NO: 7831648 - DNA, 22 bp, Homo sapiens
acaaatgaatcatacataatgt

SEQ ID NO: 7831649 - DNA, 22 bp, Homo sapiens
acaaatgaatcatacataatgt

SEQ ID NO: 7831650 - DNA, 22 bp, Homo sapiens
acaaatgaatcatacataatgt

SEQ ID NO: 7831651 - DNA, 22 bp, Homo sapiens
acaaatgaatcatacataatgt

SEQ ID NO: 7831652 - DNA, 22 bp, Homo sapiens
acaaatgaatcatacataatgt

SEQ ID NO: 7831653 - DNA, 22 bp, Homo sapiens
acaaatgaatcatacataatgt

SEQ ID NO: 7831654 - DNA, 22 bp, Homo sapiens
acaaatgaatcatacataatgt

SEQ ID NO: 7831655 - DNA, 22 bp, Homo sapiens
acaaatgactatttggtacagg

SEQ ID NO: 7831656 - DNA, 20 bp, Homo sapiens
acaaattggcagaatgacaa

SEQ ID NO: 7831657 - DNA, 19 bp, Homo sapiens
acaaattgtcctcatcaag

SEQ ID NO: 7831658 - DNA, 22 bp, Homo sapiens
acaaatgaatcatacataatgt

SEQ ID NO: 7831659 - DNA, 22 bp, Homo sapiens
acaaatgactatttggtacagg

SEQ ID NO: 7831660 - DNA, 22 bp, Homo sapiens
acaaatgaacatataagcttga

SEQ ID NO: 7831661 - DNA, 22 bp, Homo sapiens
acaaatgaacatataagcttga

SEQ ID NO: 7831662 - DNA, 22 bp, Homo sapiens
acaaatctgttttatagacttt

SEQ ID NO: 7831663 - DNA, 22 bp, Homo sapiens
acaaatgaacatataagcttga

SEQ ID NO: 7831664 - DNA, 22 bp, Homo sapiens
acaaatctgttttatagacttt

SEQ ID NO: 7831665 - DNA, 22 bp, Homo sapiens
acaaatctgttttatagacttt

SEQ ID NO: 7831666 - DNA, 22 bp, Homo sapiens
acaaatccagtgaactccagtg

SEQ ID NO: 7831667 - DNA, 22 bp, Homo sapiens
acaaatgaacctgaaatctcag

SEQ ID NO: 7831668 - DNA, 22 bp, Homo sapiens
acaaatgaacctgaaatctcag

SEQ ID NO: 7831669 - DNA, 22 bp, Homo sapiens
acaaatgaacctgaaatctcag

SEQ ID NO: 7831670 - DNA, 22 bp, Homo sapiens
acaaatgaacatataagcttga

SEQ ID NO: 7831671 - DNA, 22 bp, Homo sapiens
acaaatgaacatataagcttga

SEQ ID NO: 7831672 - DNA, 22 bp, Homo sapiens
acaaatctgttttatagacttt

SEQ ID NO: 7831673 - DNA, 22 bp, Homo sapiens
acaaatatttactgaatccact

SEQ ID NO: 7831674 - DNA, 22 bp, Homo sapiens
acaaatatttactgaatccact

SEQ ID NO: 7831675 - DNA, 22 bp, Homo sapiens
acaaatatttactgaatccact

SEQ ID NO: 7831676 - DNA, 22 bp, Homo sapiens
acaaatatttactgaatccact

SEQ ID NO: 7831677 - DNA, 22 bp, Homo sapiens
acaaagctagagaagagaattg

SEQ ID NO: 7831678 - DNA, 22 bp, Homo sapiens
acaaagctagagaagagaattg

SEQ ID NO: 7831679 - DNA, 22 bp, Homo sapiens
acaaagctagagaagagaattg

SEQ ID NO: 7831680 - DNA, 22 bp, Homo sapiens
acaaagctctggaaggctcgtc

SEQ ID NO: 7831681 - DNA, 22 bp, Homo sapiens
acaaatatttactgaatccact

SEQ ID NO: 7831682 - DNA, 22 bp, Homo sapiens
acaaagctagagaagagaattg

SEQ ID NO: 7831683 - DNA, 22 bp, Homo sapiens
acaaatatttactgaatccact

SEQ ID NO: 7831684 - DNA, 22 bp, Homo sapiens
acaaatatttactgaatccact

SEQ ID NO: 7831685 - DNA, 22 bp, Homo sapiens
acaaatatttactgaatccact

SEQ ID NO: 7831686 - DNA, 22 bp, Homo sapiens
aagaatcattgtaaagttctgt

SEQ ID NO: 7831687 - DNA, 22 bp, Homo sapiens
aagaatctatggtacatccaag

SEQ ID NO: 7831688 - DNA, 22 bp, Homo sapiens
aagaatctatggtacatccaag

SEQ ID NO: 7831689 - DNA, 22 bp, Homo sapiens
aagaatctatggtacatccaag

SEQ ID NO: 7831690 - DNA, 23 bp, Homo sapiens
aagaatctcagaattagaaatac

SEQ ID NO: 7831691 - DNA, 23 bp, Homo sapiens
aagaatctcagaattagaaatac

SEQ ID NO: 7831692 - DNA, 22 bp, Homo sapiens
aagaatctatggtacatccaag

SEQ ID NO: 7831693 - DNA, 22 bp, Homo sapiens
acaaagctagagaagagaattg

SEQ ID NO: 7831694 - DNA, 22 bp, Homo sapiens
aagaatctgacataatttcctg

SEQ ID NO: 7831695 - DNA, 22 bp, Homo sapiens
aagaatctctgatcaggcttta

SEQ ID NO: 7831696 - DNA, 15 bp, Homo sapiens
aagaatctgaagctt

SEQ ID NO: 7831697 - DNA, 22 bp, Homo sapiens
aagaatctctcaagtgtgacaa

SEQ ID NO: 7831698 - DNA, 22 bp, Homo sapiens
aagaatctctctactttattac

SEQ ID NO: 7831699 - DNA, 18 bp, Homo sapiens
aagaatctctgactcttt

SEQ ID NO: 7831700 - DNA, 22 bp, Homo sapiens
aagaatctccatctgattcact

SEQ ID NO: 7831701 - DNA, 22 bp, Homo sapiens
aagaatctccattcctgtttta

SEQ ID NO: 7831702 - DNA, 22 bp, Homo sapiens
aagaatctccatctgattcact

SEQ ID NO: 7831703 - DNA, 22 bp, Homo sapiens
aagaagaagtgttatttttaga

SEQ ID NO: 7831704 - DNA, 22 bp, Homo sapiens
aagaagaagtgttatttttaga

SEQ ID NO: 7831705 - DNA, 22 bp, Homo sapiens
aagaagaagtgttatttttaga

SEQ ID NO: 7831706 - DNA, 22 bp, Homo sapiens
aagaacttttggcaagtgttat

SEQ ID NO: 7831707 - DNA, 22 bp, Homo sapiens
aagaacttttggcaagtgttat

SEQ ID NO: 7831708 - DNA, 23 bp, Homo sapiens
aagaactttggtcctgcagagtc

SEQ ID NO: 7831709 - DNA, 23 bp, Homo sapiens
aagaactttggtcctgcagagtc

SEQ ID NO: 7831710 - DNA, 23 bp, Homo sapiens
aagaactttggtcctgcagagtc

SEQ ID NO: 7831711 - DNA, 22 bp, Homo sapiens
aagaagagaactggcatcctaa

SEQ ID NO: 7831712 - DNA, 22 bp, Homo sapiens
aagaagaattattccctaatca

SEQ ID NO: 7831713 - DNA, 22 bp, Homo sapiens
aagaagagaaatgtgctgctgg

SEQ ID NO: 7831714 - DNA, 22 bp, Homo sapiens
aagaacttgggctgagtgaaag

SEQ ID NO: 7831715 - DNA, 22 bp, Homo sapiens
aagaactttaaagcacttatga

SEQ ID NO: 7831716 - DNA, 22 bp, Homo sapiens
aagaacttcctaatatattttc

SEQ ID NO: 7831717 - DNA, 22 bp, Homo sapiens
aagaacttcctaatatattttc

SEQ ID NO: 7831718 - DNA, 22 bp, Homo sapiens
aagaactttgatttcattgcat

SEQ ID NO: 7831719 - DNA, 22 bp, Homo sapiens
aagaactttgatttcattgcat

SEQ ID NO: 7831720 - DNA, 22 bp, Homo sapiens
aagaactttgatttcattgcat

SEQ ID NO: 7831721 - DNA, 22 bp, Homo sapiens
aagaactttgatttcattgcat

SEQ ID NO: 7831722 - DNA, 22 bp, Homo sapiens
aagaactttaaagcacttatga

SEQ ID NO: 7831723 - DNA, 22 bp, Homo sapiens
aagaactgtttacaattttcac

SEQ ID NO: 7831724 - DNA, 22 bp, Homo sapiens
aagaactgtgctccaggctcca

SEQ ID NO: 7831725 - DNA, 22 bp, Homo sapiens
aagaactgtatcaagatgtagt

SEQ ID NO: 7831726 - DNA, 22 bp, Homo sapiens
aagaactgtatcaagatgtagt

SEQ ID NO: 7831727 - DNA, 22 bp, Homo sapiens
acaaaaagggagatgaggtaga

SEQ ID NO: 7831728 - DNA, 22 bp, Homo sapiens
acaaaaattagctgggcatggt

SEQ ID NO: 7831729 - DNA, 22 bp, Homo sapiens
acaaaaattagctgggcatggt

SEQ ID NO: 7831730 - DNA, 22 bp, Homo sapiens
acaaaaattagctgggcatggt

SEQ ID NO: 7831731 - DNA, 22 bp, Homo sapiens
aattttatctctaagcaggctt

SEQ ID NO: 7831732 - DNA, 22 bp, Homo sapiens
acaaaaattagctgggcatggt

SEQ ID NO: 7831733 - DNA, 22 bp, Homo sapiens
acaaaacagtgttcctgcccct

SEQ ID NO: 7831734 - DNA, 22 bp, Homo sapiens
acaaaaattagctgggcatggt

SEQ ID NO: 7831735 - DNA, 22 bp, Homo sapiens
acaaaacagtgttcctgcccct

SEQ ID NO: 7831736 - DNA, 22 bp, Homo sapiens
acaaaacagtgttcctgcccct

SEQ ID NO: 7831737 - DNA, 22 bp, Homo sapiens
acaaaacagtgttcctgcccct

SEQ ID NO: 7831738 - DNA, 22 bp, Homo sapiens
acaaaacagtgttcctgcccct

SEQ ID NO: 7831739 - DNA, 19 bp, Homo sapiens
aagaagcaataagctgtga

SEQ ID NO: 7831740 - DNA, 21 bp, Homo sapiens
aagaagcaatttattggaagg

SEQ ID NO: 7831741 - DNA, 22 bp, Homo sapiens
aattttatctctaagcaggctt

SEQ ID NO: 7831742 - DNA, 22 bp, Homo sapiens
aagaagcactttcctacatgtt

SEQ ID NO: 7831743 - DNA, 21 bp, Homo sapiens
aagaagcaatttattggaagg

SEQ ID NO: 7831744 - DNA, 21 bp, Homo sapiens
aagaagcaatttattggaagg

SEQ ID NO: 7831745 - DNA, 21 bp, Homo sapiens
aagaagcaatttattggaagg

SEQ ID NO: 7831746 - DNA, 22 bp, Homo sapiens
aagaagatggttaactttcagt

SEQ ID NO: 7831747 - DNA, 22 bp, Homo sapiens
aagaagagaactggcatcctaa

SEQ ID NO: 7831748 - DNA, 19 bp, Homo sapiens
aagaagcaataagctgtga

SEQ ID NO: 7831749 - DNA, 19 bp, Homo sapiens
aagaagcaataagctgtga

SEQ ID NO: 7831750 - DNA, 22 bp, Homo sapiens
aatgtacaagggttccagtttt

SEQ ID NO: 7831751 - DNA, 22 bp, Homo sapiens
aatgtacaagggttccagtttt

SEQ ID NO: 7831752 - DNA, 22 bp, Homo sapiens
aatgtacaagggttccagtttt

SEQ ID NO: 7831753 - DNA, 22 bp, Homo sapiens
aatgtacaagggttccagtttt

SEQ ID NO: 7831754 - DNA, 22 bp, Homo sapiens
aatgtacaagggttccagtttt

SEQ ID NO: 7831755 - DNA, 22 bp, Homo sapiens
aatgtacaataagacaaagagg

SEQ ID NO: 7831756 - DNA, 22 bp, Homo sapiens
aatgtacaagggttccagtttt

SEQ ID NO: 7831757 - DNA, 22 bp, Homo sapiens
aatgtacaataagacaaagagg

SEQ ID NO: 7831758 - DNA, 22 bp, Homo sapiens
aatgtacaataagacaaagagg

SEQ ID NO: 7831759 - DNA, 22 bp, Homo sapiens
aatgtacaataagacaaagagg

SEQ ID NO: 7831760 - DNA, 22 bp, Homo sapiens
aatgtacaataagacaaagagg

SEQ ID NO: 7831761 - DNA, 22 bp, Homo sapiens
aatgtacaataagacaaagagg

SEQ ID NO: 7831762 - DNA, 22 bp, Homo sapiens
aatgtacaataagacaaagagg

SEQ ID NO: 7831763 - DNA, 22 bp, Homo sapiens
aagaacaggttctagaaccatt

SEQ ID NO: 7831764 - DNA, 22 bp, Homo sapiens
aagaacaggttctagaaccatt

SEQ ID NO: 7831765 - DNA, 22 bp, Homo sapiens
aagaacaggttctagaaccatt

SEQ ID NO: 7831766 - DNA, 22 bp, Homo sapiens
aagaacaggttctagaaccatt

SEQ ID NO: 7831767 - DNA, 22 bp, Homo sapiens
aagaacatgttaaaagattcac

SEQ ID NO: 7831768 - DNA, 22 bp, Homo sapiens
aagaacattcgaactattttct

SEQ ID NO: 7831769 - DNA, 22 bp, Homo sapiens
aagaacattcgaactattttct

SEQ ID NO: 7831770 - DNA, 22 bp, Homo sapiens
aagaacattgatattgtctatg

SEQ ID NO: 7831771 - DNA, 22 bp, Homo sapiens
aagaacagtgtcctgggactcg

SEQ ID NO: 7831772 - DNA, 22 bp, Homo sapiens
aagaacagtgtcctgggactcg

SEQ ID NO: 7831773 - DNA, 22 bp, Homo sapiens
aagaacatgttaaaagattcac

SEQ ID NO: 7831774 - DNA, 22 bp, Homo sapiens
aagaacaggttctagaaccatt

SEQ ID NO: 7831775 - DNA, 22 bp, Homo sapiens
aagaacatttatgatggcattt

SEQ ID NO: 7831776 - DNA, 22 bp, Homo sapiens
aagaacatttatgatggcattt

SEQ ID NO: 7831777 - DNA, 22 bp, Homo sapiens
aagaacattgatattgtctatg

SEQ ID NO: 7831778 - DNA, 22 bp, Homo sapiens
aagaacattgatattgtctatg

SEQ ID NO: 7831779 - DNA, 22 bp, Homo sapiens
aagaacattgatattgtctatg

SEQ ID NO: 7831780 - DNA, 22 bp, Homo sapiens
aagaaccaaaatgaagctaggt

SEQ ID NO: 7831781 - DNA, 22 bp, Homo sapiens
aagaaccaaaatgaagctaggt

SEQ ID NO: 7831782 - DNA, 22 bp, Homo sapiens
aagaacattttgtagaatgaca

SEQ ID NO: 7831783 - DNA, 22 bp, Homo sapiens
aagaacattttgtagaatgaca

SEQ ID NO: 7831784 - DNA, 22 bp, Homo sapiens
aagaacattttgtagaatgaca

SEQ ID NO: 7831785 - DNA, 22 bp, Homo sapiens
aagaactagtcttacagcctca

SEQ ID NO: 7831786 - DNA, 22 bp, Homo sapiens
aagaactagtcttacagcctca

SEQ ID NO: 7831787 - DNA, 22 bp, Homo sapiens
aagaaccaaaatgaagctaggt

SEQ ID NO: 7831788 - DNA, 22 bp, Homo sapiens
aagaacctatatgctgatgaat

SEQ ID NO: 7831789 - DNA, 22 bp, Homo sapiens
aagaactatctctggctgtagg

SEQ ID NO: 7831790 - DNA, 22 bp, Homo sapiens
aagaactagtcttacagcctca

SEQ ID NO: 7831791 - DNA, 22 bp, Homo sapiens
aagaactatctctggctgtagg

SEQ ID NO: 7831792 - DNA, 22 bp, Homo sapiens
aagaactgagtacgttaataaa

SEQ ID NO: 7831793 - DNA, 18 bp, Homo sapiens
aagaactgaggtcctaga

SEQ ID NO: 7831794 - DNA, 22 bp, Homo sapiens
aagaactggttatgttatcttg

SEQ ID NO: 7831795 - DNA, 23 bp, Homo sapiens
aagaactgcgaatggagaaagta

SEQ ID NO: 7831796 - DNA, 23 bp, Homo sapiens
aagaactgcgaatggagaaagta

SEQ ID NO: 7831797 - DNA, 22 bp, Homo sapiens
aagataatattcattaactaga

SEQ ID NO: 7831798 - DNA, 22 bp, Homo sapiens
aagataatattcattaactaga

SEQ ID NO: 7831799 - DNA, 22 bp, Homo sapiens
aagataagtaacgagcctcagt

SEQ ID NO: 7831800 - DNA, 22 bp, Homo sapiens
aagataatattcattaactaga

SEQ ID NO: 7831801 - DNA, 22 bp, Homo sapiens
aagataatattcattaactaga

SEQ ID NO: 7831802 - DNA, 22 bp, Homo sapiens
aagagtttccagttgtggctca

SEQ ID NO: 7831803 - DNA, 22 bp, Homo sapiens
acacagctttcagtcattatct

SEQ ID NO: 7831804 - DNA, 22 bp, Homo sapiens
aagagtttatgatataacatgt

SEQ ID NO: 7831805 - DNA, 22 bp, Homo sapiens
aagataacaggaggagtttgta

SEQ ID NO: 7831806 - DNA, 22 bp, Homo sapiens
aagataagagggaggtgcctca

SEQ ID NO: 7831807 - DNA, 22 bp, Homo sapiens
aagatacacggtcaactctcaa

SEQ ID NO: 7831808 - DNA, 22 bp, Homo sapiens
aagatacaccaagagcctagta

SEQ ID NO: 7831809 - DNA, 22 bp, Homo sapiens
aagatacaccaagagcctagta

SEQ ID NO: 7831810 - DNA, 22 bp, Homo sapiens
aagataatgttctagctgtcag

SEQ ID NO: 7831811 - DNA, 22 bp, Homo sapiens
aagataatgtgtctgtctttgc

SEQ ID NO: 7831812 - DNA, 22 bp, Homo sapiens
aagatacaaatgtcaatattgg

SEQ ID NO: 7831813 - DNA, 22 bp, Homo sapiens
aagatacaaatgtcaatattgg

SEQ ID NO: 7831814 - DNA, 22 bp, Homo sapiens
aagatacaaatgtcaatattgg

SEQ ID NO: 7831815 - DNA, 22 bp, Homo sapiens
aagatacaaatgtcaatattgg

SEQ ID NO: 7831816 - DNA, 22 bp, Homo sapiens
aagatacaaatgtcaatattgg

SEQ ID NO: 7831817 - DNA, 22 bp, Homo sapiens
aagatacaaatgtcaatattgg

SEQ ID NO: 7831818 - DNA, 22 bp, Homo sapiens
acacagcttcaaagtctaattc

SEQ ID NO: 7831819 - DNA, 22 bp, Homo sapiens
acacagcttcaaagtctaattc

SEQ ID NO: 7831820 - DNA, 22 bp, Homo sapiens
acacagctttcagtcattatct

SEQ ID NO: 7831821 - DNA, 21 bp, Homo sapiens
acacagctgccggagacggat

SEQ ID NO: 7831822 - DNA, 22 bp, Homo sapiens
acacagctcagtgcctccaaga

SEQ ID NO: 7831823 - DNA, 22 bp, Homo sapiens
acacagctgtgcagttttttca

SEQ ID NO: 7831824 - DNA, 22 bp, Homo sapiens
acacagctagtgagtggcagag

SEQ ID NO: 7831825 - DNA, 22 bp, Homo sapiens
acacagctagtgagtggcagag

SEQ ID NO: 7831826 - DNA, 22 bp, Homo sapiens
acacagctcacaacgtgtgcat

SEQ ID NO: 7831827 - DNA, 22 bp, Homo sapiens
acacagctcacaacgtgtgcat

SEQ ID NO: 7831828 - DNA, 22 bp, Homo sapiens
acacagctatggggtaggaaac

SEQ ID NO: 7831829 - DNA, 22 bp, Homo sapiens
acacagctatggggtaggaaac

SEQ ID NO: 7831830 - DNA, 22 bp, Homo sapiens
acacagcaaggtctgactttgg

SEQ ID NO: 7831831 - DNA, 22 bp, Homo sapiens
acacagcaaggtctgactttgg

SEQ ID NO: 7831832 - DNA, 22 bp, Homo sapiens
acacagcagaaggcccgtgtct

SEQ ID NO: 7831833 - DNA, 22 bp, Homo sapiens
acacagcaaggtctgactttgg

SEQ ID NO: 7831834 - DNA, 22 bp, Homo sapiens
acacagcaaggtctgactttgg

SEQ ID NO: 7831835 - DNA, 17 bp, Homo sapiens
acacagccaggttctcc

SEQ ID NO: 7831836 - DNA, 17 bp, Homo sapiens
acacagccaggttctcc

SEQ ID NO: 7831837 - DNA, 22 bp, Homo sapiens
acacagcagaaggcccgtgtct

SEQ ID NO: 7831838 - DNA, 22 bp, Homo sapiens
acacagccccacggtgagcaaa

SEQ ID NO: 7831839 - DNA, 22 bp, Homo sapiens
acacagccccacggtgagcaaa

SEQ ID NO: 7831840 - DNA, 22 bp, Homo sapiens
acacagccccacggtgagcaaa

SEQ ID NO: 7831841 - DNA, 22 bp, Homo sapiens
acacagccgtgaatctgcttct

SEQ ID NO: 7831842 - DNA, 22 bp, Homo sapiens
acacagccgtgaatctgcttct

SEQ ID NO: 7831843 - DNA, 22 bp, Homo sapiens
acacagagccagggaatacagt

SEQ ID NO: 7831844 - DNA, 22 bp, Homo sapiens
acacagagctggaactgcttca

SEQ ID NO: 7831845 - DNA, 22 bp, Homo sapiens
acacagagccaaaccatatcac

SEQ ID NO: 7831846 - DNA, 22 bp, Homo sapiens
acacagagccaaaccatatcac

SEQ ID NO: 7831847 - DNA, 22 bp, Homo sapiens
acacagagccagggaatacagt

SEQ ID NO: 7831848 - DNA, 22 bp, Homo sapiens
acacagagccagggaatacagt

SEQ ID NO: 7831849 - DNA, 22 bp, Homo sapiens
acacagagcaaatcatgacaga

SEQ ID NO: 7831850 - DNA, 22 bp, Homo sapiens
acacagagccaaaccatatcac

SEQ ID NO: 7831851 - DNA, 22 bp, Homo sapiens
acacagagcaaatcatgacaga

SEQ ID NO: 7831852 - DNA, 22 bp, Homo sapiens
acacagagcaaatcatgacaga

SEQ ID NO: 7831853 - DNA, 22 bp, Homo sapiens
acacagagcaaatcatgacaga

SEQ ID NO: 7831854 - DNA, 22 bp, Homo sapiens
acacagagcaaatcatgacaga

SEQ ID NO: 7831855 - DNA, 22 bp, Homo sapiens
acacagagcaaatcatgacaga

SEQ ID NO: 7831856 - DNA, 22 bp, Homo sapiens
acacagcaacttgcagtatgga

SEQ ID NO: 7831857 - DNA, 22 bp, Homo sapiens
acacagcaacttgcagtatgga

SEQ ID NO: 7831858 - DNA, 22 bp, Homo sapiens
acacagcaacttgcagtatgga

SEQ ID NO: 7831859 - DNA, 22 bp, Homo sapiens
acacagcaacttgcagtatgga

SEQ ID NO: 7831860 - DNA, 22 bp, Homo sapiens
acacagcaaggtctgactttgg

SEQ ID NO: 7831861 - DNA, 22 bp, Homo sapiens
acacagcaaggtctgactttgg

SEQ ID NO: 7831862 - DNA, 22 bp, Homo sapiens
acacagagctggaactgcttca

SEQ ID NO: 7831863 - DNA, 22 bp, Homo sapiens
acacagagctggaactgcttca

SEQ ID NO: 7831864 - DNA, 22 bp, Homo sapiens
acacagagctggaactgcttca

SEQ ID NO: 7831865 - DNA, 22 bp, Homo sapiens
acacagagctggaactgcttca

SEQ ID NO: 7831866 - DNA, 22 bp, Homo sapiens
acacagagcttctcaactggga

SEQ ID NO: 7831867 - DNA, 22 bp, Homo sapiens
acacagagcttctcaactggga

SEQ ID NO: 7831868 - DNA, 22 bp, Homo sapiens
acacagagcttctcaactggga

SEQ ID NO: 7831869 - DNA, 22 bp, Homo sapiens
acacacatgcctttcctaagta

SEQ ID NO: 7831870 - DNA, 22 bp, Homo sapiens
acacacatgcctttcctaagta

SEQ ID NO: 7831871 - DNA, 22 bp, Homo sapiens
acacacatgcctttcctaagta

SEQ ID NO: 7831872 - DNA, 22 bp, Homo sapiens
acacacatgcctttcctaagta

SEQ ID NO: 7831873 - DNA, 22 bp, Homo sapiens
acacagaagctttttctattcc

SEQ ID NO: 7831874 - DNA, 22 bp, Homo sapiens
acacagaagctttttctattcc

SEQ ID NO: 7831875 - DNA, 22 bp, Homo sapiens
acacacatgcctttcctaagta

SEQ ID NO: 7831876 - DNA, 22 bp, Homo sapiens
acaatgttctacatatacataa

SEQ ID NO: 7831877 - DNA, 20 bp, Homo sapiens
acacagactcagcttggatg

SEQ ID NO: 7831878 - DNA, 17 bp, Homo sapiens
acacagagattaacaca

SEQ ID NO: 7831879 - DNA, 22 bp, Homo sapiens
acacagaagctttttctattcc

SEQ ID NO: 7831880 - DNA, 17 bp, Homo sapiens
acacagacaggcagaca

SEQ ID NO: 7831881 - DNA, 17 bp, Homo sapiens
acacagacaggcagaca

SEQ ID NO: 7831882 - DNA, 17 bp, Homo sapiens
acacagacaggcagaca

SEQ ID NO: 7831883 - DNA, 17 bp, Homo sapiens
acacagacaggcagaca

SEQ ID NO: 7831884 - DNA, 22 bp, Homo sapiens
acaatgtaggctgaaaaagctt

SEQ ID NO: 7831885 - DNA, 22 bp, Homo sapiens
acaatgtagttgtcatgagaca

SEQ ID NO: 7831886 - DNA, 22 bp, Homo sapiens
acaatgtagttgtcatgagaca

SEQ ID NO: 7831887 - DNA, 22 bp, Homo sapiens
acaatgtcaaaataggaaacat

SEQ ID NO: 7831888 - DNA, 22 bp, Homo sapiens
acaatgtagttgtcatgagaca

SEQ ID NO: 7831889 - DNA, 21 bp, Homo sapiens
acaatgtcaaggtcagacatt

SEQ ID NO: 7831890 - DNA, 21 bp, Homo sapiens
acaatgtcaaggtcagacatt

SEQ ID NO: 7831891 - DNA, 22 bp, Homo sapiens
acaatgtaggatatgtacttgt

SEQ ID NO: 7831892 - DNA, 22 bp, Homo sapiens
acaatgtaggctgaaaaagctt

SEQ ID NO: 7831893 - DNA, 22 bp, Homo sapiens
acaatgtaggagtatgacagta

SEQ ID NO: 7831894 - DNA, 22 bp, Homo sapiens
acaatgtaggatatgtacttgt

SEQ ID NO: 7831895 - DNA, 22 bp, Homo sapiens
acaatgtaggagtatgacagta

SEQ ID NO: 7831896 - DNA, 22 bp, Homo sapiens
acaatgtaggatatgtacttgt

SEQ ID NO: 7831897 - DNA, 22 bp, Homo sapiens
acaatgtaggatatgtacttgt

SEQ ID NO: 7831898 - DNA, 22 bp, Homo sapiens
acaatgtaggagtatgacagta

SEQ ID NO: 7831899 - DNA, 23 bp, Homo sapiens
acaatgtctgttcataaaatacc

SEQ ID NO: 7831900 - DNA, 22 bp, Homo sapiens
acaatgtctcatattcgtgttc

SEQ ID NO: 7831901 - DNA, 22 bp, Homo sapiens
acaatgtctcatattcgtgttc

SEQ ID NO: 7831902 - DNA, 22 bp, Homo sapiens
acaatgtctcatattcgtgttc

SEQ ID NO: 7831903 - DNA, 22 bp, Homo sapiens
acaatgtcacctctcatgtttt

SEQ ID NO: 7831904 - DNA, 22 bp, Homo sapiens
acaatgttctacatatacataa

SEQ ID NO: 7831905 - DNA, 22 bp, Homo sapiens
acaatgtgtttttatacatttg

SEQ ID NO: 7831906 - DNA, 22 bp, Homo sapiens
acaatgtgggcatgagaaacca

SEQ ID NO: 7831907 - DNA, 22 bp, Homo sapiens
acaatgtgacctgacagtgtta

SEQ ID NO: 7831908 - DNA, 22 bp, Homo sapiens
acaatgtgataatttaaagata

SEQ ID NO: 7831909 - DNA, 22 bp, Homo sapiens
acaatgtgcttatgaaggcagt

SEQ ID NO: 7831910 - DNA, 22 bp, Homo sapiens
acaatgtgataatttaaagata

SEQ ID NO: 7831911 - DNA, 22 bp, Homo sapiens
acaatattgtacccagaagttt

SEQ ID NO: 7831912 - DNA, 22 bp, Homo sapiens
acaatattgtacccagaagttt

SEQ ID NO: 7831913 - DNA, 22 bp, Homo sapiens
acaatattgtacccagaagttt

SEQ ID NO: 7831914 - DNA, 22 bp, Homo sapiens
acaatattgtacccagaagttt

SEQ ID NO: 7831915 - DNA, 22 bp, Homo sapiens
acaatattgtacccagaagttt

SEQ ID NO: 7831916 - DNA, 20 bp, Homo sapiens
acaatatgtagatgaatagc

SEQ ID NO: 7831917 - DNA, 22 bp, Homo sapiens
acaatgtagagtaaaatatgtt

SEQ ID NO: 7831918 - DNA, 22 bp, Homo sapiens
acaatgtagagtaaaatatgtt

SEQ ID NO: 7831919 - DNA, 22 bp, Homo sapiens
acaatgtagagtaaaatatgtt

SEQ ID NO: 7831920 - DNA, 22 bp, Homo sapiens
acaatgtagagtaaaatatgtt

SEQ ID NO: 7831921 - DNA, 22 bp, Homo sapiens
acaatgtagagtaaaatatgtt

SEQ ID NO: 7831922 - DNA, 22 bp, Homo sapiens
acaatatttgggggcagtttgt

SEQ ID NO: 7831923 - DNA, 22 bp, Homo sapiens
acaatattgtacccagaagttt

SEQ ID NO: 7831924 - DNA, 22 bp, Homo sapiens
acaatatttgggggcagtttgt

SEQ ID NO: 7831925 - DNA, 22 bp, Homo sapiens
acaatatttgggggcagtttgt

SEQ ID NO: 7831926 - DNA, 22 bp, Homo sapiens
acaatatgggatatacatttta

SEQ ID NO: 7831927 - DNA, 22 bp, Homo sapiens
acaatatgggatatacatttta

SEQ ID NO: 7831928 - DNA, 22 bp, Homo sapiens
acaatatgggatatacatttta

SEQ ID NO: 7831929 - DNA, 20 bp, Homo sapiens
acaatatgtagatgaatagc

SEQ ID NO: 7831930 - DNA, 22 bp, Homo sapiens
acaatatagtccatgagcatgc

SEQ ID NO: 7831931 - DNA, 22 bp, Homo sapiens
acaatatagtccatgagcatgc

SEQ ID NO: 7831932 - DNA, 22 bp, Homo sapiens
acaatatagtccatgagcatgc

SEQ ID NO: 7831933 - DNA, 22 bp, Homo sapiens
acaatatagtccatgagcatgc

SEQ ID NO: 7831934 - DNA, 22 bp, Homo sapiens
acaatatagtccatgagcatgc

SEQ ID NO: 7831935 - DNA, 22 bp, Homo sapiens
acaatagtaaggtatattgtca

SEQ ID NO: 7831936 - DNA, 20 bp, Homo sapiens
acaatagatttgagcaaagt

SEQ ID NO: 7831937 - DNA, 20 bp, Homo sapiens
acaatagatttgagcaaagt

SEQ ID NO: 7831938 - DNA, 20 bp, Homo sapiens
acaatagatttgagcaaagt

SEQ ID NO: 7831939 - DNA, 22 bp, Homo sapiens
acaatatacacatcctaatggg

SEQ ID NO: 7831940 - DNA, 22 bp, Homo sapiens
acaatagtcaatgcacgtcatt

SEQ ID NO: 7831941 - DNA, 22 bp, Homo sapiens
acaatagagttctcataggaca

SEQ ID NO: 7831942 - DNA, 22 bp, Homo sapiens
acaatagagttctcataggaca

SEQ ID NO: 7831943 - DNA, 20 bp, Homo sapiens
acaatagatttgagcaaagt

SEQ ID NO: 7831944 - DNA, 22 bp, Homo sapiens
acaatagagttctcataggaca

SEQ ID NO: 7831945 - DNA, 22 bp, Homo sapiens
acaaggcttatagttgcttttt

SEQ ID NO: 7831946 - DNA, 22 bp, Homo sapiens
acaaggcttatagttgcttttt

SEQ ID NO: 7831947 - DNA, 22 bp, Homo sapiens
acaaggcttatagttgcttttt

SEQ ID NO: 7831948 - DNA, 22 bp, Homo sapiens
acaaggctgttggtcacaaacc

SEQ ID NO: 7831949 - DNA, 22 bp, Homo sapiens
acaaatttgtgtagttatggca

SEQ ID NO: 7831950 - DNA, 22 bp, Homo sapiens
acaacaaaatcactagtcttcc

SEQ ID NO: 7831951 - DNA, 22 bp, Homo sapiens
acaacaaaatcactagtcttcc

SEQ ID NO: 7831952 - DNA, 22 bp, Homo sapiens
acaaggcttcatattcttttta

SEQ ID NO: 7831953 - DNA, 22 bp, Homo sapiens
acaaggcttcacacagtatgaa

SEQ ID NO: 7831954 - DNA, 22 bp, Homo sapiens
acaaggcttcacacagtatgaa

SEQ ID NO: 7831955 - DNA, 22 bp, Homo sapiens
acaaggcttcacacagtatgaa

SEQ ID NO: 7831956 - DNA, 22 bp, Homo sapiens
acaaggcttatagttgcttttt

SEQ ID NO: 7831957 - DNA, 21 bp, Homo sapiens
acaatagacataagcagagca

SEQ ID NO: 7831958 - DNA, 22 bp, Homo sapiens
acaaggctttggagggttctta

SEQ ID NO: 7831959 - DNA, 21 bp, Homo sapiens
acaatagacataagcagagca

SEQ ID NO: 7831960 - DNA, 22 bp, Homo sapiens
acaaatttattgaagggcatat

SEQ ID NO: 7831961 - DNA, 22 bp, Homo sapiens
acaaattgttgggactcagccc

SEQ ID NO: 7831962 - DNA, 21 bp, Homo sapiens
acaaattgtttatataggaag

SEQ ID NO: 7831963 - DNA, 22 bp, Homo sapiens
acaaattgttgcttcatgaatg

SEQ ID NO: 7831964 - DNA, 22 bp, Homo sapiens
acaaattgttgcttcatgaatg

SEQ ID NO: 7831965 - DNA, 22 bp, Homo sapiens
acaaattgttgcttcatgaatg

SEQ ID NO: 7831966 - DNA, 22 bp, Homo sapiens
acaaattgttgcttcatgaatg

SEQ ID NO: 7831967 - DNA, 22 bp, Homo sapiens
acaaattgttgcttcatgaatg

SEQ ID NO: 7831968 - DNA, 22 bp, Homo sapiens
acaaattgttgcttcatgaatg

SEQ ID NO: 7831969 - DNA, 22 bp, Homo sapiens
acaaatttattgaagggcatat

SEQ ID NO: 7831970 - DNA, 22 bp, Homo sapiens
acaaatttcataggcaaatttt

SEQ ID NO: 7831971 - DNA, 22 bp, Homo sapiens
acaaatttcataggcaaatttt

SEQ ID NO: 7831972 - DNA, 22 bp, Homo sapiens
acaaatttcataggcaaatttt

SEQ ID NO: 7831973 - DNA, 22 bp, Homo sapiens
acaaatttcataggcaaatttt

SEQ ID NO: 7831974 - DNA, 22 bp, Homo sapiens
acaaatttcataggcaaatttt

SEQ ID NO: 7831975 - DNA, 22 bp, Homo sapiens
acaaatttcataggcaaatttt

SEQ ID NO: 7831976 - DNA, 22 bp, Homo sapiens
acaaatttgtgtagttatggca

SEQ ID NO: 7831977 - DNA, 22 bp, Homo sapiens
acaaatttgtgtagttatggca

SEQ ID NO: 7831978 - DNA, 22 bp, Homo sapiens
acaacaaaatcactagtcttcc

SEQ ID NO: 7831979 - DNA, 22 bp, Homo sapiens
acaaatttgtgtagttatggca

SEQ ID NO: 7831980 - DNA, 22 bp, Homo sapiens
acaaatttgtgtagttatggca

SEQ ID NO: 7831981 - DNA, 22 bp, Homo sapiens
acaaatttggtgagagtaaata

SEQ ID NO: 7831982 - DNA, 22 bp, Homo sapiens
acaaatttggtgagagtaaata

SEQ ID NO: 7831983 - DNA, 22 bp, Homo sapiens
acaaatttggtgagagtaaata

SEQ ID NO: 7831984 - DNA, 22 bp, Homo sapiens
acaaatttgaatcctgacttct

SEQ ID NO: 7831985 - DNA, 22 bp, Homo sapiens
acaaatttgaatcctgacttct

SEQ ID NO: 7831986 - DNA, 22 bp, Homo sapiens
acaaatttgaatcctgacttct

SEQ ID NO: 7831987 - DNA, 22 bp, Homo sapiens
acaaatttgaatcctgacttct

SEQ ID NO: 7831988 - DNA, 22 bp, Homo sapiens
acaaatttggtgagagtaaata

SEQ ID NO: 7831989 - DNA, 22 bp, Homo sapiens
acaaatttggtgagagtaaata

SEQ ID NO: 7831990 - DNA, 22 bp, Homo sapiens
acaaatttggtgagagtaaata

SEQ ID NO: 7831991 - DNA, 22 bp, Homo sapiens
acaaatttggtgagagtaaata

SEQ ID NO: 7831992 - DNA, 22 bp, Homo sapiens
aatctcttcccagtaaaaatgg

SEQ ID NO: 7831993 - DNA, 22 bp, Homo sapiens
aatctcttcccagtaaaaatgg

SEQ ID NO: 7831994 - DNA, 22 bp, Homo sapiens
aatctccatttaccctgcatct

SEQ ID NO: 7831995 - DNA, 22 bp, Homo sapiens
aatctcatttttagtttaggtg

SEQ ID NO: 7831996 - DNA, 22 bp, Homo sapiens
aatctcttgtatttcctttgac

SEQ ID NO: 7831997 - DNA, 22 bp, Homo sapiens
aatctcttgtatttcctttgac

SEQ ID NO: 7831998 - DNA, 22 bp, Homo sapiens
aatctcttcccagtaaaaatgg

SEQ ID NO: 7831999 - DNA, 22 bp, Homo sapiens
aatctcactcaaagaattctct

SEQ ID NO: 7832000 - DNA, 22 bp, Homo sapiens
aatctcagaaactggtggattt

SEQ ID NO: 7832001 - DNA, 20 bp, Homo sapiens
aatctcagtatcctatgcaa

SEQ ID NO: 7832002 - DNA, 22 bp, Homo sapiens
aatctcagctcatgcaattcca

SEQ ID NO: 7832003 - DNA, 22 bp, Homo sapiens
aatctcagagatatctgtgtcc

SEQ ID NO: 7832004 - DNA, 20 bp, Homo sapiens
aatctcagtatcctatgcaa

SEQ ID NO: 7832005 - DNA, 22 bp, Homo sapiens
aatctcagagatatctgtgtcc

SEQ ID NO: 7832006 - DNA, 17 bp, Homo sapiens
aatctcagtggcttaag

SEQ ID NO: 7832007 - DNA, 17 bp, Homo sapiens
aatctcagtggcttaag

SEQ ID NO: 7832008 - DNA, 17 bp, Homo sapiens
aatctcagtggcttaag

SEQ ID NO: 7832009 - DNA, 22 bp, Homo sapiens
aatctcatttacaacatgagga

SEQ ID NO: 7832010 - DNA, 22 bp, Homo sapiens
aatctgcataagcacagttgga

SEQ ID NO: 7832011 - DNA, 22 bp, Homo sapiens
aatctgcacaattcagtttcag

SEQ ID NO: 7832012 - DNA, 22 bp, Homo sapiens
aatctgagggaacttgaactcc

SEQ ID NO: 7832013 - DNA, 22 bp, Homo sapiens
aatctgagggaacttgaactcc

SEQ ID NO: 7832014 - DNA, 22 bp, Homo sapiens
aatctcttggttcagaagcctc

SEQ ID NO: 7832015 - DNA, 22 bp, Homo sapiens
aatctctttggctcaaggatcc

SEQ ID NO: 7832016 - DNA, 22 bp, Homo sapiens
aatctgacagctaggcaggcac

SEQ ID NO: 7832017 - DNA, 20 bp, Homo sapiens
aatctgaatcccagtcctag

SEQ ID NO: 7832018 - DNA, 22 bp, Homo sapiens
aatctgaatatttatgtgtatt

SEQ ID NO: 7832019 - DNA, 22 bp, Homo sapiens
aatctgaatatttatgtgtatt

SEQ ID NO: 7832020 - DNA, 22 bp, Homo sapiens
aatctggtttgacaacttttgt

SEQ ID NO: 7832021 - DNA, 22 bp, Homo sapiens
aatctggggctcttttctctgg

SEQ ID NO: 7832022 - DNA, 23 bp, Homo sapiens
aatctggctgatgttttttctct

SEQ ID NO: 7832023 - DNA, 22 bp, Homo sapiens
aatctggaatatttgcattgta

SEQ ID NO: 7832024 - DNA, 22 bp, Homo sapiens
aatctggaatatttgcattgta

SEQ ID NO: 7832025 - DNA, 22 bp, Homo sapiens
aatctggagagtcatctctgac

SEQ ID NO: 7832026 - DNA, 22 bp, Homo sapiens
aatctggagagtcatctctgac

SEQ ID NO: 7832027 - DNA, 22 bp, Homo sapiens
aatctggacttgtctgtgaaga

SEQ ID NO: 7832028 - DNA, 22 bp, Homo sapiens
aatctggacttgtctgtgaaga

SEQ ID NO: 7832029 - DNA, 22 bp, Homo sapiens
aatctggacttgtctgtgaaga

SEQ ID NO: 7832030 - DNA, 22 bp, Homo sapiens
aatctggagagtcatctctgac

SEQ ID NO: 7832031 - DNA, 22 bp, Homo sapiens
aatgaaatagttggctgtagag

SEQ ID NO: 7832032 - DNA, 22 bp, Homo sapiens
aatgaaatagttggctgtagag

SEQ ID NO: 7832033 - DNA, 22 bp, Homo sapiens
aatgaaatagttggctgtagag

SEQ ID NO: 7832034 - DNA, 22 bp, Homo sapiens
aatgaaatagttggctgtagag

SEQ ID NO: 7832035 - DNA, 22 bp, Homo sapiens
aatgaaatctgctgggtaaaga

SEQ ID NO: 7832036 - DNA, 22 bp, Homo sapiens
aatgaaatctgctgggtaaaga

SEQ ID NO: 7832037 - DNA, 22 bp, Homo sapiens
aatctgtattgctcatacttga

SEQ ID NO: 7832038 - DNA, 22 bp, Homo sapiens
aatctgtattgctcatacttga

SEQ ID NO: 7832039 - DNA, 22 bp, Homo sapiens
aatctgtagggaacaactgtac

SEQ ID NO: 7832040 - DNA, 22 bp, Homo sapiens
aatctgtattgctcatacttga

SEQ ID NO: 7832041 - DNA, 22 bp, Homo sapiens
aatgaaactgtatatagactgt

SEQ ID NO: 7832042 - DNA, 22 bp, Homo sapiens
aatgaaactgtatatagactgt

SEQ ID NO: 7832043 - DNA, 22 bp, Homo sapiens
aatgaaagaatgaaacagccca

SEQ ID NO: 7832044 - DNA, 22 bp, Homo sapiens
aatgaaatagttggctgtagag

SEQ ID NO: 7832045 - DNA, 22 bp, Homo sapiens
aatgcacatgccacatgtggta

SEQ ID NO: 7832046 - DNA, 22 bp, Homo sapiens
aatgcacatatatttccttatt

SEQ ID NO: 7832047 - DNA, 18 bp, Homo sapiens
aatgcacacatttactcc

SEQ ID NO: 7832048 - DNA, 22 bp, Homo sapiens
aatgcacacatttggtactgaa

SEQ ID NO: 7832049 - DNA, 22 bp, Homo sapiens
aatgcacacatttggtactgaa

SEQ ID NO: 7832050 - DNA, 22 bp, Homo sapiens
aatgcacataaatatggtctta

SEQ ID NO: 7832051 - DNA, 22 bp, Homo sapiens
aatgcagaccagtatgaaaaac

SEQ ID NO: 7832052 - DNA, 22 bp, Homo sapiens
aatgcacttagtatgaatgcct

SEQ ID NO: 7832053 - DNA, 22 bp, Homo sapiens
aatgcactgtcagtattgttga

SEQ ID NO: 7832054 - DNA, 22 bp, Homo sapiens
aatgcagaccagtatgaaaaac

SEQ ID NO: 7832055 - DNA, 22 bp, Homo sapiens
aatgcagagtaaatatttaatt

SEQ ID NO: 7832056 - DNA, 22 bp, Homo sapiens
aatgcagattcttattctgtag

SEQ ID NO: 7832057 - DNA, 22 bp, Homo sapiens
aatgcacatgccacatgtggta

SEQ ID NO: 7832058 - DNA, 22 bp, Homo sapiens
aatgcacatgttgtaataaata

SEQ ID NO: 7832059 - DNA, 22 bp, Homo sapiens
aatgcacatgttgtaataaata

SEQ ID NO: 7832060 - DNA, 22 bp, Homo sapiens
aatgcacatgttgtaataaata

SEQ ID NO: 7832061 - DNA, 18 bp, Homo sapiens
aatgaaatgtacaccttt

SEQ ID NO: 7832062 - DNA, 18 bp, Homo sapiens
aatgaaatgtacaccttt

SEQ ID NO: 7832063 - DNA, 18 bp, Homo sapiens
aatgaaatgtacaccttt

SEQ ID NO: 7832064 - DNA, 22 bp, Homo sapiens
aatgaaatgaagatatgatcag

SEQ ID NO: 7832065 - DNA, 22 bp, Homo sapiens
aatgaaatgaagatatgatcag

SEQ ID NO: 7832066 - DNA, 22 bp, Homo sapiens
aatgaaatgaagatatgatcag

SEQ ID NO: 7832067 - DNA, 22 bp, Homo sapiens
aatgaaatgaagatatgatcag

SEQ ID NO: 7832068 - DNA, 22 bp, Homo sapiens
aatgaaatgaagatatgatcag

SEQ ID NO: 7832069 - DNA, 22 bp, Homo sapiens
aatgaaatgaagatatgatcag

SEQ ID NO: 7832070 - DNA, 18 bp, Homo sapiens
aatgaaatgtacaccttt

SEQ ID NO: 7832071 - DNA, 18 bp, Homo sapiens
aatgaaatgtacaccttt

SEQ ID NO: 7832072 - DNA, 18 bp, Homo sapiens
aatgaaatgtacaccttt

SEQ ID NO: 7832073 - DNA, 22 bp, Homo sapiens
aatgaaatgtagcttatccata

SEQ ID NO: 7832074 - DNA, 22 bp, Homo sapiens
aatgaaatgtagcttatccata

SEQ ID NO: 7832075 - DNA, 18 bp, Homo sapiens
aatgaaatgtacaccttt

SEQ ID NO: 7832076 - DNA, 22 bp, Homo sapiens
aatgaaatgtagcttatccata

SEQ ID NO: 7832077 - DNA, 22 bp, Homo sapiens
aatgaaatgtagcttatccata

SEQ ID NO: 7832078 - DNA, 22 bp, Homo sapiens
aatgaaatgtagcttatccata

SEQ ID NO: 7832079 - DNA, 22 bp, Homo sapiens
aatgaaatgtagcttatccata

SEQ ID NO: 7832080 - DNA, 22 bp, Homo sapiens
aatgcacaaaggtgtctattgc

SEQ ID NO: 7832081 - DNA, 18 bp, Homo sapiens
aatgcacacatttactcc

SEQ ID NO: 7832082 - DNA, 21 bp, Homo sapiens
aatgatgaaagatgacagagt

SEQ ID NO: 7832083 - DNA, 22 bp, Homo sapiens
aatgcagtttcatttgtagaat

SEQ ID NO: 7832084 - DNA, 22 bp, Homo sapiens
aatgcagtttcatttgtagaat

SEQ ID NO: 7832085 - DNA, 22 bp, Homo sapiens
aatgcagttgaatttgggtatg

SEQ ID NO: 7832086 - DNA, 22 bp, Homo sapiens
aatgcagtgagccattaaatgg

SEQ ID NO: 7832087 - DNA, 22 bp, Homo sapiens
aatgcagtgagccattaaatgg

SEQ ID NO: 7832088 - DNA, 22 bp, Homo sapiens
aatgctgtccaataggaacata

SEQ ID NO: 7832089 - DNA, 22 bp, Homo sapiens
aatgctgtccaataggaacata

SEQ ID NO: 7832090 - DNA, 22 bp, Homo sapiens
aatgctgtccaataggaacata

SEQ ID NO: 7832091 - DNA, 22 bp, Homo sapiens
aatgcataatggtttgtgacaa

SEQ ID NO: 7832092 - DNA, 22 bp, Homo sapiens
aatgcataatggtttgtgacaa

SEQ ID NO: 7832093 - DNA, 19 bp, Homo sapiens
aatgcttaggacagtgcct

SEQ ID NO: 7832094 - DNA, 19 bp, Homo sapiens
aatgcttaggacagtgcct

SEQ ID NO: 7832095 - DNA, 22 bp, Homo sapiens
aatgcttataacgttagaatgt

SEQ ID NO: 7832096 - DNA, 22 bp, Homo sapiens
aatgcttatgggttccataata

SEQ ID NO: 7832097 - DNA, 22 bp, Homo sapiens
aatgcttatacctaatgatctt

SEQ ID NO: 7832098 - DNA, 22 bp, Homo sapiens
aatgctgtcttttctacttcat

SEQ ID NO: 7832099 - DNA, 22 bp, Homo sapiens
aatgctgtcttagcatgaaagc

SEQ ID NO: 7832100 - DNA, 22 bp, Homo sapiens
aatgctgtcttttctacttcat

SEQ ID NO: 7832101 - DNA, 22 bp, Homo sapiens
aatgctgtggagccgtggacag

SEQ ID NO: 7832102 - DNA, 22 bp, Homo sapiens
aatgctgtggagccgtggacag

SEQ ID NO: 7832103 - DNA, 22 bp, Homo sapiens
aatgctgtgatttattaagtat

SEQ ID NO: 7832104 - DNA, 22 bp, Homo sapiens
aatgctgtcttttctacttcat

SEQ ID NO: 7832105 - DNA, 22 bp, Homo sapiens
aatgctgttctgagtctgcagg

SEQ ID NO: 7832106 - DNA, 22 bp, Homo sapiens
aatgctgttctgagtctgcagg

SEQ ID NO: 7832107 - DNA, 22 bp, Homo sapiens
aatgctgttgagttgttcctgt

SEQ ID NO: 7832108 - DNA, 22 bp, Homo sapiens
aatgcttattattaatagaatg

SEQ ID NO: 7832109 - DNA, 22 bp, Homo sapiens
aatgcttattattaatagaatg

SEQ ID NO: 7832110 - DNA, 22 bp, Homo sapiens
aatgcttattattaatagaatg

SEQ ID NO: 7832111 - DNA, 22 bp, Homo sapiens
aatgcttccaaaataccaagcc

SEQ ID NO: 7832112 - DNA, 22 bp, Homo sapiens
aatgctttagaaaaccagcttt

SEQ ID NO: 7832113 - DNA, 22 bp, Homo sapiens
aatgctttagcagtgattagtg

SEQ ID NO: 7832114 - DNA, 22 bp, Homo sapiens
aatgctttagaaaaccagcttt

SEQ ID NO: 7832115 - DNA, 22 bp, Homo sapiens
aatgctttagcagtgattagtg

SEQ ID NO: 7832116 - DNA, 22 bp, Homo sapiens
aatgctttagaaaaccagcttt

SEQ ID NO: 7832117 - DNA, 22 bp, Homo sapiens
aatgctttaaatcctagtgtaa

SEQ ID NO: 7832118 - DNA, 22 bp, Homo sapiens
aatgctttaaatcctagtgtaa

SEQ ID NO: 7832119 - DNA, 22 bp, Homo sapiens
aatgctttaattgcatgtagtg

SEQ ID NO: 7832120 - DNA, 22 bp, Homo sapiens
aatgctttaattgcatgtagtg

SEQ ID NO: 7832121 - DNA, 22 bp, Homo sapiens
aacttgtaatgaaaggcaatag

SEQ ID NO: 7832122 - DNA, 22 bp, Homo sapiens
aacttggtaccaccttctgaag

SEQ ID NO: 7832123 - DNA, 22 bp, Homo sapiens
aacttggttgttggcaatttgc

SEQ ID NO: 7832124 - DNA, 22 bp, Homo sapiens
aacttggtaccaccttctgaag

SEQ ID NO: 7832125 - DNA, 22 bp, Homo sapiens
aacttggtaccaccttctgaag

SEQ ID NO: 7832126 - DNA, 22 bp, Homo sapiens
aacttggtaccaccttctgaag

SEQ ID NO: 7832127 - DNA, 22 bp, Homo sapiens
aacttggtaaattgtgtcagat

SEQ ID NO: 7832128 - DNA, 22 bp, Homo sapiens
aacttggtaaattgtgtcagat

SEQ ID NO: 7832129 - DNA, 22 bp, Homo sapiens
aacttggtaaattgtgtcagat

SEQ ID NO: 7832130 - DNA, 22 bp, Homo sapiens
aacttccaacccagaagcctaa

SEQ ID NO: 7832131 - DNA, 22 bp, Homo sapiens
aacttcatttataatgtcatta

SEQ ID NO: 7832132 - DNA, 22 bp, Homo sapiens
aatgctttcaaaaatgtgcagt

SEQ ID NO: 7832133 - DNA, 22 bp, Homo sapiens
aatgctttcaaaaatgtgcagt

SEQ ID NO: 7832134 - DNA, 22 bp, Homo sapiens
aatgctttcaaaaatgtgcagt

SEQ ID NO: 7832135 - DNA, 22 bp, Homo sapiens
aatgctttcaaaaatgtgcagt

SEQ ID NO: 7832136 - DNA, 22 bp, Homo sapiens
aatgctttagcagtgattagtg

SEQ ID NO: 7832137 - DNA, 22 bp, Homo sapiens
aactttaaggctataaattatg

SEQ ID NO: 7832138 - DNA, 22 bp, Homo sapiens
aactttaaggctataaattatg

SEQ ID NO: 7832139 - DNA, 22 bp, Homo sapiens
aactttacactgctttacatga

SEQ ID NO: 7832140 - DNA, 22 bp, Homo sapiens
aactttaaggctataaattatg

SEQ ID NO: 7832141 - DNA, 23 bp, Homo sapiens
aactttactattttgaataatgc

SEQ ID NO: 7832142 - DNA, 23 bp, Homo sapiens
aactttactattttgaataatgc

SEQ ID NO: 7832143 - DNA, 22 bp, Homo sapiens
aactttaaggctataaattatg

SEQ ID NO: 7832144 - DNA, 22 bp, Homo sapiens
aactttaaggctataaattatg

SEQ ID NO: 7832145 - DNA, 22 bp, Homo sapiens
aactttaaagaggaggcttggg

SEQ ID NO: 7832146 - DNA, 22 bp, Homo sapiens
aacttgtatatgttattcagag

SEQ ID NO: 7832147 - DNA, 22 bp, Homo sapiens
aacttgtaggactgcactgtag

SEQ ID NO: 7832148 - DNA, 21 bp, Homo sapiens
aacttgtatttctccttattc

SEQ ID NO: 7832149 - DNA, 22 bp, Homo sapiens
aacttgttagaaatgcagaatc

SEQ ID NO: 7832150 - DNA, 20 bp, Homo sapiens
aacttgttttgttttctaat

SEQ ID NO: 7832151 - DNA, 22 bp, Homo sapiens
aactttaaaaaatatgtctgtt

SEQ ID NO: 7832152 - DNA, 22 bp, Homo sapiens
aactttaaaaaatatgtctgtt

SEQ ID NO: 7832153 - DNA, 20 bp, Homo sapiens
aacttgttttgttttctaat

SEQ ID NO: 7832154 - DNA, 22 bp, Homo sapiens
aacttgtttcttccattcaaca

SEQ ID NO: 7832155 - DNA, 22 bp, Homo sapiens
aacttgtttcttccattcaaca

SEQ ID NO: 7832156 - DNA, 20 bp, Homo sapiens
aacttgttttgttttctaat

SEQ ID NO: 7832157 - DNA, 22 bp, Homo sapiens
aatgtaaagctcaggtcaggag

SEQ ID NO: 7832158 - DNA, 22 bp, Homo sapiens
aatgtaaagctcaggtcaggag

SEQ ID NO: 7832159 - DNA, 22 bp, Homo sapiens
aatgtaaagctcaggtcaggag

SEQ ID NO: 7832160 - DNA, 22 bp, Homo sapiens
aatgtaaagttgggcacaaatg

SEQ ID NO: 7832161 - DNA, 22 bp, Homo sapiens
aatgtaaagttgggcacaaatg

SEQ ID NO: 7832162 - DNA, 22 bp, Homo sapiens
aatgtaaagttgggcacaaatg

SEQ ID NO: 7832163 - DNA, 22 bp, Homo sapiens
aatgtaaagttgggcacaaatg

SEQ ID NO: 7832164 - DNA, 22 bp, Homo sapiens
aatgtaaagttgggcacaaatg

SEQ ID NO: 7832165 - DNA, 22 bp, Homo sapiens
aatgtaaagttgggcacaaatg

SEQ ID NO: 7832166 - DNA, 22 bp, Homo sapiens
aatgtaaacagcaagagaaggg

SEQ ID NO: 7832167 - DNA, 22 bp, Homo sapiens
aatgtaaacagcaagagaaggg

SEQ ID NO: 7832168 - DNA, 22 bp, Homo sapiens
aatgtaaacagcaagagaaggg

SEQ ID NO: 7832169 - DNA, 22 bp, Homo sapiens
aactttacttgaaagaacatgt

SEQ ID NO: 7832170 - DNA, 22 bp, Homo sapiens
aatgtaaacagcaagagaaggg

SEQ ID NO: 7832171 - DNA, 22 bp, Homo sapiens
aatgtaaacagcaagagaaggg

SEQ ID NO: 7832172 - DNA, 22 bp, Homo sapiens
aactttacttgaaagaacatgt

SEQ ID NO: 7832173 - DNA, 22 bp, Homo sapiens
aactttacttgaaagaacatgt

SEQ ID NO: 7832174 - DNA, 22 bp, Homo sapiens
aatgtacaaaagtcagccaact

SEQ ID NO: 7832175 - DNA, 22 bp, Homo sapiens
aatgtacaaaagtcagccaact

SEQ ID NO: 7832176 - DNA, 22 bp, Homo sapiens
aatgtaacagcaacaacaatgg

SEQ ID NO: 7832177 - DNA, 22 bp, Homo sapiens
aatgtacaaaagtcagccaact

SEQ ID NO: 7832178 - DNA, 22 bp, Homo sapiens
aatgtacaaaccttctttgtag

SEQ ID NO: 7832179 - DNA, 22 bp, Homo sapiens
aatgtacaaaccttctttgtag

SEQ ID NO: 7832180 - DNA, 22 bp, Homo sapiens
aatgtacaaaccttctttgtag

SEQ ID NO: 7832181 - DNA, 22 bp, Homo sapiens
aatgtacaaaccttctttgtag

SEQ ID NO: 7832182 - DNA, 22 bp, Homo sapiens
aatgtacaaaccttctttgtag

SEQ ID NO: 7832183 - DNA, 22 bp, Homo sapiens
aatgtacaaaccttctttgtag

SEQ ID NO: 7832184 - DNA, 22 bp, Homo sapiens
aataagaattgccagatttgaa

SEQ ID NO: 7832185 - DNA, 22 bp, Homo sapiens
aataagaattgccagatttgaa

SEQ ID NO: 7832186 - DNA, 22 bp, Homo sapiens
aataagaattgccagatttgaa

SEQ ID NO: 7832187 - DNA, 22 bp, Homo sapiens
aataatattcctctgtgtgcgt

SEQ ID NO: 7832188 - DNA, 22 bp, Homo sapiens
aataatatttgaagcttcaaag

SEQ ID NO: 7832189 - DNA, 22 bp, Homo sapiens
aataatattcctctgtgtgcgt

SEQ ID NO: 7832190 - DNA, 22 bp, Homo sapiens
aataatatttgaagcttcaaag

SEQ ID NO: 7832191 - DNA, 22 bp, Homo sapiens
aataatatttgaagcttcaaag

SEQ ID NO: 7832192 - DNA, 22 bp, Homo sapiens
aataatatttgaagcttcaaag

SEQ ID NO: 7832193 - DNA, 22 bp, Homo sapiens
aataatctccctttttgtatgt

SEQ ID NO: 7832194 - DNA, 22 bp, Homo sapiens
aataatcctgcccgtctctccg

SEQ ID NO: 7832195 - DNA, 22 bp, Homo sapiens
aataatatttgaagcttcaaag

SEQ ID NO: 7832196 - DNA, 22 bp, Homo sapiens
aataatctccctttttgtatgt

SEQ ID NO: 7832197 - DNA, 22 bp, Homo sapiens
aataatgataatggttatagct

SEQ ID NO: 7832198 - DNA, 22 bp, Homo sapiens
aataatgataatggttatagct

SEQ ID NO: 7832199 - DNA, 19 bp, Homo sapiens
aataatgccagatgtctgt

SEQ ID NO: 7832200 - DNA, 19 bp, Homo sapiens
aataatgccagatgtctgt

SEQ ID NO: 7832201 - DNA, 22 bp, Homo sapiens
aataatgagcttgtctaattgt

SEQ ID NO: 7832202 - DNA, 22 bp, Homo sapiens
aataatgagcttgtctaattgt

SEQ ID NO: 7832203 - DNA, 22 bp, Homo sapiens
aataatgagacagcttatttaa

SEQ ID NO: 7832204 - DNA, 22 bp, Homo sapiens
aataatgagacagcttatttaa

SEQ ID NO: 7832205 - DNA, 22 bp, Homo sapiens
aataatgagacagcttatttaa

SEQ ID NO: 7832206 - DNA, 22 bp, Homo sapiens
aataatgaacatttaaaacctg

SEQ ID NO: 7832207 - DNA, 22 bp, Homo sapiens
aataatgtaggatgataaatga

SEQ ID NO: 7832208 - DNA, 22 bp, Homo sapiens
aataatgtaggatgataaatga

SEQ ID NO: 7832209 - DNA, 22 bp, Homo sapiens
aataatgtaggatgataaatga

SEQ ID NO: 7832210 - DNA, 22 bp, Homo sapiens
aataatgtacatacatatttcg

SEQ ID NO: 7832211 - DNA, 22 bp, Homo sapiens
aataatgtacatacatatttcg

SEQ ID NO: 7832212 - DNA, 22 bp, Homo sapiens
aataatgtacatacatatttcg

SEQ ID NO: 7832213 - DNA, 22 bp, Homo sapiens
aataatgtctgctattttaaaa

SEQ ID NO: 7832214 - DNA, 22 bp, Homo sapiens
aataatgtctttggcttgacca

SEQ ID NO: 7832215 - DNA, 22 bp, Homo sapiens
aatacagaggggtcacaattca

SEQ ID NO: 7832216 - DNA, 22 bp, Homo sapiens
aatacagaggggtcacaattca

SEQ ID NO: 7832217 - DNA, 22 bp, Homo sapiens
aatacagaggggtcacaattca

SEQ ID NO: 7832218 - DNA, 22 bp, Homo sapiens
aatacagaggggtcacaattca

SEQ ID NO: 7832219 - DNA, 22 bp, Homo sapiens
aatacagaggggtcacaattca

SEQ ID NO: 7832220 - DNA, 22 bp, Homo sapiens
aatacagatggcatgtgaagat

SEQ ID NO: 7832221 - DNA, 22 bp, Homo sapiens
aatacagatggcatgtgaagat

SEQ ID NO: 7832222 - DNA, 22 bp, Homo sapiens
aatacagatggcatgtgaagat

SEQ ID NO: 7832223 - DNA, 22 bp, Homo sapiens
aatacagatggcatgtgaagat

SEQ ID NO: 7832224 - DNA, 22 bp, Homo sapiens
aatacagatgagcttctgcctc

SEQ ID NO: 7832225 - DNA, 22 bp, Homo sapiens
aatacagatattcagtggtact

SEQ ID NO: 7832226 - DNA, 22 bp, Homo sapiens
aacagtttatgataaattctta

SEQ ID NO: 7832227 - DNA, 22 bp, Homo sapiens
aacagtttatgataaattctta

SEQ ID NO: 7832228 - DNA, 22 bp, Homo sapiens
aacagtttatgataaattctta

SEQ ID NO: 7832229 - DNA, 22 bp, Homo sapiens
aacagtttatgagatatgctat

SEQ ID NO: 7832230 - DNA, 22 bp, Homo sapiens
aacagtttatgagatatgctat

SEQ ID NO: 7832231 - DNA, 22 bp, Homo sapiens
aacagtttatcaagtttttaca

SEQ ID NO: 7832232 - DNA, 22 bp, Homo sapiens
aacagttgatgtagctttggag

SEQ ID NO: 7832233 - DNA, 21 bp, Homo sapiens
aacagttctctttgaaggtgt

SEQ ID NO: 7832234 - DNA, 22 bp, Homo sapiens
aagttacacagagttggaggct

SEQ ID NO: 7832235 - DNA, 22 bp, Homo sapiens
aagttacacattttcattgtaa

SEQ ID NO: 7832236 - DNA, 22 bp, Homo sapiens
aagttaacccagtatttctttt

SEQ ID NO: 7832237 - DNA, 22 bp, Homo sapiens
aagtgttttgtaaacagaaaag

SEQ ID NO: 7832238 - DNA, 22 bp, Homo sapiens
aagttaaggaagtcatactatg

SEQ ID NO: 7832239 - DNA, 22 bp, Homo sapiens
aagttaaggaagtcatactatg

SEQ ID NO: 7832240 - DNA, 22 bp, Homo sapiens
aagttaagggaagattccaaac

SEQ ID NO: 7832241 - DNA, 22 bp, Homo sapiens
aagttaagtagtactctcttca

SEQ ID NO: 7832242 - DNA, 22 bp, Homo sapiens
aagttacaagactaaatggaag

SEQ ID NO: 7832243 - DNA, 22 bp, Homo sapiens
aagttacagtcagaggttaaca

SEQ ID NO: 7832244 - DNA, 22 bp, Homo sapiens
aagttacagtcagaggttaaca

SEQ ID NO: 7832245 - DNA, 22 bp, Homo sapiens
aagttacagttattatttaaaa

SEQ ID NO: 7832246 - DNA, 22 bp, Homo sapiens
aagttacagttatgaaactcac

SEQ ID NO: 7832247 - DNA, 22 bp, Homo sapiens
aagttacagttacagaatggag

SEQ ID NO: 7832248 - DNA, 22 bp, Homo sapiens
aagttacataaatgtcctctag

SEQ ID NO: 7832249 - DNA, 22 bp, Homo sapiens
aagttacatattcttgggctat

SEQ ID NO: 7832250 - DNA, 22 bp, Homo sapiens
aataagaacttgtctctggcag

SEQ ID NO: 7832251 - DNA, 22 bp, Homo sapiens
aataagaattgccagatttgaa

SEQ ID NO: 7832252 - DNA, 22 bp, Homo sapiens
aataagaattgccagatttgaa

SEQ ID NO: 7832253 - DNA, 22 bp, Homo sapiens
aagttacagttattatttaaaa

SEQ ID NO: 7832254 - DNA, 22 bp, Homo sapiens
aagttacagttggaactgtgaa

SEQ ID NO: 7832255 - DNA, 23 bp, Homo sapiens
aatatctgcagctcctggggagg

SEQ ID NO: 7832256 - DNA, 22 bp, Homo sapiens
aatatctggagatgctttttgt

SEQ ID NO: 7832257 - DNA, 22 bp, Homo sapiens
aatatctggagatgctttttgt

SEQ ID NO: 7832258 - DNA, 22 bp, Homo sapiens
aatatctcaccatgacaaagca

SEQ ID NO: 7832259 - DNA, 22 bp, Homo sapiens
aatatcctttccagagtacagt

SEQ ID NO: 7832260 - DNA, 22 bp, Homo sapiens
aatatcctgaccagtaaactaa

SEQ ID NO: 7832261 - DNA, 22 bp, Homo sapiens
aatatcctgaccagtaaactaa

SEQ ID NO: 7832262 - DNA, 22 bp, Homo sapiens
aatatctagcctttagcagctt

SEQ ID NO: 7832263 - DNA, 22 bp, Homo sapiens
aatatccattgggagcaaatgg

SEQ ID NO: 7832264 - DNA, 22 bp, Homo sapiens
aatatccattgggagcaaatgg

SEQ ID NO: 7832265 - DNA, 22 bp, Homo sapiens
aatatccattgggagcaaatgg

SEQ ID NO: 7832266 - DNA, 22 bp, Homo sapiens
aatatccattgggagcaaatgg

SEQ ID NO: 7832267 - DNA, 22 bp, Homo sapiens
aatatcccttgaagtggtgctg

SEQ ID NO: 7832268 - DNA, 22 bp, Homo sapiens
aatatccattgggagcaaatgg

SEQ ID NO: 7832269 - DNA, 22 bp, Homo sapiens
aatatccaggtagatgtcttct

SEQ ID NO: 7832270 - DNA, 22 bp, Homo sapiens
aatatccaggtagatgtcttct

SEQ ID NO: 7832271 - DNA, 22 bp, Homo sapiens
aatatccaggtagatgtcttct

SEQ ID NO: 7832272 - DNA, 22 bp, Homo sapiens
aatatccaggtagatgtcttct

SEQ ID NO: 7832273 - DNA, 22 bp, Homo sapiens
aatatcagtatattgtatcagt

SEQ ID NO: 7832274 - DNA, 22 bp, Homo sapiens
aatatcatctctcttttctgca

SEQ ID NO: 7832275 - DNA, 21 bp, Homo sapiens
aatatccaaatgattagatct

SEQ ID NO: 7832276 - DNA, 21 bp, Homo sapiens
aatatccaaatgattagatct

SEQ ID NO: 7832277 - DNA, 22 bp, Homo sapiens
aatatccacactgtgtccctgc

SEQ ID NO: 7832278 - DNA, 22 bp, Homo sapiens
aatatccacttcaatacaggca

SEQ ID NO: 7832279 - DNA, 22 bp, Homo sapiens
aatatccacttcaatacaggca

SEQ ID NO: 7832280 - DNA, 22 bp, Homo sapiens
aatataattttattcctagagt

SEQ ID NO: 7832281 - DNA, 22 bp, Homo sapiens
aatataattttattcctagagt

SEQ ID NO: 7832282 - DNA, 22 bp, Homo sapiens
aatacatatggaattccatgtt

SEQ ID NO: 7832283 - DNA, 20 bp, Homo sapiens
aatataattctctgaattta

SEQ ID NO: 7832284 - DNA, 20 bp, Homo sapiens
aatataattctctgaattta

SEQ ID NO: 7832285 - DNA, 21 bp, Homo sapiens
aatacagtgaagaatttcttt

SEQ ID NO: 7832286 - DNA, 21 bp, Homo sapiens
aatacagtgaagaatttcttt

SEQ ID NO: 7832287 - DNA, 21 bp, Homo sapiens
aatacagtgaagaatttcttt

SEQ ID NO: 7832288 - DNA, 21 bp, Homo sapiens
aatacagtgaagaatttcttt

SEQ ID NO: 7832289 - DNA, 19 bp, Homo sapiens
aatacagtgttatagaatt

SEQ ID NO: 7832290 - DNA, 19 bp, Homo sapiens
aatacagtgttatagaatt

SEQ ID NO: 7832291 - DNA, 19 bp, Homo sapiens
aatacagtgttatagaatt

SEQ ID NO: 7832292 - DNA, 22 bp, Homo sapiens
aatacataataagttttgtctg

SEQ ID NO: 7832293 - DNA, 22 bp, Homo sapiens
aatacataataagttttgtctg

SEQ ID NO: 7832294 - DNA, 22 bp, Homo sapiens
aatacataataagttttgtctg

SEQ ID NO: 7832295 - DNA, 19 bp, Homo sapiens
aatacagtgttatagaatt

SEQ ID NO: 7832296 - DNA, 22 bp, Homo sapiens
aatacatatggaattccatgtt

SEQ ID NO: 7832297 - DNA, 22 bp, Homo sapiens
aatacatatggaattccatgtt

SEQ ID NO: 7832298 - DNA, 22 bp, Homo sapiens
aatacatatggaattccatgtt

SEQ ID NO: 7832299 - DNA, 22 bp, Homo sapiens
aatacagcagatggagacaaat

SEQ ID NO: 7832300 - DNA, 22 bp, Homo sapiens
aatacagcagatggagacaaat

SEQ ID NO: 7832301 - DNA, 22 bp, Homo sapiens
aatacagcagatggagacaaat

SEQ ID NO: 7832302 - DNA, 22 bp, Homo sapiens
aatacagtaattttgatgagtt

SEQ ID NO: 7832303 - DNA, 22 bp, Homo sapiens
aatacagtaggtaatagttcat

SEQ ID NO: 7832304 - DNA, 22 bp, Homo sapiens
aatacagtaattttgatgagtt

SEQ ID NO: 7832305 - DNA, 22 bp, Homo sapiens
aatacagtgaaagtgagcaagg

SEQ ID NO: 7832306 - DNA, 22 bp, Homo sapiens
aatacagtcttactagaaaatc

SEQ ID NO: 7832307 - DNA, 22 bp, Homo sapiens
aatacagtcttactagaaaatc

SEQ ID NO: 7832308 - DNA, 22 bp, Homo sapiens
aatacagtcttactagaaaatc

SEQ ID NO: 7832309 - DNA, 22 bp, Homo sapiens
aatacagtcttactagaaaatc

SEQ ID NO: 7832310 - DNA, 22 bp, Homo sapiens
aatacagtaggtaatagttcat

SEQ ID NO: 7832311 - DNA, 22 bp, Homo sapiens
aatattgtttcaagatcacaga

SEQ ID NO: 7832312 - DNA, 22 bp, Homo sapiens
aatattgagaaccagcatgttt

SEQ ID NO: 7832313 - DNA, 22 bp, Homo sapiens
aatatttatatttctcttccct

SEQ ID NO: 7832314 - DNA, 22 bp, Homo sapiens
aatattgtttcaagatcacaga

SEQ ID NO: 7832315 - DNA, 22 bp, Homo sapiens
aatatttatatttctcttccct

SEQ ID NO: 7832316 - DNA, 22 bp, Homo sapiens
aatatttatatttctcttccct

SEQ ID NO: 7832317 - DNA, 22 bp, Homo sapiens
aatatttatgacaggaagtagc

SEQ ID NO: 7832318 - DNA, 22 bp, Homo sapiens
aatatttatgacaggaagtagc

SEQ ID NO: 7832319 - DNA, 22 bp, Homo sapiens
aatatttatgacaggaagtagc

SEQ ID NO: 7832320 - DNA, 22 bp, Homo sapiens
aatatttatgacaggaagtagc

SEQ ID NO: 7832321 - DNA, 22 bp, Homo sapiens
aatattgagaaccagcatgttt

SEQ ID NO: 7832322 - DNA, 22 bp, Homo sapiens
aatatctgtggccatacaattt

SEQ ID NO: 7832323 - DNA, 22 bp, Homo sapiens
aatatctgtggccatacaattt

SEQ ID NO: 7832324 - DNA, 22 bp, Homo sapiens
aatatctgttgttctaagccac

SEQ ID NO: 7832325 - DNA, 22 bp, Homo sapiens
aatatctgtggccatacaattt

SEQ ID NO: 7832326 - DNA, 22 bp, Homo sapiens
aatatctgtctctaatgcatat

SEQ ID NO: 7832327 - DNA, 22 bp, Homo sapiens
aatatctgtctctaatgcatat

SEQ ID NO: 7832328 - DNA, 22 bp, Homo sapiens
aatatctggagatgctttttgt

SEQ ID NO: 7832329 - DNA, 22 bp, Homo sapiens
aatatctggagatgctttttgt

SEQ ID NO: 7832330 - DNA, 22 bp, Homo sapiens
aatatctgtctctaatgcatat

SEQ ID NO: 7832331 - DNA, 22 bp, Homo sapiens
aatatttctgtagctatgttct

SEQ ID NO: 7832332 - DNA, 22 bp, Homo sapiens
aatatttctgtagctatgttct

SEQ ID NO: 7832333 - DNA, 22 bp, Homo sapiens
aatatttctgtagctatgttct

SEQ ID NO: 7832334 - DNA, 22 bp, Homo sapiens
aatatttctgtagctatgttct

SEQ ID NO: 7832335 - DNA, 22 bp, Homo sapiens
aatatttctgtagctatgttct

SEQ ID NO: 7832336 - DNA, 22 bp, Homo sapiens
aatatttctggtgcttctcact

SEQ ID NO: 7832337 - DNA, 22 bp, Homo sapiens
aatccagatgagcaatcatact

SEQ ID NO: 7832338 - DNA, 22 bp, Homo sapiens
aatccagatgagcaatcatact

SEQ ID NO: 7832339 - DNA, 22 bp, Homo sapiens
aatccagattccagaaaatcgc

SEQ ID NO: 7832340 - DNA, 22 bp, Homo sapiens
aatccagatgagcaatcatact

SEQ ID NO: 7832341 - DNA, 22 bp, Homo sapiens
aatatttctgcagaatggtttt

SEQ ID NO: 7832342 - DNA, 22 bp, Homo sapiens
aatatttctgcagaatggtttt

SEQ ID NO: 7832343 - DNA, 22 bp, Homo sapiens
aatatttctgcagaatggtttt

SEQ ID NO: 7832344 - DNA, 22 bp, Homo sapiens
aatatttctccttcgttatagc

SEQ ID NO: 7832345 - DNA, 22 bp, Homo sapiens
aatatttctggtgcttctcact

SEQ ID NO: 7832346 - DNA, 22 bp, Homo sapiens
aatatttctgcagaatggtttt

SEQ ID NO: 7832347 - DNA, 22 bp, Homo sapiens
aatatttcaaaaggaaacacag

SEQ ID NO: 7832348 - DNA, 22 bp, Homo sapiens
aatatttctccttcgttatagc

SEQ ID NO: 7832349 - DNA, 22 bp, Homo sapiens
aatatttctccttcgttatagc

SEQ ID NO: 7832350 - DNA, 22 bp, Homo sapiens
aagggcaggtgggcatttctgg

SEQ ID NO: 7832351 - DNA, 22 bp, Homo sapiens
aagggctgcatttgatgtgtca

SEQ ID NO: 7832352 - DNA, 22 bp, Homo sapiens
aagggctgcatttgatgtgtca

SEQ ID NO: 7832353 - DNA, 22 bp, Homo sapiens
aagggctgcatttgatgtgtca

SEQ ID NO: 7832354 - DNA, 22 bp, Homo sapiens
aagggctgcatttgatgtgtca

SEQ ID NO: 7832355 - DNA, 22 bp, Homo sapiens
aagggctgcaatccaaaacact

SEQ ID NO: 7832356 - DNA, 22 bp, Homo sapiens
aagggctgcaatccaaaacact

SEQ ID NO: 7832357 - DNA, 22 bp, Homo sapiens
aagggctgcaatccaaaacact

SEQ ID NO: 7832358 - DNA, 22 bp, Homo sapiens
aagggcagggagtttgtgtcta

SEQ ID NO: 7832359 - DNA, 22 bp, Homo sapiens
aagggcagggagtttgtgtcta

SEQ ID NO: 7832360 - DNA, 22 bp, Homo sapiens
aagggcaggtgggcatttctgg

SEQ ID NO: 7832361 - DNA, 22 bp, Homo sapiens
aagggcaggtgggcatttctgg

SEQ ID NO: 7832362 - DNA, 22 bp, Homo sapiens
aagggcagggagtttgtgtcta

SEQ ID NO: 7832363 - DNA, 22 bp, Homo sapiens
aagggctgccagggggtgccag

SEQ ID NO: 7832364 - DNA, 22 bp, Homo sapiens
aagggctgccagggggtgccag

SEQ ID NO: 7832365 - DNA, 22 bp, Homo sapiens
aagggctgccagggggtgccag

SEQ ID NO: 7832366 - DNA, 22 bp, Homo sapiens
aagggctgccagggggtgccag

SEQ ID NO: 7832367 - DNA, 22 bp, Homo sapiens
aagggctgccagggggtgccag

SEQ ID NO: 7832368 - DNA, 22 bp, Homo sapiens
aagggctgcatttgatgtgtca

SEQ ID NO: 7832369 - DNA, 22 bp, Homo sapiens
aagggctgccagggggtgccag

SEQ ID NO: 7832370 - DNA, 22 bp, Homo sapiens
aagggctgctgtagaagcagag

SEQ ID NO: 7832371 - DNA, 22 bp, Homo sapiens
aagggctgctgtagaagcagag

SEQ ID NO: 7832372 - DNA, 22 bp, Homo sapiens
aagggctgctgtagaagcagag

SEQ ID NO: 7832373 - DNA, 22 bp, Homo sapiens
aagggctgctgtagaagcagag

SEQ ID NO: 7832374 - DNA, 22 bp, Homo sapiens
aagggctgctgtagaagcagag

SEQ ID NO: 7832375 - DNA, 22 bp, Homo sapiens
aagggctgctgtagaagcagag

SEQ ID NO: 7832376 - DNA, 22 bp, Homo sapiens
aagggctgctgtagaagcagag

SEQ ID NO: 7832377 - DNA, 22 bp, Homo sapiens
aagggctggaatatctcttaga

SEQ ID NO: 7832378 - DNA, 22 bp, Homo sapiens
aaggtctgtattagagtttcat

SEQ ID NO: 7832379 - DNA, 21 bp, Homo sapiens
aaggtctgtaaagtgacagga

SEQ ID NO: 7832380 - DNA, 22 bp, Homo sapiens
aaggtctggatgatgggtgtgc

SEQ ID NO: 7832381 - DNA, 22 bp, Homo sapiens
aagggctggaatatctcttaga

SEQ ID NO: 7832382 - DNA, 22 bp, Homo sapiens
aagggctggaatatctcttaga

SEQ ID NO: 7832383 - DNA, 22 bp, Homo sapiens
aagggctggaatatctcttaga

SEQ ID NO: 7832384 - DNA, 22 bp, Homo sapiens
aagggctggaatatctcttaga

SEQ ID NO: 7832385 - DNA, 22 bp, Homo sapiens
aaggtgtgaactgattcattgg

SEQ ID NO: 7832386 - DNA, 22 bp, Homo sapiens
aaggtgtgaagagatgggaaga

SEQ ID NO: 7832387 - DNA, 22 bp, Homo sapiens
aaggtgtcgggttagctcagcc

SEQ ID NO: 7832388 - DNA, 22 bp, Homo sapiens
aaggtgtcgggttagctcagcc

SEQ ID NO: 7832389 - DNA, 22 bp, Homo sapiens
aaggtgtcggcagagccgcttc

SEQ ID NO: 7832390 - DNA, 22 bp, Homo sapiens
aagtccaggtcctcattccatc

SEQ ID NO: 7832391 - DNA, 22 bp, Homo sapiens
aagtacaatctttctgtaaagg

SEQ ID NO: 7832392 - DNA, 22 bp, Homo sapiens
aagtccagtatttctagatctt

SEQ ID NO: 7832393 - DNA, 22 bp, Homo sapiens
aagtccagtatttctagatctt

SEQ ID NO: 7832394 - DNA, 22 bp, Homo sapiens
aagtccagtatgagaaacctgc

SEQ ID NO: 7832395 - DNA, 22 bp, Homo sapiens
aagtccagtatgagaaacctgc

SEQ ID NO: 7832396 - DNA, 22 bp, Homo sapiens
aagtacaatctttctgtaaagg

SEQ ID NO: 7832397 - DNA, 22 bp, Homo sapiens
aagtacaatctttctgtaaagg

SEQ ID NO: 7832398 - DNA, 22 bp, Homo sapiens
aagtacaatctttctgtaaagg

SEQ ID NO: 7832399 - DNA, 22 bp, Homo sapiens
aagtccaggtcccgggctctgg

SEQ ID NO: 7832400 - DNA, 22 bp, Homo sapiens
aagtacaacgcatacagagaaa

SEQ ID NO: 7832401 - DNA, 22 bp, Homo sapiens
aagtacaacgcatacagagaaa

SEQ ID NO: 7832402 - DNA, 15 bp, Homo sapiens
aagtccagtctcctg

SEQ ID NO: 7832403 - DNA, 22 bp, Homo sapiens
aagtccagtgaaatagaatgca

SEQ ID NO: 7832404 - DNA, 22 bp, Homo sapiens
aagtccagtgaaatagaatgca

SEQ ID NO: 7832405 - DNA, 22 bp, Homo sapiens
aagtccagtgatactggcagga

SEQ ID NO: 7832406 - DNA, 22 bp, Homo sapiens
aagtccagtgatactggcagga

SEQ ID NO: 7832407 - DNA, 22 bp, Homo sapiens
aagtctgagagaaactctctca

SEQ ID NO: 7832408 - DNA, 22 bp, Homo sapiens
aagtctgagtgtcagtgcaagt

SEQ ID NO: 7832409 - DNA, 22 bp, Homo sapiens
aagtctgagtgtcagtgcaagt

SEQ ID NO: 7832410 - DNA, 22 bp, Homo sapiens
aagtctgagtgtcagtgcaagt

SEQ ID NO: 7832411 - DNA, 22 bp, Homo sapiens
aagtaatggttaaataattcta

SEQ ID NO: 7832412 - DNA, 22 bp, Homo sapiens
aagtaatctggaatttggtttt

SEQ ID NO: 7832413 - DNA, 22 bp, Homo sapiens
aagtaatgatgtcatcacagag

SEQ ID NO: 7832414 - DNA, 22 bp, Homo sapiens
aagtaatctggaatttggtttt

SEQ ID NO: 7832415 - DNA, 22 bp, Homo sapiens
aagtacaaattttgaagagctt

SEQ ID NO: 7832416 - DNA, 22 bp, Homo sapiens
aagtacaaattttgaagagctt

SEQ ID NO: 7832417 - DNA, 22 bp, Homo sapiens
aagtacaaattttgaagagctt

SEQ ID NO: 7832418 - DNA, 22 bp, Homo sapiens
aagtacaacgcatacagagaaa

SEQ ID NO: 7832419 - DNA, 22 bp, Homo sapiens
aagtacaacgcatacagagaaa

SEQ ID NO: 7832420 - DNA, 22 bp, Homo sapiens
aagtacaacgcatacagagaaa

SEQ ID NO: 7832421 - DNA, 22 bp, Homo sapiens
aagtacaacgcatacagagaaa

SEQ ID NO: 7832422 - DNA, 22 bp, Homo sapiens
aagtacaacgcatacagagaaa

SEQ ID NO: 7832423 - DNA, 22 bp, Homo sapiens
aagtacaacgcatacagagaaa

SEQ ID NO: 7832424 - DNA, 22 bp, Homo sapiens
aagtacaacgcatacagagaaa

SEQ ID NO: 7832425 - DNA, 22 bp, Homo sapiens
aagtaacatctgaacatgatgt

SEQ ID NO: 7832426 - DNA, 22 bp, Homo sapiens
aagtaacatctgaacatgatgt

SEQ ID NO: 7832427 - DNA, 22 bp, Homo sapiens
aagtaacatctgaacatgatgt

SEQ ID NO: 7832428 - DNA, 22 bp, Homo sapiens
aagtaacatctgaacatgatgt

SEQ ID NO: 7832429 - DNA, 22 bp, Homo sapiens
aagtaacatctgaacatgatgt

SEQ ID NO: 7832430 - DNA, 22 bp, Homo sapiens
aagtaacaggtgcttagtttat

SEQ ID NO: 7832431 - DNA, 22 bp, Homo sapiens
aagtaacaggtgcttagtttat

SEQ ID NO: 7832432 - DNA, 22 bp, Homo sapiens
aaggtgttcaggttttcccatt

SEQ ID NO: 7832433 - DNA, 22 bp, Homo sapiens
aaggttactcagaataacttcc

SEQ ID NO: 7832434 - DNA, 23 bp, Homo sapiens
aagtaacagggataatagcagtt

SEQ ID NO: 7832435 - DNA, 22 bp, Homo sapiens
aagtaactaaagatatccattt

SEQ ID NO: 7832436 - DNA, 22 bp, Homo sapiens
aagtaacatgggaacatctgaa

SEQ ID NO: 7832437 - DNA, 22 bp, Homo sapiens
aagtaacttatttgcaaacagg

SEQ ID NO: 7832438 - DNA, 22 bp, Homo sapiens
aagtaacttatttgcaaacagg

SEQ ID NO: 7832439 - DNA, 22 bp, Homo sapiens
aagtaacttatttgcaaacagg

SEQ ID NO: 7832440 - DNA, 22 bp, Homo sapiens
aagtaacttatttgcaaacagg

SEQ ID NO: 7832441 - DNA, 22 bp, Homo sapiens
aagtaagtcttacattcacatt

SEQ ID NO: 7832442 - DNA, 22 bp, Homo sapiens
aagtaagtggctattagctgtg

SEQ ID NO: 7832443 - DNA, 22 bp, Homo sapiens
aacagtgtctgtggttaaaggt

SEQ ID NO: 7832444 - DNA, 22 bp, Homo sapiens
aacagtgtcaggattacagata

SEQ ID NO: 7832445 - DNA, 22 bp, Homo sapiens
aacagtgtcaggattacagata

SEQ ID NO: 7832446 - DNA, 21 bp, Homo sapiens
aacagtgcttagtagatgttc

SEQ ID NO: 7832447 - DNA, 21 bp, Homo sapiens
aacagtgcttagtagatgttc

SEQ ID NO: 7832448 - DNA, 22 bp, Homo sapiens
aacagtgctgttataaatgtac

SEQ ID NO: 7832449 - DNA, 22 bp, Homo sapiens
aacagtgctgttataaatgtac

SEQ ID NO: 7832450 - DNA, 22 bp, Homo sapiens
aacagtgttttgctctttgccc

SEQ ID NO: 7832451 - DNA, 22 bp, Homo sapiens
aacagtgtttttcttcagcact

SEQ ID NO: 7832452 - DNA, 22 bp, Homo sapiens
aacagttacccttaagatcttt

SEQ ID NO: 7832453 - DNA, 22 bp, Homo sapiens
aacagttatctcacatatggaa

SEQ ID NO: 7832454 - DNA, 22 bp, Homo sapiens
aacagttattatcacattagtg

SEQ ID NO: 7832455 - DNA, 22 bp, Homo sapiens
aacagttattatcacattagtg

SEQ ID NO: 7832456 - DNA, 22 bp, Homo sapiens
aacagttattatcacattagtg

SEQ ID NO: 7832457 - DNA, 23 bp, Homo sapiens
aagtgctatgtttataagagctg

SEQ ID NO: 7832458 - DNA, 22 bp, Homo sapiens
aagtgctcagtatcctcatgtg

SEQ ID NO: 7832459 - DNA, 22 bp, Homo sapiens
aagtgctgaatgaagacacaaa

SEQ ID NO: 7832460 - DNA, 22 bp, Homo sapiens
aagtgctgggattacaggcatg

SEQ ID NO: 7832461 - DNA, 22 bp, Homo sapiens
aagtgctgggattacaggcatg

SEQ ID NO: 7832462 - DNA, 22 bp, Homo sapiens
aagtgctgagactacaggcatg

SEQ ID NO: 7832463 - DNA, 22 bp, Homo sapiens
aagtgctgagactacaggcatg

SEQ ID NO: 7832464 - DNA, 22 bp, Homo sapiens
aagtgctgggattacaggtgtg

SEQ ID NO: 7832465 - DNA, 22 bp, Homo sapiens
aagtgctgggattacaggtgtc

SEQ ID NO: 7832466 - DNA, 22 bp, Homo sapiens
aagtgctgggattacaggtgtg

SEQ ID NO: 7832467 - DNA, 22 bp, Homo sapiens
aagtgctgggattacaggtgtc

SEQ ID NO: 7832468 - DNA, 22 bp, Homo sapiens
aagtgctgggattacaggggtg

SEQ ID NO: 7832469 - DNA, 22 bp, Homo sapiens
aagtgctgggattataggcatg

SEQ ID NO: 7832470 - DNA, 22 bp, Homo sapiens
aagtgcttaaaagggtggtcta

SEQ ID NO: 7832471 - DNA, 22 bp, Homo sapiens
aagtgcttagaagttgcattag

SEQ ID NO: 7832472 - DNA, 22 bp, Homo sapiens
aagtgcttagaagttgcattag

SEQ ID NO: 7832473 - DNA, 22 bp, Homo sapiens
aacagtaaagacagaatttatc

SEQ ID NO: 7832474 - DNA, 22 bp, Homo sapiens
aacagtaagagatgttttatct

SEQ ID NO: 7832475 - DNA, 22 bp, Homo sapiens
aacagtaagagatgttttatct

SEQ ID NO: 7832476 - DNA, 22 bp, Homo sapiens
aacagtaacgagatgtcctaac

SEQ ID NO: 7832477 - DNA, 22 bp, Homo sapiens
aacagtaacgagatgtcctaac

SEQ ID NO: 7832478 - DNA, 17 bp, Homo sapiens
aacagtaagccctgttt

SEQ ID NO: 7832479 - DNA, 22 bp, Homo sapiens
aacagtgatatcaagacagaca

SEQ ID NO: 7832480 - DNA, 22 bp, Homo sapiens
aagtcttaaccaaataaatgtt

SEQ ID NO: 7832481 - DNA, 22 bp, Homo sapiens
aagtctgtagaaaaacagttta

SEQ ID NO: 7832482 - DNA, 22 bp, Homo sapiens
aagtctgtttgagtgtcacact

SEQ ID NO: 7832483 - DNA, 22 bp, Homo sapiens
aagtctgtagaaaaacagttta

SEQ ID NO: 7832484 - DNA, 22 bp, Homo sapiens
aagtctgtagaaaaacagttta

SEQ ID NO: 7832485 - DNA, 21 bp, Homo sapiens
aagtctggttgattcctttgc

SEQ ID NO: 7832486 - DNA, 22 bp, Homo sapiens
aagtctggtgctgtcctcaccc

SEQ ID NO: 7832487 - DNA, 22 bp, Homo sapiens
aagtctggtgctgtcctcaccc

SEQ ID NO: 7832488 - DNA, 18 bp, Homo sapiens
aagtctggcagctttccc

SEQ ID NO: 7832489 - DNA, 22 bp, Homo sapiens
aagtctggaagtctcagttttc

SEQ ID NO: 7832490 - DNA, 22 bp, Homo sapiens
aagtctggaacctcatgctggc

SEQ ID NO: 7832491 - DNA, 22 bp, Homo sapiens
aagtctgggccagggcacagcc

SEQ ID NO: 7832492 - DNA, 22 bp, Homo sapiens
aagtctgggccagggcacagcc

SEQ ID NO: 7832493 - DNA, 22 bp, Homo sapiens
aagtctgggcctccttcccaga

SEQ ID NO: 7832494 - DNA, 22 bp, Homo sapiens
aagtctgggccagggcacagcc

SEQ ID NO: 7832495 - DNA, 22 bp, Homo sapiens
aagtctgggcctccttcccaga

SEQ ID NO: 7832496 - DNA, 22 bp, Homo sapiens
aagtcttaggcattttatttct

SEQ ID NO: 7832497 - DNA, 22 bp, Homo sapiens
aagtcttacataaacaggaaat

SEQ ID NO: 7832498 - DNA, 22 bp, Homo sapiens
aagtcttacagacaagctgaag

SEQ ID NO: 7832499 - DNA, 18 bp, Homo sapiens
aagtcttggaatttccac

SEQ ID NO: 7832500 - DNA, 22 bp, Homo sapiens
aagtcttttgctaagagtaatg

SEQ ID NO: 7832501 - DNA, 22 bp, Homo sapiens
aagtcttttgctaagagtaatg

SEQ ID NO: 7832502 - DNA, 22 bp, Homo sapiens
aagtcttttgttcaggctggca

SEQ ID NO: 7832503 - DNA, 22 bp, Homo sapiens
aagtgccagtttctggcttcct

SEQ ID NO: 7832504 - DNA, 22 bp, Homo sapiens
aagtgcctgacctagcctggag

SEQ ID NO: 7832505 - DNA, 22 bp, Homo sapiens
aagtgcccagtgaagcagtggt

SEQ ID NO: 7832506 - DNA, 22 bp, Homo sapiens
aagtgccatcatagcatggctg

SEQ ID NO: 7832507 - DNA, 22 bp, Homo sapiens
aagtgccagggacacttcttgt

SEQ ID NO: 7832508 - DNA, 21 bp, Homo sapiens
aagtgccacccacagatgcat

SEQ ID NO: 7832509 - DNA, 21 bp, Homo sapiens
aagtgccacccacagatgcat

SEQ ID NO: 7832510 - DNA, 22 bp, Homo sapiens
aagtgcattagatagaatgatg

SEQ ID NO: 7832511 - DNA, 22 bp, Homo sapiens
aagtgctaaccacaatccacag

SEQ ID NO: 7832512 - DNA, 22 bp, Homo sapiens
aagtgctaaatgttttagttaa

SEQ ID NO: 7832513 - DNA, 23 bp, Homo sapiens
aagtgctaccaaaagaattcctc

SEQ ID NO: 7832514 - DNA, 21 bp, Homo sapiens
aagtgctaatggttgcaacag

SEQ ID NO: 7832515 - DNA, 23 bp, Homo sapiens
aagtgctaagtactgtaatcatc

SEQ ID NO: 7832516 - DNA, 22 bp, Homo sapiens
aagtgctaggattacaggtgtg

SEQ ID NO: 7832517 - DNA, 22 bp, Homo sapiens
aagtgctagaaccccagcaaca

SEQ ID NO: 7832518 - DNA, 22 bp, Homo sapiens
aagtctttttgaatctataact

SEQ ID NO: 7832519 - DNA, 22 bp, Homo sapiens
aagtcttttgttcaggctggca

SEQ ID NO: 7832520 - DNA, 22 bp, Homo sapiens
aagtgaaacatgtatctcttta

SEQ ID NO: 7832521 - DNA, 22 bp, Homo sapiens
aagtctttttgaatctataact

SEQ ID NO: 7832522 - DNA, 22 bp, Homo sapiens
aagtgcatcactactcattaca

SEQ ID NO: 7832523 - DNA, 22 bp, Homo sapiens
aagtgaaacatgtatctcttta

SEQ ID NO: 7832524 - DNA, 22 bp, Homo sapiens
aagtgcattagatagaatgatg

SEQ ID NO: 7832525 - DNA, 22 bp, Homo sapiens
aagtgaaacatgtatctcttta

SEQ ID NO: 7832526 - DNA, 22 bp, Homo sapiens
aagtgcatggtatggtctccat

SEQ ID NO: 7832527 - DNA, 22 bp, Homo sapiens
aaatggatgcctgataacgtca

SEQ ID NO: 7832528 - DNA, 18 bp, Homo sapiens
aaatggatgacagtacca

SEQ ID NO: 7832529 - DNA, 18 bp, Homo sapiens
aaatggatgacagtacca

SEQ ID NO: 7832530 - DNA, 18 bp, Homo sapiens
aaatggatgacagtacca

SEQ ID NO: 7832531 - DNA, 22 bp, Homo sapiens
aaatggatctttttataatgca

SEQ ID NO: 7832532 - DNA, 22 bp, Homo sapiens
aaatggatctgtggaatacatt

SEQ ID NO: 7832533 - DNA, 22 bp, Homo sapiens
aaatggatctgtggaatacatt

SEQ ID NO: 7832534 - DNA, 22 bp, Homo sapiens
aaatggagttctaagtatagta

SEQ ID NO: 7832535 - DNA, 22 bp, Homo sapiens
aaatggagttctaagtatagta

SEQ ID NO: 7832536 - DNA, 22 bp, Homo sapiens
aaatggaggcacgcagtggtta

SEQ ID NO: 7832537 - DNA, 22 bp, Homo sapiens
aaatggaggcacgcagtggtta

SEQ ID NO: 7832538 - DNA, 19 bp, Homo sapiens
aaatggagctaatcttgtc

SEQ ID NO: 7832539 - DNA, 22 bp, Homo sapiens
aaatggaggcaaaattggtttc

SEQ ID NO: 7832540 - DNA, 22 bp, Homo sapiens
aaatggactgtgatatttacat

SEQ ID NO: 7832541 - DNA, 22 bp, Homo sapiens
aaatggagatgataagagggtt

SEQ ID NO: 7832542 - DNA, 22 bp, Homo sapiens
aaatggaagaagtgcaatactg

SEQ ID NO: 7832543 - DNA, 22 bp, Homo sapiens
aaatggaagaagtgcaatactg

SEQ ID NO: 7832544 - DNA, 22 bp, Homo sapiens
aaatggaagctatttatgattc

SEQ ID NO: 7832545 - DNA, 22 bp, Homo sapiens
aaatggaagctatttatgattc

SEQ ID NO: 7832546 - DNA, 22 bp, Homo sapiens
aaatggaagaagtgcaatactg

SEQ ID NO: 7832547 - DNA, 22 bp, Homo sapiens
aaatggaagaagtgcaatactg

SEQ ID NO: 7832548 - DNA, 22 bp, Homo sapiens
aaatggaatgtgtttataattc

SEQ ID NO: 7832549 - DNA, 22 bp, Homo sapiens
aaatggaatgtgtttataattc

SEQ ID NO: 7832550 - DNA, 22 bp, Homo sapiens
aaatggaatgtgtttataattc

SEQ ID NO: 7832551 - DNA, 22 bp, Homo sapiens
aaatggaatgtgtttataattc

SEQ ID NO: 7832552 - DNA, 22 bp, Homo sapiens
aaatggaatgtgtttataattc

SEQ ID NO: 7832553 - DNA, 22 bp, Homo sapiens
aaatggaatgtgtttataattc

SEQ ID NO: 7832554 - DNA, 22 bp, Homo sapiens
aaggagggttcccaggtcctgg

SEQ ID NO: 7832555 - DNA, 22 bp, Homo sapiens
aaggagggttcccaggtcctgg

SEQ ID NO: 7832556 - DNA, 22 bp, Homo sapiens
aaggagggttcccaggtcctgg

SEQ ID NO: 7832557 - DNA, 22 bp, Homo sapiens
aaggagggttcccaggtcctgg

SEQ ID NO: 7832558 - DNA, 16 bp, Homo sapiens
aaggagggaagagaat

SEQ ID NO: 7832559 - DNA, 16 bp, Homo sapiens
aaggagggaagagaat

SEQ ID NO: 7832560 - DNA, 16 bp, Homo sapiens
aaggagggaagagaat

SEQ ID NO: 7832561 - DNA, 22 bp, Homo sapiens
aaggagaagggtaatcaacaca

SEQ ID NO: 7832562 - DNA, 22 bp, Homo sapiens
aaggagaagggtaatcaacaca

SEQ ID NO: 7832563 - DNA, 22 bp, Homo sapiens
aaggagaagggtaatcaacaca

SEQ ID NO: 7832564 - DNA, 22 bp, Homo sapiens
aaggagaagggtaatcaacaca

SEQ ID NO: 7832565 - DNA, 22 bp, Homo sapiens
aaggagaagtctgttgagattg

SEQ ID NO: 7832566 - DNA, 22 bp, Homo sapiens
aaggagggaaagcagtgcttct

SEQ ID NO: 7832567 - DNA, 22 bp, Homo sapiens
aaggagggaaagcagtgcttct

SEQ ID NO: 7832568 - DNA, 22 bp, Homo sapiens
aaggagaagggtaatcaacaca

SEQ ID NO: 7832569 - DNA, 22 bp, Homo sapiens
aaggagggaaagcagtgcttct

SEQ ID NO: 7832570 - DNA, 22 bp, Homo sapiens
aaatggatgttgagttaaatgt

SEQ ID NO: 7832571 - DNA, 22 bp, Homo sapiens
aaatggcaacagaagggagttc

SEQ ID NO: 7832572 - DNA, 22 bp, Homo sapiens
aaatggatgttgagttaaatgt

SEQ ID NO: 7832573 - DNA, 22 bp, Homo sapiens
aaatggatggaattgacattta

SEQ ID NO: 7832574 - DNA, 22 bp, Homo sapiens
aaatggcaatcagcagaagcta

SEQ ID NO: 7832575 - DNA, 22 bp, Homo sapiens
aaatggcaatttagtttattta

SEQ ID NO: 7832576 - DNA, 22 bp, Homo sapiens
aaatggcaatcagcagaagcta

SEQ ID NO: 7832577 - DNA, 22 bp, Homo sapiens
aaatggcaatttagtttattta

SEQ ID NO: 7832578 - DNA, 18 bp, Homo sapiens
aaatggcagaatggatag

SEQ ID NO: 7832579 - DNA, 22 bp, Homo sapiens
aaggatatttggctacagaagc

SEQ ID NO: 7832580 - DNA, 22 bp, Homo sapiens
aaggatcaagtggattttctta

SEQ ID NO: 7832581 - DNA, 22 bp, Homo sapiens
aaggcactagcaagctgcctgg

SEQ ID NO: 7832582 - DNA, 22 bp, Homo sapiens
aaggcactagcaagctgcctgg

SEQ ID NO: 7832583 - DNA, 20 bp, Homo sapiens
aaggcactatgtctgctagc

SEQ ID NO: 7832584 - DNA, 22 bp, Homo sapiens
aaggcactcagccttgggacag

SEQ ID NO: 7832585 - DNA, 20 bp, Homo sapiens
aaggcactatgtctgctagc

SEQ ID NO: 7832586 - DNA, 22 bp, Homo sapiens
aaggcactagcagaattagtga

SEQ ID NO: 7832587 - DNA, 22 bp, Homo sapiens
aaggcactagcagaattagtga

SEQ ID NO: 7832588 - DNA, 22 bp, Homo sapiens
aaggcactagcagaattagtga

SEQ ID NO: 7832589 - DNA, 22 bp, Homo sapiens
aaggcactgaacttaaattctg

SEQ ID NO: 7832590 - DNA, 22 bp, Homo sapiens
aaggcactgaacttaaattctg

SEQ ID NO: 7832591 - DNA, 22 bp, Homo sapiens
aaggcactgaaaaattgtgtgt

SEQ ID NO: 7832592 - DNA, 22 bp, Homo sapiens
aaggcactgactgtgcagggga

SEQ ID NO: 7832593 - DNA, 22 bp, Homo sapiens
aaggcactgagccagccgtctc

SEQ ID NO: 7832594 - DNA, 22 bp, Homo sapiens
aaggcactgactgtgcagggga

SEQ ID NO: 7832595 - DNA, 22 bp, Homo sapiens
aaggcactgaaaaattgtgtgt

SEQ ID NO: 7832596 - DNA, 22 bp, Homo sapiens
aaggcactgaacttaaattctg

SEQ ID NO: 7832597 - DNA, 22 bp, Homo sapiens
aaggcactgaaaaattgtgtgt

SEQ ID NO: 7832598 - DNA, 22 bp, Homo sapiens
aaggcactcattcaaggagata

SEQ ID NO: 7832599 - DNA, 22 bp, Homo sapiens
aaggcactcattcaaggagata

SEQ ID NO: 7832600 - DNA, 22 bp, Homo sapiens
aaggcactgaaaaattgtgtgt

SEQ ID NO: 7832601 - DNA, 22 bp, Homo sapiens
aaggcactcattcaaggagata

SEQ ID NO: 7832602 - DNA, 22 bp, Homo sapiens
aaggagtctgggccattcagag

SEQ ID NO: 7832603 - DNA, 22 bp, Homo sapiens
aaggagtctgggccattcagag

SEQ ID NO: 7832604 - DNA, 22 bp, Homo sapiens
aaggagtctgggccattcagag

SEQ ID NO: 7832605 - DNA, 22 bp, Homo sapiens
aaggagtctgggccattcagag

SEQ ID NO: 7832606 - DNA, 22 bp, Homo sapiens
aaggagtctgggccattcagag

SEQ ID NO: 7832607 - DNA, 22 bp, Homo sapiens
aaggagtctgggccattcagag

SEQ ID NO: 7832608 - DNA, 22 bp, Homo sapiens
aaggaggttatcccagtggact

SEQ ID NO: 7832609 - DNA, 22 bp, Homo sapiens
aaggaggttatcccagtggact

SEQ ID NO: 7832610 - DNA, 22 bp, Homo sapiens
aaggagtgctgaaaggaagcgg

SEQ ID NO: 7832611 - DNA, 22 bp, Homo sapiens
aaggagtgcatgactcagagta

SEQ ID NO: 7832612 - DNA, 22 bp, Homo sapiens
aaggagtgcatgactcagagta

SEQ ID NO: 7832613 - DNA, 22 bp, Homo sapiens
aaggagtgatatatgggtgcta

SEQ ID NO: 7832614 - DNA, 22 bp, Homo sapiens
aaggataaaaaccacttctaat

SEQ ID NO: 7832615 - DNA, 22 bp, Homo sapiens
aaggagtttgggtagtcataca

SEQ ID NO: 7832616 - DNA, 22 bp, Homo sapiens
aaggataaaaaccacttctaat

SEQ ID NO: 7832617 - DNA, 22 bp, Homo sapiens
aaggatacttttagagcctgag

SEQ ID NO: 7832618 - DNA, 22 bp, Homo sapiens
aagggcaggcagagatcatata

SEQ ID NO: 7832619 - DNA, 22 bp, Homo sapiens
aagggcaggcagagatcatata

SEQ ID NO: 7832620 - DNA, 22 bp, Homo sapiens
aagggcaggcagagatcatata

SEQ ID NO: 7832621 - DNA, 22 bp, Homo sapiens
aagggcaggcacccaccctcac

SEQ ID NO: 7832622 - DNA, 22 bp, Homo sapiens
aagggcaggcagagatcatata

SEQ ID NO: 7832623 - DNA, 22 bp, Homo sapiens
aagggcaggcagagatcatata

SEQ ID NO: 7832624 - DNA, 22 bp, Homo sapiens
aagggcaggcacccaccctcac

SEQ ID NO: 7832625 - DNA, 22 bp, Homo sapiens
aagggcaggcacccaccctcac

SEQ ID NO: 7832626 - DNA, 22 bp, Homo sapiens
aagggcaggcacccaccctcac

SEQ ID NO: 7832627 - DNA, 22 bp, Homo sapiens
aagggcaggcacccaccctcac

SEQ ID NO: 7832628 - DNA, 22 bp, Homo sapiens
aagggcaggcacccaccctcac

SEQ ID NO: 7832629 - DNA, 22 bp, Homo sapiens
aagggcaggcacccaccctcac

SEQ ID NO: 7832630 - DNA, 22 bp, Homo sapiens
aagggcaggcacccaccctcac

SEQ ID NO: 7832631 - DNA, 22 bp, Homo sapiens
aagggcaggagaagacggatat

SEQ ID NO: 7832632 - DNA, 22 bp, Homo sapiens
aagggcaggagaagacggatat

SEQ ID NO: 7832633 - DNA, 22 bp, Homo sapiens
aagggcaggagaagacggatat

SEQ ID NO: 7832634 - DNA, 22 bp, Homo sapiens
aagggcaggagaagacggatat

SEQ ID NO: 7832635 - DNA, 22 bp, Homo sapiens
aagggcaggagaagacggatat

SEQ ID NO: 7832636 - DNA, 22 bp, Homo sapiens
aagggcaggagaagacggatat

SEQ ID NO: 7832637 - DNA, 22 bp, Homo sapiens
aagggcaggagaagacggatat

SEQ ID NO: 7832638 - DNA, 22 bp, Homo sapiens
aagggcaggagaagacggatat

SEQ ID NO: 7832639 - DNA, 22 bp, Homo sapiens
aagggcaggaaaagatggatgt

SEQ ID NO: 7832640 - DNA, 22 bp, Homo sapiens
aagggcaggaaaagatggatgt

SEQ ID NO: 7832641 - DNA, 22 bp, Homo sapiens
aagggcaggaaaagatggatgt

SEQ ID NO: 7832642 - DNA, 22 bp, Homo sapiens
aagggaggggatgtaagcctgg

SEQ ID NO: 7832643 - DNA, 22 bp, Homo sapiens
aagggcaggaaaagatggatgt

SEQ ID NO: 7832644 - DNA, 22 bp, Homo sapiens
aagggcaggaaaagatggatgt

SEQ ID NO: 7832645 - DNA, 22 bp, Homo sapiens
aagggcaggaaaagatggatgt

SEQ ID NO: 7832646 - DNA, 22 bp, Homo sapiens
aaggctgacgtttgtgtttatt

SEQ ID NO: 7832647 - DNA, 22 bp, Homo sapiens
aaggctgactcaacagggggcc

SEQ ID NO: 7832648 - DNA, 22 bp, Homo sapiens
aaggctgacgtttgtgtttatt

SEQ ID NO: 7832649 - DNA, 22 bp, Homo sapiens
aaggctgacgtttgtgtttatt

SEQ ID NO: 7832650 - DNA, 22 bp, Homo sapiens
aaggctgacgtttgtgtttatt

SEQ ID NO: 7832651 - DNA, 22 bp, Homo sapiens
aaggctgactcaacagggggcc

SEQ ID NO: 7832652 - DNA, 22 bp, Homo sapiens
aaggctgactcaacagggggcc

SEQ ID NO: 7832653 - DNA, 21 bp, Homo sapiens
aaggctgagacaactcaggag

SEQ ID NO: 7832654 - DNA, 22 bp, Homo sapiens
aaggctgaccagtttacacttt

SEQ ID NO: 7832655 - DNA, 22 bp, Homo sapiens
aaggctgaccagtttacacttt

SEQ ID NO: 7832656 - DNA, 22 bp, Homo sapiens
aaggctgaccagtttacacttt

SEQ ID NO: 7832657 - DNA, 22 bp, Homo sapiens
aaggctgaccagtttacacttt

SEQ ID NO: 7832658 - DNA, 22 bp, Homo sapiens
aaggctgaccagtttacacttt

SEQ ID NO: 7832659 - DNA, 22 bp, Homo sapiens
aaggctgaccagtttacacttt

SEQ ID NO: 7832660 - DNA, 22 bp, Homo sapiens
aaggctgaattcaagggtaggc

SEQ ID NO: 7832661 - DNA, 22 bp, Homo sapiens
aaggctgaattcaagggtaggc

SEQ ID NO: 7832662 - DNA, 22 bp, Homo sapiens
aagggaggggatgtaagcctgg

SEQ ID NO: 7832663 - DNA, 22 bp, Homo sapiens
aagggaggggatgtaagcctgg

SEQ ID NO: 7832664 - DNA, 22 bp, Homo sapiens
aaggctgagagtcacagtccta

SEQ ID NO: 7832665 - DNA, 22 bp, Homo sapiens
aagggaggccagaggttttgca

SEQ ID NO: 7832666 - DNA, 22 bp, Homo sapiens
aaggctgagacagcacaggtcc

SEQ ID NO: 7832667 - DNA, 22 bp, Homo sapiens
aaggctgagacagcacaggtcc

SEQ ID NO: 7832668 - DNA, 22 bp, Homo sapiens
aaggctgagagtcacagtccta

SEQ ID NO: 7832669 - DNA, 22 bp, Homo sapiens
aaggctgagacagcacaggtcc

SEQ ID NO: 7832670 - DNA, 21 bp, Homo sapiens
aaggctgagacaactcaggag

SEQ ID NO: 7832671 - DNA, 21 bp, Homo sapiens
aaggctgagacaactcaggag

SEQ ID NO: 7832672 - DNA, 22 bp, Homo sapiens
aaggccaggtccctgcagtgca

SEQ ID NO: 7832673 - DNA, 22 bp, Homo sapiens
aaggccaggtccctgcagtgca

SEQ ID NO: 7832674 - DNA, 23 bp, Homo sapiens
aaggccagagagaggctagtgtc

SEQ ID NO: 7832675 - DNA, 22 bp, Homo sapiens
aaggccaggtccctgcagtgca

SEQ ID NO: 7832676 - DNA, 23 bp, Homo sapiens
aaggccagagagaggctagtgtc

SEQ ID NO: 7832677 - DNA, 23 bp, Homo sapiens
aaggccagagagaggctagtgtc

SEQ ID NO: 7832678 - DNA, 22 bp, Homo sapiens
aaggccaggtccctgcagtgca

SEQ ID NO: 7832679 - DNA, 22 bp, Homo sapiens
aaggccaggtccctgcagtgca

SEQ ID NO: 7832680 - DNA, 23 bp, Homo sapiens
aaggccagagagaggctagtgtc

SEQ ID NO: 7832681 - DNA, 23 bp, Homo sapiens
aaggccagagagaggctagtgtc

SEQ ID NO: 7832682 - DNA, 22 bp, Homo sapiens
aaggcactgtactagttagtta

SEQ ID NO: 7832683 - DNA, 22 bp, Homo sapiens
aaggcactgtactagttagtta

SEQ ID NO: 7832684 - DNA, 22 bp, Homo sapiens
aaggccagactctggaatgaca

SEQ ID NO: 7832685 - DNA, 22 bp, Homo sapiens
aaggcactgctttgctgcgccc

SEQ ID NO: 7832686 - DNA, 22 bp, Homo sapiens
aaggcactgtactagttagtta

SEQ ID NO: 7832687 - DNA, 22 bp, Homo sapiens
aaggcactgagccagccgtctc

SEQ ID NO: 7832688 - DNA, 22 bp, Homo sapiens
aaggcactgctttgctgcgccc

SEQ ID NO: 7832689 - DNA, 22 bp, Homo sapiens
aaggcccacagaactgtctcca

SEQ ID NO: 7832690 - DNA, 22 bp, Homo sapiens
aaggcccacagaactgtctcca

SEQ ID NO: 7832691 - DNA, 22 bp, Homo sapiens
aaggcccagcctggagcttgtt

SEQ ID NO: 7832692 - DNA, 22 bp, Homo sapiens
aaggcccagcctggagcttgtt

SEQ ID NO: 7832693 - DNA, 22 bp, Homo sapiens
aaggccatgtaggaggcatgcg

SEQ ID NO: 7832694 - DNA, 22 bp, Homo sapiens
aaggcccacagaactgtctcca

SEQ ID NO: 7832695 - DNA, 22 bp, Homo sapiens
aaggccatgcacatcctaggca

SEQ ID NO: 7832696 - DNA, 22 bp, Homo sapiens
aaggccatgaccacttgctgtg

SEQ ID NO: 7832697 - DNA, 22 bp, Homo sapiens
aaggccagtggataaaacctct

SEQ ID NO: 7832698 - DNA, 22 bp, Homo sapiens
aaggccctggccccagcttctt

SEQ ID NO: 7832699 - DNA, 22 bp, Homo sapiens
aaggcccttccaccagtcctcg

SEQ ID NO: 7832700 - DNA, 22 bp, Homo sapiens
aaggccctgtctccaaatacag

SEQ ID NO: 7832701 - DNA, 22 bp, Homo sapiens
aaggccctggccccagcttctt

SEQ ID NO: 7832702 - DNA, 22 bp, Homo sapiens
aaggccctggagtttctggaca

SEQ ID NO: 7832703 - DNA, 22 bp, Homo sapiens
aaggccctcatgcgtcagagcc

SEQ ID NO: 7832704 - DNA, 22 bp, Homo sapiens
aaggccctggcaggaagcagga

SEQ ID NO: 7832705 - DNA, 22 bp, Homo sapiens
aaggcccttccaccagtcctcg

SEQ ID NO: 7832706 - DNA, 22 bp, Homo sapiens
aaggcccttcggcttcctcagc

SEQ ID NO: 7832707 - DNA, 22 bp, Homo sapiens
aaggcccttccaccagtcctcg

SEQ ID NO: 7832708 - DNA, 22 bp, Homo sapiens
aaggcccttccaccagtcctcg

SEQ ID NO: 7832709 - DNA, 22 bp, Homo sapiens
aaggcccttccaccagtcctcg

SEQ ID NO: 7832710 - DNA, 22 bp, Homo sapiens
aaggctgaattcaagggtaggc

SEQ ID NO: 7832711 - DNA, 22 bp, Homo sapiens
aaggctgaattcaagggtaggc

SEQ ID NO: 7832712 - DNA, 22 bp, Homo sapiens
aaggctgaaagaccttgaacct

SEQ ID NO: 7832713 - DNA, 22 bp, Homo sapiens
aaggcccagcctggagcttgtt

SEQ ID NO: 7832714 - DNA, 22 bp, Homo sapiens
aaggcccagcgtgacctcagtg

SEQ ID NO: 7832715 - DNA, 22 bp, Homo sapiens
aaggcccagcctggagcttgtt

SEQ ID NO: 7832716 - DNA, 22 bp, Homo sapiens
aaggcccagcgtgacctcagtg

SEQ ID NO: 7832717 - DNA, 22 bp, Homo sapiens
aaggcccaggctgccctgggca

SEQ ID NO: 7832718 - DNA, 22 bp, Homo sapiens
aaggcccaggctgccctgggca

SEQ ID NO: 7832719 - DNA, 22 bp, Homo sapiens
aaggcccagggattggaggtca

SEQ ID NO: 7832720 - DNA, 22 bp, Homo sapiens
aaggcccagcgtgacctcagtg

SEQ ID NO: 7832721 - DNA, 22 bp, Homo sapiens
aaggcccagcgtgacctcagtg

SEQ ID NO: 7832722 - DNA, 22 bp, Homo sapiens
aaggcccagcgtgacctcagtg

SEQ ID NO: 7832723 - DNA, 22 bp, Homo sapiens
aaggcccaggctgccctgggca

SEQ ID NO: 7832724 - DNA, 22 bp, Homo sapiens
aaggcccagggattggaggtca

SEQ ID NO: 7832725 - DNA, 22 bp, Homo sapiens
aaggcccagggattggaggtca

SEQ ID NO: 7832726 - DNA, 22 bp, Homo sapiens
aaggcccagggattggaggtca

SEQ ID NO: 7832727 - DNA, 22 bp, Homo sapiens
aaggcccaggggctctagggca

SEQ ID NO: 7832728 - DNA, 22 bp, Homo sapiens
aaggcccaggggctctagggca

SEQ ID NO: 7832729 - DNA, 22 bp, Homo sapiens
aaggcccaggggctctagggca

SEQ ID NO: 7832730 - DNA, 22 bp, Homo sapiens
aaggccctaatagagcacatat

SEQ ID NO: 7832731 - DNA, 22 bp, Homo sapiens
aaggccctagaatctatattgc

SEQ ID NO: 7832732 - DNA, 22 bp, Homo sapiens
aaggccctcatgcgtcagagcc

SEQ ID NO: 7832733 - DNA, 22 bp, Homo sapiens
aaggccctcatgcgtcagagcc

SEQ ID NO: 7832734 - DNA, 22 bp, Homo sapiens
aaaatgaggtcaatatcctttt

SEQ ID NO: 7832735 - DNA, 22 bp, Homo sapiens
aaaatgatatcctgacttttat

SEQ ID NO: 7832736 - DNA, 22 bp, Homo sapiens
aaaatgatatcctgacttttat

SEQ ID NO: 7832737 - DNA, 22 bp, Homo sapiens
aaaatgaggaacggatcatggc

SEQ ID NO: 7832738 - DNA, 22 bp, Homo sapiens
aaaatgaggaacggatcatggc

SEQ ID NO: 7832739 - DNA, 22 bp, Homo sapiens
aaaatgaggaacggatcatggc

SEQ ID NO: 7832740 - DNA, 22 bp, Homo sapiens
aaaatgaggaacggatcatggc

SEQ ID NO: 7832741 - DNA, 22 bp, Homo sapiens
aaaatgagccatgaaccaacca

SEQ ID NO: 7832742 - DNA, 22 bp, Homo sapiens
aaaatgaggaacggatcatggc

SEQ ID NO: 7832743 - DNA, 22 bp, Homo sapiens
aaaatgagccatgaaccaacca

SEQ ID NO: 7832744 - DNA, 22 bp, Homo sapiens
aaaatgagccatgaaccaacca

SEQ ID NO: 7832745 - DNA, 22 bp, Homo sapiens
aaaatgatgctgtaatttggca

SEQ ID NO: 7832746 - DNA, 22 bp, Homo sapiens
aaaatgatgctgtaatttggca

SEQ ID NO: 7832747 - DNA, 22 bp, Homo sapiens
aaaatgatgctgtaatttggca

SEQ ID NO: 7832748 - DNA, 22 bp, Homo sapiens
aaaatgatatcctgacttttat

SEQ ID NO: 7832749 - DNA, 22 bp, Homo sapiens
aaaatgatgctgtaatttggca

SEQ ID NO: 7832750 - DNA, 22 bp, Homo sapiens
aaaatgatgctgtaatttggca

SEQ ID NO: 7832751 - DNA, 22 bp, Homo sapiens
aaaatgatgctgtaatttggca

SEQ ID NO: 7832752 - DNA, 22 bp, Homo sapiens
aaaatgcaaacctacctacata

SEQ ID NO: 7832753 - DNA, 22 bp, Homo sapiens
aaaatgcaaacctacctacata

SEQ ID NO: 7832754 - DNA, 22 bp, Homo sapiens
aaaatgcaaacctacctacata

SEQ ID NO: 7832755 - DNA, 20 bp, Homo sapiens
aaaatgatgggcagggcagg

SEQ ID NO: 7832756 - DNA, 20 bp, Homo sapiens
aaaatgatgggcagggcagg

SEQ ID NO: 7832757 - DNA, 22 bp, Homo sapiens
aaaatgtaaagcttgagtgtag

SEQ ID NO: 7832758 - DNA, 22 bp, Homo sapiens
aaaatgtaaagcttgagtgtag

SEQ ID NO: 7832759 - DNA, 22 bp, Homo sapiens
aaaatgtaaagcttgagtgtag

SEQ ID NO: 7832760 - DNA, 22 bp, Homo sapiens
aaaatgtaaagcttgagtgtag

SEQ ID NO: 7832761 - DNA, 22 bp, Homo sapiens
aaaatgtaaagcttgagtgtag

SEQ ID NO: 7832762 - DNA, 22 bp, Homo sapiens
aaaatgtaaagcttgagtgtag

SEQ ID NO: 7832763 - DNA, 22 bp, Homo sapiens
aaaatgctgggaaagttggaat

SEQ ID NO: 7832764 - DNA, 22 bp, Homo sapiens
aaaatgctgggaaagttggaat

SEQ ID NO: 7832765 - DNA, 22 bp, Homo sapiens
aaaatgctgggaaagttggaat

SEQ ID NO: 7832766 - DNA, 18 bp, Homo sapiens
aaaatgcaggcgacatgg

SEQ ID NO: 7832767 - DNA, 18 bp, Homo sapiens
aaaatgcaggcgacatgg

SEQ ID NO: 7832768 - DNA, 18 bp, Homo sapiens
aaaatgcaggcgacatgg

SEQ ID NO: 7832769 - DNA, 18 bp, Homo sapiens
aaaatgcaggcgacatgg

SEQ ID NO: 7832770 - DNA, 18 bp, Homo sapiens
aaaatgcaggcgacatgg

SEQ ID NO: 7832771 - DNA, 22 bp, Homo sapiens
aaaatgcatgagaatgtgctcg

SEQ ID NO: 7832772 - DNA, 22 bp, Homo sapiens
aaaatgcatgagaatgtgctcg

SEQ ID NO: 7832773 - DNA, 22 bp, Homo sapiens
aaaatgcatgagaatgtgctcg

SEQ ID NO: 7832774 - DNA, 22 bp, Homo sapiens
aaaatgcatgagaatgtgctcg

SEQ ID NO: 7832775 - DNA, 22 bp, Homo sapiens
aaaatgctatttcatggaggag

SEQ ID NO: 7832776 - DNA, 22 bp, Homo sapiens
aaaatgctatttcatggaggag

SEQ ID NO: 7832777 - DNA, 22 bp, Homo sapiens
aaaatgcatgagaatgtgctcg

SEQ ID NO: 7832778 - DNA, 22 bp, Homo sapiens
aaagcaggcagcaggctggatt

SEQ ID NO: 7832779 - DNA, 22 bp, Homo sapiens
aaagcaggcagcaggctggatt

SEQ ID NO: 7832780 - DNA, 22 bp, Homo sapiens
aaagcaggcagcaggctggatt

SEQ ID NO: 7832781 - DNA, 22 bp, Homo sapiens
aaagcagctgctctggccttga

SEQ ID NO: 7832782 - DNA, 22 bp, Homo sapiens
aaagcagctgctctggccttga

SEQ ID NO: 7832783 - DNA, 22 bp, Homo sapiens
aaagcagctgtttgactttcca

SEQ ID NO: 7832784 - DNA, 22 bp, Homo sapiens
aaagcagctgtttgactttcca

SEQ ID NO: 7832785 - DNA, 22 bp, Homo sapiens
aaagcagctgatctcagagcct

SEQ ID NO: 7832786 - DNA, 22 bp, Homo sapiens
aaagcagctgatctcagagcct

SEQ ID NO: 7832787 - DNA, 22 bp, Homo sapiens
aaagcagctgatagtctcatct

SEQ ID NO: 7832788 - DNA, 22 bp, Homo sapiens
aaagcagcggtgtctttactgc

SEQ ID NO: 7832789 - DNA, 22 bp, Homo sapiens
aaagcagggtccaaggagatgt

SEQ ID NO: 7832790 - DNA, 22 bp, Homo sapiens
aaagcagggtccaaggagatgt

SEQ ID NO: 7832791 - DNA, 22 bp, Homo sapiens
aaagcagggtccaaggagatgt

SEQ ID NO: 7832792 - DNA, 22 bp, Homo sapiens
aaagcagggtccaaggagatgt

SEQ ID NO: 7832793 - DNA, 22 bp, Homo sapiens
aaagcagggtccaaggagatgt

SEQ ID NO: 7832794 - DNA, 22 bp, Homo sapiens
aaagcagggtccaaggagatgt

SEQ ID NO: 7832795 - DNA, 22 bp, Homo sapiens
aaagcagggatgaggctagagg

SEQ ID NO: 7832796 - DNA, 22 bp, Homo sapiens
aaagcagggatgaggctagagg

SEQ ID NO: 7832797 - DNA, 22 bp, Homo sapiens
aaagcagggatgaggctagagg

SEQ ID NO: 7832798 - DNA, 22 bp, Homo sapiens
aaagcagggatgaggctagagg

SEQ ID NO: 7832799 - DNA, 22 bp, Homo sapiens
aaagcagccacagagagagcgt

SEQ ID NO: 7832800 - DNA, 22 bp, Homo sapiens
aaagcagcagcacgtggaagag

SEQ ID NO: 7832801 - DNA, 22 bp, Homo sapiens
aaagcagcagcacgtggaagag

SEQ ID NO: 7832802 - DNA, 22 bp, Homo sapiens
aaagcagcagcacctgcatttc

SEQ ID NO: 7832803 - DNA, 22 bp, Homo sapiens
aaagcagcagaatctctcaggg

SEQ ID NO: 7832804 - DNA, 22 bp, Homo sapiens
aaagcagcagaatctctcaggg

SEQ ID NO: 7832805 - DNA, 22 bp, Homo sapiens
aaagcagccacagagagagcgt

SEQ ID NO: 7832806 - DNA, 22 bp, Homo sapiens
aaagcagccactctctctgcct

SEQ ID NO: 7832807 - DNA, 22 bp, Homo sapiens
aaagcagccactctctctgcct

SEQ ID NO: 7832808 - DNA, 22 bp, Homo sapiens
aaagcagcctgctcatcctgga

SEQ ID NO: 7832809 - DNA, 22 bp, Homo sapiens
aaagcagcctgctcatcctgga

SEQ ID NO: 7832810 - DNA, 22 bp, Homo sapiens
aaagcaatggatgagaatctgt

SEQ ID NO: 7832811 - DNA, 22 bp, Homo sapiens
aaagcaatggatgagaatctgt

SEQ ID NO: 7832812 - DNA, 22 bp, Homo sapiens
aaagcaatggcacatgatggta

SEQ ID NO: 7832813 - DNA, 22 bp, Homo sapiens
aaagcagcagaaagctggcccc

SEQ ID NO: 7832814 - DNA, 22 bp, Homo sapiens
aaagcaatggcacatgatggta

SEQ ID NO: 7832815 - DNA, 22 bp, Homo sapiens
aaagcagcagaatctctcaggg

SEQ ID NO: 7832816 - DNA, 22 bp, Homo sapiens
aaagcagcagaaagctggcccc

SEQ ID NO: 7832817 - DNA, 22 bp, Homo sapiens
aaaatgtatgatggaggtgcta

SEQ ID NO: 7832818 - DNA, 22 bp, Homo sapiens
aaaatgtatgatggaggtgcta

SEQ ID NO: 7832819 - DNA, 21 bp, Homo sapiens
aaaatgtagacttttccctga

SEQ ID NO: 7832820 - DNA, 21 bp, Homo sapiens
aaaatgtagacttttccctga

SEQ ID NO: 7832821 - DNA, 21 bp, Homo sapiens
aaaatgtagacttttccctga

SEQ ID NO: 7832822 - DNA, 21 bp, Homo sapiens
aaaatgtagacttttccctga

SEQ ID NO: 7832823 - DNA, 22 bp, Homo sapiens
aaaatgtatgatggaggtgcta

SEQ ID NO: 7832824 - DNA, 22 bp, Homo sapiens
aaaatgtctgctgttggtttat

SEQ ID NO: 7832825 - DNA, 22 bp, Homo sapiens
aaaagtttaagactcattctag

SEQ ID NO: 7832826 - DNA, 21 bp, Homo sapiens
aaaagtttgacaggaaaggga

SEQ ID NO: 7832827 - DNA, 22 bp, Homo sapiens
aaaagtttaagactcattctag

SEQ ID NO: 7832828 - DNA, 22 bp, Homo sapiens
aaaagtttaagactcattctag

SEQ ID NO: 7832829 - DNA, 22 bp, Homo sapiens
aaaagtttaagactcattctag

SEQ ID NO: 7832830 - DNA, 22 bp, Homo sapiens
aaaagtttaagactcattctag

SEQ ID NO: 7832831 - DNA, 22 bp, Homo sapiens
aaaagtttaagactcattctag

SEQ ID NO: 7832832 - DNA, 22 bp, Homo sapiens
aaaagttccctggttagaaaag

SEQ ID NO: 7832833 - DNA, 22 bp, Homo sapiens
aaaagttccctggttagaaaag

SEQ ID NO: 7832834 - DNA, 22 bp, Homo sapiens
aaaagttagctattagtaggtg

SEQ ID NO: 7832835 - DNA, 22 bp, Homo sapiens
aaaagttattgatgcaggacaa

SEQ ID NO: 7832836 - DNA, 22 bp, Homo sapiens
aaaagttcattagtgagcttct

SEQ ID NO: 7832837 - DNA, 22 bp, Homo sapiens
aaaagttcattagtgagcttct

SEQ ID NO: 7832838 - DNA, 22 bp, Homo sapiens
aaaagttacctctgtaatataa

SEQ ID NO: 7832839 - DNA, 22 bp, Homo sapiens
aaaagttagctattagtaggtg

SEQ ID NO: 7832840 - DNA, 22 bp, Homo sapiens
aaaagttacctctgtaatataa

SEQ ID NO: 7832841 - DNA, 22 bp, Homo sapiens
aaaagttacctctgtaatataa

SEQ ID NO: 7832842 - DNA, 22 bp, Homo sapiens
aaaagttacctctgtaatataa

SEQ ID NO: 7832843 - DNA, 22 bp, Homo sapiens
aaaagttacctctgtaatataa

SEQ ID NO: 7832844 - DNA, 22 bp, Homo sapiens
aaaagttacctctgtaatataa

SEQ ID NO: 7832845 - DNA, 22 bp, Homo sapiens
aaaagttacctctgtaatataa

SEQ ID NO: 7832846 - DNA, 22 bp, Homo sapiens
aaaagttaactgtgttcatgca

SEQ ID NO: 7832847 - DNA, 22 bp, Homo sapiens
aaaagttaactgtgttcatgca

SEQ ID NO: 7832848 - DNA, 22 bp, Homo sapiens
aaaagttaactgtgttcatgca

SEQ ID NO: 7832849 - DNA, 22 bp, Homo sapiens
aaaagtgtccagattatgaaga

SEQ ID NO: 7832850 - DNA, 22 bp, Homo sapiens
aaaagtgttcaggaagaataat

SEQ ID NO: 7832851 - DNA, 22 bp, Homo sapiens
aaaagtgttcaggaagaataat

SEQ ID NO: 7832852 - DNA, 22 bp, Homo sapiens
aaaagtgttcaggaagaataat

SEQ ID NO: 7832853 - DNA, 19 bp, Homo sapiens
aaaaggaatattctttggg

SEQ ID NO: 7832854 - DNA, 19 bp, Homo sapiens
aaaaggaatattctttggg

SEQ ID NO: 7832855 - DNA, 19 bp, Homo sapiens
aaaaggaatattctttggg

SEQ ID NO: 7832856 - DNA, 19 bp, Homo sapiens
aaaaggaatattctttggg

SEQ ID NO: 7832857 - DNA, 22 bp, Homo sapiens
aaaagtattttgagcactttat

SEQ ID NO: 7832858 - DNA, 22 bp, Homo sapiens
aaaagtatttatggctatgtaa

SEQ ID NO: 7832859 - DNA, 21 bp, Homo sapiens
aaaaggaaggtctgtttgggg

SEQ ID NO: 7832860 - DNA, 19 bp, Homo sapiens
aaaaggaatattctttggg

SEQ ID NO: 7832861 - DNA, 21 bp, Homo sapiens
aaaaggaaggtctgtttgggg

SEQ ID NO: 7832862 - DNA, 22 bp, Homo sapiens
aaaagctctttctgctgtagat

SEQ ID NO: 7832863 - DNA, 22 bp, Homo sapiens
aaaagctagtcaatgatgtatt

SEQ ID NO: 7832864 - DNA, 22 bp, Homo sapiens
aaaagctctttctgctgtagat

SEQ ID NO: 7832865 - DNA, 22 bp, Homo sapiens
aaaataacttctactatttgca

SEQ ID NO: 7832866 - DNA, 22 bp, Homo sapiens
aaaataacttctactatttgca

SEQ ID NO: 7832867 - DNA, 22 bp, Homo sapiens
aaaataacttctactatttgca

SEQ ID NO: 7832868 - DNA, 22 bp, Homo sapiens
aaaataacttctactatttgca

SEQ ID NO: 7832869 - DNA, 18 bp, Homo sapiens
aaaataacaaagttggct

SEQ ID NO: 7832870 - DNA, 18 bp, Homo sapiens
aaaataacaaagttggct

SEQ ID NO: 7832871 - DNA, 18 bp, Homo sapiens
aaaataacaaagttggct

SEQ ID NO: 7832872 - DNA, 18 bp, Homo sapiens
aaaataacaaagttggct

SEQ ID NO: 7832873 - DNA, 22 bp, Homo sapiens
aaaagtttgtgcaaacactcag

SEQ ID NO: 7832874 - DNA, 22 bp, Homo sapiens
aaaagtttgtgcaaacactcag

SEQ ID NO: 7832875 - DNA, 21 bp, Homo sapiens
aaaagtttgacaggaaaggga

SEQ ID NO: 7832876 - DNA, 22 bp, Homo sapiens
aaaagtttgtgcaaacactcag

SEQ ID NO: 7832877 - DNA, 22 bp, Homo sapiens
aaaagtttgtgcaaacactcag

SEQ ID NO: 7832878 - DNA, 21 bp, Homo sapiens
aaaagtttgacaggaaaggga

SEQ ID NO: 7832879 - DNA, 22 bp, Homo sapiens
aaaataacttctactatttgca

SEQ ID NO: 7832880 - DNA, 22 bp, Homo sapiens
aaaataacttctactatttgca

SEQ ID NO: 7832881 - DNA, 22 bp, Homo sapiens
aaaataacttctactatttgca

SEQ ID NO: 7832882 - DNA, 22 bp, Homo sapiens
aaaataacttctactatttgca

SEQ ID NO: 7832883 - DNA, 22 bp, Homo sapiens
aaaataacttctactatttgca

SEQ ID NO: 7832884 - DNA, 22 bp, Homo sapiens
aaaatacacatactaggggaaa

SEQ ID NO: 7832885 - DNA, 22 bp, Homo sapiens
aaaatacacatactaggggaaa

SEQ ID NO: 7832886 - DNA, 22 bp, Homo sapiens
aaaataagttggtcctgtcctt

SEQ ID NO: 7832887 - DNA, 22 bp, Homo sapiens
aaaatacacatactaggggaaa

SEQ ID NO: 7832888 - DNA, 22 bp, Homo sapiens
aaaatacacatactaggggaaa

SEQ ID NO: 7832889 - DNA, 22 bp, Homo sapiens
aaaatgagacacatgtgactcc

SEQ ID NO: 7832890 - DNA, 22 bp, Homo sapiens
aaaatgagatacagtttgaaag

SEQ ID NO: 7832891 - DNA, 22 bp, Homo sapiens
aaaatgagacacatgtgactcc

SEQ ID NO: 7832892 - DNA, 22 bp, Homo sapiens
aaaatgagcatattgatccttt

SEQ ID NO: 7832893 - DNA, 22 bp, Homo sapiens
aaaatctggcaacactaagttt

SEQ ID NO: 7832894 - DNA, 22 bp, Homo sapiens
aaaatctggcaacactaagttt

SEQ ID NO: 7832895 - DNA, 22 bp, Homo sapiens
aaaatctggcaacactaagttt

SEQ ID NO: 7832896 - DNA, 22 bp, Homo sapiens
aaaatctgcttccttttacaga

SEQ ID NO: 7832897 - DNA, 22 bp, Homo sapiens
aaaatctggcaacactaagttt

SEQ ID NO: 7832898 - DNA, 22 bp, Homo sapiens
aaaatactactgtcttcttccc

SEQ ID NO: 7832899 - DNA, 22 bp, Homo sapiens
aaaatactactgtcttcttccc

SEQ ID NO: 7832900 - DNA, 22 bp, Homo sapiens
aaaatactactgtcttcttccc

SEQ ID NO: 7832901 - DNA, 22 bp, Homo sapiens
aaaatacacatactaggggaaa

SEQ ID NO: 7832902 - DNA, 22 bp, Homo sapiens
aaaatactactgtcttcttccc

SEQ ID NO: 7832903 - DNA, 22 bp, Homo sapiens
aaaatactactgtcttcttccc

SEQ ID NO: 7832904 - DNA, 22 bp, Homo sapiens
aaaatactgtggagtgttgaaa

SEQ ID NO: 7832905 - DNA, 22 bp, Homo sapiens
aaaatactgtggagtgttgaaa

SEQ ID NO: 7832906 - DNA, 22 bp, Homo sapiens
aaaatactgtggagtgttgaaa

SEQ ID NO: 7832907 - DNA, 22 bp, Homo sapiens
aaaatactgtggagtgttgaaa

SEQ ID NO: 7832908 - DNA, 22 bp, Homo sapiens
aaaatactactgtcttcttccc

SEQ ID NO: 7832909 - DNA, 22 bp, Homo sapiens
aaaatactactgtcttcttccc

SEQ ID NO: 7832910 - DNA, 22 bp, Homo sapiens
aaaatactactgtcttcttccc

SEQ ID NO: 7832911 - DNA, 22 bp, Homo sapiens
aaaacattttactgccatctca

SEQ ID NO: 7832912 - DNA, 22 bp, Homo sapiens
aaaacattttactgccatctca

SEQ ID NO: 7832913 - DNA, 22 bp, Homo sapiens
aaaacattgaattgcacactat

SEQ ID NO: 7832914 - DNA, 22 bp, Homo sapiens
aaaacattgaattgcacactat

SEQ ID NO: 7832915 - DNA, 22 bp, Homo sapiens
aaaacattttactgccatctca

SEQ ID NO: 7832916 - DNA, 22 bp, Homo sapiens
aaaacattctgtgaactctcaa

SEQ ID NO: 7832917 - DNA, 22 bp, Homo sapiens
aaaacattgaattgcacactat

SEQ ID NO: 7832918 - DNA, 22 bp, Homo sapiens
aaaacattgaattgcacactat

SEQ ID NO: 7832919 - DNA, 22 bp, Homo sapiens
aaaacattctgtgaactctcaa

SEQ ID NO: 7832920 - DNA, 22 bp, Homo sapiens
aaaacattctgtgaactctcaa

SEQ ID NO: 7832921 - DNA, 22 bp, Homo sapiens
aaaacatgtccatacagaaact

SEQ ID NO: 7832922 - DNA, 22 bp, Homo sapiens
aaaacatgtccatacagaaact

SEQ ID NO: 7832923 - DNA, 22 bp, Homo sapiens
aaaacatgtccatacagaaact

SEQ ID NO: 7832924 - DNA, 22 bp, Homo sapiens
aaaacatgtccatacagaaact

SEQ ID NO: 7832925 - DNA, 22 bp, Homo sapiens
aaaacatgtccatacagaaact

SEQ ID NO: 7832926 - DNA, 22 bp, Homo sapiens
aaaacatgtccatacagaaact

SEQ ID NO: 7832927 - DNA, 22 bp, Homo sapiens
aaaacatgtccatacagaaact

SEQ ID NO: 7832928 - DNA, 22 bp, Homo sapiens
aaaacatgtccatacagaaact

SEQ ID NO: 7832929 - DNA, 22 bp, Homo sapiens
aaaacatgtccatacagaaact

SEQ ID NO: 7832930 - DNA, 22 bp, Homo sapiens
aaaacatgtccatacagaaact

SEQ ID NO: 7832931 - DNA, 22 bp, Homo sapiens
aaaacatgtccatacagaaact

SEQ ID NO: 7832932 - DNA, 22 bp, Homo sapiens
aaaacatgtccatacagaaact

SEQ ID NO: 7832933 - DNA, 22 bp, Homo sapiens
aaaaccaagttttccttagtct

SEQ ID NO: 7832934 - DNA, 22 bp, Homo sapiens
aaaaccaggcgtttcctattat

SEQ ID NO: 7832935 - DNA, 22 bp, Homo sapiens
aaaaccagacactgtttctggg

SEQ ID NO: 7832936 - DNA, 22 bp, Homo sapiens
aaaagagtgactgataagtata

SEQ ID NO: 7832937 - DNA, 22 bp, Homo sapiens
aaaagagtcttaggcagtcata

SEQ ID NO: 7832938 - DNA, 22 bp, Homo sapiens
aaaagagtgactgataagtata

SEQ ID NO: 7832939 - DNA, 22 bp, Homo sapiens
aaaagagtgactgataagtata

SEQ ID NO: 7832940 - DNA, 22 bp, Homo sapiens
aaaagagtcttaggcagtcata

SEQ ID NO: 7832941 - DNA, 22 bp, Homo sapiens
aaaagagtcttaggcagtcata

SEQ ID NO: 7832942 - DNA, 22 bp, Homo sapiens
aaaagagtcttaggcagtcata

SEQ ID NO: 7832943 - DNA, 22 bp, Homo sapiens
aaaagagtcttaggcagtcata

SEQ ID NO: 7832944 - DNA, 22 bp, Homo sapiens
aaaaccaagttttccttagtct

SEQ ID NO: 7832945 - DNA, 22 bp, Homo sapiens
aaaaccacaaaagtggcttggt

SEQ ID NO: 7832946 - DNA, 22 bp, Homo sapiens
aaaaccacaatgacttttgcac

SEQ ID NO: 7832947 - DNA, 22 bp, Homo sapiens
aaaaccacaatgacttttgcag

SEQ ID NO: 7832948 - DNA, 22 bp, Homo sapiens
aaaaccacaattacttttgcac

SEQ ID NO: 7832949 - DNA, 22 bp, Homo sapiens
aaaaccacaattatttttgcac

SEQ ID NO: 7832950 - DNA, 22 bp, Homo sapiens
aaaaccacagttacttttgcac

SEQ ID NO: 7832951 - DNA, 22 bp, Homo sapiens
aaaaccacttccttgctattgg

SEQ ID NO: 7832952 - DNA, 22 bp, Homo sapiens
aaaaccagacactgtttctggg

SEQ ID NO: 7832953 - DNA, 22 bp, Homo sapiens
aaaaccagacactgtttctggg

SEQ ID NO: 7832954 - DNA, 22 bp, Homo sapiens
aaaaatttatggttcttctctg

SEQ ID NO: 7832955 - DNA, 22 bp, Homo sapiens
aaaacacaagaagcagggtaca

SEQ ID NO: 7832956 - DNA, 22 bp, Homo sapiens
aaaacacaagaagcagggtaca

SEQ ID NO: 7832957 - DNA, 22 bp, Homo sapiens
aaaacacaagaagcagggtaca

SEQ ID NO: 7832958 - DNA, 22 bp, Homo sapiens
aaaacacaagaagcagggtaca

SEQ ID NO: 7832959 - DNA, 22 bp, Homo sapiens
aaaacacaagaagcagggtaca

SEQ ID NO: 7832960 - DNA, 22 bp, Homo sapiens
aaaacacaagaagcagggtaca

SEQ ID NO: 7832961 - DNA, 22 bp, Homo sapiens
aaaaatttatggttcttctctg

SEQ ID NO: 7832962 - DNA, 22 bp, Homo sapiens
aaaaatttatggttcttctctg

SEQ ID NO: 7832963 - DNA, 22 bp, Homo sapiens
aaaaatttatggttcttctctg

SEQ ID NO: 7832964 - DNA, 22 bp, Homo sapiens
aaaaatttatggttcttctctg

SEQ ID NO: 7832965 - DNA, 20 bp, Homo sapiens
aaaaattgatatcgcttcct

SEQ ID NO: 7832966 - DNA, 20 bp, Homo sapiens
aaaaattgatatcgcttcct

SEQ ID NO: 7832967 - DNA, 22 bp, Homo sapiens
aaaaattgctgagaacggaatt

SEQ ID NO: 7832968 - DNA, 22 bp, Homo sapiens
aaaaattgctgagaacggaatt

SEQ ID NO: 7832969 - DNA, 22 bp, Homo sapiens
aaaaatgttatctactgtccga

SEQ ID NO: 7832970 - DNA, 22 bp, Homo sapiens
aaaaatgttatctactgtccga

SEQ ID NO: 7832971 - DNA, 22 bp, Homo sapiens
aaaaatgttatctactgtccga

SEQ ID NO: 7832972 - DNA, 22 bp, Homo sapiens
aaaaatgttatctactgtccga

SEQ ID NO: 7832973 - DNA, 22 bp, Homo sapiens
aaaaatgttatctactgtccga

SEQ ID NO: 7832974 - DNA, 22 bp, Homo sapiens
aaaaatgttatctactgtccga

SEQ ID NO: 7832975 - DNA, 22 bp, Homo sapiens
aaaaatgttatctactgtccga

SEQ ID NO: 7832976 - DNA, 22 bp, Homo sapiens
aaaaatgtgaccacagggtgtt

SEQ ID NO: 7832977 - DNA, 22 bp, Homo sapiens
aaaaatgtgaccacagggtgtt

SEQ ID NO: 7832978 - DNA, 22 bp, Homo sapiens
aaaaatgaaacggctggttggc

SEQ ID NO: 7832979 - DNA, 22 bp, Homo sapiens
aaaaatgaaacggctggttggc

SEQ ID NO: 7832980 - DNA, 22 bp, Homo sapiens
aaaaatgaaacggctggttggc

SEQ ID NO: 7832981 - DNA, 22 bp, Homo sapiens
aaaaatgaaacggctggttggc

SEQ ID NO: 7832982 - DNA, 22 bp, Homo sapiens
aaaagcaagaggctggattaaa

SEQ ID NO: 7832983 - DNA, 22 bp, Homo sapiens
aaaagcaagaggctggattaaa

SEQ ID NO: 7832984 - DNA, 22 bp, Homo sapiens
aaaagcaagaggctggattaaa

SEQ ID NO: 7832985 - DNA, 22 bp, Homo sapiens
aaaagcaagaggctggattaaa

SEQ ID NO: 7832986 - DNA, 22 bp, Homo sapiens
aaaagcaagaggctggattaaa

SEQ ID NO: 7832987 - DNA, 22 bp, Homo sapiens
aaaagatgaaatggtgtcttgg

SEQ ID NO: 7832988 - DNA, 22 bp, Homo sapiens
aaaagattgttagggagaatgt

SEQ ID NO: 7832989 - DNA, 22 bp, Homo sapiens
aaaagcaagaggctggattaaa

SEQ ID NO: 7832990 - DNA, 22 bp, Homo sapiens
aaaagattgttagggagaatgt

SEQ ID NO: 7832991 - DNA, 22 bp, Homo sapiens
aaaagagtgactgataagtata

SEQ ID NO: 7832992 - DNA, 20 bp, Homo sapiens
aaaagagtgcttcaactgct

SEQ ID NO: 7832993 - DNA, 22 bp, Homo sapiens
aaaagagtgtttcaactttggc

SEQ ID NO: 7832994 - DNA, 20 bp, Homo sapiens
aaaagagtgcttcaactgct

SEQ ID NO: 7832995 - DNA, 22 bp, Homo sapiens
aaaagatgaaatggtgtcttgg

SEQ ID NO: 7832996 - DNA, 22 bp, Homo sapiens
aaaagatgaaatggtgtcttgg

SEQ ID NO: 7832997 - DNA, 22 bp, Homo sapiens
aaaagatgaaatggtgtcttgg

SEQ ID NO: 7832998 - DNA, 22 bp, Homo sapiens
aaaagcaaggcagtctgtctga

SEQ ID NO: 7832999 - DNA, 22 bp, Homo sapiens
aaaagcaaggcagtctgtctga

SEQ ID NO: 7833000 - DNA, 22 bp, Homo sapiens
aaaagcaaggcagtctgtctga

SEQ ID NO: 7833001 - DNA, 22 bp, Homo sapiens
aaaagcaagttgcctaggttga

SEQ ID NO: 7833002 - DNA, 22 bp, Homo sapiens
aaaagcaagttgcctaggttga

SEQ ID NO: 7833003 - DNA, 22 bp, Homo sapiens
aaaagcaagttgcctaggttga

SEQ ID NO: 7833004 - DNA, 22 bp, Homo sapiens
aaaagcaagttgcctaggttga

SEQ ID NO: 7833005 - DNA, 22 bp, Homo sapiens
aaaagcaaggcagtctgtctga

SEQ ID NO: 7833006 - DNA, 22 bp, Homo sapiens
aaaagcaagaggctggattaaa

SEQ ID NO: 7833007 - DNA, 22 bp, Homo sapiens
aaaagcaagaggctggattaaa

SEQ ID NO: 7833008 - DNA, 22 bp, Homo sapiens
aaaagcaaggcagtctgtctga

SEQ ID NO: 7833009 - DNA, 22 bp, Homo sapiens
aaaagcaaggcagtctgtctga

SEQ ID NO: 7833010 - DNA, 22 bp, Homo sapiens
aaaagcaaggcagtctgtctga

SEQ ID NO: 7833011 - DNA, 22 bp, Homo sapiens
aaaagccaaggtcctcttcaga

SEQ ID NO: 7833012 - DNA, 22 bp, Homo sapiens
aaaagccatgcatacctaagag

SEQ ID NO: 7833013 - DNA, 22 bp, Homo sapiens
aaaagctagtcaatgatgtatt

SEQ ID NO: 7833014 - DNA, 22 bp, Homo sapiens
aaaagcctggatactatcatta

SEQ ID NO: 7833015 - DNA, 22 bp, Homo sapiens
aaaagcagtttatagtcagttg

SEQ ID NO: 7833016 - DNA, 22 bp, Homo sapiens
aaaagcatctcaaaggagcttc

SEQ ID NO: 7833017 - DNA, 22 bp, Homo sapiens
aaaagccaaggtcctcttcaga

SEQ ID NO: 7833018 - DNA, 22 bp, Homo sapiens
aaaagccaaggtcctcttcaga

SEQ ID NO: 7833019 - DNA, 22 bp, Homo sapiens
aaaagccaaggtcctcttcaga

SEQ ID NO: 7833020 - DNA, 22 bp, Homo sapiens
aaaagcattacatggtacgtat

SEQ ID NO: 7833021 - DNA, 22 bp, Homo sapiens
aaaagcaggtactcagcttggg

SEQ ID NO: 7833022 - DNA, 22 bp, Homo sapiens
aaaagcaggtactcagcttggg

SEQ ID NO: 7833023 - DNA, 22 bp, Homo sapiens
aaaagcaggtactcagcttggg

SEQ ID NO: 7833024 - DNA, 20 bp, Homo sapiens
aaaagcagccagagatggta

SEQ ID NO: 7833025 - DNA, 20 bp, Homo sapiens
aaaagcagccagagatggta

SEQ ID NO: 7833026 - DNA, 20 bp, Homo sapiens
aaaagcagccagagatggta

SEQ ID NO: 7833027 - DNA, 20 bp, Homo sapiens
aaaagcagccagagatggta

SEQ ID NO: 7833028 - DNA, 20 bp, Homo sapiens
aaaagcagccagagatggta

SEQ ID NO: 7833029 - DNA, 22 bp, Homo sapiens
aaaagcagtaaatgtatgacct

SEQ ID NO: 7833030 - DNA, 22 bp, Homo sapiens
aaaagcagttatctgggaggaa

SEQ ID NO: 7833031 - DNA, 22 bp, Homo sapiens
aaaagcagttatctgggaggaa

SEQ ID NO: 7833032 - DNA, 22 bp, Homo sapiens
aaaagcagttatctgggaggaa

SEQ ID NO: 7833033 - DNA, 22 bp, Homo sapiens
aaaagcagtttatagtcagttg

SEQ ID NO: 7833034 - DNA, 22 bp, Homo sapiens
aaaagcagtttatagtcagttg

SEQ ID NO: 7833035 - DNA, 22 bp, Homo sapiens
aaaagcaattgcgggttttgcc

SEQ ID NO: 7833036 - DNA, 22 bp, Homo sapiens
aaaagcaattgcgggttttgcc

SEQ ID NO: 7833037 - DNA, 22 bp, Homo sapiens
aaaagcaattgcgggttttgcc

SEQ ID NO: 7833038 - DNA, 22 bp, Homo sapiens
aaaagcaattgcgggttttgcc

SEQ ID NO: 7833039 - DNA, 22 bp, Homo sapiens
aaaagcaattgcagttcttgcc

SEQ ID NO: 7833040 - DNA, 22 bp, Homo sapiens
aaaagcaagttgcctaggttga

SEQ ID NO: 7833041 - DNA, 22 bp, Homo sapiens
aaaagcaagttgcctaggttga

SEQ ID NO: 7833042 - DNA, 22 bp, Homo sapiens
aaaagcaattgcagttcttgcc

SEQ ID NO: 7833043 - DNA, 22 bp, Homo sapiens
aaaagcaattgcagttcttgcc

SEQ ID NO: 7833044 - DNA, 22 bp, Homo sapiens
aaaagcaattgcagttcttgcc

SEQ ID NO: 7833045 - DNA, 22 bp, Homo sapiens
aaaagcaattgcagttcttgcc

SEQ ID NO: 7833046 - DNA, 22 bp, Homo sapiens
aaaagcaagttgcctaggttga

SEQ ID NO: 7833047 - DNA, 22 bp, Homo sapiens
aaaagcaagttgcctaggttga

SEQ ID NO: 7833048 - DNA, 22 bp, Homo sapiens
aaaagcaagttgcctaggttga

SEQ ID NO: 7833049 - DNA, 22 bp, Homo sapiens
aaaagcagaccacgctttgtgg

SEQ ID NO: 7833050 - DNA, 22 bp, Homo sapiens
aaaagcactacaatttcgcttc

SEQ ID NO: 7833051 - DNA, 22 bp, Homo sapiens
aaaagcagaccacgctttgtgg

SEQ ID NO: 7833052 - DNA, 22 bp, Homo sapiens
aaaagcagagactctggagcta

SEQ ID NO: 7833053 - DNA, 22 bp, Homo sapiens
aaaagcagatctccaaagtcta

SEQ ID NO: 7833054 - DNA, 20 bp, Homo sapiens
aaaagcagccagagatggta

SEQ ID NO: 7833055 - DNA, 22 bp, Homo sapiens
aaaagcagatctccaaagtcta

SEQ ID NO: 7833056 - DNA, 22 bp, Homo sapiens
aaaagcagagactctggagcta

SEQ ID NO: 7833057 - DNA, 22 bp, Homo sapiens
aaaagcagagactctggagcta

SEQ ID NO: 7833058 - DNA, 22 bp, Homo sapiens
aaaagcagagactctggagcta

SEQ ID NO: 7833059 - DNA, 22 bp, Homo sapiens
aaaagcagagactctggagcta

SEQ ID NO: 7833060 - DNA, 22 bp, Homo sapiens
aaaacacaagaagcagggtaca

SEQ ID NO: 7833061 - DNA, 22 bp, Homo sapiens
aaaacacaagaagcagggtaca

SEQ ID NO: 7833062 - DNA, 22 bp, Homo sapiens
aaaacacaagaagcagggtaca

SEQ ID NO: 7833063 - DNA, 22 bp, Homo sapiens
aaaacacaagaagcagggtaca

SEQ ID NO: 7833064 - DNA, 22 bp, Homo sapiens
aaaacacactggaccaatttaa

SEQ ID NO: 7833065 - DNA, 22 bp, Homo sapiens
aaaacacactggaccaatttaa

SEQ ID NO: 7833066 - DNA, 22 bp, Homo sapiens
aaaacacactggaccaatttaa

SEQ ID NO: 7833067 - DNA, 22 bp, Homo sapiens
aaaacactgcaaagctgattgg

SEQ ID NO: 7833068 - DNA, 22 bp, Homo sapiens
aaaacactgcctgcttgactga

SEQ ID NO: 7833069 - DNA, 22 bp, Homo sapiens
aaaacacactggaccaatttaa

SEQ ID NO: 7833070 - DNA, 22 bp, Homo sapiens
aaaacacactggaccaatttaa

SEQ ID NO: 7833071 - DNA, 22 bp, Homo sapiens
aaaacacactggaccaatttaa

SEQ ID NO: 7833072 - DNA, 22 bp, Homo sapiens
aaaacacactggaccaatttaa

SEQ ID NO: 7833073 - DNA, 22 bp, Homo sapiens
aaaacagacagccagtgtagag

SEQ ID NO: 7833074 - DNA, 22 bp, Homo sapiens
aaaacagacagccagtgtagag

SEQ ID NO: 7833075 - DNA, 22 bp, Homo sapiens
aaaacagacagccagtgtagag

SEQ ID NO: 7833076 - DNA, 22 bp, Homo sapiens
aaaacagacagccagtgtagag

SEQ ID NO: 7833077 - DNA, 22 bp, Homo sapiens
aaaacactgcctgcttgactga

SEQ ID NO: 7833078 - DNA, 22 bp, Homo sapiens
aaaacactgcctgcttgactga

SEQ ID NO: 7833079 - DNA, 22 bp, Homo sapiens
aaaacactgcctgcttgactga

SEQ ID NO: 7833080 - DNA, 23 bp, Homo sapiens
aaaacagcttcctccagtggctc

SEQ ID NO: 7833081 - DNA, 23 bp, Homo sapiens
aaaacagcttcctccagtggctc

SEQ ID NO: 7833082 - DNA, 23 bp, Homo sapiens
aaaacagcttcctccagtggctc

SEQ ID NO: 7833083 - DNA, 22 bp, Homo sapiens
aaaacagacagccagtgtagag

SEQ ID NO: 7833084 - DNA, 22 bp, Homo sapiens
aaaacagacagccagtgtagag

SEQ ID NO: 7833085 - DNA, 22 bp, Homo sapiens
aaaacagaggtgcctgggccca

SEQ ID NO: 7833086 - DNA, 22 bp, Homo sapiens
aaaacagttataaacagagtca

SEQ ID NO: 7833087 - DNA, 22 bp, Homo sapiens
aaaacagttataaacagagtca

SEQ ID NO: 7833088 - DNA, 22 bp, Homo sapiens
aaaacaggtgtcagcaaactat

SEQ ID NO: 7833089 - DNA, 22 bp, Homo sapiens
aaaacagttataaacagagtca

SEQ ID NO: 7833090 - DNA, 22 bp, Homo sapiens
aaaacaggagttttggtaggct

SEQ ID NO: 7833091 - DNA, 22 bp, Homo sapiens
aaaacaggtgtcagcaaactat

SEQ ID NO: 7833092 - DNA, 22 bp, Homo sapiens
aaaacaggagttttggtaggct

SEQ ID NO: 7833093 - DNA, 23 bp, Homo sapiens
aaaacagcttcctccagtggctc

SEQ ID NO: 7833094 - DNA, 22 bp, Homo sapiens
aaaacagttataaacagagtca

SEQ ID NO: 7833095 - DNA, 22 bp, Homo sapiens
aaaacagtttaggcatcacagt

SEQ ID NO: 7833096 - DNA, 22 bp, Homo sapiens
aaaacagttataaacagagtca

SEQ ID NO: 7833097 - DNA, 22 bp, Homo sapiens
aaaacagttataaacagagtca

SEQ ID NO: 7833098 - DNA, 22 bp, Homo sapiens
aaaagagccacttatgacctca

SEQ ID NO: 7833099 - DNA, 22 bp, Homo sapiens
aaaagagccacttatgacctca

SEQ ID NO: 7833100 - DNA, 22 bp, Homo sapiens
aaaacagtttttgctaactgct

SEQ ID NO: 7833101 - DNA, 22 bp, Homo sapiens
aaaagagcttggttgattttgc

SEQ ID NO: 7833102 - DNA, 22 bp, Homo sapiens
aaaagagcttggttgattttgc

SEQ ID NO: 7833103 - DNA, 22 bp, Homo sapiens
aaaagaggaactcttatatact

SEQ ID NO: 7833104 - DNA, 22 bp, Homo sapiens
aaaagagccacttatgacctca

SEQ ID NO: 7833105 - DNA, 22 bp, Homo sapiens
aaaagcaagttgcctaggttga

SEQ ID NO: 7833106 - DNA, 22 bp, Homo sapiens
aaaagaggagtggtttatgaca

SEQ ID NO: 7833107 - DNA, 22 bp, Homo sapiens
aaaacagtttaggcatcacagt

SEQ ID NO: 7833108 - DNA, 22 bp, Homo sapiens
aaaacagtttaggcatcacagt

SEQ ID NO: 7833109 - DNA, 22 bp, Homo sapiens
aaaacagtttaggcatcacagt

SEQ ID NO: 7833110 - DNA, 22 bp, Homo sapiens
aaaacagtttttgctaactgct

SEQ ID NO: 7833111 - DNA, 22 bp, Homo sapiens
aaaacagtttttgctaactgct

SEQ ID NO: 7833112 - DNA, 22 bp, Homo sapiens
aaaacagtttttgctaactgct

SEQ ID NO: 7833113 - DNA, 22 bp, Homo sapiens
aaacttcatggataatataaag

SEQ ID NO: 7833114 - DNA, 22 bp, Homo sapiens
aaacttcagtgaatgacttatg

SEQ ID NO: 7833115 - DNA, 22 bp, Homo sapiens
aaacttcagtgaatgacttatg

SEQ ID NO: 7833116 - DNA, 22 bp, Homo sapiens
aaatggtgctactaggagtcag

SEQ ID NO: 7833117 - DNA, 22 bp, Homo sapiens
aaacttcatggataatataaag

SEQ ID NO: 7833118 - DNA, 22 bp, Homo sapiens
aaacttcagggaataaaagagt

SEQ ID NO: 7833119 - DNA, 22 bp, Homo sapiens
aaacttcagtgaatgacttatg

SEQ ID NO: 7833120 - DNA, 22 bp, Homo sapiens
aaacttcagggaataaaagagt

SEQ ID NO: 7833121 - DNA, 22 bp, Homo sapiens
aaacttcagtaggagccaacct

SEQ ID NO: 7833122 - DNA, 22 bp, Homo sapiens
aaacttcaaggatttgcaaatc

SEQ ID NO: 7833123 - DNA, 22 bp, Homo sapiens
aaacttcaaggatttgcaaatc

SEQ ID NO: 7833124 - DNA, 22 bp, Homo sapiens
aaacttcaaggatttgcaaatc

SEQ ID NO: 7833125 - DNA, 22 bp, Homo sapiens
aaacttcaaggatttgcaaatc

SEQ ID NO: 7833126 - DNA, 22 bp, Homo sapiens
aaacttcagggaataaaagagt

SEQ ID NO: 7833127 - DNA, 22 bp, Homo sapiens
aaacttcagggaataaaagagt

SEQ ID NO: 7833128 - DNA, 22 bp, Homo sapiens
aaacttcagactccccacttct

SEQ ID NO: 7833129 - DNA, 22 bp, Homo sapiens
aaacttcaagattcaagcctgg

SEQ ID NO: 7833130 - DNA, 23 bp, Homo sapiens
aaatgacatatggtttctgaagg

SEQ ID NO: 7833131 - DNA, 22 bp, Homo sapiens
aaacttcaagattcaagcctgg

SEQ ID NO: 7833132 - DNA, 22 bp, Homo sapiens
aaacttagttaagcatattatt

SEQ ID NO: 7833133 - DNA, 22 bp, Homo sapiens
aaacttattttatcacagttca

SEQ ID NO: 7833134 - DNA, 22 bp, Homo sapiens
aaacttattttatcacagttca

SEQ ID NO: 7833135 - DNA, 22 bp, Homo sapiens
aaatggtgtttctaatgctaga

SEQ ID NO: 7833136 - DNA, 22 bp, Homo sapiens
aaatgtctgagacttctgaact

SEQ ID NO: 7833137 - DNA, 22 bp, Homo sapiens
aaatgtctctattgcctctggt

SEQ ID NO: 7833138 - DNA, 22 bp, Homo sapiens
aaatgtctctattgcctctggt

SEQ ID NO: 7833139 - DNA, 22 bp, Homo sapiens
aaatggttacaatgctttgctt

SEQ ID NO: 7833140 - DNA, 22 bp, Homo sapiens
aaatgtctgagacttctgaact

SEQ ID NO: 7833141 - DNA, 22 bp, Homo sapiens
aaatgtctgagacttctgaact

SEQ ID NO: 7833142 - DNA, 22 bp, Homo sapiens
aaatgtctgagacttctgaact

SEQ ID NO: 7833143 - DNA, 22 bp, Homo sapiens
aaatgtctgagacttctgaact

SEQ ID NO: 7833144 - DNA, 22 bp, Homo sapiens
aaatgtctgtaggggctgcagg

SEQ ID NO: 7833145 - DNA, 22 bp, Homo sapiens
aaatgtctgtatgagaaagaga

SEQ ID NO: 7833146 - DNA, 22 bp, Homo sapiens
aaatgtctctattgcctctggt

SEQ ID NO: 7833147 - DNA, 22 bp, Homo sapiens
aaatgtctgtaggggctgcagg

SEQ ID NO: 7833148 - DNA, 22 bp, Homo sapiens
aaatgtctgtatgagaaagaga

SEQ ID NO: 7833149 - DNA, 22 bp, Homo sapiens
aaatgtctgtatgagaaagaga

SEQ ID NO: 7833150 - DNA, 22 bp, Homo sapiens
aaatgtctgtatgagaaagaga

SEQ ID NO: 7833151 - DNA, 22 bp, Homo sapiens
aaatgtctgtatgagaaagaga

SEQ ID NO: 7833152 - DNA, 22 bp, Homo sapiens
aaatgtctgtatgagaaagaga

SEQ ID NO: 7833153 - DNA, 22 bp, Homo sapiens
aaatgtctgtctcatgaggaaa

SEQ ID NO: 7833154 - DNA, 22 bp, Homo sapiens
aaatgtctgtctcatgaggaaa

SEQ ID NO: 7833155 - DNA, 22 bp, Homo sapiens
aaatgtctgttagtcatatcat

SEQ ID NO: 7833156 - DNA, 22 bp, Homo sapiens
aaatgtctgtctcatgaggaaa

SEQ ID NO: 7833157 - DNA, 22 bp, Homo sapiens
aaatgtctttatctcatgtaac

SEQ ID NO: 7833158 - DNA, 22 bp, Homo sapiens
aaatgtctttatctcatgtaac

SEQ ID NO: 7833159 - DNA, 22 bp, Homo sapiens
aaatgtctttatctcatgtaac

SEQ ID NO: 7833160 - DNA, 23 bp, Homo sapiens
aaatgtcttctagctcttgagaa

SEQ ID NO: 7833161 - DNA, 22 bp, Homo sapiens
aaagacagatggcaaggatgat

SEQ ID NO: 7833162 - DNA, 22 bp, Homo sapiens
aaagacagatggcaaggatgat

SEQ ID NO: 7833163 - DNA, 22 bp, Homo sapiens
aaagacagatggcaaggatgat

SEQ ID NO: 7833164 - DNA, 22 bp, Homo sapiens
aaagacagatggcaaggatgat

SEQ ID NO: 7833165 - DNA, 22 bp, Homo sapiens
aaagacagatggcaaggatgat

SEQ ID NO: 7833166 - DNA, 22 bp, Homo sapiens
aaagacagatggcaaggatgat

SEQ ID NO: 7833167 - DNA, 22 bp, Homo sapiens
aaagacagatggcaaggatgat

SEQ ID NO: 7833168 - DNA, 22 bp, Homo sapiens
aaagacagatggcaaggatgat

SEQ ID NO: 7833169 - DNA, 22 bp, Homo sapiens
aaagacagagctgtaggggaaa

SEQ ID NO: 7833170 - DNA, 22 bp, Homo sapiens
aaagacagagctgtaggggaaa

SEQ ID NO: 7833171 - DNA, 22 bp, Homo sapiens
aaagacagacggaaacctgagg

SEQ ID NO: 7833172 - DNA, 22 bp, Homo sapiens
aaagacagacggaaacctgagg

SEQ ID NO: 7833173 - DNA, 22 bp, Homo sapiens
aaagacagagctgtaggggaaa

SEQ ID NO: 7833174 - DNA, 22 bp, Homo sapiens
aaagacagagctgtaggggaaa

SEQ ID NO: 7833175 - DNA, 22 bp, Homo sapiens
aaagacacatgtctcttagatt

SEQ ID NO: 7833176 - DNA, 22 bp, Homo sapiens
aaagacatcagaaccagctgag

SEQ ID NO: 7833177 - DNA, 22 bp, Homo sapiens
aaagacagtggattcaaaatcc

SEQ ID NO: 7833178 - DNA, 22 bp, Homo sapiens
aaagacatatttctaagtttat

SEQ ID NO: 7833179 - DNA, 22 bp, Homo sapiens
aaagacatatttctaagtttat

SEQ ID NO: 7833180 - DNA, 22 bp, Homo sapiens
aaagacagatggcaaggatgat

SEQ ID NO: 7833181 - DNA, 22 bp, Homo sapiens
aaagacagtggattcaaaatcc

SEQ ID NO: 7833182 - DNA, 22 bp, Homo sapiens
aaagacagtggattcaaaatcc

SEQ ID NO: 7833183 - DNA, 22 bp, Homo sapiens
aaagacagtggattcaaaatcc

SEQ ID NO: 7833184 - DNA, 22 bp, Homo sapiens
aaatgtctttatctcatgtaac

SEQ ID NO: 7833185 - DNA, 22 bp, Homo sapiens
aaatgtctttcaatagagaaat

SEQ ID NO: 7833186 - DNA, 22 bp, Homo sapiens
aaatgtctttcaatagagaaat

SEQ ID NO: 7833187 - DNA, 22 bp, Homo sapiens
aaatgtctttcaatagagaaat

SEQ ID NO: 7833188 - DNA, 22 bp, Homo sapiens
aaatgtctttcaatagagaaat

SEQ ID NO: 7833189 - DNA, 22 bp, Homo sapiens
aaatgtctttcttctgctacgt

SEQ ID NO: 7833190 - DNA, 22 bp, Homo sapiens
aaatgtctttcttctgctacgt

SEQ ID NO: 7833191 - DNA, 22 bp, Homo sapiens
aaatgtctttgagtatttctgc

SEQ ID NO: 7833192 - DNA, 22 bp, Homo sapiens
aaatgtctttgagtatttctgc

SEQ ID NO: 7833193 - DNA, 22 bp, Homo sapiens
aaatgtctttgagtatttctgc

SEQ ID NO: 7833194 - DNA, 22 bp, Homo sapiens
aaatgtctttgagtatttctgc

SEQ ID NO: 7833195 - DNA, 22 bp, Homo sapiens
aaatgtgacagatgcagtacag

SEQ ID NO: 7833196 - DNA, 22 bp, Homo sapiens
aaatgtctttgagtttttataa

SEQ ID NO: 7833197 - DNA, 22 bp, Homo sapiens
aaatgtctttgagtttttataa

SEQ ID NO: 7833198 - DNA, 22 bp, Homo sapiens
aaagacacacagccagcaagtg

SEQ ID NO: 7833199 - DNA, 22 bp, Homo sapiens
aaagacacacagccagcaagtg

SEQ ID NO: 7833200 - DNA, 22 bp, Homo sapiens
aaatgtgagttatagcaataga

SEQ ID NO: 7833201 - DNA, 22 bp, Homo sapiens
aaatgtgagttatagcaataga

SEQ ID NO: 7833202 - DNA, 23 bp, Homo sapiens
aaatgtgagggaaaatctttctg

SEQ ID NO: 7833203 - DNA, 22 bp, Homo sapiens
aaatgtgagactgagttttcct

SEQ ID NO: 7833204 - DNA, 23 bp, Homo sapiens
aaatgtgagggaaaatctttctg

SEQ ID NO: 7833205 - DNA, 22 bp, Homo sapiens
aaatgaactcttcctgcatccc

SEQ ID NO: 7833206 - DNA, 22 bp, Homo sapiens
aaatccagtgttcaaagtttga

SEQ ID NO: 7833207 - DNA, 22 bp, Homo sapiens
aaatccagtgttcaaagtttga

SEQ ID NO: 7833208 - DNA, 22 bp, Homo sapiens
aaatccagtttgtcatttccca

SEQ ID NO: 7833209 - DNA, 22 bp, Homo sapiens
aaatccagtttgtcatttccca

SEQ ID NO: 7833210 - DNA, 21 bp, Homo sapiens
aaatgaatgtggtagtgcaag

SEQ ID NO: 7833211 - DNA, 21 bp, Homo sapiens
aaatgaatgtggtagtgcaag

SEQ ID NO: 7833212 - DNA, 22 bp, Homo sapiens
aaatgacactaggctttttgca

SEQ ID NO: 7833213 - DNA, 22 bp, Homo sapiens
aaatgacactaggctttttgca

SEQ ID NO: 7833214 - DNA, 22 bp, Homo sapiens
aaatgacactaggctttttgca

SEQ ID NO: 7833215 - DNA, 22 bp, Homo sapiens
aaatgacactaggctttttgca

SEQ ID NO: 7833216 - DNA, 22 bp, Homo sapiens
aaatgacaataaaagtccatgc

SEQ ID NO: 7833217 - DNA, 22 bp, Homo sapiens
aaatgacaataaaagtccatgc

SEQ ID NO: 7833218 - DNA, 22 bp, Homo sapiens
aaatgacaataaaagtccatgc

SEQ ID NO: 7833219 - DNA, 22 bp, Homo sapiens
aaatgacaataaaagtccatgc

SEQ ID NO: 7833220 - DNA, 22 bp, Homo sapiens
aaatgacaataaaagtccatgc

SEQ ID NO: 7833221 - DNA, 22 bp, Homo sapiens
aaatgacaataaaagtccatgc

SEQ ID NO: 7833222 - DNA, 22 bp, Homo sapiens
aaatgacactcattcagtgtca

SEQ ID NO: 7833223 - DNA, 22 bp, Homo sapiens
aaatgacactcattcagtgtca

SEQ ID NO: 7833224 - DNA, 22 bp, Homo sapiens
aaatgacactcattcagtgtca

SEQ ID NO: 7833225 - DNA, 22 bp, Homo sapiens
aaatgacagagctgggactagt

SEQ ID NO: 7833226 - DNA, 22 bp, Homo sapiens
aaatgacagagtaagctgttta

SEQ ID NO: 7833227 - DNA, 22 bp, Homo sapiens
aaatgacagagtaagctgttta

SEQ ID NO: 7833228 - DNA, 22 bp, Homo sapiens
aaatgacagagtaagctgttta

SEQ ID NO: 7833229 - DNA, 22 bp, Homo sapiens
aaatgacagagtaagctgttta

SEQ ID NO: 7833230 - DNA, 22 bp, Homo sapiens
aaatgacagttctctctgagta

SEQ ID NO: 7833231 - DNA, 22 bp, Homo sapiens
aaatgacagagtaagctgttta

SEQ ID NO: 7833232 - DNA, 22 bp, Homo sapiens
aaactgtgcttcccaaatgccc

SEQ ID NO: 7833233 - DNA, 22 bp, Homo sapiens
aaactgtgagctagtaaatagg

SEQ ID NO: 7833234 - DNA, 23 bp, Homo sapiens
aaatgacatatggtttctgaagg

SEQ ID NO: 7833235 - DNA, 23 bp, Homo sapiens
aaatgacatatggtttctgaagg

SEQ ID NO: 7833236 - DNA, 23 bp, Homo sapiens
aaatgacatatggtttctgaagg

SEQ ID NO: 7833237 - DNA, 22 bp, Homo sapiens
aaataacagtcagggacaacat

SEQ ID NO: 7833238 - DNA, 22 bp, Homo sapiens
aaataacagtcagggacaacat

SEQ ID NO: 7833239 - DNA, 22 bp, Homo sapiens
aaataacagtcagggacaacat

SEQ ID NO: 7833240 - DNA, 22 bp, Homo sapiens
aaataacagtcagggacaacat

SEQ ID NO: 7833241 - DNA, 22 bp, Homo sapiens
aaataacagtcagggacaacat

SEQ ID NO: 7833242 - DNA, 22 bp, Homo sapiens
aaataacagtcagggacaacat

SEQ ID NO: 7833243 - DNA, 22 bp, Homo sapiens
aaataaaggaactgttttccca

SEQ ID NO: 7833244 - DNA, 22 bp, Homo sapiens
aaataaaggaactgttttccca

SEQ ID NO: 7833245 - DNA, 22 bp, Homo sapiens
aaataaaggaactgttttccca

SEQ ID NO: 7833246 - DNA, 22 bp, Homo sapiens
aaataaaggtccactttagggc

SEQ ID NO: 7833247 - DNA, 22 bp, Homo sapiens
aaataaaggtccactttagggc

SEQ ID NO: 7833248 - DNA, 22 bp, Homo sapiens
aaatacaatttcaggctgtaat

SEQ ID NO: 7833249 - DNA, 22 bp, Homo sapiens
aaatacaatttcaggctgtaat

SEQ ID NO: 7833250 - DNA, 22 bp, Homo sapiens
aaatacaatttcaggctgtaat

SEQ ID NO: 7833251 - DNA, 22 bp, Homo sapiens
aaataacagtcagggacaacat

SEQ ID NO: 7833252 - DNA, 22 bp, Homo sapiens
aaatacaatttcaggctgtaat

SEQ ID NO: 7833253 - DNA, 22 bp, Homo sapiens
aaataacagtcagggacaacat

SEQ ID NO: 7833254 - DNA, 22 bp, Homo sapiens
aaatacaatttcaggctgtaat

SEQ ID NO: 7833255 - DNA, 22 bp, Homo sapiens
aaatacaatttcaggctgtaat

SEQ ID NO: 7833256 - DNA, 22 bp, Homo sapiens
aaatacaatttcaggctgtaat

SEQ ID NO: 7833257 - DNA, 22 bp, Homo sapiens
aaatacaatttcaggctgtaat

SEQ ID NO: 7833258 - DNA, 22 bp, Homo sapiens
aaatacaatttcaggctgtaat

SEQ ID NO: 7833259 - DNA, 22 bp, Homo sapiens
aaatacaatttcaggctgtaat

SEQ ID NO: 7833260 - DNA, 22 bp, Homo sapiens
aaatacaatttcaggctgtaat

SEQ ID NO: 7833261 - DNA, 22 bp, Homo sapiens
aaatacacgtacatgtgtaaaa

SEQ ID NO: 7833262 - DNA, 21 bp, Homo sapiens
aaatacagaaacttgttttca

SEQ ID NO: 7833263 - DNA, 22 bp, Homo sapiens
aaatacagattccagggtctta

SEQ ID NO: 7833264 - DNA, 22 bp, Homo sapiens
aaatccagtgggtcctcatgag

SEQ ID NO: 7833265 - DNA, 20 bp, Homo sapiens
aaatccagtgtgtattttac

SEQ ID NO: 7833266 - DNA, 20 bp, Homo sapiens
aaatccagtgtgtattttac

SEQ ID NO: 7833267 - DNA, 21 bp, Homo sapiens
aaatacagatgcaaatctgtt

SEQ ID NO: 7833268 - DNA, 21 bp, Homo sapiens
aaatacagatgcaaatctgtt

SEQ ID NO: 7833269 - DNA, 21 bp, Homo sapiens
aaatacagatgcaaatctgtt

SEQ ID NO: 7833270 - DNA, 21 bp, Homo sapiens
aaatacagatgcaaatctgtt

SEQ ID NO: 7833271 - DNA, 21 bp, Homo sapiens
aaatacagatgcaaatctgtt

SEQ ID NO: 7833272 - DNA, 21 bp, Homo sapiens
aaatacagatgcaaatctgtt

SEQ ID NO: 7833273 - DNA, 21 bp, Homo sapiens
aaatacagatgcaaatctgtt

SEQ ID NO: 7833274 - DNA, 21 bp, Homo sapiens
aaatacagatgcaaatctgtt

SEQ ID NO: 7833275 - DNA, 21 bp, Homo sapiens
aaatacagatgcaaatctgtt

SEQ ID NO: 7833276 - DNA, 21 bp, Homo sapiens
aaatacagatgcaaatctgtt

SEQ ID NO: 7833277 - DNA, 21 bp, Homo sapiens
aaatacagatgcaaatctgtt

SEQ ID NO: 7833278 - DNA, 22 bp, Homo sapiens
aaatacagatagatttaaccca

SEQ ID NO: 7833279 - DNA, 22 bp, Homo sapiens
aaatacagatagatttaaccca

SEQ ID NO: 7833280 - DNA, 22 bp, Homo sapiens
aaatacagatagatttaaccca

SEQ ID NO: 7833281 - DNA, 22 bp, Homo sapiens
aaatacagatagatttaaccca

SEQ ID NO: 7833282 - DNA, 22 bp, Homo sapiens
aaatacagagttgcttaaaagc

SEQ ID NO: 7833283 - DNA, 22 bp, Homo sapiens
aaatacagagttgcttaaaagc

SEQ ID NO: 7833284 - DNA, 22 bp, Homo sapiens
aaatacagagttgcttaaaagc

SEQ ID NO: 7833285 - DNA, 22 bp, Homo sapiens
aaatacagagttgcttaaaagc

SEQ ID NO: 7833286 - DNA, 21 bp, Homo sapiens
aaatacagaaacttgttttca

SEQ ID NO: 7833287 - DNA, 21 bp, Homo sapiens
aaatacagaaacttgttttca

SEQ ID NO: 7833288 - DNA, 21 bp, Homo sapiens
aaatacagaaacttgttttca

SEQ ID NO: 7833289 - DNA, 22 bp, Homo sapiens
aaatacagagttgcttaaaagc

SEQ ID NO: 7833290 - DNA, 22 bp, Homo sapiens
aaatacagagttgcttaaaagc

SEQ ID NO: 7833291 - DNA, 22 bp, Homo sapiens
aaatacagagttatggacctca

SEQ ID NO: 7833292 - DNA, 22 bp, Homo sapiens
aaatacagagttatggacctca

SEQ ID NO: 7833293 - DNA, 22 bp, Homo sapiens
aaatacagagttatggacctca

SEQ ID NO: 7833294 - DNA, 22 bp, Homo sapiens
aaatacagagttatggacctca

SEQ ID NO: 7833295 - DNA, 22 bp, Homo sapiens
aaagtacaaggaaaggatctga

SEQ ID NO: 7833296 - DNA, 22 bp, Homo sapiens
aaagtacaaggaaaggatctga

SEQ ID NO: 7833297 - DNA, 22 bp, Homo sapiens
aaaggttagacagctctgcata

SEQ ID NO: 7833298 - DNA, 22 bp, Homo sapiens
aaaggttagacagctctgcata

SEQ ID NO: 7833299 - DNA, 22 bp, Homo sapiens
aaagtacaatattgagattgat

SEQ ID NO: 7833300 - DNA, 22 bp, Homo sapiens
aaagtacaaggaaaggatctga

SEQ ID NO: 7833301 - DNA, 22 bp, Homo sapiens
aaagtacaaggaaaggatctga

SEQ ID NO: 7833302 - DNA, 22 bp, Homo sapiens
aaagtacaaggaaaggatctga

SEQ ID NO: 7833303 - DNA, 22 bp, Homo sapiens
aaagtacacacagagccaagaa

SEQ ID NO: 7833304 - DNA, 22 bp, Homo sapiens
aaagtacacacagagccaagaa

SEQ ID NO: 7833305 - DNA, 22 bp, Homo sapiens
aaagtacacacagagccaagaa

SEQ ID NO: 7833306 - DNA, 22 bp, Homo sapiens
aaagtacacacagagccaagaa

SEQ ID NO: 7833307 - DNA, 22 bp, Homo sapiens
aaagtacaatattgagattgat

SEQ ID NO: 7833308 - DNA, 22 bp, Homo sapiens
aaagtacaatattgagattgat

SEQ ID NO: 7833309 - DNA, 22 bp, Homo sapiens
aaagtacaatattgagattgat

SEQ ID NO: 7833310 - DNA, 22 bp, Homo sapiens
aaagtacagccacatccaagta

SEQ ID NO: 7833311 - DNA, 22 bp, Homo sapiens
aaagtacagccacatccaagta

SEQ ID NO: 7833312 - DNA, 22 bp, Homo sapiens
aaagtacagccacatccaagta

SEQ ID NO: 7833313 - DNA, 22 bp, Homo sapiens
aaagtacagccacatccaagta

SEQ ID NO: 7833314 - DNA, 22 bp, Homo sapiens
aaagtacagccacatccaagta

SEQ ID NO: 7833315 - DNA, 22 bp, Homo sapiens
aaagtacaggaaagcctagcca

SEQ ID NO: 7833316 - DNA, 22 bp, Homo sapiens
aaagtacaggaaagcctagcca

SEQ ID NO: 7833317 - DNA, 22 bp, Homo sapiens
aaagtacaggaaagcctagcca

SEQ ID NO: 7833318 - DNA, 22 bp, Homo sapiens
aaagtacagggttgtggggtga

SEQ ID NO: 7833319 - DNA, 22 bp, Homo sapiens
aaagtacacatttatcccttat

SEQ ID NO: 7833320 - DNA, 22 bp, Homo sapiens
aaagtacacatttatcccttat

SEQ ID NO: 7833321 - DNA, 22 bp, Homo sapiens
aaagtacagatggtgaggttgg

SEQ ID NO: 7833322 - DNA, 22 bp, Homo sapiens
aaagtacagatggtgaggttgg

SEQ ID NO: 7833323 - DNA, 22 bp, Homo sapiens
aaagtacagatggtgaggttgg

SEQ ID NO: 7833324 - DNA, 22 bp, Homo sapiens
aaagtacagccacatccaagta

SEQ ID NO: 7833325 - DNA, 22 bp, Homo sapiens
aaagtacagccacatccaagta

SEQ ID NO: 7833326 - DNA, 22 bp, Homo sapiens
aaagtacagatggtgaggttgg

SEQ ID NO: 7833327 - DNA, 22 bp, Homo sapiens
aaagtacagatggtgaggttgg

SEQ ID NO: 7833328 - DNA, 22 bp, Homo sapiens
aaagtcatcagaaccttccaga

SEQ ID NO: 7833329 - DNA, 22 bp, Homo sapiens
aaagtcatcatttcttttcaaa

SEQ ID NO: 7833330 - DNA, 22 bp, Homo sapiens
aaagtcatcatttcttttcaaa

SEQ ID NO: 7833331 - DNA, 22 bp, Homo sapiens
aaagtcagttggccagatcact

SEQ ID NO: 7833332 - DNA, 22 bp, Homo sapiens
aaagtcatacatggtgcttact

SEQ ID NO: 7833333 - DNA, 22 bp, Homo sapiens
aaagtcagttggccagatcact

SEQ ID NO: 7833334 - DNA, 22 bp, Homo sapiens
aaagtcacttccttctgtcagc

SEQ ID NO: 7833335 - DNA, 22 bp, Homo sapiens
aaagtcacttacagctcttttg

SEQ ID NO: 7833336 - DNA, 22 bp, Homo sapiens
aaagtcagttggccagatcact

SEQ ID NO: 7833337 - DNA, 22 bp, Homo sapiens
aaagtcaggctgtgtacctaac

SEQ ID NO: 7833338 - DNA, 22 bp, Homo sapiens
aaagtacatgcaattcttctga

SEQ ID NO: 7833339 - DNA, 22 bp, Homo sapiens
aaagtacatgcaattcttctga

SEQ ID NO: 7833340 - DNA, 22 bp, Homo sapiens
aaagtacatgcaattcttctga

SEQ ID NO: 7833341 - DNA, 22 bp, Homo sapiens
aaagtacatgcaattcttctga

SEQ ID NO: 7833342 - DNA, 22 bp, Homo sapiens
aaagtacatgcaattcttctga

SEQ ID NO: 7833343 - DNA, 22 bp, Homo sapiens
aaagtacatgcaattcttctga

SEQ ID NO: 7833344 - DNA, 22 bp, Homo sapiens
aaagtacatgtttggccatttg

SEQ ID NO: 7833345 - DNA, 22 bp, Homo sapiens
aaagtacatagcatattccaac

SEQ ID NO: 7833346 - DNA, 22 bp, Homo sapiens
aaagtacatagcatattccaac

SEQ ID NO: 7833347 - DNA, 22 bp, Homo sapiens
aaagtacatagcatattccaac

SEQ ID NO: 7833348 - DNA, 22 bp, Homo sapiens
aaagtacatagcatattccaac

SEQ ID NO: 7833349 - DNA, 22 bp, Homo sapiens
aaagtacatagcatattccaac

SEQ ID NO: 7833350 - DNA, 22 bp, Homo sapiens
aaagtacatagcatattccaac

SEQ ID NO: 7833351 - DNA, 22 bp, Homo sapiens
aaagtacatgagattcaagggg

SEQ ID NO: 7833352 - DNA, 22 bp, Homo sapiens
aaagtacatgagattcaagggg

SEQ ID NO: 7833353 - DNA, 22 bp, Homo sapiens
aaagtacatgagattcaagggg

SEQ ID NO: 7833354 - DNA, 22 bp, Homo sapiens
aaagtacatgagattcaagggg

SEQ ID NO: 7833355 - DNA, 22 bp, Homo sapiens
aaagtacatgagattcaagggg

SEQ ID NO: 7833356 - DNA, 22 bp, Homo sapiens
aaagtacatagcatattccaac

SEQ ID NO: 7833357 - DNA, 19 bp, Homo sapiens
aaagttttattctcatttg

SEQ ID NO: 7833358 - DNA, 19 bp, Homo sapiens
aaagttttattctcatttg

SEQ ID NO: 7833359 - DNA, 22 bp, Homo sapiens
aaagttttctgccttcattaga

SEQ ID NO: 7833360 - DNA, 22 bp, Homo sapiens
aaagttctagagttgcaagaga

SEQ ID NO: 7833361 - DNA, 22 bp, Homo sapiens
aaagttttattcaagcattagt

SEQ ID NO: 7833362 - DNA, 22 bp, Homo sapiens
aaagttccttttatagacatga

SEQ ID NO: 7833363 - DNA, 22 bp, Homo sapiens
aaagttctaaaactctttgtga

SEQ ID NO: 7833364 - DNA, 22 bp, Homo sapiens
aaagtttttaagcaagaccctt

SEQ ID NO: 7833365 - DNA, 22 bp, Homo sapiens
aaataaactgaagcacagagag

SEQ ID NO: 7833366 - DNA, 22 bp, Homo sapiens
aaataaactgaagcacagagag

SEQ ID NO: 7833367 - DNA, 22 bp, Homo sapiens
aaataaactgaagcacagagag

SEQ ID NO: 7833368 - DNA, 22 bp, Homo sapiens
aaagttttctgccttcattaga

SEQ ID NO: 7833369 - DNA, 22 bp, Homo sapiens
aaataaactgaagcacagagag

SEQ ID NO: 7833370 - DNA, 22 bp, Homo sapiens
aaataaactgaagcacagagag

SEQ ID NO: 7833371 - DNA, 22 bp, Homo sapiens
aaagttttgttgattgtggaat

SEQ ID NO: 7833372 - DNA, 22 bp, Homo sapiens
aaagttttctgccttcattaga

SEQ ID NO: 7833373 - DNA, 22 bp, Homo sapiens
aaagttttctgccttcattaga

SEQ ID NO: 7833374 - DNA, 22 bp, Homo sapiens
aaagtcatgatgaaccaccgta

SEQ ID NO: 7833375 - DNA, 22 bp, Homo sapiens
aaagtcatgcagttgaactttt

SEQ ID NO: 7833376 - DNA, 22 bp, Homo sapiens
aaagtcatgcagttgaactttt

SEQ ID NO: 7833377 - DNA, 22 bp, Homo sapiens
aaagtcatggaaaatcttggaa

SEQ ID NO: 7833378 - DNA, 22 bp, Homo sapiens
aaagtcatgtaatgatatgatt

SEQ ID NO: 7833379 - DNA, 22 bp, Homo sapiens
aaagtcatccaaatttttatgt

SEQ ID NO: 7833380 - DNA, 22 bp, Homo sapiens
aaagtcatctaggagcagattt

SEQ ID NO: 7833381 - DNA, 22 bp, Homo sapiens
aaagtcatctaggagcagattt

SEQ ID NO: 7833382 - DNA, 22 bp, Homo sapiens
aaagtcatctgtcctaggctct

SEQ ID NO: 7833383 - DNA, 22 bp, Homo sapiens
aaagtcatccaaatttttatgt

SEQ ID NO: 7833384 - DNA, 22 bp, Homo sapiens
aaagtcatcatttcttttcaaa

SEQ ID NO: 7833385 - DNA, 22 bp, Homo sapiens
aaagtcatctaggagcagattt

SEQ ID NO: 7833386 - DNA, 22 bp, Homo sapiens
aaagtcattgctgttatcaatg

SEQ ID NO: 7833387 - DNA, 22 bp, Homo sapiens
aaagtcattggaatattaatga

SEQ ID NO: 7833388 - DNA, 22 bp, Homo sapiens
aaagtcattgctgttatcaatg

SEQ ID NO: 7833389 - DNA, 22 bp, Homo sapiens
aaagtcatgtttttgtttagca

SEQ ID NO: 7833390 - DNA, 22 bp, Homo sapiens
aaagtcattgctgttatcaatg

SEQ ID NO: 7833391 - DNA, 22 bp, Homo sapiens
aaagtcatgtttttgtttagca

SEQ ID NO: 7833392 - DNA, 22 bp, Homo sapiens
aaagtcatgtaatgatatgatt

SEQ ID NO: 7833393 - DNA, 22 bp, Homo sapiens
aaagtcattgtaatatatgcta

SEQ ID NO: 7833394 - DNA, 22 bp, Homo sapiens
aaagtcattgtaatatatgcta

SEQ ID NO: 7833395 - DNA, 22 bp, Homo sapiens
aaagtcattggaatattaatga

SEQ ID NO: 7833396 - DNA, 22 bp, Homo sapiens
aaagtcattggaatattaatga

SEQ ID NO: 7833397 - DNA, 22 bp, Homo sapiens
aaagttccttttatagacatga

SEQ ID NO: 7833398 - DNA, 22 bp, Homo sapiens
aaagtcatttagccttatctcc

SEQ ID NO: 7833399 - DNA, 22 bp, Homo sapiens
aaaattttactggtgtttcctt

SEQ ID NO: 7833400 - DNA, 22 bp, Homo sapiens
aaaattttcagcttgacttgat

SEQ ID NO: 7833401 - DNA, 22 bp, Homo sapiens
aaaattttactggtgtttcctt

SEQ ID NO: 7833402 - DNA, 22 bp, Homo sapiens
aaaattttactggtgtttcctt

SEQ ID NO: 7833403 - DNA, 22 bp, Homo sapiens
aaaattttactggtgtttcctt

SEQ ID NO: 7833404 - DNA, 22 bp, Homo sapiens
aaaattttactggtgtttcctt

SEQ ID NO: 7833405 - DNA, 22 bp, Homo sapiens
aaaatttccaccatctttgtgt

SEQ ID NO: 7833406 - DNA, 22 bp, Homo sapiens
aaaattttcagcttgacttgat

SEQ ID NO: 7833407 - DNA, 22 bp, Homo sapiens
aaaattttgccctatccttcat

SEQ ID NO: 7833408 - DNA, 22 bp, Homo sapiens
aaaattttcagcttgacttgat

SEQ ID NO: 7833409 - DNA, 22 bp, Homo sapiens
aaaattttcagcttgacttgat

SEQ ID NO: 7833410 - DNA, 22 bp, Homo sapiens
aaaattttcagcttgacttgat

SEQ ID NO: 7833411 - DNA, 22 bp, Homo sapiens
aaaattgtcgaacagtagtaac

SEQ ID NO: 7833412 - DNA, 22 bp, Homo sapiens
aaaattgtgaaggtttctgaaa

SEQ ID NO: 7833413 - DNA, 22 bp, Homo sapiens
aaaattgtgaaggtttctgaaa

SEQ ID NO: 7833414 - DNA, 22 bp, Homo sapiens
aaaatttccaccatctttgtgt

SEQ ID NO: 7833415 - DNA, 22 bp, Homo sapiens
aaaatttccaccatctttgtgt

SEQ ID NO: 7833416 - DNA, 22 bp, Homo sapiens
aaaattgtgaaggtttctgaaa

SEQ ID NO: 7833417 - DNA, 22 bp, Homo sapiens
aaaattgtcgaacagtagtaac

SEQ ID NO: 7833418 - DNA, 22 bp, Homo sapiens
aaaattgtcgaacagtagtaac

SEQ ID NO: 7833419 - DNA, 22 bp, Homo sapiens
aaaattgtcgaacagtagtaac

SEQ ID NO: 7833420 - DNA, 22 bp, Homo sapiens
aaaattgtcagaagttgatctt

SEQ ID NO: 7833421 - DNA, 22 bp, Homo sapiens
aaaattgtcgaacagtagtaac

SEQ ID NO: 7833422 - DNA, 22 bp, Homo sapiens
aaagctatttattacagagaat

SEQ ID NO: 7833423 - DNA, 22 bp, Homo sapiens
aaagctatgaggcatgcatttc

SEQ ID NO: 7833424 - DNA, 22 bp, Homo sapiens
aaagctattcaacacgaacatg

SEQ ID NO: 7833425 - DNA, 18 bp, Homo sapiens
aaagctatcatggaacac

SEQ ID NO: 7833426 - DNA, 18 bp, Homo sapiens
aaagctatcatggaacac

SEQ ID NO: 7833427 - DNA, 22 bp, Homo sapiens
aaagctatttgttatgagagaa

SEQ ID NO: 7833428 - DNA, 22 bp, Homo sapiens
aaagctatttgtgagttataga

SEQ ID NO: 7833429 - DNA, 22 bp, Homo sapiens
aaagctatttattacagagaat

SEQ ID NO: 7833430 - DNA, 22 bp, Homo sapiens
aaagctatttattacagagaat

SEQ ID NO: 7833431 - DNA, 22 bp, Homo sapiens
aaagctatttattacagagaat

SEQ ID NO: 7833432 - DNA, 22 bp, Homo sapiens
aaagctatagggtcaagcattt

SEQ ID NO: 7833433 - DNA, 22 bp, Homo sapiens
aaagctatagggtcaagcattt

SEQ ID NO: 7833434 - DNA, 22 bp, Homo sapiens
aaagctatcatcaatgcaactt

SEQ ID NO: 7833435 - DNA, 22 bp, Homo sapiens
aaagctagtaatattttaatcc

SEQ ID NO: 7833436 - DNA, 22 bp, Homo sapiens
aaagctagtaatattttaatcc

SEQ ID NO: 7833437 - DNA, 22 bp, Homo sapiens
aaagctagtaatattttaatcc

SEQ ID NO: 7833438 - DNA, 22 bp, Homo sapiens
aaagctatagggtcaagcattt

SEQ ID NO: 7833439 - DNA, 22 bp, Homo sapiens
aaagctagtaatattttaatcc

SEQ ID NO: 7833440 - DNA, 22 bp, Homo sapiens
aaagctagtaatattttaatcc

SEQ ID NO: 7833441 - DNA, 22 bp, Homo sapiens
aaaattttgccctatccttcat

SEQ ID NO: 7833442 - DNA, 22 bp, Homo sapiens
aaaattttgccctatccttcat

SEQ ID NO: 7833443 - DNA, 22 bp, Homo sapiens
aaagccagggacagtgtgcatg

SEQ ID NO: 7833444 - DNA, 22 bp, Homo sapiens
aaagccagggacagtgtgcatg

SEQ ID NO: 7833445 - DNA, 22 bp, Homo sapiens
aaagccaggggagggattccca

SEQ ID NO: 7833446 - DNA, 22 bp, Homo sapiens
aaagctagaaggaaattttatg

SEQ ID NO: 7833447 - DNA, 22 bp, Homo sapiens
aaagctagaaggaaattttatg

SEQ ID NO: 7833448 - DNA, 22 bp, Homo sapiens
aaagctagaaggaaattttatg

SEQ ID NO: 7833449 - DNA, 22 bp, Homo sapiens
aaagctagaaggaaattttatg

SEQ ID NO: 7833450 - DNA, 22 bp, Homo sapiens
aaaggagacttcagatctcctt

SEQ ID NO: 7833451 - DNA, 22 bp, Homo sapiens
aaaggagacagtcttacctgga

SEQ ID NO: 7833452 - DNA, 22 bp, Homo sapiens
aaaggagaaaacatacaggact

SEQ ID NO: 7833453 - DNA, 22 bp, Homo sapiens
aaaggagacagtcttacctgga

SEQ ID NO: 7833454 - DNA, 22 bp, Homo sapiens
aaaggagacagtcttacctgga

SEQ ID NO: 7833455 - DNA, 22 bp, Homo sapiens
aaaggactggatattaaagagt

SEQ ID NO: 7833456 - DNA, 22 bp, Homo sapiens
aaaggagaaaacatacaggact

SEQ ID NO: 7833457 - DNA, 22 bp, Homo sapiens
aaaggagaaaacatacaggact

SEQ ID NO: 7833458 - DNA, 22 bp, Homo sapiens
aaaggagaaaacatacaggact

SEQ ID NO: 7833459 - DNA, 22 bp, Homo sapiens
aaaggagacttcagatctcctt

SEQ ID NO: 7833460 - DNA, 22 bp, Homo sapiens
aaaggagagtaggttactccat

SEQ ID NO: 7833461 - DNA, 22 bp, Homo sapiens
aaaggagacttcagatctcctt

SEQ ID NO: 7833462 - DNA, 22 bp, Homo sapiens
aaaggagagtaggttactccat

SEQ ID NO: 7833463 - DNA, 22 bp, Homo sapiens
aaaggagagtgagtcagatgcc

SEQ ID NO: 7833464 - DNA, 22 bp, Homo sapiens
aaaggagagtgagtcagatgcc

SEQ ID NO: 7833465 - DNA, 22 bp, Homo sapiens
aaaggagagtgagtcagatgcc

SEQ ID NO: 7833466 - DNA, 22 bp, Homo sapiens
aaaggagataaagggcccttca

SEQ ID NO: 7833467 - DNA, 22 bp, Homo sapiens
aaaggagataaagggcccttca

SEQ ID NO: 7833468 - DNA, 22 bp, Homo sapiens
aaaggttaaggtgttcaagaaa

SEQ ID NO: 7833469 - DNA, 22 bp, Homo sapiens
aaaggaggaatggagagatgct

SEQ ID NO: 7833470 - DNA, 22 bp, Homo sapiens
aaaggaggaatggagagatgct

SEQ ID NO: 7833471 - DNA, 22 bp, Homo sapiens
aaagctctgggaatgcttatct

SEQ ID NO: 7833472 - DNA, 22 bp, Homo sapiens
aaagctctgagaagcactgcaa

SEQ ID NO: 7833473 - DNA, 22 bp, Homo sapiens
aaagctctcccactgtatgaag

SEQ ID NO: 7833474 - DNA, 22 bp, Homo sapiens
aaagctctcccactgtatgaag

SEQ ID NO: 7833475 - DNA, 22 bp, Homo sapiens
aaagctcacagtaatacaaggc

SEQ ID NO: 7833476 - DNA, 22 bp, Homo sapiens
aaagctcagtcagtggtgtatg

SEQ ID NO: 7833477 - DNA, 22 bp, Homo sapiens
aaagctcagtcagtggtgtatg

SEQ ID NO: 7833478 - DNA, 22 bp, Homo sapiens
aaaggacatgtcaatatcaggc

SEQ ID NO: 7833479 - DNA, 22 bp, Homo sapiens
aaaggacatgtcaatatcaggc

SEQ ID NO: 7833480 - DNA, 22 bp, Homo sapiens
aaaggacatgtcaatatcaggc

SEQ ID NO: 7833481 - DNA, 22 bp, Homo sapiens
aaaggacatgtcaatatcaggc

SEQ ID NO: 7833482 - DNA, 22 bp, Homo sapiens
aaaggacatgtcaatatcaggc

SEQ ID NO: 7833483 - DNA, 22 bp, Homo sapiens
aaaggacatgtcaatatcaggc

SEQ ID NO: 7833484 - DNA, 22 bp, Homo sapiens
aaaggacacacaggaggtgtct

SEQ ID NO: 7833485 - DNA, 22 bp, Homo sapiens
aaagctcttaatgagattatcc

SEQ ID NO: 7833486 - DNA, 22 bp, Homo sapiens
aaagctcttaatgagattatcc

SEQ ID NO: 7833487 - DNA, 22 bp, Homo sapiens
aaagctcttaatgagattatcc

SEQ ID NO: 7833488 - DNA, 22 bp, Homo sapiens
aaatcagacacagtgaaagtta

SEQ ID NO: 7833489 - DNA, 22 bp, Homo sapiens
aaatcagacacagtgaaagtta

SEQ ID NO: 7833490 - DNA, 19 bp, Homo sapiens
aaatcagaatctgcatttt

SEQ ID NO: 7833491 - DNA, 22 bp, Homo sapiens
aaatcagacacagtgaaagtta

SEQ ID NO: 7833492 - DNA, 22 bp, Homo sapiens
aaatcagacttgaattttcatc

SEQ ID NO: 7833493 - DNA, 22 bp, Homo sapiens
aaatcagagaatatatttagaa

SEQ ID NO: 7833494 - DNA, 22 bp, Homo sapiens
aaatcagacttgaattttcatc

SEQ ID NO: 7833495 - DNA, 22 bp, Homo sapiens
aaatcagagtagaattgagcca

SEQ ID NO: 7833496 - DNA, 22 bp, Homo sapiens
aaatcagaggcaacaactactt

SEQ ID NO: 7833497 - DNA, 22 bp, Homo sapiens
aaatcagaggcaacaactactt

SEQ ID NO: 7833498 - DNA, 22 bp, Homo sapiens
aaatgaacatcaagaatagcct

SEQ ID NO: 7833499 - DNA, 22 bp, Homo sapiens
aaatgaaatgagtgcctggagg

SEQ ID NO: 7833500 - DNA, 22 bp, Homo sapiens
aaatgaacagttgcattctctg

SEQ ID NO: 7833501 - DNA, 22 bp, Homo sapiens
aaatgaaatgagtgcctggagg

SEQ ID NO: 7833502 - DNA, 22 bp, Homo sapiens
aaatgaaatgagtgcctggagg

SEQ ID NO: 7833503 - DNA, 22 bp, Homo sapiens
aaatcagagtctgattttaagg

SEQ ID NO: 7833504 - DNA, 22 bp, Homo sapiens
aaatcagagtctgattttaagg

SEQ ID NO: 7833505 - DNA, 22 bp, Homo sapiens
aaatcagagtagaattgagcca

SEQ ID NO: 7833506 - DNA, 22 bp, Homo sapiens
aaatcagagtctgattttaagg

SEQ ID NO: 7833507 - DNA, 22 bp, Homo sapiens
aaatcagagtctgattttaagg

SEQ ID NO: 7833508 - DNA, 22 bp, Homo sapiens
aaatcagagtctgattttaagg

SEQ ID NO: 7833509 - DNA, 22 bp, Homo sapiens
aaatgatagtatggaactagga

SEQ ID NO: 7833510 - DNA, 22 bp, Homo sapiens
aaatgatcatgtaatttcagaa

SEQ ID NO: 7833511 - DNA, 22 bp, Homo sapiens
aaatgatgattaaaatgaggta

SEQ ID NO: 7833512 - DNA, 22 bp, Homo sapiens
aaatgatgattaaaatgaggta

SEQ ID NO: 7833513 - DNA, 22 bp, Homo sapiens
aaatgatcatgtaatttcagaa

SEQ ID NO: 7833514 - DNA, 22 bp, Homo sapiens
aaatgatagtatggaactagga

SEQ ID NO: 7833515 - DNA, 22 bp, Homo sapiens
aaatgatagtatggaactagga

SEQ ID NO: 7833516 - DNA, 22 bp, Homo sapiens
aaatgatagtatggaactagga

SEQ ID NO: 7833517 - DNA, 22 bp, Homo sapiens
aaatgagtttgcctctagatag

SEQ ID NO: 7833518 - DNA, 22 bp, Homo sapiens
aaatgagtttgcctctagatag

SEQ ID NO: 7833519 - DNA, 22 bp, Homo sapiens
aaatgagtagcgatgcacatta

SEQ ID NO: 7833520 - DNA, 23 bp, Homo sapiens
aaatgacatatggtttctgaagg

SEQ ID NO: 7833521 - DNA, 23 bp, Homo sapiens
aaatgacatatggtttctgaagg

SEQ ID NO: 7833522 - DNA, 23 bp, Homo sapiens
aaatgacatatggtttctgaagg

SEQ ID NO: 7833523 - DNA, 22 bp, Homo sapiens
aaatgacattaggatcctgcat

SEQ ID NO: 7833524 - DNA, 22 bp, Homo sapiens
aaatgaggccagatcatgcaga

SEQ ID NO: 7833525 - DNA, 22 bp, Homo sapiens
aaatgaggttaatacagtgctt

SEQ ID NO: 7833526 - DNA, 22 bp, Homo sapiens
aaatgagtagcgatgcacatta

SEQ ID NO: 7833527 - DNA, 22 bp, Homo sapiens
aaatgaggccagatcatgcaga

SEQ ID NO: 7833528 - DNA, 22 bp, Homo sapiens
aaatatttgtctgaggcggttg

SEQ ID NO: 7833529 - DNA, 22 bp, Homo sapiens
aaatatttgtctgaggcggttg

SEQ ID NO: 7833530 - DNA, 22 bp, Homo sapiens
aaatatttgtctgaggcggttg

SEQ ID NO: 7833531 - DNA, 22 bp, Homo sapiens
aaatatttgtctgaggcggttg

SEQ ID NO: 7833532 - DNA, 22 bp, Homo sapiens
aaatatttgtctgaggcggttg

SEQ ID NO: 7833533 - DNA, 22 bp, Homo sapiens
aaatatttgtctgaggcggttg

SEQ ID NO: 7833534 - DNA, 22 bp, Homo sapiens
aaatcaaaagacatgtgtttta

SEQ ID NO: 7833535 - DNA, 22 bp, Homo sapiens
aaatcaacttgtgacgttaggt

SEQ ID NO: 7833536 - DNA, 22 bp, Homo sapiens
aaatattgttttggtaagcttc

SEQ ID NO: 7833537 - DNA, 22 bp, Homo sapiens
aaatattggtaggatgcttgtt

SEQ ID NO: 7833538 - DNA, 22 bp, Homo sapiens
aaatattgttttggtaagcttc

SEQ ID NO: 7833539 - DNA, 22 bp, Homo sapiens
aaatatttgtctgaggcggttg

SEQ ID NO: 7833540 - DNA, 22 bp, Homo sapiens
aaatattggtaggatgcttgtt

SEQ ID NO: 7833541 - DNA, 23 bp, Homo sapiens
aaatattcttttttagtaagtgc

SEQ ID NO: 7833542 - DNA, 22 bp, Homo sapiens
aaatattggtaggatgcttgtt

SEQ ID NO: 7833543 - DNA, 23 bp, Homo sapiens
aaatattcttttttagtaagtgc

SEQ ID NO: 7833544 - DNA, 23 bp, Homo sapiens
aaatattcttttttagtaagtgc

SEQ ID NO: 7833545 - DNA, 23 bp, Homo sapiens
aaatattcttttttagtaagtgc

SEQ ID NO: 7833546 - DNA, 23 bp, Homo sapiens
aaatattcttttttagtaagtgc

SEQ ID NO: 7833547 - DNA, 23 bp, Homo sapiens
aaatattcttttttagtaagtgc

SEQ ID NO: 7833548 - DNA, 23 bp, Homo sapiens
aaatattcttttttagtaagtgc

SEQ ID NO: 7833549 - DNA, 22 bp, Homo sapiens
aaatcagaaaatatggagagga

SEQ ID NO: 7833550 - DNA, 22 bp, Homo sapiens
aaatcactgttattgatcttaa

SEQ ID NO: 7833551 - DNA, 22 bp, Homo sapiens
aaatcactgttattgatcttaa

SEQ ID NO: 7833552 - DNA, 22 bp, Homo sapiens
aaatcacttaaatggcttattt

SEQ ID NO: 7833553 - DNA, 22 bp, Homo sapiens
aaatcactgattaaagttagaa

SEQ ID NO: 7833554 - DNA, 22 bp, Homo sapiens
aaatcactgattaaagttagaa

SEQ ID NO: 7833555 - DNA, 22 bp, Homo sapiens
aaatcacagggtctctaagtat

SEQ ID NO: 7833556 - DNA, 17 bp, Homo sapiens
aaatcactgtcagttca

SEQ ID NO: 7833557 - DNA, 21 bp, Homo sapiens
aaatcactgtccaatcttggt

SEQ ID NO: 7833558 - DNA, 21 bp, Homo sapiens
aaatcactgtccaatcttggt

SEQ ID NO: 7833559 - DNA, 22 bp, Homo sapiens
aaatcaaggagggattatattt

SEQ ID NO: 7833560 - DNA, 22 bp, Homo sapiens
aaatcaaggagggattatattt

SEQ ID NO: 7833561 - DNA, 22 bp, Homo sapiens
aaatcaaggagggattatattt

SEQ ID NO: 7833562 - DNA, 22 bp, Homo sapiens
aaatcaaggagggattatattt

SEQ ID NO: 7833563 - DNA, 22 bp, Homo sapiens
aaatcacagggtctctaagtat

SEQ ID NO: 7833564 - DNA, 22 bp, Homo sapiens
aaatcacagggtctctaagtat

SEQ ID NO: 7833565 - DNA, 22 bp, Homo sapiens
aaatcacagggtctctaagtat

SEQ ID NO: 7833566 - DNA, 22 bp, Homo sapiens
aaatcactaagttatagtgtgg

SEQ ID NO: 7833567 - DNA, 22 bp, Homo sapiens
aaatcactaagttatagtgtgg

SEQ ID NO: 7833568 - DNA, 22 bp, Homo sapiens
aaatcactaagttatagtgtgg

SEQ ID NO: 7833569 - DNA, 22 bp, Homo sapiens
aaatgcaagttcatattttgtt

SEQ ID NO: 7833570 - DNA, 22 bp, Homo sapiens
aaatgcaagttcatattttgtt

SEQ ID NO: 7833571 - DNA, 22 bp, Homo sapiens
aaatgcaattcaggaagacaag

SEQ ID NO: 7833572 - DNA, 22 bp, Homo sapiens
aaatgcaattcaggaagacaag

SEQ ID NO: 7833573 - DNA, 22 bp, Homo sapiens
aaatgcaattcaggaagacaag

SEQ ID NO: 7833574 - DNA, 22 bp, Homo sapiens
aaatgcaattcaggaagacaag

SEQ ID NO: 7833575 - DNA, 22 bp, Homo sapiens
aaatgcaattcaggaagacaag

SEQ ID NO: 7833576 - DNA, 22 bp, Homo sapiens
aaatgcaattcaggaagacaag

SEQ ID NO: 7833577 - DNA, 22 bp, Homo sapiens
aaatgcaattgtatgtactcca

SEQ ID NO: 7833578 - DNA, 22 bp, Homo sapiens
aaatgcacaaagtaagtgtaat

SEQ ID NO: 7833579 - DNA, 22 bp, Homo sapiens
aaatgcacaaagtaagtgtaat

SEQ ID NO: 7833580 - DNA, 22 bp, Homo sapiens
aaatgcacaaagattttgcact

SEQ ID NO: 7833581 - DNA, 22 bp, Homo sapiens
aaatgcacaaagattttgcact

SEQ ID NO: 7833582 - DNA, 22 bp, Homo sapiens
aaatgcacaataaagtaaaggc

SEQ ID NO: 7833583 - DNA, 22 bp, Homo sapiens
aaatgcacaataaagtaaaggc

SEQ ID NO: 7833584 - DNA, 22 bp, Homo sapiens
aaatgccaaggagagactgtta

SEQ ID NO: 7833585 - DNA, 22 bp, Homo sapiens
aaatgcacaggagaaccaattc

SEQ ID NO: 7833586 - DNA, 22 bp, Homo sapiens
aaatgcacaggagaaccaattc

SEQ ID NO: 7833587 - DNA, 22 bp, Homo sapiens
aaatgcacaggagaaccaattc

SEQ ID NO: 7833588 - DNA, 22 bp, Homo sapiens
aaatgcacagaggccagagagg

SEQ ID NO: 7833589 - DNA, 22 bp, Homo sapiens
aaatgcacagaaaggatgtgga

SEQ ID NO: 7833590 - DNA, 22 bp, Homo sapiens
aaatgcacagagccttagagat

SEQ ID NO: 7833591 - DNA, 22 bp, Homo sapiens
aaatgcacagaggccagagagg

SEQ ID NO: 7833592 - DNA, 22 bp, Homo sapiens
aaatgcacagaggccagagagg

SEQ ID NO: 7833593 - DNA, 22 bp, Homo sapiens
aaatgcacacaccaggaaacta

SEQ ID NO: 7833594 - DNA, 22 bp, Homo sapiens
aaatgcacaataaagtaaaggc

SEQ ID NO: 7833595 - DNA, 22 bp, Homo sapiens
aaatgcacacaccaggaaacta

SEQ ID NO: 7833596 - DNA, 22 bp, Homo sapiens
aaatgcacaataaagtaaaggc

SEQ ID NO: 7833597 - DNA, 22 bp, Homo sapiens
aaatgcacaataaagtaaaggc

SEQ ID NO: 7833598 - DNA, 22 bp, Homo sapiens
aaatgatgtggagtgaaattgt

SEQ ID NO: 7833599 - DNA, 22 bp, Homo sapiens
aaatgatgtggagtgaaattgt

SEQ ID NO: 7833600 - DNA, 22 bp, Homo sapiens
aaatgatgttataagaccagga

SEQ ID NO: 7833601 - DNA, 22 bp, Homo sapiens
aaatgatgttataagaccagga

SEQ ID NO: 7833602 - DNA, 22 bp, Homo sapiens
aaatgatgtggagtgaaattgt

SEQ ID NO: 7833603 - DNA, 20 bp, Homo sapiens
aaatgatgggaataatctat

SEQ ID NO: 7833604 - DNA, 22 bp, Homo sapiens
aaatgatggtactcatgtttag

SEQ ID NO: 7833605 - DNA, 20 bp, Homo sapiens
aaatgatgggaataatctat

SEQ ID NO: 7833606 - DNA, 20 bp, Homo sapiens
aaatgatgggaataatctat

SEQ ID NO: 7833607 - DNA, 22 bp, Homo sapiens
aaatgatggaaatgaggctgaa

SEQ ID NO: 7833608 - DNA, 22 bp, Homo sapiens
aaatgatgctcacagattagtg

SEQ ID NO: 7833609 - DNA, 22 bp, Homo sapiens
aaatgatgctcacagattagtg

SEQ ID NO: 7833610 - DNA, 22 bp, Homo sapiens
aaatgattgtcaaagttctgtt

SEQ ID NO: 7833611 - DNA, 22 bp, Homo sapiens
aaatgattgtcaaagttctgtt

SEQ ID NO: 7833612 - DNA, 22 bp, Homo sapiens
aaatgattgtcaaagttctgtt

SEQ ID NO: 7833613 - DNA, 22 bp, Homo sapiens
aaatgattgtcaaagttctgtt

SEQ ID NO: 7833614 - DNA, 22 bp, Homo sapiens
aaatgattgtcaaagttctgtt

SEQ ID NO: 7833615 - DNA, 22 bp, Homo sapiens
aaatgcaacgggctttccttat

SEQ ID NO: 7833616 - DNA, 22 bp, Homo sapiens
aaatgcaaggattttgttaggc

SEQ ID NO: 7833617 - DNA, 22 bp, Homo sapiens
aaatgcaaggattttgttaggc

SEQ ID NO: 7833618 - DNA, 22 bp, Homo sapiens
aaatgcaacgggctttccttat

SEQ ID NO: 7833619 - DNA, 22 bp, Homo sapiens
aaatgcaaggccatgtgaagga

SEQ ID NO: 7833620 - DNA, 22 bp, Homo sapiens
aaatgcaaggccatgtgaagga

SEQ ID NO: 7833621 - DNA, 22 bp, Homo sapiens
aaatgcaaggccatgtgaagga

SEQ ID NO: 7833622 - DNA, 22 bp, Homo sapiens
aaatgcaaggattttgttaggc

SEQ ID NO: 7833623 - DNA, 22 bp, Homo sapiens
aaatgcaaggcacattcctttt

SEQ ID NO: 7833624 - DNA, 22 bp, Homo sapiens
aaatgcaaggcacattcctttt

SEQ ID NO: 7833625 - DNA, 22 bp, Homo sapiens
aaatgcaaggcacattcctttt

SEQ ID NO: 7833626 - DNA, 20 bp, Homo sapiens
aaatgctgtaatgtttggga

SEQ ID NO: 7833627 - DNA, 22 bp, Homo sapiens
aaatgctgggaaccattggatc

SEQ ID NO: 7833628 - DNA, 22 bp, Homo sapiens
aaatgctgtagatcagtgagtt

SEQ ID NO: 7833629 - DNA, 22 bp, Homo sapiens
aaatgctgtagatcagtgagtt

SEQ ID NO: 7833630 - DNA, 22 bp, Homo sapiens
aaatgctgtagatcagtgagtt

SEQ ID NO: 7833631 - DNA, 22 bp, Homo sapiens
aaatgctgtcagtgttattgga

SEQ ID NO: 7833632 - DNA, 18 bp, Homo sapiens
aaatgctgctcaaattcc

SEQ ID NO: 7833633 - DNA, 22 bp, Homo sapiens
aaatgctgcagctagtgtgttt

SEQ ID NO: 7833634 - DNA, 22 bp, Homo sapiens
aaatgctgcagctagtgtgttt

SEQ ID NO: 7833635 - DNA, 22 bp, Homo sapiens
aaatgccaggattattagaggc

SEQ ID NO: 7833636 - DNA, 23 bp, Homo sapiens
aaatgccagggagacaggaacca

SEQ ID NO: 7833637 - DNA, 22 bp, Homo sapiens
aaatgctgagtgtttagagatc

SEQ ID NO: 7833638 - DNA, 22 bp, Homo sapiens
aaatgcttagaggtgttcaaat

SEQ ID NO: 7833639 - DNA, 22 bp, Homo sapiens
aaatgctgttcttttaggtaga

SEQ ID NO: 7833640 - DNA, 22 bp, Homo sapiens
aaatgctgtgttttaacataga

SEQ ID NO: 7833641 - DNA, 19 bp, Homo sapiens
aaatgctgtggagggctcc

SEQ ID NO: 7833642 - DNA, 22 bp, Homo sapiens
aaatgctgtgttttaacataga

SEQ ID NO: 7833643 - DNA, 22 bp, Homo sapiens
aaatgctgtgttttaacataga

SEQ ID NO: 7833644 - DNA, 22 bp, Homo sapiens
aaatgctgtgttttaacataga

SEQ ID NO: 7833645 - DNA, 22 bp, Homo sapiens
aaatgcttcacctcattaaact

SEQ ID NO: 7833646 - DNA, 22 bp, Homo sapiens
aaatgcttattagtgtcacaaa

SEQ ID NO: 7833647 - DNA, 22 bp, Homo sapiens
aaatgcttattagtgtcacaaa

SEQ ID NO: 7833648 - DNA, 22 bp, Homo sapiens
aaatgcttattagtgtcacaaa

SEQ ID NO: 7833649 - DNA, 22 bp, Homo sapiens
aaatgcttagaggtgttcaaat

SEQ ID NO: 7833650 - DNA, 22 bp, Homo sapiens
aaatggaactgggctactaggt

SEQ ID NO: 7833651 - DNA, 22 bp, Homo sapiens
aaatggaactgttgtgcatttg

SEQ ID NO: 7833652 - DNA, 22 bp, Homo sapiens
aaatggaactgttgtgcatttg

SEQ ID NO: 7833653 - DNA, 22 bp, Homo sapiens
aaatggaactgggctactaggt

SEQ ID NO: 7833654 - DNA, 22 bp, Homo sapiens
aaatggaaaatgctgttttggt

SEQ ID NO: 7833655 - DNA, 22 bp, Homo sapiens
aaatggaaaatgctgttttggt

SEQ ID NO: 7833656 - DNA, 20 bp, Homo sapiens
aaatgcttttgacacatatt

SEQ ID NO: 7833657 - DNA, 21 bp, Homo sapiens
aaatgctttgtatatatctgt

SEQ ID NO: 7833658 - DNA, 21 bp, Homo sapiens
aaatgctttgtatatatctgt

SEQ ID NO: 7833659 - DNA, 21 bp, Homo sapiens
aaatgctttgtatatatctgt

SEQ ID NO: 7833660 - DNA, 20 bp, Homo sapiens
aaatgcttttgacacatatt

SEQ ID NO: 7833661 - DNA, 20 bp, Homo sapiens
aaatgcttttgacacatatt

SEQ ID NO: 7833662 - DNA, 22 bp, Homo sapiens
aaatgcttgctcttgattattt

SEQ ID NO: 7833663 - DNA, 22 bp, Homo sapiens
aaatgcttgctcttgattattt

SEQ ID NO: 7833664 - DNA, 22 bp, Homo sapiens
aaatgcttgctcttgattattt

SEQ ID NO: 7833665 - DNA, 22 bp, Homo sapiens
aaatgcttgctcttgattattt

SEQ ID NO: 7833666 - DNA, 22 bp, Homo sapiens
aaatgcttgcaacatcccaggt

SEQ ID NO: 7833667 - DNA, 22 bp, Homo sapiens
aaatgcttgcaacatcccaggt

SEQ ID NO: 7833668 - DNA, 22 bp, Homo sapiens
aaatgcttcacctcattaaact

SEQ ID NO: 7833669 - DNA, 22 bp, Homo sapiens
aaatgcttgtatatttcttggt

SEQ ID NO: 7833670 - DNA, 22 bp, Homo sapiens
aaatgcttgtaaattttccatg

SEQ ID NO: 7833671 - DNA, 22 bp, Homo sapiens
aaatgcttgtaaattttccatg

SEQ ID NO: 7833672 - DNA, 22 bp, Homo sapiens
aaatgcttgtaaattttccatg

SEQ ID NO: 7833673 - DNA, 22 bp, Homo sapiens
aaatgctttggtgctggtacag

SEQ ID NO: 7833674 - DNA, 22 bp, Homo sapiens
aaatgcttgtatatttcttggt

SEQ ID NO: 7833675 - DNA, 22 bp, Homo sapiens
aaatgcttgtatatttcttggt

SEQ ID NO: 7833676 - DNA, 22 bp, Homo sapiens
aaatgcttgtatatttcttggt

SEQ ID NO: 7833677 - DNA, 22 bp, Homo sapiens
aaatgctttggtgctggtacag

SEQ ID NO: 7833678 - DNA, 21 bp, Homo sapiens
aaatgctttgtatatatctgt

SEQ ID NO: 7833679 - DNA, 22 bp, Homo sapiens
aaatatgagatgttctctttcg

SEQ ID NO: 7833680 - DNA, 22 bp, Homo sapiens
aaatatgactagaatgccaggt

SEQ ID NO: 7833681 - DNA, 22 bp, Homo sapiens
aaatatgagatgttctctttcg

SEQ ID NO: 7833682 - DNA, 22 bp, Homo sapiens
aaatatgagatgttctctttcg

SEQ ID NO: 7833683 - DNA, 22 bp, Homo sapiens
aagagtttttggagtgtgagtt

SEQ ID NO: 7833684 - DNA, 22 bp, Homo sapiens
aagagtttttaatgggtactgg

SEQ ID NO: 7833685 - DNA, 22 bp, Homo sapiens
aagagttttctctgatggcatt

SEQ ID NO: 7833686 - DNA, 22 bp, Homo sapiens
aagagtttgtcagatctgcacg

SEQ ID NO: 7833687 - DNA, 22 bp, Homo sapiens
aagagttttagacaaactgatt

SEQ ID NO: 7833688 - DNA, 22 bp, Homo sapiens
aagagttttagacaaactgatt

SEQ ID NO: 7833689 - DNA, 22 bp, Homo sapiens
aagagtttgggcaagtcataaa

SEQ ID NO: 7833690 - DNA, 22 bp, Homo sapiens
aagagtttccatgctctgtgct

SEQ ID NO: 7833691 - DNA, 19 bp, Homo sapiens
aaatatcagagagatgata

SEQ ID NO: 7833692 - DNA, 22 bp, Homo sapiens
aagagtttctgattcagtaggt

SEQ ID NO: 7833693 - DNA, 22 bp, Homo sapiens
aagagtttctgggtcaaggatt

SEQ ID NO: 7833694 - DNA, 22 bp, Homo sapiens
aagagtttcttactggcatcta

SEQ ID NO: 7833695 - DNA, 22 bp, Homo sapiens
aaatatagtaaatgcatagttc

SEQ ID NO: 7833696 - DNA, 22 bp, Homo sapiens
aaatatagtaaatgcatagttc

SEQ ID NO: 7833697 - DNA, 22 bp, Homo sapiens
aaatatagtaaatgcatagttc

SEQ ID NO: 7833698 - DNA, 22 bp, Homo sapiens
aaatatagtaaatgcatagttc

SEQ ID NO: 7833699 - DNA, 22 bp, Homo sapiens
aaatatactagatgatgaccca

SEQ ID NO: 7833700 - DNA, 22 bp, Homo sapiens
aaatatagtgacacttatagtc

SEQ ID NO: 7833701 - DNA, 22 bp, Homo sapiens
aaatatagtgacacttatagtc

SEQ ID NO: 7833702 - DNA, 22 bp, Homo sapiens
aaatatagtgacacttatagtc

SEQ ID NO: 7833703 - DNA, 22 bp, Homo sapiens
aaatatagtgacacttatagtc

SEQ ID NO: 7833704 - DNA, 22 bp, Homo sapiens
aaatatagtgacacttatagtc

SEQ ID NO: 7833705 - DNA, 22 bp, Homo sapiens
aaatatagtgacacttatagtc

SEQ ID NO: 7833706 - DNA, 19 bp, Homo sapiens
aaatatcagagagatgata

SEQ ID NO: 7833707 - DNA, 22 bp, Homo sapiens
aagagagacaataggtagcatt

SEQ ID NO: 7833708 - DNA, 22 bp, Homo sapiens
aagagagaccatgggggacagg

SEQ ID NO: 7833709 - DNA, 22 bp, Homo sapiens
aagagagaccatgggggacagg

SEQ ID NO: 7833710 - DNA, 22 bp, Homo sapiens
aagagagaccatgggggacagg

SEQ ID NO: 7833711 - DNA, 22 bp, Homo sapiens
aagagagaccatgggggacagg

SEQ ID NO: 7833712 - DNA, 22 bp, Homo sapiens
aagagagaagtctctctggttc

SEQ ID NO: 7833713 - DNA, 22 bp, Homo sapiens
aagagagacaataggtagcatt

SEQ ID NO: 7833714 - DNA, 22 bp, Homo sapiens
aagagagacaataggtagcatt

SEQ ID NO: 7833715 - DNA, 22 bp, Homo sapiens
aagagagacaataggtagcatt

SEQ ID NO: 7833716 - DNA, 22 bp, Homo sapiens
aagagagagcattcttctgtta

SEQ ID NO: 7833717 - DNA, 22 bp, Homo sapiens
aagagagagtgcgctcacagaa

SEQ ID NO: 7833718 - DNA, 22 bp, Homo sapiens
aagagagagtgcgctcacagaa

SEQ ID NO: 7833719 - DNA, 22 bp, Homo sapiens
aagagagagcattcttctgtta

SEQ ID NO: 7833720 - DNA, 22 bp, Homo sapiens
aagagagagtgcgctcacagaa

SEQ ID NO: 7833721 - DNA, 22 bp, Homo sapiens
aagagagagttcctaggcaaaa

SEQ ID NO: 7833722 - DNA, 22 bp, Homo sapiens
aagagagagttcctaggcaaaa

SEQ ID NO: 7833723 - DNA, 22 bp, Homo sapiens
aagagagagttcctaggcaaaa

SEQ ID NO: 7833724 - DNA, 22 bp, Homo sapiens
aagagagagttcctaggcaaaa

SEQ ID NO: 7833725 - DNA, 22 bp, Homo sapiens
aaatatacggtccctaacagtc

SEQ ID NO: 7833726 - DNA, 22 bp, Homo sapiens
aaatatacggtccctaacagtc

SEQ ID NO: 7833727 - DNA, 22 bp, Homo sapiens
aaatatactagatgatgaccca

SEQ ID NO: 7833728 - DNA, 22 bp, Homo sapiens
aaatatactagatgatgaccca

SEQ ID NO: 7833729 - DNA, 22 bp, Homo sapiens
aaatatactagatgatgaccca

SEQ ID NO: 7833730 - DNA, 22 bp, Homo sapiens
aaatatactagatgatgaccca

SEQ ID NO: 7833731 - DNA, 22 bp, Homo sapiens
aaatatagcaattatgcctact

SEQ ID NO: 7833732 - DNA, 22 bp, Homo sapiens
aaatatagcaattatgcctact

SEQ ID NO: 7833733 - DNA, 22 bp, Homo sapiens
aaatatagcaattatgcctact

SEQ ID NO: 7833734 - DNA, 22 bp, Homo sapiens
aaatatagcaattatgcctact

SEQ ID NO: 7833735 - DNA, 22 bp, Homo sapiens
aaatatagtaaatgcatagttc

SEQ ID NO: 7833736 - DNA, 22 bp, Homo sapiens
aaatatagtaaatgcatagttc

SEQ ID NO: 7833737 - DNA, 22 bp, Homo sapiens
aaatatagtaaatgcatagttc

SEQ ID NO: 7833738 - DNA, 22 bp, Homo sapiens
aaatatagtaaatgcatagttc

SEQ ID NO: 7833739 - DNA, 22 bp, Homo sapiens
aaatagtaaagtggtagccatc

SEQ ID NO: 7833740 - DNA, 22 bp, Homo sapiens
aaatagtaaagtggtagccatc

SEQ ID NO: 7833741 - DNA, 22 bp, Homo sapiens
aaatagtaaagtggtagccatc

SEQ ID NO: 7833742 - DNA, 22 bp, Homo sapiens
aaatagtcctgggaatagtact

SEQ ID NO: 7833743 - DNA, 22 bp, Homo sapiens
aaatagtcctgggaatagtact

SEQ ID NO: 7833744 - DNA, 22 bp, Homo sapiens
aaatagtcctgggaatagtact

SEQ ID NO: 7833745 - DNA, 22 bp, Homo sapiens
aaatagtcctgggaatagtact

SEQ ID NO: 7833746 - DNA, 22 bp, Homo sapiens
aaatatacggtccctaacagtc

SEQ ID NO: 7833747 - DNA, 22 bp, Homo sapiens
aaatatacggtccctaacagtc

SEQ ID NO: 7833748 - DNA, 22 bp, Homo sapiens
aaatatacggtccctaacagtc

SEQ ID NO: 7833749 - DNA, 22 bp, Homo sapiens
aaatataccagttgcctgcatc

SEQ ID NO: 7833750 - DNA, 22 bp, Homo sapiens
aaatataccagttgcctgcatc

SEQ ID NO: 7833751 - DNA, 22 bp, Homo sapiens
aaatataccagttgcctgcatc

SEQ ID NO: 7833752 - DNA, 22 bp, Homo sapiens
aaatataatttctgcctcaata

SEQ ID NO: 7833753 - DNA, 22 bp, Homo sapiens
aaagttgttcagtaagaaactc

SEQ ID NO: 7833754 - DNA, 22 bp, Homo sapiens
aaagttgtaatggaagaaatgc

SEQ ID NO: 7833755 - DNA, 22 bp, Homo sapiens
aaagttgtgaaaccgaacatgt

SEQ ID NO: 7833756 - DNA, 22 bp, Homo sapiens
aaagttgtggtttgatgcagtt

SEQ ID NO: 7833757 - DNA, 22 bp, Homo sapiens
aagaagcagagctgtgggtgtt

SEQ ID NO: 7833758 - DNA, 22 bp, Homo sapiens
aaagttgttcagtaagaaactc

SEQ ID NO: 7833759 - DNA, 22 bp, Homo sapiens
aagaagcagctgccaggccagt

SEQ ID NO: 7833760 - DNA, 22 bp, Homo sapiens
aagaagcagctgccaggccagt

SEQ ID NO: 7833761 - DNA, 22 bp, Homo sapiens
aagaagcagctgccaggccagt

SEQ ID NO: 7833762 - DNA, 22 bp, Homo sapiens
aaagttgatttggagggatatt

SEQ ID NO: 7833763 - DNA, 22 bp, Homo sapiens
aaagttgatttggagggatatt

SEQ ID NO: 7833764 - DNA, 22 bp, Homo sapiens
aaagttgtaatggaagaaatgc

SEQ ID NO: 7833765 - DNA, 22 bp, Homo sapiens
aaagttggatttcatcctcatg

SEQ ID NO: 7833766 - DNA, 22 bp, Homo sapiens
aaagttgaccgaaagattttga

SEQ ID NO: 7833767 - DNA, 22 bp, Homo sapiens
aaagttgactactaaggaatgt

SEQ ID NO: 7833768 - DNA, 22 bp, Homo sapiens
aaagttctttctcttatttggt

SEQ ID NO: 7833769 - DNA, 22 bp, Homo sapiens
aaagttctttctcttatttggt

SEQ ID NO: 7833770 - DNA, 19 bp, Homo sapiens
aaagttgagaaacaatgga

SEQ ID NO: 7833771 - DNA, 19 bp, Homo sapiens
aaagttgagaaacaatgga

SEQ ID NO: 7833772 - DNA, 19 bp, Homo sapiens
aaagttgagaaacaatgga

SEQ ID NO: 7833773 - DNA, 22 bp, Homo sapiens
aaagttgagtgctgatctgatt

SEQ ID NO: 7833774 - DNA, 22 bp, Homo sapiens
aaagttgagttttatgtgttac

SEQ ID NO: 7833775 - DNA, 22 bp, Homo sapiens
aagaagcatggctgtagattcc

SEQ ID NO: 7833776 - DNA, 22 bp, Homo sapiens
aagaagcatggctgtagattcc

SEQ ID NO: 7833777 - DNA, 22 bp, Homo sapiens
aagaagcatggctgtagattcc

SEQ ID NO: 7833778 - DNA, 22 bp, Homo sapiens
aagaagcatggctgtagattcc

SEQ ID NO: 7833779 - DNA, 20 bp, Homo sapiens
aagaagccgggaaggcaggc

SEQ ID NO: 7833780 - DNA, 20 bp, Homo sapiens
aagaagccgggaaggcaggc

SEQ ID NO: 7833781 - DNA, 22 bp, Homo sapiens
aagaagcattctttcattggtt

SEQ ID NO: 7833782 - DNA, 22 bp, Homo sapiens
aagaagcaggtcacagacaggg

SEQ ID NO: 7833783 - DNA, 22 bp, Homo sapiens
aagaagcagctgccaggccagt

SEQ ID NO: 7833784 - DNA, 22 bp, Homo sapiens
aagaagcaggtcacagacaggg

SEQ ID NO: 7833785 - DNA, 22 bp, Homo sapiens
aagaagcaggtcacagacaggg

SEQ ID NO: 7833786 - DNA, 22 bp, Homo sapiens
aagaagcatgagaagattttat

SEQ ID NO: 7833787 - DNA, 22 bp, Homo sapiens
aagaagcatgagaagattttat

SEQ ID NO: 7833788 - DNA, 22 bp, Homo sapiens
aagaaggcggaccagaagggag

SEQ ID NO: 7833789 - DNA, 22 bp, Homo sapiens
aagaaggcggaccagaagggag

SEQ ID NO: 7833790 - DNA, 22 bp, Homo sapiens
aagaaggcggaccagaagggag

SEQ ID NO: 7833791 - DNA, 22 bp, Homo sapiens
aagaaggcggaccagaagggag

SEQ ID NO: 7833792 - DNA, 22 bp, Homo sapiens
aagaaggcctggtagacgtctt

SEQ ID NO: 7833793 - DNA, 22 bp, Homo sapiens
aagaaggcggaccagaagggag

SEQ ID NO: 7833794 - DNA, 22 bp, Homo sapiens
aagaaggcctctgccctggctt

SEQ ID NO: 7833795 - DNA, 20 bp, Homo sapiens
aagaaggcctgcccagacac

SEQ ID NO: 7833796 - DNA, 22 bp, Homo sapiens
aagaagctgatgcagagggttc

SEQ ID NO: 7833797 - DNA, 22 bp, Homo sapiens
aagaagctgtagggattaactc

SEQ ID NO: 7833798 - DNA, 22 bp, Homo sapiens
aagaagctgatgcagagggttc

SEQ ID NO: 7833799 - DNA, 22 bp, Homo sapiens
aagaagctgtagggattaactc

SEQ ID NO: 7833800 - DNA, 22 bp, Homo sapiens
aagaagctgtagggattaactc

SEQ ID NO: 7833801 - DNA, 22 bp, Homo sapiens
aaatacaaaaattagccaggca

SEQ ID NO: 7833802 - DNA, 22 bp, Homo sapiens
aaatacaaaaattagccaggca

SEQ ID NO: 7833803 - DNA, 22 bp, Homo sapiens
aaatacaaaaattagccaggca

SEQ ID NO: 7833804 - DNA, 22 bp, Homo sapiens
aaatacaaaaattagccaggca

SEQ ID NO: 7833805 - DNA, 22 bp, Homo sapiens
aaatacaaaaattagccaggca

SEQ ID NO: 7833806 - DNA, 22 bp, Homo sapiens
aaatacaaaaattagccaggca

SEQ ID NO: 7833807 - DNA, 22 bp, Homo sapiens
aaatacaaaaattagccaggca

SEQ ID NO: 7833808 - DNA, 22 bp, Homo sapiens
aaatacaaaaattagccaggca

SEQ ID NO: 7833809 - DNA, 22 bp, Homo sapiens
aagaagttaaataaatggacca

SEQ ID NO: 7833810 - DNA, 22 bp, Homo sapiens
aagaagttaaataaatggacca

SEQ ID NO: 7833811 - DNA, 22 bp, Homo sapiens
aagaaggcttcagagcccagga

SEQ ID NO: 7833812 - DNA, 22 bp, Homo sapiens
aagaaggtgtggaaagatgctc

SEQ ID NO: 7833813 - DNA, 22 bp, Homo sapiens
aagaagtctggagcaatgcaat

SEQ ID NO: 7833814 - DNA, 19 bp, Homo sapiens
aaatacagcagctgtttcc

SEQ ID NO: 7833815 - DNA, 19 bp, Homo sapiens
aaatacagcagctgtttcc

SEQ ID NO: 7833816 - DNA, 22 bp, Homo sapiens
aaatacaggagtttggacttct

SEQ ID NO: 7833817 - DNA, 22 bp, Homo sapiens
aaatacaggagtttggacttct

SEQ ID NO: 7833818 - DNA, 22 bp, Homo sapiens
aaatacaggagtttggacttct

SEQ ID NO: 7833819 - DNA, 22 bp, Homo sapiens
aaatacaggagtttggacttct

SEQ ID NO: 7833820 - DNA, 22 bp, Homo sapiens
aaatacagattcttgtgtctat

SEQ ID NO: 7833821 - DNA, 22 bp, Homo sapiens
aaatacagattcttgtgtctat

SEQ ID NO: 7833822 - DNA, 22 bp, Homo sapiens
aaatacagcagactcctgttgt

SEQ ID NO: 7833823 - DNA, 22 bp, Homo sapiens
aaatacagcagactcctgttgt

SEQ ID NO: 7833824 - DNA, 22 bp, Homo sapiens
aaatacagcagactcctgttgt

SEQ ID NO: 7833825 - DNA, 22 bp, Homo sapiens
aaatacagattctgactcagag

SEQ ID NO: 7833826 - DNA, 22 bp, Homo sapiens
aagagagaactcccttcgccag

SEQ ID NO: 7833827 - DNA, 22 bp, Homo sapiens
aagagagaagtctctctggttc

SEQ ID NO: 7833828 - DNA, 22 bp, Homo sapiens
aagagagaactcccttcgccag

SEQ ID NO: 7833829 - DNA, 22 bp, Homo sapiens
aagagagaactcccttcgccag

SEQ ID NO: 7833830 - DNA, 22 bp, Homo sapiens
aagagagaactcccttcgccag

SEQ ID NO: 7833831 - DNA, 22 bp, Homo sapiens
aaatacatacactgtacgtggc

SEQ ID NO: 7833832 - DNA, 22 bp, Homo sapiens
aaatacatacactgtacgtggc

SEQ ID NO: 7833833 - DNA, 22 bp, Homo sapiens
aaatacatacactgtacgtggc

SEQ ID NO: 7833834 - DNA, 22 bp, Homo sapiens
aaatacatacactgtacgtggc

SEQ ID NO: 7833835 - DNA, 22 bp, Homo sapiens
aaatacatacactgtacgtggc

SEQ ID NO: 7833836 - DNA, 22 bp, Homo sapiens
aaatacataaaggttgtaccag

SEQ ID NO: 7833837 - DNA, 22 bp, Homo sapiens
aaatacagtgtgtgttctttga

SEQ ID NO: 7833838 - DNA, 22 bp, Homo sapiens
aaatacagtgtgtgttctttga

SEQ ID NO: 7833839 - DNA, 22 bp, Homo sapiens
aaatacataaaggttgtaccag

SEQ ID NO: 7833840 - DNA, 22 bp, Homo sapiens
aaatacataaaggttgtaccag

SEQ ID NO: 7833841 - DNA, 22 bp, Homo sapiens
aaatacataaaggttgtaccag

SEQ ID NO: 7833842 - DNA, 22 bp, Homo sapiens
aaatacataaaggttgtaccag

SEQ ID NO: 7833843 - DNA, 22 bp, Homo sapiens
aaatacagtgtgtgttctttga

SEQ ID NO: 7833844 - DNA, 22 bp, Homo sapiens
aaatacagtgtgtgttctttga

SEQ ID NO: 7833845 - DNA, 22 bp, Homo sapiens
aaatacagtggcagcagataat

SEQ ID NO: 7833846 - DNA, 22 bp, Homo sapiens
aaatacagtgtgtgttctttga

SEQ ID NO: 7833847 - DNA, 22 bp, Homo sapiens
aaatacagtggcagcagataat

SEQ ID NO: 7833848 - DNA, 22 bp, Homo sapiens
aaatacagtggcagcagataat

SEQ ID NO: 7833849 - DNA, 22 bp, Homo sapiens
aaatacagtggcagcagataat

SEQ ID NO: 7833850 - DNA, 22 bp, Homo sapiens
aaatacagtggcagcagataat

SEQ ID NO: 7833851 - DNA, 22 bp, Homo sapiens
aaatacagtggcagcagataat

SEQ ID NO: 7833852 - DNA, 22 bp, Homo sapiens
aaatacagtggcagcagataat

SEQ ID NO: 7833853 - DNA, 22 bp, Homo sapiens
aaaggcatgattaattctgtgt

SEQ ID NO: 7833854 - DNA, 22 bp, Homo sapiens
aaaggcatgcatggtctgctcc

SEQ ID NO: 7833855 - DNA, 22 bp, Homo sapiens
aaaggcatgcctccatttctat

SEQ ID NO: 7833856 - DNA, 22 bp, Homo sapiens
aaaggcatgcctccatttctat

SEQ ID NO: 7833857 - DNA, 22 bp, Homo sapiens
aaaggcatgcctccatttctat

SEQ ID NO: 7833858 - DNA, 22 bp, Homo sapiens
aaaggctatgagatagaagata

SEQ ID NO: 7833859 - DNA, 22 bp, Homo sapiens
aacatgatttagtataatgcag

SEQ ID NO: 7833860 - DNA, 22 bp, Homo sapiens
aacatgatttcatgcatttaga

SEQ ID NO: 7833861 - DNA, 22 bp, Homo sapiens
aacatgattggaaaatgctgtc

SEQ ID NO: 7833862 - DNA, 22 bp, Homo sapiens
aacatgatagtattttgaggtg

SEQ ID NO: 7833863 - DNA, 21 bp, Homo sapiens
aacatgatatgtgtatggatt

SEQ ID NO: 7833864 - DNA, 22 bp, Homo sapiens
aacatgagtgataaaattacct

SEQ ID NO: 7833865 - DNA, 22 bp, Homo sapiens
aacatgaggcactgagtttcat

SEQ ID NO: 7833866 - DNA, 22 bp, Homo sapiens
aacatgagcattcttgtgcttg

SEQ ID NO: 7833867 - DNA, 22 bp, Homo sapiens
aacatgagcattcttgtgcttg

SEQ ID NO: 7833868 - DNA, 19 bp, Homo sapiens
aacatgacagccactctgg

SEQ ID NO: 7833869 - DNA, 22 bp, Homo sapiens
aacatgaagttttctatagtga

SEQ ID NO: 7833870 - DNA, 22 bp, Homo sapiens
aacatgaagttttctatagtga

SEQ ID NO: 7833871 - DNA, 22 bp, Homo sapiens
aacatgaagttttctatagtga

SEQ ID NO: 7833872 - DNA, 22 bp, Homo sapiens
aacatgatggggaagaacaaga

SEQ ID NO: 7833873 - DNA, 22 bp, Homo sapiens
aacatgatgacaaaggtatatt

SEQ ID NO: 7833874 - DNA, 22 bp, Homo sapiens
aacatgatgtgaagcatgaact

SEQ ID NO: 7833875 - DNA, 22 bp, Homo sapiens
aacatgatgtattttcttgtct

SEQ ID NO: 7833876 - DNA, 22 bp, Homo sapiens
aacatgatgtattttcttgtct

SEQ ID NO: 7833877 - DNA, 22 bp, Homo sapiens
aacatgatggggaagaacaaga

SEQ ID NO: 7833878 - DNA, 22 bp, Homo sapiens
aaaggctgacagggtcctaagt

SEQ ID NO: 7833879 - DNA, 22 bp, Homo sapiens
aaaggctgcaaagctgtaagtg

SEQ ID NO: 7833880 - DNA, 22 bp, Homo sapiens
aaaggctgccaggtaaaatatt

SEQ ID NO: 7833881 - DNA, 22 bp, Homo sapiens
aaaggctgccaggtaaaatatt

SEQ ID NO: 7833882 - DNA, 22 bp, Homo sapiens
aaaggctctaacaaggagagag

SEQ ID NO: 7833883 - DNA, 22 bp, Homo sapiens
aaaggctctaacaaggagagag

SEQ ID NO: 7833884 - DNA, 22 bp, Homo sapiens
aaaggctctaacaaggagagag

SEQ ID NO: 7833885 - DNA, 18 bp, Homo sapiens
aaaggctgaatatagaag

SEQ ID NO: 7833886 - DNA, 22 bp, Homo sapiens
aaaggctcatgaaccaggctcg

SEQ ID NO: 7833887 - DNA, 22 bp, Homo sapiens
aaaggctcatgaaccaggctcg

SEQ ID NO: 7833888 - DNA, 22 bp, Homo sapiens
aaaggctccttctcccatgacc

SEQ ID NO: 7833889 - DNA, 22 bp, Homo sapiens
aaaggctcagatgaggccctgg

SEQ ID NO: 7833890 - DNA, 22 bp, Homo sapiens
aaaggctcagaatcggcagacc

SEQ ID NO: 7833891 - DNA, 22 bp, Homo sapiens
aaaggctcatgaaccaggctcg

SEQ ID NO: 7833892 - DNA, 22 bp, Homo sapiens
aaaggctcacgcagttagtgat

SEQ ID NO: 7833893 - DNA, 22 bp, Homo sapiens
aaaggctcagaatcggcagacc

SEQ ID NO: 7833894 - DNA, 22 bp, Homo sapiens
aaaggctatgagatagaagata

SEQ ID NO: 7833895 - DNA, 22 bp, Homo sapiens
aaaggctatttttagatgtttg

SEQ ID NO: 7833896 - DNA, 22 bp, Homo sapiens
aaaggctatttcagggtcagta

SEQ ID NO: 7833897 - DNA, 22 bp, Homo sapiens
aaaggctattgctgataatgtt

SEQ ID NO: 7833898 - DNA, 22 bp, Homo sapiens
aaaggctcaacagctgtacttt

SEQ ID NO: 7833899 - DNA, 22 bp, Homo sapiens
aaaggctatgatagtccagtgg

SEQ ID NO: 7833900 - DNA, 22 bp, Homo sapiens
aaaggctattcagggacttgcc

SEQ ID NO: 7833901 - DNA, 22 bp, Homo sapiens
aaaggctattcagggacttgcc

SEQ ID NO: 7833902 - DNA, 22 bp, Homo sapiens
aaaggctatgagatagaagata

SEQ ID NO: 7833903 - DNA, 22 bp, Homo sapiens
aaaggctatgagatagaagata

SEQ ID NO: 7833904 - DNA, 22 bp, Homo sapiens
aaaggctatgagatagaagata

SEQ ID NO: 7833905 - DNA, 22 bp, Homo sapiens
aaaggcttctttgctccatgtc

SEQ ID NO: 7833906 - DNA, 22 bp, Homo sapiens
aaaggcttctttgctccatgtc

SEQ ID NO: 7833907 - DNA, 22 bp, Homo sapiens
aaaggcttctttgctccatgtc

SEQ ID NO: 7833908 - DNA, 22 bp, Homo sapiens
aaaggcttgcgattccttgtaa

SEQ ID NO: 7833909 - DNA, 22 bp, Homo sapiens
aaaggcttagacacagaactgt

SEQ ID NO: 7833910 - DNA, 22 bp, Homo sapiens
aaaggctggggactgaggaagg

SEQ ID NO: 7833911 - DNA, 22 bp, Homo sapiens
aaaggcttaacagaagaccttt

SEQ ID NO: 7833912 - DNA, 22 bp, Homo sapiens
aaaggctggggactgaggaagg

SEQ ID NO: 7833913 - DNA, 22 bp, Homo sapiens
aaaggctggattcagagaggtg

SEQ ID NO: 7833914 - DNA, 22 bp, Homo sapiens
aaagggaaaatatttagacata

SEQ ID NO: 7833915 - DNA, 22 bp, Homo sapiens
aaagggaaaatatttagacata

SEQ ID NO: 7833916 - DNA, 22 bp, Homo sapiens
aaagggaactctaattatcttc

SEQ ID NO: 7833917 - DNA, 22 bp, Homo sapiens
aaagggaactctaattatcttc

SEQ ID NO: 7833918 - DNA, 22 bp, Homo sapiens
aaagggaactctaattatcttc

SEQ ID NO: 7833919 - DNA, 22 bp, Homo sapiens
aaagggaagttgcacatgttcc

SEQ ID NO: 7833920 - DNA, 22 bp, Homo sapiens
aaagggaagttgcacatgttcc

SEQ ID NO: 7833921 - DNA, 22 bp, Homo sapiens
aaagggaactctaattatcttc

SEQ ID NO: 7833922 - DNA, 22 bp, Homo sapiens
aaagggaatgtgtaggacatgt

SEQ ID NO: 7833923 - DNA, 22 bp, Homo sapiens
aaagggaatgtgtaggacatgt

SEQ ID NO: 7833924 - DNA, 22 bp, Homo sapiens
aaagggaagttgcacatgttcc

SEQ ID NO: 7833925 - DNA, 22 bp, Homo sapiens
aaagggaaaatatttagacata

SEQ ID NO: 7833926 - DNA, 22 bp, Homo sapiens
aaagggagcatggctgcaggga

SEQ ID NO: 7833927 - DNA, 22 bp, Homo sapiens
aaagggagcatggctgcaggga

SEQ ID NO: 7833928 - DNA, 22 bp, Homo sapiens
aaagggagcatggctgcaggga

SEQ ID NO: 7833929 - DNA, 22 bp, Homo sapiens
aaagggaggggcgataagccgg

SEQ ID NO: 7833930 - DNA, 22 bp, Homo sapiens
aaagggcagagttcactagaaa

SEQ ID NO: 7833931 - DNA, 22 bp, Homo sapiens
aaagtcacatataacaagggca

SEQ ID NO: 7833932 - DNA, 22 bp, Homo sapiens
aaagtcacatataacaagggca

SEQ ID NO: 7833933 - DNA, 22 bp, Homo sapiens
aaagtcacatataacaagggca

SEQ ID NO: 7833934 - DNA, 22 bp, Homo sapiens
aaagtcctgttaactgttaaca

SEQ ID NO: 7833935 - DNA, 22 bp, Homo sapiens
aaagtcctgttaactgttaaca

SEQ ID NO: 7833936 - DNA, 22 bp, Homo sapiens
aaagtcctgtttgaaggacctg

SEQ ID NO: 7833937 - DNA, 22 bp, Homo sapiens
aaagtcctgtttgaaggacctg

SEQ ID NO: 7833938 - DNA, 22 bp, Homo sapiens
aaagtccttgcagtttcctctt

SEQ ID NO: 7833939 - DNA, 22 bp, Homo sapiens
aaagtcctttttgccatgcaag

SEQ ID NO: 7833940 - DNA, 22 bp, Homo sapiens
aaagtcctttttgccatgcaag

SEQ ID NO: 7833941 - DNA, 22 bp, Homo sapiens
aaagtcctttttgccatgcaag

SEQ ID NO: 7833942 - DNA, 22 bp, Homo sapiens
aaagtctaaattattcaataag

SEQ ID NO: 7833943 - DNA, 22 bp, Homo sapiens
aaagtctaaattattcaataag

SEQ ID NO: 7833944 - DNA, 22 bp, Homo sapiens
aaagtctaaattattcaataag

SEQ ID NO: 7833945 - DNA, 22 bp, Homo sapiens
aaagtctatcagttactaatca

SEQ ID NO: 7833946 - DNA, 22 bp, Homo sapiens
aaagtccagagggcacactgaa

SEQ ID NO: 7833947 - DNA, 22 bp, Homo sapiens
aaagtcacgctgatgggaaatg

SEQ ID NO: 7833948 - DNA, 22 bp, Homo sapiens
aaagtcacgctgatgggaaatg

SEQ ID NO: 7833949 - DNA, 22 bp, Homo sapiens
aaagtcctagcgatccacagaa

SEQ ID NO: 7833950 - DNA, 22 bp, Homo sapiens
aaagtcctagcgatccacagaa

SEQ ID NO: 7833951 - DNA, 22 bp, Homo sapiens
aaagtcctagcgatccacagaa

SEQ ID NO: 7833952 - DNA, 22 bp, Homo sapiens
aaagtctttctcattggccatg

SEQ ID NO: 7833953 - DNA, 22 bp, Homo sapiens
aaagtctttctcatagtcacgc

SEQ ID NO: 7833954 - DNA, 22 bp, Homo sapiens
aaagtctttattttgtatcttt

SEQ ID NO: 7833955 - DNA, 22 bp, Homo sapiens
aaagtctttattttgtatcttt

SEQ ID NO: 7833956 - DNA, 22 bp, Homo sapiens
aacttccttctagttcatatgt

SEQ ID NO: 7833957 - DNA, 22 bp, Homo sapiens
aacttccttctagttcatatgt

SEQ ID NO: 7833958 - DNA, 22 bp, Homo sapiens
aacttcctgacttctaatgagt

SEQ ID NO: 7833959 - DNA, 22 bp, Homo sapiens
aacttccaggccttgaattatt

SEQ ID NO: 7833960 - DNA, 22 bp, Homo sapiens
aacttccttctagttcatatgt

SEQ ID NO: 7833961 - DNA, 22 bp, Homo sapiens
aaagtctttctcattggccatg

SEQ ID NO: 7833962 - DNA, 22 bp, Homo sapiens
aacttccagctttctgtctaat

SEQ ID NO: 7833963 - DNA, 22 bp, Homo sapiens
aaagtcttcacggcactagtgt

SEQ ID NO: 7833964 - DNA, 22 bp, Homo sapiens
aaagtcttgttacgttccattg

SEQ ID NO: 7833965 - DNA, 22 bp, Homo sapiens
aaagtcttcacggcactagtgt

SEQ ID NO: 7833966 - DNA, 20 bp, Homo sapiens
aaagtctgtttatctctgga

SEQ ID NO: 7833967 - DNA, 20 bp, Homo sapiens
aaagtctgtttatctctgga

SEQ ID NO: 7833968 - DNA, 22 bp, Homo sapiens
aaagtcctttttgccatgcaag

SEQ ID NO: 7833969 - DNA, 22 bp, Homo sapiens
aaagtctgaaagataagagtga

SEQ ID NO: 7833970 - DNA, 22 bp, Homo sapiens
aaagtctgaaagataagagtga

SEQ ID NO: 7833971 - DNA, 22 bp, Homo sapiens
aaagtctgaaagatgctaacat

SEQ ID NO: 7833972 - DNA, 22 bp, Homo sapiens
aaagttctctatggtgtaaaaa

SEQ ID NO: 7833973 - DNA, 22 bp, Homo sapiens
aaagttctcctggattgtgctg

SEQ ID NO: 7833974 - DNA, 22 bp, Homo sapiens
aaagttctgagactgatggcta

SEQ ID NO: 7833975 - DNA, 22 bp, Homo sapiens
aaagttctgagactgatggcta

SEQ ID NO: 7833976 - DNA, 22 bp, Homo sapiens
aaagttctgagaagcagtttac

SEQ ID NO: 7833977 - DNA, 23 bp, Homo sapiens
aaagttctcttgcgtgtgggaaa

SEQ ID NO: 7833978 - DNA, 19 bp, Homo sapiens
aaagttctgactgtagagc

SEQ ID NO: 7833979 - DNA, 22 bp, Homo sapiens
aaagttctatgtaatgtttttt

SEQ ID NO: 7833980 - DNA, 22 bp, Homo sapiens
aaagttctattggatagtgctg

SEQ ID NO: 7833981 - DNA, 22 bp, Homo sapiens
aaagttacacgactatttatgt

SEQ ID NO: 7833982 - DNA, 22 bp, Homo sapiens
aaagttacacgactatttatgt

SEQ ID NO: 7833983 - DNA, 22 bp, Homo sapiens
aaagttctgatgctgatcaaag

SEQ ID NO: 7833984 - DNA, 22 bp, Homo sapiens
aaagttctgatgctgatcaaag

SEQ ID NO: 7833985 - DNA, 22 bp, Homo sapiens
aaagttctggcattttctgtct

SEQ ID NO: 7833986 - DNA, 22 bp, Homo sapiens
aaagttctgggggagaagaacg

SEQ ID NO: 7833987 - DNA, 22 bp, Homo sapiens
aaagttctgggggtgtttctgg

SEQ ID NO: 7833988 - DNA, 22 bp, Homo sapiens
aacttctgccaaacagctgtta

SEQ ID NO: 7833989 - DNA, 22 bp, Homo sapiens
aacttctgccaaacagctgtta

SEQ ID NO: 7833990 - DNA, 22 bp, Homo sapiens
aacttctggatgtttcaaatgt

SEQ ID NO: 7833991 - DNA, 22 bp, Homo sapiens
aacttctgggctgtccaaaact

SEQ ID NO: 7833992 - DNA, 22 bp, Homo sapiens
aacttctcaactagcttagagt

SEQ ID NO: 7833993 - DNA, 22 bp, Homo sapiens
aacttctaatctgtacagtttt

SEQ ID NO: 7833994 - DNA, 22 bp, Homo sapiens
aacttctgacctcaagaactgt

SEQ ID NO: 7833995 - DNA, 22 bp, Homo sapiens
aacttctgacctcaagaactgt

SEQ ID NO: 7833996 - DNA, 22 bp, Homo sapiens
aacttcttggtcctgagctgtt

SEQ ID NO: 7833997 - DNA, 22 bp, Homo sapiens
aacttgaaactgttccagaaaa

SEQ ID NO: 7833998 - DNA, 22 bp, Homo sapiens
aacttgaaactgttccagaaaa

SEQ ID NO: 7833999 - DNA, 22 bp, Homo sapiens
aacttgaaaacctcatgaattg

SEQ ID NO: 7834000 - DNA, 22 bp, Homo sapiens
aacttgaatgagaacttttgcc

SEQ ID NO: 7834001 - DNA, 22 bp, Homo sapiens
aacttgaatgagaacttttgcc

SEQ ID NO: 7834002 - DNA, 22 bp, Homo sapiens
aacttgaagaggctttttggca

SEQ ID NO: 7834003 - DNA, 22 bp, Homo sapiens
aacttgaagttgcagaaagtac

SEQ ID NO: 7834004 - DNA, 22 bp, Homo sapiens
aacttgaagttgcagaaagtac

SEQ ID NO: 7834005 - DNA, 22 bp, Homo sapiens
aacttgaactgatgagtgttag

SEQ ID NO: 7834006 - DNA, 22 bp, Homo sapiens
aacatgaaacccaaacagaata

SEQ ID NO: 7834007 - DNA, 22 bp, Homo sapiens
aacatgaaacccaaacagaata

SEQ ID NO: 7834008 - DNA, 22 bp, Homo sapiens
aacatgaaacccaaacagaata

SEQ ID NO: 7834009 - DNA, 22 bp, Homo sapiens
aacatgaaagttgctaagtgca

SEQ ID NO: 7834010 - DNA, 22 bp, Homo sapiens
aaaggcagagtgctcagctggc

SEQ ID NO: 7834011 - DNA, 22 bp, Homo sapiens
aaaggcagagtgctcagctggc

SEQ ID NO: 7834012 - DNA, 22 bp, Homo sapiens
aaaggcactggatagctgggga

SEQ ID NO: 7834013 - DNA, 22 bp, Homo sapiens
aaaggcactggatagctgggga

SEQ ID NO: 7834014 - DNA, 22 bp, Homo sapiens
aaaggcactgatcttatccagt

SEQ ID NO: 7834015 - DNA, 22 bp, Homo sapiens
aaaggcactgatcttatccagt

SEQ ID NO: 7834016 - DNA, 20 bp, Homo sapiens
aaaggcacagcaacagagct

SEQ ID NO: 7834017 - DNA, 22 bp, Homo sapiens
aaaggcactagaagttaccttt

SEQ ID NO: 7834018 - DNA, 22 bp, Homo sapiens
aaaggcactagaagttaccttt

SEQ ID NO: 7834019 - DNA, 23 bp, Homo sapiens
aaaggcacagcattgtctagcag

SEQ ID NO: 7834020 - DNA, 23 bp, Homo sapiens
aaaggcacagcattgtctagcag

SEQ ID NO: 7834021 - DNA, 23 bp, Homo sapiens
aaaggcacagcattgtctagcag

SEQ ID NO: 7834022 - DNA, 22 bp, Homo sapiens
aaaggcaaaattcttagcagga

SEQ ID NO: 7834023 - DNA, 22 bp, Homo sapiens
aaaggcaagcatttatatagga

SEQ ID NO: 7834024 - DNA, 22 bp, Homo sapiens
aaaggcaagcatttatatagga

SEQ ID NO: 7834025 - DNA, 22 bp, Homo sapiens
aaaggcaagcatttatatagga

SEQ ID NO: 7834026 - DNA, 22 bp, Homo sapiens
aaaggcaagcatttatatagga

SEQ ID NO: 7834027 - DNA, 22 bp, Homo sapiens
aaaggcaaaggctggtatggct

SEQ ID NO: 7834028 - DNA, 22 bp, Homo sapiens
aaaggcaagcatttatatagga

SEQ ID NO: 7834029 - DNA, 22 bp, Homo sapiens
aaaggcaagcatttatatagga

SEQ ID NO: 7834030 - DNA, 22 bp, Homo sapiens
aaaggcaaaattcttagcagga

SEQ ID NO: 7834031 - DNA, 22 bp, Homo sapiens
aaaggcaatttcttcttcctga

SEQ ID NO: 7834032 - DNA, 22 bp, Homo sapiens
aaaggcaatttcttcttcctga

SEQ ID NO: 7834033 - DNA, 22 bp, Homo sapiens
aaaggcacaaattcagcatttt

SEQ ID NO: 7834034 - DNA, 22 bp, Homo sapiens
aaaggcacaaattcagcatttt

SEQ ID NO: 7834035 - DNA, 22 bp, Homo sapiens
aaaggcacacactccttgttat

SEQ ID NO: 7834036 - DNA, 22 bp, Homo sapiens
aaaggcacagaagggaaaccaa

SEQ ID NO: 7834037 - DNA, 22 bp, Homo sapiens
aaaggaatattcaaaacagtca

SEQ ID NO: 7834038 - DNA, 22 bp, Homo sapiens
aaaggaatattcaaaacagtca

SEQ ID NO: 7834039 - DNA, 22 bp, Homo sapiens
aaaggaggccacatggctagga

SEQ ID NO: 7834040 - DNA, 22 bp, Homo sapiens
aaaggaggccacatggctagga

SEQ ID NO: 7834041 - DNA, 22 bp, Homo sapiens
aaaggaggccacatggctagga

SEQ ID NO: 7834042 - DNA, 22 bp, Homo sapiens
aaaggaggccacatggctagga

SEQ ID NO: 7834043 - DNA, 22 bp, Homo sapiens
aaaggataaggttatcaatttt

SEQ ID NO: 7834044 - DNA, 22 bp, Homo sapiens
aaaggagttactcataaagctt

SEQ ID NO: 7834045 - DNA, 22 bp, Homo sapiens
aaaggataaggttatcaatttt

SEQ ID NO: 7834046 - DNA, 22 bp, Homo sapiens
aaaggataaggttatcaatttt

SEQ ID NO: 7834047 - DNA, 22 bp, Homo sapiens
aaaggataaggttatcaatttt

SEQ ID NO: 7834048 - DNA, 22 bp, Homo sapiens
aaagcatattaggactgaatta

SEQ ID NO: 7834049 - DNA, 22 bp, Homo sapiens
aaagcatattaggactgaatta

SEQ ID NO: 7834050 - DNA, 22 bp, Homo sapiens
aaagcatagaattagagttagg

SEQ ID NO: 7834051 - DNA, 22 bp, Homo sapiens
aaagcagtgctgtgagaacact

SEQ ID NO: 7834052 - DNA, 22 bp, Homo sapiens
aaagcagtgctgtgagaacact

SEQ ID NO: 7834053 - DNA, 22 bp, Homo sapiens
aaagcatagaattagagttagg

SEQ ID NO: 7834054 - DNA, 21 bp, Homo sapiens
aaagcagttcttcctgcctct

SEQ ID NO: 7834055 - DNA, 22 bp, Homo sapiens
aaagcatgactcaagaattact

SEQ ID NO: 7834056 - DNA, 22 bp, Homo sapiens
aaagcatgactcaagaattact

SEQ ID NO: 7834057 - DNA, 22 bp, Homo sapiens
aaagcatgactcaagaattact

SEQ ID NO: 7834058 - DNA, 22 bp, Homo sapiens
aaagcatgactcaagaattact

SEQ ID NO: 7834059 - DNA, 21 bp, Homo sapiens
aaagcatcacgaacatttggg

SEQ ID NO: 7834060 - DNA, 21 bp, Homo sapiens
aaagcatcacgaacatttggg

SEQ ID NO: 7834061 - DNA, 22 bp, Homo sapiens
aaagcatgttgggtccctcttt

SEQ ID NO: 7834062 - DNA, 22 bp, Homo sapiens
aaagcatgtgaatagaatatgg

SEQ ID NO: 7834063 - DNA, 22 bp, Homo sapiens
aaagcatgttctgggaatagta

SEQ ID NO: 7834064 - DNA, 22 bp, Homo sapiens
aaagcatgtgaatagaatatgg

SEQ ID NO: 7834065 - DNA, 22 bp, Homo sapiens
aaagcatgtgaatagaatatgg

SEQ ID NO: 7834066 - DNA, 22 bp, Homo sapiens
aaagcatggttaaagacagtgg

SEQ ID NO: 7834067 - DNA, 22 bp, Homo sapiens
aaagcatggttaaagacagtgg

SEQ ID NO: 7834068 - DNA, 22 bp, Homo sapiens
aaagcatggcatgaagaacatg

SEQ ID NO: 7834069 - DNA, 22 bp, Homo sapiens
aaagcatgctactttatatagg

SEQ ID NO: 7834070 - DNA, 22 bp, Homo sapiens
aaagcatggcatgaagaacatg

SEQ ID NO: 7834071 - DNA, 22 bp, Homo sapiens
aaagcatgattagatagatgat

SEQ ID NO: 7834072 - DNA, 22 bp, Homo sapiens
aaagcatgctactttatatagg

SEQ ID NO: 7834073 - DNA, 22 bp, Homo sapiens
aaagcatgattagatagatgat

SEQ ID NO: 7834074 - DNA, 22 bp, Homo sapiens
aaagcatgattagatagatgat

SEQ ID NO: 7834075 - DNA, 20 bp, Homo sapiens
aaagcatttacttgtgattg

SEQ ID NO: 7834076 - DNA, 20 bp, Homo sapiens
aaagcatttacttgtgattg

SEQ ID NO: 7834077 - DNA, 22 bp, Homo sapiens
aaagcatttcatgtctagaaag

SEQ ID NO: 7834078 - DNA, 20 bp, Homo sapiens
aaagcatttacttgtgattg

SEQ ID NO: 7834079 - DNA, 22 bp, Homo sapiens
aaagcatttcatgtctagaaag

SEQ ID NO: 7834080 - DNA, 20 bp, Homo sapiens
aaagcatttacttgtgattg

SEQ ID NO: 7834081 - DNA, 22 bp, Homo sapiens
aaagcattgtttcaagattaac

SEQ ID NO: 7834082 - DNA, 22 bp, Homo sapiens
aaagcattgtttcaagattaac

SEQ ID NO: 7834083 - DNA, 22 bp, Homo sapiens
aaagcattactagactggattt

SEQ ID NO: 7834084 - DNA, 22 bp, Homo sapiens
aaagccaaatgaaagatggttc

SEQ ID NO: 7834085 - DNA, 22 bp, Homo sapiens
aaagccaaatgaaagatggttc

SEQ ID NO: 7834086 - DNA, 22 bp, Homo sapiens
aaagccaagctgggaaggcagg

SEQ ID NO: 7834087 - DNA, 23 bp, Homo sapiens
aaagccaagtcagtctactggaa

SEQ ID NO: 7834088 - DNA, 23 bp, Homo sapiens
aaagccaagtcagtctactggaa

SEQ ID NO: 7834089 - DNA, 22 bp, Homo sapiens
aaagccaaatgaaagatggttc

SEQ ID NO: 7834090 - DNA, 22 bp, Homo sapiens
aaagccacagttctatgtctgc

SEQ ID NO: 7834091 - DNA, 23 bp, Homo sapiens
aaagccaagtcagtctactggaa

SEQ ID NO: 7834092 - DNA, 20 bp, Homo sapiens
aaaggaatatatgaagtata

SEQ ID NO: 7834093 - DNA, 22 bp, Homo sapiens
aaagcagtccttcccttaaggt

SEQ ID NO: 7834094 - DNA, 20 bp, Homo sapiens
aaagcagtatgcaagtagag

SEQ ID NO: 7834095 - DNA, 22 bp, Homo sapiens
aaagcagtctcagacttaagca

SEQ ID NO: 7834096 - DNA, 20 bp, Homo sapiens
aaagcagtatgcaagtagag

SEQ ID NO: 7834097 - DNA, 22 bp, Homo sapiens
aaagcagtatgaaaggcaataa

SEQ ID NO: 7834098 - DNA, 22 bp, Homo sapiens
aaagcagtcactccagtgtgat

SEQ ID NO: 7834099 - DNA, 19 bp, Homo sapiens
aaagcagtgcatcctcttt

SEQ ID NO: 7834100 - DNA, 22 bp, Homo sapiens
aaagcagtgcaccttaattgat

SEQ ID NO: 7834101 - DNA, 22 bp, Homo sapiens
aaagcagtgcaccttaattgat

SEQ ID NO: 7834102 - DNA, 22 bp, Homo sapiens
aaagcagtctgttttaacctga

SEQ ID NO: 7834103 - DNA, 22 bp, Homo sapiens
aaagcagtctgttttaacctga

SEQ ID NO: 7834104 - DNA, 22 bp, Homo sapiens
aaagcagtctcagacttaagca

SEQ ID NO: 7834105 - DNA, 22 bp, Homo sapiens
aaagcaggttgcaattacagtg

SEQ ID NO: 7834106 - DNA, 22 bp, Homo sapiens
aaagcaggttgcaattacagtg

SEQ ID NO: 7834107 - DNA, 22 bp, Homo sapiens
aaagcaggttatgaccatggcc

SEQ ID NO: 7834108 - DNA, 22 bp, Homo sapiens
aaagcaggttatgaccatggcc

SEQ ID NO: 7834109 - DNA, 22 bp, Homo sapiens
aaagcagcacatggatatcagt

SEQ ID NO: 7834110 - DNA, 22 bp, Homo sapiens
aaagcagtataagtaacggaag

SEQ ID NO: 7834111 - DNA, 22 bp, Homo sapiens
aaagcagtagttttcaaatagt

SEQ ID NO: 7834112 - DNA, 22 bp, Homo sapiens
aaagcagtagttttcaaatagt

SEQ ID NO: 7834113 - DNA, 22 bp, Homo sapiens
aaagcagtataagtaacggaag

SEQ ID NO: 7834114 - DNA, 22 bp, Homo sapiens
aaagcagtatattggtagttgt

SEQ ID NO: 7834115 - DNA, 22 bp, Homo sapiens
aaattgtaatgacttcacttga

SEQ ID NO: 7834116 - DNA, 22 bp, Homo sapiens
aaattgtaatgacttcacttga

SEQ ID NO: 7834117 - DNA, 22 bp, Homo sapiens
aaattgtaatgacttcacttga

SEQ ID NO: 7834118 - DNA, 22 bp, Homo sapiens
aaattggcagttcagggaatta

SEQ ID NO: 7834119 - DNA, 22 bp, Homo sapiens
aaattgtagagatcgctttgtg

SEQ ID NO: 7834120 - DNA, 22 bp, Homo sapiens
aaattgtagagatcgctttgtg

SEQ ID NO: 7834121 - DNA, 22 bp, Homo sapiens
aaattgtaggatcacatgacct

SEQ ID NO: 7834122 - DNA, 22 bp, Homo sapiens
aaattgcttgagattagtctcc

SEQ ID NO: 7834123 - DNA, 22 bp, Homo sapiens
aaattggattttaaactgttgg

SEQ ID NO: 7834124 - DNA, 22 bp, Homo sapiens
aaagcagcaagtatttgttact

SEQ ID NO: 7834125 - DNA, 22 bp, Homo sapiens
aaagcagcaagtatttgttact

SEQ ID NO: 7834126 - DNA, 22 bp, Homo sapiens
aaagcagcacatggatatcagt

SEQ ID NO: 7834127 - DNA, 22 bp, Homo sapiens
aaagcagcacatggatatcagt

SEQ ID NO: 7834128 - DNA, 23 bp, Homo sapiens
aaattgtcgtaaggtggagatgt

SEQ ID NO: 7834129 - DNA, 22 bp, Homo sapiens
aaattgtccttttaagaaacag

SEQ ID NO: 7834130 - DNA, 22 bp, Homo sapiens
aaattgtctctattttgattcg

SEQ ID NO: 7834131 - DNA, 22 bp, Homo sapiens
aaagcagcaacagctgttagaa

SEQ ID NO: 7834132 - DNA, 22 bp, Homo sapiens
aaattgtatattccatttgtat

SEQ ID NO: 7834133 - DNA, 22 bp, Homo sapiens
aaattgtatattccatttgtat

SEQ ID NO: 7834134 - DNA, 22 bp, Homo sapiens
aaattgtataatgttccagctg

SEQ ID NO: 7834135 - DNA, 22 bp, Homo sapiens
aaattgtatattccatttgtat

SEQ ID NO: 7834136 - DNA, 22 bp, Homo sapiens
aaattgtcagaattcagaaagt

SEQ ID NO: 7834137 - DNA, 22 bp, Homo sapiens
aaattgtccttttaagaaacag

SEQ ID NO: 7834138 - DNA, 22 bp, Homo sapiens
aaattagatcagtggattttct

SEQ ID NO: 7834139 - DNA, 22 bp, Homo sapiens
aaattagatcagtggattttct

SEQ ID NO: 7834140 - DNA, 22 bp, Homo sapiens
aaattagatatgtgtgagactc

SEQ ID NO: 7834141 - DNA, 22 bp, Homo sapiens
aaattagaccagttcaggtcca

SEQ ID NO: 7834142 - DNA, 22 bp, Homo sapiens
aaattagaccagttcaggtcca

SEQ ID NO: 7834143 - DNA, 22 bp, Homo sapiens
aaattcagcatcctgcactgga

SEQ ID NO: 7834144 - DNA, 23 bp, Homo sapiens
aaattcagtccttcaactctgag

SEQ ID NO: 7834145 - DNA, 22 bp, Homo sapiens
aaattcagcagtgaaatgcccc

SEQ ID NO: 7834146 - DNA, 22 bp, Homo sapiens
aaattcagatggctttcttttc

SEQ ID NO: 7834147 - DNA, 22 bp, Homo sapiens
aaattcagttcctcagccacat

SEQ ID NO: 7834148 - DNA, 22 bp, Homo sapiens
aaattcagtttctgtcctggga

SEQ ID NO: 7834149 - DNA, 22 bp, Homo sapiens
aaattcagttttaataatcact

SEQ ID NO: 7834150 - DNA, 22 bp, Homo sapiens
aaattcagtgttcttcccgtaa

SEQ ID NO: 7834151 - DNA, 23 bp, Homo sapiens
aaattcagtccttcaactctgag

SEQ ID NO: 7834152 - DNA, 22 bp, Homo sapiens
aaattcatttttcttagtgtgc

SEQ ID NO: 7834153 - DNA, 22 bp, Homo sapiens
aaattcatttttcttagtgtgc

SEQ ID NO: 7834154 - DNA, 22 bp, Homo sapiens
aaattcatttttcttagtgtgc

SEQ ID NO: 7834155 - DNA, 22 bp, Homo sapiens
aaattcatttttcttagtgtgc

SEQ ID NO: 7834156 - DNA, 22 bp, Homo sapiens
aaattccaccagaatcagtaat

SEQ ID NO: 7834157 - DNA, 22 bp, Homo sapiens
aaattcatttttcttagtgtgc

SEQ ID NO: 7834158 - DNA, 22 bp, Homo sapiens
aaattcatatgttgaaatgcta

SEQ ID NO: 7834159 - DNA, 22 bp, Homo sapiens
aaattcatatgttgaaatgcta

SEQ ID NO: 7834160 - DNA, 22 bp, Homo sapiens
aaattcatatgttgaaatgcta

SEQ ID NO: 7834161 - DNA, 22 bp, Homo sapiens
aaattcatatgttgaaatgcta

SEQ ID NO: 7834162 - DNA, 22 bp, Homo sapiens
aaattcatatgttgaaatgcta

SEQ ID NO: 7834163 - DNA, 22 bp, Homo sapiens
aaattcagttttaataatcact

SEQ ID NO: 7834164 - DNA, 22 bp, Homo sapiens
aaattcagttttaataatcact

SEQ ID NO: 7834165 - DNA, 22 bp, Homo sapiens
aaattccattatgataatttcg

SEQ ID NO: 7834166 - DNA, 22 bp, Homo sapiens
aaattccattatgataatttcg

SEQ ID NO: 7834167 - DNA, 22 bp, Homo sapiens
aaattccattatgataatttcg

SEQ ID NO: 7834168 - DNA, 22 bp, Homo sapiens
aaattccagaaactcagtatat

SEQ ID NO: 7834169 - DNA, 22 bp, Homo sapiens
aaattccagttcttttacctgc

SEQ ID NO: 7834170 - DNA, 22 bp, Homo sapiens
aaattccagttcttttacctgc

SEQ ID NO: 7834171 - DNA, 22 bp, Homo sapiens
aaattccagaaactcagtatat

SEQ ID NO: 7834172 - DNA, 22 bp, Homo sapiens
aaattccagcaacaccttttta

SEQ ID NO: 7834173 - DNA, 22 bp, Homo sapiens
aaattgctgaccaagtatattc

SEQ ID NO: 7834174 - DNA, 22 bp, Homo sapiens
aaattgctgaccaagtatattc

SEQ ID NO: 7834175 - DNA, 22 bp, Homo sapiens
aaattgctggcagcctttattc

SEQ ID NO: 7834176 - DNA, 22 bp, Homo sapiens
aaattgctgacacttgaccatt

SEQ ID NO: 7834177 - DNA, 22 bp, Homo sapiens
aaattgctctttaaaagtactg

SEQ ID NO: 7834178 - DNA, 22 bp, Homo sapiens
aaattgctatatgtgaatgtga

SEQ ID NO: 7834179 - DNA, 22 bp, Homo sapiens
aaattgctatatgtgaatgtga

SEQ ID NO: 7834180 - DNA, 19 bp, Homo sapiens
tcacaggcatctccccaga

SEQ ID NO: 7834181 - DNA, 19 bp, Homo sapiens
tcacaggcatctccccaga

SEQ ID NO: 7834182 - DNA, 22 bp, Homo sapiens
tcacaggataaggtggcatcac

SEQ ID NO: 7834183 - DNA, 22 bp, Homo sapiens
tcacaggataaggtggcatcac

SEQ ID NO: 7834184 - DNA, 22 bp, Homo sapiens
tcacaggcccaaaccacgctta

SEQ ID NO: 7834185 - DNA, 22 bp, Homo sapiens
tcacaggcccaaaccacgctta

SEQ ID NO: 7834186 - DNA, 19 bp, Homo sapiens
tcacaggcatctccccaga

SEQ ID NO: 7834187 - DNA, 22 bp, Homo sapiens
tcacaggagtcataattacagt

SEQ ID NO: 7834188 - DNA, 22 bp, Homo sapiens
tcacaggagtcataattacagt

SEQ ID NO: 7834189 - DNA, 22 bp, Homo sapiens
tcacaggataaggtggcatcac

SEQ ID NO: 7834190 - DNA, 20 bp, Homo sapiens
tcacagctggctatgacagg

SEQ ID NO: 7834191 - DNA, 20 bp, Homo sapiens
tcacagctggctatgacagg

SEQ ID NO: 7834192 - DNA, 22 bp, Homo sapiens
tcacaggagtcaaggaatagta

SEQ ID NO: 7834193 - DNA, 22 bp, Homo sapiens
tcacagctggacacgttggcat

SEQ ID NO: 7834194 - DNA, 22 bp, Homo sapiens
tcacagctggacacgttggcat

SEQ ID NO: 7834195 - DNA, 20 bp, Homo sapiens
tcacagctggctatgacagg

SEQ ID NO: 7834196 - DNA, 22 bp, Homo sapiens
tcacagaataaattgagaagac

SEQ ID NO: 7834197 - DNA, 22 bp, Homo sapiens
tcacagaataaatgtactggcc

SEQ ID NO: 7834198 - DNA, 22 bp, Homo sapiens
tcacagaataaatgtactggcc

SEQ ID NO: 7834199 - DNA, 22 bp, Homo sapiens
tcacagctattctcatgtattt

SEQ ID NO: 7834200 - DNA, 22 bp, Homo sapiens
tcacagctcactgtagcctcga

SEQ ID NO: 7834201 - DNA, 22 bp, Homo sapiens
tcacagctattctcatgtattt

SEQ ID NO: 7834202 - DNA, 22 bp, Homo sapiens
tcacagctgagtttccatttct

SEQ ID NO: 7834203 - DNA, 22 bp, Homo sapiens
tcacagctctgtcaattttata

SEQ ID NO: 7834204 - DNA, 22 bp, Homo sapiens
tcacagctccagactgcaactc

SEQ ID NO: 7834205 - DNA, 22 bp, Homo sapiens
tcacagctccagactgcaactc

SEQ ID NO: 7834206 - DNA, 22 bp, Homo sapiens
tcacagctccagactgcaactc

SEQ ID NO: 7834207 - DNA, 22 bp, Homo sapiens
tcacagctccagactgcaactc

SEQ ID NO: 7834208 - DNA, 22 bp, Homo sapiens
tcacagctcactgtagcctcga

SEQ ID NO: 7834209 - DNA, 22 bp, Homo sapiens
tcacagctcactgtagcctcga

SEQ ID NO: 7834210 - DNA, 22 bp, Homo sapiens
tcacagctcactgtagcctcga

SEQ ID NO: 7834211 - DNA, 22 bp, Homo sapiens
tcacagaagcttgaagattttc

SEQ ID NO: 7834212 - DNA, 22 bp, Homo sapiens
tcacagaagccctcgcaaacta

SEQ ID NO: 7834213 - DNA, 22 bp, Homo sapiens
tcacagaagcttgaagattttc

SEQ ID NO: 7834214 - DNA, 22 bp, Homo sapiens
tcacagaagatgctggatgttg

SEQ ID NO: 7834215 - DNA, 22 bp, Homo sapiens
tcacagaagatgctggatgttg

SEQ ID NO: 7834216 - DNA, 22 bp, Homo sapiens
tcacagaaggagggaagctagt

SEQ ID NO: 7834217 - DNA, 22 bp, Homo sapiens
tcacagaaggaccttgtttcat

SEQ ID NO: 7834218 - DNA, 22 bp, Homo sapiens
tcacagaaggcatcacagaaga

SEQ ID NO: 7834219 - DNA, 22 bp, Homo sapiens
tcacagaaggcatcacagaaga

SEQ ID NO: 7834220 - DNA, 22 bp, Homo sapiens
tcacagaaggagggaagctagt

SEQ ID NO: 7834221 - DNA, 22 bp, Homo sapiens
tcacagaaggcatcacagaaga

SEQ ID NO: 7834222 - DNA, 22 bp, Homo sapiens
tcacagaagttgaatttgcatg

SEQ ID NO: 7834223 - DNA, 22 bp, Homo sapiens
tcacagaataaatgtactggcc

SEQ ID NO: 7834224 - DNA, 22 bp, Homo sapiens
tcacagaataaatgtactggcc

SEQ ID NO: 7834225 - DNA, 22 bp, Homo sapiens
tcacagaagtgtgtttcaggag

SEQ ID NO: 7834226 - DNA, 22 bp, Homo sapiens
tcacagaagtgtagtgaggaaa

SEQ ID NO: 7834227 - DNA, 22 bp, Homo sapiens
tcacagaagggaaagatgccaa

SEQ ID NO: 7834228 - DNA, 22 bp, Homo sapiens
tcacagaagggaaagatgccaa

SEQ ID NO: 7834229 - DNA, 22 bp, Homo sapiens
tcacagaagggaaagatgccaa

SEQ ID NO: 7834230 - DNA, 22 bp, Homo sapiens
tcacagaaggtggccatagctg

SEQ ID NO: 7834231 - DNA, 22 bp, Homo sapiens
tcacagaaggtggccatagctg

SEQ ID NO: 7834232 - DNA, 22 bp, Homo sapiens
tcacagaagtgtagtgaggaaa

SEQ ID NO: 7834233 - DNA, 22 bp, Homo sapiens
tcacaggctctccaccatgagg

SEQ ID NO: 7834234 - DNA, 22 bp, Homo sapiens
tcacaggctctccaccatgagg

SEQ ID NO: 7834235 - DNA, 22 bp, Homo sapiens
tcacaggctctccaccatgagg

SEQ ID NO: 7834236 - DNA, 22 bp, Homo sapiens
tcacaggctctagggattaaga

SEQ ID NO: 7834237 - DNA, 22 bp, Homo sapiens
tcacaggctggtctccgaggac

SEQ ID NO: 7834238 - DNA, 22 bp, Homo sapiens
tcacaggctggtctccgaggac

SEQ ID NO: 7834239 - DNA, 22 bp, Homo sapiens
tcacaggctggtctccgaggac

SEQ ID NO: 7834240 - DNA, 22 bp, Homo sapiens
tcacaggctggtctccgaggac

SEQ ID NO: 7834241 - DNA, 22 bp, Homo sapiens
tcacaggctctccaccatgagg

SEQ ID NO: 7834242 - DNA, 22 bp, Homo sapiens
tcacaggcttgtgaacattgca

SEQ ID NO: 7834243 - DNA, 22 bp, Homo sapiens
tcacagggatggaatagaaata

SEQ ID NO: 7834244 - DNA, 22 bp, Homo sapiens
tcacagggatggaatagaaata

SEQ ID NO: 7834245 - DNA, 23 bp, Homo sapiens
tcacagggcactggctggggttg

SEQ ID NO: 7834246 - DNA, 23 bp, Homo sapiens
tcacagggcactggctggggttg

SEQ ID NO: 7834247 - DNA, 23 bp, Homo sapiens
tcacagggcactggctggggttg

SEQ ID NO: 7834248 - DNA, 22 bp, Homo sapiens
tcacagggcattatggctccag

SEQ ID NO: 7834249 - DNA, 21 bp, Homo sapiens
tcacaggctcagggagagagt

SEQ ID NO: 7834250 - DNA, 21 bp, Homo sapiens
tcacaggctcagggagagagt

SEQ ID NO: 7834251 - DNA, 22 bp, Homo sapiens
tcacaggctaaatttatgcagg

SEQ ID NO: 7834252 - DNA, 21 bp, Homo sapiens
tcacaggctcagggagagagt

SEQ ID NO: 7834253 - DNA, 21 bp, Homo sapiens
tcacaggctcagggagagagt

SEQ ID NO: 7834254 - DNA, 22 bp, Homo sapiens
tcacaggctccagggcctggat

SEQ ID NO: 7834255 - DNA, 22 bp, Homo sapiens
tcacaggctaaatttatgcagg

SEQ ID NO: 7834256 - DNA, 22 bp, Homo sapiens
tcacaggcctggggcagagggc

SEQ ID NO: 7834257 - DNA, 22 bp, Homo sapiens
tcacaggcccaaaccacgctta

SEQ ID NO: 7834258 - DNA, 22 bp, Homo sapiens
tcacaggcccaaaccacgctta

SEQ ID NO: 7834259 - DNA, 22 bp, Homo sapiens
tcacaggcctggggcagagggc

SEQ ID NO: 7834260 - DNA, 22 bp, Homo sapiens
tcacaggcctggggcagagggc

SEQ ID NO: 7834261 - DNA, 22 bp, Homo sapiens
tcacaggcccaaaccacgctta

SEQ ID NO: 7834262 - DNA, 22 bp, Homo sapiens
tcacagggtatctgggatggat

SEQ ID NO: 7834263 - DNA, 23 bp, Homo sapiens
tcacaggggccagcgctctgtgg

SEQ ID NO: 7834264 - DNA, 23 bp, Homo sapiens
tcacaggggccagcgctctgtgg

SEQ ID NO: 7834265 - DNA, 23 bp, Homo sapiens
tcacaggggccagcgctctgtgg

SEQ ID NO: 7834266 - DNA, 23 bp, Homo sapiens
tcacaggggccagcgctctgtgg

SEQ ID NO: 7834267 - DNA, 22 bp, Homo sapiens
tcacagggcattatggctccag

SEQ ID NO: 7834268 - DNA, 21 bp, Homo sapiens
tcacaggtcaatgtgtgaagg

SEQ ID NO: 7834269 - DNA, 22 bp, Homo sapiens
tcacagggtttggaagcctcct

SEQ ID NO: 7834270 - DNA, 22 bp, Homo sapiens
tcacagggtatctgggatggat

SEQ ID NO: 7834271 - DNA, 22 bp, Homo sapiens
tcacagggtgtacatcacctat

SEQ ID NO: 7834272 - DNA, 22 bp, Homo sapiens
tcacagtactccccaaagtttc

SEQ ID NO: 7834273 - DNA, 22 bp, Homo sapiens
tcacagtactccccaaagtttc

SEQ ID NO: 7834274 - DNA, 22 bp, Homo sapiens
tcacagtactccccaaagtttc

SEQ ID NO: 7834275 - DNA, 22 bp, Homo sapiens
tcacagtactccccaaagtttc

SEQ ID NO: 7834276 - DNA, 22 bp, Homo sapiens
tcacagtactgtgactattgac

SEQ ID NO: 7834277 - DNA, 22 bp, Homo sapiens
tcacagtactgtgtgacttgag

SEQ ID NO: 7834278 - DNA, 22 bp, Homo sapiens
tcacagtactgtgactattgac

SEQ ID NO: 7834279 - DNA, 22 bp, Homo sapiens
tcacagtagacttctcaagagc

SEQ ID NO: 7834280 - DNA, 22 bp, Homo sapiens
tcacagtagacttctcaagagc

SEQ ID NO: 7834281 - DNA, 22 bp, Homo sapiens
tcacagtactgtgactattgac

SEQ ID NO: 7834282 - DNA, 22 bp, Homo sapiens
tcacagtactgtgtgacttgag

SEQ ID NO: 7834283 - DNA, 22 bp, Homo sapiens
tcacagtagacttctcaagagc

SEQ ID NO: 7834284 - DNA, 22 bp, Homo sapiens
tcacagtaactttgttgctttt

SEQ ID NO: 7834285 - DNA, 22 bp, Homo sapiens
tcacagtaactttgttgctttt

SEQ ID NO: 7834286 - DNA, 22 bp, Homo sapiens
tcacagtaactttgttgctttt

SEQ ID NO: 7834287 - DNA, 22 bp, Homo sapiens
tcacagtacatgattcagtggt

SEQ ID NO: 7834288 - DNA, 22 bp, Homo sapiens
tcacagtacatgattcagtggt

SEQ ID NO: 7834289 - DNA, 22 bp, Homo sapiens
tcacagtaaatccagaagaaat

SEQ ID NO: 7834290 - DNA, 22 bp, Homo sapiens
tcacagtaaatccagaagaaat

SEQ ID NO: 7834291 - DNA, 22 bp, Homo sapiens
tcacagtaaatccagaagaaat

SEQ ID NO: 7834292 - DNA, 22 bp, Homo sapiens
tcacagtaaaagcatggaagag

SEQ ID NO: 7834293 - DNA, 22 bp, Homo sapiens
tcacagtaaaagcatggaagag

SEQ ID NO: 7834294 - DNA, 22 bp, Homo sapiens
tcacaagatatttcagtccttt

SEQ ID NO: 7834295 - DNA, 22 bp, Homo sapiens
tcacaagatatttcagtccttt

SEQ ID NO: 7834296 - DNA, 22 bp, Homo sapiens
tcacaagatacagttagaagca

SEQ ID NO: 7834297 - DNA, 22 bp, Homo sapiens
tcacaagataaacatagctcca

SEQ ID NO: 7834298 - DNA, 22 bp, Homo sapiens
tcacaagataaacatagctcca

SEQ ID NO: 7834299 - DNA, 22 bp, Homo sapiens
tcacaagataaacatagctcca

SEQ ID NO: 7834300 - DNA, 22 bp, Homo sapiens
tcacaagatacagttagaagca

SEQ ID NO: 7834301 - DNA, 22 bp, Homo sapiens
tcacaagatacagttagaagca

SEQ ID NO: 7834302 - DNA, 22 bp, Homo sapiens
tcacaagataaacatagctcca

SEQ ID NO: 7834303 - DNA, 22 bp, Homo sapiens
tcacaagatacagttagaagca

SEQ ID NO: 7834304 - DNA, 22 bp, Homo sapiens
tcacaagagtaagttcatgcct

SEQ ID NO: 7834305 - DNA, 22 bp, Homo sapiens
tcacaagagctggactgtcttt

SEQ ID NO: 7834306 - DNA, 22 bp, Homo sapiens
tcacaagagctggactgtcttt

SEQ ID NO: 7834307 - DNA, 22 bp, Homo sapiens
tcacaaatagctatattaagga

SEQ ID NO: 7834308 - DNA, 22 bp, Homo sapiens
tcacaaatagctatattaagga

SEQ ID NO: 7834309 - DNA, 22 bp, Homo sapiens
tcacaaatagctatattaagga

SEQ ID NO: 7834310 - DNA, 22 bp, Homo sapiens
tcacaaagggagggatagctgg

SEQ ID NO: 7834311 - DNA, 22 bp, Homo sapiens
tcacaaagggagggatagctgg

SEQ ID NO: 7834312 - DNA, 22 bp, Homo sapiens
tcacaaagggagggatagctgg

SEQ ID NO: 7834313 - DNA, 22 bp, Homo sapiens
tcacaaagggagggatagctgg

SEQ ID NO: 7834314 - DNA, 22 bp, Homo sapiens
tcacaaagtgaagtgtgtcatg

SEQ ID NO: 7834315 - DNA, 22 bp, Homo sapiens
tcacaaatagctatattaagga

SEQ ID NO: 7834316 - DNA, 22 bp, Homo sapiens
tcacaaaggatgatgaattctg

SEQ ID NO: 7834317 - DNA, 22 bp, Homo sapiens
tcacaaagctttgataagcaga

SEQ ID NO: 7834318 - DNA, 22 bp, Homo sapiens
tcacaaagctttgataagcaga

SEQ ID NO: 7834319 - DNA, 22 bp, Homo sapiens
tcacaaagctttgataagcaga

SEQ ID NO: 7834320 - DNA, 22 bp, Homo sapiens
tcacaaagctttgataagcaga

SEQ ID NO: 7834321 - DNA, 22 bp, Homo sapiens
tcacaaagctttgataagcaga

SEQ ID NO: 7834322 - DNA, 22 bp, Homo sapiens
tcacaaacaatgctttggaatt

SEQ ID NO: 7834323 - DNA, 22 bp, Homo sapiens
tcacaaaaggccatgtggcttc

SEQ ID NO: 7834324 - DNA, 22 bp, Homo sapiens
tcacaaaaggccatgtggcttc

SEQ ID NO: 7834325 - DNA, 22 bp, Homo sapiens
tcacaaaaggccatgtggcttc

SEQ ID NO: 7834326 - DNA, 22 bp, Homo sapiens
tcacaaaaggccatgtggcttc

SEQ ID NO: 7834327 - DNA, 20 bp, Homo sapiens
tcaattttctacaacatttg

SEQ ID NO: 7834328 - DNA, 20 bp, Homo sapiens
tcaattttctacaacatttg

SEQ ID NO: 7834329 - DNA, 20 bp, Homo sapiens
tcaattttctacaacatttg

SEQ ID NO: 7834330 - DNA, 20 bp, Homo sapiens
tcaattttctacaacatttg

SEQ ID NO: 7834331 - DNA, 22 bp, Homo sapiens
tcacaaaagcttttgaatttgg

SEQ ID NO: 7834332 - DNA, 22 bp, Homo sapiens
tcacaaaagcttttgaatttgg

SEQ ID NO: 7834333 - DNA, 22 bp, Homo sapiens
tcacaaaagcttttgaatttgg

SEQ ID NO: 7834334 - DNA, 22 bp, Homo sapiens
tcacaaaagcttttgaatttgg

SEQ ID NO: 7834335 - DNA, 22 bp, Homo sapiens
tcacaaaagcttttgaatttgg

SEQ ID NO: 7834336 - DNA, 22 bp, Homo sapiens
tcacaaaagcttttgaatttgg

SEQ ID NO: 7834337 - DNA, 22 bp, Homo sapiens
tcacaaaagcttttgaatttgg

SEQ ID NO: 7834338 - DNA, 22 bp, Homo sapiens
tcacaaaagcttttgaatttgg

SEQ ID NO: 7834339 - DNA, 22 bp, Homo sapiens
tcacagaaaagctgagcatcag

SEQ ID NO: 7834340 - DNA, 22 bp, Homo sapiens
tcacagaaaagctgagcatcag

SEQ ID NO: 7834341 - DNA, 20 bp, Homo sapiens
tcacacatggtaagctatga

SEQ ID NO: 7834342 - DNA, 22 bp, Homo sapiens
tcacacatgctaagccagagat

SEQ ID NO: 7834343 - DNA, 22 bp, Homo sapiens
tcacacatgctaagccagagat

SEQ ID NO: 7834344 - DNA, 22 bp, Homo sapiens
tcacacatgctaagccagagat

SEQ ID NO: 7834345 - DNA, 22 bp, Homo sapiens
tcacagaaaagtggagagccta

SEQ ID NO: 7834346 - DNA, 20 bp, Homo sapiens
tcacagaaacaaatagagaa

SEQ ID NO: 7834347 - DNA, 20 bp, Homo sapiens
tcacagaaacaaatagagaa

SEQ ID NO: 7834348 - DNA, 22 bp, Homo sapiens
tcacagaaacagaatggcacag

SEQ ID NO: 7834349 - DNA, 22 bp, Homo sapiens
tcacagaaacagaatggcacag

SEQ ID NO: 7834350 - DNA, 22 bp, Homo sapiens
tcacagaaaagctgagcatcag

SEQ ID NO: 7834351 - DNA, 22 bp, Homo sapiens
tcacagaaaagctgagcatcag

SEQ ID NO: 7834352 - DNA, 22 bp, Homo sapiens
tcacaatactcactcaatggct

SEQ ID NO: 7834353 - DNA, 20 bp, Homo sapiens
tcacaatatgagctcataca

SEQ ID NO: 7834354 - DNA, 22 bp, Homo sapiens
tcacaatatttatcttccaatt

SEQ ID NO: 7834355 - DNA, 22 bp, Homo sapiens
tcacaatggcatagtataaaat

SEQ ID NO: 7834356 - DNA, 22 bp, Homo sapiens
tcacaatgcaagtgttcagtgg

SEQ ID NO: 7834357 - DNA, 22 bp, Homo sapiens
tcacaatgaaaaacactacata

SEQ ID NO: 7834358 - DNA, 22 bp, Homo sapiens
tcacacatgagtaaatacaggg

SEQ ID NO: 7834359 - DNA, 22 bp, Homo sapiens
tcacacatgagtaaatacaggg

SEQ ID NO: 7834360 - DNA, 22 bp, Homo sapiens
tcacagaaataagatagttatt

SEQ ID NO: 7834361 - DNA, 22 bp, Homo sapiens
tcacagaaataagatagttatt

SEQ ID NO: 7834362 - DNA, 22 bp, Homo sapiens
tcacagaaataagatagttatt

SEQ ID NO: 7834363 - DNA, 22 bp, Homo sapiens
tcacagaaagctgtgtcctgac

SEQ ID NO: 7834364 - DNA, 22 bp, Homo sapiens
tcacagaaagctgtgtcctgac

SEQ ID NO: 7834365 - DNA, 22 bp, Homo sapiens
tcacagaaacagaatggcacag

SEQ ID NO: 7834366 - DNA, 22 bp, Homo sapiens
tcacagaacaagcctggtggag

SEQ ID NO: 7834367 - DNA, 22 bp, Homo sapiens
tcacagaacaatgtttagttct

SEQ ID NO: 7834368 - DNA, 22 bp, Homo sapiens
tcacagaaataagatagttatt

SEQ ID NO: 7834369 - DNA, 22 bp, Homo sapiens
tcacagaaatctgttttttcta

SEQ ID NO: 7834370 - DNA, 22 bp, Homo sapiens
tcacagaaatctgttttttcta

SEQ ID NO: 7834371 - DNA, 22 bp, Homo sapiens
tcacagaagaagtagattgcat

SEQ ID NO: 7834372 - DNA, 22 bp, Homo sapiens
tcacagaagaagtagattgcat

SEQ ID NO: 7834373 - DNA, 22 bp, Homo sapiens
tcacagaacacaaatgccactt

SEQ ID NO: 7834374 - DNA, 22 bp, Homo sapiens
tcacagaacacaaatgccactt

SEQ ID NO: 7834375 - DNA, 22 bp, Homo sapiens
tcacagaacacaaatgccactt

SEQ ID NO: 7834376 - DNA, 22 bp, Homo sapiens
tcacagaacacaaatgccactt

SEQ ID NO: 7834377 - DNA, 22 bp, Homo sapiens
tcacagaagagcattaagatga

SEQ ID NO: 7834378 - DNA, 22 bp, Homo sapiens
tcacagaagagcattaagatga

SEQ ID NO: 7834379 - DNA, 22 bp, Homo sapiens
tcacagaagagcattaagatga

SEQ ID NO: 7834380 - DNA, 22 bp, Homo sapiens
tcacagaagagatattgacaga

SEQ ID NO: 7834381 - DNA, 22 bp, Homo sapiens
tcacagaagagatattgacaga

SEQ ID NO: 7834382 - DNA, 22 bp, Homo sapiens
tcacagaagaagtagattgcat

SEQ ID NO: 7834383 - DNA, 22 bp, Homo sapiens
tcacagaagaagtagattgcat

SEQ ID NO: 7834384 - DNA, 22 bp, Homo sapiens
tcacagaagagatattgacaga

SEQ ID NO: 7834385 - DNA, 22 bp, Homo sapiens
tcaattttatgaaacaaagtga

SEQ ID NO: 7834386 - DNA, 22 bp, Homo sapiens
tcaattttatgaaacaaagtga

SEQ ID NO: 7834387 - DNA, 22 bp, Homo sapiens
tcaattttatgaaacaaagtga

SEQ ID NO: 7834388 - DNA, 22 bp, Homo sapiens
tcaattttatgaaacaaagtga

SEQ ID NO: 7834389 - DNA, 22 bp, Homo sapiens
tcaattttatgaaacaaagtga

SEQ ID NO: 7834390 - DNA, 22 bp, Homo sapiens
tcaatttcttggtttgataata

SEQ ID NO: 7834391 - DNA, 22 bp, Homo sapiens
tcaatttcaacagctgataaga

SEQ ID NO: 7834392 - DNA, 20 bp, Homo sapiens
tcaatttcaggtagcatagt

SEQ ID NO: 7834393 - DNA, 22 bp, Homo sapiens
tcaatttatgtggctattcatt

SEQ ID NO: 7834394 - DNA, 22 bp, Homo sapiens
tcaatttatgtggctattcatt

SEQ ID NO: 7834395 - DNA, 22 bp, Homo sapiens
tcaatttcaacagctgataaga

SEQ ID NO: 7834396 - DNA, 22 bp, Homo sapiens
tcaatttcattctattagttaa

SEQ ID NO: 7834397 - DNA, 22 bp, Homo sapiens
tcaatttctcagaaatggtctt

SEQ ID NO: 7834398 - DNA, 22 bp, Homo sapiens
tcaataatggcaggataaattt

SEQ ID NO: 7834399 - DNA, 22 bp, Homo sapiens
tcaataagtaggatatcaagat

SEQ ID NO: 7834400 - DNA, 22 bp, Homo sapiens
tcaataatggcaggataaattt

SEQ ID NO: 7834401 - DNA, 22 bp, Homo sapiens
tcaataatggcaggataaattt

SEQ ID NO: 7834402 - DNA, 21 bp, Homo sapiens
tcaatacaggtgcatgtgtct

SEQ ID NO: 7834403 - DNA, 21 bp, Homo sapiens
tcaatacaggtgcatgtgtct

SEQ ID NO: 7834404 - DNA, 22 bp, Homo sapiens
tcaatttatgtggctattcatt

SEQ ID NO: 7834405 - DNA, 17 bp, Homo sapiens
tcaatacactgctttta

SEQ ID NO: 7834406 - DNA, 22 bp, Homo sapiens
tcaatacacatgccgctgttct

SEQ ID NO: 7834407 - DNA, 17 bp, Homo sapiens
tcaatacactgctttta

SEQ ID NO: 7834408 - DNA, 20 bp, Homo sapiens
tcaagttttgcttgacaaga

SEQ ID NO: 7834409 - DNA, 20 bp, Homo sapiens
tcaagttttgcttgacaaga

SEQ ID NO: 7834410 - DNA, 20 bp, Homo sapiens
tcaagttttgcttgacaaga

SEQ ID NO: 7834411 - DNA, 22 bp, Homo sapiens
tcaagttcacagtctggtcgct

SEQ ID NO: 7834412 - DNA, 22 bp, Homo sapiens
tcaagtttctctcagattatgg

SEQ ID NO: 7834413 - DNA, 22 bp, Homo sapiens
tcaagtttctctcagattatgg

SEQ ID NO: 7834414 - DNA, 22 bp, Homo sapiens
tcaagttaggtggttgttagga

SEQ ID NO: 7834415 - DNA, 22 bp, Homo sapiens
tcaagtgcttgtgaggtatttg

SEQ ID NO: 7834416 - DNA, 20 bp, Homo sapiens
tcaagttttgcttgacaaga

SEQ ID NO: 7834417 - DNA, 22 bp, Homo sapiens
tcaataaaattgttttcctatc

SEQ ID NO: 7834418 - DNA, 22 bp, Homo sapiens
tcaataaaattgttttcctatc

SEQ ID NO: 7834419 - DNA, 22 bp, Homo sapiens
tcaataaaattgttttcctatc

SEQ ID NO: 7834420 - DNA, 22 bp, Homo sapiens
tcaataaaattgttttcctatc

SEQ ID NO: 7834421 - DNA, 22 bp, Homo sapiens
tcaataaatagcttggctcagc

SEQ ID NO: 7834422 - DNA, 22 bp, Homo sapiens
tcaataaatagcttggctcagc

SEQ ID NO: 7834423 - DNA, 22 bp, Homo sapiens
tcaataaatccctctgaccctg

SEQ ID NO: 7834424 - DNA, 22 bp, Homo sapiens
tcaataaatccctctgaccctg

SEQ ID NO: 7834425 - DNA, 22 bp, Homo sapiens
tcaataaatagcttggctcagc

SEQ ID NO: 7834426 - DNA, 23 bp, Homo sapiens
tcaataactcgggttaaaataga

SEQ ID NO: 7834427 - DNA, 22 bp, Homo sapiens
tcaataaatccctctgaccctg

SEQ ID NO: 7834428 - DNA, 23 bp, Homo sapiens
tcaataactcgggttaaaataga

SEQ ID NO: 7834429 - DNA, 22 bp, Homo sapiens
tcaaggcacttcatgtctcagt

SEQ ID NO: 7834430 - DNA, 20 bp, Homo sapiens
tcaaggccacactgccgtgc

SEQ ID NO: 7834431 - DNA, 22 bp, Homo sapiens
tcaaggccacagtgagcagagt

SEQ ID NO: 7834432 - DNA, 21 bp, Homo sapiens
tcaaggccagcctgggcagcc

SEQ ID NO: 7834433 - DNA, 22 bp, Homo sapiens
tcaaggccacagtgagcagagt

SEQ ID NO: 7834434 - DNA, 21 bp, Homo sapiens
tcaaggccagcctgggcagcc

SEQ ID NO: 7834435 - DNA, 22 bp, Homo sapiens
tcaaggccagggaatgtagggg

SEQ ID NO: 7834436 - DNA, 22 bp, Homo sapiens
tcaaggccagggaatgtagggg

SEQ ID NO: 7834437 - DNA, 22 bp, Homo sapiens
tcaaggcctatcctcatttgta

SEQ ID NO: 7834438 - DNA, 22 bp, Homo sapiens
tcaaggcacttcatgtctcagt

SEQ ID NO: 7834439 - DNA, 22 bp, Homo sapiens
tcaaggcacttcatgtctcagt

SEQ ID NO: 7834440 - DNA, 22 bp, Homo sapiens
tcaaggcacttcatgtctcagt

SEQ ID NO: 7834441 - DNA, 22 bp, Homo sapiens
tcaaggcacttcatgtctcagt

SEQ ID NO: 7834442 - DNA, 22 bp, Homo sapiens
tcaaggcaaagtaaatattcaa

SEQ ID NO: 7834443 - DNA, 22 bp, Homo sapiens
tcaaggaggtgcttggcttcac

SEQ ID NO: 7834444 - DNA, 22 bp, Homo sapiens
tcaaggaggtgcttggcttcac

SEQ ID NO: 7834445 - DNA, 21 bp, Homo sapiens
tcaaggagtttctcttttcca

SEQ ID NO: 7834446 - DNA, 19 bp, Homo sapiens
tcaaggctccctgagggat

SEQ ID NO: 7834447 - DNA, 19 bp, Homo sapiens
tcaaggctccctgagggat

SEQ ID NO: 7834448 - DNA, 22 bp, Homo sapiens
tcaaggctattaattctgtgag

SEQ ID NO: 7834449 - DNA, 22 bp, Homo sapiens
tcaaggctattaattctgtgag

SEQ ID NO: 7834450 - DNA, 22 bp, Homo sapiens
tcaaggctaaactttcagagta

SEQ ID NO: 7834451 - DNA, 22 bp, Homo sapiens
tcaaggctattaattctgtgag

SEQ ID NO: 7834452 - DNA, 22 bp, Homo sapiens
tcaaggctaaactttcagagta

SEQ ID NO: 7834453 - DNA, 22 bp, Homo sapiens
tcaagggaggagacacagccct

SEQ ID NO: 7834454 - DNA, 22 bp, Homo sapiens
tcaagggaggagacacagccct

SEQ ID NO: 7834455 - DNA, 22 bp, Homo sapiens
tcaagggcaaatgctacctata

SEQ ID NO: 7834456 - DNA, 22 bp, Homo sapiens
tcaaggtgactgaactataaac

SEQ ID NO: 7834457 - DNA, 22 bp, Homo sapiens
tcaaggcttttggttttccata

SEQ ID NO: 7834458 - DNA, 22 bp, Homo sapiens
tcaaggcttttggttttccata

SEQ ID NO: 7834459 - DNA, 19 bp, Homo sapiens
tcaaggctgcctctccttt

SEQ ID NO: 7834460 - DNA, 22 bp, Homo sapiens
tcaagtctggagatctggaact

SEQ ID NO: 7834461 - DNA, 22 bp, Homo sapiens
tcaagtctcaatgtattatggt

SEQ ID NO: 7834462 - DNA, 22 bp, Homo sapiens
tcaagtattattacagatgtag

SEQ ID NO: 7834463 - DNA, 22 bp, Homo sapiens
tcaagtatttatttctgctggc

SEQ ID NO: 7834464 - DNA, 22 bp, Homo sapiens
tcaagtatttatttctgctggc

SEQ ID NO: 7834465 - DNA, 22 bp, Homo sapiens
tcaagtatttatttctgctggc

SEQ ID NO: 7834466 - DNA, 22 bp, Homo sapiens
tcaagtatgacatcaagtttct

SEQ ID NO: 7834467 - DNA, 22 bp, Homo sapiens
tcaagtagtacccaatgcgtgg

SEQ ID NO: 7834468 - DNA, 23 bp, Homo sapiens
tcaagtaatactcccatcttggc

SEQ ID NO: 7834469 - DNA, 22 bp, Homo sapiens
tcaaggtgatggtcttgttttc

SEQ ID NO: 7834470 - DNA, 22 bp, Homo sapiens
tcaaggtgatggtcttgttttc

SEQ ID NO: 7834471 - DNA, 22 bp, Homo sapiens
tcaaggtgctgtgctgtgctag

SEQ ID NO: 7834472 - DNA, 22 bp, Homo sapiens
tcaaggtgcatacattctggct

SEQ ID NO: 7834473 - DNA, 22 bp, Homo sapiens
tcaaggttgccaggaaggaaga

SEQ ID NO: 7834474 - DNA, 22 bp, Homo sapiens
tcaaggttgagtaaattgttgg

SEQ ID NO: 7834475 - DNA, 22 bp, Homo sapiens
tatttctgggagttcagaaatt

SEQ ID NO: 7834476 - DNA, 22 bp, Homo sapiens
tatttctgggagttcagaaatt

SEQ ID NO: 7834477 - DNA, 20 bp, Homo sapiens
tatttctgggcaaccattta

SEQ ID NO: 7834478 - DNA, 20 bp, Homo sapiens
tatttctgggcaaccattta

SEQ ID NO: 7834479 - DNA, 22 bp, Homo sapiens
tatttctgggagttcagaaatt

SEQ ID NO: 7834480 - DNA, 20 bp, Homo sapiens
tatttctgggcaaccattta

SEQ ID NO: 7834481 - DNA, 20 bp, Homo sapiens
tatttctgggcaaccattta

SEQ ID NO: 7834482 - DNA, 20 bp, Homo sapiens
tatttctgggcaaccattta

SEQ ID NO: 7834483 - DNA, 22 bp, Homo sapiens
tatttctgggagttcagaaatt

SEQ ID NO: 7834484 - DNA, 22 bp, Homo sapiens
tatttctgggagttcagaaatt

SEQ ID NO: 7834485 - DNA, 22 bp, Homo sapiens
tatttctgggagttcagaaatt

SEQ ID NO: 7834486 - DNA, 22 bp, Homo sapiens
tatttctgattgctcatgaggc

SEQ ID NO: 7834487 - DNA, 22 bp, Homo sapiens
tatttctgattgctcatgaggc

SEQ ID NO: 7834488 - DNA, 22 bp, Homo sapiens
tatttctgaggcccaggaagtg

SEQ ID NO: 7834489 - DNA, 22 bp, Homo sapiens
tatttctgaggcccaggaagtg

SEQ ID NO: 7834490 - DNA, 22 bp, Homo sapiens
tatttctgagaaccaacttacc

SEQ ID NO: 7834491 - DNA, 20 bp, Homo sapiens
tatttctgggcaaccattta

SEQ ID NO: 7834492 - DNA, 22 bp, Homo sapiens
tatttctgtaactcagggtctg

SEQ ID NO: 7834493 - DNA, 22 bp, Homo sapiens
tatttctgtatgcataaaagga

SEQ ID NO: 7834494 - DNA, 22 bp, Homo sapiens
tatttctgtatgcataaaagga

SEQ ID NO: 7834495 - DNA, 22 bp, Homo sapiens
tatttctgtcagccagatatgg

SEQ ID NO: 7834496 - DNA, 22 bp, Homo sapiens
tatttctgtcagccagatatgg

SEQ ID NO: 7834497 - DNA, 22 bp, Homo sapiens
tatttctgtcagccagatatgg

SEQ ID NO: 7834498 - DNA, 22 bp, Homo sapiens
tatttctgtatgcataaaagga

SEQ ID NO: 7834499 - DNA, 22 bp, Homo sapiens
tatttctgtatgcataaaagga

SEQ ID NO: 7834500 - DNA, 22 bp, Homo sapiens
tatttctgtcagccagatatgg

SEQ ID NO: 7834501 - DNA, 22 bp, Homo sapiens
tatttctgtttatttgtacatc

SEQ ID NO: 7834502 - DNA, 22 bp, Homo sapiens
tatttctgtttatttgtacatc

SEQ ID NO: 7834503 - DNA, 22 bp, Homo sapiens
tatttctgtttatttgtacatc

SEQ ID NO: 7834504 - DNA, 22 bp, Homo sapiens
tatttctgtttatttgtacatc

SEQ ID NO: 7834505 - DNA, 22 bp, Homo sapiens
tatttcttgagtggtcagtttc

SEQ ID NO: 7834506 - DNA, 22 bp, Homo sapiens
tatttcttgagtggtcagtttc

SEQ ID NO: 7834507 - DNA, 22 bp, Homo sapiens
tatttcttgagtggtcagtttc

SEQ ID NO: 7834508 - DNA, 22 bp, Homo sapiens
tatttcttgagtggtcagtttc

SEQ ID NO: 7834509 - DNA, 22 bp, Homo sapiens
tcaagaatttggataagaaatg

SEQ ID NO: 7834510 - DNA, 22 bp, Homo sapiens
tcaagaatttggataagaaatg

SEQ ID NO: 7834511 - DNA, 22 bp, Homo sapiens
tcaagaatagctgcaaacaggg

SEQ ID NO: 7834512 - DNA, 22 bp, Homo sapiens
tcaagaatagctgcaaacaggg

SEQ ID NO: 7834513 - DNA, 22 bp, Homo sapiens
tcaagaatttttaatgtgactg

SEQ ID NO: 7834514 - DNA, 20 bp, Homo sapiens
tcaagacagacatggagttt

SEQ ID NO: 7834515 - DNA, 22 bp, Homo sapiens
tatttcttcgggattcaagcta

SEQ ID NO: 7834516 - DNA, 22 bp, Homo sapiens
tatttcttcgggattcaagcta

SEQ ID NO: 7834517 - DNA, 22 bp, Homo sapiens
tatttcttcgggattcaagcta

SEQ ID NO: 7834518 - DNA, 22 bp, Homo sapiens
tatttcttgagactcgtcttcc

SEQ ID NO: 7834519 - DNA, 22 bp, Homo sapiens
tatttcttgagactcgtcttcc

SEQ ID NO: 7834520 - DNA, 22 bp, Homo sapiens
tatttcttgagactcgtcttcc

SEQ ID NO: 7834521 - DNA, 22 bp, Homo sapiens
tatttcttgagactcgtcttcc

SEQ ID NO: 7834522 - DNA, 22 bp, Homo sapiens
tatttcttgagactcgtcttcc

SEQ ID NO: 7834523 - DNA, 22 bp, Homo sapiens
tcaagctggctgttgctatttc

SEQ ID NO: 7834524 - DNA, 22 bp, Homo sapiens
tcaaggaagggatattcttgaa

SEQ ID NO: 7834525 - DNA, 22 bp, Homo sapiens
tcaaggaagatagctattatga

SEQ ID NO: 7834526 - DNA, 22 bp, Homo sapiens
tcaagataccaccattatatgt

SEQ ID NO: 7834527 - DNA, 22 bp, Homo sapiens
tcaagataccaccattatatgt

SEQ ID NO: 7834528 - DNA, 22 bp, Homo sapiens
tcaagatgaaagatgtagccat

SEQ ID NO: 7834529 - DNA, 22 bp, Homo sapiens
tcaagatgaaagatgtagccat

SEQ ID NO: 7834530 - DNA, 22 bp, Homo sapiens
tcaagatgaaagatgtagccat

SEQ ID NO: 7834531 - DNA, 22 bp, Homo sapiens
tcaagataagtcagtatatcaa

SEQ ID NO: 7834532 - DNA, 22 bp, Homo sapiens
tcaagagttggtcaaatccaaa

SEQ ID NO: 7834533 - DNA, 22 bp, Homo sapiens
tcaagagttggtcaaatccaaa

SEQ ID NO: 7834534 - DNA, 22 bp, Homo sapiens
tcaagataccaccattatatgt

SEQ ID NO: 7834535 - DNA, 22 bp, Homo sapiens
tcaaggaatgggtccttccctt

SEQ ID NO: 7834536 - DNA, 22 bp, Homo sapiens
tcaaggaatgggtccttccctt

SEQ ID NO: 7834537 - DNA, 22 bp, Homo sapiens
tcaaggaatgactatatgagga

SEQ ID NO: 7834538 - DNA, 20 bp, Homo sapiens
tcaaggaatgtcattttgtt

SEQ ID NO: 7834539 - DNA, 22 bp, Homo sapiens
tcaaggactattgcatgactcc

SEQ ID NO: 7834540 - DNA, 20 bp, Homo sapiens
tcaaggactccctgggaaga

SEQ ID NO: 7834541 - DNA, 22 bp, Homo sapiens
tcaaggaatttagtttagtaaa

SEQ ID NO: 7834542 - DNA, 22 bp, Homo sapiens
tcaaggagacagaaagcaatgg

SEQ ID NO: 7834543 - DNA, 22 bp, Homo sapiens
tcaaggaatgactatatgagga

SEQ ID NO: 7834544 - DNA, 22 bp, Homo sapiens
tcaaggaatgactatatgagga

SEQ ID NO: 7834545 - DNA, 22 bp, Homo sapiens
tcaaggaagtcttattgcacag

SEQ ID NO: 7834546 - DNA, 22 bp, Homo sapiens
tcaaggaaggtctgttgctcca

SEQ ID NO: 7834547 - DNA, 22 bp, Homo sapiens
tcaaggaaggtctgttgctcca

SEQ ID NO: 7834548 - DNA, 22 bp, Homo sapiens
tcaaggaagggatattcttgaa

SEQ ID NO: 7834549 - DNA, 22 bp, Homo sapiens
tcaaggaagggatattcttgaa

SEQ ID NO: 7834550 - DNA, 22 bp, Homo sapiens
tcaaggaagggatattcttgaa

SEQ ID NO: 7834551 - DNA, 22 bp, Homo sapiens
tcaagagaaggggaaatagact

SEQ ID NO: 7834552 - DNA, 18 bp, Homo sapiens
tcaagacatcatgaaata

SEQ ID NO: 7834553 - DNA, 18 bp, Homo sapiens
tcaagacatcatgaaata

SEQ ID NO: 7834554 - DNA, 18 bp, Homo sapiens
tcaagacatcatgaaata

SEQ ID NO: 7834555 - DNA, 22 bp, Homo sapiens
tcaagagacaggacgtgtttca

SEQ ID NO: 7834556 - DNA, 22 bp, Homo sapiens
tcaagagattgaataataactg

SEQ ID NO: 7834557 - DNA, 22 bp, Homo sapiens
tcaagagagtgctgcttggggt

SEQ ID NO: 7834558 - DNA, 22 bp, Homo sapiens
tcaagagccaggtaagcacagg

SEQ ID NO: 7834559 - DNA, 22 bp, Homo sapiens
tcaagagcatgtatctccctaa

SEQ ID NO: 7834560 - DNA, 22 bp, Homo sapiens
tcaagagcatgtatctccctaa

SEQ ID NO: 7834561 - DNA, 22 bp, Homo sapiens
tcaagagattgaataataactg

SEQ ID NO: 7834562 - DNA, 22 bp, Homo sapiens
tcaagacagatgggtaacttgg

SEQ ID NO: 7834563 - DNA, 22 bp, Homo sapiens
tcaagacagatgggtaacttgg

SEQ ID NO: 7834564 - DNA, 22 bp, Homo sapiens
tcaagacagatgggtaacttgg

SEQ ID NO: 7834565 - DNA, 22 bp, Homo sapiens
tcaagacagggtttaaggttga

SEQ ID NO: 7834566 - DNA, 22 bp, Homo sapiens
tcaagacagtgtgatactggcc

SEQ ID NO: 7834567 - DNA, 22 bp, Homo sapiens
tcaagacagtgtgatactggcc

SEQ ID NO: 7834568 - DNA, 22 bp, Homo sapiens
tcaagacatattaaatgtgcga

SEQ ID NO: 7834569 - DNA, 22 bp, Homo sapiens
tcaagacagtgtgatactggcc

SEQ ID NO: 7834570 - DNA, 22 bp, Homo sapiens
tcaagacatattaaatgtgcga

SEQ ID NO: 7834571 - DNA, 22 bp, Homo sapiens
tcaagacatcactgtgcatttt

SEQ ID NO: 7834572 - DNA, 22 bp, Homo sapiens
tcaagacatcactgtgcatttt

SEQ ID NO: 7834573 - DNA, 18 bp, Homo sapiens
tcaagacatcatgaaata

SEQ ID NO: 7834574 - DNA, 22 bp, Homo sapiens
tcagagcatgtgggctgcagtt

SEQ ID NO: 7834575 - DNA, 20 bp, Homo sapiens
tcagagcagttggcttgtct

SEQ ID NO: 7834576 - DNA, 20 bp, Homo sapiens
tcagagcagttggcttgtct

SEQ ID NO: 7834577 - DNA, 20 bp, Homo sapiens
tcagagcagttggcttgtct

SEQ ID NO: 7834578 - DNA, 22 bp, Homo sapiens
tcagagcagcattttacaggat

SEQ ID NO: 7834579 - DNA, 22 bp, Homo sapiens
tcagagcagactttgaaggagg

SEQ ID NO: 7834580 - DNA, 22 bp, Homo sapiens
tcagagcagactttgaaggagg

SEQ ID NO: 7834581 - DNA, 22 bp, Homo sapiens
tcagagcacttggctcatggca

SEQ ID NO: 7834582 - DNA, 22 bp, Homo sapiens
tcagagcattcgggtgacaaat

SEQ ID NO: 7834583 - DNA, 22 bp, Homo sapiens
tcagagcatgtgggctgcagtt

SEQ ID NO: 7834584 - DNA, 22 bp, Homo sapiens
tcagagcattagaggtttgtat

SEQ ID NO: 7834585 - DNA, 22 bp, Homo sapiens
tcagagcattagaggtttgtat

SEQ ID NO: 7834586 - DNA, 22 bp, Homo sapiens
tcagagcattcgggtgacaaat

SEQ ID NO: 7834587 - DNA, 22 bp, Homo sapiens
tcagagcattcgggtgacaaat

SEQ ID NO: 7834588 - DNA, 23 bp, Homo sapiens
tcagagaggccccctgcagagat

SEQ ID NO: 7834589 - DNA, 23 bp, Homo sapiens
tcagagaggccccctgcagagat

SEQ ID NO: 7834590 - DNA, 23 bp, Homo sapiens
tcagagaggccccctgcagagat

SEQ ID NO: 7834591 - DNA, 22 bp, Homo sapiens
tcagagaggttggtgataagaa

SEQ ID NO: 7834592 - DNA, 22 bp, Homo sapiens
tcagagaggttggtgataagaa

SEQ ID NO: 7834593 - DNA, 22 bp, Homo sapiens
tcagagcaccacacagttccct

SEQ ID NO: 7834594 - DNA, 22 bp, Homo sapiens
tcagagcactggtgctaccttg

SEQ ID NO: 7834595 - DNA, 22 bp, Homo sapiens
tcagagcttatctcttgctgga

SEQ ID NO: 7834596 - DNA, 22 bp, Homo sapiens
tcagagctgtgcttcaggaaag

SEQ ID NO: 7834597 - DNA, 22 bp, Homo sapiens
tcagagctgggtgcttcttcct

SEQ ID NO: 7834598 - DNA, 20 bp, Homo sapiens
tcagagctgcaggagagaaa

SEQ ID NO: 7834599 - DNA, 22 bp, Homo sapiens
tcagagctgcccatgcaagggg

SEQ ID NO: 7834600 - DNA, 22 bp, Homo sapiens
tcagagctgggtgcttcttcct

SEQ ID NO: 7834601 - DNA, 22 bp, Homo sapiens
tcagagctttggagaccaggaa

SEQ ID NO: 7834602 - DNA, 22 bp, Homo sapiens
tcagaggaaacaatctttagta

SEQ ID NO: 7834603 - DNA, 22 bp, Homo sapiens
tcagagctttggagaccaggaa

SEQ ID NO: 7834604 - DNA, 22 bp, Homo sapiens
tcagagcttcacctgttacatt

SEQ ID NO: 7834605 - DNA, 22 bp, Homo sapiens
tcagagcttcacctgttacatt

SEQ ID NO: 7834606 - DNA, 22 bp, Homo sapiens
tcagagcttatctcttgctgga

SEQ ID NO: 7834607 - DNA, 22 bp, Homo sapiens
tcagagccctgctcctccccaa

SEQ ID NO: 7834608 - DNA, 22 bp, Homo sapiens
tcagagccctgctcctccccaa

SEQ ID NO: 7834609 - DNA, 22 bp, Homo sapiens
tcagagcccctccgctgtccca

SEQ ID NO: 7834610 - DNA, 22 bp, Homo sapiens
tcagagctcatgagcagagcca

SEQ ID NO: 7834611 - DNA, 22 bp, Homo sapiens
tcagagctcatgagcagagcca

SEQ ID NO: 7834612 - DNA, 22 bp, Homo sapiens
tcagagctcatgagcagagcca

SEQ ID NO: 7834613 - DNA, 22 bp, Homo sapiens
tcagagctcatgagcagagcca

SEQ ID NO: 7834614 - DNA, 22 bp, Homo sapiens
tcagagctcctaagggctgatt

SEQ ID NO: 7834615 - DNA, 22 bp, Homo sapiens
tcagagctcctaagggctgatt

SEQ ID NO: 7834616 - DNA, 22 bp, Homo sapiens
tcagagctcctaagggctgatt

SEQ ID NO: 7834617 - DNA, 22 bp, Homo sapiens
tcagagctaaggggagagcaaa

SEQ ID NO: 7834618 - DNA, 22 bp, Homo sapiens
tcagagctcatgagcagagcca

SEQ ID NO: 7834619 - DNA, 22 bp, Homo sapiens
tcagagctcatgagcagagcca

SEQ ID NO: 7834620 - DNA, 22 bp, Homo sapiens
tcagagctaaggggagagcaaa

SEQ ID NO: 7834621 - DNA, 22 bp, Homo sapiens
tcagagctaaggggagagcaaa

SEQ ID NO: 7834622 - DNA, 22 bp, Homo sapiens
tcagcaaggcagaagggaggta

SEQ ID NO: 7834623 - DNA, 22 bp, Homo sapiens
tcagcaagtattttctgaatgc

SEQ ID NO: 7834624 - DNA, 22 bp, Homo sapiens
tcagcaaggctgcattctcatc

SEQ ID NO: 7834625 - DNA, 22 bp, Homo sapiens
tcagcaagtattttctgaatgc

SEQ ID NO: 7834626 - DNA, 22 bp, Homo sapiens
tcagcaagtggaccatcctggg

SEQ ID NO: 7834627 - DNA, 22 bp, Homo sapiens
tcagcaagtggaccatcctggg

SEQ ID NO: 7834628 - DNA, 22 bp, Homo sapiens
tcagcaagtggaccatcctggg

SEQ ID NO: 7834629 - DNA, 22 bp, Homo sapiens
tcagcaagcagggggatgttca

SEQ ID NO: 7834630 - DNA, 22 bp, Homo sapiens
tcagcaagcagggggatgttca

SEQ ID NO: 7834631 - DNA, 22 bp, Homo sapiens
tcagaggaagccttggtgggag

SEQ ID NO: 7834632 - DNA, 22 bp, Homo sapiens
tcagaggaactggactaaagcc

SEQ ID NO: 7834633 - DNA, 22 bp, Homo sapiens
tcagaggaacactgtttcatgc

SEQ ID NO: 7834634 - DNA, 22 bp, Homo sapiens
tcagaggaaaggtcagatggct

SEQ ID NO: 7834635 - DNA, 22 bp, Homo sapiens
tcagaggaaaggtcagatggct

SEQ ID NO: 7834636 - DNA, 22 bp, Homo sapiens
tcagaggaaagggaacatagtc

SEQ ID NO: 7834637 - DNA, 22 bp, Homo sapiens
tcagaggaaagggaacatagtc

SEQ ID NO: 7834638 - DNA, 22 bp, Homo sapiens
tcagaggaaaggtcagatggct

SEQ ID NO: 7834639 - DNA, 22 bp, Homo sapiens
tcagcactgaaattcttcacat

SEQ ID NO: 7834640 - DNA, 22 bp, Homo sapiens
tcagcactgatagaagtcaata

SEQ ID NO: 7834641 - DNA, 22 bp, Homo sapiens
tcagcactggcgctgggcaggt

SEQ ID NO: 7834642 - DNA, 22 bp, Homo sapiens
tcagcacttggatttcagagat

SEQ ID NO: 7834643 - DNA, 22 bp, Homo sapiens
tcagcactgtgtccagtctccc

SEQ ID NO: 7834644 - DNA, 22 bp, Homo sapiens
tcagcactgtgtccagtctccc

SEQ ID NO: 7834645 - DNA, 22 bp, Homo sapiens
tcagcaccagttatcctcaggg

SEQ ID NO: 7834646 - DNA, 22 bp, Homo sapiens
tcagcacaggtcttgcaaaaca

SEQ ID NO: 7834647 - DNA, 22 bp, Homo sapiens
tcagcaccagttatcctcaggg

SEQ ID NO: 7834648 - DNA, 22 bp, Homo sapiens
tcagcacaggtcttgcaaaaca

SEQ ID NO: 7834649 - DNA, 22 bp, Homo sapiens
tcagcaccagttatcctcaggg

SEQ ID NO: 7834650 - DNA, 22 bp, Homo sapiens
tcagcaccagttatcctcaggg

SEQ ID NO: 7834651 - DNA, 22 bp, Homo sapiens
tcagcaatgtgatactgtgcaa

SEQ ID NO: 7834652 - DNA, 22 bp, Homo sapiens
tcagcaatcctcccacaggtgg

SEQ ID NO: 7834653 - DNA, 22 bp, Homo sapiens
tcagcacaggtcttgcaaaaca

SEQ ID NO: 7834654 - DNA, 22 bp, Homo sapiens
tcagcacaggtcttgcaaaaca

SEQ ID NO: 7834655 - DNA, 20 bp, Homo sapiens
tcagcacagctgacaaggtt

SEQ ID NO: 7834656 - DNA, 20 bp, Homo sapiens
tcagcacagctgacaaggtt

SEQ ID NO: 7834657 - DNA, 22 bp, Homo sapiens
tcagcaatatgataggctttgt

SEQ ID NO: 7834658 - DNA, 22 bp, Homo sapiens
tcagacctctgaccttgccaaa

SEQ ID NO: 7834659 - DNA, 22 bp, Homo sapiens
tcagacctctgaccttgccaaa

SEQ ID NO: 7834660 - DNA, 22 bp, Homo sapiens
tcagacctctgaccttgccaaa

SEQ ID NO: 7834661 - DNA, 20 bp, Homo sapiens
tcagacccagattagcaggt

SEQ ID NO: 7834662 - DNA, 22 bp, Homo sapiens
tcagaccatcctgctgttagtg

SEQ ID NO: 7834663 - DNA, 23 bp, Homo sapiens
tcagagaactcgggcagatgacc

SEQ ID NO: 7834664 - DNA, 22 bp, Homo sapiens
tcagagaactccacaccttagg

SEQ ID NO: 7834665 - DNA, 23 bp, Homo sapiens
tcagagaactcgggcagatgacc

SEQ ID NO: 7834666 - DNA, 23 bp, Homo sapiens
tcagagaactcgggcagatgacc

SEQ ID NO: 7834667 - DNA, 22 bp, Homo sapiens
tcagagaactccacaccttagg

SEQ ID NO: 7834668 - DNA, 21 bp, Homo sapiens
tcagagaacccggcaggcaag

SEQ ID NO: 7834669 - DNA, 21 bp, Homo sapiens
tcagagaacccggcaggcaag

SEQ ID NO: 7834670 - DNA, 22 bp, Homo sapiens
tcagagaactccacaccttagg

SEQ ID NO: 7834671 - DNA, 22 bp, Homo sapiens
tcagagaactccacaccttagg

SEQ ID NO: 7834672 - DNA, 22 bp, Homo sapiens
tcagacagtttgcagtgtgcct

SEQ ID NO: 7834673 - DNA, 22 bp, Homo sapiens
tcagacagtcatcagagcttgt

SEQ ID NO: 7834674 - DNA, 22 bp, Homo sapiens
tcagacagtgtgatcagtctct

SEQ ID NO: 7834675 - DNA, 22 bp, Homo sapiens
tcagacagtgtgatcagtctct

SEQ ID NO: 7834676 - DNA, 22 bp, Homo sapiens
tcagacagtgtgatcagtctct

SEQ ID NO: 7834677 - DNA, 22 bp, Homo sapiens
tcagacatgggatatgaagctc

SEQ ID NO: 7834678 - DNA, 22 bp, Homo sapiens
tcagacatggggagagagacct

SEQ ID NO: 7834679 - DNA, 22 bp, Homo sapiens
tcagacatgttttaagacttat

SEQ ID NO: 7834680 - DNA, 22 bp, Homo sapiens
tcagacattattttcaagataa

SEQ ID NO: 7834681 - DNA, 22 bp, Homo sapiens
tcagacatctcataatgtatta

SEQ ID NO: 7834682 - DNA, 22 bp, Homo sapiens
tcagacatcgtaattacacaat

SEQ ID NO: 7834683 - DNA, 22 bp, Homo sapiens
tcagacatatttttaacaaagt

SEQ ID NO: 7834684 - DNA, 22 bp, Homo sapiens
tcagacatatcaataggcactt

SEQ ID NO: 7834685 - DNA, 22 bp, Homo sapiens
tcagacatatttttaacaaagt

SEQ ID NO: 7834686 - DNA, 20 bp, Homo sapiens
tcagagaagggactgagatt

SEQ ID NO: 7834687 - DNA, 22 bp, Homo sapiens
tcagagaaggctgagtcacggc

SEQ ID NO: 7834688 - DNA, 22 bp, Homo sapiens
tcagagaaggctgagtcacggc

SEQ ID NO: 7834689 - DNA, 22 bp, Homo sapiens
tcagagaaggcaattttatggt

SEQ ID NO: 7834690 - DNA, 22 bp, Homo sapiens
tcagagaaggctgagtcacggc

SEQ ID NO: 7834691 - DNA, 22 bp, Homo sapiens
tcagagaaggaggcacgagggc

SEQ ID NO: 7834692 - DNA, 22 bp, Homo sapiens
tcagagaaggaggcacgagggc

SEQ ID NO: 7834693 - DNA, 20 bp, Homo sapiens
tcagagaaggagctttcctg

SEQ ID NO: 7834694 - DNA, 20 bp, Homo sapiens
tcagagaaggagctttcctg

SEQ ID NO: 7834695 - DNA, 20 bp, Homo sapiens
tcagagaaggagctttcctg

SEQ ID NO: 7834696 - DNA, 22 bp, Homo sapiens
tcagagaagcttaagctgtaat

SEQ ID NO: 7834697 - DNA, 22 bp, Homo sapiens
tcagagaagcttaagctgtaat

SEQ ID NO: 7834698 - DNA, 20 bp, Homo sapiens
tcagagaaggagctttcctg

SEQ ID NO: 7834699 - DNA, 20 bp, Homo sapiens
tcagagaaggagctttcctg

SEQ ID NO: 7834700 - DNA, 22 bp, Homo sapiens
tcagagaaggaggcacgagggc

SEQ ID NO: 7834701 - DNA, 20 bp, Homo sapiens
tcagagaaggagctttcctg

SEQ ID NO: 7834702 - DNA, 22 bp, Homo sapiens
tcagagaagcttaagctgtaat

SEQ ID NO: 7834703 - DNA, 22 bp, Homo sapiens
tcagagaagctgccaggcgagc

SEQ ID NO: 7834704 - DNA, 22 bp, Homo sapiens
tcagagaagcttaagctgtaat

SEQ ID NO: 7834705 - DNA, 22 bp, Homo sapiens
tcagagaagctgccaggcgagc

SEQ ID NO: 7834706 - DNA, 22 bp, Homo sapiens
tcagagaagacatcattgtgaa

SEQ ID NO: 7834707 - DNA, 22 bp, Homo sapiens
tcagagaagacatcattgtgaa

SEQ ID NO: 7834708 - DNA, 22 bp, Homo sapiens
tcagagaagctgccaggcgagc

SEQ ID NO: 7834709 - DNA, 22 bp, Homo sapiens
tcagagaagctgccaggcgagc

SEQ ID NO: 7834710 - DNA, 22 bp, Homo sapiens
tcagagaagctgccaggcgagc

SEQ ID NO: 7834711 - DNA, 22 bp, Homo sapiens
tcagagaactgcagcccttcct

SEQ ID NO: 7834712 - DNA, 22 bp, Homo sapiens
tcagagaactgcagcccttcct

SEQ ID NO: 7834713 - DNA, 22 bp, Homo sapiens
tcagagaactggcatgtttaga

SEQ ID NO: 7834714 - DNA, 22 bp, Homo sapiens
tcagagaagacatcattgtgaa

SEQ ID NO: 7834715 - DNA, 22 bp, Homo sapiens
tcagagaactggcatgtttaga

SEQ ID NO: 7834716 - DNA, 22 bp, Homo sapiens
tcagagaactggcatgtttaga

SEQ ID NO: 7834717 - DNA, 23 bp, Homo sapiens
tcagagaactcgggcagatgacc

SEQ ID NO: 7834718 - DNA, 23 bp, Homo sapiens
tcagagaactcgggcagatgacc

SEQ ID NO: 7834719 - DNA, 23 bp, Homo sapiens
tcagagaactcgggcagatgacc

SEQ ID NO: 7834720 - DNA, 22 bp, Homo sapiens
tcagagaactgcagcccttcct

SEQ ID NO: 7834721 - DNA, 23 bp, Homo sapiens
tcagagaactcgggcagatgacc

SEQ ID NO: 7834722 - DNA, 22 bp, Homo sapiens
tcactttttgatatcattctgc

SEQ ID NO: 7834723 - DNA, 22 bp, Homo sapiens
tcactttttgatatcattctgc

SEQ ID NO: 7834724 - DNA, 22 bp, Homo sapiens
tcagaaaagaccacattattct

SEQ ID NO: 7834725 - DNA, 22 bp, Homo sapiens
tcagaaaagaccacattattct

SEQ ID NO: 7834726 - DNA, 22 bp, Homo sapiens
tcagaaaagaccacattattct

SEQ ID NO: 7834727 - DNA, 22 bp, Homo sapiens
tcacttttgatccctatgcagt

SEQ ID NO: 7834728 - DNA, 22 bp, Homo sapiens
tcacttttgatccctatgcagt

SEQ ID NO: 7834729 - DNA, 22 bp, Homo sapiens
tcacttttgatccctatgcagt

SEQ ID NO: 7834730 - DNA, 22 bp, Homo sapiens
tcacttttgatccctatgcagt

SEQ ID NO: 7834731 - DNA, 22 bp, Homo sapiens
tcacttttgggtttccagtaga

SEQ ID NO: 7834732 - DNA, 22 bp, Homo sapiens
tcacttttgggtttccagtaga

SEQ ID NO: 7834733 - DNA, 22 bp, Homo sapiens
tcactttttgatatcattctgc

SEQ ID NO: 7834734 - DNA, 22 bp, Homo sapiens
tcagaaaagagaaaatcttata

SEQ ID NO: 7834735 - DNA, 22 bp, Homo sapiens
tcagaaaagagaaaatcttata

SEQ ID NO: 7834736 - DNA, 22 bp, Homo sapiens
tcagaaaaggtagctgtgacaa

SEQ ID NO: 7834737 - DNA, 22 bp, Homo sapiens
tcagaaaaggtagctgtgacaa

SEQ ID NO: 7834738 - DNA, 22 bp, Homo sapiens
tcagaaaagagaaaatcttata

SEQ ID NO: 7834739 - DNA, 22 bp, Homo sapiens
tcagaaaagagaaaatcttata

SEQ ID NO: 7834740 - DNA, 22 bp, Homo sapiens
tcagaaaagagaaaatcttata

SEQ ID NO: 7834741 - DNA, 22 bp, Homo sapiens
tcagaaaagagaaaatcttata

SEQ ID NO: 7834742 - DNA, 22 bp, Homo sapiens
tcagaaaagaccacattattct

SEQ ID NO: 7834743 - DNA, 22 bp, Homo sapiens
tcagaaaagaccacattattct

SEQ ID NO: 7834744 - DNA, 22 bp, Homo sapiens
tcagaaaagaccacattattct

SEQ ID NO: 7834745 - DNA, 22 bp, Homo sapiens
tcagaaaaggtagctgtgacaa

SEQ ID NO: 7834746 - DNA, 22 bp, Homo sapiens
tcagaaaaggtagctgtgacaa

SEQ ID NO: 7834747 - DNA, 22 bp, Homo sapiens
tcagacagattttgacacttgc

SEQ ID NO: 7834748 - DNA, 22 bp, Homo sapiens
tcagaaaataactgttagtttg

SEQ ID NO: 7834749 - DNA, 22 bp, Homo sapiens
tcagacagcttgcagggaggtg

SEQ ID NO: 7834750 - DNA, 22 bp, Homo sapiens
tcagacagcttgcagggaggtg

SEQ ID NO: 7834751 - DNA, 22 bp, Homo sapiens
tcagacaggcctctccagcctc

SEQ ID NO: 7834752 - DNA, 22 bp, Homo sapiens
tcagacaggcctctccagcctc

SEQ ID NO: 7834753 - DNA, 20 bp, Homo sapiens
tcagacagtcgcagttctgg

SEQ ID NO: 7834754 - DNA, 22 bp, Homo sapiens
tcagacagggcttctcaaactt

SEQ ID NO: 7834755 - DNA, 22 bp, Homo sapiens
tcagacagggagtcagaaaata

SEQ ID NO: 7834756 - DNA, 22 bp, Homo sapiens
tcagacaggctggacagcttgc

SEQ ID NO: 7834757 - DNA, 22 bp, Homo sapiens
tcagacaggcttctttctccct

SEQ ID NO: 7834758 - DNA, 22 bp, Homo sapiens
tcagacaggcttctttctccct

SEQ ID NO: 7834759 - DNA, 22 bp, Homo sapiens
tcagacagggagtcagaaaata

SEQ ID NO: 7834760 - DNA, 22 bp, Homo sapiens
tcagacagggagtcagaaaata

SEQ ID NO: 7834761 - DNA, 22 bp, Homo sapiens
tcagacaggcctctccagcctc

SEQ ID NO: 7834762 - DNA, 22 bp, Homo sapiens
tcagacaggcttctttctccct

SEQ ID NO: 7834763 - DNA, 22 bp, Homo sapiens
tcacccaggatattgaagtcag

SEQ ID NO: 7834764 - DNA, 22 bp, Homo sapiens
tcacccagcgggcgcacactcg

SEQ ID NO: 7834765 - DNA, 22 bp, Homo sapiens
tcacccagccttggcgggtttg

SEQ ID NO: 7834766 - DNA, 22 bp, Homo sapiens
tcacccaggctggactgcagtg

SEQ ID NO: 7834767 - DNA, 22 bp, Homo sapiens
tcacccaggctggactgcagtg

SEQ ID NO: 7834768 - DNA, 22 bp, Homo sapiens
tcacccaggctggactgcagtg

SEQ ID NO: 7834769 - DNA, 19 bp, Homo sapiens
tcacccaggctgctggctc

SEQ ID NO: 7834770 - DNA, 22 bp, Homo sapiens
tcacccaggatattgaagtcag

SEQ ID NO: 7834771 - DNA, 19 bp, Homo sapiens
tcacccaggctgctggctc

SEQ ID NO: 7834772 - DNA, 22 bp, Homo sapiens
tcacccaggctggagtgcagtg

SEQ ID NO: 7834773 - DNA, 22 bp, Homo sapiens
tcacccaggctggactgcagtg

SEQ ID NO: 7834774 - DNA, 22 bp, Homo sapiens
tcacccaggctggagtgcagtg

SEQ ID NO: 7834775 - DNA, 22 bp, Homo sapiens
tcacccaggctggagtgcagtg

SEQ ID NO: 7834776 - DNA, 22 bp, Homo sapiens
tcacccaggctggagtgtagtg

SEQ ID NO: 7834777 - DNA, 22 bp, Homo sapiens
tcacccaggctggtgcgcagtg

SEQ ID NO: 7834778 - DNA, 22 bp, Homo sapiens
tcacccaggctggtatgcagtg

SEQ ID NO: 7834779 - DNA, 22 bp, Homo sapiens
tcacccaggctggtatgcagtg

SEQ ID NO: 7834780 - DNA, 22 bp, Homo sapiens
tcacccaggctggagtgtagtg

SEQ ID NO: 7834781 - DNA, 22 bp, Homo sapiens
tcacccaggctggagtgtagtg

SEQ ID NO: 7834782 - DNA, 22 bp, Homo sapiens
tcactctggcctctgcagcagt

SEQ ID NO: 7834783 - DNA, 22 bp, Homo sapiens
tcactctggcctctgcagcagt

SEQ ID NO: 7834784 - DNA, 22 bp, Homo sapiens
tcactctgctgcccgagggctg

SEQ ID NO: 7834785 - DNA, 22 bp, Homo sapiens
tcactctgctgcccgagggctg

SEQ ID NO: 7834786 - DNA, 22 bp, Homo sapiens
tcactctgcaggaaggagcagc

SEQ ID NO: 7834787 - DNA, 22 bp, Homo sapiens
tcactctgcaggaaggagcagc

SEQ ID NO: 7834788 - DNA, 22 bp, Homo sapiens
tcactctgcaggaaggagcagc

SEQ ID NO: 7834789 - DNA, 22 bp, Homo sapiens
tcactctgagaggtcactggaa

SEQ ID NO: 7834790 - DNA, 22 bp, Homo sapiens
tcactctgagaggtcactggaa

SEQ ID NO: 7834791 - DNA, 22 bp, Homo sapiens
tcactctgagaggtcactggaa

SEQ ID NO: 7834792 - DNA, 20 bp, Homo sapiens
tcactctgatgctagggtgg

SEQ ID NO: 7834793 - DNA, 22 bp, Homo sapiens
tcactacaacctccgcctcctg

SEQ ID NO: 7834794 - DNA, 22 bp, Homo sapiens
tcactacaacctccgcctcctg

SEQ ID NO: 7834795 - DNA, 22 bp, Homo sapiens
tcactacacaatatatttcaga

SEQ ID NO: 7834796 - DNA, 22 bp, Homo sapiens
tcactagcattgttgaaggact

SEQ ID NO: 7834797 - DNA, 22 bp, Homo sapiens
tcactacattttagacagtaaa

SEQ ID NO: 7834798 - DNA, 22 bp, Homo sapiens
tcactataatatgtcaaaatac

SEQ ID NO: 7834799 - DNA, 22 bp, Homo sapiens
tcactctgaatggtactgagga

SEQ ID NO: 7834800 - DNA, 22 bp, Homo sapiens
tcacattttctactactgtacg

SEQ ID NO: 7834801 - DNA, 22 bp, Homo sapiens
tcacattttctactactgtacg

SEQ ID NO: 7834802 - DNA, 22 bp, Homo sapiens
tcacattttctactactgtacg

SEQ ID NO: 7834803 - DNA, 22 bp, Homo sapiens
tcacagtagttgttctctgttt

SEQ ID NO: 7834804 - DNA, 22 bp, Homo sapiens
tcacattttccttggtatctgt

SEQ ID NO: 7834805 - DNA, 22 bp, Homo sapiens
tcacattttcatattctctgag

SEQ ID NO: 7834806 - DNA, 22 bp, Homo sapiens
tcacattttctactactgtacg

SEQ ID NO: 7834807 - DNA, 22 bp, Homo sapiens
tcacattttctactactgtacg

SEQ ID NO: 7834808 - DNA, 22 bp, Homo sapiens
tcacattttctactactgtacg

SEQ ID NO: 7834809 - DNA, 22 bp, Homo sapiens
tcacattttgttcaaggctagt

SEQ ID NO: 7834810 - DNA, 22 bp, Homo sapiens
tcacattttcttaggaaactta

SEQ ID NO: 7834811 - DNA, 22 bp, Homo sapiens
tcacattttgttcaaggctagt

SEQ ID NO: 7834812 - DNA, 22 bp, Homo sapiens
tcacagtagccatttcatgagt

SEQ ID NO: 7834813 - DNA, 22 bp, Homo sapiens
tcacagtagccatttcatgagt

SEQ ID NO: 7834814 - DNA, 22 bp, Homo sapiens
tcacagtagttgttctctgttt

SEQ ID NO: 7834815 - DNA, 22 bp, Homo sapiens
tcacagtagttgttctctgttt

SEQ ID NO: 7834816 - DNA, 22 bp, Homo sapiens
tcacagtataacctcatatagg

SEQ ID NO: 7834817 - DNA, 22 bp, Homo sapiens
tcacagtataacctcatatagg

SEQ ID NO: 7834818 - DNA, 22 bp, Homo sapiens
tcacattttcaaaagctggtgc

SEQ ID NO: 7834819 - DNA, 22 bp, Homo sapiens
tcacagtatagagttattttgg

SEQ ID NO: 7834820 - DNA, 22 bp, Homo sapiens
tcacagtatagagttattttgg

SEQ ID NO: 7834821 - DNA, 22 bp, Homo sapiens
tcacagtataacctcatatagg

SEQ ID NO: 7834822 - DNA, 22 bp, Homo sapiens
tcacagtataacctcatatagg

SEQ ID NO: 7834823 - DNA, 22 bp, Homo sapiens
tcacattttttactggacttaa

SEQ ID NO: 7834824 - DNA, 22 bp, Homo sapiens
tcaccaaggcattttcacagca

SEQ ID NO: 7834825 - DNA, 22 bp, Homo sapiens
tcaccaccagaagagctattct

SEQ ID NO: 7834826 - DNA, 22 bp, Homo sapiens
tcaccaataataacttgagaat

SEQ ID NO: 7834827 - DNA, 22 bp, Homo sapiens
tcaccactaggaattgtgtagt

SEQ ID NO: 7834828 - DNA, 22 bp, Homo sapiens
tcaccaaggcattttcacagca

SEQ ID NO: 7834829 - DNA, 22 bp, Homo sapiens
tcaccactcactcaggcaagtc

SEQ ID NO: 7834830 - DNA, 22 bp, Homo sapiens
tcaccactgaacagacctttgg

SEQ ID NO: 7834831 - DNA, 22 bp, Homo sapiens
tcaccagacgcgtgggtctgag

SEQ ID NO: 7834832 - DNA, 22 bp, Homo sapiens
tcaccagacagttactgcatgt

SEQ ID NO: 7834833 - DNA, 23 bp, Homo sapiens
tcaccagaaggggtcaataaaga

SEQ ID NO: 7834834 - DNA, 23 bp, Homo sapiens
tcaccagaaggggtcaataaaga

SEQ ID NO: 7834835 - DNA, 22 bp, Homo sapiens
tcaccactgaggccacgtggct

SEQ ID NO: 7834836 - DNA, 22 bp, Homo sapiens
tcaccagatgatttttcttcag

SEQ ID NO: 7834837 - DNA, 22 bp, Homo sapiens
tcaccagctctgcctcgccagt

SEQ ID NO: 7834838 - DNA, 22 bp, Homo sapiens
tcaccagatgatttttcttcag

SEQ ID NO: 7834839 - DNA, 22 bp, Homo sapiens
tcaccagatctctctgtaatgg

SEQ ID NO: 7834840 - DNA, 22 bp, Homo sapiens
tcaccagatctctctgtaatgg

SEQ ID NO: 7834841 - DNA, 22 bp, Homo sapiens
tcaccagatctctctgtaatgg

SEQ ID NO: 7834842 - DNA, 22 bp, Homo sapiens
tcaccaggactgagaccttggg

SEQ ID NO: 7834843 - DNA, 22 bp, Homo sapiens
tcaccaggactgagaccttggg

SEQ ID NO: 7834844 - DNA, 22 bp, Homo sapiens
tcaccaggattcctatcagtag

SEQ ID NO: 7834845 - DNA, 22 bp, Homo sapiens
tcaccaggattcctatcagtag

SEQ ID NO: 7834846 - DNA, 22 bp, Homo sapiens
tcacccagcagctgcttctgct

SEQ ID NO: 7834847 - DNA, 22 bp, Homo sapiens
tcaccaggcaactatgtactcc

SEQ ID NO: 7834848 - DNA, 22 bp, Homo sapiens
tcaccaggctagagtgcagtgg

SEQ ID NO: 7834849 - DNA, 22 bp, Homo sapiens
tcaccaggcaactatgtactcc

SEQ ID NO: 7834850 - DNA, 22 bp, Homo sapiens
tcaccaggattgggctgtaggc

SEQ ID NO: 7834851 - DNA, 22 bp, Homo sapiens
tcaccaggattgggctgtaggc

SEQ ID NO: 7834852 - DNA, 22 bp, Homo sapiens
tcaccaggattgggctgtaggc

SEQ ID NO: 7834853 - DNA, 22 bp, Homo sapiens
tcactttagaggaaacattgag

SEQ ID NO: 7834854 - DNA, 22 bp, Homo sapiens
tcactttagaggaaacattgag

SEQ ID NO: 7834855 - DNA, 22 bp, Homo sapiens
tcactttactttgttaatctgg

SEQ ID NO: 7834856 - DNA, 22 bp, Homo sapiens
tcactttactttgttaatctgg

SEQ ID NO: 7834857 - DNA, 22 bp, Homo sapiens
tcactttaatgatttgtagaat

SEQ ID NO: 7834858 - DNA, 22 bp, Homo sapiens
tcactttaatgatttgtagaat

SEQ ID NO: 7834859 - DNA, 22 bp, Homo sapiens
tcactttaaactactgtggtct

SEQ ID NO: 7834860 - DNA, 22 bp, Homo sapiens
tcactttacagatgggaaaact

SEQ ID NO: 7834861 - DNA, 22 bp, Homo sapiens
tcactttgaattccttgatttt

SEQ ID NO: 7834862 - DNA, 22 bp, Homo sapiens
tcactttcctcatcacgactag

SEQ ID NO: 7834863 - DNA, 22 bp, Homo sapiens
tcactttgatgacattgtagct

SEQ ID NO: 7834864 - DNA, 22 bp, Homo sapiens
tcactttgacggccaacttcta

SEQ ID NO: 7834865 - DNA, 22 bp, Homo sapiens
tcactttgacagagaaatgaat

SEQ ID NO: 7834866 - DNA, 22 bp, Homo sapiens
tcactttggaagatagcacatc

SEQ ID NO: 7834867 - DNA, 22 bp, Homo sapiens
tcactttggattatgtaatttc

SEQ ID NO: 7834868 - DNA, 23 bp, Homo sapiens
tcactttgatgtaattgaaaagc

SEQ ID NO: 7834869 - DNA, 23 bp, Homo sapiens
tcactttgatgtaattgaaaagc

SEQ ID NO: 7834870 - DNA, 23 bp, Homo sapiens
tcactttgatgtaattgaaaagc

SEQ ID NO: 7834871 - DNA, 22 bp, Homo sapiens
tcacttcttcagctttccttga

SEQ ID NO: 7834872 - DNA, 22 bp, Homo sapiens
tcacttcttcagctttccttga

SEQ ID NO: 7834873 - DNA, 22 bp, Homo sapiens
tcacttcttcccttgcacatat

SEQ ID NO: 7834874 - DNA, 22 bp, Homo sapiens
tcacttcttcccttgcacatat

SEQ ID NO: 7834875 - DNA, 19 bp, Homo sapiens
tcacttctgttagcatgga

SEQ ID NO: 7834876 - DNA, 22 bp, Homo sapiens
tcacttctgaaggtagttggca

SEQ ID NO: 7834877 - DNA, 22 bp, Homo sapiens
tcactgttagagcaaacgtatg

SEQ ID NO: 7834878 - DNA, 22 bp, Homo sapiens
tcactgttagagcaaacgtatg

SEQ ID NO: 7834879 - DNA, 22 bp, Homo sapiens
tcactgtgctctctagataggc

SEQ ID NO: 7834880 - DNA, 22 bp, Homo sapiens
tcactgtgtcctttctgcgtag

SEQ ID NO: 7834881 - DNA, 18 bp, Homo sapiens
tcactgtgtgtcttgggt

SEQ ID NO: 7834882 - DNA, 18 bp, Homo sapiens
tcactgtgtgtcttgggt

SEQ ID NO: 7834883 - DNA, 22 bp, Homo sapiens
tcactgttaataaatagcaaag

SEQ ID NO: 7834884 - DNA, 22 bp, Homo sapiens
tcactgttaataaatagcaaag

SEQ ID NO: 7834885 - DNA, 20 bp, Homo sapiens
tcacttcttccttttgtcta

SEQ ID NO: 7834886 - DNA, 20 bp, Homo sapiens
tcacttcttccttttgtcta

SEQ ID NO: 7834887 - DNA, 20 bp, Homo sapiens
tcacttcttccttttgtcta

SEQ ID NO: 7834888 - DNA, 22 bp, Homo sapiens
tcacttgaattcattctgcgaa

SEQ ID NO: 7834889 - DNA, 22 bp, Homo sapiens
tcacttgacccttctctagcct

SEQ ID NO: 7834890 - DNA, 22 bp, Homo sapiens
tcacttgactccagtttcttct

SEQ ID NO: 7834891 - DNA, 22 bp, Homo sapiens
tcacttgactttccagtcttgg

SEQ ID NO: 7834892 - DNA, 22 bp, Homo sapiens
tcacttgagatgtaccacaaac

SEQ ID NO: 7834893 - DNA, 19 bp, Homo sapiens
tcacttgtgccaggcactg

SEQ ID NO: 7834894 - DNA, 22 bp, Homo sapiens
tcactctttatcttttatgtct

SEQ ID NO: 7834895 - DNA, 22 bp, Homo sapiens
tcactctgttttactcactgtt

SEQ ID NO: 7834896 - DNA, 22 bp, Homo sapiens
tcactctgttttactcactgtt

SEQ ID NO: 7834897 - DNA, 22 bp, Homo sapiens
tcactgaaagaatgacattatg

SEQ ID NO: 7834898 - DNA, 22 bp, Homo sapiens
tcactctgtggcccaggcagtg

SEQ ID NO: 7834899 - DNA, 22 bp, Homo sapiens
tcactctgtcccccattgagat

SEQ ID NO: 7834900 - DNA, 22 bp, Homo sapiens
tcactctgggccagcgcaggta

SEQ ID NO: 7834901 - DNA, 22 bp, Homo sapiens
tcactctgggccagcgcaggta

SEQ ID NO: 7834902 - DNA, 22 bp, Homo sapiens
tcactctggcctctgcagcagt

SEQ ID NO: 7834903 - DNA, 22 bp, Homo sapiens
tcactctggcctctgcagcagt

SEQ ID NO: 7834904 - DNA, 22 bp, Homo sapiens
tcactctgggccctactgggct

SEQ ID NO: 7834905 - DNA, 22 bp, Homo sapiens
tcactctgggccagcgcaggta

SEQ ID NO: 7834906 - DNA, 22 bp, Homo sapiens
tcactctgggccctactgggct

SEQ ID NO: 7834907 - DNA, 22 bp, Homo sapiens
tcactctgtggcccaggcagtg

SEQ ID NO: 7834908 - DNA, 22 bp, Homo sapiens
tcactctgtggcccaggcagtg

SEQ ID NO: 7834909 - DNA, 22 bp, Homo sapiens
tcactctgtggcccaggcagtg

SEQ ID NO: 7834910 - DNA, 22 bp, Homo sapiens
tcactctgtggcccaggcagtg

SEQ ID NO: 7834911 - DNA, 22 bp, Homo sapiens
tcactctgttagaggaaagtgc

SEQ ID NO: 7834912 - DNA, 22 bp, Homo sapiens
tcactctgttttactcactgtt

SEQ ID NO: 7834913 - DNA, 22 bp, Homo sapiens
tcactctgttttactcactgtt

SEQ ID NO: 7834914 - DNA, 22 bp, Homo sapiens
tcactgaagtcttcaagtagga

SEQ ID NO: 7834915 - DNA, 22 bp, Homo sapiens
tcactgaagtcttcaagtagga

SEQ ID NO: 7834916 - DNA, 22 bp, Homo sapiens
tcactgaagtcttcaagtagga

SEQ ID NO: 7834917 - DNA, 21 bp, Homo sapiens
tcactgaagcctaagatgttt

SEQ ID NO: 7834918 - DNA, 21 bp, Homo sapiens
tcactgaagcctaagatgttt

SEQ ID NO: 7834919 - DNA, 22 bp, Homo sapiens
tcactgacgtggggctacttga

SEQ ID NO: 7834920 - DNA, 22 bp, Homo sapiens
tcactgagaagagtaacagcag

SEQ ID NO: 7834921 - DNA, 22 bp, Homo sapiens
tcactgagaagagtaacagcag

SEQ ID NO: 7834922 - DNA, 22 bp, Homo sapiens
tcactgaggcattcatgctctg

SEQ ID NO: 7834923 - DNA, 22 bp, Homo sapiens
tcactgatgcttatgaaagtgt

SEQ ID NO: 7834924 - DNA, 22 bp, Homo sapiens
tcactgatgcttatgaaagtgt

SEQ ID NO: 7834925 - DNA, 19 bp, Homo sapiens
tcactgaggctttgttggc

SEQ ID NO: 7834926 - DNA, 22 bp, Homo sapiens
tcactgtgctctctagataggc

SEQ ID NO: 7834927 - DNA, 23 bp, Homo sapiens
tcactgtgcccattgaggtagag

SEQ ID NO: 7834928 - DNA, 22 bp, Homo sapiens
tcaggaaggagctggcctgcca

SEQ ID NO: 7834929 - DNA, 22 bp, Homo sapiens
tcaggaaggagctggcctgcca

SEQ ID NO: 7834930 - DNA, 22 bp, Homo sapiens
tcaggaaggagctggcctgcca

SEQ ID NO: 7834931 - DNA, 22 bp, Homo sapiens
tcaggaaggagctggcctgcca

SEQ ID NO: 7834932 - DNA, 22 bp, Homo sapiens
tcaggaagctgctctgggtggt

SEQ ID NO: 7834933 - DNA, 22 bp, Homo sapiens
tcaggaagctgctctgggtggt

SEQ ID NO: 7834934 - DNA, 22 bp, Homo sapiens
tcaggaagctgaattacaaaaa

SEQ ID NO: 7834935 - DNA, 22 bp, Homo sapiens
tcaggaagctgctctgggtggt

SEQ ID NO: 7834936 - DNA, 22 bp, Homo sapiens
tcaggaagctgctctgggtggt

SEQ ID NO: 7834937 - DNA, 22 bp, Homo sapiens
tcaggaaggcgccccatcagga

SEQ ID NO: 7834938 - DNA, 22 bp, Homo sapiens
tcaggaaggcgccccatcagga

SEQ ID NO: 7834939 - DNA, 22 bp, Homo sapiens
tcaggaaggcttcacacgagtg

SEQ ID NO: 7834940 - DNA, 22 bp, Homo sapiens
tcaggaagggctcagtctgtgc

SEQ ID NO: 7834941 - DNA, 22 bp, Homo sapiens
tcaggaaggcttcacacgagtg

SEQ ID NO: 7834942 - DNA, 22 bp, Homo sapiens
tcaggaaggcacttggtgtgtt

SEQ ID NO: 7834943 - DNA, 22 bp, Homo sapiens
tcaggaaggcaaattgcatgat

SEQ ID NO: 7834944 - DNA, 22 bp, Homo sapiens
tcaggaaggcaaattgcatgat

SEQ ID NO: 7834945 - DNA, 22 bp, Homo sapiens
tcaggaaggcaaattgcatgat

SEQ ID NO: 7834946 - DNA, 22 bp, Homo sapiens
tcaggaaggcaaattgcatgat

SEQ ID NO: 7834947 - DNA, 22 bp, Homo sapiens
tcaggaaggcacttggtgtgtt

SEQ ID NO: 7834948 - DNA, 22 bp, Homo sapiens
tcaggaaggcacttggtgtgtt

SEQ ID NO: 7834949 - DNA, 22 bp, Homo sapiens
tcaggaaggcacttggtgtgtt

SEQ ID NO: 7834950 - DNA, 17 bp, Homo sapiens
tcaggaggtgtttctag

SEQ ID NO: 7834951 - DNA, 17 bp, Homo sapiens
tcaggaggtgtttctag

SEQ ID NO: 7834952 - DNA, 22 bp, Homo sapiens
tcaggaggtgtaggtcaagtga

SEQ ID NO: 7834953 - DNA, 22 bp, Homo sapiens
tcaggaggtgtaggtcaagtga

SEQ ID NO: 7834954 - DNA, 22 bp, Homo sapiens
tcaggaagggctcagtctgtgc

SEQ ID NO: 7834955 - DNA, 22 bp, Homo sapiens
tcaggaagggctcagtctgtgc

SEQ ID NO: 7834956 - DNA, 22 bp, Homo sapiens
tcaggaagggctcagtctgtgc

SEQ ID NO: 7834957 - DNA, 22 bp, Homo sapiens
tcaggaggtgtaacgaatacag

SEQ ID NO: 7834958 - DNA, 22 bp, Homo sapiens
tcaggaggtgtaggtcaagtga

SEQ ID NO: 7834959 - DNA, 22 bp, Homo sapiens
tcaggaggttgaccacggggca

SEQ ID NO: 7834960 - DNA, 22 bp, Homo sapiens
tcaggaggttgaccacggggca

SEQ ID NO: 7834961 - DNA, 22 bp, Homo sapiens
tcaggaggttgaccacggggca

SEQ ID NO: 7834962 - DNA, 17 bp, Homo sapiens
tcaggaggtgtttctag

SEQ ID NO: 7834963 - DNA, 22 bp, Homo sapiens
tcaggaggtttggattcagtta

SEQ ID NO: 7834964 - DNA, 22 bp, Homo sapiens
tcaggaggtttggattcagtta

SEQ ID NO: 7834965 - DNA, 22 bp, Homo sapiens
tcaggagtaaagacagagttcc

SEQ ID NO: 7834966 - DNA, 22 bp, Homo sapiens
tcaggagtaagggtaacccaga

SEQ ID NO: 7834967 - DNA, 22 bp, Homo sapiens
tcaggaggtttggattcagtta

SEQ ID NO: 7834968 - DNA, 22 bp, Homo sapiens
tcaggaggtttggattcagtta

SEQ ID NO: 7834969 - DNA, 22 bp, Homo sapiens
tcaggagtaaagaagacttgac

SEQ ID NO: 7834970 - DNA, 22 bp, Homo sapiens
tcaggagtaagttataagtatt

SEQ ID NO: 7834971 - DNA, 22 bp, Homo sapiens
tcaggagtactggtgtctacag

SEQ ID NO: 7834972 - DNA, 22 bp, Homo sapiens
tcaggagtcctgcctgcagcct

SEQ ID NO: 7834973 - DNA, 22 bp, Homo sapiens
tcaggagtcctgcctgcagcct

SEQ ID NO: 7834974 - DNA, 22 bp, Homo sapiens
tcaggagtctgtgcagttccac

SEQ ID NO: 7834975 - DNA, 21 bp, Homo sapiens
tcaggaagagcttctcccact

SEQ ID NO: 7834976 - DNA, 21 bp, Homo sapiens
tcaggaagagccagttcatgc

SEQ ID NO: 7834977 - DNA, 21 bp, Homo sapiens
tcaggaagagcttctcccact

SEQ ID NO: 7834978 - DNA, 21 bp, Homo sapiens
tcaggaagagccagttcatgc

SEQ ID NO: 7834979 - DNA, 21 bp, Homo sapiens
tcaggaagagccagttcatgc

SEQ ID NO: 7834980 - DNA, 21 bp, Homo sapiens
tcaggaagagccagttcatgc

SEQ ID NO: 7834981 - DNA, 21 bp, Homo sapiens
tcaggaagagccagttcatgc

SEQ ID NO: 7834982 - DNA, 22 bp, Homo sapiens
tcaggaagcatcctgaggtgtc

SEQ ID NO: 7834983 - DNA, 22 bp, Homo sapiens
tcaggaagcatcctgaggtgtc

SEQ ID NO: 7834984 - DNA, 21 bp, Homo sapiens
tcaggaagagcttctcccact

SEQ ID NO: 7834985 - DNA, 21 bp, Homo sapiens
tcaggaagagcttctcccact

SEQ ID NO: 7834986 - DNA, 22 bp, Homo sapiens
tcaggaagattagtttcctacc

SEQ ID NO: 7834987 - DNA, 22 bp, Homo sapiens
tcaggaagctactgccagcagc

SEQ ID NO: 7834988 - DNA, 22 bp, Homo sapiens
tcaggaagctcttgctgattct

SEQ ID NO: 7834989 - DNA, 22 bp, Homo sapiens
tcaggaagctcttgctgattct

SEQ ID NO: 7834990 - DNA, 22 bp, Homo sapiens
tcaggaagctcttgctgattct

SEQ ID NO: 7834991 - DNA, 22 bp, Homo sapiens
tcaggaagccactccacagaga

SEQ ID NO: 7834992 - DNA, 22 bp, Homo sapiens
tcaggaagcatcctgaggtgtc

SEQ ID NO: 7834993 - DNA, 22 bp, Homo sapiens
tcaggaagcatcctgaggtgtc

SEQ ID NO: 7834994 - DNA, 22 bp, Homo sapiens
tcaggaagcatcctgaggtgtc

SEQ ID NO: 7834995 - DNA, 22 bp, Homo sapiens
tcaggaagccggttaaatagat

SEQ ID NO: 7834996 - DNA, 22 bp, Homo sapiens
tcaggaagccggttaaatagat

SEQ ID NO: 7834997 - DNA, 22 bp, Homo sapiens
tcaggaagccggttaaatagat

SEQ ID NO: 7834998 - DNA, 22 bp, Homo sapiens
tcaggaacagcagggaggaaag

SEQ ID NO: 7834999 - DNA, 22 bp, Homo sapiens
tcaggaacagaattttctaaaa

SEQ ID NO: 7835000 - DNA, 22 bp, Homo sapiens
tcaggaacagaattttctaaaa

SEQ ID NO: 7835001 - DNA, 22 bp, Homo sapiens
tcaggaacatttaaccacaggg

SEQ ID NO: 7835002 - DNA, 22 bp, Homo sapiens
tcaggaacataatgtgagtcag

SEQ ID NO: 7835003 - DNA, 22 bp, Homo sapiens
tcaggaacatttaaccacaggg

SEQ ID NO: 7835004 - DNA, 22 bp, Homo sapiens
tcaggaacttctaggaaagctg

SEQ ID NO: 7835005 - DNA, 22 bp, Homo sapiens
tcaggaaccctggtctcctgct

SEQ ID NO: 7835006 - DNA, 22 bp, Homo sapiens
tcaggaacccccgctgggtgaa

SEQ ID NO: 7835007 - DNA, 22 bp, Homo sapiens
tcaggaaccctggtctcctgct

SEQ ID NO: 7835008 - DNA, 22 bp, Homo sapiens
tcaggaacacaggggcccatgc

SEQ ID NO: 7835009 - DNA, 22 bp, Homo sapiens
tcagctctgcactccactgtgg

SEQ ID NO: 7835010 - DNA, 22 bp, Homo sapiens
tcagctctgcaaggtcacctcc

SEQ ID NO: 7835011 - DNA, 22 bp, Homo sapiens
tcagctctgcaaggtcacctcc

SEQ ID NO: 7835012 - DNA, 22 bp, Homo sapiens
tcagctctgcaaggtcacctcc

SEQ ID NO: 7835013 - DNA, 22 bp, Homo sapiens
tcagctctctgggctcgaacct

SEQ ID NO: 7835014 - DNA, 22 bp, Homo sapiens
tcaggaagaaagaagggagtgt

SEQ ID NO: 7835015 - DNA, 22 bp, Homo sapiens
tcaggaagaaagaagggagtgt

SEQ ID NO: 7835016 - DNA, 22 bp, Homo sapiens
tcaggaagaaagaagggagtgt

SEQ ID NO: 7835017 - DNA, 22 bp, Homo sapiens
tcaggaagaaattctgtatctt

SEQ ID NO: 7835018 - DNA, 22 bp, Homo sapiens
tcaggaagaaattctgtatctt

SEQ ID NO: 7835019 - DNA, 22 bp, Homo sapiens
tcaggaagaaattctgtatctt

SEQ ID NO: 7835020 - DNA, 22 bp, Homo sapiens
tcaggaagaaattctgtatctt

SEQ ID NO: 7835021 - DNA, 22 bp, Homo sapiens
tcaggaagaagacggggcagga

SEQ ID NO: 7835022 - DNA, 22 bp, Homo sapiens
tcaggaagaagacggggcagga

SEQ ID NO: 7835023 - DNA, 22 bp, Homo sapiens
tcaggaagaagacggggcagga

SEQ ID NO: 7835024 - DNA, 22 bp, Homo sapiens
tcaggaagaagacggggcagga

SEQ ID NO: 7835025 - DNA, 22 bp, Homo sapiens
tcaggaagacaatctttggctc

SEQ ID NO: 7835026 - DNA, 22 bp, Homo sapiens
tcaggaagacaatctttggctc

SEQ ID NO: 7835027 - DNA, 22 bp, Homo sapiens
tcagctctacacacacctgtgt

SEQ ID NO: 7835028 - DNA, 22 bp, Homo sapiens
tcagctctaagttttatgcaaa

SEQ ID NO: 7835029 - DNA, 22 bp, Homo sapiens
tcagctctacacacacctgtgt

SEQ ID NO: 7835030 - DNA, 22 bp, Homo sapiens
tcagctctacacacacctgtgt

SEQ ID NO: 7835031 - DNA, 22 bp, Homo sapiens
tcagctctcacagatctcaacc

SEQ ID NO: 7835032 - DNA, 22 bp, Homo sapiens
tcagctctgcaaggtcacctcc

SEQ ID NO: 7835033 - DNA, 22 bp, Homo sapiens
tcagctctctgggctcgaacct

SEQ ID NO: 7835034 - DNA, 22 bp, Homo sapiens
tcagctctcacagatctcaacc

SEQ ID NO: 7835035 - DNA, 22 bp, Homo sapiens
tcagctctacctgggagctgtc

SEQ ID NO: 7835036 - DNA, 22 bp, Homo sapiens
tcagctctacctgggagctgtc

SEQ ID NO: 7835037 - DNA, 22 bp, Homo sapiens
tcagctcctcagagcctcagtt

SEQ ID NO: 7835038 - DNA, 22 bp, Homo sapiens
tcagctcctcagagcctcagtt

SEQ ID NO: 7835039 - DNA, 22 bp, Homo sapiens
tcagctcctcagagcctcagtt

SEQ ID NO: 7835040 - DNA, 22 bp, Homo sapiens
tcagctcctcatgcaggggata

SEQ ID NO: 7835041 - DNA, 22 bp, Homo sapiens
tcagctcctcatgcaggggata

SEQ ID NO: 7835042 - DNA, 22 bp, Homo sapiens
tcagctctaagttttatgcaaa

SEQ ID NO: 7835043 - DNA, 22 bp, Homo sapiens
tcagctccagagttgcacagtg

SEQ ID NO: 7835044 - DNA, 22 bp, Homo sapiens
tcagctccagagttgcacagtg

SEQ ID NO: 7835045 - DNA, 22 bp, Homo sapiens
tcagctcctatactttgtcctg

SEQ ID NO: 7835046 - DNA, 22 bp, Homo sapiens
tcagctccatccctgcttttgc

SEQ ID NO: 7835047 - DNA, 22 bp, Homo sapiens
tcagctcctcagagcctcagtt

SEQ ID NO: 7835048 - DNA, 22 bp, Homo sapiens
tcagctcctcagagcctcagtt

SEQ ID NO: 7835049 - DNA, 22 bp, Homo sapiens
tcagctcctcagagcctcagtt

SEQ ID NO: 7835050 - DNA, 22 bp, Homo sapiens
tcagctcctcagagcctcagtt

SEQ ID NO: 7835051 - DNA, 22 bp, Homo sapiens
tcagctcatctgagtgtcagcg

SEQ ID NO: 7835052 - DNA, 22 bp, Homo sapiens
tcagctcatctgagtgtcagcg

SEQ ID NO: 7835053 - DNA, 22 bp, Homo sapiens
tcagctccagagttgcacagtg

SEQ ID NO: 7835054 - DNA, 22 bp, Homo sapiens
tcagctccagagttgcacagtg

SEQ ID NO: 7835055 - DNA, 22 bp, Homo sapiens
tcagctccagagttgcacagtg

SEQ ID NO: 7835056 - DNA, 22 bp, Homo sapiens
tcagctccacagctcctctgcc

SEQ ID NO: 7835057 - DNA, 22 bp, Homo sapiens
tcagctccacagctcctctgcc

SEQ ID NO: 7835058 - DNA, 22 bp, Homo sapiens
tcagctccacagctcctctgcc

SEQ ID NO: 7835059 - DNA, 22 bp, Homo sapiens
tcagctacagcatctctgcttt

SEQ ID NO: 7835060 - DNA, 21 bp, Homo sapiens
tcagctcaaatgtcgcttcct

SEQ ID NO: 7835061 - DNA, 22 bp, Homo sapiens
tcagctcactctgcttcctggg

SEQ ID NO: 7835062 - DNA, 22 bp, Homo sapiens
tcagctcactctgcttcctggg

SEQ ID NO: 7835063 - DNA, 18 bp, Homo sapiens
tcagcctgttgtctgcct

SEQ ID NO: 7835064 - DNA, 18 bp, Homo sapiens
tcagcctgttgtctgcct

SEQ ID NO: 7835065 - DNA, 18 bp, Homo sapiens
tcagcctgttgtctgcct

SEQ ID NO: 7835066 - DNA, 18 bp, Homo sapiens
tcagcctgttgtctgcct

SEQ ID NO: 7835067 - DNA, 20 bp, Homo sapiens
tcagccttgaatgcttgaaa

SEQ ID NO: 7835068 - DNA, 22 bp, Homo sapiens
tcagcctggtgattcctctgtc

SEQ ID NO: 7835069 - DNA, 22 bp, Homo sapiens
tcagcctggtgattcctctgtc

SEQ ID NO: 7835070 - DNA, 22 bp, Homo sapiens
tcagcctggtgattcctctgtc

SEQ ID NO: 7835071 - DNA, 22 bp, Homo sapiens
tcagcctggcaggatggcctgg

SEQ ID NO: 7835072 - DNA, 22 bp, Homo sapiens
tcagcctggtgattcctctgtc

SEQ ID NO: 7835073 - DNA, 22 bp, Homo sapiens
tcagcaggcacaccaaaaactg

SEQ ID NO: 7835074 - DNA, 21 bp, Homo sapiens
tcagcagcttttgcagtccct

SEQ ID NO: 7835075 - DNA, 21 bp, Homo sapiens
tcagcagcttttgcagtccct

SEQ ID NO: 7835076 - DNA, 22 bp, Homo sapiens
tcagcaggcacaccaaaaactg

SEQ ID NO: 7835077 - DNA, 21 bp, Homo sapiens
tcagcagcttttgcagtccct

SEQ ID NO: 7835078 - DNA, 22 bp, Homo sapiens
tcagcagccgcagctgactcag

SEQ ID NO: 7835079 - DNA, 21 bp, Homo sapiens
tcagcagaaggaccactaggg

SEQ ID NO: 7835080 - DNA, 22 bp, Homo sapiens
tcagcagaacaaggaagcttaa

SEQ ID NO: 7835081 - DNA, 22 bp, Homo sapiens
tcagcagaaaggcactagatga

SEQ ID NO: 7835082 - DNA, 22 bp, Homo sapiens
tcagcagaacaaggaagcttaa

SEQ ID NO: 7835083 - DNA, 22 bp, Homo sapiens
tcagcagaagtatagaggccat

SEQ ID NO: 7835084 - DNA, 22 bp, Homo sapiens
tcagcagccgcagctgactcag

SEQ ID NO: 7835085 - DNA, 21 bp, Homo sapiens
tcagcagcttttgcagtccct

SEQ ID NO: 7835086 - DNA, 22 bp, Homo sapiens
tcagcagaagtatagaggccat

SEQ ID NO: 7835087 - DNA, 22 bp, Homo sapiens
tcagcagaagtatagaggccat

SEQ ID NO: 7835088 - DNA, 21 bp, Homo sapiens
tcagcagaaggaccactaggg

SEQ ID NO: 7835089 - DNA, 22 bp, Homo sapiens
tcagcactttgaagcagaagga

SEQ ID NO: 7835090 - DNA, 22 bp, Homo sapiens
tcagcacttggatttcagagat

SEQ ID NO: 7835091 - DNA, 22 bp, Homo sapiens
tcagcactttgaagcagaagga

SEQ ID NO: 7835092 - DNA, 22 bp, Homo sapiens
tcagcactttgaagcagaagga

SEQ ID NO: 7835093 - DNA, 22 bp, Homo sapiens
tcagcactttttaaagcagcat

SEQ ID NO: 7835094 - DNA, 22 bp, Homo sapiens
tcagcagaaaggcactagatga

SEQ ID NO: 7835095 - DNA, 22 bp, Homo sapiens
tcagcagaaaggcactagatga

SEQ ID NO: 7835096 - DNA, 21 bp, Homo sapiens
tcagcagaaagcaaggtcagt

SEQ ID NO: 7835097 - DNA, 21 bp, Homo sapiens
tcagcagaaagcaaggtcagt

SEQ ID NO: 7835098 - DNA, 22 bp, Homo sapiens
tcagcaggcagaaatctgcaga

SEQ ID NO: 7835099 - DNA, 22 bp, Homo sapiens
tcagcaggcagaaatctgcaga

SEQ ID NO: 7835100 - DNA, 22 bp, Homo sapiens
tcagcaggcagaaatctgcaga

SEQ ID NO: 7835101 - DNA, 22 bp, Homo sapiens
tcagcctgcgtcatggtgacac

SEQ ID NO: 7835102 - DNA, 22 bp, Homo sapiens
tcagcaggcacggacaggctgc

SEQ ID NO: 7835103 - DNA, 22 bp, Homo sapiens
tcagcaggcacggacaggctgc

SEQ ID NO: 7835104 - DNA, 22 bp, Homo sapiens
tcagcaggcacggacaggctgc

SEQ ID NO: 7835105 - DNA, 22 bp, Homo sapiens
tcagcctgctccaagtgctgcc

SEQ ID NO: 7835106 - DNA, 22 bp, Homo sapiens
tcagcctgctccaagtgctgcc

SEQ ID NO: 7835107 - DNA, 22 bp, Homo sapiens
tcagcctgctccaagtgctgcc

SEQ ID NO: 7835108 - DNA, 22 bp, Homo sapiens
tcagcctgctccaagtgctgcc

SEQ ID NO: 7835109 - DNA, 22 bp, Homo sapiens
tcagcctgctccaagtgctgcc

SEQ ID NO: 7835110 - DNA, 22 bp, Homo sapiens
tcagcctgctccaagtgctgcc

SEQ ID NO: 7835111 - DNA, 22 bp, Homo sapiens
tcagcctgcgtcatggtgacac

SEQ ID NO: 7835112 - DNA, 22 bp, Homo sapiens
tcagcctgcgtcatggtgacac

SEQ ID NO: 7835113 - DNA, 22 bp, Homo sapiens
tcagcaggcaccggaagtgttt

SEQ ID NO: 7835114 - DNA, 21 bp, Homo sapiens
tcagcaggcaccagaaggctg

SEQ ID NO: 7835115 - DNA, 21 bp, Homo sapiens
tcagcaggcaccagaaggctg

SEQ ID NO: 7835116 - DNA, 21 bp, Homo sapiens
tcagcaggcaccagaaggctg

SEQ ID NO: 7835117 - DNA, 22 bp, Homo sapiens
tcagcaggcaccggaagtgttt

SEQ ID NO: 7835118 - DNA, 22 bp, Homo sapiens
tcagcaggcaccggaagtgttt

SEQ ID NO: 7835119 - DNA, 22 bp, Homo sapiens
tcagcaggcacggacaggctgc

SEQ ID NO: 7835120 - DNA, 22 bp, Homo sapiens
tcagcaggcaccggaagtgttt

SEQ ID NO: 7835121 - DNA, 22 bp, Homo sapiens
tcaggatggagtctatccagtg

SEQ ID NO: 7835122 - DNA, 22 bp, Homo sapiens
tcaggatggagggaagcacaga

SEQ ID NO: 7835123 - DNA, 22 bp, Homo sapiens
tcaggatgaccacgagcctcta

SEQ ID NO: 7835124 - DNA, 22 bp, Homo sapiens
tcaggatggagggaagcacaga

SEQ ID NO: 7835125 - DNA, 22 bp, Homo sapiens
tcaggatgagctcataactatg

SEQ ID NO: 7835126 - DNA, 22 bp, Homo sapiens
tcaggatgagtcatcaagctgc

SEQ ID NO: 7835127 - DNA, 22 bp, Homo sapiens
tcaggatgagctcataactatg

SEQ ID NO: 7835128 - DNA, 22 bp, Homo sapiens
tcaggatggtgtggaggaaata

SEQ ID NO: 7835129 - DNA, 22 bp, Homo sapiens
tcaggatggcacccaagctctt

SEQ ID NO: 7835130 - DNA, 22 bp, Homo sapiens
tcaggatggcttctgcatcaaa

SEQ ID NO: 7835131 - DNA, 22 bp, Homo sapiens
tcaggcagtagaattgcttgaa

SEQ ID NO: 7835132 - DNA, 22 bp, Homo sapiens
tcaggcagtctgactccggagg

SEQ ID NO: 7835133 - DNA, 22 bp, Homo sapiens
tcaggcagtctgactccggagg

SEQ ID NO: 7835134 - DNA, 22 bp, Homo sapiens
tcaggcagtagaattgcttgaa

SEQ ID NO: 7835135 - DNA, 20 bp, Homo sapiens
tcaggatgtgctgagtgaag

SEQ ID NO: 7835136 - DNA, 20 bp, Homo sapiens
tcaggatgtgctgagtgaag

SEQ ID NO: 7835137 - DNA, 22 bp, Homo sapiens
tcaggatgttaatatagcatta

SEQ ID NO: 7835138 - DNA, 20 bp, Homo sapiens
tcaggcagtggggaaaggca

SEQ ID NO: 7835139 - DNA, 20 bp, Homo sapiens
tcaggcagtggggaaaggca

SEQ ID NO: 7835140 - DNA, 21 bp, Homo sapiens
tcaggcagtgcaaatacatgg

SEQ ID NO: 7835141 - DNA, 21 bp, Homo sapiens
tcaggcagtgcaaatacatgg

SEQ ID NO: 7835142 - DNA, 22 bp, Homo sapiens
tcaggcagtctgactccggagg

SEQ ID NO: 7835143 - DNA, 21 bp, Homo sapiens
tcaggcagtgcaaatacatgg

SEQ ID NO: 7835144 - DNA, 21 bp, Homo sapiens
tcaggcagtgcaaatacatgg

SEQ ID NO: 7835145 - DNA, 21 bp, Homo sapiens
tcaggcagtgcaaatacatgg

SEQ ID NO: 7835146 - DNA, 21 bp, Homo sapiens
tcaggcagtgcaaatacatgg

SEQ ID NO: 7835147 - DNA, 22 bp, Homo sapiens
tcaggcagtctgactccggagg

SEQ ID NO: 7835148 - DNA, 22 bp, Homo sapiens
tcaggagtgataccatttgtca

SEQ ID NO: 7835149 - DNA, 22 bp, Homo sapiens
tcaggagtgataccatttgtca

SEQ ID NO: 7835150 - DNA, 22 bp, Homo sapiens
tcaggagtgcagcagtttggag

SEQ ID NO: 7835151 - DNA, 22 bp, Homo sapiens
tcaggagtgccagtaccttttg

SEQ ID NO: 7835152 - DNA, 21 bp, Homo sapiens
tcaggagtggagagaattggt

SEQ ID NO: 7835153 - DNA, 22 bp, Homo sapiens
tcaggagtttcaggtgtaagtg

SEQ ID NO: 7835154 - DNA, 22 bp, Homo sapiens
tcaggagtttggcctacagagg

SEQ ID NO: 7835155 - DNA, 22 bp, Homo sapiens
tcaggagtttggcctacagagg

SEQ ID NO: 7835156 - DNA, 22 bp, Homo sapiens
tcaggagttgaaggggatcctg

SEQ ID NO: 7835157 - DNA, 19 bp, Homo sapiens
tcaggagttagttgtgctc

SEQ ID NO: 7835158 - DNA, 22 bp, Homo sapiens
tcaggatgaccacgagcctcta

SEQ ID NO: 7835159 - DNA, 22 bp, Homo sapiens
tcaggatgaagtcagaggggtc

SEQ ID NO: 7835160 - DNA, 22 bp, Homo sapiens
tcaggatgaccacgagcctcta

SEQ ID NO: 7835161 - DNA, 22 bp, Homo sapiens
tcaggatgacttcaaggaggaa

SEQ ID NO: 7835162 - DNA, 22 bp, Homo sapiens
tcaggatgacttcaaggaggaa

SEQ ID NO: 7835163 - DNA, 22 bp, Homo sapiens
tcaggatgaagtcagaggggtc

SEQ ID NO: 7835164 - DNA, 22 bp, Homo sapiens
tcaggatgaagtcagaggggtc

SEQ ID NO: 7835165 - DNA, 22 bp, Homo sapiens
tcaggatccatagactcccaaa

SEQ ID NO: 7835166 - DNA, 22 bp, Homo sapiens
tcaggatcaggggcctttcctt

SEQ ID NO: 7835167 - DNA, 18 bp, Homo sapiens
tcaggagtttgtggatgg

SEQ ID NO: 7835168 - DNA, 22 bp, Homo sapiens
tcaggcagtggtaaatgagtta

SEQ ID NO: 7835169 - DNA, 20 bp, Homo sapiens
tcaggcagtggggaaaggca

SEQ ID NO: 7835170 - DNA, 20 bp, Homo sapiens
tcaggcagtggggaaaggca

SEQ ID NO: 7835171 - DNA, 20 bp, Homo sapiens
tcaggcagtggggaaaggca

SEQ ID NO: 7835172 - DNA, 20 bp, Homo sapiens
tcaggcagtggggaaaggca

SEQ ID NO: 7835173 - DNA, 20 bp, Homo sapiens
tcaggcagtggggaaaggca

SEQ ID NO: 7835174 - DNA, 20 bp, Homo sapiens
tcaggcagtggggaaaggca

SEQ ID NO: 7835175 - DNA, 20 bp, Homo sapiens
tcaggcagtggggaaaggca

SEQ ID NO: 7835176 - DNA, 19 bp, Homo sapiens
tcaggcagttattcacaaa

SEQ ID NO: 7835177 - DNA, 19 bp, Homo sapiens
tcaggcagttattcacaaa

SEQ ID NO: 7835178 - DNA, 22 bp, Homo sapiens
tcaggcagtggtaaatgagtta

SEQ ID NO: 7835179 - DNA, 22 bp, Homo sapiens
tcaggcagtggtaaatgagtta

SEQ ID NO: 7835180 - DNA, 19 bp, Homo sapiens
tcaggcagttattcacaaa

SEQ ID NO: 7835181 - DNA, 19 bp, Homo sapiens
tcaggcagttattcacaaa

SEQ ID NO: 7835182 - DNA, 19 bp, Homo sapiens
tcaggcagttattcacaaa

SEQ ID NO: 7835183 - DNA, 19 bp, Homo sapiens
tcaggcagttattcacaaa

SEQ ID NO: 7835184 - DNA, 19 bp, Homo sapiens
tcaggcagttattcacaaa

SEQ ID NO: 7835185 - DNA, 22 bp, Homo sapiens
tcaggcagtggtaaatgagtta

SEQ ID NO: 7835186 - DNA, 22 bp, Homo sapiens
tcaggcagtggtaaatgagtta

SEQ ID NO: 7835187 - DNA, 22 bp, Homo sapiens
tcaggcagtggtaaatgagtta

SEQ ID NO: 7835188 - DNA, 19 bp, Homo sapiens
tcaggcagttattcacaaa

SEQ ID NO: 7835189 - DNA, 19 bp, Homo sapiens
tcaggcagttattcacaaa

SEQ ID NO: 7835190 - DNA, 22 bp, Homo sapiens
tcaggccaaagaaacagcatga

SEQ ID NO: 7835191 - DNA, 22 bp, Homo sapiens
tcaggccaaggtagacatgact

SEQ ID NO: 7835192 - DNA, 22 bp, Homo sapiens
tcaggccaaagaaacagcatga

SEQ ID NO: 7835193 - DNA, 22 bp, Homo sapiens
tcaggccaaggtagacatgact

SEQ ID NO: 7835194 - DNA, 22 bp, Homo sapiens
tcaggccacggctcactgagac

SEQ ID NO: 7835195 - DNA, 22 bp, Homo sapiens
tcaggccacggctcactgagac

SEQ ID NO: 7835196 - DNA, 22 bp, Homo sapiens
tcaggccaaggtagacatgact

SEQ ID NO: 7835197 - DNA, 22 bp, Homo sapiens
tcaggcattcccatgcataaga

SEQ ID NO: 7835198 - DNA, 22 bp, Homo sapiens
tcaggccaaggtagacatgact

SEQ ID NO: 7835199 - DNA, 22 bp, Homo sapiens
tcaggcatggctcttcctcagg

SEQ ID NO: 7835200 - DNA, 22 bp, Homo sapiens
tcaggcatggctcttcctcagg

SEQ ID NO: 7835201 - DNA, 19 bp, Homo sapiens
tcaggcagttattcacaaa

SEQ ID NO: 7835202 - DNA, 22 bp, Homo sapiens
tcaggcatgcattctgcaggtt

SEQ ID NO: 7835203 - DNA, 22 bp, Homo sapiens
tcaggcctgagaaaaatccttt

SEQ ID NO: 7835204 - DNA, 22 bp, Homo sapiens
tcaggcctgcaaatgaatggta

SEQ ID NO: 7835205 - DNA, 22 bp, Homo sapiens
tcaggcctgcaaatgaatggta

SEQ ID NO: 7835206 - DNA, 22 bp, Homo sapiens
tcaggcctgcaaatgaatggta

SEQ ID NO: 7835207 - DNA, 22 bp, Homo sapiens
tcaggccaggagatcagattga

SEQ ID NO: 7835208 - DNA, 22 bp, Homo sapiens
tcaggccaggagatcagattga

SEQ ID NO: 7835209 - DNA, 22 bp, Homo sapiens
tcaggccagcaccatccctatc

SEQ ID NO: 7835210 - DNA, 22 bp, Homo sapiens
tcaggccacttcacaggtgatt

SEQ ID NO: 7835211 - DNA, 22 bp, Homo sapiens
tcaggccacttcacaggtgatt

SEQ ID NO: 7835212 - DNA, 22 bp, Homo sapiens
tcaggccacttcacaggtgatt

SEQ ID NO: 7835213 - DNA, 22 bp, Homo sapiens
tcaggccacttcacaggtgatt

SEQ ID NO: 7835214 - DNA, 22 bp, Homo sapiens
tcaggccacggctcactgagac

SEQ ID NO: 7835215 - DNA, 22 bp, Homo sapiens
tcaggccacttcacaggtgatt

SEQ ID NO: 7835216 - DNA, 22 bp, Homo sapiens
tcaggccacggctcactgagac

SEQ ID NO: 7835217 - DNA, 22 bp, Homo sapiens
tcaggcctgcaaggagagtccc

SEQ ID NO: 7835218 - DNA, 22 bp, Homo sapiens
tcaggcctgcaaggagagtccc

SEQ ID NO: 7835219 - DNA, 22 bp, Homo sapiens
tcaggcctgcaaggagagtccc

SEQ ID NO: 7835220 - DNA, 22 bp, Homo sapiens
tcaggcctgcaggcttcctgga

SEQ ID NO: 7835221 - DNA, 22 bp, Homo sapiens
tcaggcctgcaaggagagtccc

SEQ ID NO: 7835222 - DNA, 22 bp, Homo sapiens
tcaggcctgcaggcttcctgga

SEQ ID NO: 7835223 - DNA, 22 bp, Homo sapiens
tcaggcctgcaggcttcctgga

SEQ ID NO: 7835224 - DNA, 22 bp, Homo sapiens
tcaggcctgccctgaaagcaca

SEQ ID NO: 7835225 - DNA, 22 bp, Homo sapiens
tcaggcctgccctgaaagcaca

SEQ ID NO: 7835226 - DNA, 22 bp, Homo sapiens
tcaggcctgccctgaaagcaca

SEQ ID NO: 7835227 - DNA, 22 bp, Homo sapiens
tcaggcctgccctgaaagcaca

SEQ ID NO: 7835228 - DNA, 22 bp, Homo sapiens
tcaggcctgctgtatgatggat

SEQ ID NO: 7835229 - DNA, 22 bp, Homo sapiens
tcaggcctgctgtatgatggat

SEQ ID NO: 7835230 - DNA, 22 bp, Homo sapiens
tcaggcctgcaggcttcctgga

SEQ ID NO: 7835231 - DNA, 22 bp, Homo sapiens
tcaggcctgcaggcttcctgga

SEQ ID NO: 7835232 - DNA, 22 bp, Homo sapiens
tcaggcctgcaggcttcctgga

SEQ ID NO: 7835233 - DNA, 22 bp, Homo sapiens
tcaggcctgcagtgccaaccca

SEQ ID NO: 7835234 - DNA, 22 bp, Homo sapiens
tcaggcctgcagtgccaaccca

SEQ ID NO: 7835235 - DNA, 22 bp, Homo sapiens
tcaggcctgcagtgccaaccca

SEQ ID NO: 7835236 - DNA, 22 bp, Homo sapiens
tcagggaacatcgttaaactag

SEQ ID NO: 7835237 - DNA, 22 bp, Homo sapiens
tcagggaacatcgttaaactag

SEQ ID NO: 7835238 - DNA, 22 bp, Homo sapiens
tcagggaacaatgttatggctt

SEQ ID NO: 7835239 - DNA, 22 bp, Homo sapiens
tcagggaacaatgttatggctt

SEQ ID NO: 7835240 - DNA, 22 bp, Homo sapiens
tcagggaacaatgttatggctt

SEQ ID NO: 7835241 - DNA, 22 bp, Homo sapiens
tcagggaaatttccatgtgttt

SEQ ID NO: 7835242 - DNA, 22 bp, Homo sapiens
tcagggaaatagcagggctgaa

SEQ ID NO: 7835243 - DNA, 22 bp, Homo sapiens
tcagggaaatagcagggctgaa

SEQ ID NO: 7835244 - DNA, 22 bp, Homo sapiens
tcagggaaatagcagggctgaa

SEQ ID NO: 7835245 - DNA, 22 bp, Homo sapiens
tcagggaaattcaagggagatt

SEQ ID NO: 7835246 - DNA, 22 bp, Homo sapiens
tcagggaaattcaagggagatt

SEQ ID NO: 7835247 - DNA, 22 bp, Homo sapiens
tcagggaaatttccatgtgttt

SEQ ID NO: 7835248 - DNA, 22 bp, Homo sapiens
tcagggaaattcaagggagatt

SEQ ID NO: 7835249 - DNA, 22 bp, Homo sapiens
tcagggaaattcaagggagatt

SEQ ID NO: 7835250 - DNA, 22 bp, Homo sapiens
tcagggaaaggggagagtcatt

SEQ ID NO: 7835251 - DNA, 22 bp, Homo sapiens
tcagggaaaggggagagtcatt

SEQ ID NO: 7835252 - DNA, 22 bp, Homo sapiens
tcagggaaaggggagagtcatt

SEQ ID NO: 7835253 - DNA, 22 bp, Homo sapiens
tcagggaaatagcagggctgaa

SEQ ID NO: 7835254 - DNA, 22 bp, Homo sapiens
tcagggaaaggggagagtcatt

SEQ ID NO: 7835255 - DNA, 22 bp, Homo sapiens
tcagggaaacctaaggaagcca

SEQ ID NO: 7835256 - DNA, 22 bp, Homo sapiens
tcagggaaaggggagagtcatt

SEQ ID NO: 7835257 - DNA, 22 bp, Homo sapiens
tcagggaaacctaaggaagcca

SEQ ID NO: 7835258 - DNA, 22 bp, Homo sapiens
tcagggaaaggggagagtcatt

SEQ ID NO: 7835259 - DNA, 22 bp, Homo sapiens
tcagggaaacctaaggaagcca

SEQ ID NO: 7835260 - DNA, 22 bp, Homo sapiens
tcagggaaacaggttttccctt

SEQ ID NO: 7835261 - DNA, 22 bp, Homo sapiens
tcagggaaacctaaggaagcca

SEQ ID NO: 7835262 - DNA, 22 bp, Homo sapiens
tcagggaaacaggttttccctt

SEQ ID NO: 7835263 - DNA, 22 bp, Homo sapiens
tcagggaaacctaaggaagcca

SEQ ID NO: 7835264 - DNA, 22 bp, Homo sapiens
tcagggaaaagtcacactgggt

SEQ ID NO: 7835265 - DNA, 22 bp, Homo sapiens
tcagggaaaagtcacactgggt

SEQ ID NO: 7835266 - DNA, 22 bp, Homo sapiens
tcagggaaaagtcacactgggt

SEQ ID NO: 7835267 - DNA, 22 bp, Homo sapiens
tcagggaaaagtcacactgggt

SEQ ID NO: 7835268 - DNA, 22 bp, Homo sapiens
tcagggaaaagtcacactgggt

SEQ ID NO: 7835269 - DNA, 18 bp, Homo sapiens
tcaggctgggcctccttc

SEQ ID NO: 7835270 - DNA, 18 bp, Homo sapiens
tcaggctgggcctccttc

SEQ ID NO: 7835271 - DNA, 18 bp, Homo sapiens
tcaggctgggcctccttc

SEQ ID NO: 7835272 - DNA, 22 bp, Homo sapiens
tcaggctgggagacaatcactg

SEQ ID NO: 7835273 - DNA, 22 bp, Homo sapiens
tcaggctgggagacaatcactg

SEQ ID NO: 7835274 - DNA, 22 bp, Homo sapiens
tcaggctggagtgcagtggcgc

SEQ ID NO: 7835275 - DNA, 22 bp, Homo sapiens
tcaggctggagtgcagtggcgc

SEQ ID NO: 7835276 - DNA, 22 bp, Homo sapiens
tcaggctgggagacaatcactg

SEQ ID NO: 7835277 - DNA, 22 bp, Homo sapiens
tcaggctttttctcaacctctt

SEQ ID NO: 7835278 - DNA, 22 bp, Homo sapiens
tcagggaaaacatcccgcctaa

SEQ ID NO: 7835279 - DNA, 22 bp, Homo sapiens
tcaggctttttctcaacctctt

SEQ ID NO: 7835280 - DNA, 22 bp, Homo sapiens
tcaggctggggtgctaaggtgt

SEQ ID NO: 7835281 - DNA, 22 bp, Homo sapiens
tcaggctggggtgctaaggtgt

SEQ ID NO: 7835282 - DNA, 22 bp, Homo sapiens
tcaggctggggtgctaaggtgt

SEQ ID NO: 7835283 - DNA, 22 bp, Homo sapiens
tcaggctggggtgctaaggtgt

SEQ ID NO: 7835284 - DNA, 22 bp, Homo sapiens
tcaggctggggtgctaaggtgt

SEQ ID NO: 7835285 - DNA, 22 bp, Homo sapiens
tcaggctggggtgctaaggtgt

SEQ ID NO: 7835286 - DNA, 22 bp, Homo sapiens
tcaggctgggctcctctcccca

SEQ ID NO: 7835287 - DNA, 18 bp, Homo sapiens
tcaggctgggcctccttc

SEQ ID NO: 7835288 - DNA, 22 bp, Homo sapiens
tcaggctgggctcctctcccca

SEQ ID NO: 7835289 - DNA, 22 bp, Homo sapiens
tcaggctgggctcctctcccca

SEQ ID NO: 7835290 - DNA, 22 bp, Homo sapiens
tcaggctgctttcatgcttaga

SEQ ID NO: 7835291 - DNA, 22 bp, Homo sapiens
tcaggctgctgtactgtgaatg

SEQ ID NO: 7835292 - DNA, 22 bp, Homo sapiens
tcaggctgctgtactgtgaatg

SEQ ID NO: 7835293 - DNA, 22 bp, Homo sapiens
tcaggctgctgtactgtgaatg

SEQ ID NO: 7835294 - DNA, 18 bp, Homo sapiens
tcaggctggaagtttgcc

SEQ ID NO: 7835295 - DNA, 22 bp, Homo sapiens
tcaggctggaatgcagtggggc

SEQ ID NO: 7835296 - DNA, 18 bp, Homo sapiens
tcaggctggaagtttgcc

SEQ ID NO: 7835297 - DNA, 22 bp, Homo sapiens
tcaggctgctttcatgcttaga

SEQ ID NO: 7835298 - DNA, 18 bp, Homo sapiens
tcaggctggaagtttgcc

SEQ ID NO: 7835299 - DNA, 18 bp, Homo sapiens
tcaggctggaagtttgcc

SEQ ID NO: 7835300 - DNA, 22 bp, Homo sapiens
tcaggctggaatgcagtggggc

SEQ ID NO: 7835301 - DNA, 22 bp, Homo sapiens
tcaggctggaatgcagtggggc

SEQ ID NO: 7835302 - DNA, 22 bp, Homo sapiens
tcaggctggaatgcagtggggc

SEQ ID NO: 7835303 - DNA, 22 bp, Homo sapiens
tcaggctggaatgcagtggggc

SEQ ID NO: 7835304 - DNA, 22 bp, Homo sapiens
tcaggctggaatgcagtggggc

SEQ ID NO: 7835305 - DNA, 22 bp, Homo sapiens
tcaggctggaatgcagtggggc

SEQ ID NO: 7835306 - DNA, 22 bp, Homo sapiens
tcaggctggaatgcagtggggc

SEQ ID NO: 7835307 - DNA, 22 bp, Homo sapiens
tcaggctggaatgcagtggggc

SEQ ID NO: 7835308 - DNA, 22 bp, Homo sapiens
tcaggctggagtgcagtggcgc

SEQ ID NO: 7835309 - DNA, 22 bp, Homo sapiens
tcaggctggagtgcagtggcgc

SEQ ID NO: 7835310 - DNA, 22 bp, Homo sapiens
tcaggctggagtgcagtggcgc

SEQ ID NO: 7835311 - DNA, 22 bp, Homo sapiens
tcaggctggagtgcagtggcgc

SEQ ID NO: 7835312 - DNA, 22 bp, Homo sapiens
tcaggctggagtgcagtggcgc

SEQ ID NO: 7835313 - DNA, 22 bp, Homo sapiens
tcaggctggagtgcagtggcgc

SEQ ID NO: 7835314 - DNA, 22 bp, Homo sapiens
tcaggctggagtgcagtggcgc

SEQ ID NO: 7835315 - DNA, 21 bp, Homo sapiens
tcaggctgatgtcgatgttag

SEQ ID NO: 7835316 - DNA, 22 bp, Homo sapiens
tcaggctgataggaggaactga

SEQ ID NO: 7835317 - DNA, 21 bp, Homo sapiens
tcaggctgatgtcgatgttag

SEQ ID NO: 7835318 - DNA, 22 bp, Homo sapiens
tcaggctgataggaggaactga

SEQ ID NO: 7835319 - DNA, 22 bp, Homo sapiens
tcaggctgataggaggaactga

SEQ ID NO: 7835320 - DNA, 22 bp, Homo sapiens
tcaggctgataggaggaactga

SEQ ID NO: 7835321 - DNA, 22 bp, Homo sapiens
tcaggctgataggaggaactga

SEQ ID NO: 7835322 - DNA, 22 bp, Homo sapiens
tcaggctgctggccagcaggct

SEQ ID NO: 7835323 - DNA, 22 bp, Homo sapiens
tcaggctgctggccagcaggct

SEQ ID NO: 7835324 - DNA, 22 bp, Homo sapiens
tcaggctgctggccagcaggct

SEQ ID NO: 7835325 - DNA, 22 bp, Homo sapiens
tcaggctgctggccagcaggct

SEQ ID NO: 7835326 - DNA, 22 bp, Homo sapiens
tcaggctgctggccagcaggct

SEQ ID NO: 7835327 - DNA, 22 bp, Homo sapiens
tcaggctgctggccagcaggct

SEQ ID NO: 7835328 - DNA, 22 bp, Homo sapiens
tcaggctgctggccagcaggct

SEQ ID NO: 7835329 - DNA, 22 bp, Homo sapiens
tcaggctgctgtactgtgaatg

SEQ ID NO: 7835330 - DNA, 22 bp, Homo sapiens
tcaggcctgtgctggaggagat

SEQ ID NO: 7835331 - DNA, 22 bp, Homo sapiens
tcaggcctgtgctggaggagat

SEQ ID NO: 7835332 - DNA, 22 bp, Homo sapiens
tcaggcctgtgctggaggagat

SEQ ID NO: 7835333 - DNA, 22 bp, Homo sapiens
tcaggcctgtgctggaggagat

SEQ ID NO: 7835334 - DNA, 16 bp, Homo sapiens
tcaggcctggacgagc

SEQ ID NO: 7835335 - DNA, 16 bp, Homo sapiens
tcaggcctggacgagc

SEQ ID NO: 7835336 - DNA, 22 bp, Homo sapiens
tcaggcctggagaaaggaatga

SEQ ID NO: 7835337 - DNA, 22 bp, Homo sapiens
tcaggcctggagaaaggaatga

SEQ ID NO: 7835338 - DNA, 22 bp, Homo sapiens
tcaggccttcagacctggcccg

SEQ ID NO: 7835339 - DNA, 22 bp, Homo sapiens
tcaggccttcagacctggcccg

SEQ ID NO: 7835340 - DNA, 22 bp, Homo sapiens
tcaggccttcagacctggcccg

SEQ ID NO: 7835341 - DNA, 22 bp, Homo sapiens
tcaggccttcagacctggcccg

SEQ ID NO: 7835342 - DNA, 22 bp, Homo sapiens
tcaggctgaggtcatctgcatc

SEQ ID NO: 7835343 - DNA, 22 bp, Homo sapiens
tcaggctgataggaggaactga

SEQ ID NO: 7835344 - DNA, 22 bp, Homo sapiens
tcagtgtaagttatgtagatgt

SEQ ID NO: 7835345 - DNA, 22 bp, Homo sapiens
tcagtgtaagttatgtagatgt

SEQ ID NO: 7835346 - DNA, 22 bp, Homo sapiens
tcagtggttggatgatggtcgc

SEQ ID NO: 7835347 - DNA, 18 bp, Homo sapiens
tcagtgtagatctgtgta

SEQ ID NO: 7835348 - DNA, 22 bp, Homo sapiens
tcagtggtggaagcagcaaacc

SEQ ID NO: 7835349 - DNA, 22 bp, Homo sapiens
tcagtggttaagttctgtccac

SEQ ID NO: 7835350 - DNA, 22 bp, Homo sapiens
tcagtggtggaagcagcaaacc

SEQ ID NO: 7835351 - DNA, 22 bp, Homo sapiens
tcagtggtctaggcaatatata

SEQ ID NO: 7835352 - DNA, 22 bp, Homo sapiens
tcagtgcagtagaactttagtt

SEQ ID NO: 7835353 - DNA, 22 bp, Homo sapiens
tcagtggtcttggctgattgtt

SEQ ID NO: 7835354 - DNA, 22 bp, Homo sapiens
tcagtgcagggtgggagagaga

SEQ ID NO: 7835355 - DNA, 22 bp, Homo sapiens
tcagtgcagggtgggagagaga

SEQ ID NO: 7835356 - DNA, 22 bp, Homo sapiens
tcagtgcagggtgggagagaga

SEQ ID NO: 7835357 - DNA, 22 bp, Homo sapiens
tcagtgcagggtgggagagaga

SEQ ID NO: 7835358 - DNA, 22 bp, Homo sapiens
tcagtgtcatatcaagaagatg

SEQ ID NO: 7835359 - DNA, 22 bp, Homo sapiens
tcagtgtcagtcttttagatat

SEQ ID NO: 7835360 - DNA, 20 bp, Homo sapiens
tcagtgtcagtagccactac

SEQ ID NO: 7835361 - DNA, 20 bp, Homo sapiens
tcagtgtcagtagccactac

SEQ ID NO: 7835362 - DNA, 22 bp, Homo sapiens
tcagtgtcatcacttaatataa

SEQ ID NO: 7835363 - DNA, 22 bp, Homo sapiens
tcagtgtcatcacttaatataa

SEQ ID NO: 7835364 - DNA, 22 bp, Homo sapiens
tcagtgtcatatcaagaagatg

SEQ ID NO: 7835365 - DNA, 16 bp, Homo sapiens
tcagtgtcagctcctg

SEQ ID NO: 7835366 - DNA, 22 bp, Homo sapiens
tcagtgtcacaggatgctatgc

SEQ ID NO: 7835367 - DNA, 22 bp, Homo sapiens
tcagtgtcacaggatgctatgc

SEQ ID NO: 7835368 - DNA, 21 bp, Homo sapiens
tcagtgtatttaagaatgttg

SEQ ID NO: 7835369 - DNA, 21 bp, Homo sapiens
tcagtgtatttaagaatgttg

SEQ ID NO: 7835370 - DNA, 22 bp, Homo sapiens
tcagtgtatggagtgctggatt

SEQ ID NO: 7835371 - DNA, 22 bp, Homo sapiens
tcagtgtctatagataaggttt

SEQ ID NO: 7835372 - DNA, 22 bp, Homo sapiens
tcagtgtctatagataaggttt

SEQ ID NO: 7835373 - DNA, 22 bp, Homo sapiens
tcagtgtctcatatgaggtttc

SEQ ID NO: 7835374 - DNA, 22 bp, Homo sapiens
tcagtgtctcatatgaggtttc

SEQ ID NO: 7835375 - DNA, 22 bp, Homo sapiens
tcagtgtctgtgggcaggatgg

SEQ ID NO: 7835376 - DNA, 22 bp, Homo sapiens
tcagtgtgttaacccaggggca

SEQ ID NO: 7835377 - DNA, 19 bp, Homo sapiens
tcagtgtgtgggaggtggt

SEQ ID NO: 7835378 - DNA, 22 bp, Homo sapiens
tcagtgtgttactttctcctat

SEQ ID NO: 7835379 - DNA, 22 bp, Homo sapiens
tcagtgttacattatatagaac

SEQ ID NO: 7835380 - DNA, 22 bp, Homo sapiens
tcagtgtgttcaattggatagg

SEQ ID NO: 7835381 - DNA, 22 bp, Homo sapiens
tcagtgttaatcagtggtacct

SEQ ID NO: 7835382 - DNA, 22 bp, Homo sapiens
tcagtgtgttcaattggatagg

SEQ ID NO: 7835383 - DNA, 22 bp, Homo sapiens
tcagtgtgttcaattggatagg

SEQ ID NO: 7835384 - DNA, 22 bp, Homo sapiens
tcagtgtgttattctactttca

SEQ ID NO: 7835385 - DNA, 22 bp, Homo sapiens
tcagtgtccataaataaagttt

SEQ ID NO: 7835386 - DNA, 22 bp, Homo sapiens
tcagtgtccaaaaagaggcaag

SEQ ID NO: 7835387 - DNA, 22 bp, Homo sapiens
tcagtgtccaaaaagaggcaag

SEQ ID NO: 7835388 - DNA, 22 bp, Homo sapiens
tcagtgtccaaaaagaggcaag

SEQ ID NO: 7835389 - DNA, 22 bp, Homo sapiens
tcagtgtcccgtctcttaactc

SEQ ID NO: 7835390 - DNA, 19 bp, Homo sapiens
tcagtgtccctgttaatat

SEQ ID NO: 7835391 - DNA, 22 bp, Homo sapiens
tcagtgtccggagcctgagtgc

SEQ ID NO: 7835392 - DNA, 22 bp, Homo sapiens
tcagtgtccggagcctgagtgc

SEQ ID NO: 7835393 - DNA, 23 bp, Homo sapiens
tcagtgtctagttgtggaattga

SEQ ID NO: 7835394 - DNA, 22 bp, Homo sapiens
tcagtgtccttcgttcttgttg

SEQ ID NO: 7835395 - DNA, 22 bp, Homo sapiens
tcagtgtctagggacagtaatc

SEQ ID NO: 7835396 - DNA, 22 bp, Homo sapiens
tcagtgtcctgtgcggtgcagc

SEQ ID NO: 7835397 - DNA, 22 bp, Homo sapiens
tcagtgaaatgcatattcttcg

SEQ ID NO: 7835398 - DNA, 22 bp, Homo sapiens
tcagtgaaatgcatattcttcg

SEQ ID NO: 7835399 - DNA, 22 bp, Homo sapiens
tcagtgaaatgcatattcttcg

SEQ ID NO: 7835400 - DNA, 22 bp, Homo sapiens
tcagtgaaatgcatattcttcg

SEQ ID NO: 7835401 - DNA, 22 bp, Homo sapiens
tcagtcttttaactttctgcca

SEQ ID NO: 7835402 - DNA, 22 bp, Homo sapiens
tcagtcttgtttttctggtcca

SEQ ID NO: 7835403 - DNA, 22 bp, Homo sapiens
tcagtcttgtttgattcctcac

SEQ ID NO: 7835404 - DNA, 23 bp, Homo sapiens
tcagtcttggcttctgattttcc

SEQ ID NO: 7835405 - DNA, 22 bp, Homo sapiens
tcagtctttgcttatgacaata

SEQ ID NO: 7835406 - DNA, 22 bp, Homo sapiens
tcagtctttcgaattcagccag

SEQ ID NO: 7835407 - DNA, 22 bp, Homo sapiens
tcagtctttccctccctcagtt

SEQ ID NO: 7835408 - DNA, 22 bp, Homo sapiens
tcagtctttcgaattcagccag

SEQ ID NO: 7835409 - DNA, 22 bp, Homo sapiens
tcagtgatttctggggtgaggg

SEQ ID NO: 7835410 - DNA, 22 bp, Homo sapiens
tcagtgatttctggggtgaggg

SEQ ID NO: 7835411 - DNA, 22 bp, Homo sapiens
tcagtgactgggtattaaatca

SEQ ID NO: 7835412 - DNA, 22 bp, Homo sapiens
tcagtgacaactatgaatattt

SEQ ID NO: 7835413 - DNA, 22 bp, Homo sapiens
tcagtgacaactatgaatattt

SEQ ID NO: 7835414 - DNA, 22 bp, Homo sapiens
tcagtgaatgagataactttag

SEQ ID NO: 7835415 - DNA, 22 bp, Homo sapiens
tcagtgaaccttctgtggcagg

SEQ ID NO: 7835416 - DNA, 22 bp, Homo sapiens
tcagtgcaaaaaatgggctaga

SEQ ID NO: 7835417 - DNA, 22 bp, Homo sapiens
tcagtgcaaaaaatgggctaga

SEQ ID NO: 7835418 - DNA, 22 bp, Homo sapiens
tcagtgcaaaaaatgggctaga

SEQ ID NO: 7835419 - DNA, 23 bp, Homo sapiens
tcagtgcaaaaataggattttgg

SEQ ID NO: 7835420 - DNA, 22 bp, Homo sapiens
tcagtgcaatcaaggtatgttt

SEQ ID NO: 7835421 - DNA, 21 bp, Homo sapiens
tcagtgcaattctatggggaa

SEQ ID NO: 7835422 - DNA, 22 bp, Homo sapiens
tcagtgcacagagatttttgtt

SEQ ID NO: 7835423 - DNA, 22 bp, Homo sapiens
tcagtgcacagagatttttgtt

SEQ ID NO: 7835424 - DNA, 22 bp, Homo sapiens
tcagtgcacccaattctctcca

SEQ ID NO: 7835425 - DNA, 21 bp, Homo sapiens
tcagtgcaattctatggggaa

SEQ ID NO: 7835426 - DNA, 22 bp, Homo sapiens
tcagtgcaatcaaggtatgttt

SEQ ID NO: 7835427 - DNA, 21 bp, Homo sapiens
tcagtgcaattctatggggaa

SEQ ID NO: 7835428 - DNA, 22 bp, Homo sapiens
tcagtgcacaatgacggtggct

SEQ ID NO: 7835429 - DNA, 22 bp, Homo sapiens
tcagtgcacaatgacggtggct

SEQ ID NO: 7835430 - DNA, 22 bp, Homo sapiens
tcagtgcagactgtaagttgga

SEQ ID NO: 7835431 - DNA, 22 bp, Homo sapiens
tcagtgcagaatagtgatgcat

SEQ ID NO: 7835432 - DNA, 22 bp, Homo sapiens
tcagtgcagactgtaagttgga

SEQ ID NO: 7835433 - DNA, 20 bp, Homo sapiens
tcagtgcagattgtccaagt

SEQ ID NO: 7835434 - DNA, 22 bp, Homo sapiens
tcagtgcagaatagtgatgcat

SEQ ID NO: 7835435 - DNA, 22 bp, Homo sapiens
tcagtgcacccaattctctcca

SEQ ID NO: 7835436 - DNA, 22 bp, Homo sapiens
tcagtgcacccaattctctcca

SEQ ID NO: 7835437 - DNA, 22 bp, Homo sapiens
tcagtgcagaatagtgatgcat

SEQ ID NO: 7835438 - DNA, 22 bp, Homo sapiens
tcagtgcagcggcagcagctct

SEQ ID NO: 7835439 - DNA, 20 bp, Homo sapiens
tcagtgcagattgtccaagt

SEQ ID NO: 7835440 - DNA, 22 bp, Homo sapiens
tcagtgcagcggcagcagctct

SEQ ID NO: 7835441 - DNA, 22 bp, Homo sapiens
tcagtgcaggaatttccttaga

SEQ ID NO: 7835442 - DNA, 22 bp, Homo sapiens
tcagtgcagggtgggagagaga

SEQ ID NO: 7835443 - DNA, 22 bp, Homo sapiens
tcagtgcaggaatctctagcca

SEQ ID NO: 7835444 - DNA, 22 bp, Homo sapiens
tcagtgcaggaatctctagcca

SEQ ID NO: 7835445 - DNA, 22 bp, Homo sapiens
tcagggacagggtgctgctgcg

SEQ ID NO: 7835446 - DNA, 22 bp, Homo sapiens
tcagggaccaccactcacccag

SEQ ID NO: 7835447 - DNA, 22 bp, Homo sapiens
tcagggacagggtgctgctgcg

SEQ ID NO: 7835448 - DNA, 22 bp, Homo sapiens
tcagggacaggatgggcatttc

SEQ ID NO: 7835449 - DNA, 22 bp, Homo sapiens
tcagggaatgggcccagtccct

SEQ ID NO: 7835450 - DNA, 22 bp, Homo sapiens
tcagggaatgtgatacaggaag

SEQ ID NO: 7835451 - DNA, 22 bp, Homo sapiens
tcagggaatgtgatacaggaag

SEQ ID NO: 7835452 - DNA, 22 bp, Homo sapiens
tcagggaatgatgcacacagtt

SEQ ID NO: 7835453 - DNA, 22 bp, Homo sapiens
tcagggaatgatgcacacagtt

SEQ ID NO: 7835454 - DNA, 22 bp, Homo sapiens
tcagggaatgatgcacacagtt

SEQ ID NO: 7835455 - DNA, 17 bp, Homo sapiens
tcagggaatgaggttgt

SEQ ID NO: 7835456 - DNA, 22 bp, Homo sapiens
tcaggtggccaaatgggagcgc

SEQ ID NO: 7835457 - DNA, 22 bp, Homo sapiens
tcaggtgtcaagcagggagctg

SEQ ID NO: 7835458 - DNA, 22 bp, Homo sapiens
tcaggtggctggttgctggcta

SEQ ID NO: 7835459 - DNA, 22 bp, Homo sapiens
tcagggacccctctgagtggag

SEQ ID NO: 7835460 - DNA, 22 bp, Homo sapiens
tcagggacccctctgagtggag

SEQ ID NO: 7835461 - DNA, 22 bp, Homo sapiens
tcagggacgtgagctcagagtc

SEQ ID NO: 7835462 - DNA, 22 bp, Homo sapiens
tcaggtggccaaatgggagcgc

SEQ ID NO: 7835463 - DNA, 22 bp, Homo sapiens
tcagggaagaaatgggacttta

SEQ ID NO: 7835464 - DNA, 22 bp, Homo sapiens
tcagggaagaaatgggacttta

SEQ ID NO: 7835465 - DNA, 22 bp, Homo sapiens
tcagggaagacttcttagagga

SEQ ID NO: 7835466 - DNA, 22 bp, Homo sapiens
tcagggaacatcgttaaactag

SEQ ID NO: 7835467 - DNA, 22 bp, Homo sapiens
tcagggaagacttcttagagga

SEQ ID NO: 7835468 - DNA, 22 bp, Homo sapiens
tcagggaacctctcctgtttct

SEQ ID NO: 7835469 - DNA, 22 bp, Homo sapiens
tcagggaactacttctccctat

SEQ ID NO: 7835470 - DNA, 22 bp, Homo sapiens
tcagggaacctctcctgtttct

SEQ ID NO: 7835471 - DNA, 22 bp, Homo sapiens
tcagggaagaaatgggacttta

SEQ ID NO: 7835472 - DNA, 22 bp, Homo sapiens
tcagggaagaaatgggacttta

SEQ ID NO: 7835473 - DNA, 22 bp, Homo sapiens
tcagggaagagagatctcctag

SEQ ID NO: 7835474 - DNA, 22 bp, Homo sapiens
tcagggaagagagatctcctag

SEQ ID NO: 7835475 - DNA, 21 bp, Homo sapiens
tcagggaagtgtgcagaaggg

SEQ ID NO: 7835476 - DNA, 21 bp, Homo sapiens
tcagggaagtgtgcagaaggg

SEQ ID NO: 7835477 - DNA, 21 bp, Homo sapiens
tcagggaagtgtgcagaaggg

SEQ ID NO: 7835478 - DNA, 18 bp, Homo sapiens
tcagggaagagaatatga

SEQ ID NO: 7835479 - DNA, 22 bp, Homo sapiens
tcagggaagacttcttagagga

SEQ ID NO: 7835480 - DNA, 18 bp, Homo sapiens
tcagggaagagaatatga

SEQ ID NO: 7835481 - DNA, 17 bp, Homo sapiens
tcagggaatgaggttgt

SEQ ID NO: 7835482 - DNA, 17 bp, Homo sapiens
tcagggaatgaggttgt

SEQ ID NO: 7835483 - DNA, 17 bp, Homo sapiens
tcagggaatgaggttgt

SEQ ID NO: 7835484 - DNA, 18 bp, Homo sapiens
tcagggaatcttggcctt

SEQ ID NO: 7835485 - DNA, 18 bp, Homo sapiens
tcagggaatcttggcctt

SEQ ID NO: 7835486 - DNA, 22 bp, Homo sapiens
tcagggaatcagactctgcagc

SEQ ID NO: 7835487 - DNA, 19 bp, Homo sapiens
tcagggaagttcaaagctc

SEQ ID NO: 7835488 - DNA, 22 bp, Homo sapiens
tcagggaataagtagatgagtg

SEQ ID NO: 7835489 - DNA, 22 bp, Homo sapiens
tcagggaataagtagatgagtg

SEQ ID NO: 7835490 - DNA, 22 bp, Homo sapiens
tcagggaataagtagatgagtg

SEQ ID NO: 7835491 - DNA, 22 bp, Homo sapiens
tcagggaataagtagatgagtg

SEQ ID NO: 7835492 - DNA, 19 bp, Homo sapiens
tcagggaagttcaaagctc

SEQ ID NO: 7835493 - DNA, 19 bp, Homo sapiens
tcagggaagttcaaagctc

SEQ ID NO: 7835494 - DNA, 21 bp, Homo sapiens
tcagggaagtgtgcagaaggg

SEQ ID NO: 7835495 - DNA, 21 bp, Homo sapiens
tcagggaagtgtgcagaaggg

SEQ ID NO: 7835496 - DNA, 22 bp, Homo sapiens
tcagtcttctagcaaatccagg

SEQ ID NO: 7835497 - DNA, 23 bp, Homo sapiens
tcagtcttccctgtcagtaatag

SEQ ID NO: 7835498 - DNA, 22 bp, Homo sapiens
tcagtcttctagcaaatccagg

SEQ ID NO: 7835499 - DNA, 23 bp, Homo sapiens
tcagtcttccctgtcagtaatag

SEQ ID NO: 7835500 - DNA, 23 bp, Homo sapiens
tcagtcttccctgtcagtaatag

SEQ ID NO: 7835501 - DNA, 22 bp, Homo sapiens
tcagtcttccctccagtgcaac

SEQ ID NO: 7835502 - DNA, 22 bp, Homo sapiens
tcagtcttcaaatctgagtcgt

SEQ ID NO: 7835503 - DNA, 17 bp, Homo sapiens
tcagtctctgtcctgga

SEQ ID NO: 7835504 - DNA, 22 bp, Homo sapiens
tcaggtttaggaatttggaaag

SEQ ID NO: 7835505 - DNA, 22 bp, Homo sapiens
tcagtctctggggcttctgttt

SEQ ID NO: 7835506 - DNA, 22 bp, Homo sapiens
tcagtctctggctgtgtctgac

SEQ ID NO: 7835507 - DNA, 22 bp, Homo sapiens
tcaggtttttctcaaatcaggt

SEQ ID NO: 7835508 - DNA, 22 bp, Homo sapiens
tcaggttctggtgagggccctt

SEQ ID NO: 7835509 - DNA, 22 bp, Homo sapiens
tcattatagagttgtattttag

SEQ ID NO: 7835510 - DNA, 22 bp, Homo sapiens
tcattatagagttgtattttag

SEQ ID NO: 7835511 - DNA, 22 bp, Homo sapiens
tcattataaacatatgctaaag

SEQ ID NO: 7835512 - DNA, 22 bp, Homo sapiens
tcattatcctagtatcttgaat

SEQ ID NO: 7835513 - DNA, 22 bp, Homo sapiens
tcattatcctagtatcttgaat

SEQ ID NO: 7835514 - DNA, 22 bp, Homo sapiens
tcattatcctagtatcttgaat

SEQ ID NO: 7835515 - DNA, 22 bp, Homo sapiens
tcattatcttggctcatttctg

SEQ ID NO: 7835516 - DNA, 22 bp, Homo sapiens
tcattattctctttaatgttct

SEQ ID NO: 7835517 - DNA, 18 bp, Homo sapiens
tcattattgtttctggag

SEQ ID NO: 7835518 - DNA, 22 bp, Homo sapiens
tcattatttgctttagttatgt

SEQ ID NO: 7835519 - DNA, 22 bp, Homo sapiens
tcattattctctttaatgttct

SEQ ID NO: 7835520 - DNA, 22 bp, Homo sapiens
tcattattctctttaatgttct

SEQ ID NO: 7835521 - DNA, 22 bp, Homo sapiens
tcattattctctttaatgttct

SEQ ID NO: 7835522 - DNA, 18 bp, Homo sapiens
tcattagggattgcaaag

SEQ ID NO: 7835523 - DNA, 22 bp, Homo sapiens
tcattagaaatgcagattctca

SEQ ID NO: 7835524 - DNA, 18 bp, Homo sapiens
tcattacttgtctcccct

SEQ ID NO: 7835525 - DNA, 22 bp, Homo sapiens
tcattacagtgtttatatgtct

SEQ ID NO: 7835526 - DNA, 22 bp, Homo sapiens
tcattacagtgtttatatgtct

SEQ ID NO: 7835527 - DNA, 22 bp, Homo sapiens
tcatggctgaaacagtaacaca

SEQ ID NO: 7835528 - DNA, 22 bp, Homo sapiens
tcatggctgaaacagtaacaca

SEQ ID NO: 7835529 - DNA, 22 bp, Homo sapiens
tcattacagagatataatctac

SEQ ID NO: 7835530 - DNA, 20 bp, Homo sapiens
tcattacagtgctaagatgt

SEQ ID NO: 7835531 - DNA, 22 bp, Homo sapiens
tcattacagagatataatctac

SEQ ID NO: 7835532 - DNA, 20 bp, Homo sapiens
tcattacagtgctaagatgt

SEQ ID NO: 7835533 - DNA, 18 bp, Homo sapiens
tcattcaaagtctactga

SEQ ID NO: 7835534 - DNA, 18 bp, Homo sapiens
tcattcaaagtctactga

SEQ ID NO: 7835535 - DNA, 22 bp, Homo sapiens
tcattattttggactggagtgt

SEQ ID NO: 7835536 - DNA, 22 bp, Homo sapiens
tcattatttgctttagttatgt

SEQ ID NO: 7835537 - DNA, 18 bp, Homo sapiens
tcattcaaagtctactga

SEQ ID NO: 7835538 - DNA, 22 bp, Homo sapiens
tcattcaagatttcaatagatt

SEQ ID NO: 7835539 - DNA, 22 bp, Homo sapiens
tcattcaatgtaagcatatata

SEQ ID NO: 7835540 - DNA, 23 bp, Homo sapiens
tcattcaaggctggtatctttca

SEQ ID NO: 7835541 - DNA, 23 bp, Homo sapiens
tcattcaaggctggtatctttca

SEQ ID NO: 7835542 - DNA, 22 bp, Homo sapiens
tcattcataaaaattagttggc

SEQ ID NO: 7835543 - DNA, 22 bp, Homo sapiens
tcattcatactcttttctatta

SEQ ID NO: 7835544 - DNA, 22 bp, Homo sapiens
tcattcaggttgggcaagtgtc

SEQ ID NO: 7835545 - DNA, 22 bp, Homo sapiens
tcattcaggttgggcaagtgtc

SEQ ID NO: 7835546 - DNA, 22 bp, Homo sapiens
tcattcatatctctcaagctta

SEQ ID NO: 7835547 - DNA, 22 bp, Homo sapiens
tcattcactttgaaataaacga

SEQ ID NO: 7835548 - DNA, 22 bp, Homo sapiens
tcattcactttgaaataaacga

SEQ ID NO: 7835549 - DNA, 21 bp, Homo sapiens
tcattcacagggtattgtata

SEQ ID NO: 7835550 - DNA, 22 bp, Homo sapiens
tcatgcttattgcatatttgga

SEQ ID NO: 7835551 - DNA, 22 bp, Homo sapiens
tcatgcttattgcatatttgga

SEQ ID NO: 7835552 - DNA, 22 bp, Homo sapiens
tcatgcttaaaagacacttgag

SEQ ID NO: 7835553 - DNA, 22 bp, Homo sapiens
tcatgcttaaaagacacttgag

SEQ ID NO: 7835554 - DNA, 22 bp, Homo sapiens
tcatgctgtgaactgtatacat

SEQ ID NO: 7835555 - DNA, 22 bp, Homo sapiens
tcatgctgtgaactgtatacat

SEQ ID NO: 7835556 - DNA, 22 bp, Homo sapiens
tcatgctgggtactatggctgc

SEQ ID NO: 7835557 - DNA, 22 bp, Homo sapiens
tcatgctttgggttagaaacct

SEQ ID NO: 7835558 - DNA, 22 bp, Homo sapiens
tcatgctttggttgctgtcctt

SEQ ID NO: 7835559 - DNA, 22 bp, Homo sapiens
tcatggaaacagcaatgctaat

SEQ ID NO: 7835560 - DNA, 22 bp, Homo sapiens
tcatggaaacagcaatgctaat

SEQ ID NO: 7835561 - DNA, 23 bp, Homo sapiens
tcatggaactgggcaatcttgaa

SEQ ID NO: 7835562 - DNA, 22 bp, Homo sapiens
tcatggaatagagcagtggcaa

SEQ ID NO: 7835563 - DNA, 21 bp, Homo sapiens
tcatggaagtaacaaacatat

SEQ ID NO: 7835564 - DNA, 20 bp, Homo sapiens
tcatggaatctcactctagt

SEQ ID NO: 7835565 - DNA, 22 bp, Homo sapiens
tcatggctctaaagacatagat

SEQ ID NO: 7835566 - DNA, 22 bp, Homo sapiens
tcatggctaatgcagtatattc

SEQ ID NO: 7835567 - DNA, 22 bp, Homo sapiens
tcatggctaaccaaggcctgat

SEQ ID NO: 7835568 - DNA, 22 bp, Homo sapiens
tcatggcattgttaagggtttt

SEQ ID NO: 7835569 - DNA, 22 bp, Homo sapiens
tcatggccaaagtcaggagtgt

SEQ ID NO: 7835570 - DNA, 20 bp, Homo sapiens
tcatggcagccacccacagg

SEQ ID NO: 7835571 - DNA, 22 bp, Homo sapiens
tcatggcacttagtgtctcaaa

SEQ ID NO: 7835572 - DNA, 20 bp, Homo sapiens
tcatggcagccacccacagg

SEQ ID NO: 7835573 - DNA, 22 bp, Homo sapiens
tcatggcacttagcacagtcct

SEQ ID NO: 7835574 - DNA, 22 bp, Homo sapiens
tcatggcacttagtgtctcaaa

SEQ ID NO: 7835575 - DNA, 22 bp, Homo sapiens
tcatggcacttagcacagtcct

SEQ ID NO: 7835576 - DNA, 22 bp, Homo sapiens
tcatggcagccctttactagag

SEQ ID NO: 7835577 - DNA, 22 bp, Homo sapiens
tcatggcagtataattcctcaa

SEQ ID NO: 7835578 - DNA, 22 bp, Homo sapiens
tcatggcagtttaataagtggt

SEQ ID NO: 7835579 - DNA, 22 bp, Homo sapiens
tcatggcattgttaagggtttt

SEQ ID NO: 7835580 - DNA, 22 bp, Homo sapiens
tcatggatgggcccagctctgt

SEQ ID NO: 7835581 - DNA, 22 bp, Homo sapiens
tcatggattaaattattaagtt

SEQ ID NO: 7835582 - DNA, 22 bp, Homo sapiens
tcatggatgggcccagctctgt

SEQ ID NO: 7835583 - DNA, 22 bp, Homo sapiens
tcatggcacatgccctccaggg

SEQ ID NO: 7835584 - DNA, 22 bp, Homo sapiens
tcatggcacttagcacagtcct

SEQ ID NO: 7835585 - DNA, 22 bp, Homo sapiens
tcatggcacatgccctccaggg

SEQ ID NO: 7835586 - DNA, 21 bp, Homo sapiens
tcatggattttctctgctttt

SEQ ID NO: 7835587 - DNA, 22 bp, Homo sapiens
tcatggagactttgagcctgtt

SEQ ID NO: 7835588 - DNA, 22 bp, Homo sapiens
tcatggagactttgagcctgtt

SEQ ID NO: 7835589 - DNA, 22 bp, Homo sapiens
tcatggataaaatattggttaa

SEQ ID NO: 7835590 - DNA, 19 bp, Homo sapiens
tcatggatcaggtagttta

SEQ ID NO: 7835591 - DNA, 22 bp, Homo sapiens
tcatggatggccgggaggtgat

SEQ ID NO: 7835592 - DNA, 22 bp, Homo sapiens
tcagtgttattagatgaggttt

SEQ ID NO: 7835593 - DNA, 22 bp, Homo sapiens
tcagtgttagacaagtttggaa

SEQ ID NO: 7835594 - DNA, 22 bp, Homo sapiens
tcagtgttagacaagtttggaa

SEQ ID NO: 7835595 - DNA, 22 bp, Homo sapiens
tcagtgttattagatgaggttt

SEQ ID NO: 7835596 - DNA, 22 bp, Homo sapiens
tcatagctaagctccagagtgc

SEQ ID NO: 7835597 - DNA, 22 bp, Homo sapiens
tcataggaatgatattttatct

SEQ ID NO: 7835598 - DNA, 22 bp, Homo sapiens
tcataggagtagcagtgagagg

SEQ ID NO: 7835599 - DNA, 22 bp, Homo sapiens
tcataggctaaggatttttccc

SEQ ID NO: 7835600 - DNA, 22 bp, Homo sapiens
tcataggctcctctgcttctgc

SEQ ID NO: 7835601 - DNA, 22 bp, Homo sapiens
tcataggctttgacttagttgt

SEQ ID NO: 7835602 - DNA, 22 bp, Homo sapiens
tcagtgttcgctcagggactcc

SEQ ID NO: 7835603 - DNA, 18 bp, Homo sapiens
tcatagattcaagagtat

SEQ ID NO: 7835604 - DNA, 22 bp, Homo sapiens
tcatataactggatattttcaa

SEQ ID NO: 7835605 - DNA, 22 bp, Homo sapiens
tcatataactggatattttcaa

SEQ ID NO: 7835606 - DNA, 22 bp, Homo sapiens
tcatataactggatattttcaa

SEQ ID NO: 7835607 - DNA, 22 bp, Homo sapiens
tcatataactggatattttcaa

SEQ ID NO: 7835608 - DNA, 22 bp, Homo sapiens
tcatagtttagttagtatgatt

SEQ ID NO: 7835609 - DNA, 22 bp, Homo sapiens
tcatagtttagttagtatgatt

SEQ ID NO: 7835610 - DNA, 22 bp, Homo sapiens
tcatagggcatcaagcagagca

SEQ ID NO: 7835611 - DNA, 22 bp, Homo sapiens
tcatataagtttaaaactatct

SEQ ID NO: 7835612 - DNA, 22 bp, Homo sapiens
tcatataagtttaaaactatct

SEQ ID NO: 7835613 - DNA, 22 bp, Homo sapiens
tcatataagtttaaaactatct

SEQ ID NO: 7835614 - DNA, 22 bp, Homo sapiens
tcatataagagctttagagtca

SEQ ID NO: 7835615 - DNA, 22 bp, Homo sapiens
tcatataagtttaaaactatct

SEQ ID NO: 7835616 - DNA, 22 bp, Homo sapiens
tcatataagtttaaaactatct

SEQ ID NO: 7835617 - DNA, 22 bp, Homo sapiens
tcatataagtttaaaactatct

SEQ ID NO: 7835618 - DNA, 22 bp, Homo sapiens
tcatatgtatgatctctgtaca

SEQ ID NO: 7835619 - DNA, 22 bp, Homo sapiens
tcatatgtcactcatgggcata

SEQ ID NO: 7835620 - DNA, 20 bp, Homo sapiens
tcatatgtggttgtatacaa

SEQ ID NO: 7835621 - DNA, 22 bp, Homo sapiens
tcatattaacaatgaaactcag

SEQ ID NO: 7835622 - DNA, 22 bp, Homo sapiens
tcatattaacaatgaaactcag

SEQ ID NO: 7835623 - DNA, 22 bp, Homo sapiens
tcatatgcatatgaaatttttg

SEQ ID NO: 7835624 - DNA, 22 bp, Homo sapiens
tcatatgattgtaatgagaata

SEQ ID NO: 7835625 - DNA, 22 bp, Homo sapiens
tcatatatttagttgtgcaaca

SEQ ID NO: 7835626 - DNA, 22 bp, Homo sapiens
tcatatattttggcagtgatca

SEQ ID NO: 7835627 - DNA, 22 bp, Homo sapiens
tcatatattttggcagtgatca

SEQ ID NO: 7835628 - DNA, 22 bp, Homo sapiens
tcatatactgccttgtagatta

SEQ ID NO: 7835629 - DNA, 22 bp, Homo sapiens
tcatatagagggcatacaaatg

SEQ ID NO: 7835630 - DNA, 22 bp, Homo sapiens
tcatatatctgcaaagcagtat

SEQ ID NO: 7835631 - DNA, 22 bp, Homo sapiens
tcatatatctgcaaagcagtat

SEQ ID NO: 7835632 - DNA, 22 bp, Homo sapiens
tcatatatctgcaaagcagtat

SEQ ID NO: 7835633 - DNA, 22 bp, Homo sapiens
tcatatacctgcatgtgcatgt

SEQ ID NO: 7835634 - DNA, 22 bp, Homo sapiens
tcatatacctgcatgtgcatgt

SEQ ID NO: 7835635 - DNA, 22 bp, Homo sapiens
tcatataccagagagtttatat

SEQ ID NO: 7835636 - DNA, 22 bp, Homo sapiens
tcatataagtttaaaactatct

SEQ ID NO: 7835637 - DNA, 22 bp, Homo sapiens
tcatataagtttaaaactatct

SEQ ID NO: 7835638 - DNA, 22 bp, Homo sapiens
tcatataagtttaaaactatct

SEQ ID NO: 7835639 - DNA, 22 bp, Homo sapiens
tcatataagtttaaaactatct

SEQ ID NO: 7835640 - DNA, 22 bp, Homo sapiens
tcatatttaggcctttaattca

SEQ ID NO: 7835641 - DNA, 22 bp, Homo sapiens
tcatatttaggcctttaattca

SEQ ID NO: 7835642 - DNA, 22 bp, Homo sapiens
tcatattagggtaatgataaga

SEQ ID NO: 7835643 - DNA, 22 bp, Homo sapiens
tcatattagggtaatgataaga

SEQ ID NO: 7835644 - DNA, 22 bp, Homo sapiens
tcatattagggtaatgataaga

SEQ ID NO: 7835645 - DNA, 21 bp, Homo sapiens
tcatatttctcttgctattgt

SEQ ID NO: 7835646 - DNA, 21 bp, Homo sapiens
tcatatttctcttgctattgt

SEQ ID NO: 7835647 - DNA, 21 bp, Homo sapiens
tcatatttctcttgctattgt

SEQ ID NO: 7835648 - DNA, 21 bp, Homo sapiens
tcatatttctcttgctattgt

SEQ ID NO: 7835649 - DNA, 22 bp, Homo sapiens
tcatatttatatgttggcacag

SEQ ID NO: 7835650 - DNA, 22 bp, Homo sapiens
tcatatttatatgttggcacag

SEQ ID NO: 7835651 - DNA, 22 bp, Homo sapiens
tcatatttagttcacgctcaat

SEQ ID NO: 7835652 - DNA, 22 bp, Homo sapiens
tcatatttagttcacgctcaat

SEQ ID NO: 7835653 - DNA, 22 bp, Homo sapiens
tcatgcctgattatgttactca

SEQ ID NO: 7835654 - DNA, 23 bp, Homo sapiens
tcatgcccaggctccagatgtca

SEQ ID NO: 7835655 - DNA, 22 bp, Homo sapiens
tcatgcctggaatctcaccact

SEQ ID NO: 7835656 - DNA, 22 bp, Homo sapiens
tcatgctagttaagaacacaat

SEQ ID NO: 7835657 - DNA, 22 bp, Homo sapiens
tcatgctgagtcctggctttgt

SEQ ID NO: 7835658 - DNA, 22 bp, Homo sapiens
tcatgctgagtcctggctttgt

SEQ ID NO: 7835659 - DNA, 22 bp, Homo sapiens
tcatgctgggtactatggctgc

SEQ ID NO: 7835660 - DNA, 22 bp, Homo sapiens
tcatgctggcccagaatggagg

SEQ ID NO: 7835661 - DNA, 22 bp, Homo sapiens
tcatgctgcaggcccaggcagg

SEQ ID NO: 7835662 - DNA, 22 bp, Homo sapiens
tcatgctgaggatgctgtgaag

SEQ ID NO: 7835663 - DNA, 20 bp, Homo sapiens
tcccagtcagccagagtgag

SEQ ID NO: 7835664 - DNA, 22 bp, Homo sapiens
tcccaggttccaccatccaggg

SEQ ID NO: 7835665 - DNA, 22 bp, Homo sapiens
tcccagtgagatgaaacaggta

SEQ ID NO: 7835666 - DNA, 22 bp, Homo sapiens
tcccagtgagatgaaacaggta

SEQ ID NO: 7835667 - DNA, 22 bp, Homo sapiens
tcccagtgagcacaggtagtgc

SEQ ID NO: 7835668 - DNA, 22 bp, Homo sapiens
tcccagtgagcacaggtagtgc

SEQ ID NO: 7835669 - DNA, 22 bp, Homo sapiens
tcccagtgaggtcctggctgtc

SEQ ID NO: 7835670 - DNA, 22 bp, Homo sapiens
tcccagtgaggtcctggctgtc

SEQ ID NO: 7835671 - DNA, 22 bp, Homo sapiens
tcccagtgctacagacagggca

SEQ ID NO: 7835672 - DNA, 22 bp, Homo sapiens
tcccagtgaggtcctggctgtc

SEQ ID NO: 7835673 - DNA, 22 bp, Homo sapiens
tcccagtgctgctaaagaggta

SEQ ID NO: 7835674 - DNA, 22 bp, Homo sapiens
tcccagtggcttcataaggcag

SEQ ID NO: 7835675 - DNA, 22 bp, Homo sapiens
tcccagtgggaagcagcacgct

SEQ ID NO: 7835676 - DNA, 22 bp, Homo sapiens
tcccagtgggaagcagcacgct

SEQ ID NO: 7835677 - DNA, 22 bp, Homo sapiens
tcccatatatgcaaaaatgtaa

SEQ ID NO: 7835678 - DNA, 22 bp, Homo sapiens
tcccatagatttttcagggtta

SEQ ID NO: 7835679 - DNA, 22 bp, Homo sapiens
tcccatcaatgtctgcagaaga

SEQ ID NO: 7835680 - DNA, 22 bp, Homo sapiens
tcccatcaatgtctgcagaaga

SEQ ID NO: 7835681 - DNA, 22 bp, Homo sapiens
tcccatcacatggagagtgaag

SEQ ID NO: 7835682 - DNA, 22 bp, Homo sapiens
tcccagtttttctccactaagg

SEQ ID NO: 7835683 - DNA, 22 bp, Homo sapiens
tcccagtttttctccactaagg

SEQ ID NO: 7835684 - DNA, 22 bp, Homo sapiens
tcccagtttttctccactaagg

SEQ ID NO: 7835685 - DNA, 22 bp, Homo sapiens
tcccagtttttctccactaagg

SEQ ID NO: 7835686 - DNA, 22 bp, Homo sapiens
tcccagtggtcttgaaacaggg

SEQ ID NO: 7835687 - DNA, 22 bp, Homo sapiens
tcccagtgggtgactggaggct

SEQ ID NO: 7835688 - DNA, 22 bp, Homo sapiens
tcccagtggtgggtgcacattt

SEQ ID NO: 7835689 - DNA, 22 bp, Homo sapiens
tcccagtggtgggtgcacattt

SEQ ID NO: 7835690 - DNA, 22 bp, Homo sapiens
tcccagtggtcttgaaacaggg

SEQ ID NO: 7835691 - DNA, 22 bp, Homo sapiens
tcccagtgtggcaggccatgga

SEQ ID NO: 7835692 - DNA, 22 bp, Homo sapiens
tcccagtgtggcaggccatgga

SEQ ID NO: 7835693 - DNA, 20 bp, Homo sapiens
tcccatcacgcctgtgccag

SEQ ID NO: 7835694 - DNA, 22 bp, Homo sapiens
tcccatcactagcatctgcacc

SEQ ID NO: 7835695 - DNA, 22 bp, Homo sapiens
tcccatcactagcatctgcacc

SEQ ID NO: 7835696 - DNA, 22 bp, Homo sapiens
tcccatcatctgttctggctac

SEQ ID NO: 7835697 - DNA, 22 bp, Homo sapiens
tcccatcatctgttctggctac

SEQ ID NO: 7835698 - DNA, 22 bp, Homo sapiens
tcccatggatagtgaccttgtt

SEQ ID NO: 7835699 - DNA, 23 bp, Homo sapiens
tcccatgggctcactgccctgca

SEQ ID NO: 7835700 - DNA, 22 bp, Homo sapiens
tcccatggtctatatagaggca

SEQ ID NO: 7835701 - DNA, 23 bp, Homo sapiens
tcccatgggctcactgccctgca

SEQ ID NO: 7835702 - DNA, 22 bp, Homo sapiens
tcccatgtaagaaggagacagg

SEQ ID NO: 7835703 - DNA, 22 bp, Homo sapiens
tcccattctgccaaggacattg

SEQ ID NO: 7835704 - DNA, 22 bp, Homo sapiens
tcccatgttaccaaggagtcac

SEQ ID NO: 7835705 - DNA, 22 bp, Homo sapiens
tcccatttattaattagtttgc

SEQ ID NO: 7835706 - DNA, 22 bp, Homo sapiens
tcccatttcacaacaaaactgg

SEQ ID NO: 7835707 - DNA, 22 bp, Homo sapiens
tcccatttatctagatgtcaga

SEQ ID NO: 7835708 - DNA, 22 bp, Homo sapiens
tcccagggatcctccgggtcgc

SEQ ID NO: 7835709 - DNA, 22 bp, Homo sapiens
tcccagggatcctccgggtcgc

SEQ ID NO: 7835710 - DNA, 22 bp, Homo sapiens
tcccagggactggatgatgcag

SEQ ID NO: 7835711 - DNA, 22 bp, Homo sapiens
tcccacagtgaagttcatgata

SEQ ID NO: 7835712 - DNA, 22 bp, Homo sapiens
tcccacagtctcacaatgcata

SEQ ID NO: 7835713 - DNA, 22 bp, Homo sapiens
tcccacagtctcacaatgcata

SEQ ID NO: 7835714 - DNA, 22 bp, Homo sapiens
tcccacagggcttctctgtaca

SEQ ID NO: 7835715 - DNA, 22 bp, Homo sapiens
tcccacaggcccagggcggaaa

SEQ ID NO: 7835716 - DNA, 22 bp, Homo sapiens
tcccacaggaggagttggaaat

SEQ ID NO: 7835717 - DNA, 22 bp, Homo sapiens
tcccacaggagcctgagtccca

SEQ ID NO: 7835718 - DNA, 22 bp, Homo sapiens
tcccacaggaaagtagacattg

SEQ ID NO: 7835719 - DNA, 22 bp, Homo sapiens
tcccacaggaaagtagacattg

SEQ ID NO: 7835720 - DNA, 22 bp, Homo sapiens
tcccacagcttcgtgcttcccc

SEQ ID NO: 7835721 - DNA, 22 bp, Homo sapiens
tcccagggtcctcttctggaat

SEQ ID NO: 7835722 - DNA, 22 bp, Homo sapiens
tcccagggattaggacatggat

SEQ ID NO: 7835723 - DNA, 22 bp, Homo sapiens
tcccagggattaggacatggat

SEQ ID NO: 7835724 - DNA, 22 bp, Homo sapiens
tcccagggatcctccgggtcgc

SEQ ID NO: 7835725 - DNA, 21 bp, Homo sapiens
tcccagggtcttatgggatgt

SEQ ID NO: 7835726 - DNA, 22 bp, Homo sapiens
tcccagggtgaaatgcagtagg

SEQ ID NO: 7835727 - DNA, 21 bp, Homo sapiens
tcccagggtcttatgggatgt

SEQ ID NO: 7835728 - DNA, 22 bp, Homo sapiens
tcccagggtgaaatgcagtagg

SEQ ID NO: 7835729 - DNA, 22 bp, Homo sapiens
tcccagggtgcgcctgccctcg

SEQ ID NO: 7835730 - DNA, 22 bp, Homo sapiens
tcccagggtgcgcctgccctcg

SEQ ID NO: 7835731 - DNA, 22 bp, Homo sapiens
tcccagggtgcgcctgccctcg

SEQ ID NO: 7835732 - DNA, 22 bp, Homo sapiens
tcccagggttacagccagggca

SEQ ID NO: 7835733 - DNA, 22 bp, Homo sapiens
tcccagggttacagccagggca

SEQ ID NO: 7835734 - DNA, 22 bp, Homo sapiens
tcccagggttacagccagggca

SEQ ID NO: 7835735 - DNA, 22 bp, Homo sapiens
tcccagggttacagccagggca

SEQ ID NO: 7835736 - DNA, 22 bp, Homo sapiens
tcccagggttacagccagggca

SEQ ID NO: 7835737 - DNA, 22 bp, Homo sapiens
tcccagggttacagccagggca

SEQ ID NO: 7835738 - DNA, 22 bp, Homo sapiens
tcccagggttacagccagggca

SEQ ID NO: 7835739 - DNA, 22 bp, Homo sapiens
tcccagggttacagccagggca

SEQ ID NO: 7835740 - DNA, 22 bp, Homo sapiens
tcccaggttccaccatccaggg

SEQ ID NO: 7835741 - DNA, 22 bp, Homo sapiens
tccccacactttcactcctggc

SEQ ID NO: 7835742 - DNA, 22 bp, Homo sapiens
tccccacactttcactcctggc

SEQ ID NO: 7835743 - DNA, 22 bp, Homo sapiens
tccccacactttcactcctggc

SEQ ID NO: 7835744 - DNA, 22 bp, Homo sapiens
tccccacagcagaagatctgag

SEQ ID NO: 7835745 - DNA, 22 bp, Homo sapiens
tccccacatctctgcatcaggc

SEQ ID NO: 7835746 - DNA, 22 bp, Homo sapiens
tccccacatctctgcatcaggc

SEQ ID NO: 7835747 - DNA, 21 bp, Homo sapiens
tccccacatttctaaacagac

SEQ ID NO: 7835748 - DNA, 22 bp, Homo sapiens
tccccacatctctgcatcaggc

SEQ ID NO: 7835749 - DNA, 21 bp, Homo sapiens
tccccacatttctaaacagac

SEQ ID NO: 7835750 - DNA, 22 bp, Homo sapiens
tccccaccccagaactactagg

SEQ ID NO: 7835751 - DNA, 21 bp, Homo sapiens
tccccacatttctaaacagac

SEQ ID NO: 7835752 - DNA, 22 bp, Homo sapiens
tccccacacagatacagagtag

SEQ ID NO: 7835753 - DNA, 22 bp, Homo sapiens
tccccacacagatacagagtag

SEQ ID NO: 7835754 - DNA, 22 bp, Homo sapiens
tccccacacagatacagagtag

SEQ ID NO: 7835755 - DNA, 22 bp, Homo sapiens
tccccaagtaaagatcctgaga

SEQ ID NO: 7835756 - DNA, 22 bp, Homo sapiens
tccccacacagatacagagtag

SEQ ID NO: 7835757 - DNA, 19 bp, Homo sapiens
tccccaagagttctagctc

SEQ ID NO: 7835758 - DNA, 19 bp, Homo sapiens
tccccaagagttctagctc

SEQ ID NO: 7835759 - DNA, 22 bp, Homo sapiens
tccccaaagctttgtggtcagg

SEQ ID NO: 7835760 - DNA, 19 bp, Homo sapiens
tccccaagagttctagctc

SEQ ID NO: 7835761 - DNA, 22 bp, Homo sapiens
tcccattttggatgcggattgg

SEQ ID NO: 7835762 - DNA, 22 bp, Homo sapiens
tcccatttcatgctggctgtgg

SEQ ID NO: 7835763 - DNA, 22 bp, Homo sapiens
tcccatttcatgctggctgtgg

SEQ ID NO: 7835764 - DNA, 22 bp, Homo sapiens
tcccatttcttgcatccttgct

SEQ ID NO: 7835765 - DNA, 22 bp, Homo sapiens
tccccacctaagatacccatct

SEQ ID NO: 7835766 - DNA, 22 bp, Homo sapiens
tccccacctacacactgctcct

SEQ ID NO: 7835767 - DNA, 22 bp, Homo sapiens
tccccacctacacactgctcct

SEQ ID NO: 7835768 - DNA, 22 bp, Homo sapiens
tccccacctacacactgctcct

SEQ ID NO: 7835769 - DNA, 22 bp, Homo sapiens
tccccacctacacactgctcct

SEQ ID NO: 7835770 - DNA, 22 bp, Homo sapiens
tccccacctacacactgctcct

SEQ ID NO: 7835771 - DNA, 22 bp, Homo sapiens
tccccacctaagatacccatct

SEQ ID NO: 7835772 - DNA, 22 bp, Homo sapiens
tccccacctaagatacccatct

SEQ ID NO: 7835773 - DNA, 22 bp, Homo sapiens
tccccacctaagatacccatct

SEQ ID NO: 7835774 - DNA, 22 bp, Homo sapiens
tccccaccccagaactactagg

SEQ ID NO: 7835775 - DNA, 22 bp, Homo sapiens
tccccaccccagaactactagg

SEQ ID NO: 7835776 - DNA, 22 bp, Homo sapiens
tccccaccccagaactactagg

SEQ ID NO: 7835777 - DNA, 22 bp, Homo sapiens
tccccaggaaggcccttcctgg

SEQ ID NO: 7835778 - DNA, 22 bp, Homo sapiens
tccccaggaatcaggtggttgc

SEQ ID NO: 7835779 - DNA, 22 bp, Homo sapiens
tccccaggaatcaggtggttgc

SEQ ID NO: 7835780 - DNA, 22 bp, Homo sapiens
tccccaggactaagttgcaatc

SEQ ID NO: 7835781 - DNA, 22 bp, Homo sapiens
tccccaggagcaatgattcagt

SEQ ID NO: 7835782 - DNA, 22 bp, Homo sapiens
tccccaggaatcaggtggttgc

SEQ ID NO: 7835783 - DNA, 22 bp, Homo sapiens
tccccaggactaagttgcaatc

SEQ ID NO: 7835784 - DNA, 22 bp, Homo sapiens
tccccaggaaattctgattctt

SEQ ID NO: 7835785 - DNA, 22 bp, Homo sapiens
tccccaggaaggcccttcctgg

SEQ ID NO: 7835786 - DNA, 22 bp, Homo sapiens
tccccactcaccactggccaaa

SEQ ID NO: 7835787 - DNA, 22 bp, Homo sapiens
tccccactcaccactggccaaa

SEQ ID NO: 7835788 - DNA, 22 bp, Homo sapiens
tccccactcaccactggccaaa

SEQ ID NO: 7835789 - DNA, 22 bp, Homo sapiens
tccccaggaaattctgattctt

SEQ ID NO: 7835790 - DNA, 22 bp, Homo sapiens
tccccaggggcatctctctgct

SEQ ID NO: 7835791 - DNA, 22 bp, Homo sapiens
tccccaggggcctgggcacagt

SEQ ID NO: 7835792 - DNA, 22 bp, Homo sapiens
tccccaggggcatctctctgct

SEQ ID NO: 7835793 - DNA, 22 bp, Homo sapiens
tccccaggggcctgggcacagt

SEQ ID NO: 7835794 - DNA, 22 bp, Homo sapiens
tccccagggtccctgcttccat

SEQ ID NO: 7835795 - DNA, 22 bp, Homo sapiens
tccccagggtccctgcttccat

SEQ ID NO: 7835796 - DNA, 22 bp, Homo sapiens
tccccagggtccctgcttccat

SEQ ID NO: 7835797 - DNA, 22 bp, Homo sapiens
tccccaggggcctgggcacagt

SEQ ID NO: 7835798 - DNA, 22 bp, Homo sapiens
tccccaggggcctgggcacagt

SEQ ID NO: 7835799 - DNA, 20 bp, Homo sapiens
tccccagggcatcaggagca

SEQ ID NO: 7835800 - DNA, 22 bp, Homo sapiens
tccccagggctgcagagggtgt

SEQ ID NO: 7835801 - DNA, 22 bp, Homo sapiens
tccccagggctgcagagggtgt

SEQ ID NO: 7835802 - DNA, 22 bp, Homo sapiens
tccccagggctgcagagggtgt

SEQ ID NO: 7835803 - DNA, 22 bp, Homo sapiens
tccccagggctgcagagggtgt

SEQ ID NO: 7835804 - DNA, 22 bp, Homo sapiens
tccccaggggcatctctctgct

SEQ ID NO: 7835805 - DNA, 22 bp, Homo sapiens
tccccaggggcatctctctgct

SEQ ID NO: 7835806 - DNA, 22 bp, Homo sapiens
tccccaggggcatctctctgct

SEQ ID NO: 7835807 - DNA, 22 bp, Homo sapiens
tccccaggagcaatgattcagt

SEQ ID NO: 7835808 - DNA, 22 bp, Homo sapiens
tccccaggagttttactttgca

SEQ ID NO: 7835809 - DNA, 20 bp, Homo sapiens
tccccagggcatcaggagca

SEQ ID NO: 7835810 - DNA, 20 bp, Homo sapiens
tccccagggcatcaggagca

SEQ ID NO: 7835811 - DNA, 20 bp, Homo sapiens
tccccagggcatcaggagca

SEQ ID NO: 7835812 - DNA, 22 bp, Homo sapiens
tccagcagccacacctctggac

SEQ ID NO: 7835813 - DNA, 22 bp, Homo sapiens
tccagcagccacacctctggac

SEQ ID NO: 7835814 - DNA, 22 bp, Homo sapiens
tccagcagccacacctctggac

SEQ ID NO: 7835815 - DNA, 22 bp, Homo sapiens
tccagcagccacacctctggac

SEQ ID NO: 7835816 - DNA, 22 bp, Homo sapiens
tccagcagccacacctctggac

SEQ ID NO: 7835817 - DNA, 22 bp, Homo sapiens
tccagcagccacacctctggac

SEQ ID NO: 7835818 - DNA, 22 bp, Homo sapiens
tccagcagccacacctctggac

SEQ ID NO: 7835819 - DNA, 22 bp, Homo sapiens
tccagcagcccgaaggcccatc

SEQ ID NO: 7835820 - DNA, 22 bp, Homo sapiens
tccagcagcccgaaggcccatc

SEQ ID NO: 7835821 - DNA, 22 bp, Homo sapiens
tccagcagcccgaaggcccatc

SEQ ID NO: 7835822 - DNA, 22 bp, Homo sapiens
tccagcagcccgaaggcccatc

SEQ ID NO: 7835823 - DNA, 22 bp, Homo sapiens
tccagcagcctgacttccctct

SEQ ID NO: 7835824 - DNA, 22 bp, Homo sapiens
tccagcagcctgacttccctct

SEQ ID NO: 7835825 - DNA, 22 bp, Homo sapiens
tccagcagggaattagtagtct

SEQ ID NO: 7835826 - DNA, 22 bp, Homo sapiens
tccagcaggtgtttgccaactt

SEQ ID NO: 7835827 - DNA, 22 bp, Homo sapiens
tccagcaggtgtttgccaactt

SEQ ID NO: 7835828 - DNA, 22 bp, Homo sapiens
tccagcaggtgtttgccaactt

SEQ ID NO: 7835829 - DNA, 22 bp, Homo sapiens
tccagcaggtgtttgccaactt

SEQ ID NO: 7835830 - DNA, 22 bp, Homo sapiens
tccagcaggtgtttgccaactt

SEQ ID NO: 7835831 - DNA, 18 bp, Homo sapiens
tccagcaggtctgaggtg

SEQ ID NO: 7835832 - DNA, 18 bp, Homo sapiens
tccagcaggtctgaggtg

SEQ ID NO: 7835833 - DNA, 18 bp, Homo sapiens
tccagcaggtctgaggtg

SEQ ID NO: 7835834 - DNA, 22 bp, Homo sapiens
tccagcaggtccgagacaagtt

SEQ ID NO: 7835835 - DNA, 22 bp, Homo sapiens
tccagcaggtccgagacaagtt

SEQ ID NO: 7835836 - DNA, 22 bp, Homo sapiens
tccagcaggtccgagacaagtt

SEQ ID NO: 7835837 - DNA, 18 bp, Homo sapiens
tccagcaggtctgaggtg

SEQ ID NO: 7835838 - DNA, 23 bp, Homo sapiens
tccagcagagccttccaggaggg

SEQ ID NO: 7835839 - DNA, 23 bp, Homo sapiens
tccagcagagccttccaggaggg

SEQ ID NO: 7835840 - DNA, 22 bp, Homo sapiens
tccagcagaggttgataatacc

SEQ ID NO: 7835841 - DNA, 23 bp, Homo sapiens
tccagcagagccttccaggaggg

SEQ ID NO: 7835842 - DNA, 22 bp, Homo sapiens
tccagcagactcatcagcaagg

SEQ ID NO: 7835843 - DNA, 23 bp, Homo sapiens
tccagcagagccttccaggaggg

SEQ ID NO: 7835844 - DNA, 23 bp, Homo sapiens
tccagcagagccttccaggaggg

SEQ ID NO: 7835845 - DNA, 22 bp, Homo sapiens
tccagcagaccatcaaggctca

SEQ ID NO: 7835846 - DNA, 22 bp, Homo sapiens
tccagcagaccatcaaggctca

SEQ ID NO: 7835847 - DNA, 22 bp, Homo sapiens
tccagcagaccatcaaggctca

SEQ ID NO: 7835848 - DNA, 22 bp, Homo sapiens
tccagcagactcatcagcaagg

SEQ ID NO: 7835849 - DNA, 22 bp, Homo sapiens
tccagcagactcatcagcaagg

SEQ ID NO: 7835850 - DNA, 22 bp, Homo sapiens
tccagcagactcatcagcaagg

SEQ ID NO: 7835851 - DNA, 22 bp, Homo sapiens
tccagcagactcatcagcaagg

SEQ ID NO: 7835852 - DNA, 22 bp, Homo sapiens
tccagcagaccatcaaggctca

SEQ ID NO: 7835853 - DNA, 23 bp, Homo sapiens
tccagcagccaagaagggtagaa

SEQ ID NO: 7835854 - DNA, 23 bp, Homo sapiens
tccagcagccaagaagggtagaa

SEQ ID NO: 7835855 - DNA, 23 bp, Homo sapiens
tccagcagccaagaagggtagaa

SEQ ID NO: 7835856 - DNA, 22 bp, Homo sapiens
tccagcagccacacctctggac

SEQ ID NO: 7835857 - DNA, 22 bp, Homo sapiens
tccagcagccacacctctggac

SEQ ID NO: 7835858 - DNA, 23 bp, Homo sapiens
tccagcagccaagaagggtagaa

SEQ ID NO: 7835859 - DNA, 18 bp, Homo sapiens
tccagcagcatagtttcc

SEQ ID NO: 7835860 - DNA, 23 bp, Homo sapiens
tccagcagccaagaagggtagaa

SEQ ID NO: 7835861 - DNA, 22 bp, Homo sapiens
tccagcagagtctctgaggggg

SEQ ID NO: 7835862 - DNA, 22 bp, Homo sapiens
tccagcagagtctctgaggggg

SEQ ID NO: 7835863 - DNA, 22 bp, Homo sapiens
tccagcagagtctctgaggggg

SEQ ID NO: 7835864 - DNA, 22 bp, Homo sapiens
tccagcagaggttgataatacc

SEQ ID NO: 7835865 - DNA, 22 bp, Homo sapiens
tccagcagagtctctgaggggg

SEQ ID NO: 7835866 - DNA, 22 bp, Homo sapiens
tccagcagagtctctgaggggg

SEQ ID NO: 7835867 - DNA, 18 bp, Homo sapiens
tccagcagcatagtttcc

SEQ ID NO: 7835868 - DNA, 21 bp, Homo sapiens
tccagaggaggacagactcag

SEQ ID NO: 7835869 - DNA, 22 bp, Homo sapiens
tccagaggcaaaaaggtatgga

SEQ ID NO: 7835870 - DNA, 22 bp, Homo sapiens
tccagaggcaaaaaggtatgga

SEQ ID NO: 7835871 - DNA, 18 bp, Homo sapiens
tccagagctggtgcttct

SEQ ID NO: 7835872 - DNA, 22 bp, Homo sapiens
tccagagctgtatgattttttt

SEQ ID NO: 7835873 - DNA, 22 bp, Homo sapiens
tccagagctgtatgattttttt

SEQ ID NO: 7835874 - DNA, 22 bp, Homo sapiens
tccagagctgtcctactgtgag

SEQ ID NO: 7835875 - DNA, 22 bp, Homo sapiens
tccagagctgtcctactgtgag

SEQ ID NO: 7835876 - DNA, 22 bp, Homo sapiens
tccagagctgggtctgtgctca

SEQ ID NO: 7835877 - DNA, 22 bp, Homo sapiens
tccagagctgagggtcagtaga

SEQ ID NO: 7835878 - DNA, 22 bp, Homo sapiens
tccagagctgggtctgtgctca

SEQ ID NO: 7835879 - DNA, 22 bp, Homo sapiens
tccagagctgggtctgtgctca

SEQ ID NO: 7835880 - DNA, 22 bp, Homo sapiens
tccagagctgggtctgtgctca

SEQ ID NO: 7835881 - DNA, 22 bp, Homo sapiens
tccagagctctgggcatagctg

SEQ ID NO: 7835882 - DNA, 23 bp, Homo sapiens
tccagagctcatgctctcaacca

SEQ ID NO: 7835883 - DNA, 22 bp, Homo sapiens
tccagagctctgggcatagctg

SEQ ID NO: 7835884 - DNA, 22 bp, Homo sapiens
tccagagctgagcagtcattct

SEQ ID NO: 7835885 - DNA, 22 bp, Homo sapiens
tccagagctgagcagtcattct

SEQ ID NO: 7835886 - DNA, 22 bp, Homo sapiens
tccagagctgagcagtcattct

SEQ ID NO: 7835887 - DNA, 22 bp, Homo sapiens
tccagagctctgggcatagctg

SEQ ID NO: 7835888 - DNA, 22 bp, Homo sapiens
tccagagggcgatggctggggg

SEQ ID NO: 7835889 - DNA, 22 bp, Homo sapiens
tccagagggcgatggctggggg

SEQ ID NO: 7835890 - DNA, 22 bp, Homo sapiens
tccagagggcgatggctggggg

SEQ ID NO: 7835891 - DNA, 22 bp, Homo sapiens
tccagaggggcagccctgtgct

SEQ ID NO: 7835892 - DNA, 22 bp, Homo sapiens
tccagaggggcagccctgtgct

SEQ ID NO: 7835893 - DNA, 22 bp, Homo sapiens
tccagagggcgatggctggggg

SEQ ID NO: 7835894 - DNA, 22 bp, Homo sapiens
tccagaggggcagccctgtgct

SEQ ID NO: 7835895 - DNA, 22 bp, Homo sapiens
tccagaggggcagccctgtgct

SEQ ID NO: 7835896 - DNA, 22 bp, Homo sapiens
tccagaggtatgtagagagtat

SEQ ID NO: 7835897 - DNA, 22 bp, Homo sapiens
tccagaggggcagccctgtgct

SEQ ID NO: 7835898 - DNA, 20 bp, Homo sapiens
tccagaggccacatccagtg

SEQ ID NO: 7835899 - DNA, 22 bp, Homo sapiens
tccagaggctccaaagggagat

SEQ ID NO: 7835900 - DNA, 20 bp, Homo sapiens
tccagaggccacatccagtg

SEQ ID NO: 7835901 - DNA, 22 bp, Homo sapiens
tccagaggcagctgcggtcagg

SEQ ID NO: 7835902 - DNA, 22 bp, Homo sapiens
tccagaggcagctgcggtcagg

SEQ ID NO: 7835903 - DNA, 22 bp, Homo sapiens
tccagaggcagctgcggtcagg

SEQ ID NO: 7835904 - DNA, 22 bp, Homo sapiens
tccagaggctccaaagggagat

SEQ ID NO: 7835905 - DNA, 22 bp, Homo sapiens
tccagaggctctgagggagagt

SEQ ID NO: 7835906 - DNA, 22 bp, Homo sapiens
tccagaggctctgagggagagt

SEQ ID NO: 7835907 - DNA, 22 bp, Homo sapiens
tcattgcagttgagttgtgtta

SEQ ID NO: 7835908 - DNA, 19 bp, Homo sapiens
tccagaagtccctgagcgg

SEQ ID NO: 7835909 - DNA, 19 bp, Homo sapiens
tccagaagtccctgagcgg

SEQ ID NO: 7835910 - DNA, 19 bp, Homo sapiens
tccagaagtccctgagcgg

SEQ ID NO: 7835911 - DNA, 22 bp, Homo sapiens
tccagaaggggaaatttggctt

SEQ ID NO: 7835912 - DNA, 19 bp, Homo sapiens
tccagaagtccctgagcgg

SEQ ID NO: 7835913 - DNA, 22 bp, Homo sapiens
tccagaaggccacccggggatg

SEQ ID NO: 7835914 - DNA, 22 bp, Homo sapiens
tccagaaggccacccggggatg

SEQ ID NO: 7835915 - DNA, 22 bp, Homo sapiens
tcattgcagaaataaaggtgaa

SEQ ID NO: 7835916 - DNA, 22 bp, Homo sapiens
tcattgagtaatactgtagtgt

SEQ ID NO: 7835917 - DNA, 20 bp, Homo sapiens
tccagagagtggcaaagctc

SEQ ID NO: 7835918 - DNA, 20 bp, Homo sapiens
tccagagagtggcaaagctc

SEQ ID NO: 7835919 - DNA, 22 bp, Homo sapiens
tccagagaggtttctccatgct

SEQ ID NO: 7835920 - DNA, 20 bp, Homo sapiens
tccagagagtggcaaagctc

SEQ ID NO: 7835921 - DNA, 20 bp, Homo sapiens
tccagagagtggcaaagctc

SEQ ID NO: 7835922 - DNA, 22 bp, Homo sapiens
tccagagaggtttctccatgct

SEQ ID NO: 7835923 - DNA, 22 bp, Homo sapiens
tccagagaggtttctccatgct

SEQ ID NO: 7835924 - DNA, 22 bp, Homo sapiens
tccagacattttatagcagtct

SEQ ID NO: 7835925 - DNA, 22 bp, Homo sapiens
tccagagaggtttctccatgct

SEQ ID NO: 7835926 - DNA, 22 bp, Homo sapiens
tccagagaggtttctccatgct

SEQ ID NO: 7835927 - DNA, 22 bp, Homo sapiens
tccagagaggtttctccatgct

SEQ ID NO: 7835928 - DNA, 22 bp, Homo sapiens
tccagagaggtttctccatgct

SEQ ID NO: 7835929 - DNA, 20 bp, Homo sapiens
tccagacatctagctcagtt

SEQ ID NO: 7835930 - DNA, 22 bp, Homo sapiens
tccagaatactctgaaatcatt

SEQ ID NO: 7835931 - DNA, 22 bp, Homo sapiens
tccagacattttatagcagtct

SEQ ID NO: 7835932 - DNA, 18 bp, Homo sapiens
tccagagagggagaagtg

SEQ ID NO: 7835933 - DNA, 22 bp, Homo sapiens
tccagacattttatagcagtct

SEQ ID NO: 7835934 - DNA, 20 bp, Homo sapiens
tccagacatctagctcagtt

SEQ ID NO: 7835935 - DNA, 20 bp, Homo sapiens
tccagacatctagctcagtt

SEQ ID NO: 7835936 - DNA, 22 bp, Homo sapiens
tccagaatcaatagcagttatc

SEQ ID NO: 7835937 - DNA, 20 bp, Homo sapiens
tccagacatctagctcagtt

SEQ ID NO: 7835938 - DNA, 22 bp, Homo sapiens
tcattgagctgtatggacacaa

SEQ ID NO: 7835939 - DNA, 22 bp, Homo sapiens
tcattgacagttgtttcaaata

SEQ ID NO: 7835940 - DNA, 22 bp, Homo sapiens
tcattgagttgcacttttacta

SEQ ID NO: 7835941 - DNA, 22 bp, Homo sapiens
tcattgatggcttctttcttgc

SEQ ID NO: 7835942 - DNA, 23 bp, Homo sapiens
tcattgatcttgtcagagcattt

SEQ ID NO: 7835943 - DNA, 21 bp, Homo sapiens
tcattgatagaatgtgatgag

SEQ ID NO: 7835944 - DNA, 22 bp, Homo sapiens
tcattgataaagtactgctttt

SEQ ID NO: 7835945 - DNA, 19 bp, Homo sapiens
tcattgattgtagttacat

SEQ ID NO: 7835946 - DNA, 15 bp, Homo sapiens
tcattgattctggat

SEQ ID NO: 7835947 - DNA, 20 bp, Homo sapiens
tcattgcacataatggaagc

SEQ ID NO: 7835948 - DNA, 22 bp, Homo sapiens
tcattgaatgagatgcaataga

SEQ ID NO: 7835949 - DNA, 18 bp, Homo sapiens
tccagagcagtctttggc

SEQ ID NO: 7835950 - DNA, 22 bp, Homo sapiens
tccagagccccaattcacctct

SEQ ID NO: 7835951 - DNA, 22 bp, Homo sapiens
tccagagccccaattcacctct

SEQ ID NO: 7835952 - DNA, 22 bp, Homo sapiens
tccagagccccagtctagtggg

SEQ ID NO: 7835953 - DNA, 22 bp, Homo sapiens
tccagagcctatatgttcaact

SEQ ID NO: 7835954 - DNA, 22 bp, Homo sapiens
tccagagccccagtctagtggg

SEQ ID NO: 7835955 - DNA, 22 bp, Homo sapiens
tccagagccccagtctagtggg

SEQ ID NO: 7835956 - DNA, 18 bp, Homo sapiens
tccagagcagtctttggc

SEQ ID NO: 7835957 - DNA, 22 bp, Homo sapiens
tccagagcaggtgtctacacag

SEQ ID NO: 7835958 - DNA, 22 bp, Homo sapiens
tccagagcaggtggtcagaagg

SEQ ID NO: 7835959 - DNA, 22 bp, Homo sapiens
tccagagcaggtggtcagaagg

SEQ ID NO: 7835960 - DNA, 22 bp, Homo sapiens
tccagagcaggtggtcagaagg

SEQ ID NO: 7835961 - DNA, 22 bp, Homo sapiens
tccagagatcacactgggcagg

SEQ ID NO: 7835962 - DNA, 22 bp, Homo sapiens
tccagagataactatttaggag

SEQ ID NO: 7835963 - DNA, 20 bp, Homo sapiens
tccagagagtggcaaagctc

SEQ ID NO: 7835964 - DNA, 22 bp, Homo sapiens
tccagagatcacactgggcagg

SEQ ID NO: 7835965 - DNA, 22 bp, Homo sapiens
tccagagatcacactgggcagg

SEQ ID NO: 7835966 - DNA, 22 bp, Homo sapiens
tccagagatcacactgggcagg

SEQ ID NO: 7835967 - DNA, 22 bp, Homo sapiens
tccagagatcacactgggcagg

SEQ ID NO: 7835968 - DNA, 22 bp, Homo sapiens
tccagagatcacactgggcagg

SEQ ID NO: 7835969 - DNA, 22 bp, Homo sapiens
tccagagatccaaagaatatga

SEQ ID NO: 7835970 - DNA, 22 bp, Homo sapiens
tccagagatccaaagaatatga

SEQ ID NO: 7835971 - DNA, 22 bp, Homo sapiens
tccagagatccaaagaatatga

SEQ ID NO: 7835972 - DNA, 22 bp, Homo sapiens
tccagagatctctcttccctgt

SEQ ID NO: 7835973 - DNA, 22 bp, Homo sapiens
tccagagatctctcttccctgt

SEQ ID NO: 7835974 - DNA, 17 bp, Homo sapiens
tccagagcacagagctc

SEQ ID NO: 7835975 - DNA, 17 bp, Homo sapiens
tccagagcacagagctc

SEQ ID NO: 7835976 - DNA, 17 bp, Homo sapiens
tccagagcacagagctc

SEQ ID NO: 7835977 - DNA, 17 bp, Homo sapiens
tccagagcacagagctc

SEQ ID NO: 7835978 - DNA, 22 bp, Homo sapiens
tccagagcctgcgcactggctg

SEQ ID NO: 7835979 - DNA, 22 bp, Homo sapiens
tccagagcctgcgcactggctg

SEQ ID NO: 7835980 - DNA, 22 bp, Homo sapiens
tccagagcctgcgcactggctg

SEQ ID NO: 7835981 - DNA, 22 bp, Homo sapiens
tccagagcctttctgcttgaca

SEQ ID NO: 7835982 - DNA, 22 bp, Homo sapiens
tccagagcctttctgcttgaca

SEQ ID NO: 7835983 - DNA, 22 bp, Homo sapiens
tccagagccttcgataagaaga

SEQ ID NO: 7835984 - DNA, 22 bp, Homo sapiens
tccagagcctggggtttgtaac

SEQ ID NO: 7835985 - DNA, 22 bp, Homo sapiens
tccagagctaattcagcagctg

SEQ ID NO: 7835986 - DNA, 18 bp, Homo sapiens
tccagagctactgtggtg

SEQ ID NO: 7835987 - DNA, 22 bp, Homo sapiens
tccagagctaattcagcagctg

SEQ ID NO: 7835988 - DNA, 22 bp, Homo sapiens
tccagagctaattcagcagctg

SEQ ID NO: 7835989 - DNA, 22 bp, Homo sapiens
tccagagctaattcagcagctg

SEQ ID NO: 7835990 - DNA, 22 bp, Homo sapiens
tccagagctaattcagcagctg

SEQ ID NO: 7835991 - DNA, 22 bp, Homo sapiens
tccagagctaattcagcagctg

SEQ ID NO: 7835992 - DNA, 22 bp, Homo sapiens
tccagagctacttgctcaactt

SEQ ID NO: 7835993 - DNA, 18 bp, Homo sapiens
tccagagctactgtggtg

SEQ ID NO: 7835994 - DNA, 23 bp, Homo sapiens
tccagagctcatgctctcaacca

SEQ ID NO: 7835995 - DNA, 23 bp, Homo sapiens
tccagagctcatgctctcaacca

SEQ ID NO: 7835996 - DNA, 23 bp, Homo sapiens
tccagagctcatgctctcaacca

SEQ ID NO: 7835997 - DNA, 22 bp, Homo sapiens
tccagagctacttgctcaactt

SEQ ID NO: 7835998 - DNA, 22 bp, Homo sapiens
tccagagctacttgctcaactt

SEQ ID NO: 7835999 - DNA, 22 bp, Homo sapiens
tccagcagtccatgtgagacac

SEQ ID NO: 7836000 - DNA, 22 bp, Homo sapiens
tccagcagtccatgtgagacac

SEQ ID NO: 7836001 - DNA, 22 bp, Homo sapiens
tccagcagtccatgtgagacac

SEQ ID NO: 7836002 - DNA, 22 bp, Homo sapiens
tccagcagtccatgtgagacac

SEQ ID NO: 7836003 - DNA, 22 bp, Homo sapiens
tccagcagtccatgtgagacac

SEQ ID NO: 7836004 - DNA, 22 bp, Homo sapiens
tccagcagtccatgtgagacac

SEQ ID NO: 7836005 - DNA, 20 bp, Homo sapiens
tccagcagtatgctatactt

SEQ ID NO: 7836006 - DNA, 20 bp, Homo sapiens
tccagcagtatgctatactt

SEQ ID NO: 7836007 - DNA, 22 bp, Homo sapiens
tccagcagtaaggaaagtacat

SEQ ID NO: 7836008 - DNA, 20 bp, Homo sapiens
tccagcagtatgctatactt

SEQ ID NO: 7836009 - DNA, 22 bp, Homo sapiens
tccagcaggttggtcaggtgca

SEQ ID NO: 7836010 - DNA, 22 bp, Homo sapiens
tccagcaggttggtcaggtgca

SEQ ID NO: 7836011 - DNA, 22 bp, Homo sapiens
tccagcaggttggtcaggtgca

SEQ ID NO: 7836012 - DNA, 22 bp, Homo sapiens
tccagcaggttggtcaggtgca

SEQ ID NO: 7836013 - DNA, 22 bp, Homo sapiens
tccagcaggttggtcaggtgca

SEQ ID NO: 7836014 - DNA, 22 bp, Homo sapiens
tccagcaggttggtcaggtgca

SEQ ID NO: 7836015 - DNA, 22 bp, Homo sapiens
tccagcaggttggtcaggtgca

SEQ ID NO: 7836016 - DNA, 22 bp, Homo sapiens
tccagcagtgctcaggactcac

SEQ ID NO: 7836017 - DNA, 22 bp, Homo sapiens
tccagcagtgctcaggactcac

SEQ ID NO: 7836018 - DNA, 16 bp, Homo sapiens
tccagcagtctctgta

SEQ ID NO: 7836019 - DNA, 22 bp, Homo sapiens
tccagcagtgctctagagcgtg

SEQ ID NO: 7836020 - DNA, 22 bp, Homo sapiens
tccagcagtgctcaggactcac

SEQ ID NO: 7836021 - DNA, 22 bp, Homo sapiens
tccagcagtgctcaggactcac

SEQ ID NO: 7836022 - DNA, 20 bp, Homo sapiens
tccagcatataaactcctct

SEQ ID NO: 7836023 - DNA, 19 bp, Homo sapiens
tccagcagtgcttgaaatc

SEQ ID NO: 7836024 - DNA, 19 bp, Homo sapiens
tccagcagtgcttgaaatc

SEQ ID NO: 7836025 - DNA, 19 bp, Homo sapiens
tccagcagtgcttgaaatc

SEQ ID NO: 7836026 - DNA, 22 bp, Homo sapiens
tccagcagtgctctagagcgtg

SEQ ID NO: 7836027 - DNA, 22 bp, Homo sapiens
tccagcagtgctcaggactcac

SEQ ID NO: 7836028 - DNA, 22 bp, Homo sapiens
tccagcagtgctcaggactcac

SEQ ID NO: 7836029 - DNA, 22 bp, Homo sapiens
tccagcagtgctctagagcgtg

SEQ ID NO: 7836030 - DNA, 22 bp, Homo sapiens
tccagcagtgctctagagcgtg

SEQ ID NO: 7836031 - DNA, 22 bp, Homo sapiens
tccagcagtgctctagagcgtg

SEQ ID NO: 7836032 - DNA, 22 bp, Homo sapiens
tccagcattcttagacctctat

SEQ ID NO: 7836033 - DNA, 22 bp, Homo sapiens
tccagcattcttagacctctat

SEQ ID NO: 7836034 - DNA, 22 bp, Homo sapiens
tccagcattcttagacctctat

SEQ ID NO: 7836035 - DNA, 22 bp, Homo sapiens
tccagcattagatgtgaaattg

SEQ ID NO: 7836036 - DNA, 22 bp, Homo sapiens
tccagcatgactagttccccat

SEQ ID NO: 7836037 - DNA, 22 bp, Homo sapiens
tccagcatatatagagaatgag

SEQ ID NO: 7836038 - DNA, 22 bp, Homo sapiens
tccagcatatatagagaatgag

SEQ ID NO: 7836039 - DNA, 22 bp, Homo sapiens
tccagcatttttcaatagaatt

SEQ ID NO: 7836040 - DNA, 23 bp, Homo sapiens
tccagccaaatctggctgacagt

SEQ ID NO: 7836041 - DNA, 23 bp, Homo sapiens
tccagccaaatctggctgacagt

SEQ ID NO: 7836042 - DNA, 22 bp, Homo sapiens
tccagccaactgcctagggagc

SEQ ID NO: 7836043 - DNA, 23 bp, Homo sapiens
tccagccaaatctggctgacagt

SEQ ID NO: 7836044 - DNA, 22 bp, Homo sapiens
tccagccaactgcctagggagc

SEQ ID NO: 7836045 - DNA, 22 bp, Homo sapiens
tccagccaatcagagctgaggc

SEQ ID NO: 7836046 - DNA, 22 bp, Homo sapiens
tccagcctttctactcactgag

SEQ ID NO: 7836047 - DNA, 22 bp, Homo sapiens
tccagcctttctactcactgag

SEQ ID NO: 7836048 - DNA, 22 bp, Homo sapiens
tccagcctttctactcactgag

SEQ ID NO: 7836049 - DNA, 22 bp, Homo sapiens
tccagccaatcagagctgaggc

SEQ ID NO: 7836050 - DNA, 22 bp, Homo sapiens
tccagccaatcagagctgaggc

SEQ ID NO: 7836051 - DNA, 22 bp, Homo sapiens
tccagccaatcagagctgaggc

SEQ ID NO: 7836052 - DNA, 22 bp, Homo sapiens
tccagccaccaccttgattgcc

SEQ ID NO: 7836053 - DNA, 22 bp, Homo sapiens
tccagccaactgcctagggagc

SEQ ID NO: 7836054 - DNA, 22 bp, Homo sapiens
tccagccaagccttggtagctg

SEQ ID NO: 7836055 - DNA, 22 bp, Homo sapiens
tccagccaagccttggtagctg

SEQ ID NO: 7836056 - DNA, 22 bp, Homo sapiens
tccagccaatcagagctgaggc

SEQ ID NO: 7836057 - DNA, 22 bp, Homo sapiens
tccagccaagccttggtagctg

SEQ ID NO: 7836058 - DNA, 22 bp, Homo sapiens
tccagccaatcaactattgttt

SEQ ID NO: 7836059 - DNA, 22 bp, Homo sapiens
tccagctcaaagtgctcctgtc

SEQ ID NO: 7836060 - DNA, 22 bp, Homo sapiens
tccagctcaaagtgctcctgtc

SEQ ID NO: 7836061 - DNA, 22 bp, Homo sapiens
tccagctcaaagtgctcctgtc

SEQ ID NO: 7836062 - DNA, 22 bp, Homo sapiens
tccagctcaaagtgctcctgtc

SEQ ID NO: 7836063 - DNA, 22 bp, Homo sapiens
tccagctcaaattcagcttcca

SEQ ID NO: 7836064 - DNA, 20 bp, Homo sapiens
tccagcgtgtgactctgcgc

SEQ ID NO: 7836065 - DNA, 22 bp, Homo sapiens
tccagcctttctactcactgag

SEQ ID NO: 7836066 - DNA, 20 bp, Homo sapiens
tccagcgtgtgactctgcgc

SEQ ID NO: 7836067 - DNA, 22 bp, Homo sapiens
tccagcctttctactcactgag

SEQ ID NO: 7836068 - DNA, 22 bp, Homo sapiens
tccagcctttctactcactgag

SEQ ID NO: 7836069 - DNA, 22 bp, Homo sapiens
tccagctcagggttggctcaag

SEQ ID NO: 7836070 - DNA, 22 bp, Homo sapiens
tccagctcagggttggctcaag

SEQ ID NO: 7836071 - DNA, 22 bp, Homo sapiens
tccagctcagggttggctcaag

SEQ ID NO: 7836072 - DNA, 22 bp, Homo sapiens
tccagctcagggttggctcaag

SEQ ID NO: 7836073 - DNA, 22 bp, Homo sapiens
tccagctcagggttggctcaag

SEQ ID NO: 7836074 - DNA, 22 bp, Homo sapiens
tccagctcagatgcagggatca

SEQ ID NO: 7836075 - DNA, 22 bp, Homo sapiens
tccagctcagggttggctcaag

SEQ ID NO: 7836076 - DNA, 18 bp, Homo sapiens
tccagctcacagatgggc

SEQ ID NO: 7836077 - DNA, 18 bp, Homo sapiens
tccagctcacagatgggc

SEQ ID NO: 7836078 - DNA, 22 bp, Homo sapiens
tccagctcacagatagcgtggg

SEQ ID NO: 7836079 - DNA, 22 bp, Homo sapiens
tccagctcacagatagcgtggg

SEQ ID NO: 7836080 - DNA, 18 bp, Homo sapiens
tccagctcacagatgggc

SEQ ID NO: 7836081 - DNA, 18 bp, Homo sapiens
tccagctcacagatgggc

SEQ ID NO: 7836082 - DNA, 18 bp, Homo sapiens
tccagctcacagatgggc

SEQ ID NO: 7836083 - DNA, 22 bp, Homo sapiens
tccagctcagatgcagggatca

SEQ ID NO: 7836084 - DNA, 22 bp, Homo sapiens
tccagctcatctgtctccatta

SEQ ID NO: 7836085 - DNA, 22 bp, Homo sapiens
tccagctcagggttggctcaag

SEQ ID NO: 7836086 - DNA, 22 bp, Homo sapiens
tccagctcagggttggctcaag

SEQ ID NO: 7836087 - DNA, 22 bp, Homo sapiens
tccagctcatctgtctccatta

SEQ ID NO: 7836088 - DNA, 22 bp, Homo sapiens
tccagctcccactctcactgct

SEQ ID NO: 7836089 - DNA, 22 bp, Homo sapiens
tccagctccacagcctccctgt

SEQ ID NO: 7836090 - DNA, 22 bp, Homo sapiens
tccagctcatctgtctccatta

SEQ ID NO: 7836091 - DNA, 22 bp, Homo sapiens
tccagctcccactctcactgct

SEQ ID NO: 7836092 - DNA, 22 bp, Homo sapiens
tccagctcccactctcactgct

SEQ ID NO: 7836093 - DNA, 22 bp, Homo sapiens
tccagctcccactctcactgct

SEQ ID NO: 7836094 - DNA, 23 bp, Homo sapiens
tccagctcccttcaatggcactg

SEQ ID NO: 7836095 - DNA, 23 bp, Homo sapiens
tccagctcccttcaatggcactg

SEQ ID NO: 7836096 - DNA, 22 bp, Homo sapiens
tccagctcccactctcactgct

SEQ ID NO: 7836097 - DNA, 22 bp, Homo sapiens
tccagctcccactctcactgct

SEQ ID NO: 7836098 - DNA, 23 bp, Homo sapiens
tccagctcccttcaatggcactg

SEQ ID NO: 7836099 - DNA, 23 bp, Homo sapiens
tccagctcccttcaatggcactg

SEQ ID NO: 7836100 - DNA, 22 bp, Homo sapiens
tccagctcccactctcactgct

SEQ ID NO: 7836101 - DNA, 23 bp, Homo sapiens
tccagctcccttcaatggcactg

SEQ ID NO: 7836102 - DNA, 20 bp, Homo sapiens
tccagctccgtgttcttcct

SEQ ID NO: 7836103 - DNA, 17 bp, Homo sapiens
tccagctcctcattgtt

SEQ ID NO: 7836104 - DNA, 17 bp, Homo sapiens
tccagctcctcattgtt

SEQ ID NO: 7836105 - DNA, 17 bp, Homo sapiens
tccagctcctcattgtt

SEQ ID NO: 7836106 - DNA, 17 bp, Homo sapiens
tccagctcctcattgtt

SEQ ID NO: 7836107 - DNA, 22 bp, Homo sapiens
tccagctcctctacccgatgcg

SEQ ID NO: 7836108 - DNA, 22 bp, Homo sapiens
tccagctcctctacccgatgcg

SEQ ID NO: 7836109 - DNA, 17 bp, Homo sapiens
tccagctcctcattgtt

SEQ ID NO: 7836110 - DNA, 22 bp, Homo sapiens
tccaggaaagtgggatgtgtgt

SEQ ID NO: 7836111 - DNA, 21 bp, Homo sapiens
tccaggaaagttttaagagtg

SEQ ID NO: 7836112 - DNA, 21 bp, Homo sapiens
tccaggaaagttttaagagtg

SEQ ID NO: 7836113 - DNA, 21 bp, Homo sapiens
tccaggaaagttttaagagtg

SEQ ID NO: 7836114 - DNA, 21 bp, Homo sapiens
tccaggaaagttttaagagtg

SEQ ID NO: 7836115 - DNA, 22 bp, Homo sapiens
tccaggaaatcagaagtggtaa

SEQ ID NO: 7836116 - DNA, 22 bp, Homo sapiens
tccaggaaacatctccgcctaa

SEQ ID NO: 7836117 - DNA, 22 bp, Homo sapiens
tccaggaaacagcatctcagca

SEQ ID NO: 7836118 - DNA, 22 bp, Homo sapiens
tccaggaaagcactgggctggg

SEQ ID NO: 7836119 - DNA, 22 bp, Homo sapiens
tccaggaaagtgggatgtgtgt

SEQ ID NO: 7836120 - DNA, 22 bp, Homo sapiens
tccaggaaagtgggatgtgtgt

SEQ ID NO: 7836121 - DNA, 22 bp, Homo sapiens
tccaggaggctctggttgacgt

SEQ ID NO: 7836122 - DNA, 22 bp, Homo sapiens
tccaggaggcctcatttcctgt

SEQ ID NO: 7836123 - DNA, 22 bp, Homo sapiens
tccaggaggcctcatttcctgt

SEQ ID NO: 7836124 - DNA, 22 bp, Homo sapiens
tccaggaggctctggttgacgt

SEQ ID NO: 7836125 - DNA, 19 bp, Homo sapiens
tccaggaggctgccattga

SEQ ID NO: 7836126 - DNA, 22 bp, Homo sapiens
tccaggaaacagcatctcagca

SEQ ID NO: 7836127 - DNA, 22 bp, Homo sapiens
tccaggaaacagcatctcagca

SEQ ID NO: 7836128 - DNA, 22 bp, Homo sapiens
tccaggaaacagcatctcagca

SEQ ID NO: 7836129 - DNA, 22 bp, Homo sapiens
tccaggaaacatctccgcctaa

SEQ ID NO: 7836130 - DNA, 22 bp, Homo sapiens
tccaggaaacagcatctcagca

SEQ ID NO: 7836131 - DNA, 22 bp, Homo sapiens
tccaggaaacactcaagccatg

SEQ ID NO: 7836132 - DNA, 22 bp, Homo sapiens
tccaggaaaaggcttgcagggg

SEQ ID NO: 7836133 - DNA, 22 bp, Homo sapiens
tccaggaaacactcaagccatg

SEQ ID NO: 7836134 - DNA, 22 bp, Homo sapiens
tccaggaaacactcaagccatg

SEQ ID NO: 7836135 - DNA, 22 bp, Homo sapiens
tccaggaaacactcaagccatg

SEQ ID NO: 7836136 - DNA, 22 bp, Homo sapiens
tccaggaaaaggcttgcagggg

SEQ ID NO: 7836137 - DNA, 20 bp, Homo sapiens
tccagctttgcctctaactg

SEQ ID NO: 7836138 - DNA, 20 bp, Homo sapiens
tccagctttgcctctaactg

SEQ ID NO: 7836139 - DNA, 22 bp, Homo sapiens
tccagctttggctctagctaca

SEQ ID NO: 7836140 - DNA, 22 bp, Homo sapiens
tccagctttcacgctcctgcct

SEQ ID NO: 7836141 - DNA, 19 bp, Homo sapiens
tccagctgttttgagtcac

SEQ ID NO: 7836142 - DNA, 19 bp, Homo sapiens
tccagctgttttgagtcac

SEQ ID NO: 7836143 - DNA, 19 bp, Homo sapiens
tccagctgttttgagtcac

SEQ ID NO: 7836144 - DNA, 22 bp, Homo sapiens
tccagcttataggtagatttaa

SEQ ID NO: 7836145 - DNA, 22 bp, Homo sapiens
tccagcttcagctcttggatag

SEQ ID NO: 7836146 - DNA, 22 bp, Homo sapiens
tccagctgttgttttatctcag

SEQ ID NO: 7836147 - DNA, 22 bp, Homo sapiens
tccagctgttgttttatctcag

SEQ ID NO: 7836148 - DNA, 22 bp, Homo sapiens
tccagctgttgatattctaggt

SEQ ID NO: 7836149 - DNA, 20 bp, Homo sapiens
tccagctgttgagatctgag

SEQ ID NO: 7836150 - DNA, 22 bp, Homo sapiens
tccagctgttccatcagctctt

SEQ ID NO: 7836151 - DNA, 22 bp, Homo sapiens
tccagctgttccatcagctctt

SEQ ID NO: 7836152 - DNA, 22 bp, Homo sapiens
tccagctgttccatcagctctt

SEQ ID NO: 7836153 - DNA, 22 bp, Homo sapiens
tccagctgttgatattctaggt

SEQ ID NO: 7836154 - DNA, 20 bp, Homo sapiens
tccagctgttgagatctgag

SEQ ID NO: 7836155 - DNA, 18 bp, Homo sapiens
tccagcttgcacttaaat

SEQ ID NO: 7836156 - DNA, 22 bp, Homo sapiens
tccagcttgcctggtcttttgg

SEQ ID NO: 7836157 - DNA, 22 bp, Homo sapiens
tccagcttcttgacttggtggt

SEQ ID NO: 7836158 - DNA, 22 bp, Homo sapiens
tccagcttccagtggctggctg

SEQ ID NO: 7836159 - DNA, 22 bp, Homo sapiens
tccagctttcacgctcctgcct

SEQ ID NO: 7836160 - DNA, 22 bp, Homo sapiens
tccagctttcacgctcctgcct

SEQ ID NO: 7836161 - DNA, 22 bp, Homo sapiens
tccagctttcacgctcctgcct

SEQ ID NO: 7836162 - DNA, 22 bp, Homo sapiens
tccagctttcacgctcctgcct

SEQ ID NO: 7836163 - DNA, 22 bp, Homo sapiens
tccagcttggcagagctacctg

SEQ ID NO: 7836164 - DNA, 22 bp, Homo sapiens
tccagcttggagagaagtttct

SEQ ID NO: 7836165 - DNA, 21 bp, Homo sapiens
tccagctcctgccactcctta

SEQ ID NO: 7836166 - DNA, 22 bp, Homo sapiens
tccagctcctgagttcactgct

SEQ ID NO: 7836167 - DNA, 22 bp, Homo sapiens
tccagctcctctacccgatgcg

SEQ ID NO: 7836168 - DNA, 22 bp, Homo sapiens
tccagctcctgagttcactgct

SEQ ID NO: 7836169 - DNA, 22 bp, Homo sapiens
tccagctcctgagttcactgct

SEQ ID NO: 7836170 - DNA, 22 bp, Homo sapiens
tccagctcctgagttcactgct

SEQ ID NO: 7836171 - DNA, 22 bp, Homo sapiens
tccagctctaaggctgatagcc

SEQ ID NO: 7836172 - DNA, 22 bp, Homo sapiens
tccagctctaaggctgatagcc

SEQ ID NO: 7836173 - DNA, 22 bp, Homo sapiens
tccagctctaaggctgatagcc

SEQ ID NO: 7836174 - DNA, 22 bp, Homo sapiens
tccagctctaacatgctgggcc

SEQ ID NO: 7836175 - DNA, 22 bp, Homo sapiens
tccagctctaacatgctgggcc

SEQ ID NO: 7836176 - DNA, 22 bp, Homo sapiens
tccagctctaacatgctgggcc

SEQ ID NO: 7836177 - DNA, 21 bp, Homo sapiens
tccagctcctgccactcctta

SEQ ID NO: 7836178 - DNA, 22 bp, Homo sapiens
tccagctctgcttcacagtctc

SEQ ID NO: 7836179 - DNA, 22 bp, Homo sapiens
tccagctctgctgtgcgccggt

SEQ ID NO: 7836180 - DNA, 18 bp, Homo sapiens
tccagctctgccacttac

SEQ ID NO: 7836181 - DNA, 22 bp, Homo sapiens
tccagctctgcttcacagtctc

SEQ ID NO: 7836182 - DNA, 22 bp, Homo sapiens
tccagctctgattctcactagc

SEQ ID NO: 7836183 - DNA, 22 bp, Homo sapiens
tccagctctgattctcactagc

SEQ ID NO: 7836184 - DNA, 19 bp, Homo sapiens
tccagctggtatgcccaga

SEQ ID NO: 7836185 - DNA, 19 bp, Homo sapiens
tccagctggtatgcccaga

SEQ ID NO: 7836186 - DNA, 22 bp, Homo sapiens
tccagctgtactttgtcctggc

SEQ ID NO: 7836187 - DNA, 19 bp, Homo sapiens
tccagctggtatgcccaga

SEQ ID NO: 7836188 - DNA, 22 bp, Homo sapiens
tccagctgtagtggatttgaga

SEQ ID NO: 7836189 - DNA, 21 bp, Homo sapiens
tccagctgtgattatgaatgt

SEQ ID NO: 7836190 - DNA, 20 bp, Homo sapiens
tccagctgtctttcagagac

SEQ ID NO: 7836191 - DNA, 20 bp, Homo sapiens
tccagctgtctttcagagac

SEQ ID NO: 7836192 - DNA, 20 bp, Homo sapiens
tccagctgtctttcagagac

SEQ ID NO: 7836193 - DNA, 22 bp, Homo sapiens
tccagctgttccatcagctctt

SEQ ID NO: 7836194 - DNA, 22 bp, Homo sapiens
tccagctgtgctccaggaggtg

SEQ ID NO: 7836195 - DNA, 22 bp, Homo sapiens
tccagctgtgctccaggaggtg

SEQ ID NO: 7836196 - DNA, 22 bp, Homo sapiens
tccagctgtgctccaggaggtg

SEQ ID NO: 7836197 - DNA, 22 bp, Homo sapiens
tccagctgtgctccaggaggtg

SEQ ID NO: 7836198 - DNA, 22 bp, Homo sapiens
tccagctctggcttggctagct

SEQ ID NO: 7836199 - DNA, 22 bp, Homo sapiens
tccagctctggcttggctagct

SEQ ID NO: 7836200 - DNA, 21 bp, Homo sapiens
tccagctcttatgttcatgaa

SEQ ID NO: 7836201 - DNA, 22 bp, Homo sapiens
tccagctctggcttggctagct

SEQ ID NO: 7836202 - DNA, 22 bp, Homo sapiens
tccagctctggcttggctagct

SEQ ID NO: 7836203 - DNA, 22 bp, Homo sapiens
tccagctggggcagtggctggg

SEQ ID NO: 7836204 - DNA, 22 bp, Homo sapiens
tccagctggggacatgggcttc

SEQ ID NO: 7836205 - DNA, 22 bp, Homo sapiens
tccagctggggacatgggcttc

SEQ ID NO: 7836206 - DNA, 22 bp, Homo sapiens
tccagctggggcagtggctggg

SEQ ID NO: 7836207 - DNA, 22 bp, Homo sapiens
tccagctggggcagtggctggg

SEQ ID NO: 7836208 - DNA, 22 bp, Homo sapiens
tccagctggggccgaagtggat

SEQ ID NO: 7836209 - DNA, 22 bp, Homo sapiens
tccagctggggcagtggctggg

SEQ ID NO: 7836210 - DNA, 22 bp, Homo sapiens
tccagctggggcagtggctggg

SEQ ID NO: 7836211 - DNA, 22 bp, Homo sapiens
tccaggctaggtttacaggaca

SEQ ID NO: 7836212 - DNA, 22 bp, Homo sapiens
tccaggctaggtttacaggaca

SEQ ID NO: 7836213 - DNA, 22 bp, Homo sapiens
tccaggctaggtttacaggaca

SEQ ID NO: 7836214 - DNA, 22 bp, Homo sapiens
tccaggctcagcacttgctact

SEQ ID NO: 7836215 - DNA, 22 bp, Homo sapiens
tccaggctcagcacttgctact

SEQ ID NO: 7836216 - DNA, 22 bp, Homo sapiens
tccaggctcagcacttgctact

SEQ ID NO: 7836217 - DNA, 22 bp, Homo sapiens
tccaggccactgcagaggctct

SEQ ID NO: 7836218 - DNA, 22 bp, Homo sapiens
tccaggccactgcagaggctct

SEQ ID NO: 7836219 - DNA, 22 bp, Homo sapiens
tccaggccactgcagaggctct

SEQ ID NO: 7836220 - DNA, 22 bp, Homo sapiens
tccaggccactgcagaggctct

SEQ ID NO: 7836221 - DNA, 22 bp, Homo sapiens
tccaggctctaggctgctctcc

SEQ ID NO: 7836222 - DNA, 22 bp, Homo sapiens
tccaggctctaggctgctctcc

SEQ ID NO: 7836223 - DNA, 22 bp, Homo sapiens
tccaggctctaggctgctctcc

SEQ ID NO: 7836224 - DNA, 22 bp, Homo sapiens
tccaggctcagcacttgctact

SEQ ID NO: 7836225 - DNA, 22 bp, Homo sapiens
tccaggctctcaggtgtcagca

SEQ ID NO: 7836226 - DNA, 22 bp, Homo sapiens
tccaggctctcaggtgtcagca

SEQ ID NO: 7836227 - DNA, 22 bp, Homo sapiens
tccaggctctaggctgctctcc

SEQ ID NO: 7836228 - DNA, 22 bp, Homo sapiens
tccaggctctaggctgctctcc

SEQ ID NO: 7836229 - DNA, 22 bp, Homo sapiens
tccaggctctaggctgctctcc

SEQ ID NO: 7836230 - DNA, 22 bp, Homo sapiens
tccaggctctcaggtgtcagca

SEQ ID NO: 7836231 - DNA, 22 bp, Homo sapiens
tccaggctctcaggtgtcagca

SEQ ID NO: 7836232 - DNA, 22 bp, Homo sapiens
tccaggctctcaggtgtcagca

SEQ ID NO: 7836233 - DNA, 22 bp, Homo sapiens
tccaggctctcaggtgtcagca

SEQ ID NO: 7836234 - DNA, 22 bp, Homo sapiens
tccaggctctcaggtgtcagca

SEQ ID NO: 7836235 - DNA, 19 bp, Homo sapiens
tccaggctgagagtcagct

SEQ ID NO: 7836236 - DNA, 19 bp, Homo sapiens
tccaggctgagagtcagct

SEQ ID NO: 7836237 - DNA, 19 bp, Homo sapiens
tccaggctgagagtcagct

SEQ ID NO: 7836238 - DNA, 19 bp, Homo sapiens
tccaggctgagagtcagct

SEQ ID NO: 7836239 - DNA, 19 bp, Homo sapiens
tccaggctgagagtcagct

SEQ ID NO: 7836240 - DNA, 22 bp, Homo sapiens
tccaggctgacgcagctattta

SEQ ID NO: 7836241 - DNA, 22 bp, Homo sapiens
tccaggctgacgcagctattta

SEQ ID NO: 7836242 - DNA, 19 bp, Homo sapiens
tccaggctgagagtcagct

SEQ ID NO: 7836243 - DNA, 23 bp, Homo sapiens
tccaggctgaaggagcagatttt

SEQ ID NO: 7836244 - DNA, 23 bp, Homo sapiens
tccaggctgaaggagcagatttt

SEQ ID NO: 7836245 - DNA, 22 bp, Homo sapiens
tccaggctgacgcagctattta

SEQ ID NO: 7836246 - DNA, 23 bp, Homo sapiens
tccaggctgaaggagcagatttt

SEQ ID NO: 7836247 - DNA, 23 bp, Homo sapiens
tccaggctgaaggagcagatttt

SEQ ID NO: 7836248 - DNA, 22 bp, Homo sapiens
tccaggctctcaggtgtcagca

SEQ ID NO: 7836249 - DNA, 22 bp, Homo sapiens
tccaggctctcaggtgtcagca

SEQ ID NO: 7836250 - DNA, 22 bp, Homo sapiens
tccaggctgcaaggccacaggg

SEQ ID NO: 7836251 - DNA, 22 bp, Homo sapiens
tccaggctgcaaggccacaggg

SEQ ID NO: 7836252 - DNA, 21 bp, Homo sapiens
tccaggctgatgatgtcaact

SEQ ID NO: 7836253 - DNA, 21 bp, Homo sapiens
tccaggctgatgatgtcaact

SEQ ID NO: 7836254 - DNA, 22 bp, Homo sapiens
tccaggctgcaaggccacaggg

SEQ ID NO: 7836255 - DNA, 22 bp, Homo sapiens
tccaggctgcaaggccacaggg

SEQ ID NO: 7836256 - DNA, 22 bp, Homo sapiens
tccaggctgcaaggccacaggg

SEQ ID NO: 7836257 - DNA, 19 bp, Homo sapiens
tccaggctgagagtcagct

SEQ ID NO: 7836258 - DNA, 22 bp, Homo sapiens
tccaggctgatccatgaagaat

SEQ ID NO: 7836259 - DNA, 19 bp, Homo sapiens
tccaggctgagagtcagct

SEQ ID NO: 7836260 - DNA, 22 bp, Homo sapiens
tccaggctgatccatgaagaat

SEQ ID NO: 7836261 - DNA, 22 bp, Homo sapiens
tccaggctgatccatgaagaat

SEQ ID NO: 7836262 - DNA, 21 bp, Homo sapiens
tccaggctgatgatgtcaact

SEQ ID NO: 7836263 - DNA, 22 bp, Homo sapiens
tccaggctgatccatgaagaat

SEQ ID NO: 7836264 - DNA, 22 bp, Homo sapiens
tccaggcatgtcccaagccgga

SEQ ID NO: 7836265 - DNA, 22 bp, Homo sapiens
tccaggcatggtgtaattttgc

SEQ ID NO: 7836266 - DNA, 23 bp, Homo sapiens
tccaggcatgagctctggatgga

SEQ ID NO: 7836267 - DNA, 22 bp, Homo sapiens
tccaggcatggtgtaattttgc

SEQ ID NO: 7836268 - DNA, 23 bp, Homo sapiens
tccaggcatgagctctggatgga

SEQ ID NO: 7836269 - DNA, 23 bp, Homo sapiens
tccaggcatgagctctggatgga

SEQ ID NO: 7836270 - DNA, 23 bp, Homo sapiens
tccaggcatgagctctggatgga

SEQ ID NO: 7836271 - DNA, 23 bp, Homo sapiens
tccaggcatgagctctggatgga

SEQ ID NO: 7836272 - DNA, 23 bp, Homo sapiens
tccaggcatgagctctggatgga

SEQ ID NO: 7836273 - DNA, 22 bp, Homo sapiens
tccaggcatgtcccaagccgga

SEQ ID NO: 7836274 - DNA, 22 bp, Homo sapiens
tccaggcatgtctgagtccttc

SEQ ID NO: 7836275 - DNA, 22 bp, Homo sapiens
tccaggcatgtctgagtccttc

SEQ ID NO: 7836276 - DNA, 22 bp, Homo sapiens
tccaggcatgtctgagtccttc

SEQ ID NO: 7836277 - DNA, 22 bp, Homo sapiens
tccaggcatgtctgagtccttc

SEQ ID NO: 7836278 - DNA, 22 bp, Homo sapiens
tccaggcatgtggccagtactc

SEQ ID NO: 7836279 - DNA, 22 bp, Homo sapiens
tccaggcatgtggccagtactc

SEQ ID NO: 7836280 - DNA, 22 bp, Homo sapiens
tccaggcatgtggccagtactc

SEQ ID NO: 7836281 - DNA, 22 bp, Homo sapiens
tccaggcatgtggccagtactc

SEQ ID NO: 7836282 - DNA, 19 bp, Homo sapiens
tccaggcatccttcaggct

SEQ ID NO: 7836283 - DNA, 19 bp, Homo sapiens
tccaggcatccttcaggct

SEQ ID NO: 7836284 - DNA, 19 bp, Homo sapiens
tccaggcatccttcaggct

SEQ ID NO: 7836285 - DNA, 19 bp, Homo sapiens
tccaggcatccttcaggct

SEQ ID NO: 7836286 - DNA, 23 bp, Homo sapiens
tccaggcatgagctctggatgga

SEQ ID NO: 7836287 - DNA, 23 bp, Homo sapiens
tccaggcatgagctctggatgga

SEQ ID NO: 7836288 - DNA, 23 bp, Homo sapiens
tccaggcatgagctctggatgga

SEQ ID NO: 7836289 - DNA, 22 bp, Homo sapiens
tccaggcatctgtattttttaa

SEQ ID NO: 7836290 - DNA, 19 bp, Homo sapiens
tccaggcatccttcaggct

SEQ ID NO: 7836291 - DNA, 22 bp, Homo sapiens
tccaggcatctgtattttttaa

SEQ ID NO: 7836292 - DNA, 16 bp, Homo sapiens
tccaggcatatctgag

SEQ ID NO: 7836293 - DNA, 17 bp, Homo sapiens
tccaggcatatctccta

SEQ ID NO: 7836294 - DNA, 17 bp, Homo sapiens
tccaggcatatctccta

SEQ ID NO: 7836295 - DNA, 22 bp, Homo sapiens
tccaggcatcccccaggacaga

SEQ ID NO: 7836296 - DNA, 22 bp, Homo sapiens
tccaggcatcccccaggacaga

SEQ ID NO: 7836297 - DNA, 22 bp, Homo sapiens
tccaggcatcccccaggacaga

SEQ ID NO: 7836298 - DNA, 22 bp, Homo sapiens
tccaggcatcccccaggacaga

SEQ ID NO: 7836299 - DNA, 16 bp, Homo sapiens
tccaggcatatctgag

SEQ ID NO: 7836300 - DNA, 22 bp, Homo sapiens
tccaggcatgttgggaagatga

SEQ ID NO: 7836301 - DNA, 22 bp, Homo sapiens
tccaggcatgttgggaagatga

SEQ ID NO: 7836302 - DNA, 15 bp, Homo sapiens
tccaggcattcattc

SEQ ID NO: 7836303 - DNA, 22 bp, Homo sapiens
tccaggcatgttgggaagatga

SEQ ID NO: 7836304 - DNA, 22 bp, Homo sapiens
tccaggcattccagccattcca

SEQ ID NO: 7836305 - DNA, 22 bp, Homo sapiens
tccaggcattccagccattcca

SEQ ID NO: 7836306 - DNA, 22 bp, Homo sapiens
tccaggcattggagagataatg

SEQ ID NO: 7836307 - DNA, 22 bp, Homo sapiens
tccaggcattggagagataatg

SEQ ID NO: 7836308 - DNA, 22 bp, Homo sapiens
tccaggccaatgtagcaggccc

SEQ ID NO: 7836309 - DNA, 22 bp, Homo sapiens
tccaggccaatgtagcaggccc

SEQ ID NO: 7836310 - DNA, 22 bp, Homo sapiens
tccaggccaatgtagcaggccc

SEQ ID NO: 7836311 - DNA, 22 bp, Homo sapiens
tccaggccaatgtagcaggccc

SEQ ID NO: 7836312 - DNA, 22 bp, Homo sapiens
tccaggccaatgtagcaggccc

SEQ ID NO: 7836313 - DNA, 22 bp, Homo sapiens
tccaggccaatgtagcaggccc

SEQ ID NO: 7836314 - DNA, 22 bp, Homo sapiens
tccaggccacgacctcctggat

SEQ ID NO: 7836315 - DNA, 22 bp, Homo sapiens
tccaggccacgacctcctggat

SEQ ID NO: 7836316 - DNA, 22 bp, Homo sapiens
tccaggccacgacctcctggat

SEQ ID NO: 7836317 - DNA, 22 bp, Homo sapiens
tccaggccacgacctcctggat

SEQ ID NO: 7836318 - DNA, 22 bp, Homo sapiens
tccaggccacgacctcctggat

SEQ ID NO: 7836319 - DNA, 22 bp, Homo sapiens
tccaggccacgacctcctggat

SEQ ID NO: 7836320 - DNA, 22 bp, Homo sapiens
tccaggccacgacctcctggat

SEQ ID NO: 7836321 - DNA, 22 bp, Homo sapiens
tccaggccacatggatggcgat

SEQ ID NO: 7836322 - DNA, 22 bp, Homo sapiens
tccaggccacatggatggcgat

SEQ ID NO: 7836323 - DNA, 22 bp, Homo sapiens
tccaggccacatggatggcgat

SEQ ID NO: 7836324 - DNA, 22 bp, Homo sapiens
tccaggccaatgtagcaggccc

SEQ ID NO: 7836325 - DNA, 22 bp, Homo sapiens
tccaggccaatgtagcaggccc

SEQ ID NO: 7836326 - DNA, 22 bp, Homo sapiens
tccaggagtttgagactgcagt

SEQ ID NO: 7836327 - DNA, 22 bp, Homo sapiens
tccaggagtttgagactgcagt

SEQ ID NO: 7836328 - DNA, 22 bp, Homo sapiens
tccaggagtttgagactgcagt

SEQ ID NO: 7836329 - DNA, 22 bp, Homo sapiens
tccaggagtttgagactgcagt

SEQ ID NO: 7836330 - DNA, 22 bp, Homo sapiens
tccaggagtttgacctgtgggc

SEQ ID NO: 7836331 - DNA, 22 bp, Homo sapiens
tccaggagtggggcagaggtct

SEQ ID NO: 7836332 - DNA, 22 bp, Homo sapiens
tccaggagtggggcagaggtct

SEQ ID NO: 7836333 - DNA, 22 bp, Homo sapiens
tccaggagtgtgtgctaatggg

SEQ ID NO: 7836334 - DNA, 22 bp, Homo sapiens
tccaggagtgtgtgctaatggg

SEQ ID NO: 7836335 - DNA, 21 bp, Homo sapiens
tccaggagttctaataggtgt

SEQ ID NO: 7836336 - DNA, 21 bp, Homo sapiens
tccaggagtggctgggcaggg

SEQ ID NO: 7836337 - DNA, 21 bp, Homo sapiens
tccaggagtggctgggcaggg

SEQ ID NO: 7836338 - DNA, 21 bp, Homo sapiens
tccaggagtggctgggcaggg

SEQ ID NO: 7836339 - DNA, 22 bp, Homo sapiens
tccaggagtggggcagaggtct

SEQ ID NO: 7836340 - DNA, 22 bp, Homo sapiens
tccaggagtgataaggccactg

SEQ ID NO: 7836341 - DNA, 22 bp, Homo sapiens
tccaggagtgataaggccactg

SEQ ID NO: 7836342 - DNA, 22 bp, Homo sapiens
tccaggagtctagcctcaggcc

SEQ ID NO: 7836343 - DNA, 21 bp, Homo sapiens
tccaggagtggctgggcaggg

SEQ ID NO: 7836344 - DNA, 22 bp, Homo sapiens
tccaggagtgataaggccactg

SEQ ID NO: 7836345 - DNA, 22 bp, Homo sapiens
tccaggcagggcagccatcaag

SEQ ID NO: 7836346 - DNA, 22 bp, Homo sapiens
tccaggcagggcagccatcaag

SEQ ID NO: 7836347 - DNA, 22 bp, Homo sapiens
tccaggcagggcagccatcaag

SEQ ID NO: 7836348 - DNA, 22 bp, Homo sapiens
tccaggcagggcagccatcaag

SEQ ID NO: 7836349 - DNA, 22 bp, Homo sapiens
tccaggcagggcagccatcaag

SEQ ID NO: 7836350 - DNA, 22 bp, Homo sapiens
tccaggattgtcagccagaagg

SEQ ID NO: 7836351 - DNA, 22 bp, Homo sapiens
tccaggagtttgagactgcagt

SEQ ID NO: 7836352 - DNA, 22 bp, Homo sapiens
tccaggatggtgacggtggcca

SEQ ID NO: 7836353 - DNA, 22 bp, Homo sapiens
tccaggatgcccgcttttgctt

SEQ ID NO: 7836354 - DNA, 22 bp, Homo sapiens
tccaggattgcaggtgcacaac

SEQ ID NO: 7836355 - DNA, 22 bp, Homo sapiens
tccaggattgcaggtgcacaac

SEQ ID NO: 7836356 - DNA, 22 bp, Homo sapiens
tccaggattgtcagccagaagg

SEQ ID NO: 7836357 - DNA, 22 bp, Homo sapiens
tccaggattgcaggtgcacaac

SEQ ID NO: 7836358 - DNA, 22 bp, Homo sapiens
tccaggcagttttccaggttgt

SEQ ID NO: 7836359 - DNA, 22 bp, Homo sapiens
tccaggcagttttccaggttgt

SEQ ID NO: 7836360 - DNA, 22 bp, Homo sapiens
tccaggcagttttccaggttgt

SEQ ID NO: 7836361 - DNA, 22 bp, Homo sapiens
tccaggcagtcattaatctcta

SEQ ID NO: 7836362 - DNA, 22 bp, Homo sapiens
tccaggcagggttaagggtcct

SEQ ID NO: 7836363 - DNA, 22 bp, Homo sapiens
tccaggcataagccttgagtgt

SEQ ID NO: 7836364 - DNA, 22 bp, Homo sapiens
tccaggcagttttccaggttgt

SEQ ID NO: 7836365 - DNA, 22 bp, Homo sapiens
tccaggcatagaaggcacgcac

SEQ ID NO: 7836366 - DNA, 22 bp, Homo sapiens
tccaggcataatgcccagtggt

SEQ ID NO: 7836367 - DNA, 22 bp, Homo sapiens
tccaggcatagaaggcacgcac

SEQ ID NO: 7836368 - DNA, 22 bp, Homo sapiens
tccaggcataatgcccagtggt

SEQ ID NO: 7836369 - DNA, 22 bp, Homo sapiens
tccaggcataatgcccagtggt

SEQ ID NO: 7836370 - DNA, 22 bp, Homo sapiens
tccaggcataatgcccagtggt

SEQ ID NO: 7836371 - DNA, 20 bp, Homo sapiens
tccaggaggttagtgtggct

SEQ ID NO: 7836372 - DNA, 22 bp, Homo sapiens
tccaggaggtgaggggaccaaa

SEQ ID NO: 7836373 - DNA, 22 bp, Homo sapiens
tccaggaggtgaggggaccaaa

SEQ ID NO: 7836374 - DNA, 22 bp, Homo sapiens
tccaggaggtgaggggaccaaa

SEQ ID NO: 7836375 - DNA, 22 bp, Homo sapiens
tccaggaggttgagactgcagt

SEQ ID NO: 7836376 - DNA, 22 bp, Homo sapiens
tccaggaggttgagactgcagt

SEQ ID NO: 7836377 - DNA, 22 bp, Homo sapiens
tccaggaggttgagactgcagt

SEQ ID NO: 7836378 - DNA, 22 bp, Homo sapiens
tccaggaggttgagactgcagt

SEQ ID NO: 7836379 - DNA, 20 bp, Homo sapiens
tccaggaggttagtgtggct

SEQ ID NO: 7836380 - DNA, 20 bp, Homo sapiens
tccaggaggttagtgtggct

SEQ ID NO: 7836381 - DNA, 22 bp, Homo sapiens
tccaggaggttgagactgcagt

SEQ ID NO: 7836382 - DNA, 22 bp, Homo sapiens
tccaggaggggtaggcagtatg

SEQ ID NO: 7836383 - DNA, 22 bp, Homo sapiens
tccaggagggggagccgtgccg

SEQ ID NO: 7836384 - DNA, 22 bp, Homo sapiens
tccaggagggggagccgtgccg

SEQ ID NO: 7836385 - DNA, 22 bp, Homo sapiens
tccaggagggttttctgccttc

SEQ ID NO: 7836386 - DNA, 22 bp, Homo sapiens
tccaggagggttttctgccttc

SEQ ID NO: 7836387 - DNA, 22 bp, Homo sapiens
tccaggaggtatgagtggcccc

SEQ ID NO: 7836388 - DNA, 22 bp, Homo sapiens
tccaggagggttttctgccttc

SEQ ID NO: 7836389 - DNA, 22 bp, Homo sapiens
tccaggagggttttctgccttc

SEQ ID NO: 7836390 - DNA, 22 bp, Homo sapiens
tccaggagtcagacagatggtg

SEQ ID NO: 7836391 - DNA, 22 bp, Homo sapiens
tccaggagtcagacagatggtg

SEQ ID NO: 7836392 - DNA, 22 bp, Homo sapiens
tccaggagtcagacagatggtg

SEQ ID NO: 7836393 - DNA, 22 bp, Homo sapiens
tccaggaggttgagtgagttcc

SEQ ID NO: 7836394 - DNA, 22 bp, Homo sapiens
tccaggaggttgagtgagttcc

SEQ ID NO: 7836395 - DNA, 22 bp, Homo sapiens
tccaggaggtttggaggaagca

SEQ ID NO: 7836396 - DNA, 22 bp, Homo sapiens
tccaggaggtttggaggaagca

SEQ ID NO: 7836397 - DNA, 22 bp, Homo sapiens
tccaggaggtttggaggaagca

SEQ ID NO: 7836398 - DNA, 22 bp, Homo sapiens
tccaggaggtttggaggaagca

SEQ ID NO: 7836399 - DNA, 22 bp, Homo sapiens
tccaggaggtttggaggaagca

SEQ ID NO: 7836400 - DNA, 22 bp, Homo sapiens
tccaggagtcctgggtggcccc

SEQ ID NO: 7836401 - DNA, 22 bp, Homo sapiens
tccaggagtctagcctcaggcc

SEQ ID NO: 7836402 - DNA, 22 bp, Homo sapiens
tccaggagtctagcctcaggcc

SEQ ID NO: 7836403 - DNA, 22 bp, Homo sapiens
tccaggagtctagcctcaggcc

SEQ ID NO: 7836404 - DNA, 22 bp, Homo sapiens
tccaggagtctagcctcaggcc

SEQ ID NO: 7836405 - DNA, 22 bp, Homo sapiens
tccaggagtctagcctcaggcc

SEQ ID NO: 7836406 - DNA, 22 bp, Homo sapiens
tccaggagtgataaggccactg

SEQ ID NO: 7836407 - DNA, 22 bp, Homo sapiens
tccaggagtcctgggagtgatt

SEQ ID NO: 7836408 - DNA, 22 bp, Homo sapiens
tccaggagtcctgggagtgatt

SEQ ID NO: 7836409 - DNA, 22 bp, Homo sapiens
tccaggagtcctgggagtgatt

SEQ ID NO: 7836410 - DNA, 22 bp, Homo sapiens
tccaggagtcctgggtggcccc

SEQ ID NO: 7836411 - DNA, 22 bp, Homo sapiens
tcccacacagcccgctcaccgg

SEQ ID NO: 7836412 - DNA, 22 bp, Homo sapiens
tcccacacagcccgctcaccgg

SEQ ID NO: 7836413 - DNA, 22 bp, Homo sapiens
tcccacacctgtctattcctag

SEQ ID NO: 7836414 - DNA, 22 bp, Homo sapiens
tcccacactacacggttgttgg

SEQ ID NO: 7836415 - DNA, 22 bp, Homo sapiens
tcccacacttgaaacaaggctg

SEQ ID NO: 7836416 - DNA, 22 bp, Homo sapiens
tcccacacttgaaacaaggctg

SEQ ID NO: 7836417 - DNA, 21 bp, Homo sapiens
tcccacagaaactgcgaaatt

SEQ ID NO: 7836418 - DNA, 22 bp, Homo sapiens
tcccaattaacaggtatcaggc

SEQ ID NO: 7836419 - DNA, 22 bp, Homo sapiens
tcccacacagcccgctcaccgg

SEQ ID NO: 7836420 - DNA, 22 bp, Homo sapiens
tcccacacagcccgctcaccgg

SEQ ID NO: 7836421 - DNA, 22 bp, Homo sapiens
tcccaagtagatgggaatacag

SEQ ID NO: 7836422 - DNA, 22 bp, Homo sapiens
tcccaatgtggtttctgcaaga

SEQ ID NO: 7836423 - DNA, 21 bp, Homo sapiens
tcccacagaaactgcgaaatt

SEQ ID NO: 7836424 - DNA, 22 bp, Homo sapiens
tcccacagaccatgagtggaag

SEQ ID NO: 7836425 - DNA, 22 bp, Homo sapiens
tcccacagaccatgagtggaag

SEQ ID NO: 7836426 - DNA, 22 bp, Homo sapiens
tcccacagatgctgtccagagt

SEQ ID NO: 7836427 - DNA, 22 bp, Homo sapiens
tcccacagatgctgtccagagt

SEQ ID NO: 7836428 - DNA, 22 bp, Homo sapiens
tcccacagagtggctcacctag

SEQ ID NO: 7836429 - DNA, 21 bp, Homo sapiens
tcccacagcgccagctcctgt

SEQ ID NO: 7836430 - DNA, 21 bp, Homo sapiens
tcccacagcgccagctcctgt

SEQ ID NO: 7836431 - DNA, 22 bp, Homo sapiens
tcccaaggtgctcggcaacagg

SEQ ID NO: 7836432 - DNA, 22 bp, Homo sapiens
tcccaaggtgctcggcaacagg

SEQ ID NO: 7836433 - DNA, 22 bp, Homo sapiens
tcccaaggccaggcatctagaa

SEQ ID NO: 7836434 - DNA, 22 bp, Homo sapiens
tcccaaggcctctagttgatta

SEQ ID NO: 7836435 - DNA, 22 bp, Homo sapiens
tcccaaggcctctagttgatta

SEQ ID NO: 7836436 - DNA, 20 bp, Homo sapiens
tcccaagggctgagaggatc

SEQ ID NO: 7836437 - DNA, 22 bp, Homo sapiens
tcccaaggccaggcatctagaa

SEQ ID NO: 7836438 - DNA, 22 bp, Homo sapiens
tcccaaggcacagggcagggac

SEQ ID NO: 7836439 - DNA, 22 bp, Homo sapiens
tcccaaggcacagggcagggac

SEQ ID NO: 7836440 - DNA, 20 bp, Homo sapiens
tcccaaggatgcctgggtgt

SEQ ID NO: 7836441 - DNA, 20 bp, Homo sapiens
tcccaaggatgcctgggtgt

SEQ ID NO: 7836442 - DNA, 20 bp, Homo sapiens
tcccaaggatgcctgggtgt

SEQ ID NO: 7836443 - DNA, 22 bp, Homo sapiens
tcccaaggataagagagtctga

SEQ ID NO: 7836444 - DNA, 22 bp, Homo sapiens
tcccaagcaatgagtcagggcc

SEQ ID NO: 7836445 - DNA, 22 bp, Homo sapiens
tccatgccaggcagtcgatgca

SEQ ID NO: 7836446 - DNA, 22 bp, Homo sapiens
tccatgcagaggagctggtggc

SEQ ID NO: 7836447 - DNA, 22 bp, Homo sapiens
tccatgcagaggagctggtggc

SEQ ID NO: 7836448 - DNA, 20 bp, Homo sapiens
tccatgcagtttccatacag

SEQ ID NO: 7836449 - DNA, 22 bp, Homo sapiens
tcccaagccctggatgcctcag

SEQ ID NO: 7836450 - DNA, 22 bp, Homo sapiens
tcccaagccctggatgcctcag

SEQ ID NO: 7836451 - DNA, 21 bp, Homo sapiens
tcccaagctgctggctcagct

SEQ ID NO: 7836452 - DNA, 21 bp, Homo sapiens
tcccaagctgctggctcagct

SEQ ID NO: 7836453 - DNA, 22 bp, Homo sapiens
tcccaagcttagggctctcagt

SEQ ID NO: 7836454 - DNA, 22 bp, Homo sapiens
tcccaagcttagggctctcagt

SEQ ID NO: 7836455 - DNA, 22 bp, Homo sapiens
tcccaagcttagggctctcagt

SEQ ID NO: 7836456 - DNA, 22 bp, Homo sapiens
tcccaagcttagggctctcagt

SEQ ID NO: 7836457 - DNA, 23 bp, Homo sapiens
tccatgagatgtgggcttctagt

SEQ ID NO: 7836458 - DNA, 23 bp, Homo sapiens
tccatgagatgtgggcttctagt

SEQ ID NO: 7836459 - DNA, 22 bp, Homo sapiens
tccatgagctagggattcatca

SEQ ID NO: 7836460 - DNA, 22 bp, Homo sapiens
tccatgaggcagggaggctggc

SEQ ID NO: 7836461 - DNA, 20 bp, Homo sapiens
tccatcttgggcagaagcag

SEQ ID NO: 7836462 - DNA, 22 bp, Homo sapiens
tccatgagaacccttggagata

SEQ ID NO: 7836463 - DNA, 22 bp, Homo sapiens
tccatgagaggtaactttacaa

SEQ ID NO: 7836464 - DNA, 22 bp, Homo sapiens
tccatgagggacactggatgct

SEQ ID NO: 7836465 - DNA, 20 bp, Homo sapiens
tccatgagttagagactata

SEQ ID NO: 7836466 - DNA, 22 bp, Homo sapiens
tccatgagtttgaggaaaagag

SEQ ID NO: 7836467 - DNA, 22 bp, Homo sapiens
tccatgcagagaactgaagtac

SEQ ID NO: 7836468 - DNA, 20 bp, Homo sapiens
tccatgcaaatacagagttt

SEQ ID NO: 7836469 - DNA, 20 bp, Homo sapiens
tccatgcaaatacagagttt

SEQ ID NO: 7836470 - DNA, 22 bp, Homo sapiens
tccatgcaaacagtggctagct

SEQ ID NO: 7836471 - DNA, 22 bp, Homo sapiens
tccatgcaaacagtggctagct

SEQ ID NO: 7836472 - DNA, 22 bp, Homo sapiens
tccatgatttgagcacatgccg

SEQ ID NO: 7836473 - DNA, 22 bp, Homo sapiens
tccatgattggtcatcatagaa

SEQ ID NO: 7836474 - DNA, 23 bp, Homo sapiens
tccatctgtgagcatgccctgga

SEQ ID NO: 7836475 - DNA, 23 bp, Homo sapiens
tccatctgtgagcatgccctgga

SEQ ID NO: 7836476 - DNA, 22 bp, Homo sapiens
tccatctgtttactataaagat

SEQ ID NO: 7836477 - DNA, 22 bp, Homo sapiens
tccatctgtttactataaagat

SEQ ID NO: 7836478 - DNA, 20 bp, Homo sapiens
tccatcttgggcagaagcag

SEQ ID NO: 7836479 - DNA, 20 bp, Homo sapiens
tccatcttgggcagaagcag

SEQ ID NO: 7836480 - DNA, 22 bp, Homo sapiens
tccatctgtctttcccatccac

SEQ ID NO: 7836481 - DNA, 22 bp, Homo sapiens
tccatctgtctttcccatccac

SEQ ID NO: 7836482 - DNA, 22 bp, Homo sapiens
tccatctgtcaaatatcatgct

SEQ ID NO: 7836483 - DNA, 22 bp, Homo sapiens
tccatctgtctttcccatccac

SEQ ID NO: 7836484 - DNA, 22 bp, Homo sapiens
tccatctgtcaaatatcatgct

SEQ ID NO: 7836485 - DNA, 22 bp, Homo sapiens
tccatctggtgagtgaggagcc

SEQ ID NO: 7836486 - DNA, 22 bp, Homo sapiens
tccatctggtgagtgaggagcc

SEQ ID NO: 7836487 - DNA, 22 bp, Homo sapiens
tccatctggtgagtgaggagcc

SEQ ID NO: 7836488 - DNA, 20 bp, Homo sapiens
tccatctggtataagctgat

SEQ ID NO: 7836489 - DNA, 22 bp, Homo sapiens
tccatctggtaaaattcattga

SEQ ID NO: 7836490 - DNA, 22 bp, Homo sapiens
tccatctggagacttcctggtc

SEQ ID NO: 7836491 - DNA, 22 bp, Homo sapiens
tccatctggatggtatgtgtaa

SEQ ID NO: 7836492 - DNA, 22 bp, Homo sapiens
tccatctggatggtatgtgtaa

SEQ ID NO: 7836493 - DNA, 22 bp, Homo sapiens
tccatctgcatttggtttctgt

SEQ ID NO: 7836494 - DNA, 22 bp, Homo sapiens
tccatccataccacttggagac

SEQ ID NO: 7836495 - DNA, 22 bp, Homo sapiens
tccatccataccacttggagac

SEQ ID NO: 7836496 - DNA, 22 bp, Homo sapiens
tccatccaggccagcagtaatc

SEQ ID NO: 7836497 - DNA, 22 bp, Homo sapiens
tccatccagattttaagtgctg

SEQ ID NO: 7836498 - DNA, 22 bp, Homo sapiens
tccatccatggatggaaatgtg

SEQ ID NO: 7836499 - DNA, 21 bp, Homo sapiens
tccatccatcagtccagccag

SEQ ID NO: 7836500 - DNA, 22 bp, Homo sapiens
tccatccatgtaggaagatggt

SEQ ID NO: 7836501 - DNA, 22 bp, Homo sapiens
tccatccatgtaggaagatggt

SEQ ID NO: 7836502 - DNA, 22 bp, Homo sapiens
tccatctacggctataccaccc

SEQ ID NO: 7836503 - DNA, 18 bp, Homo sapiens
tccatcctctgctcttca

SEQ ID NO: 7836504 - DNA, 22 bp, Homo sapiens
tccatccctgactcctcctgga

SEQ ID NO: 7836505 - DNA, 22 bp, Homo sapiens
tccatccattttctttgctgtt

SEQ ID NO: 7836506 - DNA, 22 bp, Homo sapiens
tccatccatttgagagtggagt

SEQ ID NO: 7836507 - DNA, 22 bp, Homo sapiens
tccaggctgcagtcttgccctc

SEQ ID NO: 7836508 - DNA, 22 bp, Homo sapiens
tccaggctgcaaggccacaggg

SEQ ID NO: 7836509 - DNA, 22 bp, Homo sapiens
tccaggctgcagtcttgccctc

SEQ ID NO: 7836510 - DNA, 22 bp, Homo sapiens
tccaggctgcagtcttgccctc

SEQ ID NO: 7836511 - DNA, 22 bp, Homo sapiens
tccaggctgccacagtgcaacg

SEQ ID NO: 7836512 - DNA, 22 bp, Homo sapiens
tccaggctgccacagtgcaacg

SEQ ID NO: 7836513 - DNA, 22 bp, Homo sapiens
tccaggctgccacagtgcaacg

SEQ ID NO: 7836514 - DNA, 22 bp, Homo sapiens
tccaggctgccacagtgcaacg

SEQ ID NO: 7836515 - DNA, 22 bp, Homo sapiens
tccaggctggaaatgtcaaact

SEQ ID NO: 7836516 - DNA, 22 bp, Homo sapiens
tccaggctggaaatgtcaaact

SEQ ID NO: 7836517 - DNA, 22 bp, Homo sapiens
tccaggctggaaatgtcaaact

SEQ ID NO: 7836518 - DNA, 21 bp, Homo sapiens
tccaggctggaaggggcgttg

SEQ ID NO: 7836519 - DNA, 22 bp, Homo sapiens
tccagggcagggtgcgcatggg

SEQ ID NO: 7836520 - DNA, 22 bp, Homo sapiens
tccagggcagggtgcgcatggg

SEQ ID NO: 7836521 - DNA, 22 bp, Homo sapiens
tccagggcagggtgcgcatggg

SEQ ID NO: 7836522 - DNA, 19 bp, Homo sapiens
tccagggcaggaacatgta

SEQ ID NO: 7836523 - DNA, 22 bp, Homo sapiens
tccagggccacagaggatgcta

SEQ ID NO: 7836524 - DNA, 22 bp, Homo sapiens
tccagggccacagaggatgcta

SEQ ID NO: 7836525 - DNA, 22 bp, Homo sapiens
tccagggccacagaggatgcta

SEQ ID NO: 7836526 - DNA, 22 bp, Homo sapiens
tccagggccaagtcatggaacc

SEQ ID NO: 7836527 - DNA, 22 bp, Homo sapiens
tccagggccaagtcatggaacc

SEQ ID NO: 7836528 - DNA, 19 bp, Homo sapiens
tccagggcaggaacatgta

SEQ ID NO: 7836529 - DNA, 19 bp, Homo sapiens
tccagggcaggaacatgta

SEQ ID NO: 7836530 - DNA, 19 bp, Homo sapiens
tccagggcaggaacatgta

SEQ ID NO: 7836531 - DNA, 19 bp, Homo sapiens
tccagggcaggaacatgta

SEQ ID NO: 7836532 - DNA, 19 bp, Homo sapiens
tccagggcaggaacatgta

SEQ ID NO: 7836533 - DNA, 19 bp, Homo sapiens
tccagggcaggaacatgta

SEQ ID NO: 7836534 - DNA, 19 bp, Homo sapiens
tccagggcaggaacatgta

SEQ ID NO: 7836535 - DNA, 22 bp, Homo sapiens
tccaggctggaaatgtcaaact

SEQ ID NO: 7836536 - DNA, 22 bp, Homo sapiens
tccagggcagccgcgggtgcgc

SEQ ID NO: 7836537 - DNA, 22 bp, Homo sapiens
tccagggcagccgcgggtgcgc

SEQ ID NO: 7836538 - DNA, 22 bp, Homo sapiens
tccagggccacagaggatgcta

SEQ ID NO: 7836539 - DNA, 22 bp, Homo sapiens
tccagggccacagaggatgcta

SEQ ID NO: 7836540 - DNA, 22 bp, Homo sapiens
tccagggccacagaggatgcta

SEQ ID NO: 7836541 - DNA, 22 bp, Homo sapiens
tccagggccacagaggatgcta

SEQ ID NO: 7836542 - DNA, 22 bp, Homo sapiens
tccagggccacagaggatgcta

SEQ ID NO: 7836543 - DNA, 22 bp, Homo sapiens
tccagggccacagaggatgcta

SEQ ID NO: 7836544 - DNA, 22 bp, Homo sapiens
tccagggccacagaggatgcta

SEQ ID NO: 7836545 - DNA, 22 bp, Homo sapiens
tccagggccatctccatgaggc

SEQ ID NO: 7836546 - DNA, 22 bp, Homo sapiens
tccagggccatgaagttgcaca

SEQ ID NO: 7836547 - DNA, 22 bp, Homo sapiens
tccagggccatctccatgaggc

SEQ ID NO: 7836548 - DNA, 22 bp, Homo sapiens
tccagggccatctccatgaggc

SEQ ID NO: 7836549 - DNA, 22 bp, Homo sapiens
tccagggccagtccttgtctgt

SEQ ID NO: 7836550 - DNA, 22 bp, Homo sapiens
tccagggccagtccttgtctgt

SEQ ID NO: 7836551 - DNA, 22 bp, Homo sapiens
tccagggccagtccttgtctgt

SEQ ID NO: 7836552 - DNA, 22 bp, Homo sapiens
tccagggccatctccatgaggc

SEQ ID NO: 7836553 - DNA, 22 bp, Homo sapiens
tccagggccatctccatgaggc

SEQ ID NO: 7836554 - DNA, 20 bp, Homo sapiens
tccagggccctggctcctct

SEQ ID NO: 7836555 - DNA, 20 bp, Homo sapiens
tccagggccctggctcctct

SEQ ID NO: 7836556 - DNA, 20 bp, Homo sapiens
tccagggccctggctcctct

SEQ ID NO: 7836557 - DNA, 20 bp, Homo sapiens
tccagggccctggctcctct

SEQ ID NO: 7836558 - DNA, 22 bp, Homo sapiens
tccagggccccccagttgcacg

SEQ ID NO: 7836559 - DNA, 20 bp, Homo sapiens
tccagggccctggctcctct

SEQ ID NO: 7836560 - DNA, 20 bp, Homo sapiens
tccagggccctggctcctct

SEQ ID NO: 7836561 - DNA, 22 bp, Homo sapiens
tccagggccccccagttgcacg

SEQ ID NO: 7836562 - DNA, 22 bp, Homo sapiens
tccagggccccccagttgcacg

SEQ ID NO: 7836563 - DNA, 22 bp, Homo sapiens
tccagggccccccagttgcacg

SEQ ID NO: 7836564 - DNA, 22 bp, Homo sapiens
tccagggccccccagttgcacg

SEQ ID NO: 7836565 - DNA, 22 bp, Homo sapiens
tccagggccccccagttgcacg

SEQ ID NO: 7836566 - DNA, 22 bp, Homo sapiens
tccagggccatgaagttgcaca

SEQ ID NO: 7836567 - DNA, 22 bp, Homo sapiens
tccagggccatgaagttgcaca

SEQ ID NO: 7836568 - DNA, 22 bp, Homo sapiens
tccagggccatgaagttgcaca

SEQ ID NO: 7836569 - DNA, 22 bp, Homo sapiens
tccagggccatgaagttgcaca

SEQ ID NO: 7836570 - DNA, 22 bp, Homo sapiens
tccagggccatgaagttgcaca

SEQ ID NO: 7836571 - DNA, 22 bp, Homo sapiens
tccatcagcatgcaggctgttc

SEQ ID NO: 7836572 - DNA, 22 bp, Homo sapiens
tccatcagattccctcctgaga

SEQ ID NO: 7836573 - DNA, 22 bp, Homo sapiens
tccatcactattatctacaaca

SEQ ID NO: 7836574 - DNA, 22 bp, Homo sapiens
tccatcacgtaggcatgattga

SEQ ID NO: 7836575 - DNA, 22 bp, Homo sapiens
tccatcaccatttctgcgagct

SEQ ID NO: 7836576 - DNA, 22 bp, Homo sapiens
tccagtttatttttggcagggt

SEQ ID NO: 7836577 - DNA, 22 bp, Homo sapiens
tccagtttattatgcatttaca

SEQ ID NO: 7836578 - DNA, 22 bp, Homo sapiens
tccagtttatttttggcagggt

SEQ ID NO: 7836579 - DNA, 22 bp, Homo sapiens
tccagtttccaatcactgcacg

SEQ ID NO: 7836580 - DNA, 22 bp, Homo sapiens
tccagtttcatagctaaggaac

SEQ ID NO: 7836581 - DNA, 22 bp, Homo sapiens
tccagtttccaatcactgcacg

SEQ ID NO: 7836582 - DNA, 22 bp, Homo sapiens
tccatcatggcagcagcagtga

SEQ ID NO: 7836583 - DNA, 22 bp, Homo sapiens
tccatcaggctcgtgggctctc

SEQ ID NO: 7836584 - DNA, 22 bp, Homo sapiens
tccatcagcatgcaggctgttc

SEQ ID NO: 7836585 - DNA, 22 bp, Homo sapiens
tccatcaggctcgtgggctctc

SEQ ID NO: 7836586 - DNA, 22 bp, Homo sapiens
tccatccaccctgcattatatt

SEQ ID NO: 7836587 - DNA, 22 bp, Homo sapiens
tccatccacattaacagatacg

SEQ ID NO: 7836588 - DNA, 20 bp, Homo sapiens
tccagggctagggagctcat

SEQ ID NO: 7836589 - DNA, 20 bp, Homo sapiens
tccagggctagggagctcat

SEQ ID NO: 7836590 - DNA, 22 bp, Homo sapiens
tccagggctcattccctctgca

SEQ ID NO: 7836591 - DNA, 22 bp, Homo sapiens
tccagggctcattccctctgca

SEQ ID NO: 7836592 - DNA, 22 bp, Homo sapiens
tccagggctcattccctctgca

SEQ ID NO: 7836593 - DNA, 22 bp, Homo sapiens
tccagggctcattccctctgca

SEQ ID NO: 7836594 - DNA, 22 bp, Homo sapiens
tccagggctcattccctctgca

SEQ ID NO: 7836595 - DNA, 22 bp, Homo sapiens
tccagttgcccatctctcttct

SEQ ID NO: 7836596 - DNA, 22 bp, Homo sapiens
tccagggctccccaacatccag

SEQ ID NO: 7836597 - DNA, 20 bp, Homo sapiens
tccagggccctggctcctct

SEQ ID NO: 7836598 - DNA, 20 bp, Homo sapiens
tccagggccctggctcctct

SEQ ID NO: 7836599 - DNA, 22 bp, Homo sapiens
tccagggcctgaggttgaagtg

SEQ ID NO: 7836600 - DNA, 22 bp, Homo sapiens
tccagggcctgaggttgaagtg

SEQ ID NO: 7836601 - DNA, 22 bp, Homo sapiens
tccagggcctgaggttgaagtg

SEQ ID NO: 7836602 - DNA, 22 bp, Homo sapiens
tccagggcctgaggttgaagtg

SEQ ID NO: 7836603 - DNA, 22 bp, Homo sapiens
tccagggcctgaggttgaagtg

SEQ ID NO: 7836604 - DNA, 22 bp, Homo sapiens
tccagggcctgaggttgaagtg

SEQ ID NO: 7836605 - DNA, 22 bp, Homo sapiens
tccagggccttacctcttcaga

SEQ ID NO: 7836606 - DNA, 22 bp, Homo sapiens
tccagggccttacctcttcaga

SEQ ID NO: 7836607 - DNA, 22 bp, Homo sapiens
tccagggccttacctcttcaga

SEQ ID NO: 7836608 - DNA, 22 bp, Homo sapiens
tccagggcgtgtgtgaaggaaa

SEQ ID NO: 7836609 - DNA, 22 bp, Homo sapiens
tccagggcgtgtgtgaaggaaa

SEQ ID NO: 7836610 - DNA, 22 bp, Homo sapiens
tccagggcgtgtgtgaaggaaa

SEQ ID NO: 7836611 - DNA, 21 bp, Homo sapiens
tccagggcgggcgcacggaga

SEQ ID NO: 7836612 - DNA, 21 bp, Homo sapiens
tccagggcgggcgcacggaga

SEQ ID NO: 7836613 - DNA, 20 bp, Homo sapiens
tccagggctagggagctcat

SEQ ID NO: 7836614 - DNA, 20 bp, Homo sapiens
tccagggctagggagctcat

SEQ ID NO: 7836615 - DNA, 20 bp, Homo sapiens
tccagggctagggagctcat

SEQ ID NO: 7836616 - DNA, 20 bp, Homo sapiens
tccagggctagggagctcat

SEQ ID NO: 7836617 - DNA, 20 bp, Homo sapiens
tccagggctagggagctcat

SEQ ID NO: 7836618 - DNA, 20 bp, Homo sapiens
tccagggctagggagctcat

SEQ ID NO: 7836619 - DNA, 22 bp, Homo sapiens
tccagggctacaaggcaccaga

SEQ ID NO: 7836620 - DNA, 22 bp, Homo sapiens
tccagggcgtgtgtgaaggaaa

SEQ ID NO: 7836621 - DNA, 22 bp, Homo sapiens
tccagggctacaaggcaccaga

SEQ ID NO: 7836622 - DNA, 22 bp, Homo sapiens
tccagggctacaaggcaccaga

SEQ ID NO: 7836623 - DNA, 22 bp, Homo sapiens
tccagggctacaaggcaccaga

SEQ ID NO: 7836624 - DNA, 22 bp, Homo sapiens
tccagggctacaaggcaccaga

SEQ ID NO: 7836625 - DNA, 22 bp, Homo sapiens
taactcttccaacactccttcc

SEQ ID NO: 7836626 - DNA, 22 bp, Homo sapiens
taactctttactatacatttat

SEQ ID NO: 7836627 - DNA, 22 bp, Homo sapiens
taactgaaaatccctcttctcc

SEQ ID NO: 7836628 - DNA, 19 bp, Homo sapiens
taactctttccttttcccc

SEQ ID NO: 7836629 - DNA, 22 bp, Homo sapiens
taactgaacatctcaaatcaag

SEQ ID NO: 7836630 - DNA, 22 bp, Homo sapiens
taactgaacatctcaaatcaag

SEQ ID NO: 7836631 - DNA, 22 bp, Homo sapiens
taactgaatgtattacaacaga

SEQ ID NO: 7836632 - DNA, 22 bp, Homo sapiens
taactgatattgaaaaacatca

SEQ ID NO: 7836633 - DNA, 22 bp, Homo sapiens
taactgatgtgaacttaccatt

SEQ ID NO: 7836634 - DNA, 22 bp, Homo sapiens
taactgatgttcccttactgta

SEQ ID NO: 7836635 - DNA, 22 bp, Homo sapiens
taactgattcctttttgaaaat

SEQ ID NO: 7836636 - DNA, 22 bp, Homo sapiens
taactcaaatacttatgttact

SEQ ID NO: 7836637 - DNA, 22 bp, Homo sapiens
taactcaaatatgttgtctgaa

SEQ ID NO: 7836638 - DNA, 22 bp, Homo sapiens
taactcaacttggagggttctt

SEQ ID NO: 7836639 - DNA, 22 bp, Homo sapiens
taactcactccaaaaaggcatt

SEQ ID NO: 7836640 - DNA, 22 bp, Homo sapiens
taactcatggagaggcggagtt

SEQ ID NO: 7836641 - DNA, 22 bp, Homo sapiens
taactcaaaatgcacctgctga

SEQ ID NO: 7836642 - DNA, 22 bp, Homo sapiens
taactaggattacaagcgtgcg

SEQ ID NO: 7836643 - DNA, 22 bp, Homo sapiens
taactaggattacaagcgtgcg

SEQ ID NO: 7836644 - DNA, 22 bp, Homo sapiens
taactctgaatcctcacagcag

SEQ ID NO: 7836645 - DNA, 22 bp, Homo sapiens
taactctagtcccaggcatgaa

SEQ ID NO: 7836646 - DNA, 22 bp, Homo sapiens
taactctcacagtgcaacatga

SEQ ID NO: 7836647 - DNA, 22 bp, Homo sapiens
taactctagtcccaggcatgaa

SEQ ID NO: 7836648 - DNA, 22 bp, Homo sapiens
taactcccaacatcatggctct

SEQ ID NO: 7836649 - DNA, 22 bp, Homo sapiens
taactccattttacagagtagg

SEQ ID NO: 7836650 - DNA, 22 bp, Homo sapiens
taactcccaacatcatggctct

SEQ ID NO: 7836651 - DNA, 22 bp, Homo sapiens
taactccatctctgtgtctgct

SEQ ID NO: 7836652 - DNA, 22 bp, Homo sapiens
taactccatctctgtgtctgct

SEQ ID NO: 7836653 - DNA, 22 bp, Homo sapiens
taactccacacccctcttggtg

SEQ ID NO: 7836654 - DNA, 22 bp, Homo sapiens
taactccacacccctcttggtg

SEQ ID NO: 7836655 - DNA, 22 bp, Homo sapiens
taactccagagaatccatccat

SEQ ID NO: 7836656 - DNA, 22 bp, Homo sapiens
taactacatttcactgcaatta

SEQ ID NO: 7836657 - DNA, 22 bp, Homo sapiens
taactacatttcactgcaatta

SEQ ID NO: 7836658 - DNA, 22 bp, Homo sapiens
taactacatttcactgcaatta

SEQ ID NO: 7836659 - DNA, 22 bp, Homo sapiens
taactactaattgatgataatg

SEQ ID NO: 7836660 - DNA, 22 bp, Homo sapiens
taactagaatggctattttgag

SEQ ID NO: 7836661 - DNA, 22 bp, Homo sapiens
taactagaatggctattttgag

SEQ ID NO: 7836662 - DNA, 22 bp, Homo sapiens
taactagatgtgagaatattca

SEQ ID NO: 7836663 - DNA, 22 bp, Homo sapiens
taactagatatagactttctac

SEQ ID NO: 7836664 - DNA, 20 bp, Homo sapiens
taacggaagctgtaaaatct

SEQ ID NO: 7836665 - DNA, 22 bp, Homo sapiens
taactaagtgactcaagtgatc

SEQ ID NO: 7836666 - DNA, 22 bp, Homo sapiens
taactacaagggcggtctctgt

SEQ ID NO: 7836667 - DNA, 22 bp, Homo sapiens
taacctgactgctctttagaat

SEQ ID NO: 7836668 - DNA, 22 bp, Homo sapiens
taacctgactgctctttagaat

SEQ ID NO: 7836669 - DNA, 22 bp, Homo sapiens
taacctgactgctctttagaat

SEQ ID NO: 7836670 - DNA, 22 bp, Homo sapiens
taacctgaggagaacagtgctt

SEQ ID NO: 7836671 - DNA, 23 bp, Homo sapiens
taacctgagattgcaagggagct

SEQ ID NO: 7836672 - DNA, 23 bp, Homo sapiens
taacctgagattgcaagggagct

SEQ ID NO: 7836673 - DNA, 23 bp, Homo sapiens
taacctgagattgcaagggagct

SEQ ID NO: 7836674 - DNA, 23 bp, Homo sapiens
taacctgagttttttagatgcaa

SEQ ID NO: 7836675 - DNA, 23 bp, Homo sapiens
taacctgagttttttagatgcaa

SEQ ID NO: 7836676 - DNA, 23 bp, Homo sapiens
taacctgagttttttagatgcaa

SEQ ID NO: 7836677 - DNA, 22 bp, Homo sapiens
taacctgaggagaacagtgctt

SEQ ID NO: 7836678 - DNA, 22 bp, Homo sapiens
taacctctgagctccagcttct

SEQ ID NO: 7836679 - DNA, 22 bp, Homo sapiens
taacctgaggagaacagtgctt

SEQ ID NO: 7836680 - DNA, 22 bp, Homo sapiens
taaatttacccaaggaacatgt

SEQ ID NO: 7836681 - DNA, 22 bp, Homo sapiens
taaatttacccaaggaacatgt

SEQ ID NO: 7836682 - DNA, 22 bp, Homo sapiens
taaattgttttctagaagttgt

SEQ ID NO: 7836683 - DNA, 22 bp, Homo sapiens
taaattgtggccatttgtgttt

SEQ ID NO: 7836684 - DNA, 22 bp, Homo sapiens
taaattgcataagtacaaatga

SEQ ID NO: 7836685 - DNA, 22 bp, Homo sapiens
taaattgagattattagggtaa

SEQ ID NO: 7836686 - DNA, 23 bp, Homo sapiens
taaattgatggtatgggttaagc

SEQ ID NO: 7836687 - DNA, 22 bp, Homo sapiens
taaattcagtgagtaatttctg

SEQ ID NO: 7836688 - DNA, 22 bp, Homo sapiens
taaattcagtgagtaatttctg

SEQ ID NO: 7836689 - DNA, 22 bp, Homo sapiens
taaattcactcctggtagacct

SEQ ID NO: 7836690 - DNA, 22 bp, Homo sapiens
taaattcactcctggtagacct

SEQ ID NO: 7836691 - DNA, 22 bp, Homo sapiens
taaattcagtgagtaatttctg

SEQ ID NO: 7836692 - DNA, 22 bp, Homo sapiens
taaattcccaactctgctcttc

SEQ ID NO: 7836693 - DNA, 22 bp, Homo sapiens
taaattcagtgagtaatttctg

SEQ ID NO: 7836694 - DNA, 22 bp, Homo sapiens
taaattcagtgagtaatttctg

SEQ ID NO: 7836695 - DNA, 22 bp, Homo sapiens
taaattgaaaatctacagaaca

SEQ ID NO: 7836696 - DNA, 22 bp, Homo sapiens
taaattgaaaatctacagaaca

SEQ ID NO: 7836697 - DNA, 22 bp, Homo sapiens
taaattgaaaatctacagaaca

SEQ ID NO: 7836698 - DNA, 22 bp, Homo sapiens
taaatttttgttaacagcctct

SEQ ID NO: 7836699 - DNA, 22 bp, Homo sapiens
taaatttttgttaacagcctct

SEQ ID NO: 7836700 - DNA, 22 bp, Homo sapiens
taaatttttgttaacagcctct

SEQ ID NO: 7836701 - DNA, 22 bp, Homo sapiens
taacattaaaagagataattga

SEQ ID NO: 7836702 - DNA, 22 bp, Homo sapiens
taaatttacccaaggaacatgt

SEQ ID NO: 7836703 - DNA, 23 bp, Homo sapiens
taaatttcttgattcttatgtga

SEQ ID NO: 7836704 - DNA, 23 bp, Homo sapiens
taaatttcttgattcttatgtga

SEQ ID NO: 7836705 - DNA, 22 bp, Homo sapiens
taacattaaaagagataattga

SEQ ID NO: 7836706 - DNA, 22 bp, Homo sapiens
taacattaaaagagataattga

SEQ ID NO: 7836707 - DNA, 22 bp, Homo sapiens
taacattacagacaccttgtgt

SEQ ID NO: 7836708 - DNA, 22 bp, Homo sapiens
taacattaaaagagataattga

SEQ ID NO: 7836709 - DNA, 22 bp, Homo sapiens
taaccaaagggcctaaggaatg

SEQ ID NO: 7836710 - DNA, 22 bp, Homo sapiens
taacattacggacatctgtcag

SEQ ID NO: 7836711 - DNA, 22 bp, Homo sapiens
taaccatattttccattaagtt

SEQ ID NO: 7836712 - DNA, 22 bp, Homo sapiens
taaccagcatgaaatctgcagc

SEQ ID NO: 7836713 - DNA, 22 bp, Homo sapiens
taaccagacagaaacagctaga

SEQ ID NO: 7836714 - DNA, 22 bp, Homo sapiens
taacattacggacatctgtcag

SEQ ID NO: 7836715 - DNA, 20 bp, Homo sapiens
taaccaagaattggcaaggg

SEQ ID NO: 7836716 - DNA, 22 bp, Homo sapiens
taaccaataaccaataagatac

SEQ ID NO: 7836717 - DNA, 22 bp, Homo sapiens
taaccatgcatgtctctagttt

SEQ ID NO: 7836718 - DNA, 22 bp, Homo sapiens
taaccatattttccattaagtt

SEQ ID NO: 7836719 - DNA, 22 bp, Homo sapiens
taaccccgccctcaatgtgaat

SEQ ID NO: 7836720 - DNA, 22 bp, Homo sapiens
taacccgtgttactggcataag

SEQ ID NO: 7836721 - DNA, 22 bp, Homo sapiens
taacctgaacacacaataggga

SEQ ID NO: 7836722 - DNA, 22 bp, Homo sapiens
taacctgaacacacaataggga

SEQ ID NO: 7836723 - DNA, 22 bp, Homo sapiens
taacctgaacacacaataggga

SEQ ID NO: 7836724 - DNA, 22 bp, Homo sapiens
taaagtatccagttattcttct

SEQ ID NO: 7836725 - DNA, 22 bp, Homo sapiens
taaagtatccagttattcttct

SEQ ID NO: 7836726 - DNA, 22 bp, Homo sapiens
taaagtcaaggtactgtttcac

SEQ ID NO: 7836727 - DNA, 22 bp, Homo sapiens
taaagtcaaggtactgtttcac

SEQ ID NO: 7836728 - DNA, 22 bp, Homo sapiens
taaagtgcccagggaaagcggg

SEQ ID NO: 7836729 - DNA, 22 bp, Homo sapiens
taaagtatattttttctcaata

SEQ ID NO: 7836730 - DNA, 22 bp, Homo sapiens
taaagtatccagttattcttct

SEQ ID NO: 7836731 - DNA, 22 bp, Homo sapiens
taaagtatattttttctcaata

SEQ ID NO: 7836732 - DNA, 22 bp, Homo sapiens
taaagtatattttttctcaata

SEQ ID NO: 7836733 - DNA, 22 bp, Homo sapiens
taaagtgcttatgataaccaag

SEQ ID NO: 7836734 - DNA, 22 bp, Homo sapiens
taaagtgctgggattataggcc

SEQ ID NO: 7836735 - DNA, 22 bp, Homo sapiens
taaagtgctggatttgagtaaa

SEQ ID NO: 7836736 - DNA, 22 bp, Homo sapiens
taaagtgctggatttgagtaaa

SEQ ID NO: 7836737 - DNA, 22 bp, Homo sapiens
taaagtgctggatttgagtaaa

SEQ ID NO: 7836738 - DNA, 23 bp, Homo sapiens
taaagtgctgatggtgagggagc

SEQ ID NO: 7836739 - DNA, 22 bp, Homo sapiens
taaagtgctcataaaaatggat

SEQ ID NO: 7836740 - DNA, 22 bp, Homo sapiens
taaagtgcgacccagtccccag

SEQ ID NO: 7836741 - DNA, 22 bp, Homo sapiens
taaagtgcctcaggtcctgggt

SEQ ID NO: 7836742 - DNA, 22 bp, Homo sapiens
taaagtataagcattggagtat

SEQ ID NO: 7836743 - DNA, 22 bp, Homo sapiens
taaagtataagcattggagtat

SEQ ID NO: 7836744 - DNA, 22 bp, Homo sapiens
taaagtagcaagtttagactga

SEQ ID NO: 7836745 - DNA, 22 bp, Homo sapiens
taaagtagcaagtttagactga

SEQ ID NO: 7836746 - DNA, 22 bp, Homo sapiens
taaagtagcaagtttagactga

SEQ ID NO: 7836747 - DNA, 22 bp, Homo sapiens
taaagtaatccttcataaggag

SEQ ID NO: 7836748 - DNA, 22 bp, Homo sapiens
taaagtaatccttcataaggag

SEQ ID NO: 7836749 - DNA, 22 bp, Homo sapiens
taaaggttagtagcagggaaac

SEQ ID NO: 7836750 - DNA, 22 bp, Homo sapiens
taaaggttataaaggttagggg

SEQ ID NO: 7836751 - DNA, 22 bp, Homo sapiens
taaaggtagtgtgacatattgt

SEQ ID NO: 7836752 - DNA, 22 bp, Homo sapiens
taaaggtagtgtgacatattgt

SEQ ID NO: 7836753 - DNA, 22 bp, Homo sapiens
taaaggtatgtcttaatcaaac

SEQ ID NO: 7836754 - DNA, 22 bp, Homo sapiens
taaattatgtcacatgactctg

SEQ ID NO: 7836755 - DNA, 22 bp, Homo sapiens
taaattatgttccatgtccttt

SEQ ID NO: 7836756 - DNA, 22 bp, Homo sapiens
taaattcactcctggtagacct

SEQ ID NO: 7836757 - DNA, 22 bp, Homo sapiens
taaattatgttccatgtccttt

SEQ ID NO: 7836758 - DNA, 22 bp, Homo sapiens
taaattatgttccatgtccttt

SEQ ID NO: 7836759 - DNA, 22 bp, Homo sapiens
taaattagggactttagttaat

SEQ ID NO: 7836760 - DNA, 22 bp, Homo sapiens
taaattagggactttagttaat

SEQ ID NO: 7836761 - DNA, 20 bp, Homo sapiens
taaattagccttgaagatta

SEQ ID NO: 7836762 - DNA, 20 bp, Homo sapiens
taaattagccttgaagatta

SEQ ID NO: 7836763 - DNA, 20 bp, Homo sapiens
taaattagccttgaagatta

SEQ ID NO: 7836764 - DNA, 20 bp, Homo sapiens
taaattagccttgaagatta

SEQ ID NO: 7836765 - DNA, 20 bp, Homo sapiens
taaattagccttgaagatta

SEQ ID NO: 7836766 - DNA, 20 bp, Homo sapiens
taaattagccttgaagatta

SEQ ID NO: 7836767 - DNA, 22 bp, Homo sapiens
taaattatggctggcagagcag

SEQ ID NO: 7836768 - DNA, 22 bp, Homo sapiens
taaattatggctggcagagcag

SEQ ID NO: 7836769 - DNA, 20 bp, Homo sapiens
taaattagccttgaagatta

SEQ ID NO: 7836770 - DNA, 22 bp, Homo sapiens
taaattatggctggcagagcag

SEQ ID NO: 7836771 - DNA, 22 bp, Homo sapiens
taaattatggctggcagagcag

SEQ ID NO: 7836772 - DNA, 22 bp, Homo sapiens
taaattagggactttagttaat

SEQ ID NO: 7836773 - DNA, 22 bp, Homo sapiens
taaattagggactttagttaat

SEQ ID NO: 7836774 - DNA, 22 bp, Homo sapiens
taaattagagccaggtaagttt

SEQ ID NO: 7836775 - DNA, 22 bp, Homo sapiens
taaattagagccaggtaagttt

SEQ ID NO: 7836776 - DNA, 22 bp, Homo sapiens
taaattagagccaggtaagttt

SEQ ID NO: 7836777 - DNA, 20 bp, Homo sapiens
taaattagccttgaagatta

SEQ ID NO: 7836778 - DNA, 22 bp, Homo sapiens
taaattactcaatgcacataaa

SEQ ID NO: 7836779 - DNA, 22 bp, Homo sapiens
taaattactcaatgcacataaa

SEQ ID NO: 7836780 - DNA, 23 bp, Homo sapiens
taaattacctttccagtgcaggg

SEQ ID NO: 7836781 - DNA, 22 bp, Homo sapiens
taaattaccctttagggaattg

SEQ ID NO: 7836782 - DNA, 23 bp, Homo sapiens
taaattacctttccagtgcaggg

SEQ ID NO: 7836783 - DNA, 22 bp, Homo sapiens
taaagtgcttcctaacccagag

SEQ ID NO: 7836784 - DNA, 22 bp, Homo sapiens
taaagtggtggtgctaatgtat

SEQ ID NO: 7836785 - DNA, 22 bp, Homo sapiens
taaagtgcttcctaacccagag

SEQ ID NO: 7836786 - DNA, 22 bp, Homo sapiens
taaagtgcttatgataaccaag

SEQ ID NO: 7836787 - DNA, 22 bp, Homo sapiens
taaagtgtatgccatctctcat

SEQ ID NO: 7836788 - DNA, 22 bp, Homo sapiens
taaagtgtctgcctcagctcag

SEQ ID NO: 7836789 - DNA, 22 bp, Homo sapiens
taaagtgtctgcctcagctcag

SEQ ID NO: 7836790 - DNA, 22 bp, Homo sapiens
taaagtgtgcatggtcaaatat

SEQ ID NO: 7836791 - DNA, 22 bp, Homo sapiens
taaagtgtgcatggtcaaatat

SEQ ID NO: 7836792 - DNA, 22 bp, Homo sapiens
taaattaaagattggagaagga

SEQ ID NO: 7836793 - DNA, 22 bp, Homo sapiens
taaattaaagattggagaagga

SEQ ID NO: 7836794 - DNA, 22 bp, Homo sapiens
taaaatgatctctcatgttctt

SEQ ID NO: 7836795 - DNA, 22 bp, Homo sapiens
taaaatgatctctcatgttctt

SEQ ID NO: 7836796 - DNA, 22 bp, Homo sapiens
taaaatagaggatgtcatgcta

SEQ ID NO: 7836797 - DNA, 22 bp, Homo sapiens
taaaatagaggatgtcatgcta

SEQ ID NO: 7836798 - DNA, 22 bp, Homo sapiens
taaaatagaggatgtcatgcta

SEQ ID NO: 7836799 - DNA, 22 bp, Homo sapiens
taaaatgccagaccagttcacg

SEQ ID NO: 7836800 - DNA, 22 bp, Homo sapiens
taaaatggtaactttcatttgc

SEQ ID NO: 7836801 - DNA, 22 bp, Homo sapiens
taaaatggtaactttcatttgc

SEQ ID NO: 7836802 - DNA, 22 bp, Homo sapiens
taaaatggtaactttcatttgc

SEQ ID NO: 7836803 - DNA, 22 bp, Homo sapiens
taaaatgtagcttctaggctgg

SEQ ID NO: 7836804 - DNA, 22 bp, Homo sapiens
taaaatgtagcttctaggctgg

SEQ ID NO: 7836805 - DNA, 19 bp, Homo sapiens
taaaatgtctgtggtcagt

SEQ ID NO: 7836806 - DNA, 22 bp, Homo sapiens
taaaatgtgtttctgtatggtt

SEQ ID NO: 7836807 - DNA, 22 bp, Homo sapiens
taaaatgtgtttctgtatggtt

SEQ ID NO: 7836808 - DNA, 19 bp, Homo sapiens
taaaatgtctgtggtcagt

SEQ ID NO: 7836809 - DNA, 22 bp, Homo sapiens
taaaatgccagaccagttcacg

SEQ ID NO: 7836810 - DNA, 19 bp, Homo sapiens
taaaatgtctgtggtcagt

SEQ ID NO: 7836811 - DNA, 19 bp, Homo sapiens
taaaatgtctgtggtcagt

SEQ ID NO: 7836812 - DNA, 22 bp, Homo sapiens
gtttttatctaatagcagttat

SEQ ID NO: 7836813 - DNA, 22 bp, Homo sapiens
gtttttatctaatagcagttat

SEQ ID NO: 7836814 - DNA, 22 bp, Homo sapiens
gtttttattgtgtaaatgtggg

SEQ ID NO: 7836815 - DNA, 22 bp, Homo sapiens
gtttttattgtgtaaatgtggg

SEQ ID NO: 7836816 - DNA, 22 bp, Homo sapiens
gtttttattgtgtaaatgtggg

SEQ ID NO: 7836817 - DNA, 22 bp, Homo sapiens
gtttttattgtgtaaatgtggg

SEQ ID NO: 7836818 - DNA, 22 bp, Homo sapiens
gtttttattgtgtaaatgtggg

SEQ ID NO: 7836819 - DNA, 22 bp, Homo sapiens
taaaagttttagttgtacataa

SEQ ID NO: 7836820 - DNA, 22 bp, Homo sapiens
taaaagttttagttgtacataa

SEQ ID NO: 7836821 - DNA, 22 bp, Homo sapiens
gtttttactaaggttgctaagt

SEQ ID NO: 7836822 - DNA, 22 bp, Homo sapiens
gtttttatatcctgtggagtgt

SEQ ID NO: 7836823 - DNA, 22 bp, Homo sapiens
gtttttatatcctgtggagtgt

SEQ ID NO: 7836824 - DNA, 22 bp, Homo sapiens
gttttgttttgagtcaactcca

SEQ ID NO: 7836825 - DNA, 22 bp, Homo sapiens
gttttgttttgagtcaactcca

SEQ ID NO: 7836826 - DNA, 22 bp, Homo sapiens
gttttgttttgagtcaactcca

SEQ ID NO: 7836827 - DNA, 19 bp, Homo sapiens
gttttgtttgcagaactta

SEQ ID NO: 7836828 - DNA, 19 bp, Homo sapiens
gttttgtttgcagaactta

SEQ ID NO: 7836829 - DNA, 19 bp, Homo sapiens
gttttgtttgcagaactta

SEQ ID NO: 7836830 - DNA, 22 bp, Homo sapiens
gttttgttgctgcagagctcaa

SEQ ID NO: 7836831 - DNA, 22 bp, Homo sapiens
taaaatgtgtttctgtatggtt

SEQ ID NO: 7836832 - DNA, 22 bp, Homo sapiens
taaaatgtgtttctgtatggtt

SEQ ID NO: 7836833 - DNA, 22 bp, Homo sapiens
taaaatgtttgcaagagaccag

SEQ ID NO: 7836834 - DNA, 22 bp, Homo sapiens
taaaatgtttgcaagagaccag

SEQ ID NO: 7836835 - DNA, 18 bp, Homo sapiens
taaaattcaaggcagggt

SEQ ID NO: 7836836 - DNA, 22 bp, Homo sapiens
taaaatgtttgcaagagaccag

SEQ ID NO: 7836837 - DNA, 18 bp, Homo sapiens
taaaattcaaggcagggt

SEQ ID NO: 7836838 - DNA, 22 bp, Homo sapiens
taaaattgcggtgaatatttcc

SEQ ID NO: 7836839 - DNA, 22 bp, Homo sapiens
taaaattgcggtgaatatttcc

SEQ ID NO: 7836840 - DNA, 22 bp, Homo sapiens
taaaattgcggtgaatatttcc

SEQ ID NO: 7836841 - DNA, 22 bp, Homo sapiens
taaaattgcggtgaatatttcc

SEQ ID NO: 7836842 - DNA, 22 bp, Homo sapiens
taaaattgcggtgaatatttcc

SEQ ID NO: 7836843 - DNA, 22 bp, Homo sapiens
taaaattgcggtgaatatttcc

SEQ ID NO: 7836844 - DNA, 22 bp, Homo sapiens
taaaattgcggtgaatatttcc

SEQ ID NO: 7836845 - DNA, 22 bp, Homo sapiens
taaaatttgtccctgagtgttg

SEQ ID NO: 7836846 - DNA, 22 bp, Homo sapiens
taaaatttgtccctgagtgttg

SEQ ID NO: 7836847 - DNA, 22 bp, Homo sapiens
taaaatttgtccctgagtgttg

SEQ ID NO: 7836848 - DNA, 22 bp, Homo sapiens
taaaatttgtccctgagtgttg

SEQ ID NO: 7836849 - DNA, 22 bp, Homo sapiens
taaaatttgtccctgagtgttg

SEQ ID NO: 7836850 - DNA, 22 bp, Homo sapiens
taaacaagaaacattttctgtt

SEQ ID NO: 7836851 - DNA, 22 bp, Homo sapiens
taaacaagaaacattttctgtt

SEQ ID NO: 7836852 - DNA, 22 bp, Homo sapiens
taaacaagctggactgataagt

SEQ ID NO: 7836853 - DNA, 22 bp, Homo sapiens
taaacaattcctctctaggcat

SEQ ID NO: 7836854 - DNA, 22 bp, Homo sapiens
taaacaattcctctctaggcat

SEQ ID NO: 7836855 - DNA, 22 bp, Homo sapiens
taaacactcacttcatagccat

SEQ ID NO: 7836856 - DNA, 22 bp, Homo sapiens
taaacaagggttactgagcatg

SEQ ID NO: 7836857 - DNA, 22 bp, Homo sapiens
taaacaagggttactgagcatg

SEQ ID NO: 7836858 - DNA, 22 bp, Homo sapiens
taaacaagggttactgagcatg

SEQ ID NO: 7836859 - DNA, 22 bp, Homo sapiens
taaacaagctggactgataagt

SEQ ID NO: 7836860 - DNA, 22 bp, Homo sapiens
taaacaagctggactgataagt

SEQ ID NO: 7836861 - DNA, 22 bp, Homo sapiens
taaacaagaaacattttctgtt

SEQ ID NO: 7836862 - DNA, 22 bp, Homo sapiens
taaacaagctgtctgatattct

SEQ ID NO: 7836863 - DNA, 22 bp, Homo sapiens
taaagggtaggttttactgtaa

SEQ ID NO: 7836864 - DNA, 22 bp, Homo sapiens
taaagggtaggttttactgtaa

SEQ ID NO: 7836865 - DNA, 22 bp, Homo sapiens
taaagggtaggttttactgtaa

SEQ ID NO: 7836866 - DNA, 22 bp, Homo sapiens
taaacagaattcaggcaagata

SEQ ID NO: 7836867 - DNA, 22 bp, Homo sapiens
taaaggcttttagtgatggtaa

SEQ ID NO: 7836868 - DNA, 22 bp, Homo sapiens
taaacagaatgcgtaagaagtg

SEQ ID NO: 7836869 - DNA, 22 bp, Homo sapiens
taaacagaatgcgtaagaagtg

SEQ ID NO: 7836870 - DNA, 22 bp, Homo sapiens
taaacagaaagcagatgtactt

SEQ ID NO: 7836871 - DNA, 22 bp, Homo sapiens
taaacactgccttggtgggtca

SEQ ID NO: 7836872 - DNA, 22 bp, Homo sapiens
gttttgaatcactgcgcttcac

SEQ ID NO: 7836873 - DNA, 22 bp, Homo sapiens
gttttgaaatgaaagaaccaag

SEQ ID NO: 7836874 - DNA, 22 bp, Homo sapiens
gttttgaagaagaccttgaaac

SEQ ID NO: 7836875 - DNA, 22 bp, Homo sapiens
gttttgaaatgaaagaaccaag

SEQ ID NO: 7836876 - DNA, 22 bp, Homo sapiens
gttttgaaatgaaagaaccaag

SEQ ID NO: 7836877 - DNA, 21 bp, Homo sapiens
gttttctttgatagagggaag

SEQ ID NO: 7836878 - DNA, 21 bp, Homo sapiens
gttttctttgatagagggaag

SEQ ID NO: 7836879 - DNA, 22 bp, Homo sapiens
gttttctttgaatgcttctaga

SEQ ID NO: 7836880 - DNA, 22 bp, Homo sapiens
gttttctttgaatgcttctaga

SEQ ID NO: 7836881 - DNA, 22 bp, Homo sapiens
gttttctttgaatgcttctaga

SEQ ID NO: 7836882 - DNA, 22 bp, Homo sapiens
gttttcttcctgcaattggcat

SEQ ID NO: 7836883 - DNA, 22 bp, Homo sapiens
gttttcttcctgcaattggcat

SEQ ID NO: 7836884 - DNA, 22 bp, Homo sapiens
gttttcttcctgcaattggcat

SEQ ID NO: 7836885 - DNA, 22 bp, Homo sapiens
gttttccactggattgtttgga

SEQ ID NO: 7836886 - DNA, 22 bp, Homo sapiens
gttttcattactgctgtgattt

SEQ ID NO: 7836887 - DNA, 22 bp, Homo sapiens
gttttcattactgctgtgattt

SEQ ID NO: 7836888 - DNA, 22 bp, Homo sapiens
gttttcattactgctgtgattt

SEQ ID NO: 7836889 - DNA, 18 bp, Homo sapiens
gttttgaattgtcttaca

SEQ ID NO: 7836890 - DNA, 18 bp, Homo sapiens
gttttgaattgtcttaca

SEQ ID NO: 7836891 - DNA, 18 bp, Homo sapiens
gttttgaattgtcttaca

SEQ ID NO: 7836892 - DNA, 18 bp, Homo sapiens
gttttgaattgtcttaca

SEQ ID NO: 7836893 - DNA, 22 bp, Homo sapiens
gttttgatatatgcatacatta

SEQ ID NO: 7836894 - DNA, 22 bp, Homo sapiens
gttttgatatatgcatacatta

SEQ ID NO: 7836895 - DNA, 22 bp, Homo sapiens
gttttgcagagtgcaataaatc

SEQ ID NO: 7836896 - DNA, 19 bp, Homo sapiens
gttttgcaggcagagggga

SEQ ID NO: 7836897 - DNA, 22 bp, Homo sapiens
gttttgcagagtgcaataaatc

SEQ ID NO: 7836898 - DNA, 19 bp, Homo sapiens
gttttgcaggcagagggga

SEQ ID NO: 7836899 - DNA, 19 bp, Homo sapiens
gttttgcaggcagagggga

SEQ ID NO: 7836900 - DNA, 22 bp, Homo sapiens
gttttgctgactcccacaggaa

SEQ ID NO: 7836901 - DNA, 22 bp, Homo sapiens
gttttggagtcaggcttagatg

SEQ ID NO: 7836902 - DNA, 22 bp, Homo sapiens
gttttggtaagaatagtcatcc

SEQ ID NO: 7836903 - DNA, 22 bp, Homo sapiens
gttttgtgaggcacccacaggt

SEQ ID NO: 7836904 - DNA, 18 bp, Homo sapiens
gttttgtggctagtagtg

SEQ ID NO: 7836905 - DNA, 22 bp, Homo sapiens
gttttgtgaggcacccacaggt

SEQ ID NO: 7836906 - DNA, 22 bp, Homo sapiens
gttttgtgaggcacccacaggt

SEQ ID NO: 7836907 - DNA, 22 bp, Homo sapiens
gttttgttgctgcagagctcaa

SEQ ID NO: 7836908 - DNA, 22 bp, Homo sapiens
gttttgttcttgtccagggaaa

SEQ ID NO: 7836909 - DNA, 22 bp, Homo sapiens
gttttgttcttgtccagggaaa

SEQ ID NO: 7836910 - DNA, 22 bp, Homo sapiens
gttttgttgctgcagagctcaa

SEQ ID NO: 7836911 - DNA, 22 bp, Homo sapiens
gttttgttcttgtccagggaaa

SEQ ID NO: 7836912 - DNA, 22 bp, Homo sapiens
gttttgttcatgaacattgggt

SEQ ID NO: 7836913 - DNA, 22 bp, Homo sapiens
gttttgttcatgaacattgggt

SEQ ID NO: 7836914 - DNA, 22 bp, Homo sapiens
gttttgttcatgaacattgggt

SEQ ID NO: 7836915 - DNA, 18 bp, Homo sapiens
gttttgtggctagtagtg

SEQ ID NO: 7836916 - DNA, 22 bp, Homo sapiens
gtttccagctttctgatgcttg

SEQ ID NO: 7836917 - DNA, 22 bp, Homo sapiens
gtttccaggcactttttctgct

SEQ ID NO: 7836918 - DNA, 22 bp, Homo sapiens
gtttccaggaggctacacctga

SEQ ID NO: 7836919 - DNA, 22 bp, Homo sapiens
gtttccagagtgagggcacttg

SEQ ID NO: 7836920 - DNA, 22 bp, Homo sapiens
gtttccagccaatcccctcagg

SEQ ID NO: 7836921 - DNA, 22 bp, Homo sapiens
gtttccagagtgagggcacttg

SEQ ID NO: 7836922 - DNA, 22 bp, Homo sapiens
gtttccagcctagagatggtga

SEQ ID NO: 7836923 - DNA, 22 bp, Homo sapiens
gtttccagccctgcaggtttaa

SEQ ID NO: 7836924 - DNA, 22 bp, Homo sapiens
gtttccagcctagagatggtga

SEQ ID NO: 7836925 - DNA, 22 bp, Homo sapiens
gtttccaactagtatgatcagg

SEQ ID NO: 7836926 - DNA, 22 bp, Homo sapiens
gtttccagagatcatttacata

SEQ ID NO: 7836927 - DNA, 22 bp, Homo sapiens
gtttccatgaaaatgtttctgc

SEQ ID NO: 7836928 - DNA, 22 bp, Homo sapiens
gtttccatgcagtagagcttag

SEQ ID NO: 7836929 - DNA, 22 bp, Homo sapiens
gtttccaggcccctccctagac

SEQ ID NO: 7836930 - DNA, 22 bp, Homo sapiens
gtttccaggcgatatcagctgc

SEQ ID NO: 7836931 - DNA, 22 bp, Homo sapiens
gtttccaggcgatatcagctgc

SEQ ID NO: 7836932 - DNA, 22 bp, Homo sapiens
gtttccaggcgatatcagctgc

SEQ ID NO: 7836933 - DNA, 22 bp, Homo sapiens
gtttccaggctttggtatggtt

SEQ ID NO: 7836934 - DNA, 22 bp, Homo sapiens
gttttcatgtctattgggcata

SEQ ID NO: 7836935 - DNA, 22 bp, Homo sapiens
gttttcatgtctattgggcata

SEQ ID NO: 7836936 - DNA, 22 bp, Homo sapiens
gtttcccagtctgcagagttct

SEQ ID NO: 7836937 - DNA, 22 bp, Homo sapiens
gtttcccaggctgtggggccct

SEQ ID NO: 7836938 - DNA, 22 bp, Homo sapiens
gtttcccaggctgtggggccct

SEQ ID NO: 7836939 - DNA, 22 bp, Homo sapiens
gtttccatgggagaagacagtg

SEQ ID NO: 7836940 - DNA, 22 bp, Homo sapiens
gtttccatgggagaagacagtg

SEQ ID NO: 7836941 - DNA, 22 bp, Homo sapiens
gtttccatggctctgttaatgg

SEQ ID NO: 7836942 - DNA, 22 bp, Homo sapiens
gtttccatggaagcaaaggtgg

SEQ ID NO: 7836943 - DNA, 22 bp, Homo sapiens
gtttccatggtgtttcttgggt

SEQ ID NO: 7836944 - DNA, 22 bp, Homo sapiens
gtttccattgtcctatctatag

SEQ ID NO: 7836945 - DNA, 22 bp, Homo sapiens
gtttccattgtcctatctatag

SEQ ID NO: 7836946 - DNA, 22 bp, Homo sapiens
gtttccatggtgtttcttgggt

SEQ ID NO: 7836947 - DNA, 22 bp, Homo sapiens
gtttcccaaattgttcacaggg

SEQ ID NO: 7836948 - DNA, 22 bp, Homo sapiens
gtttccattgtcctatctatag

SEQ ID NO: 7836949 - DNA, 22 bp, Homo sapiens
gttgagtgggttaggatgctga

SEQ ID NO: 7836950 - DNA, 22 bp, Homo sapiens
gttgagtacctgctttatgtca

SEQ ID NO: 7836951 - DNA, 22 bp, Homo sapiens
gttgaggtgatgccagccctgc

SEQ ID NO: 7836952 - DNA, 22 bp, Homo sapiens
gttgaggtgatgccagccctgc

SEQ ID NO: 7836953 - DNA, 22 bp, Homo sapiens
gttgaggtgatgccagccctgc

SEQ ID NO: 7836954 - DNA, 22 bp, Homo sapiens
gttgaggtgatgccagccctgc

SEQ ID NO: 7836955 - DNA, 22 bp, Homo sapiens
gttgaggtgatgccagccctgc

SEQ ID NO: 7836956 - DNA, 22 bp, Homo sapiens
gttgaggtgatgccagccctgc

SEQ ID NO: 7836957 - DNA, 22 bp, Homo sapiens
gttcatttatgatgtaacatgt

SEQ ID NO: 7836958 - DNA, 22 bp, Homo sapiens
gttgaggagcaagcatgtgtct

SEQ ID NO: 7836959 - DNA, 22 bp, Homo sapiens
gttgaggaggttcagggtggtt

SEQ ID NO: 7836960 - DNA, 22 bp, Homo sapiens
gttgaggtgatgccagccctgc

SEQ ID NO: 7836961 - DNA, 22 bp, Homo sapiens
gttgaggaggcactcactgtca

SEQ ID NO: 7836962 - DNA, 22 bp, Homo sapiens
gttcatgtggaaatttaaaaca

SEQ ID NO: 7836963 - DNA, 22 bp, Homo sapiens
gttcatgtggaaatttaaaaca

SEQ ID NO: 7836964 - DNA, 22 bp, Homo sapiens
gttcatgtggaaatttaaaaca

SEQ ID NO: 7836965 - DNA, 22 bp, Homo sapiens
gttcatgtggtttttaaaggat

SEQ ID NO: 7836966 - DNA, 20 bp, Homo sapiens
gttcatgtctcaaatagaaa

SEQ ID NO: 7836967 - DNA, 22 bp, Homo sapiens
gttcatgatgaggaaaacagga

SEQ ID NO: 7836968 - DNA, 20 bp, Homo sapiens
gttcatgtctcaaatagaaa

SEQ ID NO: 7836969 - DNA, 22 bp, Homo sapiens
gttcattcatcaaatatttact

SEQ ID NO: 7836970 - DNA, 22 bp, Homo sapiens
gttcattctgaaaagcagcttg

SEQ ID NO: 7836971 - DNA, 22 bp, Homo sapiens
gttcatgtttgtgtattgctca

SEQ ID NO: 7836972 - DNA, 22 bp, Homo sapiens
gttcattgtcatgtttcattgc

SEQ ID NO: 7836973 - DNA, 22 bp, Homo sapiens
gttcattgtggatgcttaaata

SEQ ID NO: 7836974 - DNA, 22 bp, Homo sapiens
gttcattgtgtgtggtcttctt

SEQ ID NO: 7836975 - DNA, 22 bp, Homo sapiens
gttcattgttaacgtgtccact

SEQ ID NO: 7836976 - DNA, 22 bp, Homo sapiens
gttcatatttaactaagatagg

SEQ ID NO: 7836977 - DNA, 22 bp, Homo sapiens
gttcatatttaactaagatagg

SEQ ID NO: 7836978 - DNA, 22 bp, Homo sapiens
gttcatatttaactaagatagg

SEQ ID NO: 7836979 - DNA, 22 bp, Homo sapiens
gttcatcactcagagacctccc

SEQ ID NO: 7836980 - DNA, 22 bp, Homo sapiens
gttcatccatattatagcatgt

SEQ ID NO: 7836981 - DNA, 22 bp, Homo sapiens
gttcatccatgtcagcgtatat

SEQ ID NO: 7836982 - DNA, 22 bp, Homo sapiens
gttcatcctgacttggattagt

SEQ ID NO: 7836983 - DNA, 22 bp, Homo sapiens
gttcataatttgaaggaatagg

SEQ ID NO: 7836984 - DNA, 22 bp, Homo sapiens
gttcataatttgaaggaatagg

SEQ ID NO: 7836985 - DNA, 22 bp, Homo sapiens
gttcatattctaagtaactggc

SEQ ID NO: 7836986 - DNA, 22 bp, Homo sapiens
gttcagttttgaaatgttaatt

SEQ ID NO: 7836987 - DNA, 22 bp, Homo sapiens
gttcagtgccagttctaagact

SEQ ID NO: 7836988 - DNA, 22 bp, Homo sapiens
gttcagtgattctcggtgttca

SEQ ID NO: 7836989 - DNA, 22 bp, Homo sapiens
gttcagtcacgtgcccaagttc

SEQ ID NO: 7836990 - DNA, 22 bp, Homo sapiens
gttcagtcacgtgcccaagttc

SEQ ID NO: 7836991 - DNA, 22 bp, Homo sapiens
gttcagtgtctctctattttat

SEQ ID NO: 7836992 - DNA, 22 bp, Homo sapiens
gttcagtggtgtatccccagtg

SEQ ID NO: 7836993 - DNA, 22 bp, Homo sapiens
gttcagtgattctcggtgttca

SEQ ID NO: 7836994 - DNA, 22 bp, Homo sapiens
gttcagtgccagttctaagact

SEQ ID NO: 7836995 - DNA, 22 bp, Homo sapiens
gttcagtggggccttgggggac

SEQ ID NO: 7836996 - DNA, 22 bp, Homo sapiens
gttcagtggggccttgggggac

SEQ ID NO: 7836997 - DNA, 22 bp, Homo sapiens
gttcagtgtttacatgattgtt

SEQ ID NO: 7836998 - DNA, 22 bp, Homo sapiens
gttcagtgtctctctattttat

SEQ ID NO: 7836999 - DNA, 22 bp, Homo sapiens
gttcagtgtttacatgattgtt

SEQ ID NO: 7837000 - DNA, 22 bp, Homo sapiens
gttcagtgtttttattgacagg

SEQ ID NO: 7837001 - DNA, 22 bp, Homo sapiens
gttcagtgtttgatttctgctg

SEQ ID NO: 7837002 - DNA, 22 bp, Homo sapiens
gttcagtgtttgatttctgctg

SEQ ID NO: 7837003 - DNA, 22 bp, Homo sapiens
gttcagtgtttttattgacagg

SEQ ID NO: 7837004 - DNA, 22 bp, Homo sapiens
gttcagtgtttttattgacagg

SEQ ID NO: 7837005 - DNA, 21 bp, Homo sapiens
gttcaatagctctttgaatgc

SEQ ID NO: 7837006 - DNA, 22 bp, Homo sapiens
gttcacatcctgctttttccct

SEQ ID NO: 7837007 - DNA, 22 bp, Homo sapiens
gttcacatcccagaaagagcat

SEQ ID NO: 7837008 - DNA, 22 bp, Homo sapiens
gttcacatcacttcactgaacc

SEQ ID NO: 7837009 - DNA, 22 bp, Homo sapiens
gttcacatgctctcatgctttt

SEQ ID NO: 7837010 - DNA, 22 bp, Homo sapiens
gttcacatgctctcatgctttt

SEQ ID NO: 7837011 - DNA, 22 bp, Homo sapiens
gttcacatcctggctgtgccac

SEQ ID NO: 7837012 - DNA, 22 bp, Homo sapiens
gttcacatccttgtgaggattt

SEQ ID NO: 7837013 - DNA, 22 bp, Homo sapiens
gttacaaaggtcataaaagtgt

SEQ ID NO: 7837014 - DNA, 22 bp, Homo sapiens
gttacaaaggtcataaaagtgt

SEQ ID NO: 7837015 - DNA, 22 bp, Homo sapiens
gttacaaaggactgggggccac

SEQ ID NO: 7837016 - DNA, 22 bp, Homo sapiens
gttacaaaggactgggggccac

SEQ ID NO: 7837017 - DNA, 22 bp, Homo sapiens
gttacaaaggactgggggccac

SEQ ID NO: 7837018 - DNA, 22 bp, Homo sapiens
gttacaaaggactgggggccac

SEQ ID NO: 7837019 - DNA, 22 bp, Homo sapiens
gttacaaaggtcataaaagtgt

SEQ ID NO: 7837020 - DNA, 22 bp, Homo sapiens
gttacaaaggactgggggccac

SEQ ID NO: 7837021 - DNA, 22 bp, Homo sapiens
gttcagcagcagtgattttgtg

SEQ ID NO: 7837022 - DNA, 22 bp, Homo sapiens
gttcaggaagtctcagctggga

SEQ ID NO: 7837023 - DNA, 22 bp, Homo sapiens
gttcagctcaagcaataatttt

SEQ ID NO: 7837024 - DNA, 22 bp, Homo sapiens
gttcagctaggaatggagatgc

SEQ ID NO: 7837025 - DNA, 22 bp, Homo sapiens
gttcagcaatagatctagaggc

SEQ ID NO: 7837026 - DNA, 22 bp, Homo sapiens
gttcagcaatagatctagaggc

SEQ ID NO: 7837027 - DNA, 22 bp, Homo sapiens
gttcagcaagtactcagtccac

SEQ ID NO: 7837028 - DNA, 22 bp, Homo sapiens
gttcagcaagtactcagtccac

SEQ ID NO: 7837029 - DNA, 22 bp, Homo sapiens
gttcacatgtgttatcttcttt

SEQ ID NO: 7837030 - DNA, 22 bp, Homo sapiens
gttcacattaactcaccggtgc

SEQ ID NO: 7837031 - DNA, 22 bp, Homo sapiens
gttcactgctttcttagtactc

SEQ ID NO: 7837032 - DNA, 20 bp, Homo sapiens
gttcactgagcttaaatgtt

SEQ ID NO: 7837033 - DNA, 22 bp, Homo sapiens
gttcacatggcattttcacatc

SEQ ID NO: 7837034 - DNA, 22 bp, Homo sapiens
gttcacatggcattttcacatc

SEQ ID NO: 7837035 - DNA, 22 bp, Homo sapiens
gttcacatgtgttatcttcttt

SEQ ID NO: 7837036 - DNA, 22 bp, Homo sapiens
gttcacatgtggtcatgctgtc

SEQ ID NO: 7837037 - DNA, 22 bp, Homo sapiens
gttcagagaaagagacacctta

SEQ ID NO: 7837038 - DNA, 22 bp, Homo sapiens
gttcagagaaagagacacctta

SEQ ID NO: 7837039 - DNA, 21 bp, Homo sapiens
gttcagagattattgagtcat

SEQ ID NO: 7837040 - DNA, 21 bp, Homo sapiens
gttcagagattattgagtcat

SEQ ID NO: 7837041 - DNA, 22 bp, Homo sapiens
gttcactgtactggtgatggtt

SEQ ID NO: 7837042 - DNA, 22 bp, Homo sapiens
gttcactgggtttgatttcctt

SEQ ID NO: 7837043 - DNA, 22 bp, Homo sapiens
gttcagaaaacattggaataca

SEQ ID NO: 7837044 - DNA, 22 bp, Homo sapiens
gttcactgtactggtgatggtt

SEQ ID NO: 7837045 - DNA, 22 bp, Homo sapiens
gttcagaaattaggagaataaa

SEQ ID NO: 7837046 - DNA, 22 bp, Homo sapiens
gttgcaggaagcacacacatgt

SEQ ID NO: 7837047 - DNA, 22 bp, Homo sapiens
gttgcaggaagcacacacatgt

SEQ ID NO: 7837048 - DNA, 22 bp, Homo sapiens
gttgcataagaccacaaggagc

SEQ ID NO: 7837049 - DNA, 22 bp, Homo sapiens
gttgcattaatctgctcaggct

SEQ ID NO: 7837050 - DNA, 22 bp, Homo sapiens
gttgcaggaggatggctgcata

SEQ ID NO: 7837051 - DNA, 22 bp, Homo sapiens
gttgcaggaggatggctgcata

SEQ ID NO: 7837052 - DNA, 22 bp, Homo sapiens
gttgcctaggctggagtgcagt

SEQ ID NO: 7837053 - DNA, 22 bp, Homo sapiens
gttgccctggctctgcccagct

SEQ ID NO: 7837054 - DNA, 22 bp, Homo sapiens
gttgccaggggctgctgtcacc

SEQ ID NO: 7837055 - DNA, 22 bp, Homo sapiens
gttgcctaggctggtcttgaac

SEQ ID NO: 7837056 - DNA, 22 bp, Homo sapiens
gttgcattttaaatgcatgttg

SEQ ID NO: 7837057 - DNA, 22 bp, Homo sapiens
gttgcatttagttatctgtctg

SEQ ID NO: 7837058 - DNA, 22 bp, Homo sapiens
gttgccagacttctgtggctcc

SEQ ID NO: 7837059 - DNA, 22 bp, Homo sapiens
gttgcattttccctccagaggt

SEQ ID NO: 7837060 - DNA, 22 bp, Homo sapiens
gttgatgaaaatgaattgcatg

SEQ ID NO: 7837061 - DNA, 19 bp, Homo sapiens
gttgatgtttccccatctt

SEQ ID NO: 7837062 - DNA, 22 bp, Homo sapiens
gttgagtgggttaggatgctga

SEQ ID NO: 7837063 - DNA, 22 bp, Homo sapiens
gttgatttgaagagcagaaagt

SEQ ID NO: 7837064 - DNA, 22 bp, Homo sapiens
gttgcaaatgggaagatggtta

SEQ ID NO: 7837065 - DNA, 22 bp, Homo sapiens
gttgcaaactcctacttctcat

SEQ ID NO: 7837066 - DNA, 22 bp, Homo sapiens
gttgcagatgtggaactcgtgc

SEQ ID NO: 7837067 - DNA, 22 bp, Homo sapiens
gttgcagatgtggaactcgtgc

SEQ ID NO: 7837068 - DNA, 22 bp, Homo sapiens
gttgcagacactccacagtcga

SEQ ID NO: 7837069 - DNA, 22 bp, Homo sapiens
gttgcacagttcctcaagcagg

SEQ ID NO: 7837070 - DNA, 22 bp, Homo sapiens
gttgcacactggctataacaag

SEQ ID NO: 7837071 - DNA, 22 bp, Homo sapiens
gttgggaaggtgaacatgatgc

SEQ ID NO: 7837072 - DNA, 22 bp, Homo sapiens
gttgggaaggcaagaagtagaa

SEQ ID NO: 7837073 - DNA, 22 bp, Homo sapiens
gttgggaagtgtagctccacct

SEQ ID NO: 7837074 - DNA, 22 bp, Homo sapiens
gttgggaatttattccttttct

SEQ ID NO: 7837075 - DNA, 22 bp, Homo sapiens
gttgggagcagcagaccaagag

SEQ ID NO: 7837076 - DNA, 22 bp, Homo sapiens
gttgctcaggcaggagtacagt

SEQ ID NO: 7837077 - DNA, 22 bp, Homo sapiens
gttgctcaggcaggagtacagt

SEQ ID NO: 7837078 - DNA, 22 bp, Homo sapiens
gttgctcaggcaggagtacagt

SEQ ID NO: 7837079 - DNA, 22 bp, Homo sapiens
gttgctcaggcaggagtacagt

SEQ ID NO: 7837080 - DNA, 23 bp, Homo sapiens
gttgcctttgcatcttcatccat

SEQ ID NO: 7837081 - DNA, 22 bp, Homo sapiens
gttgccttctatgattctcagt

SEQ ID NO: 7837082 - DNA, 22 bp, Homo sapiens
gttgccttcactggtcttggca

SEQ ID NO: 7837083 - DNA, 22 bp, Homo sapiens
gttggggaaggtgggagaatgt

SEQ ID NO: 7837084 - DNA, 22 bp, Homo sapiens
gttgggcttcagatgagggtca

SEQ ID NO: 7837085 - DNA, 22 bp, Homo sapiens
gttgggcttcagatgagggtca

SEQ ID NO: 7837086 - DNA, 22 bp, Homo sapiens
gttgggcttatgtaattttaag

SEQ ID NO: 7837087 - DNA, 22 bp, Homo sapiens
gttggggtaccttgaggctggg

SEQ ID NO: 7837088 - DNA, 22 bp, Homo sapiens
gttggggaaggtgggagaatgt

SEQ ID NO: 7837089 - DNA, 22 bp, Homo sapiens
gttgggagcagcagaccaagag

SEQ ID NO: 7837090 - DNA, 22 bp, Homo sapiens
gttgggccccagaggtccaggc

SEQ ID NO: 7837091 - DNA, 22 bp, Homo sapiens
gttgggctcattacagcctgct

SEQ ID NO: 7837092 - DNA, 22 bp, Homo sapiens
gttgggctgggagctgccctga

SEQ ID NO: 7837093 - DNA, 22 bp, Homo sapiens
gttgggctgaagtgtgtgctta

SEQ ID NO: 7837094 - DNA, 22 bp, Homo sapiens
gttgggttaaccaggatgtcaa

SEQ ID NO: 7837095 - DNA, 22 bp, Homo sapiens
gttggggtccaatgaagcgagc

SEQ ID NO: 7837096 - DNA, 19 bp, Homo sapiens
gttggtcattctacacaac

SEQ ID NO: 7837097 - DNA, 22 bp, Homo sapiens
gttggtcaggatggtctcaaac

SEQ ID NO: 7837098 - DNA, 22 bp, Homo sapiens
gtttcatggagagctgaatatt

SEQ ID NO: 7837099 - DNA, 22 bp, Homo sapiens
gtttcatgccatttccagattg

SEQ ID NO: 7837100 - DNA, 22 bp, Homo sapiens
gtttcatggagagctgaatatt

SEQ ID NO: 7837101 - DNA, 22 bp, Homo sapiens
gtttcatggttgtttgatggca

SEQ ID NO: 7837102 - DNA, 22 bp, Homo sapiens
gtttcatggttgtttgatggca

SEQ ID NO: 7837103 - DNA, 18 bp, Homo sapiens
gtttcatgcatgtgaaac

SEQ ID NO: 7837104 - DNA, 18 bp, Homo sapiens
gtttcatgcatgtgaaac

SEQ ID NO: 7837105 - DNA, 22 bp, Homo sapiens
gtttcatgccatttccagattg

SEQ ID NO: 7837106 - DNA, 18 bp, Homo sapiens
gtttcatgcatgtgaaac

SEQ ID NO: 7837107 - DNA, 22 bp, Homo sapiens
gtttcatggttgtttgatggca

SEQ ID NO: 7837108 - DNA, 22 bp, Homo sapiens
gtttcatatatagtaactgaaa

SEQ ID NO: 7837109 - DNA, 22 bp, Homo sapiens
gtttcatataccaagcacttga

SEQ ID NO: 7837110 - DNA, 22 bp, Homo sapiens
gtttcataggcatgtgacctat

SEQ ID NO: 7837111 - DNA, 22 bp, Homo sapiens
gtttcatatatagtaactgaaa

SEQ ID NO: 7837112 - DNA, 18 bp, Homo sapiens
gtttcatgcatgtgaaac

SEQ ID NO: 7837113 - DNA, 22 bp, Homo sapiens
gtttcatgactgatgttgttga

SEQ ID NO: 7837114 - DNA, 22 bp, Homo sapiens
gtttcatatgcagttaacagca

SEQ ID NO: 7837115 - DNA, 22 bp, Homo sapiens
gtttcatacagattattcatgg

SEQ ID NO: 7837116 - DNA, 22 bp, Homo sapiens
gtttcatagcatatacgtgtgt

SEQ ID NO: 7837117 - DNA, 22 bp, Homo sapiens
gtttcataggcatgtgacctat

SEQ ID NO: 7837118 - DNA, 22 bp, Homo sapiens
gtttcatagctacgattttggg

SEQ ID NO: 7837119 - DNA, 22 bp, Homo sapiens
gtttcatagcatatacgtgtgt

SEQ ID NO: 7837120 - DNA, 22 bp, Homo sapiens
gtttcataattcaatcaaatga

SEQ ID NO: 7837121 - DNA, 22 bp, Homo sapiens
gtttcagggccttttatgtgtt

SEQ ID NO: 7837122 - DNA, 22 bp, Homo sapiens
gttgtaagtttaatgtcaattg

SEQ ID NO: 7837123 - DNA, 22 bp, Homo sapiens
gttgtaagtttaatgtcaattg

SEQ ID NO: 7837124 - DNA, 22 bp, Homo sapiens
gttgtacaaaatatcagtgagg

SEQ ID NO: 7837125 - DNA, 19 bp, Homo sapiens
gttgtaaatggaggtttct

SEQ ID NO: 7837126 - DNA, 22 bp, Homo sapiens
gttgtacagcatccagtgcaga

SEQ ID NO: 7837127 - DNA, 22 bp, Homo sapiens
gttgtacagacatgaaacttgc

SEQ ID NO: 7837128 - DNA, 22 bp, Homo sapiens
gttgtacagacatgaaacttgc

SEQ ID NO: 7837129 - DNA, 22 bp, Homo sapiens
gttgtacaattgtttcacatgc

SEQ ID NO: 7837130 - DNA, 22 bp, Homo sapiens
gttgtaaatacagcagataatt

SEQ ID NO: 7837131 - DNA, 22 bp, Homo sapiens
gttggtggatgtgggcagagca

SEQ ID NO: 7837132 - DNA, 22 bp, Homo sapiens
gttggtggatgtgggcagagca

SEQ ID NO: 7837133 - DNA, 22 bp, Homo sapiens
gttggtggatgtgggcagagca

SEQ ID NO: 7837134 - DNA, 22 bp, Homo sapiens
gtttcagagtagaacctcaagg

SEQ ID NO: 7837135 - DNA, 22 bp, Homo sapiens
gtttcagaggtgttcattttca

SEQ ID NO: 7837136 - DNA, 22 bp, Homo sapiens
gtttcagaaatgttctcctgct

SEQ ID NO: 7837137 - DNA, 22 bp, Homo sapiens
gtttcagaaatgttctcctgct

SEQ ID NO: 7837138 - DNA, 22 bp, Homo sapiens
gttgtacagcatccagtgcaga

SEQ ID NO: 7837139 - DNA, 22 bp, Homo sapiens
gtttcagatttggtttcagaag

SEQ ID NO: 7837140 - DNA, 22 bp, Homo sapiens
gtttcagatttggtttcagaag

SEQ ID NO: 7837141 - DNA, 22 bp, Homo sapiens
gtttcagctcttcctggaacca

SEQ ID NO: 7837142 - DNA, 22 bp, Homo sapiens
gtttcagagttagtgctggctg

SEQ ID NO: 7837143 - DNA, 22 bp, Homo sapiens
gtttcagagttagtgctggctg

SEQ ID NO: 7837144 - DNA, 22 bp, Homo sapiens
gtttcagatatatttgtactta

SEQ ID NO: 7837145 - DNA, 22 bp, Homo sapiens
gtttcagatatatttgtactta

SEQ ID NO: 7837146 - DNA, 22 bp, Homo sapiens
gtgctctgtgtattaggatgtc

SEQ ID NO: 7837147 - DNA, 22 bp, Homo sapiens
gtgctctgtgtattaggatgtc

SEQ ID NO: 7837148 - DNA, 22 bp, Homo sapiens
gtgctctgtggattgagttgaa

SEQ ID NO: 7837149 - DNA, 22 bp, Homo sapiens
gtgctctgtggattgagttgaa

SEQ ID NO: 7837150 - DNA, 22 bp, Homo sapiens
gtgctctgtggattgagttgaa

SEQ ID NO: 7837151 - DNA, 22 bp, Homo sapiens
gtgctctgtggattgagttgaa

SEQ ID NO: 7837152 - DNA, 22 bp, Homo sapiens
gtgctctgtggattgagttgaa

SEQ ID NO: 7837153 - DNA, 22 bp, Homo sapiens
gtgctctgtgtattaggatgtc

SEQ ID NO: 7837154 - DNA, 22 bp, Homo sapiens
gtgctctgggctgcctgacatg

SEQ ID NO: 7837155 - DNA, 22 bp, Homo sapiens
gtgctctgggctgcctgacatg

SEQ ID NO: 7837156 - DNA, 21 bp, Homo sapiens
gtgctctgggcagcagagggc

SEQ ID NO: 7837157 - DNA, 21 bp, Homo sapiens
gtgctctgggcagcagagggc

SEQ ID NO: 7837158 - DNA, 21 bp, Homo sapiens
gtgctctgggcagcagagggc

SEQ ID NO: 7837159 - DNA, 21 bp, Homo sapiens
gtgctctgggcagcagagggc

SEQ ID NO: 7837160 - DNA, 22 bp, Homo sapiens
gtgctctggctggtctcccggt

SEQ ID NO: 7837161 - DNA, 22 bp, Homo sapiens
gtgctgaaatagaggaggtggc

SEQ ID NO: 7837162 - DNA, 22 bp, Homo sapiens
gtgctgaaatggacctcaggaa

SEQ ID NO: 7837163 - DNA, 22 bp, Homo sapiens
gtgctgaacatttgggacttgt

SEQ ID NO: 7837164 - DNA, 22 bp, Homo sapiens
gtgctgaactataaaaagcttt

SEQ ID NO: 7837165 - DNA, 18 bp, Homo sapiens
gtgtgcagttgcaggggt

SEQ ID NO: 7837166 - DNA, 18 bp, Homo sapiens
gtgtgcagttgcaggggt

SEQ ID NO: 7837167 - DNA, 22 bp, Homo sapiens
gtgctgaagaagtctgttcgcc

SEQ ID NO: 7837168 - DNA, 22 bp, Homo sapiens
gtgtgcatcttggtaatggagc

SEQ ID NO: 7837169 - DNA, 22 bp, Homo sapiens
gtgtgcatcttttctgcttgat

SEQ ID NO: 7837170 - DNA, 22 bp, Homo sapiens
gtgtgcatgcatagacaccaca

SEQ ID NO: 7837171 - DNA, 22 bp, Homo sapiens
gtgtgcatatgtgtggctctcc

SEQ ID NO: 7837172 - DNA, 22 bp, Homo sapiens
gtgtgcatctcacccttccccg

SEQ ID NO: 7837173 - DNA, 22 bp, Homo sapiens
gtgctgaagtgaaattcatcaa

SEQ ID NO: 7837174 - DNA, 22 bp, Homo sapiens
gtgtgcatagtcgtgcatgcat

SEQ ID NO: 7837175 - DNA, 22 bp, Homo sapiens
gtgtgcatagtcgtgcatgcat

SEQ ID NO: 7837176 - DNA, 18 bp, Homo sapiens
gtgtgcagttgcaggggt

SEQ ID NO: 7837177 - DNA, 22 bp, Homo sapiens
gtgtgcatatgtgtggctctcc

SEQ ID NO: 7837178 - DNA, 22 bp, Homo sapiens
gtgtgccactgcctgaggaccc

SEQ ID NO: 7837179 - DNA, 22 bp, Homo sapiens
gtgtgccagacatgatgctatg

SEQ ID NO: 7837180 - DNA, 22 bp, Homo sapiens
gtgtgccaggaactggctgctg

SEQ ID NO: 7837181 - DNA, 22 bp, Homo sapiens
gtgtgccagtcctgactcctga

SEQ ID NO: 7837182 - DNA, 22 bp, Homo sapiens
gtgtgccatttgcttcctgtta

SEQ ID NO: 7837183 - DNA, 22 bp, Homo sapiens
gtgtgccactgcctgaggaccc

SEQ ID NO: 7837184 - DNA, 22 bp, Homo sapiens
gtgtgccaccagtcaaggtgaa

SEQ ID NO: 7837185 - DNA, 22 bp, Homo sapiens
gtgtgccaccactgacaggatt

SEQ ID NO: 7837186 - DNA, 22 bp, Homo sapiens
gtgtgccaccactgacaggatt

SEQ ID NO: 7837187 - DNA, 22 bp, Homo sapiens
gtgtgccaccactgacaggatt

SEQ ID NO: 7837188 - DNA, 22 bp, Homo sapiens
gtgtgccaactatattaatatt

SEQ ID NO: 7837189 - DNA, 22 bp, Homo sapiens
gtgtgccaacaaaagacagtgc

SEQ ID NO: 7837190 - DNA, 23 bp, Homo sapiens
gtgtgccaagcactgtgccagga

SEQ ID NO: 7837191 - DNA, 23 bp, Homo sapiens
gtgtgccaagcactgtgccagga

SEQ ID NO: 7837192 - DNA, 19 bp, Homo sapiens
gtgtgcattgtcgcatcat

SEQ ID NO: 7837193 - DNA, 19 bp, Homo sapiens
gtgtgcattgtcgcatcat

SEQ ID NO: 7837194 - DNA, 22 bp, Homo sapiens
gtgtgcatgtggaagcatgtat

SEQ ID NO: 7837195 - DNA, 22 bp, Homo sapiens
gtgtgcatgtggaagcatgtat

SEQ ID NO: 7837196 - DNA, 22 bp, Homo sapiens
gtgtgcatgtatatacttttat

SEQ ID NO: 7837197 - DNA, 22 bp, Homo sapiens
gtgtgcatgcatagacaccaca

SEQ ID NO: 7837198 - DNA, 22 bp, Homo sapiens
gtgtgcatgtgcttgcacagat

SEQ ID NO: 7837199 - DNA, 22 bp, Homo sapiens
gtgtgcatgtgcttgcacagat

SEQ ID NO: 7837200 - DNA, 22 bp, Homo sapiens
gtgtgcatgtgcttgcacagat

SEQ ID NO: 7837201 - DNA, 22 bp, Homo sapiens
gtgctctgagtttgcatgtcag

SEQ ID NO: 7837202 - DNA, 22 bp, Homo sapiens
gtgctctgagtttgcatgtcag

SEQ ID NO: 7837203 - DNA, 22 bp, Homo sapiens
gtgctctgcctggggtcatggc

SEQ ID NO: 7837204 - DNA, 22 bp, Homo sapiens
gtgctctgcctggggtcatggc

SEQ ID NO: 7837205 - DNA, 22 bp, Homo sapiens
gtgctctgcctggggtcatggc

SEQ ID NO: 7837206 - DNA, 22 bp, Homo sapiens
gtgctctgcctggggtcatggc

SEQ ID NO: 7837207 - DNA, 23 bp, Homo sapiens
gtgctctgcggtctgctagtctg

SEQ ID NO: 7837208 - DNA, 23 bp, Homo sapiens
gtgctctgcggtctgctagtctg

SEQ ID NO: 7837209 - DNA, 23 bp, Homo sapiens
gtgctctgcggtctgctagtctg

SEQ ID NO: 7837210 - DNA, 22 bp, Homo sapiens
gtgctctggccaagcgcgtgcg

SEQ ID NO: 7837211 - DNA, 22 bp, Homo sapiens
gtgctctggccaagcgcgtgcg

SEQ ID NO: 7837212 - DNA, 22 bp, Homo sapiens
gtgctccctccttcctcaagga

SEQ ID NO: 7837213 - DNA, 22 bp, Homo sapiens
gtgctccctccttcctcaagga

SEQ ID NO: 7837214 - DNA, 22 bp, Homo sapiens
gtgctcctggccacatgaagct

SEQ ID NO: 7837215 - DNA, 22 bp, Homo sapiens
gtgctcctggccacatgaagct

SEQ ID NO: 7837216 - DNA, 22 bp, Homo sapiens
gtgctctaggaccttagaagtg

SEQ ID NO: 7837217 - DNA, 22 bp, Homo sapiens
gtgctccctccttcctcaagga

SEQ ID NO: 7837218 - DNA, 22 bp, Homo sapiens
gtgctccctccttcctcaagga

SEQ ID NO: 7837219 - DNA, 22 bp, Homo sapiens
gtgctccctccttcctcaagga

SEQ ID NO: 7837220 - DNA, 22 bp, Homo sapiens
gtgctccctccttcctcaagga

SEQ ID NO: 7837221 - DNA, 22 bp, Homo sapiens
gtgctccctccttcctcaagga

SEQ ID NO: 7837222 - DNA, 22 bp, Homo sapiens
gtgctccctccttcctcaagga

SEQ ID NO: 7837223 - DNA, 22 bp, Homo sapiens
gtgctcattttgtaatgtaact

SEQ ID NO: 7837224 - DNA, 22 bp, Homo sapiens
gtgctccaacattagtgtgctt

SEQ ID NO: 7837225 - DNA, 22 bp, Homo sapiens
gtgctccatggcctgtgtccat

SEQ ID NO: 7837226 - DNA, 22 bp, Homo sapiens
gtgctccaggtcgctcagagag

SEQ ID NO: 7837227 - DNA, 22 bp, Homo sapiens
gtgctccaggtcgctcagagag

SEQ ID NO: 7837228 - DNA, 22 bp, Homo sapiens
gtgctcagcccggatgagatca

SEQ ID NO: 7837229 - DNA, 22 bp, Homo sapiens
gtgctcactgtgagacgtcctg

SEQ ID NO: 7837230 - DNA, 22 bp, Homo sapiens
gtgctcaggaccaaatgaacca

SEQ ID NO: 7837231 - DNA, 22 bp, Homo sapiens
gtgctcactccccacagtgccc

SEQ ID NO: 7837232 - DNA, 22 bp, Homo sapiens
gtgctcactccccacagtgccc

SEQ ID NO: 7837233 - DNA, 22 bp, Homo sapiens
gtgctcaggaccaaatgaacca

SEQ ID NO: 7837234 - DNA, 22 bp, Homo sapiens
gtgctcaggggcaatcctggga

SEQ ID NO: 7837235 - DNA, 22 bp, Homo sapiens
gtgctcatcgtggagcctgagg

SEQ ID NO: 7837236 - DNA, 22 bp, Homo sapiens
gtgctcatagatgatgctcttt

SEQ ID NO: 7837237 - DNA, 22 bp, Homo sapiens
gtgctcatatattcctcacata

SEQ ID NO: 7837238 - DNA, 18 bp, Homo sapiens
gttaattttgaagttcat

SEQ ID NO: 7837239 - DNA, 22 bp, Homo sapiens
gttaatttgcagctttcgagct

SEQ ID NO: 7837240 - DNA, 22 bp, Homo sapiens
gttacaaactcaggtgccaaaa

SEQ ID NO: 7837241 - DNA, 22 bp, Homo sapiens
gttacaaactcaggtgccaaaa

SEQ ID NO: 7837242 - DNA, 22 bp, Homo sapiens
gttacaaactcaggtgccaaaa

SEQ ID NO: 7837243 - DNA, 22 bp, Homo sapiens
gttacaaactcaggtgccaaaa

SEQ ID NO: 7837244 - DNA, 22 bp, Homo sapiens
gttacaaactcaggtgccaaaa

SEQ ID NO: 7837245 - DNA, 22 bp, Homo sapiens
gttacaaactcaggtgccaaaa

SEQ ID NO: 7837246 - DNA, 22 bp, Homo sapiens
gttacaaagcacttcaagtgaa

SEQ ID NO: 7837247 - DNA, 22 bp, Homo sapiens
gttacaaaggaagcttcactgc

SEQ ID NO: 7837248 - DNA, 22 bp, Homo sapiens
gttacaaaggaagcttcactgc

SEQ ID NO: 7837249 - DNA, 22 bp, Homo sapiens
gttacaaaggaagcttcactgc

SEQ ID NO: 7837250 - DNA, 22 bp, Homo sapiens
gttacaaaggaagcttcactgc

SEQ ID NO: 7837251 - DNA, 22 bp, Homo sapiens
gttacaaaggaagcttcactgc

SEQ ID NO: 7837252 - DNA, 22 bp, Homo sapiens
gttacaaagcacttcaagtgaa

SEQ ID NO: 7837253 - DNA, 22 bp, Homo sapiens
gttacaaagcacttcaagtgaa

SEQ ID NO: 7837254 - DNA, 22 bp, Homo sapiens
gttacaaagcacttcaagtgaa

SEQ ID NO: 7837255 - DNA, 22 bp, Homo sapiens
gttacaaagcacttcaagtgaa

SEQ ID NO: 7837256 - DNA, 22 bp, Homo sapiens
gttacaaagcacttcaagtgaa

SEQ ID NO: 7837257 - DNA, 23 bp, Homo sapiens
gttaataatgaacactttctccc

SEQ ID NO: 7837258 - DNA, 22 bp, Homo sapiens
gttaatacaaccatgatcttct

SEQ ID NO: 7837259 - DNA, 23 bp, Homo sapiens
gttaataatgaacactttctccc

SEQ ID NO: 7837260 - DNA, 22 bp, Homo sapiens
gttaataaaggtatagaatcag

SEQ ID NO: 7837261 - DNA, 22 bp, Homo sapiens
gttaataaaggtatagaatcag

SEQ ID NO: 7837262 - DNA, 22 bp, Homo sapiens
gttaataaaggtatagaatcag

SEQ ID NO: 7837263 - DNA, 22 bp, Homo sapiens
gttaataaaggtatagaatcag

SEQ ID NO: 7837264 - DNA, 22 bp, Homo sapiens
gttaaggctgagcaggacactg

SEQ ID NO: 7837265 - DNA, 22 bp, Homo sapiens
gttaagtgaatgtcatgtcagg

SEQ ID NO: 7837266 - DNA, 22 bp, Homo sapiens
gttaagtgagggcttttgagtc

SEQ ID NO: 7837267 - DNA, 22 bp, Homo sapiens
gttaaggctgagcaggacactg

SEQ ID NO: 7837268 - DNA, 22 bp, Homo sapiens
gttaaggctgagcaggacactg

SEQ ID NO: 7837269 - DNA, 22 bp, Homo sapiens
gttaaggatcttgagatgagga

SEQ ID NO: 7837270 - DNA, 22 bp, Homo sapiens
gttaatgtgtctgacacaatgg

SEQ ID NO: 7837271 - DNA, 22 bp, Homo sapiens
gttaatttagtagagtccagat

SEQ ID NO: 7837272 - DNA, 22 bp, Homo sapiens
gttaatttagtagagtccagat

SEQ ID NO: 7837273 - DNA, 22 bp, Homo sapiens
gttaatgttatctgaagacagt

SEQ ID NO: 7837274 - DNA, 22 bp, Homo sapiens
gttaatgtgtctgacacaatgg

SEQ ID NO: 7837275 - DNA, 22 bp, Homo sapiens
gttaatgtgtctgacacaatgg

SEQ ID NO: 7837276 - DNA, 22 bp, Homo sapiens
gttaatgtgatataaagtattt

SEQ ID NO: 7837277 - DNA, 22 bp, Homo sapiens
gttaatatttacctgtcaagaa

SEQ ID NO: 7837278 - DNA, 22 bp, Homo sapiens
gttaatacaaccatgatcttct

SEQ ID NO: 7837279 - DNA, 22 bp, Homo sapiens
gttaatctgctttcaaaatgca

SEQ ID NO: 7837280 - DNA, 22 bp, Homo sapiens
gttaatgtcactttatgtggct

SEQ ID NO: 7837281 - DNA, 22 bp, Homo sapiens
gttaatgtcttcctattctaca

SEQ ID NO: 7837282 - DNA, 22 bp, Homo sapiens
gttaatgtgatataaagtattt

SEQ ID NO: 7837283 - DNA, 22 bp, Homo sapiens
gtgtggcttgggtgaggcgcct

SEQ ID NO: 7837284 - DNA, 22 bp, Homo sapiens
gtgtggcttgggtgaggcgcct

SEQ ID NO: 7837285 - DNA, 22 bp, Homo sapiens
gtgtggcttgggtgaggcgcct

SEQ ID NO: 7837286 - DNA, 22 bp, Homo sapiens
gtgtgggaatggcggtcgtgca

SEQ ID NO: 7837287 - DNA, 22 bp, Homo sapiens
gtgtgggaaggctaggatgctg

SEQ ID NO: 7837288 - DNA, 22 bp, Homo sapiens
gtgtgggaatggcggtcgtgca

SEQ ID NO: 7837289 - DNA, 22 bp, Homo sapiens
gtgtgggaatggcggtcgtgca

SEQ ID NO: 7837290 - DNA, 22 bp, Homo sapiens
gtgtgggacgggtgagtggcca

SEQ ID NO: 7837291 - DNA, 22 bp, Homo sapiens
gtgtgggacgggtgagtggcca

SEQ ID NO: 7837292 - DNA, 22 bp, Homo sapiens
gtgtgggacgggtgagtggcca

SEQ ID NO: 7837293 - DNA, 22 bp, Homo sapiens
gttaagaattcgttctcatgtt

SEQ ID NO: 7837294 - DNA, 22 bp, Homo sapiens
gttaagaatcaagacttatctt

SEQ ID NO: 7837295 - DNA, 22 bp, Homo sapiens
gttaagaatcaagacttatctt

SEQ ID NO: 7837296 - DNA, 22 bp, Homo sapiens
gttaagaagctagagatgaaca

SEQ ID NO: 7837297 - DNA, 22 bp, Homo sapiens
gttaagaacttgttgaaggtct

SEQ ID NO: 7837298 - DNA, 22 bp, Homo sapiens
gttaagaatcaagacttatctt

SEQ ID NO: 7837299 - DNA, 22 bp, Homo sapiens
gttaagaagctagagatgaaca

SEQ ID NO: 7837300 - DNA, 22 bp, Homo sapiens
gttaagaacttgttgaaggtct

SEQ ID NO: 7837301 - DNA, 22 bp, Homo sapiens
gtgtgccctggctccagcacca

SEQ ID NO: 7837302 - DNA, 22 bp, Homo sapiens
gtgtgcctcccattagggtgta

SEQ ID NO: 7837303 - DNA, 22 bp, Homo sapiens
gtgtgccctggctccagcacca

SEQ ID NO: 7837304 - DNA, 22 bp, Homo sapiens
gtgtgcccgggggaagcaggtg

SEQ ID NO: 7837305 - DNA, 22 bp, Homo sapiens
gtgtgcccgggggaagcaggtg

SEQ ID NO: 7837306 - DNA, 22 bp, Homo sapiens
gtgtgcccaggtaaagcatttc

SEQ ID NO: 7837307 - DNA, 22 bp, Homo sapiens
gtgtgcctcgccaagctgtcgg

SEQ ID NO: 7837308 - DNA, 22 bp, Homo sapiens
gtgtgcctcccattagggtgta

SEQ ID NO: 7837309 - DNA, 22 bp, Homo sapiens
gtgtgcccttgttcagcagagt

SEQ ID NO: 7837310 - DNA, 22 bp, Homo sapiens
gtgtggcctcaacgggatgcaa

SEQ ID NO: 7837311 - DNA, 23 bp, Homo sapiens
gtgtgcctttatcttctgtactc

SEQ ID NO: 7837312 - DNA, 22 bp, Homo sapiens
gtgtggccttgggagaggtctg

SEQ ID NO: 7837313 - DNA, 22 bp, Homo sapiens
gtgtggccttgggagaggtctg

SEQ ID NO: 7837314 - DNA, 22 bp, Homo sapiens
gtgtggctacctcagaggagca

SEQ ID NO: 7837315 - DNA, 22 bp, Homo sapiens
gtgtggctagaagtgtcttgtt

SEQ ID NO: 7837316 - DNA, 22 bp, Homo sapiens
gtgtggctacctcagaggagca

SEQ ID NO: 7837317 - DNA, 22 bp, Homo sapiens
gtgtggctacctcagaggagca

SEQ ID NO: 7837318 - DNA, 18 bp, Homo sapiens
gtgtggctgagatgaggc

SEQ ID NO: 7837319 - DNA, 22 bp, Homo sapiens
gtgtggctaggatggctttgct

SEQ ID NO: 7837320 - DNA, 22 bp, Homo sapiens
gtgtggctgaaatcaaggcagg

SEQ ID NO: 7837321 - DNA, 22 bp, Homo sapiens
gtgtggctgattgacatggtca

SEQ ID NO: 7837322 - DNA, 18 bp, Homo sapiens
gtgtggctgagatgaggc

SEQ ID NO: 7837323 - DNA, 22 bp, Homo sapiens
gtgtggctgtttagtgactttc

SEQ ID NO: 7837324 - DNA, 22 bp, Homo sapiens
tacatagaacatgtttaatgtc

SEQ ID NO: 7837325 - DNA, 22 bp, Homo sapiens
tacatactttttcttgcaagca

SEQ ID NO: 7837326 - DNA, 22 bp, Homo sapiens
tacatagagggtaatagcatca

SEQ ID NO: 7837327 - DNA, 22 bp, Homo sapiens
tacatagagggtaatagcatca

SEQ ID NO: 7837328 - DNA, 22 bp, Homo sapiens
tacatagagaagttacagtgga

SEQ ID NO: 7837329 - DNA, 22 bp, Homo sapiens
tacatagattttgaaactggac

SEQ ID NO: 7837330 - DNA, 21 bp, Homo sapiens
tacatagaggtgatatctgtt

SEQ ID NO: 7837331 - DNA, 22 bp, Homo sapiens
tacatagattttgaaactggac

SEQ ID NO: 7837332 - DNA, 22 bp, Homo sapiens
tacatagagggtaatagcatca

SEQ ID NO: 7837333 - DNA, 22 bp, Homo sapiens
tacatagagggtaatagcatca

SEQ ID NO: 7837334 - DNA, 22 bp, Homo sapiens
tacatagagggtaatagcatca

SEQ ID NO: 7837335 - DNA, 21 bp, Homo sapiens
tacatagaggtgatatctgtt

SEQ ID NO: 7837336 - DNA, 22 bp, Homo sapiens
tacatacatgtatgtgtgtatt

SEQ ID NO: 7837337 - DNA, 22 bp, Homo sapiens
tacatacatgtatgtgtgtatt

SEQ ID NO: 7837338 - DNA, 22 bp, Homo sapiens
tacatacatgtatgtgtgtatt

SEQ ID NO: 7837339 - DNA, 22 bp, Homo sapiens
tacatacattacctcatttagt

SEQ ID NO: 7837340 - DNA, 22 bp, Homo sapiens
tacatacattacctcatttagt

SEQ ID NO: 7837341 - DNA, 22 bp, Homo sapiens
tacatacatgtatgtgtgtatt

SEQ ID NO: 7837342 - DNA, 22 bp, Homo sapiens
tacatactccataatgacagca

SEQ ID NO: 7837343 - DNA, 22 bp, Homo sapiens
tacatacattacctcatttagt

SEQ ID NO: 7837344 - DNA, 22 bp, Homo sapiens
tacatacattacctcatttagt

SEQ ID NO: 7837345 - DNA, 22 bp, Homo sapiens
tacatacattacctcatttagt

SEQ ID NO: 7837346 - DNA, 22 bp, Homo sapiens
tacagtaatgtgtccctgcagg

SEQ ID NO: 7837347 - DNA, 22 bp, Homo sapiens
tacagtaatctggacatgattt

SEQ ID NO: 7837348 - DNA, 22 bp, Homo sapiens
tacagtaatctggacatgattt

SEQ ID NO: 7837349 - DNA, 22 bp, Homo sapiens
tacagtaatctggacatgattt

SEQ ID NO: 7837350 - DNA, 22 bp, Homo sapiens
tacagtaataaaatgagctaca

SEQ ID NO: 7837351 - DNA, 22 bp, Homo sapiens
tacagtaatctggacatgattt

SEQ ID NO: 7837352 - DNA, 22 bp, Homo sapiens
tacagtaatctggacatgattt

SEQ ID NO: 7837353 - DNA, 22 bp, Homo sapiens
tacagtaatctggacatgattt

SEQ ID NO: 7837354 - DNA, 22 bp, Homo sapiens
tacagtaagatgaaatagcaat

SEQ ID NO: 7837355 - DNA, 21 bp, Homo sapiens
tacagtaagttgggtggtcct

SEQ ID NO: 7837356 - DNA, 21 bp, Homo sapiens
tacagtaagttgggtggtcct

SEQ ID NO: 7837357 - DNA, 22 bp, Homo sapiens
tacagtaataaaatgagctaca

SEQ ID NO: 7837358 - DNA, 22 bp, Homo sapiens
tacagtaataaaatgagctaca

SEQ ID NO: 7837359 - DNA, 22 bp, Homo sapiens
tacagtagaatttttagtaact

SEQ ID NO: 7837360 - DNA, 22 bp, Homo sapiens
tacagtagaatgcggtgccagt

SEQ ID NO: 7837361 - DNA, 22 bp, Homo sapiens
tacagtagacaatgttagtatg

SEQ ID NO: 7837362 - DNA, 22 bp, Homo sapiens
tacagtagaatttttagtaact

SEQ ID NO: 7837363 - DNA, 22 bp, Homo sapiens
tacagtagctactcaataacta

SEQ ID NO: 7837364 - DNA, 22 bp, Homo sapiens
tacagtagctgaggttctcagg

SEQ ID NO: 7837365 - DNA, 22 bp, Homo sapiens
tacatacatggtggaatggtta

SEQ ID NO: 7837366 - DNA, 22 bp, Homo sapiens
tacagtagaatcttatagccca

SEQ ID NO: 7837367 - DNA, 22 bp, Homo sapiens
tacagtacctgccacgttgttg

SEQ ID NO: 7837368 - DNA, 22 bp, Homo sapiens
tacagtacacaggtaccaagct

SEQ ID NO: 7837369 - DNA, 22 bp, Homo sapiens
tacagtacagtctagactctgg

SEQ ID NO: 7837370 - DNA, 22 bp, Homo sapiens
tacagtaccctgatgaactaaa

SEQ ID NO: 7837371 - DNA, 22 bp, Homo sapiens
tacagtaccagaaatgctaaga

SEQ ID NO: 7837372 - DNA, 22 bp, Homo sapiens
tacaggaggattatcaaaggat

SEQ ID NO: 7837373 - DNA, 19 bp, Homo sapiens
tacaggaggcctgcaatct

SEQ ID NO: 7837374 - DNA, 20 bp, Homo sapiens
tacaggagtgagtgggtggg

SEQ ID NO: 7837375 - DNA, 20 bp, Homo sapiens
tacaggagtgagtgggtggg

SEQ ID NO: 7837376 - DNA, 19 bp, Homo sapiens
tacaggaggcctgcaatct

SEQ ID NO: 7837377 - DNA, 19 bp, Homo sapiens
tacaggcagtttctacaat

SEQ ID NO: 7837378 - DNA, 19 bp, Homo sapiens
tacaggcagtttctacaat

SEQ ID NO: 7837379 - DNA, 19 bp, Homo sapiens
tacaggcagtttctacaat

SEQ ID NO: 7837380 - DNA, 22 bp, Homo sapiens
tacaggcactgaaatgcttatt

SEQ ID NO: 7837381 - DNA, 22 bp, Homo sapiens
tacaggcactgaaatgcttatt

SEQ ID NO: 7837382 - DNA, 17 bp, Homo sapiens
tacaggagagcaggaac

SEQ ID NO: 7837383 - DNA, 17 bp, Homo sapiens
tacaggagagcaggaac

SEQ ID NO: 7837384 - DNA, 22 bp, Homo sapiens
tacagcactctggggagcatga

SEQ ID NO: 7837385 - DNA, 22 bp, Homo sapiens
tacagcacggtgcatttactac

SEQ ID NO: 7837386 - DNA, 22 bp, Homo sapiens
tacagcacggtgcatttactac

SEQ ID NO: 7837387 - DNA, 21 bp, Homo sapiens
tacagcaccgagtaggccctc

SEQ ID NO: 7837388 - DNA, 22 bp, Homo sapiens
tacaggagcacaaaagagttga

SEQ ID NO: 7837389 - DNA, 22 bp, Homo sapiens
tacaggagcacaaaagagttga

SEQ ID NO: 7837390 - DNA, 22 bp, Homo sapiens
tacaggagcacaaaagagttga

SEQ ID NO: 7837391 - DNA, 22 bp, Homo sapiens
tacagcactctggggagcatga

SEQ ID NO: 7837392 - DNA, 22 bp, Homo sapiens
tacaggagctgctctgtgatac

SEQ ID NO: 7837393 - DNA, 22 bp, Homo sapiens
tacaggagcatggggaagggat

SEQ ID NO: 7837394 - DNA, 22 bp, Homo sapiens
tacaggagcatggggaagggat

SEQ ID NO: 7837395 - DNA, 22 bp, Homo sapiens
tacaggcatgtagcatggtgat

SEQ ID NO: 7837396 - DNA, 22 bp, Homo sapiens
tacaggcatgaatgaaatctgt

SEQ ID NO: 7837397 - DNA, 22 bp, Homo sapiens
tacaggcatgaatgaaatctgt

SEQ ID NO: 7837398 - DNA, 19 bp, Homo sapiens
tacaggcagtttctacaat

SEQ ID NO: 7837399 - DNA, 22 bp, Homo sapiens
tacaggcccatagtccctgctt

SEQ ID NO: 7837400 - DNA, 22 bp, Homo sapiens
tacaggcccatagtccctgctt

SEQ ID NO: 7837401 - DNA, 22 bp, Homo sapiens
tacaggcccatagtccctgctt

SEQ ID NO: 7837402 - DNA, 20 bp, Homo sapiens
tacaggctctgagagatgat

SEQ ID NO: 7837403 - DNA, 20 bp, Homo sapiens
tacaggctctgagagatgat

SEQ ID NO: 7837404 - DNA, 22 bp, Homo sapiens
tacaggctgcagggctagaggg

SEQ ID NO: 7837405 - DNA, 22 bp, Homo sapiens
tacaggctgcagggctagaggg

SEQ ID NO: 7837406 - DNA, 22 bp, Homo sapiens
tacaggctcttgtcagacgtat

SEQ ID NO: 7837407 - DNA, 22 bp, Homo sapiens
tacaggctgcagggctagaggg

SEQ ID NO: 7837408 - DNA, 22 bp, Homo sapiens
tacagtaagatgaaatagcaat

SEQ ID NO: 7837409 - DNA, 22 bp, Homo sapiens
tacagtaagatgaaatagcaat

SEQ ID NO: 7837410 - DNA, 22 bp, Homo sapiens
tacagtaactggaattcttctt

SEQ ID NO: 7837411 - DNA, 22 bp, Homo sapiens
tacagtaagatgaaatagcaat

SEQ ID NO: 7837412 - DNA, 22 bp, Homo sapiens
tacagtaagatgaaatagcaat

SEQ ID NO: 7837413 - DNA, 22 bp, Homo sapiens
tacagggactcccgcagagata

SEQ ID NO: 7837414 - DNA, 22 bp, Homo sapiens
tacagggaccaataataactat

SEQ ID NO: 7837415 - DNA, 22 bp, Homo sapiens
tacagggactcccgcagagata

SEQ ID NO: 7837416 - DNA, 22 bp, Homo sapiens
tacagtaactggaattcttctt

SEQ ID NO: 7837417 - DNA, 22 bp, Homo sapiens
tacattctactttttcactccc

SEQ ID NO: 7837418 - DNA, 22 bp, Homo sapiens
tacattccttcgtttagagatt

SEQ ID NO: 7837419 - DNA, 22 bp, Homo sapiens
tacattctactttttcactccc

SEQ ID NO: 7837420 - DNA, 22 bp, Homo sapiens
tacattctactttttcactccc

SEQ ID NO: 7837421 - DNA, 22 bp, Homo sapiens
tacattctactttttcactccc

SEQ ID NO: 7837422 - DNA, 22 bp, Homo sapiens
tacattctatatctgttacatc

SEQ ID NO: 7837423 - DNA, 22 bp, Homo sapiens
tacattctcttcccattgtctc

SEQ ID NO: 7837424 - DNA, 22 bp, Homo sapiens
tacattctatatctgttacatc

SEQ ID NO: 7837425 - DNA, 22 bp, Homo sapiens
tacattctatatctgttacatc

SEQ ID NO: 7837426 - DNA, 22 bp, Homo sapiens
tacattctatatctgttacatc

SEQ ID NO: 7837427 - DNA, 22 bp, Homo sapiens
tacattctatatctgttacatc

SEQ ID NO: 7837428 - DNA, 22 bp, Homo sapiens
tacattctatatctgttacatc

SEQ ID NO: 7837429 - DNA, 22 bp, Homo sapiens
tacattctcttcccattgtctc

SEQ ID NO: 7837430 - DNA, 22 bp, Homo sapiens
tacattctcttcccattgtctc

SEQ ID NO: 7837431 - DNA, 22 bp, Homo sapiens
tacattctgaaataaatggttt

SEQ ID NO: 7837432 - DNA, 22 bp, Homo sapiens
tacattctgaaataaatggttt

SEQ ID NO: 7837433 - DNA, 22 bp, Homo sapiens
tacattctggaaaggcacagac

SEQ ID NO: 7837434 - DNA, 22 bp, Homo sapiens
tacattctgaaataaatggttt

SEQ ID NO: 7837435 - DNA, 22 bp, Homo sapiens
tacattctcttcccattgtctc

SEQ ID NO: 7837436 - DNA, 22 bp, Homo sapiens
tacattctgaaataaatggttt

SEQ ID NO: 7837437 - DNA, 16 bp, Homo sapiens
tacattctgatcactg

SEQ ID NO: 7837438 - DNA, 16 bp, Homo sapiens
tacattctgatcactg

SEQ ID NO: 7837439 - DNA, 23 bp, Homo sapiens
tacattctgtatttttatagagt

SEQ ID NO: 7837440 - DNA, 22 bp, Homo sapiens
tacattgaaagtcatttaatcc

SEQ ID NO: 7837441 - DNA, 22 bp, Homo sapiens
tacattgaaagtcatttaatcc

SEQ ID NO: 7837442 - DNA, 22 bp, Homo sapiens
tacattgaaatcaatggatgtg

SEQ ID NO: 7837443 - DNA, 22 bp, Homo sapiens
tacattctggtggagaaagtaa

SEQ ID NO: 7837444 - DNA, 23 bp, Homo sapiens
tacattctgtatttttatagagt

SEQ ID NO: 7837445 - DNA, 23 bp, Homo sapiens
tacattctgtatttttatagagt

SEQ ID NO: 7837446 - DNA, 23 bp, Homo sapiens
tacattctgtatttttatagagt

SEQ ID NO: 7837447 - DNA, 23 bp, Homo sapiens
tacattctgtatttttatagagt

SEQ ID NO: 7837448 - DNA, 23 bp, Homo sapiens
tacattctgtatttttatagagt

SEQ ID NO: 7837449 - DNA, 22 bp, Homo sapiens
tacattctggtggagaaagtaa

SEQ ID NO: 7837450 - DNA, 22 bp, Homo sapiens
tacattctggtggagaaagtaa

SEQ ID NO: 7837451 - DNA, 22 bp, Homo sapiens
tacattctggtggagaaagtaa

SEQ ID NO: 7837452 - DNA, 22 bp, Homo sapiens
tacatttcctgtcagagatata

SEQ ID NO: 7837453 - DNA, 21 bp, Homo sapiens
tacatttgagagctataagct

SEQ ID NO: 7837454 - DNA, 21 bp, Homo sapiens
tacatttgagagctataagct

SEQ ID NO: 7837455 - DNA, 22 bp, Homo sapiens
tacatttgattctctcctccaa

SEQ ID NO: 7837456 - DNA, 22 bp, Homo sapiens
tacattgagtattatttagcca

SEQ ID NO: 7837457 - DNA, 22 bp, Homo sapiens
tacattgaggcagtagctggag

SEQ ID NO: 7837458 - DNA, 22 bp, Homo sapiens
tacattgagcacgtactatgtg

SEQ ID NO: 7837459 - DNA, 22 bp, Homo sapiens
tacatttggatgtgcttaagtg

SEQ ID NO: 7837460 - DNA, 22 bp, Homo sapiens
tacatttggatgtgcttaagtg

SEQ ID NO: 7837461 - DNA, 22 bp, Homo sapiens
tacatttgctttgattttcagc

SEQ ID NO: 7837462 - DNA, 21 bp, Homo sapiens
tacattgactacaaataaagc

SEQ ID NO: 7837463 - DNA, 21 bp, Homo sapiens
tacattgactacaaataaagc

SEQ ID NO: 7837464 - DNA, 21 bp, Homo sapiens
tacattgactacaaataaagc

SEQ ID NO: 7837465 - DNA, 21 bp, Homo sapiens
tacattgactacaaataaagc

SEQ ID NO: 7837466 - DNA, 22 bp, Homo sapiens
tacattgaattttttagcatgt

SEQ ID NO: 7837467 - DNA, 21 bp, Homo sapiens
tacattgaagaatgggaatga

SEQ ID NO: 7837468 - DNA, 22 bp, Homo sapiens
tacattgactgtgtgcatcaca

SEQ ID NO: 7837469 - DNA, 22 bp, Homo sapiens
tacattgactctctgtccctaa

SEQ ID NO: 7837470 - DNA, 22 bp, Homo sapiens
tacattgactctctgtccctaa

SEQ ID NO: 7837471 - DNA, 22 bp, Homo sapiens
tacattgagaaccactgcttag

SEQ ID NO: 7837472 - DNA, 22 bp, Homo sapiens
tacattgagaaccactgcttag

SEQ ID NO: 7837473 - DNA, 22 bp, Homo sapiens
tacattgacttggattgttaga

SEQ ID NO: 7837474 - DNA, 22 bp, Homo sapiens
tacatatagacagttactctag

SEQ ID NO: 7837475 - DNA, 22 bp, Homo sapiens
tacatatagacagttactctag

SEQ ID NO: 7837476 - DNA, 22 bp, Homo sapiens
tacatatagacagttactctag

SEQ ID NO: 7837477 - DNA, 22 bp, Homo sapiens
tacatatagacagttactctag

SEQ ID NO: 7837478 - DNA, 22 bp, Homo sapiens
tacatatactgagtgatttgct

SEQ ID NO: 7837479 - DNA, 22 bp, Homo sapiens
tacatatagacagttactctag

SEQ ID NO: 7837480 - DNA, 22 bp, Homo sapiens
tacatatagacagttactctag

SEQ ID NO: 7837481 - DNA, 22 bp, Homo sapiens
tacatcatggcttcatgctgca

SEQ ID NO: 7837482 - DNA, 22 bp, Homo sapiens
tacatatagacagttactctag

SEQ ID NO: 7837483 - DNA, 22 bp, Homo sapiens
tacatcatggtgagcaggaggc

SEQ ID NO: 7837484 - DNA, 22 bp, Homo sapiens
tacatcatggcttcatgctgca

SEQ ID NO: 7837485 - DNA, 22 bp, Homo sapiens
tacatatactgagtgatttgct

SEQ ID NO: 7837486 - DNA, 22 bp, Homo sapiens
tacatatactgagtgatttgct

SEQ ID NO: 7837487 - DNA, 22 bp, Homo sapiens
tacatatactgagtgatttgct

SEQ ID NO: 7837488 - DNA, 22 bp, Homo sapiens
tacatatactgagtgatttgct

SEQ ID NO: 7837489 - DNA, 22 bp, Homo sapiens
tacatatactgagtgatttgct

SEQ ID NO: 7837490 - DNA, 22 bp, Homo sapiens
tacatagttccatttacaggaa

SEQ ID NO: 7837491 - DNA, 22 bp, Homo sapiens
tacatagttccacttctgtttt

SEQ ID NO: 7837492 - DNA, 22 bp, Homo sapiens
tacatagtgaacatttacagag

SEQ ID NO: 7837493 - DNA, 22 bp, Homo sapiens
tacatagtgaacatttacagag

SEQ ID NO: 7837494 - DNA, 22 bp, Homo sapiens
tacatagctcctagtgatgcat

SEQ ID NO: 7837495 - DNA, 22 bp, Homo sapiens
tacatagctcctagtgatgcat

SEQ ID NO: 7837496 - DNA, 22 bp, Homo sapiens
tacatagcaaggaaatgacaga

SEQ ID NO: 7837497 - DNA, 22 bp, Homo sapiens
tacatagtattcacattgtttt

SEQ ID NO: 7837498 - DNA, 22 bp, Homo sapiens
tacatagtattcacattgtttt

SEQ ID NO: 7837499 - DNA, 22 bp, Homo sapiens
tacatagctcctagtgatgcat

SEQ ID NO: 7837500 - DNA, 22 bp, Homo sapiens
tacataggtacagcctttttta

SEQ ID NO: 7837501 - DNA, 22 bp, Homo sapiens
tacataggtacagcctttttta

SEQ ID NO: 7837502 - DNA, 22 bp, Homo sapiens
tacatcattttggagatgagca

SEQ ID NO: 7837503 - DNA, 22 bp, Homo sapiens
tacatcccagccagcagaatca

SEQ ID NO: 7837504 - DNA, 22 bp, Homo sapiens
tacatccaaatgaattagaatt

SEQ ID NO: 7837505 - DNA, 22 bp, Homo sapiens
tacatccaaatgaattagaatt

SEQ ID NO: 7837506 - DNA, 22 bp, Homo sapiens
tacatcatgtaagcagaatcat

SEQ ID NO: 7837507 - DNA, 22 bp, Homo sapiens
tacatcattttggagatgagca

SEQ ID NO: 7837508 - DNA, 22 bp, Homo sapiens
tacatctagccttacaattatt

SEQ ID NO: 7837509 - DNA, 22 bp, Homo sapiens
tacatccaaagttgaggtgcct

SEQ ID NO: 7837510 - DNA, 19 bp, Homo sapiens
tacatcctcttcctctttg

SEQ ID NO: 7837511 - DNA, 22 bp, Homo sapiens
tacatctatactgatctacatt

SEQ ID NO: 7837512 - DNA, 22 bp, Homo sapiens
tacatctatactgatctacatt

SEQ ID NO: 7837513 - DNA, 22 bp, Homo sapiens
tacatctagccttacaattatt

SEQ ID NO: 7837514 - DNA, 22 bp, Homo sapiens
tacatcatgtaagcagaatcat

SEQ ID NO: 7837515 - DNA, 22 bp, Homo sapiens
tacatctatctagatgctcaga

SEQ ID NO: 7837516 - DNA, 18 bp, Homo sapiens
tacatctatatagtgttt

SEQ ID NO: 7837517 - DNA, 22 bp, Homo sapiens
tacatctatactgatctacatt

SEQ ID NO: 7837518 - DNA, 22 bp, Homo sapiens
tacatctatctagatgctcaga

SEQ ID NO: 7837519 - DNA, 18 bp, Homo sapiens
tacatctatatagtgttt

SEQ ID NO: 7837520 - DNA, 20 bp, Homo sapiens
tacatctctcagatgtctaa

SEQ ID NO: 7837521 - DNA, 22 bp, Homo sapiens
tacatctcatctgtgctctccg

SEQ ID NO: 7837522 - DNA, 22 bp, Homo sapiens
tacatctatttgacagatacag

SEQ ID NO: 7837523 - DNA, 22 bp, Homo sapiens
tacattcctgttagcatctaag

SEQ ID NO: 7837524 - DNA, 22 bp, Homo sapiens
tacattcctgggctccacccta

SEQ ID NO: 7837525 - DNA, 22 bp, Homo sapiens
tacatgaacaaaatagcagaaa

SEQ ID NO: 7837526 - DNA, 22 bp, Homo sapiens
tacagagtatttttaatatggt

SEQ ID NO: 7837527 - DNA, 22 bp, Homo sapiens
tacagagtgttattacagaatc

SEQ ID NO: 7837528 - DNA, 22 bp, Homo sapiens
tacagagtgttattacagaatc

SEQ ID NO: 7837529 - DNA, 22 bp, Homo sapiens
tacagagttttcctgccaagaa

SEQ ID NO: 7837530 - DNA, 22 bp, Homo sapiens
tacagaagtaaataccaaaagc

SEQ ID NO: 7837531 - DNA, 17 bp, Homo sapiens
tacagaaggcaccacaa

SEQ ID NO: 7837532 - DNA, 17 bp, Homo sapiens
tacagaaggcaccacaa

SEQ ID NO: 7837533 - DNA, 22 bp, Homo sapiens
tacagataaattttaagtagaa

SEQ ID NO: 7837534 - DNA, 22 bp, Homo sapiens
tacagatacagatctagataca

SEQ ID NO: 7837535 - DNA, 22 bp, Homo sapiens
tacagatagaattagtgagtta

SEQ ID NO: 7837536 - DNA, 22 bp, Homo sapiens
tacagaaattgccaccagctct

SEQ ID NO: 7837537 - DNA, 22 bp, Homo sapiens
tacagaaattgccaccagctct

SEQ ID NO: 7837538 - DNA, 22 bp, Homo sapiens
tacagaaattgccaccagctct

SEQ ID NO: 7837539 - DNA, 22 bp, Homo sapiens
tacagaaattgccaccagctct

SEQ ID NO: 7837540 - DNA, 22 bp, Homo sapiens
tacagaaatcacatcgctttga

SEQ ID NO: 7837541 - DNA, 22 bp, Homo sapiens
tacagaaatcacatcgctttga

SEQ ID NO: 7837542 - DNA, 22 bp, Homo sapiens
tacagaaatactggggggttct

SEQ ID NO: 7837543 - DNA, 22 bp, Homo sapiens
tacagaaatactggggggttct

SEQ ID NO: 7837544 - DNA, 22 bp, Homo sapiens
tacagaaatacagtcaggccta

SEQ ID NO: 7837545 - DNA, 22 bp, Homo sapiens
tacagaaatacagtcaggccta

SEQ ID NO: 7837546 - DNA, 22 bp, Homo sapiens
tacagaaatacagtcaggccta

SEQ ID NO: 7837547 - DNA, 22 bp, Homo sapiens
tacagaaatacagtcaggccta

SEQ ID NO: 7837548 - DNA, 22 bp, Homo sapiens
tacagaaatcacatcgctttga

SEQ ID NO: 7837549 - DNA, 22 bp, Homo sapiens
tacagaaatcacatcgctttga

SEQ ID NO: 7837550 - DNA, 22 bp, Homo sapiens
tacagaaatcacatcgctttga

SEQ ID NO: 7837551 - DNA, 23 bp, Homo sapiens
tacagaaggagtagtcactaaga

SEQ ID NO: 7837552 - DNA, 23 bp, Homo sapiens
tacagaaggagtagtcactaaga

SEQ ID NO: 7837553 - DNA, 22 bp, Homo sapiens
tacagaagcttttgaaaagatg

SEQ ID NO: 7837554 - DNA, 22 bp, Homo sapiens
tacagaagcttttgaaaagatg

SEQ ID NO: 7837555 - DNA, 22 bp, Homo sapiens
tacagaagctgagacactgaga

SEQ ID NO: 7837556 - DNA, 22 bp, Homo sapiens
tacagaaattgccaccagctct

SEQ ID NO: 7837557 - DNA, 22 bp, Homo sapiens
tacagaaattgccaccagctct

SEQ ID NO: 7837558 - DNA, 22 bp, Homo sapiens
tacagaagctgagacactgaga

SEQ ID NO: 7837559 - DNA, 22 bp, Homo sapiens
tacagaagctgagacactgaga

SEQ ID NO: 7837560 - DNA, 18 bp, Homo sapiens
tacagaactggagtagaa

SEQ ID NO: 7837561 - DNA, 22 bp, Homo sapiens
tacagcaatgcctgaaatagta

SEQ ID NO: 7837562 - DNA, 22 bp, Homo sapiens
tacagcaatgcctgaaatagta

SEQ ID NO: 7837563 - DNA, 22 bp, Homo sapiens
tacagcaatgcctgaaatagta

SEQ ID NO: 7837564 - DNA, 22 bp, Homo sapiens
tacagcaatgcctgaaatagta

SEQ ID NO: 7837565 - DNA, 22 bp, Homo sapiens
tacagcaatggttctaagagtc

SEQ ID NO: 7837566 - DNA, 22 bp, Homo sapiens
tacagcacagcaaagaggacgg

SEQ ID NO: 7837567 - DNA, 22 bp, Homo sapiens
tacagcaataatgacaccgctc

SEQ ID NO: 7837568 - DNA, 21 bp, Homo sapiens
tacagcaacggaggttttcta

SEQ ID NO: 7837569 - DNA, 22 bp, Homo sapiens
tacagcaataatgacaccgctc

SEQ ID NO: 7837570 - DNA, 22 bp, Homo sapiens
tacagattttgtgaagaagtgt

SEQ ID NO: 7837571 - DNA, 22 bp, Homo sapiens
tacagattttgtgaagaagtgt

SEQ ID NO: 7837572 - DNA, 22 bp, Homo sapiens
tacagattttgtgaagaagtgt

SEQ ID NO: 7837573 - DNA, 22 bp, Homo sapiens
tacagattttgtgaagaagtgt

SEQ ID NO: 7837574 - DNA, 22 bp, Homo sapiens
tacagcaaagaaaccctcagtc

SEQ ID NO: 7837575 - DNA, 21 bp, Homo sapiens
tacagatgaggagaccaaggc

SEQ ID NO: 7837576 - DNA, 21 bp, Homo sapiens
tacagatgaggagaccaaggc

SEQ ID NO: 7837577 - DNA, 21 bp, Homo sapiens
tacagatgaggagaccaaggc

SEQ ID NO: 7837578 - DNA, 21 bp, Homo sapiens
tacagatgaggagaccaaggc

SEQ ID NO: 7837579 - DNA, 22 bp, Homo sapiens
tacagatattgtacagttatag

SEQ ID NO: 7837580 - DNA, 22 bp, Homo sapiens
tacagatattgtacagttatag

SEQ ID NO: 7837581 - DNA, 22 bp, Homo sapiens
tacagatatttctcttcaacaa

SEQ ID NO: 7837582 - DNA, 22 bp, Homo sapiens
tacagattgaggtttttaatat

SEQ ID NO: 7837583 - DNA, 18 bp, Homo sapiens
tacagattatagatacat

SEQ ID NO: 7837584 - DNA, 18 bp, Homo sapiens
tacagattatagatacat

SEQ ID NO: 7837585 - DNA, 22 bp, Homo sapiens
tacagattgaggtttttaatat

SEQ ID NO: 7837586 - DNA, 22 bp, Homo sapiens
tacagatttggggagtaaagtt

SEQ ID NO: 7837587 - DNA, 22 bp, Homo sapiens
tacagatttggggagtaaagtt

SEQ ID NO: 7837588 - DNA, 22 bp, Homo sapiens
tacagatttggggagtaaagtt

SEQ ID NO: 7837589 - DNA, 22 bp, Homo sapiens
tacagataggaggaatctgaaa

SEQ ID NO: 7837590 - DNA, 22 bp, Homo sapiens
tacagataggaggaatctgaaa

SEQ ID NO: 7837591 - DNA, 22 bp, Homo sapiens
tacagataggaggaatctgaaa

SEQ ID NO: 7837592 - DNA, 22 bp, Homo sapiens
tacagatatagagatttataga

SEQ ID NO: 7837593 - DNA, 22 bp, Homo sapiens
tacagatatagagatttataga

SEQ ID NO: 7837594 - DNA, 22 bp, Homo sapiens
tacagatatgtatgcacttttt

SEQ ID NO: 7837595 - DNA, 22 bp, Homo sapiens
tacagatatgttccatgcatcg

SEQ ID NO: 7837596 - DNA, 22 bp, Homo sapiens
tacaacaggaatttcaactttg

SEQ ID NO: 7837597 - DNA, 21 bp, Homo sapiens
tacaacaggttttatttcgat

SEQ ID NO: 7837598 - DNA, 22 bp, Homo sapiens
tacaacaggaatttcaactttg

SEQ ID NO: 7837599 - DNA, 22 bp, Homo sapiens
tacaacagacctagatgaatga

SEQ ID NO: 7837600 - DNA, 22 bp, Homo sapiens
tacaacaatttccacattagaa

SEQ ID NO: 7837601 - DNA, 22 bp, Homo sapiens
tacaacagacctagatgaatga

SEQ ID NO: 7837602 - DNA, 22 bp, Homo sapiens
tacaacagaagtgtttatttag

SEQ ID NO: 7837603 - DNA, 22 bp, Homo sapiens
tacaacagacaggaataagatt

SEQ ID NO: 7837604 - DNA, 22 bp, Homo sapiens
tacaacagacaggaataagatt

SEQ ID NO: 7837605 - DNA, 22 bp, Homo sapiens
tacaacactggttcgacatgtg

SEQ ID NO: 7837606 - DNA, 22 bp, Homo sapiens
tacaacaatttccacattagaa

SEQ ID NO: 7837607 - DNA, 20 bp, Homo sapiens
tacaacaagtagagacatac

SEQ ID NO: 7837608 - DNA, 22 bp, Homo sapiens
tacaacaatttccacattagaa

SEQ ID NO: 7837609 - DNA, 22 bp, Homo sapiens
tacaacaatttccacattagaa

SEQ ID NO: 7837610 - DNA, 22 bp, Homo sapiens
tacaacaatttccacattagaa

SEQ ID NO: 7837611 - DNA, 22 bp, Homo sapiens
tacaacaatttccacattagaa

SEQ ID NO: 7837612 - DNA, 22 bp, Homo sapiens
tacaacaatttccacattagaa

SEQ ID NO: 7837613 - DNA, 22 bp, Homo sapiens
tacaaatccaagacccatacaa

SEQ ID NO: 7837614 - DNA, 22 bp, Homo sapiens
tacaaatgaaccaactttgatg

SEQ ID NO: 7837615 - DNA, 22 bp, Homo sapiens
tacaaatcagatcatgagttta

SEQ ID NO: 7837616 - DNA, 22 bp, Homo sapiens
tacaaatcagatcatgagttta

SEQ ID NO: 7837617 - DNA, 20 bp, Homo sapiens
tacaacaagtagagacatac

SEQ ID NO: 7837618 - DNA, 20 bp, Homo sapiens
tacaacaagtagagacatac

SEQ ID NO: 7837619 - DNA, 22 bp, Homo sapiens
tacaaatccaagacccatacaa

SEQ ID NO: 7837620 - DNA, 20 bp, Homo sapiens
tacaacaagtagagacatac

SEQ ID NO: 7837621 - DNA, 20 bp, Homo sapiens
tacaacaagtagagacatac

SEQ ID NO: 7837622 - DNA, 22 bp, Homo sapiens
tacaaagtcagaataacaggtg

SEQ ID NO: 7837623 - DNA, 22 bp, Homo sapiens
tacaaagtcagaataacaggtg

SEQ ID NO: 7837624 - DNA, 22 bp, Homo sapiens
tacaaagtcagaataacaggtg

SEQ ID NO: 7837625 - DNA, 22 bp, Homo sapiens
tacaaagtcccattgccatgga

SEQ ID NO: 7837626 - DNA, 22 bp, Homo sapiens
tacaaagtcttgggttctaggc

SEQ ID NO: 7837627 - DNA, 22 bp, Homo sapiens
tacaaagtgaaataattctgag

SEQ ID NO: 7837628 - DNA, 22 bp, Homo sapiens
tacaaagtgaaataattctgag

SEQ ID NO: 7837629 - DNA, 22 bp, Homo sapiens
tacaaagtgaaataattctgag

SEQ ID NO: 7837630 - DNA, 22 bp, Homo sapiens
tacaaagtgagcaacctctttt

SEQ ID NO: 7837631 - DNA, 22 bp, Homo sapiens
tacaaagtgctttagaaatgaa

SEQ ID NO: 7837632 - DNA, 22 bp, Homo sapiens
tacaaagtgctttagaaatgaa

SEQ ID NO: 7837633 - DNA, 22 bp, Homo sapiens
tacaaagtgagcaacctctttt

SEQ ID NO: 7837634 - DNA, 22 bp, Homo sapiens
tacaaagtgctttagaaatgaa

SEQ ID NO: 7837635 - DNA, 22 bp, Homo sapiens
tacaaagtgctttagaaatgaa

SEQ ID NO: 7837636 - DNA, 22 bp, Homo sapiens
tacaaagtgctttagaaatgaa

SEQ ID NO: 7837637 - DNA, 22 bp, Homo sapiens
tacaaagtgctttagaaatgaa

SEQ ID NO: 7837638 - DNA, 22 bp, Homo sapiens
tacaaagtgtgcccatgctgag

SEQ ID NO: 7837639 - DNA, 22 bp, Homo sapiens
tacaaagtgtgcccatgctgag

SEQ ID NO: 7837640 - DNA, 22 bp, Homo sapiens
tacaaagtgggaaacgaaggtt

SEQ ID NO: 7837641 - DNA, 22 bp, Homo sapiens
tacaaagtgggaaacgaaggtt

SEQ ID NO: 7837642 - DNA, 22 bp, Homo sapiens
tacaaagtgggaaacgaaggtt

SEQ ID NO: 7837643 - DNA, 22 bp, Homo sapiens
tacaaagtgctttagaaatgaa

SEQ ID NO: 7837644 - DNA, 22 bp, Homo sapiens
tacaaagtttgagaatgctttc

SEQ ID NO: 7837645 - DNA, 22 bp, Homo sapiens
tacaaagtttgagaatgctttc

SEQ ID NO: 7837646 - DNA, 22 bp, Homo sapiens
tacaaagtgtgcccatgctgag

SEQ ID NO: 7837647 - DNA, 22 bp, Homo sapiens
tacaaagtgaaataattctgag

SEQ ID NO: 7837648 - DNA, 22 bp, Homo sapiens
tacaaagttttcttggattgag

SEQ ID NO: 7837649 - DNA, 22 bp, Homo sapiens
tacaaatcagatcatgagttta

SEQ ID NO: 7837650 - DNA, 22 bp, Homo sapiens
tacaaagtttggggtcctcaaa

SEQ ID NO: 7837651 - DNA, 22 bp, Homo sapiens
tacaacagtaatcaaggttttt

SEQ ID NO: 7837652 - DNA, 22 bp, Homo sapiens
tacaacataacgggcattcagt

SEQ ID NO: 7837653 - DNA, 22 bp, Homo sapiens
tacactattttactgatacaaa

SEQ ID NO: 7837654 - DNA, 22 bp, Homo sapiens
tacactattttactgatacaaa

SEQ ID NO: 7837655 - DNA, 22 bp, Homo sapiens
tacactctaattctttggtcct

SEQ ID NO: 7837656 - DNA, 22 bp, Homo sapiens
tacactctaattctttggtcct

SEQ ID NO: 7837657 - DNA, 22 bp, Homo sapiens
tacactctaattctttggtcct

SEQ ID NO: 7837658 - DNA, 22 bp, Homo sapiens
tacactgaaagagaggattgaa

SEQ ID NO: 7837659 - DNA, 22 bp, Homo sapiens
tacactcttaggaattggttat

SEQ ID NO: 7837660 - DNA, 22 bp, Homo sapiens
tacactcttaggaattggttat

SEQ ID NO: 7837661 - DNA, 22 bp, Homo sapiens
tacactgaagtgtcttggtata

SEQ ID NO: 7837662 - DNA, 22 bp, Homo sapiens
tacacttttctggttactcttg

SEQ ID NO: 7837663 - DNA, 22 bp, Homo sapiens
tacacttttctggttactcttg

SEQ ID NO: 7837664 - DNA, 22 bp, Homo sapiens
tacactttttactacagattct

SEQ ID NO: 7837665 - DNA, 22 bp, Homo sapiens
tacacttttctggttactcttg

SEQ ID NO: 7837666 - DNA, 22 bp, Homo sapiens
tacacttttcaatgtagtctgt

SEQ ID NO: 7837667 - DNA, 22 bp, Homo sapiens
tacactgagcaggaagaagtgg

SEQ ID NO: 7837668 - DNA, 22 bp, Homo sapiens
tacagaaaaacatctggagccg

SEQ ID NO: 7837669 - DNA, 22 bp, Homo sapiens
tacagaaaaacatctggagccg

SEQ ID NO: 7837670 - DNA, 22 bp, Homo sapiens
tacagaaaaacatctggagccg

SEQ ID NO: 7837671 - DNA, 22 bp, Homo sapiens
tacagaaaaacatctggagccg

SEQ ID NO: 7837672 - DNA, 22 bp, Homo sapiens
tacagaaaaacatctggagccg

SEQ ID NO: 7837673 - DNA, 22 bp, Homo sapiens
tacactttttactacagattct

SEQ ID NO: 7837674 - DNA, 20 bp, Homo sapiens
tacagaaacaggacttttgg

SEQ ID NO: 7837675 - DNA, 20 bp, Homo sapiens
tacagaaacaggacttttgg

SEQ ID NO: 7837676 - DNA, 20 bp, Homo sapiens
tacagaaacaggacttttgg

SEQ ID NO: 7837677 - DNA, 22 bp, Homo sapiens
tacagaaacagcgtggttagaa

SEQ ID NO: 7837678 - DNA, 22 bp, Homo sapiens
tacagaaacagcgtggttagaa

SEQ ID NO: 7837679 - DNA, 22 bp, Homo sapiens
tacagaaacagcgtggttagaa

SEQ ID NO: 7837680 - DNA, 22 bp, Homo sapiens
tacagaaacagcgtggttagaa

SEQ ID NO: 7837681 - DNA, 22 bp, Homo sapiens
tacagaaacagcgtggttagaa

SEQ ID NO: 7837682 - DNA, 22 bp, Homo sapiens
tacagaaacagcgtggttagaa

SEQ ID NO: 7837683 - DNA, 22 bp, Homo sapiens
tacagaaaaacttggaggcttt

SEQ ID NO: 7837684 - DNA, 22 bp, Homo sapiens
tacagaaaaactggcattgaag

SEQ ID NO: 7837685 - DNA, 22 bp, Homo sapiens
tacagaaaaactggcattgaag

SEQ ID NO: 7837686 - DNA, 22 bp, Homo sapiens
tacagaaaaactggcattgaag

SEQ ID NO: 7837687 - DNA, 22 bp, Homo sapiens
tacagaaaaacttggaggcttt

SEQ ID NO: 7837688 - DNA, 22 bp, Homo sapiens
tacagaaaaacttggaggcttt

SEQ ID NO: 7837689 - DNA, 22 bp, Homo sapiens
tacagaaagggatgattgatct

SEQ ID NO: 7837690 - DNA, 22 bp, Homo sapiens
tacagaaagggatgattgatct

SEQ ID NO: 7837691 - DNA, 22 bp, Homo sapiens
tacagaaagggatgattgatct

SEQ ID NO: 7837692 - DNA, 22 bp, Homo sapiens
tacagaaagggatgattgatct

SEQ ID NO: 7837693 - DNA, 22 bp, Homo sapiens
tacagaaagacctctcgggaaa

SEQ ID NO: 7837694 - DNA, 22 bp, Homo sapiens
tacagaaagacctctcgggaaa

SEQ ID NO: 7837695 - DNA, 22 bp, Homo sapiens
tacagaaagggatgattgatct

SEQ ID NO: 7837696 - DNA, 22 bp, Homo sapiens
tacagaaagggatgattgatct

SEQ ID NO: 7837697 - DNA, 20 bp, Homo sapiens
tacagaaacaggacttttgg

SEQ ID NO: 7837698 - DNA, 20 bp, Homo sapiens
tacagaaacaggacttttgg

SEQ ID NO: 7837699 - DNA, 22 bp, Homo sapiens
tacagaaagacctctcgggaaa

SEQ ID NO: 7837700 - DNA, 20 bp, Homo sapiens
tacagaaacaggacttttgg

SEQ ID NO: 7837701 - DNA, 22 bp, Homo sapiens
tacaaagtaatgtataatatcg

SEQ ID NO: 7837702 - DNA, 22 bp, Homo sapiens
tacaaagtaatgtataatatcg

SEQ ID NO: 7837703 - DNA, 22 bp, Homo sapiens
tacaaagtaatgtataatatcg

SEQ ID NO: 7837704 - DNA, 22 bp, Homo sapiens
tacaaagtaatgtataatatcg

SEQ ID NO: 7837705 - DNA, 22 bp, Homo sapiens
tacaaagtaatgtataatatcg

SEQ ID NO: 7837706 - DNA, 22 bp, Homo sapiens
tacaaagtaatgtataatatcg

SEQ ID NO: 7837707 - DNA, 22 bp, Homo sapiens
tacaaagggggaagagattctg

SEQ ID NO: 7837708 - DNA, 21 bp, Homo sapiens
tacaaagggaaattctggctc

SEQ ID NO: 7837709 - DNA, 22 bp, Homo sapiens
tacaaaggcttaaagagatttc

SEQ ID NO: 7837710 - DNA, 22 bp, Homo sapiens
tacaaaggcggtttttctgggc

SEQ ID NO: 7837711 - DNA, 22 bp, Homo sapiens
tacaaaggagtagagaaggctt

SEQ ID NO: 7837712 - DNA, 22 bp, Homo sapiens
tacaaaggaggtgcatagaaca

SEQ ID NO: 7837713 - DNA, 22 bp, Homo sapiens
tacaaagtcaccagcttcttgc

SEQ ID NO: 7837714 - DNA, 22 bp, Homo sapiens
tacaaagtcaccagcttcttgc

SEQ ID NO: 7837715 - DNA, 22 bp, Homo sapiens
tacaaagtcacattgaaatgaa

SEQ ID NO: 7837716 - DNA, 22 bp, Homo sapiens
tacaaagtcacattgaaatgaa

SEQ ID NO: 7837717 - DNA, 22 bp, Homo sapiens
tacaaagtaatgtataatatcg

SEQ ID NO: 7837718 - DNA, 22 bp, Homo sapiens
tacaaagtagaaattcagtaaa

SEQ ID NO: 7837719 - DNA, 22 bp, Homo sapiens
tacaaagtagaaattcagtaaa

SEQ ID NO: 7837720 - DNA, 22 bp, Homo sapiens
tacaaagtaatgtataatatcg

SEQ ID NO: 7837721 - DNA, 22 bp, Homo sapiens
tacaaagtaatgtataatatcg

SEQ ID NO: 7837722 - DNA, 22 bp, Homo sapiens
tacaaagatagtgttagagtaa

SEQ ID NO: 7837723 - DNA, 22 bp, Homo sapiens
tacaaagataaaatctcaccat

SEQ ID NO: 7837724 - DNA, 22 bp, Homo sapiens
tacaaagatagtgttagagtaa

SEQ ID NO: 7837725 - DNA, 22 bp, Homo sapiens
tacaaagatagtgttagagtaa

SEQ ID NO: 7837726 - DNA, 22 bp, Homo sapiens
tacaaagatagtgttagagtaa

SEQ ID NO: 7837727 - DNA, 22 bp, Homo sapiens
tacaaagatagtgttagagtaa

SEQ ID NO: 7837728 - DNA, 22 bp, Homo sapiens
tacaaagatagtgttagagtaa

SEQ ID NO: 7837729 - DNA, 22 bp, Homo sapiens
tacaaagatagtgttagagtaa

SEQ ID NO: 7837730 - DNA, 22 bp, Homo sapiens
tacaaagatagtgttagagtaa

SEQ ID NO: 7837731 - DNA, 22 bp, Homo sapiens
tacaaagcttgtactgtgtgac

SEQ ID NO: 7837732 - DNA, 22 bp, Homo sapiens
tacaaagcttgtactgtgtgac

SEQ ID NO: 7837733 - DNA, 22 bp, Homo sapiens
tacaaagctgtatagcctggtc

SEQ ID NO: 7837734 - DNA, 22 bp, Homo sapiens
tacaaaggaaacttcttttccc

SEQ ID NO: 7837735 - DNA, 22 bp, Homo sapiens
tacaaaggacagcagaaaaata

SEQ ID NO: 7837736 - DNA, 22 bp, Homo sapiens
tacaaaggagaatagggtagca

SEQ ID NO: 7837737 - DNA, 22 bp, Homo sapiens
tacaaaggagactctgtattta

SEQ ID NO: 7837738 - DNA, 22 bp, Homo sapiens
tacaaaggagactctgtattta

SEQ ID NO: 7837739 - DNA, 22 bp, Homo sapiens
tacaaaggagataaattggagg

SEQ ID NO: 7837740 - DNA, 19 bp, Homo sapiens
tacaaaggaggatgtaaaa

SEQ ID NO: 7837741 - DNA, 22 bp, Homo sapiens
tacaaagagtttggtctctaga

SEQ ID NO: 7837742 - DNA, 22 bp, Homo sapiens
tacaaagagtttggtctctaga

SEQ ID NO: 7837743 - DNA, 22 bp, Homo sapiens
tacaaagagtttggtctctaga

SEQ ID NO: 7837744 - DNA, 22 bp, Homo sapiens
tacaaagagtttggtctctaga

SEQ ID NO: 7837745 - DNA, 22 bp, Homo sapiens
tacaaagagtttggtctctaga

SEQ ID NO: 7837746 - DNA, 22 bp, Homo sapiens
tacaaagaggtaattgcatata

SEQ ID NO: 7837747 - DNA, 22 bp, Homo sapiens
tacaaagaggtaattgcatata

SEQ ID NO: 7837748 - DNA, 22 bp, Homo sapiens
tacaaagaggtaattgcatata

SEQ ID NO: 7837749 - DNA, 22 bp, Homo sapiens
tacaaagaggtaattgcatata

SEQ ID NO: 7837750 - DNA, 22 bp, Homo sapiens
tacaaagaggcagctccatttt

SEQ ID NO: 7837751 - DNA, 20 bp, Homo sapiens
tacaaagagcccctctcttc

SEQ ID NO: 7837752 - DNA, 20 bp, Homo sapiens
tacaaagaatgaggttcagg

SEQ ID NO: 7837753 - DNA, 20 bp, Homo sapiens
tacaaagaatgaggttcagg

SEQ ID NO: 7837754 - DNA, 22 bp, Homo sapiens
tacaaactgttattattattgt

SEQ ID NO: 7837755 - DNA, 22 bp, Homo sapiens
tacaaacttgttttaagtaagt

SEQ ID NO: 7837756 - DNA, 22 bp, Homo sapiens
tacaaacttgttttaagtaagt

SEQ ID NO: 7837757 - DNA, 20 bp, Homo sapiens
tacaaagaatgaggttcagg

SEQ ID NO: 7837758 - DNA, 20 bp, Homo sapiens
tacaaagaatgaggttcagg

SEQ ID NO: 7837759 - DNA, 20 bp, Homo sapiens
tacaaagaatgaggttcagg

SEQ ID NO: 7837760 - DNA, 20 bp, Homo sapiens
tacaaagaatgaggttcagg

SEQ ID NO: 7837761 - DNA, 22 bp, Homo sapiens
tacaaaaaattgatactgacga

SEQ ID NO: 7837762 - DNA, 22 bp, Homo sapiens
tacaaactccgaagtttgtacc

SEQ ID NO: 7837763 - DNA, 22 bp, Homo sapiens
tacaaaaaattgatactgacga

SEQ ID NO: 7837764 - DNA, 18 bp, Homo sapiens
tacaaactccttgaaggc

SEQ ID NO: 7837765 - DNA, 18 bp, Homo sapiens
tacaaactccttgaaggc

SEQ ID NO: 7837766 - DNA, 18 bp, Homo sapiens
tacaaactccttgaaggc

SEQ ID NO: 7837767 - DNA, 22 bp, Homo sapiens
tacaaactctttatatttcata

SEQ ID NO: 7837768 - DNA, 22 bp, Homo sapiens
tacaaactctttatatttcata

SEQ ID NO: 7837769 - DNA, 22 bp, Homo sapiens
tacaaactctttatatttcata

SEQ ID NO: 7837770 - DNA, 22 bp, Homo sapiens
tacaaactctttatatttcata

SEQ ID NO: 7837771 - DNA, 22 bp, Homo sapiens
tacaaactgtccagcccagagg

SEQ ID NO: 7837772 - DNA, 22 bp, Homo sapiens
tacaaactctttatatttcata

SEQ ID NO: 7837773 - DNA, 22 bp, Homo sapiens
tacaaactgtccagcccagagg

SEQ ID NO: 7837774 - DNA, 22 bp, Homo sapiens
tacaaactgttattattattgt

SEQ ID NO: 7837775 - DNA, 22 bp, Homo sapiens
tacaaactgttattattattgt

SEQ ID NO: 7837776 - DNA, 22 bp, Homo sapiens
tacaaactgttattattattgt

SEQ ID NO: 7837777 - DNA, 22 bp, Homo sapiens
tacaaactgttattattattgt

SEQ ID NO: 7837778 - DNA, 22 bp, Homo sapiens
tacaaaaaattgatactgacga

SEQ ID NO: 7837779 - DNA, 22 bp, Homo sapiens
tacaaaaaattgatactgacga

SEQ ID NO: 7837780 - DNA, 22 bp, Homo sapiens
taattattatgacaacaattgc

SEQ ID NO: 7837781 - DNA, 23 bp, Homo sapiens
taattatggaataatttgcaacg

SEQ ID NO: 7837782 - DNA, 22 bp, Homo sapiens
taattatgtatgcaagctcagt

SEQ ID NO: 7837783 - DNA, 22 bp, Homo sapiens
tacaaaaaattgatactgacga

SEQ ID NO: 7837784 - DNA, 22 bp, Homo sapiens
tacaaaaaattgatactgacga

SEQ ID NO: 7837785 - DNA, 22 bp, Homo sapiens
tacaaaaaattgatactgacga

SEQ ID NO: 7837786 - DNA, 22 bp, Homo sapiens
tacaaaaaattgatactgacga

SEQ ID NO: 7837787 - DNA, 22 bp, Homo sapiens
tacaaaaaattgatactgacga

SEQ ID NO: 7837788 - DNA, 23 bp, Homo sapiens
taattatggaataatttgcaacg

SEQ ID NO: 7837789 - DNA, 22 bp, Homo sapiens
taattatagccgctattttgct

SEQ ID NO: 7837790 - DNA, 22 bp, Homo sapiens
taattatagccgctattttgct

SEQ ID NO: 7837791 - DNA, 22 bp, Homo sapiens
taattatagccgctattttgct

SEQ ID NO: 7837792 - DNA, 22 bp, Homo sapiens
taattacaaagcaagcacaggg

SEQ ID NO: 7837793 - DNA, 22 bp, Homo sapiens
taattacaaagcaagcacaggg

SEQ ID NO: 7837794 - DNA, 22 bp, Homo sapiens
taattacaaagcaagcacaggg

SEQ ID NO: 7837795 - DNA, 22 bp, Homo sapiens
taattacaaagcaagcacaggg

SEQ ID NO: 7837796 - DNA, 22 bp, Homo sapiens
taattaacatacaaaacagctg

SEQ ID NO: 7837797 - DNA, 22 bp, Homo sapiens
taattacaaagcaagcacaggg

SEQ ID NO: 7837798 - DNA, 22 bp, Homo sapiens
taatgtttttctcaacattgct

SEQ ID NO: 7837799 - DNA, 22 bp, Homo sapiens
taattaacatacaaaacagctg

SEQ ID NO: 7837800 - DNA, 22 bp, Homo sapiens
taatgtttttctcaacattgct

SEQ ID NO: 7837801 - DNA, 22 bp, Homo sapiens
taatgtttccagtctatgatgg

SEQ ID NO: 7837802 - DNA, 22 bp, Homo sapiens
taatgtttccagtctatgatgg

SEQ ID NO: 7837803 - DNA, 22 bp, Homo sapiens
taattacaggtccaaaacaatc

SEQ ID NO: 7837804 - DNA, 22 bp, Homo sapiens
taattacaggtccaaaacaatc

SEQ ID NO: 7837805 - DNA, 22 bp, Homo sapiens
taattacaggtccaaaacaatc

SEQ ID NO: 7837806 - DNA, 22 bp, Homo sapiens
taattacagaggtttgccagtt

SEQ ID NO: 7837807 - DNA, 22 bp, Homo sapiens
taattacaaagcaagcacaggg

SEQ ID NO: 7837808 - DNA, 22 bp, Homo sapiens
taattacagaggtttgccagtt

SEQ ID NO: 7837809 - DNA, 22 bp, Homo sapiens
taattacagaggtttgccagtt

SEQ ID NO: 7837810 - DNA, 22 bp, Homo sapiens
taattacagaggtttgccagtt

SEQ ID NO: 7837811 - DNA, 22 bp, Homo sapiens
taattagagtcacaagtaacca

SEQ ID NO: 7837812 - DNA, 22 bp, Homo sapiens
taattagagtttggtaaacaat

SEQ ID NO: 7837813 - DNA, 22 bp, Homo sapiens
taattactaagggctgcatacc

SEQ ID NO: 7837814 - DNA, 22 bp, Homo sapiens
taattacaggtccaaaacaatc

SEQ ID NO: 7837815 - DNA, 22 bp, Homo sapiens
taattacaggtccaaaacaatc

SEQ ID NO: 7837816 - DNA, 22 bp, Homo sapiens
taattacaggtccaaaacaatc

SEQ ID NO: 7837817 - DNA, 22 bp, Homo sapiens
taattataacagttacatctta

SEQ ID NO: 7837818 - DNA, 22 bp, Homo sapiens
taattataacagttacatctta

SEQ ID NO: 7837819 - DNA, 22 bp, Homo sapiens
taattataacagttacatctta

SEQ ID NO: 7837820 - DNA, 22 bp, Homo sapiens
taattataacagttacatctta

SEQ ID NO: 7837821 - DNA, 22 bp, Homo sapiens
taattataacagttacatctta

SEQ ID NO: 7837822 - DNA, 22 bp, Homo sapiens
taattataacagttacatctta

SEQ ID NO: 7837823 - DNA, 22 bp, Homo sapiens
taattagagtttggtaaacaat

SEQ ID NO: 7837824 - DNA, 23 bp, Homo sapiens
taattagatgttgattcctgaga

SEQ ID NO: 7837825 - DNA, 22 bp, Homo sapiens
taattataaactgcagtaggta

SEQ ID NO: 7837826 - DNA, 21 bp, Homo sapiens
taattagcaaagctgagattc

SEQ ID NO: 7837827 - DNA, 22 bp, Homo sapiens
taattatagcattggagtggcc

SEQ ID NO: 7837828 - DNA, 22 bp, Homo sapiens
taattatacaaaaaggcatgca

SEQ ID NO: 7837829 - DNA, 22 bp, Homo sapiens
taattatacaaaaaggcatgca

SEQ ID NO: 7837830 - DNA, 22 bp, Homo sapiens
taattatagccgctattttgct

SEQ ID NO: 7837831 - DNA, 22 bp, Homo sapiens
taattatagccgctattttgct

SEQ ID NO: 7837832 - DNA, 22 bp, Homo sapiens
taattatagccgctattttgct

SEQ ID NO: 7837833 - DNA, 22 bp, Homo sapiens
taattatagccgctattttgct

SEQ ID NO: 7837834 - DNA, 22 bp, Homo sapiens
taattataacatgctttctggc

SEQ ID NO: 7837835 - DNA, 22 bp, Homo sapiens
taattataacatgctttctggc

SEQ ID NO: 7837836 - DNA, 22 bp, Homo sapiens
taattatacaaaaaggcatgca

SEQ ID NO: 7837837 - DNA, 22 bp, Homo sapiens
taattatacaaaaaggcatgca

SEQ ID NO: 7837838 - DNA, 22 bp, Homo sapiens
taatagaatagtggaaacattg

SEQ ID NO: 7837839 - DNA, 22 bp, Homo sapiens
taatagaatagtggaaacattg

SEQ ID NO: 7837840 - DNA, 22 bp, Homo sapiens
taatagaatagtggaaacattg

SEQ ID NO: 7837841 - DNA, 22 bp, Homo sapiens
taatagaatagtggaaacattg

SEQ ID NO: 7837842 - DNA, 22 bp, Homo sapiens
taatagaatagtggaaacattg

SEQ ID NO: 7837843 - DNA, 22 bp, Homo sapiens
taatacttttgccttgtattca

SEQ ID NO: 7837844 - DNA, 22 bp, Homo sapiens
taatagaaaggtattttttgca

SEQ ID NO: 7837845 - DNA, 22 bp, Homo sapiens
taatagaaaggtattttttgca

SEQ ID NO: 7837846 - DNA, 22 bp, Homo sapiens
taatacttaccttgcagagtct

SEQ ID NO: 7837847 - DNA, 22 bp, Homo sapiens
taatacttaccttgcagagtct

SEQ ID NO: 7837848 - DNA, 22 bp, Homo sapiens
taatacttgtcataaaggcatt

SEQ ID NO: 7837849 - DNA, 22 bp, Homo sapiens
taatacttgtcataaaggcatt

SEQ ID NO: 7837850 - DNA, 22 bp, Homo sapiens
taatacttgctttggatgtatg

SEQ ID NO: 7837851 - DNA, 22 bp, Homo sapiens
taatactttgaatgagagctaa

SEQ ID NO: 7837852 - DNA, 22 bp, Homo sapiens
taatacttttgccttgtattca

SEQ ID NO: 7837853 - DNA, 22 bp, Homo sapiens
taatacttttgccttgtattca

SEQ ID NO: 7837854 - DNA, 22 bp, Homo sapiens
taatacttttgccttgtattca

SEQ ID NO: 7837855 - DNA, 22 bp, Homo sapiens
taatactgtgcttcattttcct

SEQ ID NO: 7837856 - DNA, 22 bp, Homo sapiens
taatactgtgcttcattttcct

SEQ ID NO: 7837857 - DNA, 22 bp, Homo sapiens
taatactgtatactgcaaattt

SEQ ID NO: 7837858 - DNA, 22 bp, Homo sapiens
taatactgtaacttggtgggtc

SEQ ID NO: 7837859 - DNA, 22 bp, Homo sapiens
taatactgtatactgcaaattt

SEQ ID NO: 7837860 - DNA, 22 bp, Homo sapiens
taatactgtatactgcaaattt

SEQ ID NO: 7837861 - DNA, 22 bp, Homo sapiens
taatactgggaaatacttgggt

SEQ ID NO: 7837862 - DNA, 22 bp, Homo sapiens
taatactgatgtctgagcccca

SEQ ID NO: 7837863 - DNA, 22 bp, Homo sapiens
taatactgagccaccaggtagg

SEQ ID NO: 7837864 - DNA, 23 bp, Homo sapiens
taatactgcttcagaggcttaga

SEQ ID NO: 7837865 - DNA, 22 bp, Homo sapiens
taatactgctgtgcttgagttg

SEQ ID NO: 7837866 - DNA, 19 bp, Homo sapiens
taatactggctgtagctgg

SEQ ID NO: 7837867 - DNA, 19 bp, Homo sapiens
taatactggctgtagctgg

SEQ ID NO: 7837868 - DNA, 22 bp, Homo sapiens
taatgtttccagtctatgatgg

SEQ ID NO: 7837869 - DNA, 22 bp, Homo sapiens
taatgtttccagtctatgatgg

SEQ ID NO: 7837870 - DNA, 22 bp, Homo sapiens
taatgggcccaaaggagctgag

SEQ ID NO: 7837871 - DNA, 22 bp, Homo sapiens
taatggctaaaattcagaagaa

SEQ ID NO: 7837872 - DNA, 22 bp, Homo sapiens
taatgggctatctgttgagact

SEQ ID NO: 7837873 - DNA, 22 bp, Homo sapiens
taatggtgcttctgtgagataa

SEQ ID NO: 7837874 - DNA, 22 bp, Homo sapiens
taatggtgcagtgggtgtaact

SEQ ID NO: 7837875 - DNA, 22 bp, Homo sapiens
taatggtgcttctgtgagataa

SEQ ID NO: 7837876 - DNA, 22 bp, Homo sapiens
taatagctgtgggaaataaaag

SEQ ID NO: 7837877 - DNA, 22 bp, Homo sapiens
taatagctgttattgttataac

SEQ ID NO: 7837878 - DNA, 22 bp, Homo sapiens
taatagctgttattgttataac

SEQ ID NO: 7837879 - DNA, 22 bp, Homo sapiens
taatagctgttattgttataac

SEQ ID NO: 7837880 - DNA, 22 bp, Homo sapiens
taatggcattgattacatgaaa

SEQ ID NO: 7837881 - DNA, 22 bp, Homo sapiens
taatggcagagtcatgctttct

SEQ ID NO: 7837882 - DNA, 22 bp, Homo sapiens
taatagaatagtggaaacattg

SEQ ID NO: 7837883 - DNA, 22 bp, Homo sapiens
taatagcattatcatcaaaact

SEQ ID NO: 7837884 - DNA, 22 bp, Homo sapiens
taatagcattatcatcaaaact

SEQ ID NO: 7837885 - DNA, 22 bp, Homo sapiens
taatagcattatcatcaaaact

SEQ ID NO: 7837886 - DNA, 22 bp, Homo sapiens
taatagcattatcatcaaaact

SEQ ID NO: 7837887 - DNA, 22 bp, Homo sapiens
taagggttcagaatgcagtggt

SEQ ID NO: 7837888 - DNA, 22 bp, Homo sapiens
taagggttcagaatgcagtggt

SEQ ID NO: 7837889 - DNA, 22 bp, Homo sapiens
taagggttcagaatgcagtggt

SEQ ID NO: 7837890 - DNA, 22 bp, Homo sapiens
taagggttcagaatgcagtggt

SEQ ID NO: 7837891 - DNA, 22 bp, Homo sapiens
taagggctgaacatttgtgtcc

SEQ ID NO: 7837892 - DNA, 22 bp, Homo sapiens
taagggcaggttccaaaagggt

SEQ ID NO: 7837893 - DNA, 21 bp, Homo sapiens
taagggcaggaattgggcttt

SEQ ID NO: 7837894 - DNA, 21 bp, Homo sapiens
taagggcaggaattgggcttt

SEQ ID NO: 7837895 - DNA, 22 bp, Homo sapiens
taagggaacagcttcaaactca

SEQ ID NO: 7837896 - DNA, 22 bp, Homo sapiens
taaggtgtggtagtttagttct

SEQ ID NO: 7837897 - DNA, 22 bp, Homo sapiens
taaggtgaaaacacaagttgct

SEQ ID NO: 7837898 - DNA, 22 bp, Homo sapiens
taaggtctttggtcactggtag

SEQ ID NO: 7837899 - DNA, 22 bp, Homo sapiens
taaggtcatggtgaataataag

SEQ ID NO: 7837900 - DNA, 22 bp, Homo sapiens
taaggtaattgttgctgaaatt

SEQ ID NO: 7837901 - DNA, 22 bp, Homo sapiens
taaggctcttgagatggggaga

SEQ ID NO: 7837902 - DNA, 22 bp, Homo sapiens
taaggctgggaattgctgagct

SEQ ID NO: 7837903 - DNA, 22 bp, Homo sapiens
taaggctgggaattgctgagct

SEQ ID NO: 7837904 - DNA, 22 bp, Homo sapiens
taaggctccctttgccacttgt

SEQ ID NO: 7837905 - DNA, 22 bp, Homo sapiens
taaggctcatgtaattagagat

SEQ ID NO: 7837906 - DNA, 22 bp, Homo sapiens
taaggctcatgtaattagagat

SEQ ID NO: 7837907 - DNA, 22 bp, Homo sapiens
taaggctgttaggaggattaaa

SEQ ID NO: 7837908 - DNA, 22 bp, Homo sapiens
taaggctttctaaatatgcaga

SEQ ID NO: 7837909 - DNA, 22 bp, Homo sapiens
taagggaacagcttcaaactca

SEQ ID NO: 7837910 - DNA, 22 bp, Homo sapiens
taaggcttcttggaatactgca

SEQ ID NO: 7837911 - DNA, 22 bp, Homo sapiens
taaggcttcttggaatactgca

SEQ ID NO: 7837912 - DNA, 22 bp, Homo sapiens
taaggcttcagcattcaaaaca

SEQ ID NO: 7837913 - DNA, 22 bp, Homo sapiens
taaggcccgtgagtttcatatc

SEQ ID NO: 7837914 - DNA, 22 bp, Homo sapiens
taaggcccgtgagtttcatatc

SEQ ID NO: 7837915 - DNA, 22 bp, Homo sapiens
taaggctactgtcagcttcagg

SEQ ID NO: 7837916 - DNA, 22 bp, Homo sapiens
taaggcccgtgagtttcatatc

SEQ ID NO: 7837917 - DNA, 22 bp, Homo sapiens
taaggccttgaaaggatgtcct

SEQ ID NO: 7837918 - DNA, 22 bp, Homo sapiens
taaggccttgaaaggatgtcct

SEQ ID NO: 7837919 - DNA, 22 bp, Homo sapiens
taaggctatcttttgagtgtgt

SEQ ID NO: 7837920 - DNA, 22 bp, Homo sapiens
taaggctatctgagtttatgtg

SEQ ID NO: 7837921 - DNA, 22 bp, Homo sapiens
taaggctagtgcctgactgggt

SEQ ID NO: 7837922 - DNA, 22 bp, Homo sapiens
taaggctaggaattctctgaag

SEQ ID NO: 7837923 - DNA, 22 bp, Homo sapiens
taaggctagcaagatgagaata

SEQ ID NO: 7837924 - DNA, 22 bp, Homo sapiens
taaggctagcaagatgagaata

SEQ ID NO: 7837925 - DNA, 22 bp, Homo sapiens
taaggccaccgttatagaacca

SEQ ID NO: 7837926 - DNA, 22 bp, Homo sapiens
taaggccaccgttatagaacca

SEQ ID NO: 7837927 - DNA, 22 bp, Homo sapiens
taaggcaaagtgatttcttaaa

SEQ ID NO: 7837928 - DNA, 22 bp, Homo sapiens
taaggcaagaaactcctgtgta

SEQ ID NO: 7837929 - DNA, 22 bp, Homo sapiens
taaggcaaaggggaagttatca

SEQ ID NO: 7837930 - DNA, 22 bp, Homo sapiens
taaggcaaagaaccatagtaat

SEQ ID NO: 7837931 - DNA, 22 bp, Homo sapiens
taactggtagattttaaatcgg

SEQ ID NO: 7837932 - DNA, 22 bp, Homo sapiens
taaggcaaacaggaaagcaggc

SEQ ID NO: 7837933 - DNA, 22 bp, Homo sapiens
taactggaagtataattatcaa

SEQ ID NO: 7837934 - DNA, 22 bp, Homo sapiens
taactggactcgatgctgaagg

SEQ ID NO: 7837935 - DNA, 22 bp, Homo sapiens
taactggactcgatgctgaagg

SEQ ID NO: 7837936 - DNA, 22 bp, Homo sapiens
taactggtactctggtagcctg

SEQ ID NO: 7837937 - DNA, 22 bp, Homo sapiens
taactgcctactgtgcaaatat

SEQ ID NO: 7837938 - DNA, 22 bp, Homo sapiens
taactgccagcagcgatgaaca

SEQ ID NO: 7837939 - DNA, 22 bp, Homo sapiens
taaggcaagagcagggtctttg

SEQ ID NO: 7837940 - DNA, 22 bp, Homo sapiens
taaggcaagagcagggtctttg

SEQ ID NO: 7837941 - DNA, 22 bp, Homo sapiens
taaggcaggactggatagctat

SEQ ID NO: 7837942 - DNA, 22 bp, Homo sapiens
taaggcaagtttttagtggaca

SEQ ID NO: 7837943 - DNA, 22 bp, Homo sapiens
taaggcaggaactggctgtttt

SEQ ID NO: 7837944 - DNA, 22 bp, Homo sapiens
taaggcaggtatggtaccaggc

SEQ ID NO: 7837945 - DNA, 22 bp, Homo sapiens
taaggcaggtagatgactacgg

SEQ ID NO: 7837946 - DNA, 22 bp, Homo sapiens
taaggcaggtatggtaccaggc

SEQ ID NO: 7837947 - DNA, 22 bp, Homo sapiens
taaggcaggctttcatccagag

SEQ ID NO: 7837948 - DNA, 22 bp, Homo sapiens
taaggcaggtagatgactacgg

SEQ ID NO: 7837949 - DNA, 19 bp, Homo sapiens
taaggccaaaagtaagtgt

SEQ ID NO: 7837950 - DNA, 23 bp, Homo sapiens
taaggcattttttctgtatcagt

SEQ ID NO: 7837951 - DNA, 22 bp, Homo sapiens
taaggccaagttcatatacaac

SEQ ID NO: 7837952 - DNA, 23 bp, Homo sapiens
taaggcattttttctgtatcagt

SEQ ID NO: 7837953 - DNA, 18 bp, Homo sapiens
taaggcattcttatgtga

SEQ ID NO: 7837954 - DNA, 22 bp, Homo sapiens
taaggcattctcatgctgtgaa

SEQ ID NO: 7837955 - DNA, 18 bp, Homo sapiens
taaggcattcttatgtga

SEQ ID NO: 7837956 - DNA, 22 bp, Homo sapiens
taaggcatgctagcagtatgaa

SEQ ID NO: 7837957 - DNA, 22 bp, Homo sapiens
taaggcatgctagcagtatgaa

SEQ ID NO: 7837958 - DNA, 22 bp, Homo sapiens
taaggcatgagtttatttcata

SEQ ID NO: 7837959 - DNA, 22 bp, Homo sapiens
taaggcattagagtgaaagcaa

SEQ ID NO: 7837960 - DNA, 22 bp, Homo sapiens
taaggcattatagagacagcct

SEQ ID NO: 7837961 - DNA, 22 bp, Homo sapiens
taaggcagtagtgtctgtaggg

SEQ ID NO: 7837962 - DNA, 22 bp, Homo sapiens
taaggcagtgaaactattctgt

SEQ ID NO: 7837963 - DNA, 22 bp, Homo sapiens
taaggcagtgagaagaaacagg

SEQ ID NO: 7837964 - DNA, 22 bp, Homo sapiens
taaggcagtgagaagaaacagg

SEQ ID NO: 7837965 - DNA, 22 bp, Homo sapiens
taaggcagtgagaagaaacagg

SEQ ID NO: 7837966 - DNA, 22 bp, Homo sapiens
taaggcagttttgcctgagata

SEQ ID NO: 7837967 - DNA, 22 bp, Homo sapiens
taaggcataaggaagatttgga

SEQ ID NO: 7837968 - DNA, 22 bp, Homo sapiens
taaggcataaggaagatttgga

SEQ ID NO: 7837969 - DNA, 22 bp, Homo sapiens
taaggcatgagtttatttcata

SEQ ID NO: 7837970 - DNA, 22 bp, Homo sapiens
taaggcataaggccagaggcta

SEQ ID NO: 7837971 - DNA, 20 bp, Homo sapiens
taaggcatcaagtttgggta

SEQ ID NO: 7837972 - DNA, 22 bp, Homo sapiens
taagtaaaacattcaagaagtc

SEQ ID NO: 7837973 - DNA, 22 bp, Homo sapiens
taagtaaaacattcaagaagtc

SEQ ID NO: 7837974 - DNA, 22 bp, Homo sapiens
taaggtttcttcagatactagt

SEQ ID NO: 7837975 - DNA, 22 bp, Homo sapiens
taagtaaatttataatgtgatt

SEQ ID NO: 7837976 - DNA, 22 bp, Homo sapiens
taagtaaatttataatgtgatt

SEQ ID NO: 7837977 - DNA, 22 bp, Homo sapiens
taagtaaatttataatgtgatt

SEQ ID NO: 7837978 - DNA, 22 bp, Homo sapiens
taagtaaaacattcaagaagtc

SEQ ID NO: 7837979 - DNA, 22 bp, Homo sapiens
taagtaaaacattcaagaagtc

SEQ ID NO: 7837980 - DNA, 22 bp, Homo sapiens
taagtaattgcagcaatttgcc

SEQ ID NO: 7837981 - DNA, 22 bp, Homo sapiens
taagtaattgcagcaatttgcc

SEQ ID NO: 7837982 - DNA, 22 bp, Homo sapiens
taagtacaaatgtatacataag

SEQ ID NO: 7837983 - DNA, 22 bp, Homo sapiens
taagtacaaatgtatacataag

SEQ ID NO: 7837984 - DNA, 22 bp, Homo sapiens
taagtacaaatgtatacataag

SEQ ID NO: 7837985 - DNA, 19 bp, Homo sapiens
taagtactttacaagtact

SEQ ID NO: 7837986 - DNA, 22 bp, Homo sapiens
taagtagactgttgaacttggt

SEQ ID NO: 7837987 - DNA, 19 bp, Homo sapiens
taagtactttacaagtact

SEQ ID NO: 7837988 - DNA, 22 bp, Homo sapiens
taagtacatttgggaccacctg

SEQ ID NO: 7837989 - DNA, 22 bp, Homo sapiens
taagtacatttgggaccacctg

SEQ ID NO: 7837990 - DNA, 22 bp, Homo sapiens
taagtacagaatgaggagatgt

SEQ ID NO: 7837991 - DNA, 22 bp, Homo sapiens
taagtacagaatgaggagatgt

SEQ ID NO: 7837992 - DNA, 22 bp, Homo sapiens
taagtacaaatgtatacataag

SEQ ID NO: 7837993 - DNA, 22 bp, Homo sapiens
taagtacaaatgtatacataag

SEQ ID NO: 7837994 - DNA, 22 bp, Homo sapiens
taagtacaaatgtatacataag

SEQ ID NO: 7837995 - DNA, 22 bp, Homo sapiens
taagtacaaatgtatacataag

SEQ ID NO: 7837996 - DNA, 22 bp, Homo sapiens
taagtgatttgtagtatactat

SEQ ID NO: 7837997 - DNA, 23 bp, Homo sapiens
taagtgattccaagtttcaggga

SEQ ID NO: 7837998 - DNA, 22 bp, Homo sapiens
taagtgatttataaggagatat

SEQ ID NO: 7837999 - DNA, 22 bp, Homo sapiens
taagtgatttgtagtatactat

SEQ ID NO: 7838000 - DNA, 22 bp, Homo sapiens
taagtgcaatgttttacttaaa

SEQ ID NO: 7838001 - DNA, 22 bp, Homo sapiens
taagtgcatctgatctttcatg

SEQ ID NO: 7838002 - DNA, 22 bp, Homo sapiens
taagtgcatgattgaacttggc

SEQ ID NO: 7838003 - DNA, 22 bp, Homo sapiens
taagtgatgagcacagtaatta

SEQ ID NO: 7838004 - DNA, 22 bp, Homo sapiens
taagtgatgagcacagtaatta

SEQ ID NO: 7838005 - DNA, 22 bp, Homo sapiens
taagtgatgaagacctgtttgg

SEQ ID NO: 7838006 - DNA, 22 bp, Homo sapiens
taagtgatgaaagcagatgtct

SEQ ID NO: 7838007 - DNA, 23 bp, Homo sapiens
taagtgataaagagtagagatgg

SEQ ID NO: 7838008 - DNA, 22 bp, Homo sapiens
taagtgagttcttgctagattt

SEQ ID NO: 7838009 - DNA, 23 bp, Homo sapiens
taagtgattagaatttgctgtca

SEQ ID NO: 7838010 - DNA, 22 bp, Homo sapiens
taagtgatgtcttggttaatga

SEQ ID NO: 7838011 - DNA, 22 bp, Homo sapiens
taagtgatgatagtacctagaa

SEQ ID NO: 7838012 - DNA, 23 bp, Homo sapiens
taagtgattagaatttgctgtca

SEQ ID NO: 7838013 - DNA, 17 bp, Homo sapiens
taagtgattatctcata

SEQ ID NO: 7838014 - DNA, 17 bp, Homo sapiens
taagtgattatctcata

SEQ ID NO: 7838015 - DNA, 22 bp, Homo sapiens
taagtagatgcaaaatggagtt

SEQ ID NO: 7838016 - DNA, 22 bp, Homo sapiens
taagtagatgcaaaatggagtt

SEQ ID NO: 7838017 - DNA, 22 bp, Homo sapiens
taagtagcctacaagtatattt

SEQ ID NO: 7838018 - DNA, 22 bp, Homo sapiens
taagtgaatattttcttctgta

SEQ ID NO: 7838019 - DNA, 22 bp, Homo sapiens
taagtgaatccttgagaagaaa

SEQ ID NO: 7838020 - DNA, 22 bp, Homo sapiens
taagtgaatattttcttctgta

SEQ ID NO: 7838021 - DNA, 22 bp, Homo sapiens
taagtgaatattttcttctgta

SEQ ID NO: 7838022 - DNA, 22 bp, Homo sapiens
taagtgaatactaaggatggag

SEQ ID NO: 7838023 - DNA, 22 bp, Homo sapiens
taagtgagctagcagaagtgac

SEQ ID NO: 7838024 - DNA, 22 bp, Homo sapiens
taagtgagggagctgggacttg

SEQ ID NO: 7838025 - DNA, 22 bp, Homo sapiens
taagtgagctagcagaagtgac

SEQ ID NO: 7838026 - DNA, 22 bp, Homo sapiens
taagtgagatctgaaatgaaat

SEQ ID NO: 7838027 - DNA, 22 bp, Homo sapiens
taagtgagccctcagagtatgg

SEQ ID NO: 7838028 - DNA, 20 bp, Homo sapiens
taagtgagaacatgtggtat

SEQ ID NO: 7838029 - DNA, 22 bp, Homo sapiens
taagtgagaactaaaccttctg

SEQ ID NO: 7838030 - DNA, 22 bp, Homo sapiens
taagtgaattgtccgaggacac

SEQ ID NO: 7838031 - DNA, 22 bp, Homo sapiens
taagtgagaaagacattaactg

SEQ ID NO: 7838032 - DNA, 22 bp, Homo sapiens
taataagtctgttgtttaattg

SEQ ID NO: 7838033 - DNA, 22 bp, Homo sapiens
taagtgttgatctgagtgctaa

SEQ ID NO: 7838034 - DNA, 22 bp, Homo sapiens
taagtgtctctcgaattatgct

SEQ ID NO: 7838035 - DNA, 22 bp, Homo sapiens
taagtgttattattctcacttt

SEQ ID NO: 7838036 - DNA, 22 bp, Homo sapiens
taagtgtgtaataggtccttct

SEQ ID NO: 7838037 - DNA, 22 bp, Homo sapiens
taagtgtctctcgaattatgct

SEQ ID NO: 7838038 - DNA, 22 bp, Homo sapiens
taagtgtccctattgtgatttt

SEQ ID NO: 7838039 - DNA, 22 bp, Homo sapiens
taagtggttgcttgttttcatt

SEQ ID NO: 7838040 - DNA, 18 bp, Homo sapiens
taagtgtaattgacaatt

SEQ ID NO: 7838041 - DNA, 22 bp, Homo sapiens
taagtggtaccaagctcagtga

SEQ ID NO: 7838042 - DNA, 22 bp, Homo sapiens
taagtgcatgattgaacttggc

SEQ ID NO: 7838043 - DNA, 22 bp, Homo sapiens
taagtgggctcaggtgcttgga

SEQ ID NO: 7838044 - DNA, 22 bp, Homo sapiens
taatacagatacaaaggaggac

SEQ ID NO: 7838045 - DNA, 22 bp, Homo sapiens
taataattaacagtgatgggtc

SEQ ID NO: 7838046 - DNA, 22 bp, Homo sapiens
taataattaacagtgatgggtc

SEQ ID NO: 7838047 - DNA, 22 bp, Homo sapiens
taataatagcagtagctgccac

SEQ ID NO: 7838048 - DNA, 22 bp, Homo sapiens
taataatagcagtagctgccac

SEQ ID NO: 7838049 - DNA, 22 bp, Homo sapiens
taataatagcagtagctgccac

SEQ ID NO: 7838050 - DNA, 22 bp, Homo sapiens
taatacatcattcatctaagga

SEQ ID NO: 7838051 - DNA, 22 bp, Homo sapiens
taatacagtagcttttacacag

SEQ ID NO: 7838052 - DNA, 22 bp, Homo sapiens
taatacagtagcttttacacag

SEQ ID NO: 7838053 - DNA, 22 bp, Homo sapiens
taatacctggccttgatacagt

SEQ ID NO: 7838054 - DNA, 22 bp, Homo sapiens
taatacctagagatgatacaaa

SEQ ID NO: 7838055 - DNA, 22 bp, Homo sapiens
taatacctggccttgatacagt

SEQ ID NO: 7838056 - DNA, 22 bp, Homo sapiens
taataccttgatctctcttgtc

SEQ ID NO: 7838057 - DNA, 22 bp, Homo sapiens
taatactgaaaggagtatcagc

SEQ ID NO: 7838058 - DNA, 22 bp, Homo sapiens
taatactgaaagggaaatgtcc

SEQ ID NO: 7838059 - DNA, 22 bp, Homo sapiens
taatactgaaagggaaatgtcc

SEQ ID NO: 7838060 - DNA, 22 bp, Homo sapiens
taatactgactaaagatatcaa

SEQ ID NO: 7838061 - DNA, 22 bp, Homo sapiens
taatactgactaaagatatcaa

SEQ ID NO: 7838062 - DNA, 22 bp, Homo sapiens
taatactgaaggtaaaatttct

SEQ ID NO: 7838063 - DNA, 21 bp, Homo sapiens
taatactgaaagtgacatctg

SEQ ID NO: 7838064 - DNA, 21 bp, Homo sapiens
taatactgaaagtgacatctg

SEQ ID NO: 7838065 - DNA, 22 bp, Homo sapiens
taatacctagagatgatacaaa

SEQ ID NO: 7838066 - DNA, 22 bp, Homo sapiens
taatacctactggtcattgcaa

SEQ ID NO: 7838067 - DNA, 22 bp, Homo sapiens
taataccactgtgctcattata

SEQ ID NO: 7838068 - DNA, 22 bp, Homo sapiens
taatacatcattcatctaagga

SEQ ID NO: 7838069 - DNA, 22 bp, Homo sapiens
taatacattacctaacctctct

SEQ ID NO: 7838070 - DNA, 22 bp, Homo sapiens
taatacattacctaacctctct

SEQ ID NO: 7838071 - DNA, 22 bp, Homo sapiens
taatacattacctaacctctct

SEQ ID NO: 7838072 - DNA, 22 bp, Homo sapiens
taatacattacctaacctctct

SEQ ID NO: 7838073 - DNA, 22 bp, Homo sapiens
taatacatcattcatctaagga

SEQ ID NO: 7838074 - DNA, 22 bp, Homo sapiens
taatacatcattcatctaagga

SEQ ID NO: 7838075 - DNA, 22 bp, Homo sapiens
taatacatcattcatctaagga

SEQ ID NO: 7838076 - DNA, 22 bp, Homo sapiens
taatacatgtattccagagagt

SEQ ID NO: 7838077 - DNA, 22 bp, Homo sapiens
tatgtctctgaaccttagcaag

SEQ ID NO: 7838078 - DNA, 22 bp, Homo sapiens
tatgtctcatggaagggcatta

SEQ ID NO: 7838079 - DNA, 22 bp, Homo sapiens
tatgtctgaatcttatttaaat

SEQ ID NO: 7838080 - DNA, 22 bp, Homo sapiens
tatgtcctgctactctctcatg

SEQ ID NO: 7838081 - DNA, 22 bp, Homo sapiens
tatgtcctgctactctctcatg

SEQ ID NO: 7838082 - DNA, 22 bp, Homo sapiens
tatgtacatacatgtgcatacg

SEQ ID NO: 7838083 - DNA, 22 bp, Homo sapiens
tatgtacatacatgtgcatacg

SEQ ID NO: 7838084 - DNA, 22 bp, Homo sapiens
tatgtacataacatgaaatgca

SEQ ID NO: 7838085 - DNA, 22 bp, Homo sapiens
tatgtacatacatgtgcatacg

SEQ ID NO: 7838086 - DNA, 22 bp, Homo sapiens
tatgtacatacatgtgcatacg

SEQ ID NO: 7838087 - DNA, 22 bp, Homo sapiens
tatgtacataacatgaaatgca

SEQ ID NO: 7838088 - DNA, 22 bp, Homo sapiens
tatgtacataacatgaaatgca

SEQ ID NO: 7838089 - DNA, 22 bp, Homo sapiens
tatgtacataacatgaaatgca

SEQ ID NO: 7838090 - DNA, 22 bp, Homo sapiens
tatgtacagtccttaacttaaa

SEQ ID NO: 7838091 - DNA, 22 bp, Homo sapiens
tatgtacagtccttaacttaaa

SEQ ID NO: 7838092 - DNA, 22 bp, Homo sapiens
tatgtacagtccttaacttaaa

SEQ ID NO: 7838093 - DNA, 22 bp, Homo sapiens
tatgtacagtccttaacttaaa

SEQ ID NO: 7838094 - DNA, 22 bp, Homo sapiens
tatgtacagtccttaacttaaa

SEQ ID NO: 7838095 - DNA, 22 bp, Homo sapiens
tatgtacagggatagaacttga

SEQ ID NO: 7838096 - DNA, 22 bp, Homo sapiens
tatgtacagtccttaacttaaa

SEQ ID NO: 7838097 - DNA, 22 bp, Homo sapiens
tatgtacagtccttaacttaaa

SEQ ID NO: 7838098 - DNA, 22 bp, Homo sapiens
tatgtacataacatgaaatgca

SEQ ID NO: 7838099 - DNA, 22 bp, Homo sapiens
tatgtacataacatgaaatgca

SEQ ID NO: 7838100 - DNA, 22 bp, Homo sapiens
tatgtacataacatgaaatgca

SEQ ID NO: 7838101 - DNA, 22 bp, Homo sapiens
tatgtacagtccttaacttaaa

SEQ ID NO: 7838102 - DNA, 22 bp, Homo sapiens
tatgtacagtccttaacttaaa

SEQ ID NO: 7838103 - DNA, 22 bp, Homo sapiens
tatgtacagtccttaacttaaa

SEQ ID NO: 7838104 - DNA, 22 bp, Homo sapiens
tatgtacagggatagaacttga

SEQ ID NO: 7838105 - DNA, 22 bp, Homo sapiens
tatgtacagggatagaacttga

SEQ ID NO: 7838106 - DNA, 22 bp, Homo sapiens
tatgtacagggatagaacttga

SEQ ID NO: 7838107 - DNA, 22 bp, Homo sapiens
tatgtacagggatagaacttga

SEQ ID NO: 7838108 - DNA, 22 bp, Homo sapiens
tatgtacacttaagtttgagaa

SEQ ID NO: 7838109 - DNA, 22 bp, Homo sapiens
tatgtacacttaagtttgagaa

SEQ ID NO: 7838110 - DNA, 22 bp, Homo sapiens
tatgtacagggatagaacttga

SEQ ID NO: 7838111 - DNA, 22 bp, Homo sapiens
tatgtacaccggggaaggtggg

SEQ ID NO: 7838112 - DNA, 22 bp, Homo sapiens
tatgtacaccaaggattgaaaa

SEQ ID NO: 7838113 - DNA, 22 bp, Homo sapiens
tatgtacaccaaggattgaaaa

SEQ ID NO: 7838114 - DNA, 22 bp, Homo sapiens
tatgtacaccggggaaggtggg

SEQ ID NO: 7838115 - DNA, 22 bp, Homo sapiens
tatgtacaccggggaaggtggg

SEQ ID NO: 7838116 - DNA, 22 bp, Homo sapiens
tatgtacacggtggctctgaag

SEQ ID NO: 7838117 - DNA, 22 bp, Homo sapiens
tatgtacacggtggctctgaag

SEQ ID NO: 7838118 - DNA, 22 bp, Homo sapiens
tatgtacaccggggaaggtggg

SEQ ID NO: 7838119 - DNA, 22 bp, Homo sapiens
tatgtacaccaaggattgaaaa

SEQ ID NO: 7838120 - DNA, 22 bp, Homo sapiens
tatgtacaccaaggattgaaaa

SEQ ID NO: 7838121 - DNA, 22 bp, Homo sapiens
tatgtacaccaaggattgaaaa

SEQ ID NO: 7838122 - DNA, 22 bp, Homo sapiens
tatgtacacatacacttgtaat

SEQ ID NO: 7838123 - DNA, 22 bp, Homo sapiens
tatgtacacatacacttgtaat

SEQ ID NO: 7838124 - DNA, 22 bp, Homo sapiens
tatgtacaccaaggattgaaaa

SEQ ID NO: 7838125 - DNA, 22 bp, Homo sapiens
tatgtacacatacacttgtaat

SEQ ID NO: 7838126 - DNA, 22 bp, Homo sapiens
tatgtacacatacacttgtaat

SEQ ID NO: 7838127 - DNA, 22 bp, Homo sapiens
tatgtacacatacacttgtaat

SEQ ID NO: 7838128 - DNA, 22 bp, Homo sapiens
tatgtacacatacacttgtaat

SEQ ID NO: 7838129 - DNA, 22 bp, Homo sapiens
tatgtacacatacacttgtaat

SEQ ID NO: 7838130 - DNA, 22 bp, Homo sapiens
tatgtacacacacatgcatgta

SEQ ID NO: 7838131 - DNA, 22 bp, Homo sapiens
tatgtacacacacatgcatgta

SEQ ID NO: 7838132 - DNA, 22 bp, Homo sapiens
tatgtacacacacatgcatgta

SEQ ID NO: 7838133 - DNA, 22 bp, Homo sapiens
tatgtacacacacatgcatgta

SEQ ID NO: 7838134 - DNA, 22 bp, Homo sapiens
tatgtacacacacatgcatgta

SEQ ID NO: 7838135 - DNA, 22 bp, Homo sapiens
tatgtacacacacatgcatgta

SEQ ID NO: 7838136 - DNA, 22 bp, Homo sapiens
tatgtacacacacatgcatgta

SEQ ID NO: 7838137 - DNA, 22 bp, Homo sapiens
tatgtacacacacatgcatgta

SEQ ID NO: 7838138 - DNA, 22 bp, Homo sapiens
tatgtacacacacatgcatgta

SEQ ID NO: 7838139 - DNA, 22 bp, Homo sapiens
tatgtacaatcagcagttcata

SEQ ID NO: 7838140 - DNA, 22 bp, Homo sapiens
tatgtacaatttgttgtatgtc

SEQ ID NO: 7838141 - DNA, 22 bp, Homo sapiens
tatgtacaatttgttgtatgtc

SEQ ID NO: 7838142 - DNA, 22 bp, Homo sapiens
tatgtacaatttgttgtatgtc

SEQ ID NO: 7838143 - DNA, 22 bp, Homo sapiens
tatgtacaatttgttgtatgtc

SEQ ID NO: 7838144 - DNA, 22 bp, Homo sapiens
tatgtacaatttgttgtatgtc

SEQ ID NO: 7838145 - DNA, 22 bp, Homo sapiens
tatgtacaatttgttgtatgtc

SEQ ID NO: 7838146 - DNA, 22 bp, Homo sapiens
tatgtacaagcacacatgtgac

SEQ ID NO: 7838147 - DNA, 22 bp, Homo sapiens
tatgtacaatcagcagttcata

SEQ ID NO: 7838148 - DNA, 22 bp, Homo sapiens
tatgtacaagcacacatgtgac

SEQ ID NO: 7838149 - DNA, 22 bp, Homo sapiens
tatgtacaagcacacatgtgac

SEQ ID NO: 7838150 - DNA, 22 bp, Homo sapiens
tatgtacaagcacacatgtgac

SEQ ID NO: 7838151 - DNA, 22 bp, Homo sapiens
tatgtacaagcacacatgtgac

SEQ ID NO: 7838152 - DNA, 22 bp, Homo sapiens
tatgtacaagcacacatgtgac

SEQ ID NO: 7838153 - DNA, 22 bp, Homo sapiens
tatgtacaagcacacatgtgac

SEQ ID NO: 7838154 - DNA, 22 bp, Homo sapiens
tatgtacaatcagcagttcata

SEQ ID NO: 7838155 - DNA, 22 bp, Homo sapiens
tatgtacaatcagcagttcata

SEQ ID NO: 7838156 - DNA, 22 bp, Homo sapiens
tatgtacaatcagcagttcata

SEQ ID NO: 7838157 - DNA, 22 bp, Homo sapiens
tatgtacaatcagcagttcata

SEQ ID NO: 7838158 - DNA, 22 bp, Homo sapiens
tatgtacaatcagcagttcata

SEQ ID NO: 7838159 - DNA, 22 bp, Homo sapiens
tatgtacaatcagcagttcata

SEQ ID NO: 7838160 - DNA, 22 bp, Homo sapiens
tatgtacaatcagcagttcata

SEQ ID NO: 7838161 - DNA, 22 bp, Homo sapiens
tatgtacaatcagcagttcata

SEQ ID NO: 7838162 - DNA, 22 bp, Homo sapiens
tatgagcaagagtttgtgaagg

SEQ ID NO: 7838163 - DNA, 22 bp, Homo sapiens
tatgagcaagagtttgtgaagg

SEQ ID NO: 7838164 - DNA, 22 bp, Homo sapiens
tatgagcagacagtggttttac

SEQ ID NO: 7838165 - DNA, 22 bp, Homo sapiens
tatgagcagacagtggttttac

SEQ ID NO: 7838166 - DNA, 22 bp, Homo sapiens
tatgagaatctgcagtatgctt

SEQ ID NO: 7838167 - DNA, 22 bp, Homo sapiens
tatgagaataatctggtaaata

SEQ ID NO: 7838168 - DNA, 22 bp, Homo sapiens
tatgagaatctgcagtatgctt

SEQ ID NO: 7838169 - DNA, 23 bp, Homo sapiens
tatgagaattaagtgcgagtgcc

SEQ ID NO: 7838170 - DNA, 22 bp, Homo sapiens
tatgagaatctgcagtatgctt

SEQ ID NO: 7838171 - DNA, 22 bp, Homo sapiens
tatgagataatagatgtgtaaa

SEQ ID NO: 7838172 - DNA, 22 bp, Homo sapiens
tatgagaatttgctaattggct

SEQ ID NO: 7838173 - DNA, 22 bp, Homo sapiens
tatgagctttggaatgagaaac

SEQ ID NO: 7838174 - DNA, 22 bp, Homo sapiens
tatgaggtaggtattatactta

SEQ ID NO: 7838175 - DNA, 20 bp, Homo sapiens
tatgagtattactttcagga

SEQ ID NO: 7838176 - DNA, 22 bp, Homo sapiens
tatgaggtaggtattatactta

SEQ ID NO: 7838177 - DNA, 22 bp, Homo sapiens
tatgagtacaaggactctgtct

SEQ ID NO: 7838178 - DNA, 22 bp, Homo sapiens
tatgagtggcgtagaggtaggg

SEQ ID NO: 7838179 - DNA, 22 bp, Homo sapiens
tatgagttcagttatcttaagt

SEQ ID NO: 7838180 - DNA, 22 bp, Homo sapiens
tatgtacaagcacacatgtgac

SEQ ID NO: 7838181 - DNA, 22 bp, Homo sapiens
tatgtacaagcacacatgtgac

SEQ ID NO: 7838182 - DNA, 19 bp, Homo sapiens
tatgtgtgcatttgtgcat

SEQ ID NO: 7838183 - DNA, 22 bp, Homo sapiens
tatgtgcatatgcatacacaca

SEQ ID NO: 7838184 - DNA, 22 bp, Homo sapiens
tatgtgaccttctgaatgagta

SEQ ID NO: 7838185 - DNA, 22 bp, Homo sapiens
tatgtgacatatctcagtttga

SEQ ID NO: 7838186 - DNA, 22 bp, Homo sapiens
tatgtgacatatctcagtttga

SEQ ID NO: 7838187 - DNA, 22 bp, Homo sapiens
tatgtgacttgacaaagcttcc

SEQ ID NO: 7838188 - DNA, 22 bp, Homo sapiens
tatgtgatataggctatttgat

SEQ ID NO: 7838189 - DNA, 20 bp, Homo sapiens
tatgtgattttctcatcaat

SEQ ID NO: 7838190 - DNA, 22 bp, Homo sapiens
tatgtgcacattagagagatgg

SEQ ID NO: 7838191 - DNA, 22 bp, Homo sapiens
tatgtgcaaattaattgctaga

SEQ ID NO: 7838192 - DNA, 22 bp, Homo sapiens
tatgtctttttctcactatagt

SEQ ID NO: 7838193 - DNA, 22 bp, Homo sapiens
tatgtctttttctcactatagt

SEQ ID NO: 7838194 - DNA, 22 bp, Homo sapiens
tatgtcttttgcttgcaaatag

SEQ ID NO: 7838195 - DNA, 22 bp, Homo sapiens
tatgtcttttgcttgcaaatag

SEQ ID NO: 7838196 - DNA, 22 bp, Homo sapiens
tatgtcttttgcttgcaaatag

SEQ ID NO: 7838197 - DNA, 22 bp, Homo sapiens
tatgtgaatacagcagtggatg

SEQ ID NO: 7838198 - DNA, 22 bp, Homo sapiens
tatgtgacaaaagtaaactgca

SEQ ID NO: 7838199 - DNA, 22 bp, Homo sapiens
tatgtctttagtatcttttgga

SEQ ID NO: 7838200 - DNA, 22 bp, Homo sapiens
tatgtctttagtatcttttgga

SEQ ID NO: 7838201 - DNA, 22 bp, Homo sapiens
tatgtctttagtatcttttgga

SEQ ID NO: 7838202 - DNA, 22 bp, Homo sapiens
tatgtctttattctctgatgcg

SEQ ID NO: 7838203 - DNA, 22 bp, Homo sapiens
tatgtctttattctctgatgcg

SEQ ID NO: 7838204 - DNA, 22 bp, Homo sapiens
tatgtctttgtccatgtgcagt

SEQ ID NO: 7838205 - DNA, 22 bp, Homo sapiens
tatgtctttgtccatgtgcagt

SEQ ID NO: 7838206 - DNA, 22 bp, Homo sapiens
tatgtctttgtcccactcccag

SEQ ID NO: 7838207 - DNA, 22 bp, Homo sapiens
tatgtctttgtccatgtgcagt

SEQ ID NO: 7838208 - DNA, 22 bp, Homo sapiens
tatgtctttgtcccactcccag

SEQ ID NO: 7838209 - DNA, 22 bp, Homo sapiens
tatgtcttttccaatgctgtct

SEQ ID NO: 7838210 - DNA, 22 bp, Homo sapiens
tatgtcttttccaatgctgtct

SEQ ID NO: 7838211 - DNA, 22 bp, Homo sapiens
tatgtctggaccactgcagccc

SEQ ID NO: 7838212 - DNA, 22 bp, Homo sapiens
tatgtcttaactctagaaaggt

SEQ ID NO: 7838213 - DNA, 22 bp, Homo sapiens
tatgtcttaatccttccttagg

SEQ ID NO: 7838214 - DNA, 22 bp, Homo sapiens
tatgtcttaatccttccttagg

SEQ ID NO: 7838215 - DNA, 22 bp, Homo sapiens
tatgtcttactacagcaattaa

SEQ ID NO: 7838216 - DNA, 22 bp, Homo sapiens
tatgtcttactacagcaattaa

SEQ ID NO: 7838217 - DNA, 22 bp, Homo sapiens
tatgtcttaatccttccttagg

SEQ ID NO: 7838218 - DNA, 22 bp, Homo sapiens
tatgtcttactacagcaattaa

SEQ ID NO: 7838219 - DNA, 22 bp, Homo sapiens
tatgtcttagaacaaaacagtg

SEQ ID NO: 7838220 - DNA, 22 bp, Homo sapiens
tatgtcttactacagcaattaa

SEQ ID NO: 7838221 - DNA, 22 bp, Homo sapiens
tatgtcttcgtcacctatctca

SEQ ID NO: 7838222 - DNA, 22 bp, Homo sapiens
tatgtcttgaaatgagaagcca

SEQ ID NO: 7838223 - DNA, 22 bp, Homo sapiens
tatgtcttccctagcaggcaga

SEQ ID NO: 7838224 - DNA, 22 bp, Homo sapiens
tatgtcttcgtcacctatctca

SEQ ID NO: 7838225 - DNA, 22 bp, Homo sapiens
tatgtcttcgtcacctatctca

SEQ ID NO: 7838226 - DNA, 22 bp, Homo sapiens
tatgtcttgtgtttgctaatct

SEQ ID NO: 7838227 - DNA, 22 bp, Homo sapiens
tatgtcttgtgtttgctaatct

SEQ ID NO: 7838228 - DNA, 22 bp, Homo sapiens
tatgtcttgcatttttcaaact

SEQ ID NO: 7838229 - DNA, 22 bp, Homo sapiens
tatgtcttgcatttttcaaact

SEQ ID NO: 7838230 - DNA, 22 bp, Homo sapiens
tatgtcttgaaatgagaagcca

SEQ ID NO: 7838231 - DNA, 22 bp, Homo sapiens
tatgtgtgctttttccatgcat

SEQ ID NO: 7838232 - DNA, 22 bp, Homo sapiens
tatgtgtggcagctgggagtgt

SEQ ID NO: 7838233 - DNA, 22 bp, Homo sapiens
tatgtgtgctttttccatgcat

SEQ ID NO: 7838234 - DNA, 19 bp, Homo sapiens
tatgtgtgcatttgtgcat

SEQ ID NO: 7838235 - DNA, 19 bp, Homo sapiens
tatgtgtgcatttgtgcat

SEQ ID NO: 7838236 - DNA, 22 bp, Homo sapiens
tatgtgtgcatgtatacattaa

SEQ ID NO: 7838237 - DNA, 22 bp, Homo sapiens
tattacactttcttcttcaagc

SEQ ID NO: 7838238 - DNA, 22 bp, Homo sapiens
tatgtgtggcagctgggagtgt

SEQ ID NO: 7838239 - DNA, 22 bp, Homo sapiens
tattacatccacttttattgca

SEQ ID NO: 7838240 - DNA, 22 bp, Homo sapiens
tattacatccacttttattgca

SEQ ID NO: 7838241 - DNA, 22 bp, Homo sapiens
tattacagctttgattatctgg

SEQ ID NO: 7838242 - DNA, 22 bp, Homo sapiens
tattacagaatcaggcataact

SEQ ID NO: 7838243 - DNA, 22 bp, Homo sapiens
tattacagggctagttatgagt

SEQ ID NO: 7838244 - DNA, 22 bp, Homo sapiens
tattacactttcttcttcaagc

SEQ ID NO: 7838245 - DNA, 22 bp, Homo sapiens
tattacagaatcaggcataact

SEQ ID NO: 7838246 - DNA, 22 bp, Homo sapiens
tattagaaagcttaatatcgtg

SEQ ID NO: 7838247 - DNA, 22 bp, Homo sapiens
tattagaaagcttaatatcgtg

SEQ ID NO: 7838248 - DNA, 22 bp, Homo sapiens
tattactgaggttttatggagt

SEQ ID NO: 7838249 - DNA, 22 bp, Homo sapiens
tattacatccacttttattgca

SEQ ID NO: 7838250 - DNA, 22 bp, Homo sapiens
tattactgaggttttatggagt

SEQ ID NO: 7838251 - DNA, 22 bp, Homo sapiens
tattagaaagcttaatatcgtg

SEQ ID NO: 7838252 - DNA, 22 bp, Homo sapiens
tattagaaaggctattgcatag

SEQ ID NO: 7838253 - DNA, 22 bp, Homo sapiens
tattagaaaggctattgcatag

SEQ ID NO: 7838254 - DNA, 22 bp, Homo sapiens
tattagaaaggctattgcatag

SEQ ID NO: 7838255 - DNA, 22 bp, Homo sapiens
tattagaaaggctattgcatag

SEQ ID NO: 7838256 - DNA, 22 bp, Homo sapiens
tattagaaaggctattgcatag

SEQ ID NO: 7838257 - DNA, 22 bp, Homo sapiens
tattagaggaaccaaggtggag

SEQ ID NO: 7838258 - DNA, 22 bp, Homo sapiens
tattagatttgtttctgtagat

SEQ ID NO: 7838259 - DNA, 22 bp, Homo sapiens
tattagatttgtttctgtagat

SEQ ID NO: 7838260 - DNA, 22 bp, Homo sapiens
tattagcaacagagctcttgtt

SEQ ID NO: 7838261 - DNA, 22 bp, Homo sapiens
tattagattaactttaatgtct

SEQ ID NO: 7838262 - DNA, 22 bp, Homo sapiens
tattagcacaaagcaaggtatt

SEQ ID NO: 7838263 - DNA, 22 bp, Homo sapiens
tattagcagttgtatgtgtctg

SEQ ID NO: 7838264 - DNA, 22 bp, Homo sapiens
tattagctccagtactgttgcc

SEQ ID NO: 7838265 - DNA, 22 bp, Homo sapiens
tattagcttctggttttgttct

SEQ ID NO: 7838266 - DNA, 22 bp, Homo sapiens
tatttaatttgctcattgtgat

SEQ ID NO: 7838267 - DNA, 22 bp, Homo sapiens
tatttaatttgctcattgtgat

SEQ ID NO: 7838268 - DNA, 20 bp, Homo sapiens
tatttacaacttagagcctc

SEQ ID NO: 7838269 - DNA, 20 bp, Homo sapiens
tatttacaacttagagcctc

SEQ ID NO: 7838270 - DNA, 22 bp, Homo sapiens
tatttataatctgccaaagaga

SEQ ID NO: 7838271 - DNA, 22 bp, Homo sapiens
tatttataacagtgagaacggg

SEQ ID NO: 7838272 - DNA, 22 bp, Homo sapiens
tatttataacagtgagaacggg

SEQ ID NO: 7838273 - DNA, 22 bp, Homo sapiens
tatttataatctgccaaagaga

SEQ ID NO: 7838274 - DNA, 22 bp, Homo sapiens
tatttataatctgccaaagaga

SEQ ID NO: 7838275 - DNA, 22 bp, Homo sapiens
tatttataatctgccaaagaga

SEQ ID NO: 7838276 - DNA, 22 bp, Homo sapiens
tattgacatttttatagcttga

SEQ ID NO: 7838277 - DNA, 22 bp, Homo sapiens
tattgacagtgactattggtag

SEQ ID NO: 7838278 - DNA, 22 bp, Homo sapiens
tattgacatttttatagcttga

SEQ ID NO: 7838279 - DNA, 22 bp, Homo sapiens
tattgacagtgactattggtag

SEQ ID NO: 7838280 - DNA, 22 bp, Homo sapiens
tatttaattagtgattgtagag

SEQ ID NO: 7838281 - DNA, 22 bp, Homo sapiens
tatttaattagtgattgtagag

SEQ ID NO: 7838282 - DNA, 22 bp, Homo sapiens
tatttaattagtgattgtagag

SEQ ID NO: 7838283 - DNA, 22 bp, Homo sapiens
tattgacactttttgtgtagcc

SEQ ID NO: 7838284 - DNA, 22 bp, Homo sapiens
tattgacaatttgtgaaactat

SEQ ID NO: 7838285 - DNA, 22 bp, Homo sapiens
tattgacactttttgtgtagcc

SEQ ID NO: 7838286 - DNA, 22 bp, Homo sapiens
tattgacagagggtcagaagag

SEQ ID NO: 7838287 - DNA, 22 bp, Homo sapiens
tattgacaggtgcctgcagaca

SEQ ID NO: 7838288 - DNA, 22 bp, Homo sapiens
tattgacaggtgcctgcagaca

SEQ ID NO: 7838289 - DNA, 21 bp, Homo sapiens
tatttattaatttgtaaggct

SEQ ID NO: 7838290 - DNA, 21 bp, Homo sapiens
tatttattaatttgtaaggct

SEQ ID NO: 7838291 - DNA, 21 bp, Homo sapiens
tatttattaatttgtaaggct

SEQ ID NO: 7838292 - DNA, 21 bp, Homo sapiens
tatttattaatttgtaaggct

SEQ ID NO: 7838293 - DNA, 22 bp, Homo sapiens
tatttatgtggaccataagcct

SEQ ID NO: 7838294 - DNA, 22 bp, Homo sapiens
tatttatgtggaccataagcct

SEQ ID NO: 7838295 - DNA, 22 bp, Homo sapiens
tatttatgtggaccataagcct

SEQ ID NO: 7838296 - DNA, 22 bp, Homo sapiens
tatttatgtctctgcagagaat

SEQ ID NO: 7838297 - DNA, 22 bp, Homo sapiens
tatttatgtatgtggatgtgtt

SEQ ID NO: 7838298 - DNA, 22 bp, Homo sapiens
tatttatcgagtgtctactatg

SEQ ID NO: 7838299 - DNA, 22 bp, Homo sapiens
tatttatcgagtgtctactatg

SEQ ID NO: 7838300 - DNA, 22 bp, Homo sapiens
tatttatattctgccttctgct

SEQ ID NO: 7838301 - DNA, 22 bp, Homo sapiens
tatttatattctgccttctgct

SEQ ID NO: 7838302 - DNA, 22 bp, Homo sapiens
tatttataatctgccaaagaga

SEQ ID NO: 7838303 - DNA, 22 bp, Homo sapiens
tatttataatctgccaaagaga

SEQ ID NO: 7838304 - DNA, 22 bp, Homo sapiens
tatttataccaggtgatcggag

SEQ ID NO: 7838305 - DNA, 22 bp, Homo sapiens
tatttctgagaaccaacttacc

SEQ ID NO: 7838306 - DNA, 22 bp, Homo sapiens
tatttctgagaaccaacttacc

SEQ ID NO: 7838307 - DNA, 22 bp, Homo sapiens
tatttctgaatccaaaaggtca

SEQ ID NO: 7838308 - DNA, 22 bp, Homo sapiens
tatttctgaatccaaaaggtca

SEQ ID NO: 7838309 - DNA, 22 bp, Homo sapiens
tatttctctttgtagggatata

SEQ ID NO: 7838310 - DNA, 22 bp, Homo sapiens
tatttctctttgtagggatata

SEQ ID NO: 7838311 - DNA, 22 bp, Homo sapiens
tatttctcttcaaaattgatgt

SEQ ID NO: 7838312 - DNA, 22 bp, Homo sapiens
tatttctcttcaaaattgatgt

SEQ ID NO: 7838313 - DNA, 22 bp, Homo sapiens
tatttctcttcaaaattgatgt

SEQ ID NO: 7838314 - DNA, 22 bp, Homo sapiens
tatttctcttcaaaattgatgt

SEQ ID NO: 7838315 - DNA, 22 bp, Homo sapiens
tatttctcagcattttacatcc

SEQ ID NO: 7838316 - DNA, 22 bp, Homo sapiens
tatttctcagcattttacatcc

SEQ ID NO: 7838317 - DNA, 22 bp, Homo sapiens
tatttctattccccaggcaagt

SEQ ID NO: 7838318 - DNA, 22 bp, Homo sapiens
tatttctattccccaggcaagt

SEQ ID NO: 7838319 - DNA, 22 bp, Homo sapiens
tatttcaacgtatgaaaagctg

SEQ ID NO: 7838320 - DNA, 22 bp, Homo sapiens
tatttctaagctgtaagtctga

SEQ ID NO: 7838321 - DNA, 22 bp, Homo sapiens
tatttattggacagtgttgctg

SEQ ID NO: 7838322 - DNA, 22 bp, Homo sapiens
tatttattggacagtgttgctg

SEQ ID NO: 7838323 - DNA, 19 bp, Homo sapiens
tatttcaaagtgccgtcta

SEQ ID NO: 7838324 - DNA, 22 bp, Homo sapiens
tatttattctttgtactgcctt

SEQ ID NO: 7838325 - DNA, 22 bp, Homo sapiens
tatttattggacagtgttgctg

SEQ ID NO: 7838326 - DNA, 22 bp, Homo sapiens
tatttattctttgtactgcctt

SEQ ID NO: 7838327 - DNA, 22 bp, Homo sapiens
tatttattctttgtactgcctt

SEQ ID NO: 7838328 - DNA, 22 bp, Homo sapiens
tatttattggacagtgttgctg

SEQ ID NO: 7838329 - DNA, 22 bp, Homo sapiens
tatttattggacagtgttgctg

SEQ ID NO: 7838330 - DNA, 22 bp, Homo sapiens
tatttattggacagtgttgctg

SEQ ID NO: 7838331 - DNA, 22 bp, Homo sapiens
tatttattggacagtgttgctg

SEQ ID NO: 7838332 - DNA, 22 bp, Homo sapiens
tatttattggacagtgttgctg

SEQ ID NO: 7838333 - DNA, 22 bp, Homo sapiens
tatttattctttgtactgcctt

SEQ ID NO: 7838334 - DNA, 22 bp, Homo sapiens
tatttattctttgtactgcctt

SEQ ID NO: 7838335 - DNA, 22 bp, Homo sapiens
tatttattctttgtactgcctt

SEQ ID NO: 7838336 - DNA, 22 bp, Homo sapiens
tatttattcattcagcaagcat

SEQ ID NO: 7838337 - DNA, 22 bp, Homo sapiens
tatttattcattcagcaagcat

SEQ ID NO: 7838338 - DNA, 22 bp, Homo sapiens
tatttattcattcagcaagcat

SEQ ID NO: 7838339 - DNA, 22 bp, Homo sapiens
tatttattcattcagcaagcat

SEQ ID NO: 7838340 - DNA, 22 bp, Homo sapiens
tatttattcattcagcaagcat

SEQ ID NO: 7838341 - DNA, 22 bp, Homo sapiens
tattctgtgtgatatgtaaatg

SEQ ID NO: 7838342 - DNA, 22 bp, Homo sapiens
tattctgtgtgatatgtaaatg

SEQ ID NO: 7838343 - DNA, 22 bp, Homo sapiens
tattctgtgtgatatgtaaatg

SEQ ID NO: 7838344 - DNA, 22 bp, Homo sapiens
tattctgtgtgatatgtaaatg

SEQ ID NO: 7838345 - DNA, 22 bp, Homo sapiens
tattctgatttcaagtgagagt

SEQ ID NO: 7838346 - DNA, 22 bp, Homo sapiens
tattctctgcagctgaatgttt

SEQ ID NO: 7838347 - DNA, 22 bp, Homo sapiens
tattctctgcagctgaatgttt

SEQ ID NO: 7838348 - DNA, 22 bp, Homo sapiens
tattctgctaagtgatttctac

SEQ ID NO: 7838349 - DNA, 22 bp, Homo sapiens
tattctgcttcccgtggcacaa

SEQ ID NO: 7838350 - DNA, 22 bp, Homo sapiens
tattctactagcattgttcact

SEQ ID NO: 7838351 - DNA, 22 bp, Homo sapiens
tattctactagcattgttcact

SEQ ID NO: 7838352 - DNA, 22 bp, Homo sapiens
tattctagtaccctgaaaacct

SEQ ID NO: 7838353 - DNA, 22 bp, Homo sapiens
tattctagaagtccaccagtct

SEQ ID NO: 7838354 - DNA, 22 bp, Homo sapiens
tattctcagcaacacacatgga

SEQ ID NO: 7838355 - DNA, 22 bp, Homo sapiens
tattctcagcaacacacatgga

SEQ ID NO: 7838356 - DNA, 22 bp, Homo sapiens
tattctcagtgctataagtaga

SEQ ID NO: 7838357 - DNA, 22 bp, Homo sapiens
tattctcagtgctataagtaga

SEQ ID NO: 7838358 - DNA, 22 bp, Homo sapiens
tattctcatcatcactggagct

SEQ ID NO: 7838359 - DNA, 22 bp, Homo sapiens
tattctcattagtctgtattcc

SEQ ID NO: 7838360 - DNA, 22 bp, Homo sapiens
tattctccccggatcagggcaa

SEQ ID NO: 7838361 - DNA, 22 bp, Homo sapiens
tattctccccggatcagggcaa

SEQ ID NO: 7838362 - DNA, 22 bp, Homo sapiens
tattctccccggatcagggcaa

SEQ ID NO: 7838363 - DNA, 22 bp, Homo sapiens
tattctccccggatcagggcaa

SEQ ID NO: 7838364 - DNA, 22 bp, Homo sapiens
tattctcattagtctgtattcc

SEQ ID NO: 7838365 - DNA, 22 bp, Homo sapiens
tattctctccccaatcttgctt

SEQ ID NO: 7838366 - DNA, 22 bp, Homo sapiens
tattctctccccaatcttgctt

SEQ ID NO: 7838367 - DNA, 22 bp, Homo sapiens
tattcttactctcgactgcatt

SEQ ID NO: 7838368 - DNA, 22 bp, Homo sapiens
tattcttactctcgactgcatt

SEQ ID NO: 7838369 - DNA, 22 bp, Homo sapiens
tattcttgactgcttactatgt

SEQ ID NO: 7838370 - DNA, 22 bp, Homo sapiens
tattcttgtaccttaaatgatt

SEQ ID NO: 7838371 - DNA, 22 bp, Homo sapiens
tattcttgtatactacaatctt

SEQ ID NO: 7838372 - DNA, 22 bp, Homo sapiens
tattcttgtaccttaaatgatt

SEQ ID NO: 7838373 - DNA, 22 bp, Homo sapiens
tattcttgtaccttaaatgatt

SEQ ID NO: 7838374 - DNA, 22 bp, Homo sapiens
tattcttgtatactacaatctt

SEQ ID NO: 7838375 - DNA, 22 bp, Homo sapiens
tattcttgtcttttccagaaat

SEQ ID NO: 7838376 - DNA, 22 bp, Homo sapiens
tattgaaatccattacgttctt

SEQ ID NO: 7838377 - DNA, 22 bp, Homo sapiens
tattgaaatccattacgttctt

SEQ ID NO: 7838378 - DNA, 22 bp, Homo sapiens
tattgaaattcttcatgtcctc

SEQ ID NO: 7838379 - DNA, 22 bp, Homo sapiens
tattgaaatgaatgacagtgat

SEQ ID NO: 7838380 - DNA, 22 bp, Homo sapiens
tattgaaatgaatgacagtgat

SEQ ID NO: 7838381 - DNA, 22 bp, Homo sapiens
tattgaaattcttcatgtcctc

SEQ ID NO: 7838382 - DNA, 22 bp, Homo sapiens
tattgacaatttgtgaaactat

SEQ ID NO: 7838383 - DNA, 22 bp, Homo sapiens
tattgacaatttgtgaaactat

SEQ ID NO: 7838384 - DNA, 22 bp, Homo sapiens
tattgacaataggcaactgagg

SEQ ID NO: 7838385 - DNA, 22 bp, Homo sapiens
tattgacaatttgtgaaactat

SEQ ID NO: 7838386 - DNA, 22 bp, Homo sapiens
tattaggctagtcaatagagat

SEQ ID NO: 7838387 - DNA, 22 bp, Homo sapiens
tattaggcatttgaggataaac

SEQ ID NO: 7838388 - DNA, 23 bp, Homo sapiens
tattagggccaggactggcaaat

SEQ ID NO: 7838389 - DNA, 22 bp, Homo sapiens
tattaggtagattttactgatt

SEQ ID NO: 7838390 - DNA, 22 bp, Homo sapiens
tattattaaatggcagaatttt

SEQ ID NO: 7838391 - DNA, 22 bp, Homo sapiens
tattaggtagattttactgatt

SEQ ID NO: 7838392 - DNA, 22 bp, Homo sapiens
tattaggtaaaggacttgcagg

SEQ ID NO: 7838393 - DNA, 22 bp, Homo sapiens
tattattatagttattgggaag

SEQ ID NO: 7838394 - DNA, 22 bp, Homo sapiens
tattattatattggatgagact

SEQ ID NO: 7838395 - DNA, 22 bp, Homo sapiens
tattattatgcatagcatgaaa

SEQ ID NO: 7838396 - DNA, 22 bp, Homo sapiens
tattattgcaagtatataaagt

SEQ ID NO: 7838397 - DNA, 22 bp, Homo sapiens
tattattgcaagtatataaagt

SEQ ID NO: 7838398 - DNA, 22 bp, Homo sapiens
tattattgcaagtatataaagt

SEQ ID NO: 7838399 - DNA, 22 bp, Homo sapiens
tattattgcaagtatataaagt

SEQ ID NO: 7838400 - DNA, 22 bp, Homo sapiens
tattattgacatttacttggtg

SEQ ID NO: 7838401 - DNA, 22 bp, Homo sapiens
tattattgactattcagaatgt

SEQ ID NO: 7838402 - DNA, 22 bp, Homo sapiens
tattattgactattcagaatgt

SEQ ID NO: 7838403 - DNA, 22 bp, Homo sapiens
tattattgactattcagaatgt

SEQ ID NO: 7838404 - DNA, 22 bp, Homo sapiens
tattccttggcaaaaaatatat

SEQ ID NO: 7838405 - DNA, 22 bp, Homo sapiens
tattcctgttccccatcaccac

SEQ ID NO: 7838406 - DNA, 22 bp, Homo sapiens
tattctacagtgttagtgttag

SEQ ID NO: 7838407 - DNA, 22 bp, Homo sapiens
tattctacagtgttagtgttag

SEQ ID NO: 7838408 - DNA, 22 bp, Homo sapiens
tattcatgtcggctgaaaaagc

SEQ ID NO: 7838409 - DNA, 22 bp, Homo sapiens
tattcatgggggtccaggtacc

SEQ ID NO: 7838410 - DNA, 22 bp, Homo sapiens
tattcatgtcggctgaaaaagc

SEQ ID NO: 7838411 - DNA, 22 bp, Homo sapiens
tattcattatgaccaaatctag

SEQ ID NO: 7838412 - DNA, 22 bp, Homo sapiens
tattcattatgaccaaatctag

SEQ ID NO: 7838413 - DNA, 22 bp, Homo sapiens
tattccaaaatagttaagcact

SEQ ID NO: 7838414 - DNA, 22 bp, Homo sapiens
tattcaaagtaccttcattgcc

SEQ ID NO: 7838415 - DNA, 22 bp, Homo sapiens
tattcaaagtaccttcattgcc

SEQ ID NO: 7838416 - DNA, 22 bp, Homo sapiens
tattcaaagtaccttcattgcc

SEQ ID NO: 7838417 - DNA, 22 bp, Homo sapiens
tattcaaagtaccttcattgcc

SEQ ID NO: 7838418 - DNA, 22 bp, Homo sapiens
tattcaaagtaccttcattgcc

SEQ ID NO: 7838419 - DNA, 22 bp, Homo sapiens
tattcatgggaggtcacaactt

SEQ ID NO: 7838420 - DNA, 22 bp, Homo sapiens
tattattttagcactgaggatt

SEQ ID NO: 7838421 - DNA, 22 bp, Homo sapiens
tattattgcaagtatataaagt

SEQ ID NO: 7838422 - DNA, 19 bp, Homo sapiens
tattatttgtagcaaggcc

SEQ ID NO: 7838423 - DNA, 19 bp, Homo sapiens
tattatttgtagcaaggcc

SEQ ID NO: 7838424 - DNA, 19 bp, Homo sapiens
tattatttgtagcaaggcc

SEQ ID NO: 7838425 - DNA, 22 bp, Homo sapiens
tatagccaataatagtgtgtga

SEQ ID NO: 7838426 - DNA, 18 bp, Homo sapiens
tatagccactgaaatgtg

SEQ ID NO: 7838427 - DNA, 22 bp, Homo sapiens
tatagccatttccagtggcatc

SEQ ID NO: 7838428 - DNA, 22 bp, Homo sapiens
tatagctttgctgagaaaaaga

SEQ ID NO: 7838429 - DNA, 22 bp, Homo sapiens
tataggaaaggagtggtcacaa

SEQ ID NO: 7838430 - DNA, 22 bp, Homo sapiens
tataggaaacatacgtgactag

SEQ ID NO: 7838431 - DNA, 22 bp, Homo sapiens
tatagctttgctgagaaaaaga

SEQ ID NO: 7838432 - DNA, 22 bp, Homo sapiens
tatagcaattcagaatacatgt

SEQ ID NO: 7838433 - DNA, 22 bp, Homo sapiens
tatagcaattcagaatacatgt

SEQ ID NO: 7838434 - DNA, 22 bp, Homo sapiens
tatagcagtataacatgtttac

SEQ ID NO: 7838435 - DNA, 21 bp, Homo sapiens
tatagcagcatgatttataat

SEQ ID NO: 7838436 - DNA, 22 bp, Homo sapiens
tatagcactgcaatatttccct

SEQ ID NO: 7838437 - DNA, 22 bp, Homo sapiens
tataggaatgacgtcatttcct

SEQ ID NO: 7838438 - DNA, 22 bp, Homo sapiens
tataggaaggcagattttagct

SEQ ID NO: 7838439 - DNA, 22 bp, Homo sapiens
tataggaagtaattgttgcctg

SEQ ID NO: 7838440 - DNA, 22 bp, Homo sapiens
tatagccatttccagtggcatc

SEQ ID NO: 7838441 - DNA, 22 bp, Homo sapiens
tataggaaggcagattttagct

SEQ ID NO: 7838442 - DNA, 22 bp, Homo sapiens
tataggaaatttatctcctggg

SEQ ID NO: 7838443 - DNA, 22 bp, Homo sapiens
tataggaaataggtcttctgtg

SEQ ID NO: 7838444 - DNA, 22 bp, Homo sapiens
tatatatatgcacacacaccta

SEQ ID NO: 7838445 - DNA, 22 bp, Homo sapiens
tatatatgggggaagctggatg

SEQ ID NO: 7838446 - DNA, 22 bp, Homo sapiens
tatatatgagcatgtgaggaca

SEQ ID NO: 7838447 - DNA, 22 bp, Homo sapiens
tatatatgagcatgtgaggaca

SEQ ID NO: 7838448 - DNA, 22 bp, Homo sapiens
tatagttccatctgctctattt

SEQ ID NO: 7838449 - DNA, 22 bp, Homo sapiens
tatagttagtttcataatcatg

SEQ ID NO: 7838450 - DNA, 22 bp, Homo sapiens
tatagttagtttcataatcatg

SEQ ID NO: 7838451 - DNA, 21 bp, Homo sapiens
tatagtcacttgagcattatc

SEQ ID NO: 7838452 - DNA, 22 bp, Homo sapiens
tatagtgcattatttacagtaa

SEQ ID NO: 7838453 - DNA, 22 bp, Homo sapiens
tatagtgtctctagatcaaaga

SEQ ID NO: 7838454 - DNA, 22 bp, Homo sapiens
tatagtgtctctagatcaaaga

SEQ ID NO: 7838455 - DNA, 22 bp, Homo sapiens
tatagtatacttaaagtctatt

SEQ ID NO: 7838456 - DNA, 22 bp, Homo sapiens
tatagtacatggaatcttcata

SEQ ID NO: 7838457 - DNA, 22 bp, Homo sapiens
tatagtacatggaatcttcata

SEQ ID NO: 7838458 - DNA, 22 bp, Homo sapiens
tatagtacatggaatcttcata

SEQ ID NO: 7838459 - DNA, 22 bp, Homo sapiens
tataggcagatctgagaatatt

SEQ ID NO: 7838460 - DNA, 22 bp, Homo sapiens
tatagtacacttaggtacttca

SEQ ID NO: 7838461 - DNA, 22 bp, Homo sapiens
tatagtaaaattttcatttatg

SEQ ID NO: 7838462 - DNA, 22 bp, Homo sapiens
tatagtaaaattttcatttatg

SEQ ID NO: 7838463 - DNA, 22 bp, Homo sapiens
tataggtagccatatttgatag

SEQ ID NO: 7838464 - DNA, 22 bp, Homo sapiens
tataggtacttggaaaataagg

SEQ ID NO: 7838465 - DNA, 22 bp, Homo sapiens
tataggtgaataaatgagttta

SEQ ID NO: 7838466 - DNA, 22 bp, Homo sapiens
tatatattcttaagtagtgtag

SEQ ID NO: 7838467 - DNA, 22 bp, Homo sapiens
tatatattcttaagtagtgtag

SEQ ID NO: 7838468 - DNA, 22 bp, Homo sapiens
tatatattcttaagtagtgtag

SEQ ID NO: 7838469 - DNA, 22 bp, Homo sapiens
tatatattcttaagtagtgtag

SEQ ID NO: 7838470 - DNA, 22 bp, Homo sapiens
tatatattcttaagtagtgtag

SEQ ID NO: 7838471 - DNA, 22 bp, Homo sapiens
tatatattcttaagtagtgtag

SEQ ID NO: 7838472 - DNA, 19 bp, Homo sapiens
tatatattttggggttgtg

SEQ ID NO: 7838473 - DNA, 19 bp, Homo sapiens
tatatattttggggttgtg

SEQ ID NO: 7838474 - DNA, 22 bp, Homo sapiens
tatatcagcaaagcatttaaaa

SEQ ID NO: 7838475 - DNA, 22 bp, Homo sapiens
tatatcagagttaaaagaatgt

SEQ ID NO: 7838476 - DNA, 22 bp, Homo sapiens
tatatcatggagattaacattc

SEQ ID NO: 7838477 - DNA, 22 bp, Homo sapiens
tatatcatggagattaacattc

SEQ ID NO: 7838478 - DNA, 22 bp, Homo sapiens
tatatcatggagattaacattc

SEQ ID NO: 7838479 - DNA, 22 bp, Homo sapiens
tatatcatggagattaacattc

SEQ ID NO: 7838480 - DNA, 22 bp, Homo sapiens
tatatcagcaaagcatttaaaa

SEQ ID NO: 7838481 - DNA, 22 bp, Homo sapiens
tatatcatggagattaacattc

SEQ ID NO: 7838482 - DNA, 19 bp, Homo sapiens
tatatattttggggttgtg

SEQ ID NO: 7838483 - DNA, 22 bp, Homo sapiens
tatatctaggaaccctgagatt

SEQ ID NO: 7838484 - DNA, 22 bp, Homo sapiens
tatatctaagtgtatgtaagag

SEQ ID NO: 7838485 - DNA, 22 bp, Homo sapiens
tatatccatttgtctgctaatt

SEQ ID NO: 7838486 - DNA, 22 bp, Homo sapiens
tatatctaagtgtatgtaagag

SEQ ID NO: 7838487 - DNA, 22 bp, Homo sapiens
tatatcttatatgtgcaggtac

SEQ ID NO: 7838488 - DNA, 22 bp, Homo sapiens
tatatgacagtatcattttaaa

SEQ ID NO: 7838489 - DNA, 22 bp, Homo sapiens
tatatgacagtatcattttaaa

SEQ ID NO: 7838490 - DNA, 20 bp, Homo sapiens
tatatgacatcatgatctta

SEQ ID NO: 7838491 - DNA, 22 bp, Homo sapiens
tatatcatggagattaacattc

SEQ ID NO: 7838492 - DNA, 22 bp, Homo sapiens
tatatcatggagattaacattc

SEQ ID NO: 7838493 - DNA, 22 bp, Homo sapiens
tatatcatggagattaacattc

SEQ ID NO: 7838494 - DNA, 22 bp, Homo sapiens
tatatccagaaaatcagttcat

SEQ ID NO: 7838495 - DNA, 22 bp, Homo sapiens
tatatccataggctgtgcctag

SEQ ID NO: 7838496 - DNA, 22 bp, Homo sapiens
tatccaaagtggcatattatag

SEQ ID NO: 7838497 - DNA, 22 bp, Homo sapiens
tatccaaagtttctcagaaact

SEQ ID NO: 7838498 - DNA, 22 bp, Homo sapiens
tatccaattcaccattgatggg

SEQ ID NO: 7838499 - DNA, 22 bp, Homo sapiens
tatatgatgccaaataacctgt

SEQ ID NO: 7838500 - DNA, 20 bp, Homo sapiens
tatatgacatcatgatctta

SEQ ID NO: 7838501 - DNA, 22 bp, Homo sapiens
tatccaaagtggcatattatag

SEQ ID NO: 7838502 - DNA, 22 bp, Homo sapiens
tatccaattcaccattgatggg

SEQ ID NO: 7838503 - DNA, 22 bp, Homo sapiens
tatccaaagtttctcagaaact

SEQ ID NO: 7838504 - DNA, 22 bp, Homo sapiens
tatccacactgggatgttttga

SEQ ID NO: 7838505 - DNA, 22 bp, Homo sapiens
tatccacactcaaggggagggg

SEQ ID NO: 7838506 - DNA, 23 bp, Homo sapiens
tatccagtagggcccagagctga

SEQ ID NO: 7838507 - DNA, 22 bp, Homo sapiens
tatccagtgtgaactcctctac

SEQ ID NO: 7838508 - DNA, 22 bp, Homo sapiens
tatccatagtttatagatcaag

SEQ ID NO: 7838509 - DNA, 22 bp, Homo sapiens
tatccatagtttatagatcaag

SEQ ID NO: 7838510 - DNA, 22 bp, Homo sapiens
tatccatctatgtgtgtctgtg

SEQ ID NO: 7838511 - DNA, 22 bp, Homo sapiens
tatcccaggaggccacctgtca

SEQ ID NO: 7838512 - DNA, 22 bp, Homo sapiens
tatcccaggaggccacctgtca

SEQ ID NO: 7838513 - DNA, 22 bp, Homo sapiens
tatccatttattttctaggcaa

SEQ ID NO: 7838514 - DNA, 22 bp, Homo sapiens
tatccattatgttggctagtct

SEQ ID NO: 7838515 - DNA, 22 bp, Homo sapiens
tatccatcagtcacactataga

SEQ ID NO: 7838516 - DNA, 22 bp, Homo sapiens
tatccatcttctttgagaatgg

SEQ ID NO: 7838517 - DNA, 22 bp, Homo sapiens
tatccatctttgaaactttaag

SEQ ID NO: 7838518 - DNA, 22 bp, Homo sapiens
tatccattaggtctatggtcaa

SEQ ID NO: 7838519 - DNA, 22 bp, Homo sapiens
tatccatggccaatcaaataca

SEQ ID NO: 7838520 - DNA, 20 bp, Homo sapiens
tatctaaatgcttacattac

SEQ ID NO: 7838521 - DNA, 22 bp, Homo sapiens
tatctaaaggatttaatttagt

SEQ ID NO: 7838522 - DNA, 22 bp, Homo sapiens
tatctaaaggatttaatttagt

SEQ ID NO: 7838523 - DNA, 22 bp, Homo sapiens
tatctaaaggatttaatttagt

SEQ ID NO: 7838524 - DNA, 22 bp, Homo sapiens
tatctaataaatctgataagta

SEQ ID NO: 7838525 - DNA, 22 bp, Homo sapiens
tatctaagagagtcaatattta

SEQ ID NO: 7838526 - DNA, 22 bp, Homo sapiens
tatctaataaatctgataagta

SEQ ID NO: 7838527 - DNA, 22 bp, Homo sapiens
tatctacaggtgtcaggtaaga

SEQ ID NO: 7838528 - DNA, 20 bp, Homo sapiens
tatctaaatgcttacattac

SEQ ID NO: 7838529 - DNA, 22 bp, Homo sapiens
tatctaagaattccagagaaag

SEQ ID NO: 7838530 - DNA, 22 bp, Homo sapiens
tatctaaatggaatattccaga

SEQ ID NO: 7838531 - DNA, 22 bp, Homo sapiens
tatctaaaggatttaatttagt

SEQ ID NO: 7838532 - DNA, 22 bp, Homo sapiens
tatcctgttttgcacaattata

SEQ ID NO: 7838533 - DNA, 22 bp, Homo sapiens
tatcctgtccatcctcccactg

SEQ ID NO: 7838534 - DNA, 22 bp, Homo sapiens
tatcctgtgtactgtctagtac

SEQ ID NO: 7838535 - DNA, 22 bp, Homo sapiens
tatcctgttttacctggcacag

SEQ ID NO: 7838536 - DNA, 22 bp, Homo sapiens
tatccgtgatgtttataaacca

SEQ ID NO: 7838537 - DNA, 22 bp, Homo sapiens
tatccccctttctcaggaagct

SEQ ID NO: 7838538 - DNA, 22 bp, Homo sapiens
tatctacagttaatatgtcatc

SEQ ID NO: 7838539 - DNA, 22 bp, Homo sapiens
tatctacatgtaggtatgtatg

SEQ ID NO: 7838540 - DNA, 21 bp, Homo sapiens
tatctactggtgtctttcaga

SEQ ID NO: 7838541 - DNA, 23 bp, Homo sapiens
tatctactttgcaattcagtacc

SEQ ID NO: 7838542 - DNA, 22 bp, Homo sapiens
tatctagaaacagagttttact

SEQ ID NO: 7838543 - DNA, 22 bp, Homo sapiens
tatctactcctctttcagatgc

SEQ ID NO: 7838544 - DNA, 22 bp, Homo sapiens
tatctacattcttgtatcttct

SEQ ID NO: 7838545 - DNA, 21 bp, Homo sapiens
tatctactggtgtctttcaga

SEQ ID NO: 7838546 - DNA, 19 bp, Homo sapiens
tatgacaagtactagttct

SEQ ID NO: 7838547 - DNA, 19 bp, Homo sapiens
tatgacaagtactagttct

SEQ ID NO: 7838548 - DNA, 22 bp, Homo sapiens
tatctagatagtttagccatct

SEQ ID NO: 7838549 - DNA, 22 bp, Homo sapiens
tatctagatatttggataaatg

SEQ ID NO: 7838550 - DNA, 22 bp, Homo sapiens
tatctagataccaagaagcaca

SEQ ID NO: 7838551 - DNA, 16 bp, Homo sapiens
tatctagagttgaggt

SEQ ID NO: 7838552 - DNA, 16 bp, Homo sapiens
tatctagagttgaggt

SEQ ID NO: 7838553 - DNA, 22 bp, Homo sapiens
tatctagataccaagaagcaca

SEQ ID NO: 7838554 - DNA, 22 bp, Homo sapiens
tatctagatagtttagccatct

SEQ ID NO: 7838555 - DNA, 22 bp, Homo sapiens
tatctagataccaagaagcaca

SEQ ID NO: 7838556 - DNA, 22 bp, Homo sapiens
tatctagaaacagagttttact

SEQ ID NO: 7838557 - DNA, 22 bp, Homo sapiens
tatctagaaatttcttttgttg

SEQ ID NO: 7838558 - DNA, 22 bp, Homo sapiens
tatctagaaatttcttttgttg

SEQ ID NO: 7838559 - DNA, 22 bp, Homo sapiens
tatctagaactccagaatgtag

SEQ ID NO: 7838560 - DNA, 22 bp, Homo sapiens
tatctagaaatttcttttgttg

SEQ ID NO: 7838561 - DNA, 22 bp, Homo sapiens
tatctagaactccagaatgtag

SEQ ID NO: 7838562 - DNA, 22 bp, Homo sapiens
tatctagaactccagaatgtag

SEQ ID NO: 7838563 - DNA, 22 bp, Homo sapiens
tatctagagcctggaagtcttg

SEQ ID NO: 7838564 - DNA, 22 bp, Homo sapiens
tatctagagcctggaagtcttg

SEQ ID NO: 7838565 - DNA, 22 bp, Homo sapiens
tatctagagtcctgctgagaac

SEQ ID NO: 7838566 - DNA, 22 bp, Homo sapiens
tatctagagtcctgctgagaac

SEQ ID NO: 7838567 - DNA, 22 bp, Homo sapiens
tatctagagcagtggttctcaa

SEQ ID NO: 7838568 - DNA, 22 bp, Homo sapiens
tatctagagcctggaagtcttg

SEQ ID NO: 7838569 - DNA, 22 bp, Homo sapiens
tatctagaactccagaatgtag

SEQ ID NO: 7838570 - DNA, 22 bp, Homo sapiens
tatctagagcagtggttctcaa

SEQ ID NO: 7838571 - DNA, 22 bp, Homo sapiens
tatctagagcagtggttctcaa

SEQ ID NO: 7838572 - DNA, 22 bp, Homo sapiens
tatgagaaaggagaatgacttt

SEQ ID NO: 7838573 - DNA, 22 bp, Homo sapiens
tatgagaaaggagaatgacttt

SEQ ID NO: 7838574 - DNA, 22 bp, Homo sapiens
tatgagaaattatacctaggtt

SEQ ID NO: 7838575 - DNA, 22 bp, Homo sapiens
tatgagaaattatacctaggtt

SEQ ID NO: 7838576 - DNA, 22 bp, Homo sapiens
tatgagaaagtcgtatgtctcc

SEQ ID NO: 7838577 - DNA, 22 bp, Homo sapiens
tatgagaaagtcgtatgtctcc

SEQ ID NO: 7838578 - DNA, 22 bp, Homo sapiens
tatgagaaaataaatatctgtt

SEQ ID NO: 7838579 - DNA, 21 bp, Homo sapiens
tatgagaaaactgaggtgcat

SEQ ID NO: 7838580 - DNA, 22 bp, Homo sapiens
tatgagaaaataaatatctgtt

SEQ ID NO: 7838581 - DNA, 21 bp, Homo sapiens
tatgagaaaactgaggtgcat

SEQ ID NO: 7838582 - DNA, 22 bp, Homo sapiens
tatgagaaaataaatatctgtt

SEQ ID NO: 7838583 - DNA, 22 bp, Homo sapiens
tatgacttatttcatcagttct

SEQ ID NO: 7838584 - DNA, 22 bp, Homo sapiens
tatgacttttcccaattcagga

SEQ ID NO: 7838585 - DNA, 22 bp, Homo sapiens
tatgagaaattgctgatatttg

SEQ ID NO: 7838586 - DNA, 22 bp, Homo sapiens
tatgagaacaagaacaatctcc

SEQ ID NO: 7838587 - DNA, 22 bp, Homo sapiens
tatgagaacgggggcgtgtggg

SEQ ID NO: 7838588 - DNA, 22 bp, Homo sapiens
tatgagaactgacagagtgcca

SEQ ID NO: 7838589 - DNA, 22 bp, Homo sapiens
tatgagaacaagaacaatctcc

SEQ ID NO: 7838590 - DNA, 23 bp, Homo sapiens
tatgagaacccatacgctgtctt

SEQ ID NO: 7838591 - DNA, 18 bp, Homo sapiens
tatgagaagattagcaat

SEQ ID NO: 7838592 - DNA, 22 bp, Homo sapiens
tatgagaaggtatggtgacttg

SEQ ID NO: 7838593 - DNA, 22 bp, Homo sapiens
tatgagaactgacagagtgcca

SEQ ID NO: 7838594 - DNA, 18 bp, Homo sapiens
tatgagaagattagcaat

SEQ ID NO: 7838595 - DNA, 22 bp, Homo sapiens
tatgagaagaacaggtgacttt

SEQ ID NO: 7838596 - DNA, 22 bp, Homo sapiens
tatgacattatgtattacatgt

SEQ ID NO: 7838597 - DNA, 22 bp, Homo sapiens
tatgacattatgtattacatgt

SEQ ID NO: 7838598 - DNA, 22 bp, Homo sapiens
tatgacattataaaggattatt

SEQ ID NO: 7838599 - DNA, 22 bp, Homo sapiens
tatgacattataaaggattatt

SEQ ID NO: 7838600 - DNA, 22 bp, Homo sapiens
tatgacatcagaagactttaaa

SEQ ID NO: 7838601 - DNA, 22 bp, Homo sapiens
tatgacatcagaagactttaaa

SEQ ID NO: 7838602 - DNA, 22 bp, Homo sapiens
tatgacatgtgatctcaagagg

SEQ ID NO: 7838603 - DNA, 22 bp, Homo sapiens
tatgacattatgtattacatgt

SEQ ID NO: 7838604 - DNA, 22 bp, Homo sapiens
tatgacattgctttttagaact

SEQ ID NO: 7838605 - DNA, 22 bp, Homo sapiens
tatgacattgctttttagaact

SEQ ID NO: 7838606 - DNA, 22 bp, Homo sapiens
tatgacattgctttttagaact

SEQ ID NO: 7838607 - DNA, 22 bp, Homo sapiens
tatgacattatgtattacatgt

SEQ ID NO: 7838608 - DNA, 22 bp, Homo sapiens
tatgacagtgaaaaaaatcaga

SEQ ID NO: 7838609 - DNA, 22 bp, Homo sapiens
tatgacagtgaaaaaaatcaga

SEQ ID NO: 7838610 - DNA, 22 bp, Homo sapiens
tatgacagtgaaaaaaatcaga

SEQ ID NO: 7838611 - DNA, 22 bp, Homo sapiens
tatgacaggcatgagatcctaa

SEQ ID NO: 7838612 - DNA, 22 bp, Homo sapiens
tatgacagcaaatatccatgag

SEQ ID NO: 7838613 - DNA, 22 bp, Homo sapiens
tatgacagcaaatatccatgag

SEQ ID NO: 7838614 - DNA, 22 bp, Homo sapiens
tatgacaccattttggtcagtg

SEQ ID NO: 7838615 - DNA, 22 bp, Homo sapiens
tatgacatttctctgatttgtg

SEQ ID NO: 7838616 - DNA, 22 bp, Homo sapiens
tatgacattggccaagttctgt

SEQ ID NO: 7838617 - DNA, 22 bp, Homo sapiens
tatgacatttctctgatttgtg

SEQ ID NO: 7838618 - DNA, 22 bp, Homo sapiens
tatgacatttctctgatttgtg

SEQ ID NO: 7838619 - DNA, 22 bp, Homo sapiens
tatgacatttctctgatttgtg

SEQ ID NO: 7838620 - DNA, 22 bp, Homo sapiens
tatgacattttcccagatttat

SEQ ID NO: 7838621 - DNA, 22 bp, Homo sapiens
tatgacattttcccagatttat

SEQ ID NO: 7838622 - DNA, 22 bp, Homo sapiens
tatgacattttcccagatttat

SEQ ID NO: 7838623 - DNA, 22 bp, Homo sapiens
tatgacattgctttttagaact

SEQ ID NO: 7838624 - DNA, 22 bp, Homo sapiens
tatgacattgctttttagaact

SEQ ID NO: 7838625 - DNA, 22 bp, Homo sapiens
tatgacattgctttttagaact

SEQ ID NO: 7838626 - DNA, 22 bp, Homo sapiens
tatgacattggccaagttctgt

SEQ ID NO: 7838627 - DNA, 22 bp, Homo sapiens
tatgacattgctttttagaact

SEQ ID NO: 7838628 - DNA, 22 bp, Homo sapiens
tatgaccttaggaagcaagaag

SEQ ID NO: 7838629 - DNA, 22 bp, Homo sapiens
tatgactatagggcttagtgtt

SEQ ID NO: 7838630 - DNA, 22 bp, Homo sapiens
tatgactttggaaaaattactt

SEQ ID NO: 7838631 - DNA, 22 bp, Homo sapiens
tatgactttggaaaaattactt

SEQ ID NO: 7838632 - DNA, 22 bp, Homo sapiens
tatgacattttgccagcattgc

SEQ ID NO: 7838633 - DNA, 22 bp, Homo sapiens
tatgacattttgccagcattgc

SEQ ID NO: 7838634 - DNA, 22 bp, Homo sapiens
tatgacattttgccagcattgc

SEQ ID NO: 7838635 - DNA, 22 bp, Homo sapiens
tatgacattttttgtggccttc

SEQ ID NO: 7838636 - DNA, 22 bp, Homo sapiens
tatacacattacagtttcagga

SEQ ID NO: 7838637 - DNA, 22 bp, Homo sapiens
tatacacattacagtttcagga

SEQ ID NO: 7838638 - DNA, 22 bp, Homo sapiens
tatacacattacagtttcagga

SEQ ID NO: 7838639 - DNA, 22 bp, Homo sapiens
tatacacatttttacctatagt

SEQ ID NO: 7838640 - DNA, 22 bp, Homo sapiens
tatacacatgtgtgtattcata

SEQ ID NO: 7838641 - DNA, 22 bp, Homo sapiens
tatacacatgtgtgtattcata

SEQ ID NO: 7838642 - DNA, 22 bp, Homo sapiens
tatacacatgtgtgtattcata

SEQ ID NO: 7838643 - DNA, 23 bp, Homo sapiens
tatacacatgtggcagtatagtg

SEQ ID NO: 7838644 - DNA, 23 bp, Homo sapiens
tatacacatgtggcagtatagtg

SEQ ID NO: 7838645 - DNA, 23 bp, Homo sapiens
tatacacatgtggcagtatagtg

SEQ ID NO: 7838646 - DNA, 22 bp, Homo sapiens
tatacacatgtgtgtattcata

SEQ ID NO: 7838647 - DNA, 22 bp, Homo sapiens
tatacacatgtgtgtattcata

SEQ ID NO: 7838648 - DNA, 22 bp, Homo sapiens
tatacacatgtgtgtattcata

SEQ ID NO: 7838649 - DNA, 22 bp, Homo sapiens
tatacacatttttacctatagt

SEQ ID NO: 7838650 - DNA, 22 bp, Homo sapiens
tatacacatttttacctatagt

SEQ ID NO: 7838651 - DNA, 22 bp, Homo sapiens
tatacacatttttacctatagt

SEQ ID NO: 7838652 - DNA, 22 bp, Homo sapiens
tatacacatttttacctatagt

SEQ ID NO: 7838653 - DNA, 22 bp, Homo sapiens
tatacacatttttacctatagt

SEQ ID NO: 7838654 - DNA, 22 bp, Homo sapiens
tatacagaacattaagaactgt

SEQ ID NO: 7838655 - DNA, 22 bp, Homo sapiens
tatacagaacattaagaactgt

SEQ ID NO: 7838656 - DNA, 22 bp, Homo sapiens
tatacagaacattaagaactgt

SEQ ID NO: 7838657 - DNA, 22 bp, Homo sapiens
tatacagaaagaattcaagtct

SEQ ID NO: 7838658 - DNA, 22 bp, Homo sapiens
tatacagaaagaattcaagtct

SEQ ID NO: 7838659 - DNA, 22 bp, Homo sapiens
tatacactgttgttgggagtct

SEQ ID NO: 7838660 - DNA, 22 bp, Homo sapiens
tatacactgatataaggagtaa

SEQ ID NO: 7838661 - DNA, 22 bp, Homo sapiens
tatacacatatacgtttgtgtg

SEQ ID NO: 7838662 - DNA, 22 bp, Homo sapiens
tatacacatatacgtttgtgtg

SEQ ID NO: 7838663 - DNA, 22 bp, Homo sapiens
tatacacatatcttctaggcct

SEQ ID NO: 7838664 - DNA, 22 bp, Homo sapiens
tatacacatatcttctaggcct

SEQ ID NO: 7838665 - DNA, 22 bp, Homo sapiens
tatacacaggaatctgtgaaaa

SEQ ID NO: 7838666 - DNA, 22 bp, Homo sapiens
tatacacatatacgtttgtgtg

SEQ ID NO: 7838667 - DNA, 17 bp, Homo sapiens
tatacacagacagactg

SEQ ID NO: 7838668 - DNA, 17 bp, Homo sapiens
tatacacagacagactg

SEQ ID NO: 7838669 - DNA, 22 bp, Homo sapiens
tatacacaggaatctgtgaaaa

SEQ ID NO: 7838670 - DNA, 17 bp, Homo sapiens
tatacacagacagactg

SEQ ID NO: 7838671 - DNA, 17 bp, Homo sapiens
tatacacagacagactg

SEQ ID NO: 7838672 - DNA, 22 bp, Homo sapiens
tatacacatatcttctaggcct

SEQ ID NO: 7838673 - DNA, 22 bp, Homo sapiens
tatacacatatcttctaggcct

SEQ ID NO: 7838674 - DNA, 22 bp, Homo sapiens
tatacacatatcttctaggcct

SEQ ID NO: 7838675 - DNA, 22 bp, Homo sapiens
tatacacatcctccaaagatag

SEQ ID NO: 7838676 - DNA, 22 bp, Homo sapiens
tatacacatcctccaaagatag

SEQ ID NO: 7838677 - DNA, 23 bp, Homo sapiens
tatacacatgtggcagtatagtg

SEQ ID NO: 7838678 - DNA, 23 bp, Homo sapiens
tatacacatgtggcagtatagtg

SEQ ID NO: 7838679 - DNA, 23 bp, Homo sapiens
tatacacatgtggcagtatagtg

SEQ ID NO: 7838680 - DNA, 22 bp, Homo sapiens
tatacacatcctccaaagatag

SEQ ID NO: 7838681 - DNA, 22 bp, Homo sapiens
tatacacatcctccaaagatag

SEQ ID NO: 7838682 - DNA, 22 bp, Homo sapiens
tatacacacatgctccggcctt

SEQ ID NO: 7838683 - DNA, 22 bp, Homo sapiens
tatacacacctccaaagcagga

SEQ ID NO: 7838684 - DNA, 22 bp, Homo sapiens
tatacacacctccaaagcagga

SEQ ID NO: 7838685 - DNA, 22 bp, Homo sapiens
tatacacacctccaaagcagga

SEQ ID NO: 7838686 - DNA, 22 bp, Homo sapiens
tatacacaaggtgtgcatttgt

SEQ ID NO: 7838687 - DNA, 22 bp, Homo sapiens
tatacacaaggtgtgcatttgt

SEQ ID NO: 7838688 - DNA, 22 bp, Homo sapiens
tatacacaaggtgtgcatttgt

SEQ ID NO: 7838689 - DNA, 22 bp, Homo sapiens
tatacacaaggtgtgcatttgt

SEQ ID NO: 7838690 - DNA, 22 bp, Homo sapiens
tatacacaaggtgtgcatttgt

SEQ ID NO: 7838691 - DNA, 22 bp, Homo sapiens
tatacacaaggtgtgcatttgt

SEQ ID NO: 7838692 - DNA, 22 bp, Homo sapiens
tatacacacatgctccggcctt

SEQ ID NO: 7838693 - DNA, 22 bp, Homo sapiens
tatacacacatgctccggcctt

SEQ ID NO: 7838694 - DNA, 22 bp, Homo sapiens
tatacacaaggtgtgcatttgt

SEQ ID NO: 7838695 - DNA, 22 bp, Homo sapiens
tatacaatggctgaatcatcca

SEQ ID NO: 7838696 - DNA, 22 bp, Homo sapiens
tatacaatggctgaatcatcca

SEQ ID NO: 7838697 - DNA, 22 bp, Homo sapiens
tatacaatggctgaatcatcca

SEQ ID NO: 7838698 - DNA, 22 bp, Homo sapiens
tatacacaaacaaggggttaag

SEQ ID NO: 7838699 - DNA, 22 bp, Homo sapiens
tatacaatggctgaatcatcca

SEQ ID NO: 7838700 - DNA, 22 bp, Homo sapiens
tatacacaaacaaggggttaag

SEQ ID NO: 7838701 - DNA, 22 bp, Homo sapiens
tatacaatggctgaatcatcca

SEQ ID NO: 7838702 - DNA, 22 bp, Homo sapiens
tatacaatggctgaatcatcca

SEQ ID NO: 7838703 - DNA, 22 bp, Homo sapiens
tatacaatggctgaatcatcca

SEQ ID NO: 7838704 - DNA, 22 bp, Homo sapiens
tatacaatggctgaatcatcca

SEQ ID NO: 7838705 - DNA, 22 bp, Homo sapiens
tatacaatggctgaatcatcca

SEQ ID NO: 7838706 - DNA, 22 bp, Homo sapiens
tatacaatggctgaatcatcca

SEQ ID NO: 7838707 - DNA, 22 bp, Homo sapiens
tatacaatgagtacattctggg

SEQ ID NO: 7838708 - DNA, 22 bp, Homo sapiens
tatacaatgagtacattctggg

SEQ ID NO: 7838709 - DNA, 22 bp, Homo sapiens
tatacaatgagtacattctggg

SEQ ID NO: 7838710 - DNA, 22 bp, Homo sapiens
tatacaatgagtacattctggg

SEQ ID NO: 7838711 - DNA, 22 bp, Homo sapiens
tatacaatgagtacattctggg

SEQ ID NO: 7838712 - DNA, 22 bp, Homo sapiens
tatacaatgagtacattctggg

SEQ ID NO: 7838713 - DNA, 22 bp, Homo sapiens
tatacaagtaatgctgaatgat

SEQ ID NO: 7838714 - DNA, 22 bp, Homo sapiens
tatacaagtgagaagaagagtt

SEQ ID NO: 7838715 - DNA, 22 bp, Homo sapiens
tatacaagtaatgctgaatgat

SEQ ID NO: 7838716 - DNA, 22 bp, Homo sapiens
tatacaagtgagaagaagagtt

SEQ ID NO: 7838717 - DNA, 22 bp, Homo sapiens
tatacaagaggtgagatgagca

SEQ ID NO: 7838718 - DNA, 22 bp, Homo sapiens
tatacaagaggtgagatgagca

SEQ ID NO: 7838719 - DNA, 22 bp, Homo sapiens
tataatttatcatgtcacagtt

SEQ ID NO: 7838720 - DNA, 22 bp, Homo sapiens
tataatttggggaaagtggtgt

SEQ ID NO: 7838721 - DNA, 22 bp, Homo sapiens
tataatttggggaaagtggtgt

SEQ ID NO: 7838722 - DNA, 22 bp, Homo sapiens
tataattttaagtggtaaatta

SEQ ID NO: 7838723 - DNA, 22 bp, Homo sapiens
tataattttaagtggtaaatta

SEQ ID NO: 7838724 - DNA, 22 bp, Homo sapiens
tataaatgccaggactttagat

SEQ ID NO: 7838725 - DNA, 22 bp, Homo sapiens
tataaatgccaggactttagat

SEQ ID NO: 7838726 - DNA, 22 bp, Homo sapiens
tataaatgcacttttgaaatat

SEQ ID NO: 7838727 - DNA, 22 bp, Homo sapiens
tataaattattaggctgctaaa

SEQ ID NO: 7838728 - DNA, 22 bp, Homo sapiens
tataaattattaggctgctaaa

SEQ ID NO: 7838729 - DNA, 22 bp, Homo sapiens
tataaattattaggctgctaaa

SEQ ID NO: 7838730 - DNA, 22 bp, Homo sapiens
tataaattaatgtgcccatgag

SEQ ID NO: 7838731 - DNA, 22 bp, Homo sapiens
tataaattattaggctgctaaa

SEQ ID NO: 7838732 - DNA, 22 bp, Homo sapiens
tataaattaatgtgcccatgag

SEQ ID NO: 7838733 - DNA, 22 bp, Homo sapiens
tataaattaatgtgcccatgag

SEQ ID NO: 7838734 - DNA, 22 bp, Homo sapiens
tataaattaatgtgcccatgag

SEQ ID NO: 7838735 - DNA, 22 bp, Homo sapiens
tataaattaatgtgcccatgag

SEQ ID NO: 7838736 - DNA, 22 bp, Homo sapiens
tataaatgcacttttgaaatat

SEQ ID NO: 7838737 - DNA, 22 bp, Homo sapiens
tataaatgcacttttgaaatat

SEQ ID NO: 7838738 - DNA, 22 bp, Homo sapiens
tataaatgcacttttgaaatat

SEQ ID NO: 7838739 - DNA, 22 bp, Homo sapiens
tataaatgcacttttgaaatat

SEQ ID NO: 7838740 - DNA, 22 bp, Homo sapiens
tataaagtttcgaaagatgtat

SEQ ID NO: 7838741 - DNA, 22 bp, Homo sapiens
tataaagtttcgaaagatgtat

SEQ ID NO: 7838742 - DNA, 22 bp, Homo sapiens
taggtgtcttgtgtatggtaca

SEQ ID NO: 7838743 - DNA, 22 bp, Homo sapiens
tataatttatcatgtcacagtt

SEQ ID NO: 7838744 - DNA, 22 bp, Homo sapiens
tataatttatcatgtcacagtt

SEQ ID NO: 7838745 - DNA, 22 bp, Homo sapiens
tataattagtaaatggcagatt

SEQ ID NO: 7838746 - DNA, 22 bp, Homo sapiens
tataactacttgaagagttcag

SEQ ID NO: 7838747 - DNA, 22 bp, Homo sapiens
tataacaccatgttctacagat

SEQ ID NO: 7838748 - DNA, 22 bp, Homo sapiens
tataacactcagaaagaatcat

SEQ ID NO: 7838749 - DNA, 22 bp, Homo sapiens
tataacactcagaaagaatcat

SEQ ID NO: 7838750 - DNA, 22 bp, Homo sapiens
tataacaggaagtattcaaaca

SEQ ID NO: 7838751 - DNA, 22 bp, Homo sapiens
tataacaggaagtattcaaaca

SEQ ID NO: 7838752 - DNA, 22 bp, Homo sapiens
tataacaggaagtattcaaaca

SEQ ID NO: 7838753 - DNA, 20 bp, Homo sapiens
tataaattcagagctttggt

SEQ ID NO: 7838754 - DNA, 21 bp, Homo sapiens
tataacacacttcagcttctc

SEQ ID NO: 7838755 - DNA, 20 bp, Homo sapiens
tataaattcagagctttggt

SEQ ID NO: 7838756 - DNA, 20 bp, Homo sapiens
tataaattcagagctttggt

SEQ ID NO: 7838757 - DNA, 20 bp, Homo sapiens
tataaattcagagctttggt

SEQ ID NO: 7838758 - DNA, 20 bp, Homo sapiens
tataaattcagagctttggt

SEQ ID NO: 7838759 - DNA, 22 bp, Homo sapiens
tataaattattaggctgctaaa

SEQ ID NO: 7838760 - DNA, 20 bp, Homo sapiens
tataaattcagagctttggt

SEQ ID NO: 7838761 - DNA, 22 bp, Homo sapiens
tataaattattaggctgctaaa

SEQ ID NO: 7838762 - DNA, 22 bp, Homo sapiens
tataaattattaggctgctaaa

SEQ ID NO: 7838763 - DNA, 22 bp, Homo sapiens
taggggtgtttcgagagaggtt

SEQ ID NO: 7838764 - DNA, 22 bp, Homo sapiens
taggggtgtttcgagagaggtt

SEQ ID NO: 7838765 - DNA, 22 bp, Homo sapiens
taggggtgtttcgagagaggtt

SEQ ID NO: 7838766 - DNA, 22 bp, Homo sapiens
taggggtgtttcgagagaggtt

SEQ ID NO: 7838767 - DNA, 22 bp, Homo sapiens
taggtcatcagattgacaaggg

SEQ ID NO: 7838768 - DNA, 22 bp, Homo sapiens
taggtcagaacaagcagtatcg

SEQ ID NO: 7838769 - DNA, 21 bp, Homo sapiens
taggtatttctatcatgtctc

SEQ ID NO: 7838770 - DNA, 22 bp, Homo sapiens
taggggtgaggccaggcatcag

SEQ ID NO: 7838771 - DNA, 22 bp, Homo sapiens
taggggtgaggccaggcatcag

SEQ ID NO: 7838772 - DNA, 22 bp, Homo sapiens
taggggtgaggccaggcatcag

SEQ ID NO: 7838773 - DNA, 22 bp, Homo sapiens
taggggtgaggccaggcatcag

SEQ ID NO: 7838774 - DNA, 22 bp, Homo sapiens
taggggtggagctaagagtccc

SEQ ID NO: 7838775 - DNA, 22 bp, Homo sapiens
taggggtggagctaagagtccc

SEQ ID NO: 7838776 - DNA, 22 bp, Homo sapiens
taggggtgggatccaggaatta

SEQ ID NO: 7838777 - DNA, 22 bp, Homo sapiens
taggggtgggatccaggaatta

SEQ ID NO: 7838778 - DNA, 22 bp, Homo sapiens
taggggtgggatccaggaatta

SEQ ID NO: 7838779 - DNA, 22 bp, Homo sapiens
taggtctgtaaatgagagagac

SEQ ID NO: 7838780 - DNA, 22 bp, Homo sapiens
taggtcccagcatcttctgagc

SEQ ID NO: 7838781 - DNA, 22 bp, Homo sapiens
taggtcccagcatcttctgagc

SEQ ID NO: 7838782 - DNA, 22 bp, Homo sapiens
taggtctgatttccattcagtc

SEQ ID NO: 7838783 - DNA, 22 bp, Homo sapiens
taggtctctcttcttgatggga

SEQ ID NO: 7838784 - DNA, 22 bp, Homo sapiens
taggtgggtgacttccatgggg

SEQ ID NO: 7838785 - DNA, 22 bp, Homo sapiens
taggtgggtgacttccatgggg

SEQ ID NO: 7838786 - DNA, 21 bp, Homo sapiens
taggtgggagccccagtatgc

SEQ ID NO: 7838787 - DNA, 22 bp, Homo sapiens
taggtgtctgctcttatttaac

SEQ ID NO: 7838788 - DNA, 22 bp, Homo sapiens
taggtgtctgtcctgggctgtg

SEQ ID NO: 7838789 - DNA, 22 bp, Homo sapiens
tagaaaggaagctacttagggg

SEQ ID NO: 7838790 - DNA, 22 bp, Homo sapiens
tagaaaggaacaggtcagcgtt

SEQ ID NO: 7838791 - DNA, 22 bp, Homo sapiens
tagaaagctggaggaattcttt

SEQ ID NO: 7838792 - DNA, 22 bp, Homo sapiens
tagaaaggcaagcgtgaaatat

SEQ ID NO: 7838793 - DNA, 22 bp, Homo sapiens
tagaaaggcaagcgtgaaatat

SEQ ID NO: 7838794 - DNA, 22 bp, Homo sapiens
tagaaaggatattgagatgaat

SEQ ID NO: 7838795 - DNA, 22 bp, Homo sapiens
tagaaaggagcattttagacta

SEQ ID NO: 7838796 - DNA, 22 bp, Homo sapiens
tagaaaggatattgagatgaat

SEQ ID NO: 7838797 - DNA, 22 bp, Homo sapiens
tagaaaggagcattttagacta

SEQ ID NO: 7838798 - DNA, 22 bp, Homo sapiens
tagaaagcgttaaatctacaga

SEQ ID NO: 7838799 - DNA, 22 bp, Homo sapiens
tagaaagctgagtaatacattt

SEQ ID NO: 7838800 - DNA, 22 bp, Homo sapiens
tagaaagaacttcatgtaaaac

SEQ ID NO: 7838801 - DNA, 22 bp, Homo sapiens
tagaaagaacttcatgtaaaac

SEQ ID NO: 7838802 - DNA, 22 bp, Homo sapiens
tagaaagaacttcatgtaaaac

SEQ ID NO: 7838803 - DNA, 22 bp, Homo sapiens
tagaaagtactaaatttaactg

SEQ ID NO: 7838804 - DNA, 22 bp, Homo sapiens
tagaaagtactaaatttaactg

SEQ ID NO: 7838805 - DNA, 22 bp, Homo sapiens
tagaaagtaaatcagttttatt

SEQ ID NO: 7838806 - DNA, 22 bp, Homo sapiens
tagaaagtaaatcagttttatt

SEQ ID NO: 7838807 - DNA, 22 bp, Homo sapiens
tagaaaggcaatcattcttgga

SEQ ID NO: 7838808 - DNA, 22 bp, Homo sapiens
tagaaaggctgctgccaaccca

SEQ ID NO: 7838809 - DNA, 22 bp, Homo sapiens
tagaaagtagccacttacagag

SEQ ID NO: 7838810 - DNA, 22 bp, Homo sapiens
tagaaagtcaaaacactgtgtt

SEQ ID NO: 7838811 - DNA, 21 bp, Homo sapiens
tagaaagtcaaagctatcagc

SEQ ID NO: 7838812 - DNA, 22 bp, Homo sapiens
tagaaagtcaaaacactgtgtt

SEQ ID NO: 7838813 - DNA, 22 bp, Homo sapiens
tagaaagtggttgagagtttag

SEQ ID NO: 7838814 - DNA, 22 bp, Homo sapiens
tagaaagtgaaggttaattaat

SEQ ID NO: 7838815 - DNA, 22 bp, Homo sapiens
tagaaatcagcaggcatatgta

SEQ ID NO: 7838816 - DNA, 22 bp, Homo sapiens
tagaaatcagcaggcatatgta

SEQ ID NO: 7838817 - DNA, 22 bp, Homo sapiens
tagaaataaatctgcagctggg

SEQ ID NO: 7838818 - DNA, 22 bp, Homo sapiens
tagaaataaatctgcagctggg

SEQ ID NO: 7838819 - DNA, 22 bp, Homo sapiens
tagaaatcacagaaaatcaggg

SEQ ID NO: 7838820 - DNA, 22 bp, Homo sapiens
tagaaatcacagaaaatcaggg

SEQ ID NO: 7838821 - DNA, 22 bp, Homo sapiens
tagaaatcacaaaccagtagtt

SEQ ID NO: 7838822 - DNA, 22 bp, Homo sapiens
tagaaatcacaaaccagtagtt

SEQ ID NO: 7838823 - DNA, 22 bp, Homo sapiens
tagaaatcaggtttttagaaag

SEQ ID NO: 7838824 - DNA, 22 bp, Homo sapiens
tagaaatcaggtttttagaaag

SEQ ID NO: 7838825 - DNA, 22 bp, Homo sapiens
tagaaatcaggtttttagaaag

SEQ ID NO: 7838826 - DNA, 17 bp, Homo sapiens
tagaaatcatagggttg

SEQ ID NO: 7838827 - DNA, 22 bp, Homo sapiens
tagaaatcatttagaagtattg

SEQ ID NO: 7838828 - DNA, 22 bp, Homo sapiens
tagaaatcatttagaagtattg

SEQ ID NO: 7838829 - DNA, 22 bp, Homo sapiens
tagaaatcatttagaagtattg

SEQ ID NO: 7838830 - DNA, 22 bp, Homo sapiens
tagaaatctacttagactttct

SEQ ID NO: 7838831 - DNA, 22 bp, Homo sapiens
tagaaatccccagtctcatagt

SEQ ID NO: 7838832 - DNA, 20 bp, Homo sapiens
tagaaatcttataaaagact

SEQ ID NO: 7838833 - DNA, 22 bp, Homo sapiens
tagaaatctacttagactttct

SEQ ID NO: 7838834 - DNA, 20 bp, Homo sapiens
tagaaatcttataaaagact

SEQ ID NO: 7838835 - DNA, 22 bp, Homo sapiens
tagaaatgaatgtttaaaagtc

SEQ ID NO: 7838836 - DNA, 22 bp, Homo sapiens
tagaaatgagccatggtagagc

SEQ ID NO: 7838837 - DNA, 22 bp, Homo sapiens
tagaaatgaatgtttaaaagtc

SEQ ID NO: 7838838 - DNA, 22 bp, Homo sapiens
tagaaatccccagtctcatagt

SEQ ID NO: 7838839 - DNA, 22 bp, Homo sapiens
tagaaatcttgttactatgtgt

SEQ ID NO: 7838840 - DNA, 22 bp, Homo sapiens
tagaaatcttgttactatgtgt

SEQ ID NO: 7838841 - DNA, 22 bp, Homo sapiens
tagaaatcttgttactatgtgt

SEQ ID NO: 7838842 - DNA, 22 bp, Homo sapiens
tagaaatgattgagctgtaata

SEQ ID NO: 7838843 - DNA, 22 bp, Homo sapiens
tagaaatgattggttgagctct

SEQ ID NO: 7838844 - DNA, 22 bp, Homo sapiens
tagaaatgattggttgagctct

SEQ ID NO: 7838845 - DNA, 22 bp, Homo sapiens
tagaaatgattggttgagctct

SEQ ID NO: 7838846 - DNA, 22 bp, Homo sapiens
tagaaatgattggttgagctct

SEQ ID NO: 7838847 - DNA, 22 bp, Homo sapiens
tagaaatgattggttgagctct

SEQ ID NO: 7838848 - DNA, 22 bp, Homo sapiens
tagaaatgattttgatgcttca

SEQ ID NO: 7838849 - DNA, 22 bp, Homo sapiens
tagaaatgattttgatgcttca

SEQ ID NO: 7838850 - DNA, 22 bp, Homo sapiens
tagaaatgcagtgtactgtgtc

SEQ ID NO: 7838851 - DNA, 22 bp, Homo sapiens
tagaaatgcagtgtactgtgtc

SEQ ID NO: 7838852 - DNA, 22 bp, Homo sapiens
tagaaatgcagtgtactgtgtc

SEQ ID NO: 7838853 - DNA, 22 bp, Homo sapiens
tagaaatgcccagattctgcta

SEQ ID NO: 7838854 - DNA, 22 bp, Homo sapiens
tagaaatgcccagattctgcta

SEQ ID NO: 7838855 - DNA, 22 bp, Homo sapiens
tagaaatggagaacagattaat

SEQ ID NO: 7838856 - DNA, 22 bp, Homo sapiens
tagaaatggagaacagattaat

SEQ ID NO: 7838857 - DNA, 22 bp, Homo sapiens
tagaaatggagaacagattaat

SEQ ID NO: 7838858 - DNA, 22 bp, Homo sapiens
tagaaatgcccagattctgcta

SEQ ID NO: 7838859 - DNA, 22 bp, Homo sapiens
tagaaatgcccagattctgcta

SEQ ID NO: 7838860 - DNA, 22 bp, Homo sapiens
tagacagagtgaagacaagtgg

SEQ ID NO: 7838861 - DNA, 22 bp, Homo sapiens
tagacagagtgaagacaagtgg

SEQ ID NO: 7838862 - DNA, 22 bp, Homo sapiens
tagacagagtgaagacaagtgg

SEQ ID NO: 7838863 - DNA, 22 bp, Homo sapiens
tagacagaatccagcccacgcc

SEQ ID NO: 7838864 - DNA, 22 bp, Homo sapiens
tagacactttagaagtaagggt

SEQ ID NO: 7838865 - DNA, 22 bp, Homo sapiens
tagacagaatccagcccacgcc

SEQ ID NO: 7838866 - DNA, 23 bp, Homo sapiens
tagacactcctttgtctgtcctt

SEQ ID NO: 7838867 - DNA, 21 bp, Homo sapiens
tagaggcaggagggactgcag

SEQ ID NO: 7838868 - DNA, 21 bp, Homo sapiens
tagaggcaggagggactgcag

SEQ ID NO: 7838869 - DNA, 21 bp, Homo sapiens
tagaggcaggagggactgcag

SEQ ID NO: 7838870 - DNA, 21 bp, Homo sapiens
tagaggcaggagggactgcag

SEQ ID NO: 7838871 - DNA, 22 bp, Homo sapiens
tagacagatgttttctggctgt

SEQ ID NO: 7838872 - DNA, 22 bp, Homo sapiens
tagaggcagaagaaattgacaa

SEQ ID NO: 7838873 - DNA, 22 bp, Homo sapiens
tagacacatcttcatccacaat

SEQ ID NO: 7838874 - DNA, 22 bp, Homo sapiens
tagacacatcttcatccacaat

SEQ ID NO: 7838875 - DNA, 23 bp, Homo sapiens
tagacactcctttgtctgtcctt

SEQ ID NO: 7838876 - DNA, 22 bp, Homo sapiens
tagacactgtatgagctgggtg

SEQ ID NO: 7838877 - DNA, 22 bp, Homo sapiens
tagacactagggatttagtact

SEQ ID NO: 7838878 - DNA, 22 bp, Homo sapiens
tagacacatcttcatccacaat

SEQ ID NO: 7838879 - DNA, 22 bp, Homo sapiens
tagacacatcaaggatcagttt

SEQ ID NO: 7838880 - DNA, 22 bp, Homo sapiens
tagaggcataagagggaagcag

SEQ ID NO: 7838881 - DNA, 22 bp, Homo sapiens
tagaggcataagagggaagcag

SEQ ID NO: 7838882 - DNA, 22 bp, Homo sapiens
tagaggcataagagggaagcag

SEQ ID NO: 7838883 - DNA, 22 bp, Homo sapiens
tagaggcataagagggaagcag

SEQ ID NO: 7838884 - DNA, 22 bp, Homo sapiens
tagaggcataagagggaagcag

SEQ ID NO: 7838885 - DNA, 22 bp, Homo sapiens
tagaggcattaatgaataaaca

SEQ ID NO: 7838886 - DNA, 22 bp, Homo sapiens
tagaggcattaatgaataaaca

SEQ ID NO: 7838887 - DNA, 22 bp, Homo sapiens
tagaggcattaatgaataaaca

SEQ ID NO: 7838888 - DNA, 22 bp, Homo sapiens
tagaggcattgcttaatttcag

SEQ ID NO: 7838889 - DNA, 22 bp, Homo sapiens
tagaggcattgcttaatttcag

SEQ ID NO: 7838890 - DNA, 22 bp, Homo sapiens
tagaggcattgcttaatttcag

SEQ ID NO: 7838891 - DNA, 22 bp, Homo sapiens
tagaggcctgaaagaatgatca

SEQ ID NO: 7838892 - DNA, 22 bp, Homo sapiens
tagaggccgaatgctgagctgg

SEQ ID NO: 7838893 - DNA, 22 bp, Homo sapiens
tagaggctcctgtgtgtaggtt

SEQ ID NO: 7838894 - DNA, 22 bp, Homo sapiens
tagagggaagactgctagattt

SEQ ID NO: 7838895 - DNA, 22 bp, Homo sapiens
tagagggccagctggacagcga

SEQ ID NO: 7838896 - DNA, 22 bp, Homo sapiens
tagagggccagctggacagcga

SEQ ID NO: 7838897 - DNA, 22 bp, Homo sapiens
tagaggggaaaatgcgtattaa

SEQ ID NO: 7838898 - DNA, 22 bp, Homo sapiens
tagaggctttcagcggtaggtc

SEQ ID NO: 7838899 - DNA, 22 bp, Homo sapiens
tagaggcttctactgctcactt

SEQ ID NO: 7838900 - DNA, 22 bp, Homo sapiens
tagaggctgggaattattttca

SEQ ID NO: 7838901 - DNA, 22 bp, Homo sapiens
tagaggctgggaattattttca

SEQ ID NO: 7838902 - DNA, 22 bp, Homo sapiens
tagaggctgggaattattttca

SEQ ID NO: 7838903 - DNA, 22 bp, Homo sapiens
tagaggctcttcattgcagtag

SEQ ID NO: 7838904 - DNA, 22 bp, Homo sapiens
tagaggctcttcattgcagtag

SEQ ID NO: 7838905 - DNA, 22 bp, Homo sapiens
tagaattcaagattcaacaggc

SEQ ID NO: 7838906 - DNA, 23 bp, Homo sapiens
tagaattcaatctgttccacatc

SEQ ID NO: 7838907 - DNA, 23 bp, Homo sapiens
tagaattcaatctgttccacatc

SEQ ID NO: 7838908 - DNA, 22 bp, Homo sapiens
tagaattcatgttactgttagc

SEQ ID NO: 7838909 - DNA, 22 bp, Homo sapiens
tagaattcatgttactgttagc

SEQ ID NO: 7838910 - DNA, 22 bp, Homo sapiens
tagaattatgccttgctgtcca

SEQ ID NO: 7838911 - DNA, 22 bp, Homo sapiens
tagaatgttcacctttaaatga

SEQ ID NO: 7838912 - DNA, 22 bp, Homo sapiens
tagaatgttcacctttaaatga

SEQ ID NO: 7838913 - DNA, 22 bp, Homo sapiens
tagaatgtgcctggaatacagt

SEQ ID NO: 7838914 - DNA, 22 bp, Homo sapiens
tagaatgtgcaaatgtgcacac

SEQ ID NO: 7838915 - DNA, 23 bp, Homo sapiens
tagaatgtcattcaatgatatgg

SEQ ID NO: 7838916 - DNA, 23 bp, Homo sapiens
tagaatgtcattcaatgatatgg

SEQ ID NO: 7838917 - DNA, 22 bp, Homo sapiens
tagaatgtggaggtaacagact

SEQ ID NO: 7838918 - DNA, 22 bp, Homo sapiens
tagaatgttaagaatatgtata

SEQ ID NO: 7838919 - DNA, 22 bp, Homo sapiens
tagaatgtggaggtaacagact

SEQ ID NO: 7838920 - DNA, 22 bp, Homo sapiens
tagaatgtggaggtaacagact

SEQ ID NO: 7838921 - DNA, 22 bp, Homo sapiens
tagaatgtagtgcttcaagatt

SEQ ID NO: 7838922 - DNA, 22 bp, Homo sapiens
tagaatgtagtgcttcaagatt

SEQ ID NO: 7838923 - DNA, 22 bp, Homo sapiens
tagaatgtagtgcttcaagatt

SEQ ID NO: 7838924 - DNA, 22 bp, Homo sapiens
tagaatgtagtgcttcaagatt

SEQ ID NO: 7838925 - DNA, 21 bp, Homo sapiens
tagaatgctattgtcttttct

SEQ ID NO: 7838926 - DNA, 19 bp, Homo sapiens
tagaatgcccacttaaaaa

SEQ ID NO: 7838927 - DNA, 19 bp, Homo sapiens
tagaatgcccacttaaaaa

SEQ ID NO: 7838928 - DNA, 22 bp, Homo sapiens
tagaaatggagaacagattaat

SEQ ID NO: 7838929 - DNA, 22 bp, Homo sapiens
tagaaatggagaacagattaat

SEQ ID NO: 7838930 - DNA, 20 bp, Homo sapiens
tagaatctgttctgattcat

SEQ ID NO: 7838931 - DNA, 20 bp, Homo sapiens
tagaatctgttctgattcat

SEQ ID NO: 7838932 - DNA, 22 bp, Homo sapiens
tagaatctttaaaattcatagt

SEQ ID NO: 7838933 - DNA, 22 bp, Homo sapiens
tagaatgagaaagtgtagcagg

SEQ ID NO: 7838934 - DNA, 22 bp, Homo sapiens
tagaatctttaaaattcatagt

SEQ ID NO: 7838935 - DNA, 22 bp, Homo sapiens
tagaatctttaaaattcatagt

SEQ ID NO: 7838936 - DNA, 22 bp, Homo sapiens
tagacaatatttgaaagtagtg

SEQ ID NO: 7838937 - DNA, 22 bp, Homo sapiens
tagacaatctcagcaaacacac

SEQ ID NO: 7838938 - DNA, 22 bp, Homo sapiens
tagacaatatttgaaagtagtg

SEQ ID NO: 7838939 - DNA, 22 bp, Homo sapiens
tagacaatatttgaaagtagtg

SEQ ID NO: 7838940 - DNA, 22 bp, Homo sapiens
tagacaatatttgaaagtagtg

SEQ ID NO: 7838941 - DNA, 22 bp, Homo sapiens
tagacacaaatctcagtgacac

SEQ ID NO: 7838942 - DNA, 22 bp, Homo sapiens
tagacacaaatctcagtgacac

SEQ ID NO: 7838943 - DNA, 22 bp, Homo sapiens
tagacacatcaaggatcagttt

SEQ ID NO: 7838944 - DNA, 22 bp, Homo sapiens
tagacacatacccttgcccaaa

SEQ ID NO: 7838945 - DNA, 22 bp, Homo sapiens
tagacacaggggaatgtgaggt

SEQ ID NO: 7838946 - DNA, 22 bp, Homo sapiens
tagacacaagagaagggtataa

SEQ ID NO: 7838947 - DNA, 22 bp, Homo sapiens
tagaatttcatgtatgttgggg

SEQ ID NO: 7838948 - DNA, 22 bp, Homo sapiens
tagaatttcatgtatgttgggg

SEQ ID NO: 7838949 - DNA, 22 bp, Homo sapiens
tagaattttctgctttgatagt

SEQ ID NO: 7838950 - DNA, 22 bp, Homo sapiens
tagaatttcatgtatgttgggg

SEQ ID NO: 7838951 - DNA, 22 bp, Homo sapiens
tagaattttctgctttgatagt

SEQ ID NO: 7838952 - DNA, 22 bp, Homo sapiens
tagaattttctgctttgatagt

SEQ ID NO: 7838953 - DNA, 22 bp, Homo sapiens
tagaattttctgctttgatagt

SEQ ID NO: 7838954 - DNA, 22 bp, Homo sapiens
tagacaaaagggggcagatatg

SEQ ID NO: 7838955 - DNA, 22 bp, Homo sapiens
tagaattttctgctttgatagt

SEQ ID NO: 7838956 - DNA, 22 bp, Homo sapiens
tagacaaactgatacttggcga

SEQ ID NO: 7838957 - DNA, 22 bp, Homo sapiens
tagacaactggagatagtctga

SEQ ID NO: 7838958 - DNA, 22 bp, Homo sapiens
tagacaatatttgaaagtagtg

SEQ ID NO: 7838959 - DNA, 22 bp, Homo sapiens
tagacaaactgatacttggcga

SEQ ID NO: 7838960 - DNA, 22 bp, Homo sapiens
tagacaaactgatacttggcga

SEQ ID NO: 7838961 - DNA, 22 bp, Homo sapiens
tagaaacaatgacatgcttgta

SEQ ID NO: 7838962 - DNA, 22 bp, Homo sapiens
tagaaacacagagagacccatg

SEQ ID NO: 7838963 - DNA, 22 bp, Homo sapiens
tagaaacacagagagacccatg

SEQ ID NO: 7838964 - DNA, 22 bp, Homo sapiens
tagaaacacagagagacccatg

SEQ ID NO: 7838965 - DNA, 22 bp, Homo sapiens
tagaaacacagagagacccatg

SEQ ID NO: 7838966 - DNA, 22 bp, Homo sapiens
tagaaacaatgacatgcttgta

SEQ ID NO: 7838967 - DNA, 22 bp, Homo sapiens
tagaaacaatgacatgcttgta

SEQ ID NO: 7838968 - DNA, 22 bp, Homo sapiens
tagaaacaatgacatgcttgta

SEQ ID NO: 7838969 - DNA, 22 bp, Homo sapiens
tagaaacaatgacatgcttgta

SEQ ID NO: 7838970 - DNA, 22 bp, Homo sapiens
tagaaacaagtttctctttggg

SEQ ID NO: 7838971 - DNA, 22 bp, Homo sapiens
tagaaacaatgacatgcttgta

SEQ ID NO: 7838972 - DNA, 22 bp, Homo sapiens
tagaaacaatgacatgcttgta

SEQ ID NO: 7838973 - DNA, 22 bp, Homo sapiens
tagaaacaatgacatgcttgta

SEQ ID NO: 7838974 - DNA, 22 bp, Homo sapiens
tagaaacaatgacatgcttgta

SEQ ID NO: 7838975 - DNA, 22 bp, Homo sapiens
tagaaacaagtttctctttggg

SEQ ID NO: 7838976 - DNA, 22 bp, Homo sapiens
tagaaacaatgacatgcttgta

SEQ ID NO: 7838977 - DNA, 22 bp, Homo sapiens
tagaaacaatgacatgcttgta

SEQ ID NO: 7838978 - DNA, 22 bp, Homo sapiens
tagaaaagccccagctggaggg

SEQ ID NO: 7838979 - DNA, 22 bp, Homo sapiens
tagaaacaagtttctctttggg

SEQ ID NO: 7838980 - DNA, 22 bp, Homo sapiens
tagaaacacagatctggtgtca

SEQ ID NO: 7838981 - DNA, 22 bp, Homo sapiens
tagaaacacagagagacccatg

SEQ ID NO: 7838982 - DNA, 22 bp, Homo sapiens
tagaaacacagatctggtgtca

SEQ ID NO: 7838983 - DNA, 22 bp, Homo sapiens
tagaaacacagatctggtgtca

SEQ ID NO: 7838984 - DNA, 22 bp, Homo sapiens
tagaaacagaaaactgtaatag

SEQ ID NO: 7838985 - DNA, 22 bp, Homo sapiens
tagaaacagaaaactgtaatag

SEQ ID NO: 7838986 - DNA, 22 bp, Homo sapiens
tagaaacagaaaactgtaatag

SEQ ID NO: 7838987 - DNA, 22 bp, Homo sapiens
tagaaacagaaaactgtaatag

SEQ ID NO: 7838988 - DNA, 22 bp, Homo sapiens
tagaaacagaaaactgtaatag

SEQ ID NO: 7838989 - DNA, 22 bp, Homo sapiens
tagaaacagaaaactgtaatag

SEQ ID NO: 7838990 - DNA, 22 bp, Homo sapiens
tagaaacagaatatgagtgaga

SEQ ID NO: 7838991 - DNA, 22 bp, Homo sapiens
tagaaacagaatatgagtgaga

SEQ ID NO: 7838992 - DNA, 22 bp, Homo sapiens
tagaaacagaatatgagtgaga

SEQ ID NO: 7838993 - DNA, 22 bp, Homo sapiens
tagaaacagaatatgagtgaga

SEQ ID NO: 7838994 - DNA, 22 bp, Homo sapiens
tagaaacagaatatgagtgaga

SEQ ID NO: 7838995 - DNA, 22 bp, Homo sapiens
tagaaacagaatatgagtgaga

SEQ ID NO: 7838996 - DNA, 22 bp, Homo sapiens
tagaaacagaaaactgtaatag

SEQ ID NO: 7838997 - DNA, 22 bp, Homo sapiens
tagaaacagaatatgagtgaga

SEQ ID NO: 7838998 - DNA, 22 bp, Homo sapiens
tagaaacagaatatgagtgaga

SEQ ID NO: 7838999 - DNA, 22 bp, Homo sapiens
tagaaacagcatatattagccc

SEQ ID NO: 7839000 - DNA, 22 bp, Homo sapiens
tagaaacagcatatattagccc

SEQ ID NO: 7839001 - DNA, 22 bp, Homo sapiens
tagaaacagcatatattagccc

SEQ ID NO: 7839002 - DNA, 22 bp, Homo sapiens
tagaaacagcatatattagccc

SEQ ID NO: 7839003 - DNA, 22 bp, Homo sapiens
tagaaacagcatatattagccc

SEQ ID NO: 7839004 - DNA, 22 bp, Homo sapiens
tagaaacagcatatattagccc

SEQ ID NO: 7839005 - DNA, 22 bp, Homo sapiens
tagaaacagcatatattagccc

SEQ ID NO: 7839006 - DNA, 22 bp, Homo sapiens
tagaaacagcatatattagccc

SEQ ID NO: 7839007 - DNA, 22 bp, Homo sapiens
tagaaacagcatatattagccc

SEQ ID NO: 7839008 - DNA, 22 bp, Homo sapiens
tagaaacagcatatattagccc

SEQ ID NO: 7839009 - DNA, 22 bp, Homo sapiens
tagaaacatataggatggcagg

SEQ ID NO: 7839010 - DNA, 22 bp, Homo sapiens
tagaaacatataggatggcagg

SEQ ID NO: 7839011 - DNA, 22 bp, Homo sapiens
tagaaacatatgtttgagacat

SEQ ID NO: 7839012 - DNA, 22 bp, Homo sapiens
tagaaacatatgtttgagacat

SEQ ID NO: 7839013 - DNA, 22 bp, Homo sapiens
tagaaacatatgtttgagacat

SEQ ID NO: 7839014 - DNA, 22 bp, Homo sapiens
tagaaacatataggatggcagg

SEQ ID NO: 7839015 - DNA, 22 bp, Homo sapiens
tagaaacatataggatggcagg

SEQ ID NO: 7839016 - DNA, 22 bp, Homo sapiens
tagaaacatataggatggcagg

SEQ ID NO: 7839017 - DNA, 22 bp, Homo sapiens
tagaaacatataggatggcagg

SEQ ID NO: 7839018 - DNA, 22 bp, Homo sapiens
tagaaacagaatatgagtgaga

SEQ ID NO: 7839019 - DNA, 22 bp, Homo sapiens
tagaaacagagagatatgcccc

SEQ ID NO: 7839020 - DNA, 22 bp, Homo sapiens
tagaaacagagagatatgcccc

SEQ ID NO: 7839021 - DNA, 22 bp, Homo sapiens
tagaaacagagagatatgcccc

SEQ ID NO: 7839022 - DNA, 22 bp, Homo sapiens
tagaaacagagagatatgcccc

SEQ ID NO: 7839023 - DNA, 22 bp, Homo sapiens
tagaaacagagagatatgcccc

SEQ ID NO: 7839024 - DNA, 22 bp, Homo sapiens
tagaaacagagcaggtggccca

SEQ ID NO: 7839025 - DNA, 22 bp, Homo sapiens
tagaaacagagcaggtggccca

SEQ ID NO: 7839026 - DNA, 22 bp, Homo sapiens
tagaaacagagagatatgcccc

SEQ ID NO: 7839027 - DNA, 22 bp, Homo sapiens
tagaaacagatgtttttgaaga

SEQ ID NO: 7839028 - DNA, 22 bp, Homo sapiens
tagaaacagatgtttttgaaga

SEQ ID NO: 7839029 - DNA, 22 bp, Homo sapiens
tagaaacagatgtttttgaaga

SEQ ID NO: 7839030 - DNA, 22 bp, Homo sapiens
tagaaacagagcaggtggccca

SEQ ID NO: 7839031 - DNA, 22 bp, Homo sapiens
tagaaacagatgtttttgaaga

SEQ ID NO: 7839032 - DNA, 22 bp, Homo sapiens
tagaaacagagcaggtggccca

SEQ ID NO: 7839033 - DNA, 22 bp, Homo sapiens
tagaaacagatgtttttgaaga

SEQ ID NO: 7839034 - DNA, 22 bp, Homo sapiens
tagaaacagatgtttttgaaga

SEQ ID NO: 7839035 - DNA, 22 bp, Homo sapiens
tagaaacattcagttgcagtcc

SEQ ID NO: 7839036 - DNA, 22 bp, Homo sapiens
tagaaaccatctcactgctcag

SEQ ID NO: 7839037 - DNA, 22 bp, Homo sapiens
tagaaacattcagttgcagtcc

SEQ ID NO: 7839038 - DNA, 22 bp, Homo sapiens
tagaaacccaggatttgtattt

SEQ ID NO: 7839039 - DNA, 22 bp, Homo sapiens
tagaaacccaggatttgtattt

SEQ ID NO: 7839040 - DNA, 22 bp, Homo sapiens
tagaaaccatctcactgctcag

SEQ ID NO: 7839041 - DNA, 22 bp, Homo sapiens
tagaaaccatctcactgctcag

SEQ ID NO: 7839042 - DNA, 22 bp, Homo sapiens
tagaaacattcagttgcagtcc

SEQ ID NO: 7839043 - DNA, 22 bp, Homo sapiens
tagaaacattcagttgcagtcc

SEQ ID NO: 7839044 - DNA, 22 bp, Homo sapiens
tagaaacccatgtttattcagt

SEQ ID NO: 7839045 - DNA, 22 bp, Homo sapiens
tagaaaccctgccttagtagct

SEQ ID NO: 7839046 - DNA, 22 bp, Homo sapiens
tagaaacattcagttgcagtcc

SEQ ID NO: 7839047 - DNA, 22 bp, Homo sapiens
tagaaacctcagggaaatcttt

SEQ ID NO: 7839048 - DNA, 22 bp, Homo sapiens
tagaaacctcagggaaatcttt

SEQ ID NO: 7839049 - DNA, 22 bp, Homo sapiens
tagaaactactagaataagaga

SEQ ID NO: 7839050 - DNA, 22 bp, Homo sapiens
tagaaactactagaataagaga

SEQ ID NO: 7839051 - DNA, 22 bp, Homo sapiens
tagaaactagattgatagcgga

SEQ ID NO: 7839052 - DNA, 22 bp, Homo sapiens
tagaaactactagaataagaga

SEQ ID NO: 7839053 - DNA, 22 bp, Homo sapiens
tagaaactgatagtcttgtgct

SEQ ID NO: 7839054 - DNA, 22 bp, Homo sapiens
tagaaactctcacgagtgaaac

SEQ ID NO: 7839055 - DNA, 22 bp, Homo sapiens
tagaaactgatagtcttgtgct

SEQ ID NO: 7839056 - DNA, 22 bp, Homo sapiens
tagaaagaaattcagattggct

SEQ ID NO: 7839057 - DNA, 22 bp, Homo sapiens
tagaaagaaattcagattggct

SEQ ID NO: 7839058 - DNA, 22 bp, Homo sapiens
tagaaagaaattcagattggct

SEQ ID NO: 7839059 - DNA, 22 bp, Homo sapiens
tagaaactctcaatctgggatg

SEQ ID NO: 7839060 - DNA, 22 bp, Homo sapiens
tagaaactcaggatactcttcc

SEQ ID NO: 7839061 - DNA, 22 bp, Homo sapiens
tagaaactcacgttatcattgc

SEQ ID NO: 7839062 - DNA, 22 bp, Homo sapiens
tagaaactagattgatagcgga

SEQ ID NO: 7839063 - DNA, 22 bp, Homo sapiens
tagaaactcacgttatcattgc

SEQ ID NO: 7839064 - DNA, 22 bp, Homo sapiens
tagaaactcacgttatcattgc

SEQ ID NO: 7839065 - DNA, 22 bp, Homo sapiens
tagaaacatatgtttgagacat

SEQ ID NO: 7839066 - DNA, 22 bp, Homo sapiens
tagaaacatatgtttgagacat

SEQ ID NO: 7839067 - DNA, 22 bp, Homo sapiens
tagaaacatatgtttgagacat

SEQ ID NO: 7839068 - DNA, 22 bp, Homo sapiens
tagaaacatatgtttgagacat

SEQ ID NO: 7839069 - DNA, 22 bp, Homo sapiens
tagaaacatcagctaaccaaaa

SEQ ID NO: 7839070 - DNA, 22 bp, Homo sapiens
tagaaacatcagctaaccaaaa

SEQ ID NO: 7839071 - DNA, 22 bp, Homo sapiens
tagaaacatcagctaaccaaaa

SEQ ID NO: 7839072 - DNA, 22 bp, Homo sapiens
tagaaacatcagctaaccaaaa

SEQ ID NO: 7839073 - DNA, 22 bp, Homo sapiens
tagaaacatcagctaaccaaaa

SEQ ID NO: 7839074 - DNA, 22 bp, Homo sapiens
tagaaacatcagctaaccaaaa

SEQ ID NO: 7839075 - DNA, 22 bp, Homo sapiens
tagaaacatcagctaaccaaaa

SEQ ID NO: 7839076 - DNA, 22 bp, Homo sapiens
tagaaacatgagagaaactctt

SEQ ID NO: 7839077 - DNA, 22 bp, Homo sapiens
tagaaacatgagagaaactctt

SEQ ID NO: 7839078 - DNA, 22 bp, Homo sapiens
tagaaacatcagctaaccaaaa

SEQ ID NO: 7839079 - DNA, 22 bp, Homo sapiens
tagaaacatgttctgttctgtt

SEQ ID NO: 7839080 - DNA, 22 bp, Homo sapiens
tagaaacatgttctgttctgtt

SEQ ID NO: 7839081 - DNA, 22 bp, Homo sapiens
tagaaacatgttctgttctgtt

SEQ ID NO: 7839082 - DNA, 22 bp, Homo sapiens
tagaaacatgttctgttctgtt

SEQ ID NO: 7839083 - DNA, 22 bp, Homo sapiens
tagaaacatgagagaaactctt

SEQ ID NO: 7839084 - DNA, 22 bp, Homo sapiens
tagaaacatgagagaaactctt

SEQ ID NO: 7839085 - DNA, 22 bp, Homo sapiens
tagaaacatgagagaaactctt

SEQ ID NO: 7839086 - DNA, 22 bp, Homo sapiens
tagaaacatgagagaaactctt

SEQ ID NO: 7839087 - DNA, 22 bp, Homo sapiens
tagaaacatgagagaaactctt

SEQ ID NO: 7839088 - DNA, 22 bp, Homo sapiens
tagaaacattcagttgcagtcc

SEQ ID NO: 7839089 - DNA, 22 bp, Homo sapiens
tagaaacattcagttgcagtcc

SEQ ID NO: 7839090 - DNA, 22 bp, Homo sapiens
tagaaacatgttctgttctgtt

SEQ ID NO: 7839091 - DNA, 22 bp, Homo sapiens
tagaaacattcagttgcagtcc

SEQ ID NO: 7839092 - DNA, 22 bp, Homo sapiens
tagaaacatgttctgttctgtt

SEQ ID NO: 7839093 - DNA, 22 bp, Homo sapiens
tacttttagcctatttgattct

SEQ ID NO: 7839094 - DNA, 22 bp, Homo sapiens
tacttttagcctatttgattct

SEQ ID NO: 7839095 - DNA, 22 bp, Homo sapiens
tacttttaaaattcacaggtat

SEQ ID NO: 7839096 - DNA, 22 bp, Homo sapiens
tacttttaaaattcacaggtat

SEQ ID NO: 7839097 - DNA, 22 bp, Homo sapiens
tactttgtggagattaaaaata

SEQ ID NO: 7839098 - DNA, 22 bp, Homo sapiens
tactttggttgaatatgtaatg

SEQ ID NO: 7839099 - DNA, 22 bp, Homo sapiens
tactttgtcatgctaagagtga

SEQ ID NO: 7839100 - DNA, 22 bp, Homo sapiens
tactttgtcatgctaagagtga

SEQ ID NO: 7839101 - DNA, 22 bp, Homo sapiens
tactttggttgaatatgtaatg

SEQ ID NO: 7839102 - DNA, 22 bp, Homo sapiens
tactttgtcattctaaccttcc

SEQ ID NO: 7839103 - DNA, 22 bp, Homo sapiens
tactttgtgccaggcactgggt

SEQ ID NO: 7839104 - DNA, 22 bp, Homo sapiens
tactttgtggagattaaaaata

SEQ ID NO: 7839105 - DNA, 22 bp, Homo sapiens
tactttgtggagattaaaaata

SEQ ID NO: 7839106 - DNA, 22 bp, Homo sapiens
tactttgtggagattaaaaata

SEQ ID NO: 7839107 - DNA, 22 bp, Homo sapiens
tactttggggacaatatggaat

SEQ ID NO: 7839108 - DNA, 22 bp, Homo sapiens
tactttggggacaatatggaat

SEQ ID NO: 7839109 - DNA, 22 bp, Homo sapiens
tactttggggacaatatggaat

SEQ ID NO: 7839110 - DNA, 22 bp, Homo sapiens
tactttggaagagttcatacag

SEQ ID NO: 7839111 - DNA, 22 bp, Homo sapiens
tactttgggtttagaataaact

SEQ ID NO: 7839112 - DNA, 22 bp, Homo sapiens
tactttgggtttagaataaact

SEQ ID NO: 7839113 - DNA, 22 bp, Homo sapiens
tactttgggtttagaataaact

SEQ ID NO: 7839114 - DNA, 22 bp, Homo sapiens
tactttggtatcaaactaaaac

SEQ ID NO: 7839115 - DNA, 22 bp, Homo sapiens
tactttggtatcaaactaaaac

SEQ ID NO: 7839116 - DNA, 22 bp, Homo sapiens
tactttggtatcaaactaaaac

SEQ ID NO: 7839117 - DNA, 22 bp, Homo sapiens
tactttggggacaatatggaat

SEQ ID NO: 7839118 - DNA, 22 bp, Homo sapiens
tactttggaagagttcatacag

SEQ ID NO: 7839119 - DNA, 22 bp, Homo sapiens
tactttgcggcgcggaggagca

SEQ ID NO: 7839120 - DNA, 22 bp, Homo sapiens
tactttgcagcttgataaaatg

SEQ ID NO: 7839121 - DNA, 22 bp, Homo sapiens
tactttgctaaaatgtgcagaa

SEQ ID NO: 7839122 - DNA, 22 bp, Homo sapiens
tactttggatccttacaatagc

SEQ ID NO: 7839123 - DNA, 22 bp, Homo sapiens
tactttggatccttacaatagc

SEQ ID NO: 7839124 - DNA, 22 bp, Homo sapiens
tactttgcagcttgataaaatg

SEQ ID NO: 7839125 - DNA, 22 bp, Homo sapiens
tactttgcatgcttgtgtgatc

SEQ ID NO: 7839126 - DNA, 21 bp, Homo sapiens
tactttgcaatgtatctcctt

SEQ ID NO: 7839127 - DNA, 19 bp, Homo sapiens
tacatttgtgtacacttgt

SEQ ID NO: 7839128 - DNA, 22 bp, Homo sapiens
tacatttgggacaataagagaa

SEQ ID NO: 7839129 - DNA, 22 bp, Homo sapiens
tacattttctaggggaccaaga

SEQ ID NO: 7839130 - DNA, 22 bp, Homo sapiens
tacattttctaggggaccaaga

SEQ ID NO: 7839131 - DNA, 22 bp, Homo sapiens
tacattttctaggggaccaaga

SEQ ID NO: 7839132 - DNA, 22 bp, Homo sapiens
tacatttgttatagaaatgaag

SEQ ID NO: 7839133 - DNA, 22 bp, Homo sapiens
taccaaaaagtgagccccagag

SEQ ID NO: 7839134 - DNA, 22 bp, Homo sapiens
tacattttctaggggaccaaga

SEQ ID NO: 7839135 - DNA, 22 bp, Homo sapiens
tacattttctaggggaccaaga

SEQ ID NO: 7839136 - DNA, 22 bp, Homo sapiens
taccaaaaccaagccattatct

SEQ ID NO: 7839137 - DNA, 22 bp, Homo sapiens
taccaaaaccaagccattatct

SEQ ID NO: 7839138 - DNA, 22 bp, Homo sapiens
taccaaaaccaagccattatct

SEQ ID NO: 7839139 - DNA, 22 bp, Homo sapiens
taccaaagattaaatagcaaca

SEQ ID NO: 7839140 - DNA, 22 bp, Homo sapiens
taccaaagatacataaatgtga

SEQ ID NO: 7839141 - DNA, 22 bp, Homo sapiens
tactttgaattaaatatttcag

SEQ ID NO: 7839142 - DNA, 22 bp, Homo sapiens
taccaaagaatattttaaatag

SEQ ID NO: 7839143 - DNA, 22 bp, Homo sapiens
taccaaagatacataaatgtga

SEQ ID NO: 7839144 - DNA, 22 bp, Homo sapiens
taccaaagaatattttaaatag

SEQ ID NO: 7839145 - DNA, 22 bp, Homo sapiens
tactttgataaggttcttctat

SEQ ID NO: 7839146 - DNA, 22 bp, Homo sapiens
tactttgacgccggtgggaata

SEQ ID NO: 7839147 - DNA, 22 bp, Homo sapiens
tactttgagatgatgctgatcg

SEQ ID NO: 7839148 - DNA, 22 bp, Homo sapiens
tactttgaccaccatctgatta

SEQ ID NO: 7839149 - DNA, 22 bp, Homo sapiens
taccaaaagcttgtttcataca

SEQ ID NO: 7839150 - DNA, 22 bp, Homo sapiens
taccaaaagcttgtttcataca

SEQ ID NO: 7839151 - DNA, 22 bp, Homo sapiens
taccaaaagcttgtttcataca

SEQ ID NO: 7839152 - DNA, 22 bp, Homo sapiens
taccaaaaccaagccattatct

SEQ ID NO: 7839153 - DNA, 22 bp, Homo sapiens
taccaaaagcttgtttcataca

SEQ ID NO: 7839154 - DNA, 22 bp, Homo sapiens
taccaaagaatattttaaatag

SEQ ID NO: 7839155 - DNA, 22 bp, Homo sapiens
tactttttatgataagaactga

SEQ ID NO: 7839156 - DNA, 22 bp, Homo sapiens
tactttttatgataagaactga

SEQ ID NO: 7839157 - DNA, 22 bp, Homo sapiens
tactttttatgataagaactga

SEQ ID NO: 7839158 - DNA, 22 bp, Homo sapiens
tactttttatgataagaactga

SEQ ID NO: 7839159 - DNA, 22 bp, Homo sapiens
tactttttatgataagaactga

SEQ ID NO: 7839160 - DNA, 22 bp, Homo sapiens
tactttttatgataagaactga

SEQ ID NO: 7839161 - DNA, 22 bp, Homo sapiens
tactttttatgataagaactga

SEQ ID NO: 7839162 - DNA, 22 bp, Homo sapiens
tactttttatgataagaactga

SEQ ID NO: 7839163 - DNA, 22 bp, Homo sapiens
tactttttatgataagaactga

SEQ ID NO: 7839164 - DNA, 22 bp, Homo sapiens
tactttttatgataagaactga

SEQ ID NO: 7839165 - DNA, 22 bp, Homo sapiens
tacttttctttgtcatgcatct

SEQ ID NO: 7839166 - DNA, 22 bp, Homo sapiens
tacttttctgtgtggcagtcac

SEQ ID NO: 7839167 - DNA, 22 bp, Homo sapiens
tacttttctgtgtggcagtcac

SEQ ID NO: 7839168 - DNA, 22 bp, Homo sapiens
tacttttctttgtcatgcatct

SEQ ID NO: 7839169 - DNA, 22 bp, Homo sapiens
tacttttctttgtcatgcatct

SEQ ID NO: 7839170 - DNA, 22 bp, Homo sapiens
tactttttagcacagtgtgtgc

SEQ ID NO: 7839171 - DNA, 22 bp, Homo sapiens
tactttttagcacagtgtgtgc

SEQ ID NO: 7839172 - DNA, 22 bp, Homo sapiens
tactttttagcacagtgtgtgc

SEQ ID NO: 7839173 - DNA, 22 bp, Homo sapiens
tactttttagcacagtgtgtgc

SEQ ID NO: 7839174 - DNA, 22 bp, Homo sapiens
tactttttagcacagtgtgtgc

SEQ ID NO: 7839175 - DNA, 22 bp, Homo sapiens
tactttttagcacagtgtgtgc

SEQ ID NO: 7839176 - DNA, 22 bp, Homo sapiens
tacttttcataatgaagcagca

SEQ ID NO: 7839177 - DNA, 22 bp, Homo sapiens
tacttttcacccagcccgcttc

SEQ ID NO: 7839178 - DNA, 22 bp, Homo sapiens
tacttttcaagcagctggttat

SEQ ID NO: 7839179 - DNA, 22 bp, Homo sapiens
tacttttcctggaaccactgct

SEQ ID NO: 7839180 - DNA, 22 bp, Homo sapiens
tacttttccagggctggctgag

SEQ ID NO: 7839181 - DNA, 22 bp, Homo sapiens
tacttttccagggctggctgag

SEQ ID NO: 7839182 - DNA, 22 bp, Homo sapiens
tacttttctataggtttgaaat

SEQ ID NO: 7839183 - DNA, 22 bp, Homo sapiens
tacttttcctggaaccactgct

SEQ ID NO: 7839184 - DNA, 22 bp, Homo sapiens
tacttttctataggtttgaaat

SEQ ID NO: 7839185 - DNA, 22 bp, Homo sapiens
tacttttatgtgatgaaatctg

SEQ ID NO: 7839186 - DNA, 22 bp, Homo sapiens
tacttttattattgcccctcca

SEQ ID NO: 7839187 - DNA, 22 bp, Homo sapiens
tacttttatgtgatgaaatctg

SEQ ID NO: 7839188 - DNA, 22 bp, Homo sapiens
tacttttatgtgatgaaatctg

SEQ ID NO: 7839189 - DNA, 22 bp, Homo sapiens
tacttttagcctatttgattct

SEQ ID NO: 7839190 - DNA, 22 bp, Homo sapiens
tacttttagcctatttgattct

SEQ ID NO: 7839191 - DNA, 22 bp, Homo sapiens
tacttttagcctatttgattct

SEQ ID NO: 7839192 - DNA, 22 bp, Homo sapiens
tacttttatgtgatgaaatctg

SEQ ID NO: 7839193 - DNA, 22 bp, Homo sapiens
tagaaaactaatacatgcttga

SEQ ID NO: 7839194 - DNA, 22 bp, Homo sapiens
tagaaaactaatacatgcttga

SEQ ID NO: 7839195 - DNA, 22 bp, Homo sapiens
tagaaaactaatacatgcttga

SEQ ID NO: 7839196 - DNA, 22 bp, Homo sapiens
tagaaaactaatacatgcttga

SEQ ID NO: 7839197 - DNA, 22 bp, Homo sapiens
tactttttgtctctttgaatgt

SEQ ID NO: 7839198 - DNA, 22 bp, Homo sapiens
tactttttgtctctttgaatgt

SEQ ID NO: 7839199 - DNA, 22 bp, Homo sapiens
tactttttgtctctttgaatgt

SEQ ID NO: 7839200 - DNA, 22 bp, Homo sapiens
tactttttgtctctttgaatgt

SEQ ID NO: 7839201 - DNA, 22 bp, Homo sapiens
tactttttgtctctttgaatgt

SEQ ID NO: 7839202 - DNA, 22 bp, Homo sapiens
tagaaaagataacattctgtgc

SEQ ID NO: 7839203 - DNA, 22 bp, Homo sapiens
tagaaaagataacattctgtgc

SEQ ID NO: 7839204 - DNA, 22 bp, Homo sapiens
tagaaaagataacattctgtgc

SEQ ID NO: 7839205 - DNA, 22 bp, Homo sapiens
tagaaaagataacattctgtgc

SEQ ID NO: 7839206 - DNA, 22 bp, Homo sapiens
tagaaaagataacattctgtgc

SEQ ID NO: 7839207 - DNA, 22 bp, Homo sapiens
tagaaaagccccagctggaggg

SEQ ID NO: 7839208 - DNA, 22 bp, Homo sapiens
tagaaaagaattttatttgata

SEQ ID NO: 7839209 - DNA, 22 bp, Homo sapiens
tagaaaagaattttatttgata

SEQ ID NO: 7839210 - DNA, 22 bp, Homo sapiens
tagaaaagaattttatttgata

SEQ ID NO: 7839211 - DNA, 22 bp, Homo sapiens
tagaaaagaagtctggccggga

SEQ ID NO: 7839212 - DNA, 22 bp, Homo sapiens
tagcagagcagggatcagagcc

SEQ ID NO: 7839213 - DNA, 22 bp, Homo sapiens
tagcagagcagggatcagagcc

SEQ ID NO: 7839214 - DNA, 22 bp, Homo sapiens
tagcagagcgggtgcgaggcgg

SEQ ID NO: 7839215 - DNA, 22 bp, Homo sapiens
tagcagagctgcaatatagacc

SEQ ID NO: 7839216 - DNA, 22 bp, Homo sapiens
tagcagagcacatcttcattct

SEQ ID NO: 7839217 - DNA, 19 bp, Homo sapiens
tagcagagatgactccagc

SEQ ID NO: 7839218 - DNA, 19 bp, Homo sapiens
tagcagagatgactccagc

SEQ ID NO: 7839219 - DNA, 21 bp, Homo sapiens
tagcagagatcattttctcct

SEQ ID NO: 7839220 - DNA, 22 bp, Homo sapiens
tagcagagatatgggcatagat

SEQ ID NO: 7839221 - DNA, 19 bp, Homo sapiens
tagcagagatgactccagc

SEQ ID NO: 7839222 - DNA, 22 bp, Homo sapiens
tagcagaggaaaagagaacatt

SEQ ID NO: 7839223 - DNA, 22 bp, Homo sapiens
tagcagaggaaaagagaacatt

SEQ ID NO: 7839224 - DNA, 22 bp, Homo sapiens
tagcagaggaaatccagagtaa

SEQ ID NO: 7839225 - DNA, 22 bp, Homo sapiens
tagcagagctgcaatatagacc

SEQ ID NO: 7839226 - DNA, 22 bp, Homo sapiens
tagcagagctgggactagatta

SEQ ID NO: 7839227 - DNA, 22 bp, Homo sapiens
tagcagaggaaaagagaacatt

SEQ ID NO: 7839228 - DNA, 22 bp, Homo sapiens
tagcagaggctgtctgacttaa

SEQ ID NO: 7839229 - DNA, 22 bp, Homo sapiens
tagcagaggctgtctgacttaa

SEQ ID NO: 7839230 - DNA, 22 bp, Homo sapiens
tagcagaggcaaggatgtgaat

SEQ ID NO: 7839231 - DNA, 22 bp, Homo sapiens
tagcagaggcaaggatgtgaat

SEQ ID NO: 7839232 - DNA, 22 bp, Homo sapiens
tagcagaggctactgctccttg

SEQ ID NO: 7839233 - DNA, 23 bp, Homo sapiens
tagcagcatttttagcctctgtc

SEQ ID NO: 7839234 - DNA, 23 bp, Homo sapiens
tagcagcatttttagcctctgtc

SEQ ID NO: 7839235 - DNA, 22 bp, Homo sapiens
tagcagcatgtaagtgagtaga

SEQ ID NO: 7839236 - DNA, 23 bp, Homo sapiens
tagcagcatttttagcctctgtc

SEQ ID NO: 7839237 - DNA, 22 bp, Homo sapiens
tagcagcatcctgtggtgatgg

SEQ ID NO: 7839238 - DNA, 22 bp, Homo sapiens
tagcagcatgtaagtgagtaga

SEQ ID NO: 7839239 - DNA, 22 bp, Homo sapiens
tagcagcatgtaagtgagtaga

SEQ ID NO: 7839240 - DNA, 22 bp, Homo sapiens
tagcagcatgtaagtgagtaga

SEQ ID NO: 7839241 - DNA, 22 bp, Homo sapiens
tagcagcatgtaagtgagtaga

SEQ ID NO: 7839242 - DNA, 22 bp, Homo sapiens
tagcagctacctggctaagagt

SEQ ID NO: 7839243 - DNA, 22 bp, Homo sapiens
tagcagcccagtttctggccaa

SEQ ID NO: 7839244 - DNA, 22 bp, Homo sapiens
tagcagcatttttgtagagtat

SEQ ID NO: 7839245 - DNA, 22 bp, Homo sapiens
tagcagcatttttgtagagtat

SEQ ID NO: 7839246 - DNA, 22 bp, Homo sapiens
tagcagcatttttgtagagtat

SEQ ID NO: 7839247 - DNA, 23 bp, Homo sapiens
tagcagcatttttagcctctgtc

SEQ ID NO: 7839248 - DNA, 22 bp, Homo sapiens
tagcagcatttttgtagagtat

SEQ ID NO: 7839249 - DNA, 22 bp, Homo sapiens
tagcagaggtaagtgtggcaat

SEQ ID NO: 7839250 - DNA, 22 bp, Homo sapiens
tagcagagggtagtgccggggc

SEQ ID NO: 7839251 - DNA, 22 bp, Homo sapiens
tagcagagtaatactttggagc

SEQ ID NO: 7839252 - DNA, 22 bp, Homo sapiens
tagcagagtaatactttggagc

SEQ ID NO: 7839253 - DNA, 22 bp, Homo sapiens
tagcagagtagtgcctccagat

SEQ ID NO: 7839254 - DNA, 22 bp, Homo sapiens
tagcagagtaatactttggagc

SEQ ID NO: 7839255 - DNA, 22 bp, Homo sapiens
tagcagcagtggtgtatttaga

SEQ ID NO: 7839256 - DNA, 17 bp, Homo sapiens
tagcagcagtaattgtg

SEQ ID NO: 7839257 - DNA, 17 bp, Homo sapiens
tagcagcagtaattgtg

SEQ ID NO: 7839258 - DNA, 17 bp, Homo sapiens
tagcagcagtaattgtg

SEQ ID NO: 7839259 - DNA, 22 bp, Homo sapiens
tagcagagtgattggccatgag

SEQ ID NO: 7839260 - DNA, 22 bp, Homo sapiens
tagcagagtatcttgcaaatta

SEQ ID NO: 7839261 - DNA, 20 bp, Homo sapiens
tagaggggacaatcattgcc

SEQ ID NO: 7839262 - DNA, 18 bp, Homo sapiens
tagagggggcctgggcat

SEQ ID NO: 7839263 - DNA, 22 bp, Homo sapiens
tagaggtactcccctcaaagtt

SEQ ID NO: 7839264 - DNA, 22 bp, Homo sapiens
tagagggttattaggacagaag

SEQ ID NO: 7839265 - DNA, 22 bp, Homo sapiens
tagagggttattaggacagaag

SEQ ID NO: 7839266 - DNA, 22 bp, Homo sapiens
tagaggtagagttacattagtc

SEQ ID NO: 7839267 - DNA, 22 bp, Homo sapiens
tagaggtagatggtcagccaat

SEQ ID NO: 7839268 - DNA, 22 bp, Homo sapiens
tagaggtagcaacaggactaga

SEQ ID NO: 7839269 - DNA, 22 bp, Homo sapiens
tagaggtataccaaaaaggcat

SEQ ID NO: 7839270 - DNA, 22 bp, Homo sapiens
tagaggtatttttgatggtcat

SEQ ID NO: 7839271 - DNA, 22 bp, Homo sapiens
tagaggtgacactgagaccata

SEQ ID NO: 7839272 - DNA, 22 bp, Homo sapiens
tagaggtgagacttcagtgaca

SEQ ID NO: 7839273 - DNA, 22 bp, Homo sapiens
tagaggtgagccatcaaggggc

SEQ ID NO: 7839274 - DNA, 22 bp, Homo sapiens
tagaggtgagatattttatttt

SEQ ID NO: 7839275 - DNA, 22 bp, Homo sapiens
tagcagaagaacaacatgatct

SEQ ID NO: 7839276 - DNA, 22 bp, Homo sapiens
tagcagaagttccaatgcatat

SEQ ID NO: 7839277 - DNA, 22 bp, Homo sapiens
tagcagaagtcaccccgccact

SEQ ID NO: 7839278 - DNA, 22 bp, Homo sapiens
tagcagaagttccaatgcatat

SEQ ID NO: 7839279 - DNA, 22 bp, Homo sapiens
tagcagaagttgcaaactaggg

SEQ ID NO: 7839280 - DNA, 22 bp, Homo sapiens
tagcagaagttgcaaactaggg

SEQ ID NO: 7839281 - DNA, 22 bp, Homo sapiens
tagcagactttgtgtctggttt

SEQ ID NO: 7839282 - DNA, 22 bp, Homo sapiens
tagcagaagttgcaaactaggg

SEQ ID NO: 7839283 - DNA, 21 bp, Homo sapiens
tagcagagagttaacttctcc

SEQ ID NO: 7839284 - DNA, 22 bp, Homo sapiens
tagcagagaggtttcagctaat

SEQ ID NO: 7839285 - DNA, 22 bp, Homo sapiens
tagcagagaggggacagtggca

SEQ ID NO: 7839286 - DNA, 22 bp, Homo sapiens
tagaggtgttgttgatatagaa

SEQ ID NO: 7839287 - DNA, 22 bp, Homo sapiens
tagaggtgttgacgccaaggta

SEQ ID NO: 7839288 - DNA, 22 bp, Homo sapiens
tagaggtgttcattctctccat

SEQ ID NO: 7839289 - DNA, 22 bp, Homo sapiens
tagagtaaatagtatgagaaag

SEQ ID NO: 7839290 - DNA, 22 bp, Homo sapiens
tagagtaaatagtatgagaaag

SEQ ID NO: 7839291 - DNA, 22 bp, Homo sapiens
tagcagaaccagtcagtgagcc

SEQ ID NO: 7839292 - DNA, 22 bp, Homo sapiens
tagagtaacacaaacgaattgg

SEQ ID NO: 7839293 - DNA, 22 bp, Homo sapiens
tagcagaaccagtcagtgagcc

SEQ ID NO: 7839294 - DNA, 22 bp, Homo sapiens
tagagtaaatagtatgagaaag

SEQ ID NO: 7839295 - DNA, 22 bp, Homo sapiens
tagcagaagaaattcagagttg

SEQ ID NO: 7839296 - DNA, 22 bp, Homo sapiens
tagctttaatgagttggtaaga

SEQ ID NO: 7839297 - DNA, 22 bp, Homo sapiens
tagctttaatgagttggtaaga

SEQ ID NO: 7839298 - DNA, 22 bp, Homo sapiens
tagcttaaaccaatctgaataa

SEQ ID NO: 7839299 - DNA, 22 bp, Homo sapiens
tagctgtttgaagtatttttct

SEQ ID NO: 7839300 - DNA, 22 bp, Homo sapiens
tagctgttgcaataaacagttc

SEQ ID NO: 7839301 - DNA, 22 bp, Homo sapiens
tagctgttcccagctctgtgta

SEQ ID NO: 7839302 - DNA, 22 bp, Homo sapiens
tagctgaatgtgaccttaaaga

SEQ ID NO: 7839303 - DNA, 22 bp, Homo sapiens
tagctcttgccagatcctcgat

SEQ ID NO: 7839304 - DNA, 22 bp, Homo sapiens
tagctctgtggatctttttaag

SEQ ID NO: 7839305 - DNA, 22 bp, Homo sapiens
tagctcttcatttcatctgatt

SEQ ID NO: 7839306 - DNA, 22 bp, Homo sapiens
tagccttttgggaagggctatt

SEQ ID NO: 7839307 - DNA, 22 bp, Homo sapiens
tagctcctggtgagcctactct

SEQ ID NO: 7839308 - DNA, 22 bp, Homo sapiens
tagctctgacatttgcaattac

SEQ ID NO: 7839309 - DNA, 22 bp, Homo sapiens
tagctctgacatttgcaattac

SEQ ID NO: 7839310 - DNA, 22 bp, Homo sapiens
tagctctctctatatgagtgac

SEQ ID NO: 7839311 - DNA, 22 bp, Homo sapiens
tagctctctctatatgagtgac

SEQ ID NO: 7839312 - DNA, 22 bp, Homo sapiens
tagctctctttatctttctata

SEQ ID NO: 7839313 - DNA, 22 bp, Homo sapiens
tagctctgaccaagagactgag

SEQ ID NO: 7839314 - DNA, 22 bp, Homo sapiens
tagctctctttatctttctata

SEQ ID NO: 7839315 - DNA, 22 bp, Homo sapiens
tagccgggtgttgtgtcatgca

SEQ ID NO: 7839316 - DNA, 22 bp, Homo sapiens
tagcctctctcctccacaacct

SEQ ID NO: 7839317 - DNA, 22 bp, Homo sapiens
tagccttttgggaagggctatt

SEQ ID NO: 7839318 - DNA, 22 bp, Homo sapiens
tagccgggtgttgtgtcatgca

SEQ ID NO: 7839319 - DNA, 22 bp, Homo sapiens
tagccgggtgtggtggaactcc

SEQ ID NO: 7839320 - DNA, 22 bp, Homo sapiens
tagctcttcaatcactgtctcc

SEQ ID NO: 7839321 - DNA, 22 bp, Homo sapiens
tagctcttcaatcactgtctcc

SEQ ID NO: 7839322 - DNA, 22 bp, Homo sapiens
tagctctgtgctctggatctgt

SEQ ID NO: 7839323 - DNA, 22 bp, Homo sapiens
tagctctgtcacctggcaaagt

SEQ ID NO: 7839324 - DNA, 22 bp, Homo sapiens
tagctctgtggatctttttaag

SEQ ID NO: 7839325 - DNA, 22 bp, Homo sapiens
tagctctggagtcttctcagaa

SEQ ID NO: 7839326 - DNA, 22 bp, Homo sapiens
tagctctggagtcttctcagaa

SEQ ID NO: 7839327 - DNA, 22 bp, Homo sapiens
tagctctggagtcttctcagaa

SEQ ID NO: 7839328 - DNA, 22 bp, Homo sapiens
tagctctggcattctttccaaa

SEQ ID NO: 7839329 - DNA, 22 bp, Homo sapiens
tagctctgtcacatacactgca

SEQ ID NO: 7839330 - DNA, 22 bp, Homo sapiens
tagctctgccaaatggaggctg

SEQ ID NO: 7839331 - DNA, 22 bp, Homo sapiens
tagctctgcaatgaagcccagg

SEQ ID NO: 7839332 - DNA, 22 bp, Homo sapiens
tagctctgctggaaggagtcag

SEQ ID NO: 7839333 - DNA, 22 bp, Homo sapiens
tagctctgctggaaggagtcag

SEQ ID NO: 7839334 - DNA, 22 bp, Homo sapiens
tagctctgcaatgaagcccagg

SEQ ID NO: 7839335 - DNA, 22 bp, Homo sapiens
tagctctgaggccatctccggt

SEQ ID NO: 7839336 - DNA, 19 bp, Homo sapiens
tagccctggccatcatgag

SEQ ID NO: 7839337 - DNA, 22 bp, Homo sapiens
tagccctgctgtgatgtgaagt

SEQ ID NO: 7839338 - DNA, 19 bp, Homo sapiens
tagccctggccatcatgag

SEQ ID NO: 7839339 - DNA, 22 bp, Homo sapiens
tagccctggagcagggaaatac

SEQ ID NO: 7839340 - DNA, 21 bp, Homo sapiens
tagccctctctgtctgtgtac

SEQ ID NO: 7839341 - DNA, 22 bp, Homo sapiens
tagccctctccagcgaggtctg

SEQ ID NO: 7839342 - DNA, 22 bp, Homo sapiens
tagccctctttaatccttccct

SEQ ID NO: 7839343 - DNA, 22 bp, Homo sapiens
tagccgcttaattatttggtga

SEQ ID NO: 7839344 - DNA, 22 bp, Homo sapiens
tagcccttttctgagcccacat

SEQ ID NO: 7839345 - DNA, 22 bp, Homo sapiens
tagcccttttctgagcccacat

SEQ ID NO: 7839346 - DNA, 21 bp, Homo sapiens
tagcccttctccacctcgccc

SEQ ID NO: 7839347 - DNA, 22 bp, Homo sapiens
tagccctgtccttggcctgtgc

SEQ ID NO: 7839348 - DNA, 22 bp, Homo sapiens
tagccctgtccttggcctgtgc

SEQ ID NO: 7839349 - DNA, 21 bp, Homo sapiens
tagcccttctccacctcgccc

SEQ ID NO: 7839350 - DNA, 22 bp, Homo sapiens
tagcccctgcctttgaacctgg

SEQ ID NO: 7839351 - DNA, 22 bp, Homo sapiens
tagcccctgcctttgaacctgg

SEQ ID NO: 7839352 - DNA, 22 bp, Homo sapiens
tagcccctgcctttgaacctgg

SEQ ID NO: 7839353 - DNA, 22 bp, Homo sapiens
tagccctcagcttggagcgtgg

SEQ ID NO: 7839354 - DNA, 22 bp, Homo sapiens
tagccctcatctgctcaaaagg

SEQ ID NO: 7839355 - DNA, 22 bp, Homo sapiens
tagcccatttgttggaagcatg

SEQ ID NO: 7839356 - DNA, 23 bp, Homo sapiens
tagcccattgtgcttgtggtttt

SEQ ID NO: 7839357 - DNA, 22 bp, Homo sapiens
tagcccattacctttggattgg

SEQ ID NO: 7839358 - DNA, 22 bp, Homo sapiens
tagcccatgtgcgtgttggggg

SEQ ID NO: 7839359 - DNA, 17 bp, Homo sapiens
tagcccatggctgccag

SEQ ID NO: 7839360 - DNA, 22 bp, Homo sapiens
tagcccatggactggtcagctg

SEQ ID NO: 7839361 - DNA, 22 bp, Homo sapiens
tagcccatgcagctctgtcatt

SEQ ID NO: 7839362 - DNA, 22 bp, Homo sapiens
tagcccctgcctttgaacctgg

SEQ ID NO: 7839363 - DNA, 22 bp, Homo sapiens
tagccccagctactcggaagct

SEQ ID NO: 7839364 - DNA, 22 bp, Homo sapiens
tagcagctcactaactctgcgt

SEQ ID NO: 7839365 - DNA, 22 bp, Homo sapiens
tagcagctccatttctctggca

SEQ ID NO: 7839366 - DNA, 22 bp, Homo sapiens
tagcagctccatttctctggca

SEQ ID NO: 7839367 - DNA, 22 bp, Homo sapiens
tagcagctcctaaacagtggtg

SEQ ID NO: 7839368 - DNA, 22 bp, Homo sapiens
tagcccagcatgagcagagctg

SEQ ID NO: 7839369 - DNA, 22 bp, Homo sapiens
tagcccagcatgagcagagctg

SEQ ID NO: 7839370 - DNA, 22 bp, Homo sapiens
tagcccagcatgagcagagctg

SEQ ID NO: 7839371 - DNA, 22 bp, Homo sapiens
tagcccagcatgagcagagctg

SEQ ID NO: 7839372 - DNA, 22 bp, Homo sapiens
tagcccagctaactcggtgagc

SEQ ID NO: 7839373 - DNA, 22 bp, Homo sapiens
tagcagctcactaactctgcgt

SEQ ID NO: 7839374 - DNA, 22 bp, Homo sapiens
tagcagctcactaactctgcgt

SEQ ID NO: 7839375 - DNA, 22 bp, Homo sapiens
tagcagctcactaactctgcgt

SEQ ID NO: 7839376 - DNA, 22 bp, Homo sapiens
tagcagctcactaactctgcgt

SEQ ID NO: 7839377 - DNA, 22 bp, Homo sapiens
tagcagctccatttctctggca

SEQ ID NO: 7839378 - DNA, 22 bp, Homo sapiens
tagcagctcacagcctcccatt

SEQ ID NO: 7839379 - DNA, 22 bp, Homo sapiens
tagcagctcacagcctcccatt

SEQ ID NO: 7839380 - DNA, 22 bp, Homo sapiens
tagcagctatgccattttgaca

SEQ ID NO: 7839381 - DNA, 22 bp, Homo sapiens
tagcagctatgccattttgaca

SEQ ID NO: 7839382 - DNA, 22 bp, Homo sapiens
tagcccatgatggtggaaggca

SEQ ID NO: 7839383 - DNA, 22 bp, Homo sapiens
tagcccatatggtgcctttgtg

SEQ ID NO: 7839384 - DNA, 22 bp, Homo sapiens
tagcccatatgaaatgatttgg

SEQ ID NO: 7839385 - DNA, 22 bp, Homo sapiens
tagcccaggctgtagtgcagtg

SEQ ID NO: 7839386 - DNA, 22 bp, Homo sapiens
tagcccaggctgtagtgcagtg

SEQ ID NO: 7839387 - DNA, 22 bp, Homo sapiens
tagcccaggctgtagtgcagtg

SEQ ID NO: 7839388 - DNA, 22 bp, Homo sapiens
tagcccaggctggagtgcaggg

SEQ ID NO: 7839389 - DNA, 22 bp, Homo sapiens
tagcccaggctggagtgcaggg

SEQ ID NO: 7839390 - DNA, 22 bp, Homo sapiens
tagcccaggctggagtgcaggg

SEQ ID NO: 7839391 - DNA, 22 bp, Homo sapiens
tagcccagctcaaatgaccggt

SEQ ID NO: 7839392 - DNA, 22 bp, Homo sapiens
tagcccaggagaattgtctttc

SEQ ID NO: 7839393 - DNA, 22 bp, Homo sapiens
tagcccaggctggagggcagtg

SEQ ID NO: 7839394 - DNA, 22 bp, Homo sapiens
tagcccaggctggagggcagtg

SEQ ID NO: 7839395 - DNA, 22 bp, Homo sapiens
tagcccaggctggagggcagtg

SEQ ID NO: 7839396 - DNA, 22 bp, Homo sapiens
tagctttaggatggttctcttg

SEQ ID NO: 7839397 - DNA, 22 bp, Homo sapiens
tagctttaggcacgtttgaatt

SEQ ID NO: 7839398 - DNA, 22 bp, Homo sapiens
tagctttagtgaaaaatatcag

SEQ ID NO: 7839399 - DNA, 22 bp, Homo sapiens
tagctttagtgaaaaatatcag

SEQ ID NO: 7839400 - DNA, 22 bp, Homo sapiens
tagctttagtgaaaaatatcag

SEQ ID NO: 7839401 - DNA, 22 bp, Homo sapiens
tagctttagaaatattctcaga

SEQ ID NO: 7839402 - DNA, 22 bp, Homo sapiens
tagctttgacagttgcaggcag

SEQ ID NO: 7839403 - DNA, 22 bp, Homo sapiens
tagctttgaagttatttaacag

SEQ ID NO: 7839404 - DNA, 22 bp, Homo sapiens
tagctttgaacttctgggctca

SEQ ID NO: 7839405 - DNA, 22 bp, Homo sapiens
tagctttgaccaacgactggtc

SEQ ID NO: 7839406 - DNA, 22 bp, Homo sapiens
tagctttgcaaaggaagtttta

SEQ ID NO: 7839407 - DNA, 22 bp, Homo sapiens
tagctttgccacacatgtagat

SEQ ID NO: 7839408 - DNA, 22 bp, Homo sapiens
tagctttgccatctgtcacata

SEQ ID NO: 7839409 - DNA, 22 bp, Homo sapiens
tagctttgccatctgtcacata

SEQ ID NO: 7839410 - DNA, 22 bp, Homo sapiens
tagctttgcccgtgctggattt

SEQ ID NO: 7839411 - DNA, 22 bp, Homo sapiens
tagctttgcctgaagtaatcag

SEQ ID NO: 7839412 - DNA, 22 bp, Homo sapiens
tagctttgcctgaagtaatcag

SEQ ID NO: 7839413 - DNA, 22 bp, Homo sapiens
tagctttgcctgttaatcacaa

SEQ ID NO: 7839414 - DNA, 22 bp, Homo sapiens
tagctttgggaatgctctcctg

SEQ ID NO: 7839415 - DNA, 22 bp, Homo sapiens
tagctttggattctttggggaa

SEQ ID NO: 7839416 - DNA, 22 bp, Homo sapiens
tagctttgctggcaagcatgtc

SEQ ID NO: 7839417 - DNA, 22 bp, Homo sapiens
tagctttgcctgttaatcacaa

SEQ ID NO: 7839418 - DNA, 22 bp, Homo sapiens
tagctttgctggcaagcatgtc

SEQ ID NO: 7839419 - DNA, 22 bp, Homo sapiens
taggaaaagtctagattgatga

SEQ ID NO: 7839420 - DNA, 22 bp, Homo sapiens
taggaaaagtctagattgatga

SEQ ID NO: 7839421 - DNA, 22 bp, Homo sapiens
taggaaaagtctagattgatga

SEQ ID NO: 7839422 - DNA, 22 bp, Homo sapiens
taggaaaagcacaggatgttct

SEQ ID NO: 7839423 - DNA, 22 bp, Homo sapiens
taggaaaagcacaggatgttct

SEQ ID NO: 7839424 - DNA, 22 bp, Homo sapiens
taggaaaacgtgattttctcac

SEQ ID NO: 7839425 - DNA, 22 bp, Homo sapiens
taggaaaaatacagaattatat

SEQ ID NO: 7839426 - DNA, 22 bp, Homo sapiens
taggaaaacgtgattttctcac

SEQ ID NO: 7839427 - DNA, 22 bp, Homo sapiens
taggaaaaatacagaattatat

SEQ ID NO: 7839428 - DNA, 22 bp, Homo sapiens
tagctttgtttatcaaggggca

SEQ ID NO: 7839429 - DNA, 22 bp, Homo sapiens
tagcttttagtacttaatggct

SEQ ID NO: 7839430 - DNA, 22 bp, Homo sapiens
tagctttgtcctccaccctcag

SEQ ID NO: 7839431 - DNA, 22 bp, Homo sapiens
tagctttgtattatcagcattg

SEQ ID NO: 7839432 - DNA, 22 bp, Homo sapiens
tagctttgtgtatgatgtctgt

SEQ ID NO: 7839433 - DNA, 22 bp, Homo sapiens
tagctttgtgtatgatgtctgt

SEQ ID NO: 7839434 - DNA, 22 bp, Homo sapiens
tagctttgtgaagtttacagac

SEQ ID NO: 7839435 - DNA, 16 bp, Homo sapiens
tagctttgtgttgtgg

SEQ ID NO: 7839436 - DNA, 22 bp, Homo sapiens
tagctttgtgtcctgatttagc

SEQ ID NO: 7839437 - DNA, 22 bp, Homo sapiens
tagctttgttagaatgtcttca

SEQ ID NO: 7839438 - DNA, 22 bp, Homo sapiens
tagctttgttagaatgtcttca

SEQ ID NO: 7839439 - DNA, 22 bp, Homo sapiens
tagctttgttagaatgtcttca

SEQ ID NO: 7839440 - DNA, 22 bp, Homo sapiens
taggacaggtgaggggctgtgg

SEQ ID NO: 7839441 - DNA, 22 bp, Homo sapiens
taggaaactcaaagggaagtgg

SEQ ID NO: 7839442 - DNA, 22 bp, Homo sapiens
taggaaactaatacagtctgga

SEQ ID NO: 7839443 - DNA, 22 bp, Homo sapiens
taggaaaccaatcttttgggag

SEQ ID NO: 7839444 - DNA, 22 bp, Homo sapiens
taggaaacagtgcatatatagt

SEQ ID NO: 7839445 - DNA, 22 bp, Homo sapiens
taggaaacatttgaagaggatt

SEQ ID NO: 7839446 - DNA, 22 bp, Homo sapiens
taggaaacaaagtggatgaaat

SEQ ID NO: 7839447 - DNA, 22 bp, Homo sapiens
taggaaacaaagtggatgaaat

SEQ ID NO: 7839448 - DNA, 22 bp, Homo sapiens
taggaaacaaagtaatgcaact

SEQ ID NO: 7839449 - DNA, 22 bp, Homo sapiens
taggaaacaaagcttagcagga

SEQ ID NO: 7839450 - DNA, 22 bp, Homo sapiens
taggaaacaaacctgcctcttc

SEQ ID NO: 7839451 - DNA, 22 bp, Homo sapiens
taggaaaatatctcttattggg

SEQ ID NO: 7839452 - DNA, 22 bp, Homo sapiens
taggaaacaaacctgcctcttc

SEQ ID NO: 7839453 - DNA, 22 bp, Homo sapiens
taggaaacaaacctgcctcttc

SEQ ID NO: 7839454 - DNA, 22 bp, Homo sapiens
taggaaaatatctcttattggg

SEQ ID NO: 7839455 - DNA, 22 bp, Homo sapiens
taggaaaatatctcttattggg

SEQ ID NO: 7839456 - DNA, 22 bp, Homo sapiens
taggacagtttactttggttac

SEQ ID NO: 7839457 - DNA, 22 bp, Homo sapiens
taggagggggaacaaggcatac

SEQ ID NO: 7839458 - DNA, 22 bp, Homo sapiens
taggagggggaacaaggcatac

SEQ ID NO: 7839459 - DNA, 22 bp, Homo sapiens
taggagggttagagggaaatat

SEQ ID NO: 7839460 - DNA, 22 bp, Homo sapiens
taggacagtggagataaccaga

SEQ ID NO: 7839461 - DNA, 22 bp, Homo sapiens
taggacagtggagataaccaga

SEQ ID NO: 7839462 - DNA, 22 bp, Homo sapiens
taggacagttatgggttttatt

SEQ ID NO: 7839463 - DNA, 22 bp, Homo sapiens
taggacagtagctggtgcacag

SEQ ID NO: 7839464 - DNA, 22 bp, Homo sapiens
taggacagtagctggtgcacag

SEQ ID NO: 7839465 - DNA, 22 bp, Homo sapiens
taggatggtacaaggcaggggt

SEQ ID NO: 7839466 - DNA, 22 bp, Homo sapiens
taggatgatcttgtagagagat

SEQ ID NO: 7839467 - DNA, 22 bp, Homo sapiens
taggatggtcacagagatggac

SEQ ID NO: 7839468 - DNA, 20 bp, Homo sapiens
taggatgaaagtggtttctg

SEQ ID NO: 7839469 - DNA, 22 bp, Homo sapiens
taggatgacacagcaagtatag

SEQ ID NO: 7839470 - DNA, 22 bp, Homo sapiens
taggatgaagtagttatacagc

SEQ ID NO: 7839471 - DNA, 22 bp, Homo sapiens
taggatgacaccaccaagacct

SEQ ID NO: 7839472 - DNA, 22 bp, Homo sapiens
taggatgactgatagtgattcc

SEQ ID NO: 7839473 - DNA, 22 bp, Homo sapiens
taggatgactgatagtgattcc

SEQ ID NO: 7839474 - DNA, 22 bp, Homo sapiens
taggatttactttgacaatatt

SEQ ID NO: 7839475 - DNA, 22 bp, Homo sapiens
taggatttaataaaagaataga

SEQ ID NO: 7839476 - DNA, 22 bp, Homo sapiens
taggatttaggctttaacatct

SEQ ID NO: 7839477 - DNA, 22 bp, Homo sapiens
taggatttaggctttaacatct

SEQ ID NO: 7839478 - DNA, 22 bp, Homo sapiens
taggatttaggctttaacatct

SEQ ID NO: 7839479 - DNA, 22 bp, Homo sapiens
taggatgtgccaggaaagaaag

SEQ ID NO: 7839480 - DNA, 22 bp, Homo sapiens
taggattcaagatagtagactg

SEQ ID NO: 7839481 - DNA, 22 bp, Homo sapiens
taggatatgtgaaatcatatta

SEQ ID NO: 7839482 - DNA, 22 bp, Homo sapiens
taggatgaaaagtgttctttga

SEQ ID NO: 7839483 - DNA, 22 bp, Homo sapiens
taggatatgcatttttatacat

SEQ ID NO: 7839484 - DNA, 22 bp, Homo sapiens
taggatatgagtaagcctttgt

SEQ ID NO: 7839485 - DNA, 22 bp, Homo sapiens
taggacataagtattctaactt

SEQ ID NO: 7839486 - DNA, 22 bp, Homo sapiens
tagggatgggagattctcaaac

SEQ ID NO: 7839487 - DNA, 22 bp, Homo sapiens
tagggatggcagcatgtagctt

SEQ ID NO: 7839488 - DNA, 22 bp, Homo sapiens
tagggatggaaactaggaatct

SEQ ID NO: 7839489 - DNA, 22 bp, Homo sapiens
tagggatggatgatgcctggca

SEQ ID NO: 7839490 - DNA, 22 bp, Homo sapiens
tagggatggatgatgcctggca

SEQ ID NO: 7839491 - DNA, 22 bp, Homo sapiens
tagggatgatggagcctatgta

SEQ ID NO: 7839492 - DNA, 22 bp, Homo sapiens
tagggatgatgtctaaaatcat

SEQ ID NO: 7839493 - DNA, 22 bp, Homo sapiens
tagggatgcttagtaggaccca

SEQ ID NO: 7839494 - DNA, 20 bp, Homo sapiens
tagggatgccagtacttctc

SEQ ID NO: 7839495 - DNA, 22 bp, Homo sapiens
tagggatggaaacccgttttct

SEQ ID NO: 7839496 - DNA, 22 bp, Homo sapiens
tagggatgtcctgagacttggc

SEQ ID NO: 7839497 - DNA, 22 bp, Homo sapiens
tagggatgtaaacatagtaatt

SEQ ID NO: 7839498 - DNA, 22 bp, Homo sapiens
tagggatgtggtgagaactgag

SEQ ID NO: 7839499 - DNA, 22 bp, Homo sapiens
tagggcagagcttgtacacgat

SEQ ID NO: 7839500 - DNA, 22 bp, Homo sapiens
tagggcagagcttgtacacgat

SEQ ID NO: 7839501 - DNA, 22 bp, Homo sapiens
tagggcagagcttgtacacgat

SEQ ID NO: 7839502 - DNA, 22 bp, Homo sapiens
tagggcactatttgtgactgaa

SEQ ID NO: 7839503 - DNA, 22 bp, Homo sapiens
tagggcagagcttgtacacgat

SEQ ID NO: 7839504 - DNA, 22 bp, Homo sapiens
tagggcagagtccaggatgggc

SEQ ID NO: 7839505 - DNA, 22 bp, Homo sapiens
tagggatgagccagtgggtagt

SEQ ID NO: 7839506 - DNA, 22 bp, Homo sapiens
tagggatgaggatagatttttc

SEQ ID NO: 7839507 - DNA, 22 bp, Homo sapiens
tagggatgatggagcctatgta

SEQ ID NO: 7839508 - DNA, 22 bp, Homo sapiens
tagggatgagcaactggtagtg

SEQ ID NO: 7839509 - DNA, 22 bp, Homo sapiens
tagggatgactatgattcccac

SEQ ID NO: 7839510 - DNA, 22 bp, Homo sapiens
tagggatgagccagtgggtagt

SEQ ID NO: 7839511 - DNA, 22 bp, Homo sapiens
tagggatgacgaaaggacagag

SEQ ID NO: 7839512 - DNA, 22 bp, Homo sapiens
tagggatgaagatggtatttct

SEQ ID NO: 7839513 - DNA, 22 bp, Homo sapiens
tagggatgaagttgctatttac

SEQ ID NO: 7839514 - DNA, 22 bp, Homo sapiens
tagggatgaagatggtatttct

SEQ ID NO: 7839515 - DNA, 22 bp, Homo sapiens
tagggagctctggcagaaggaa

SEQ ID NO: 7839516 - DNA, 22 bp, Homo sapiens
tagggagcagccctgccactcc

SEQ ID NO: 7839517 - DNA, 22 bp, Homo sapiens
tagggagcagccctgccactcc

SEQ ID NO: 7839518 - DNA, 22 bp, Homo sapiens
tagggagatgcaagggacggag

SEQ ID NO: 7839519 - DNA, 22 bp, Homo sapiens
tagggagcagccctgccactcc

SEQ ID NO: 7839520 - DNA, 22 bp, Homo sapiens
tagggagatgcaagggacggag

SEQ ID NO: 7839521 - DNA, 22 bp, Homo sapiens
tagggaggagggttttcaaatc

SEQ ID NO: 7839522 - DNA, 22 bp, Homo sapiens
tagggagctctggcagaaggaa

SEQ ID NO: 7839523 - DNA, 22 bp, Homo sapiens
tagggaggagggttttcaaatc

SEQ ID NO: 7839524 - DNA, 22 bp, Homo sapiens
tagggaggctacttcttgtagg

SEQ ID NO: 7839525 - DNA, 22 bp, Homo sapiens
tagggaggctacttcttgtagg

SEQ ID NO: 7839526 - DNA, 22 bp, Homo sapiens
tagggaggctacttcttgtagg

SEQ ID NO: 7839527 - DNA, 22 bp, Homo sapiens
tagggaggctacttcttgtagg

SEQ ID NO: 7839528 - DNA, 22 bp, Homo sapiens
tagggacactgctcatgagttc

SEQ ID NO: 7839529 - DNA, 22 bp, Homo sapiens
tagggacactgctcatgagttc

SEQ ID NO: 7839530 - DNA, 22 bp, Homo sapiens
taggctgggcattctggccagg

SEQ ID NO: 7839531 - DNA, 22 bp, Homo sapiens
tagggagaaacaccaatttatt

SEQ ID NO: 7839532 - DNA, 22 bp, Homo sapiens
tagggagatgcaagggacggag

SEQ ID NO: 7839533 - DNA, 22 bp, Homo sapiens
tagggagatgcaagggacggag

SEQ ID NO: 7839534 - DNA, 22 bp, Homo sapiens
tagggagaggaagcaggccgct

SEQ ID NO: 7839535 - DNA, 22 bp, Homo sapiens
tagggagaggaagcaggccgct

SEQ ID NO: 7839536 - DNA, 20 bp, Homo sapiens
tagggagatatgctcttttc

SEQ ID NO: 7839537 - DNA, 22 bp, Homo sapiens
tagggagaggaagcaggccgct

SEQ ID NO: 7839538 - DNA, 22 bp, Homo sapiens
taggcactggttgtggatagtt

SEQ ID NO: 7839539 - DNA, 22 bp, Homo sapiens
taggcactggttgtggatagtt

SEQ ID NO: 7839540 - DNA, 22 bp, Homo sapiens
taggcagaaaggaaggcaagtt

SEQ ID NO: 7839541 - DNA, 22 bp, Homo sapiens
taggcagaaaggaaggcaagtt

SEQ ID NO: 7839542 - DNA, 22 bp, Homo sapiens
taggcagaaaggaaggcaagtt

SEQ ID NO: 7839543 - DNA, 22 bp, Homo sapiens
taggctgggcattctggccagg

SEQ ID NO: 7839544 - DNA, 22 bp, Homo sapiens
taggctgggcattctggccagg

SEQ ID NO: 7839545 - DNA, 22 bp, Homo sapiens
taggctgggagcctgaggctag

SEQ ID NO: 7839546 - DNA, 22 bp, Homo sapiens
taggctgggagcctgaggctag

SEQ ID NO: 7839547 - DNA, 22 bp, Homo sapiens
taggattttttggattctggat

SEQ ID NO: 7839548 - DNA, 22 bp, Homo sapiens
taggattttaacccacctctga

SEQ ID NO: 7839549 - DNA, 22 bp, Homo sapiens
taggatttctctttttgcaact

SEQ ID NO: 7839550 - DNA, 22 bp, Homo sapiens
taggattttttggattctggat

SEQ ID NO: 7839551 - DNA, 22 bp, Homo sapiens
taggatttggctttagtcaggt

SEQ ID NO: 7839552 - DNA, 22 bp, Homo sapiens
taggatttctctttttgcaact

SEQ ID NO: 7839553 - DNA, 22 bp, Homo sapiens
taggatttattctacaatattg

SEQ ID NO: 7839554 - DNA, 22 bp, Homo sapiens
taggatttattctacaatattg

SEQ ID NO: 7839555 - DNA, 22 bp, Homo sapiens
taggcaagtggaccagaggttt

SEQ ID NO: 7839556 - DNA, 22 bp, Homo sapiens
taggcaagttgcccaatctctc

SEQ ID NO: 7839557 - DNA, 22 bp, Homo sapiens
taggcaagtggaccagaggttt

SEQ ID NO: 7839558 - DNA, 22 bp, Homo sapiens
taggcaagtggaccagaggttt

SEQ ID NO: 7839559 - DNA, 22 bp, Homo sapiens
taggcactgaccttctcagatt

SEQ ID NO: 7839560 - DNA, 22 bp, Homo sapiens
taggcactgaccttctcagatt

SEQ ID NO: 7839561 - DNA, 22 bp, Homo sapiens
taggcactgagtacatattggt

SEQ ID NO: 7839562 - DNA, 22 bp, Homo sapiens
taggcactgggctaggacaggt

SEQ ID NO: 7839563 - DNA, 22 bp, Homo sapiens
taggcactagacatggttacca

SEQ ID NO: 7839564 - DNA, 22 bp, Homo sapiens
taggcacaagaccatgcaaagg

SEQ ID NO: 7839565 - DNA, 22 bp, Homo sapiens
taggcaatgttctaaggaatga

SEQ ID NO: 7839566 - DNA, 22 bp, Homo sapiens
taggcaattagtaacgcagaaa

SEQ ID NO: 7839567 - DNA, 22 bp, Homo sapiens
gctgcctcactccagcccaata

SEQ ID NO: 7839568 - DNA, 22 bp, Homo sapiens
gctgcctcactccagcccaata

SEQ ID NO: 7839569 - DNA, 22 bp, Homo sapiens
gctgcctagtctgctgagcaga

SEQ ID NO: 7839570 - DNA, 22 bp, Homo sapiens
gctgcctagttctttatgtgaa

SEQ ID NO: 7839571 - DNA, 22 bp, Homo sapiens
gctgcctacgcttgagccctgg

SEQ ID NO: 7839572 - DNA, 22 bp, Homo sapiens
gctgcctcactccagcccaata

SEQ ID NO: 7839573 - DNA, 22 bp, Homo sapiens
gctgcctcactccagcccaata

SEQ ID NO: 7839574 - DNA, 22 bp, Homo sapiens
gctgcctcaggcacctcctggc

SEQ ID NO: 7839575 - DNA, 22 bp, Homo sapiens
gctgcctcactccagcccaata

SEQ ID NO: 7839576 - DNA, 22 bp, Homo sapiens
gctgccctgtggtccagcaggt

SEQ ID NO: 7839577 - DNA, 22 bp, Homo sapiens
gctgcccttcgtcatctataaa

SEQ ID NO: 7839578 - DNA, 22 bp, Homo sapiens
gctgccctgtttagccagggtt

SEQ ID NO: 7839579 - DNA, 22 bp, Homo sapiens
gctgccctgtttagccagggtt

SEQ ID NO: 7839580 - DNA, 22 bp, Homo sapiens
gctgcctccaatctgtgccccg

SEQ ID NO: 7839581 - DNA, 22 bp, Homo sapiens
gctgcctcaggcacctcctggc

SEQ ID NO: 7839582 - DNA, 22 bp, Homo sapiens
gctgcctcaggcacctcctggc

SEQ ID NO: 7839583 - DNA, 22 bp, Homo sapiens
gctgcctcaggcacctcctggc

SEQ ID NO: 7839584 - DNA, 22 bp, Homo sapiens
gctgcctcaggcacctcctggc

SEQ ID NO: 7839585 - DNA, 22 bp, Homo sapiens
gctgcctcaggcacctcctggc

SEQ ID NO: 7839586 - DNA, 22 bp, Homo sapiens
gctgcctgtcctgaggagtccg

SEQ ID NO: 7839587 - DNA, 22 bp, Homo sapiens
gctgcctccaatctgtgccccg

SEQ ID NO: 7839588 - DNA, 22 bp, Homo sapiens
gctgcctccaatctgtgccccg

SEQ ID NO: 7839589 - DNA, 22 bp, Homo sapiens
gctgcctccaatctgtgccccg

SEQ ID NO: 7839590 - DNA, 22 bp, Homo sapiens
gctgcctgtcctgaggagtccg

SEQ ID NO: 7839591 - DNA, 22 bp, Homo sapiens
gctgcctgtcctgaggagtccg

SEQ ID NO: 7839592 - DNA, 22 bp, Homo sapiens
gctgcctgtcctgaggagtccg

SEQ ID NO: 7839593 - DNA, 22 bp, Homo sapiens
gctgccctaatatcacatgtta

SEQ ID NO: 7839594 - DNA, 22 bp, Homo sapiens
gctgccctaatatcacatgtta

SEQ ID NO: 7839595 - DNA, 22 bp, Homo sapiens
gctgccccccggactcggcggg

SEQ ID NO: 7839596 - DNA, 22 bp, Homo sapiens
gctgccccgagccatccttcag

SEQ ID NO: 7839597 - DNA, 22 bp, Homo sapiens
gctgccccgagccatccttcag

SEQ ID NO: 7839598 - DNA, 22 bp, Homo sapiens
gctgccccccggactcggcggg

SEQ ID NO: 7839599 - DNA, 22 bp, Homo sapiens
gctgccccccggactcggcggg

SEQ ID NO: 7839600 - DNA, 22 bp, Homo sapiens
gctgccccagctgggggctgga

SEQ ID NO: 7839601 - DNA, 22 bp, Homo sapiens
gctgccccccggactcggcggg

SEQ ID NO: 7839602 - DNA, 22 bp, Homo sapiens
gctgccccagctgggggctgga

SEQ ID NO: 7839603 - DNA, 22 bp, Homo sapiens
gctgcccattgctctcccactc

SEQ ID NO: 7839604 - DNA, 22 bp, Homo sapiens
gctgcccattgctctcccactc

SEQ ID NO: 7839605 - DNA, 22 bp, Homo sapiens
gctgcccattccactggatggt

SEQ ID NO: 7839606 - DNA, 22 bp, Homo sapiens
gctgcccattgctctcccactc

SEQ ID NO: 7839607 - DNA, 22 bp, Homo sapiens
gctgccctgtggtccagcaggt

SEQ ID NO: 7839608 - DNA, 22 bp, Homo sapiens
gctgccctgtggtccagcaggt

SEQ ID NO: 7839609 - DNA, 18 bp, Homo sapiens
gctgccctagctcccctc

SEQ ID NO: 7839610 - DNA, 22 bp, Homo sapiens
gctgccctgtctgcagcaggac

SEQ ID NO: 7839611 - DNA, 22 bp, Homo sapiens
gctgccctagaagtacagagag

SEQ ID NO: 7839612 - DNA, 22 bp, Homo sapiens
gctgccctagaagtacagagag

SEQ ID NO: 7839613 - DNA, 22 bp, Homo sapiens
gctgccctacccgaggcactct

SEQ ID NO: 7839614 - DNA, 22 bp, Homo sapiens
gctgccctacccgaggcactct

SEQ ID NO: 7839615 - DNA, 22 bp, Homo sapiens
gctgccctacccgaggcactct

SEQ ID NO: 7839616 - DNA, 22 bp, Homo sapiens
gctgcccagttctgctgctgcc

SEQ ID NO: 7839617 - DNA, 22 bp, Homo sapiens
gctgcccagtgtgctcatgcag

SEQ ID NO: 7839618 - DNA, 22 bp, Homo sapiens
gctgcccagtgtgctcatgcag

SEQ ID NO: 7839619 - DNA, 22 bp, Homo sapiens
gctgcccagttctgctgctgcc

SEQ ID NO: 7839620 - DNA, 22 bp, Homo sapiens
gctgcccagttctgctgctgcc

SEQ ID NO: 7839621 - DNA, 22 bp, Homo sapiens
gctgcccattccactggatggt

SEQ ID NO: 7839622 - DNA, 22 bp, Homo sapiens
gctgcccagggctgagtgtcct

SEQ ID NO: 7839623 - DNA, 22 bp, Homo sapiens
gctgcccagggctgagtgtcct

SEQ ID NO: 7839624 - DNA, 22 bp, Homo sapiens
gctgcccagggctgagtgtcct

SEQ ID NO: 7839625 - DNA, 22 bp, Homo sapiens
gctgcccaggcaacattgactt

SEQ ID NO: 7839626 - DNA, 22 bp, Homo sapiens
gctgcccagggtggagccggct

SEQ ID NO: 7839627 - DNA, 22 bp, Homo sapiens
gctgcccagggtggagccggct

SEQ ID NO: 7839628 - DNA, 22 bp, Homo sapiens
gctgcccacaaccccgtgtcta

SEQ ID NO: 7839629 - DNA, 22 bp, Homo sapiens
gctgcccacaaccccgtgtcta

SEQ ID NO: 7839630 - DNA, 22 bp, Homo sapiens
gctgcccacaaccccgtgtcta

SEQ ID NO: 7839631 - DNA, 22 bp, Homo sapiens
gctgcccagcaggccccagggg

SEQ ID NO: 7839632 - DNA, 22 bp, Homo sapiens
gctgcccacagcgggtgtttcg

SEQ ID NO: 7839633 - DNA, 22 bp, Homo sapiens
gctgcccagacattgaatcagg

SEQ ID NO: 7839634 - DNA, 22 bp, Homo sapiens
gctgcccaggaagcctggggtt

SEQ ID NO: 7839635 - DNA, 22 bp, Homo sapiens
gctgcccaggagaggtggggct

SEQ ID NO: 7839636 - DNA, 22 bp, Homo sapiens
gctgcccaggagaggtggggct

SEQ ID NO: 7839637 - DNA, 22 bp, Homo sapiens
gctgcccaggaagcctggggtt

SEQ ID NO: 7839638 - DNA, 22 bp, Homo sapiens
gctgcccagcaggccccagggg

SEQ ID NO: 7839639 - DNA, 22 bp, Homo sapiens
gctgagggcatgtgtggcgact

SEQ ID NO: 7839640 - DNA, 22 bp, Homo sapiens
gctgagggcagcctcctaggtc

SEQ ID NO: 7839641 - DNA, 22 bp, Homo sapiens
gctgagggcatgtgtggcgact

SEQ ID NO: 7839642 - DNA, 22 bp, Homo sapiens
gctgagggcatgtgtggcgact

SEQ ID NO: 7839643 - DNA, 22 bp, Homo sapiens
gctgagggcatgtgtggcgact

SEQ ID NO: 7839644 - DNA, 22 bp, Homo sapiens
gctgagggcatgtgtggcgact

SEQ ID NO: 7839645 - DNA, 19 bp, Homo sapiens
gctgagggccacccagccc

SEQ ID NO: 7839646 - DNA, 22 bp, Homo sapiens
gctgagggctgtaacagcagag

SEQ ID NO: 7839647 - DNA, 22 bp, Homo sapiens
gctgagggccgcatagggtcat

SEQ ID NO: 7839648 - DNA, 22 bp, Homo sapiens
gctgagggctggtcacatttgt

SEQ ID NO: 7839649 - DNA, 22 bp, Homo sapiens
gctgagggccgcatagggtcat

SEQ ID NO: 7839650 - DNA, 22 bp, Homo sapiens
gctgagggctgtaacagcagag

SEQ ID NO: 7839651 - DNA, 22 bp, Homo sapiens
gctgagggctgtaacagcagag

SEQ ID NO: 7839652 - DNA, 22 bp, Homo sapiens
gctgagggctgtaacagcagag

SEQ ID NO: 7839653 - DNA, 22 bp, Homo sapiens
gctgcccaattacagggccgtg

SEQ ID NO: 7839654 - DNA, 22 bp, Homo sapiens
gctgcccaattacagggccgtg

SEQ ID NO: 7839655 - DNA, 22 bp, Homo sapiens
gctgcccaattacagggccgtg

SEQ ID NO: 7839656 - DNA, 20 bp, Homo sapiens
gctgcgatccgtttcacagt

SEQ ID NO: 7839657 - DNA, 22 bp, Homo sapiens
gctgcgccggatcccacgttcc

SEQ ID NO: 7839658 - DNA, 22 bp, Homo sapiens
gctgcgagctcttgttctgaga

SEQ ID NO: 7839659 - DNA, 22 bp, Homo sapiens
gctgccttttgctcctcccacc

SEQ ID NO: 7839660 - DNA, 22 bp, Homo sapiens
gctgcgtcgagacagcctggca

SEQ ID NO: 7839661 - DNA, 22 bp, Homo sapiens
gctgctcagtgggcctgagcct

SEQ ID NO: 7839662 - DNA, 22 bp, Homo sapiens
gctgctaagcgtttctgttcca

SEQ ID NO: 7839663 - DNA, 22 bp, Homo sapiens
gctgctaagcgtttctgttcca

SEQ ID NO: 7839664 - DNA, 22 bp, Homo sapiens
gctgcgtcgagacagcctggca

SEQ ID NO: 7839665 - DNA, 18 bp, Homo sapiens
gctgcgtgggatgtgacc

SEQ ID NO: 7839666 - DNA, 22 bp, Homo sapiens
gctgccttcagttctgattcat

SEQ ID NO: 7839667 - DNA, 22 bp, Homo sapiens
gctgccttatgtctattagtat

SEQ ID NO: 7839668 - DNA, 22 bp, Homo sapiens
gctgccttatgtctattagtat

SEQ ID NO: 7839669 - DNA, 22 bp, Homo sapiens
gctgccttatgtctattagtat

SEQ ID NO: 7839670 - DNA, 22 bp, Homo sapiens
gctgccttaacttcttcgctgt

SEQ ID NO: 7839671 - DNA, 22 bp, Homo sapiens
gctgccttagagggagtggttc

SEQ ID NO: 7839672 - DNA, 20 bp, Homo sapiens
gctgcctgtttctgtaagta

SEQ ID NO: 7839673 - DNA, 20 bp, Homo sapiens
gctgcctgtttctgtaagta

SEQ ID NO: 7839674 - DNA, 22 bp, Homo sapiens
gctgcctgttgaagggtctgtg

SEQ ID NO: 7839675 - DNA, 20 bp, Homo sapiens
gctgcctgtttctgtaagta

SEQ ID NO: 7839676 - DNA, 20 bp, Homo sapiens
gctgcctgtttctgtaagta

SEQ ID NO: 7839677 - DNA, 22 bp, Homo sapiens
gctgcctgtggcccttctgggt

SEQ ID NO: 7839678 - DNA, 22 bp, Homo sapiens
gctgcctgtgcgggtcgctagg

SEQ ID NO: 7839679 - DNA, 22 bp, Homo sapiens
gctgcctgtgcactttctcgta

SEQ ID NO: 7839680 - DNA, 22 bp, Homo sapiens
gctgcctgtgcactttctcgta

SEQ ID NO: 7839681 - DNA, 22 bp, Homo sapiens
gctgcctgtctgctgacccagg

SEQ ID NO: 7839682 - DNA, 22 bp, Homo sapiens
gctgcctgtcctgaggagtccg

SEQ ID NO: 7839683 - DNA, 22 bp, Homo sapiens
gctgcctgtcctgaggagtccg

SEQ ID NO: 7839684 - DNA, 22 bp, Homo sapiens
gctgcctgtctgtttcttttat

SEQ ID NO: 7839685 - DNA, 22 bp, Homo sapiens
gctgcctgtctgctgacccagg

SEQ ID NO: 7839686 - DNA, 22 bp, Homo sapiens
gctgcctgtctgctgacccagg

SEQ ID NO: 7839687 - DNA, 22 bp, Homo sapiens
gctgcctgttgaagggtctgtg

SEQ ID NO: 7839688 - DNA, 22 bp, Homo sapiens
gctgcctgttgaagggtctgtg

SEQ ID NO: 7839689 - DNA, 22 bp, Homo sapiens
gctgcctgttgaagggtctgtg

SEQ ID NO: 7839690 - DNA, 22 bp, Homo sapiens
gctgcctgttgaagggtctgtg

SEQ ID NO: 7839691 - DNA, 22 bp, Homo sapiens
gctgcctgttgaagggtctgtg

SEQ ID NO: 7839692 - DNA, 22 bp, Homo sapiens
gctgcctgtgtggccactcact

SEQ ID NO: 7839693 - DNA, 22 bp, Homo sapiens
gctgcctgtgtggccactcact

SEQ ID NO: 7839694 - DNA, 22 bp, Homo sapiens
gctgcctgtgtggccactcact

SEQ ID NO: 7839695 - DNA, 22 bp, Homo sapiens
gctgcctgtggcccttctgggt

SEQ ID NO: 7839696 - DNA, 22 bp, Homo sapiens
gctgcctgtggcccttctgggt

SEQ ID NO: 7839697 - DNA, 22 bp, Homo sapiens
gctgcctgtggcccttctgggt

SEQ ID NO: 7839698 - DNA, 22 bp, Homo sapiens
gctgcttctcctccctggggat

SEQ ID NO: 7839699 - DNA, 22 bp, Homo sapiens
gctgcttgattaggttgacact

SEQ ID NO: 7839700 - DNA, 22 bp, Homo sapiens
gctgctttaaaatcagcatagc

SEQ ID NO: 7839701 - DNA, 22 bp, Homo sapiens
gctgcttgattaggttgacact

SEQ ID NO: 7839702 - DNA, 22 bp, Homo sapiens
gctgcttcagggacgtgccagc

SEQ ID NO: 7839703 - DNA, 22 bp, Homo sapiens
gctgcttcctagaaggcccagt

SEQ ID NO: 7839704 - DNA, 22 bp, Homo sapiens
gctgcttcctagaaggcccagt

SEQ ID NO: 7839705 - DNA, 22 bp, Homo sapiens
gctgctgttcctccagtggatc

SEQ ID NO: 7839706 - DNA, 22 bp, Homo sapiens
gctgctgttgatttagtccaat

SEQ ID NO: 7839707 - DNA, 22 bp, Homo sapiens
gctgctgttgatttagtccaat

SEQ ID NO: 7839708 - DNA, 22 bp, Homo sapiens
gctgctgtgttggagagggact

SEQ ID NO: 7839709 - DNA, 21 bp, Homo sapiens
gctgctgtgggccagggaggc

SEQ ID NO: 7839710 - DNA, 22 bp, Homo sapiens
gctgctgtgtgggagacaggcg

SEQ ID NO: 7839711 - DNA, 21 bp, Homo sapiens
gctgctgtgggccagggaggc

SEQ ID NO: 7839712 - DNA, 22 bp, Homo sapiens
gctgctgttatgatgttacttt

SEQ ID NO: 7839713 - DNA, 22 bp, Homo sapiens
gctgctgttcctccagtggatc

SEQ ID NO: 7839714 - DNA, 22 bp, Homo sapiens
gctgctgttcctccagtggatc

SEQ ID NO: 7839715 - DNA, 22 bp, Homo sapiens
gctgctgtgccccatctgcaga

SEQ ID NO: 7839716 - DNA, 22 bp, Homo sapiens
gctgctgtgcctggcgtcctgt

SEQ ID NO: 7839717 - DNA, 22 bp, Homo sapiens
gctgctgtgcctggcgtcctgt

SEQ ID NO: 7839718 - DNA, 21 bp, Homo sapiens
gctgctgtgggccagggaggc

SEQ ID NO: 7839719 - DNA, 21 bp, Homo sapiens
gctgctgtgggccagggaggc

SEQ ID NO: 7839720 - DNA, 21 bp, Homo sapiens
gctgctgtgggccagggaggc

SEQ ID NO: 7839721 - DNA, 22 bp, Homo sapiens
gctgctgtctggtctgagggct

SEQ ID NO: 7839722 - DNA, 22 bp, Homo sapiens
gctgctgtgaattttttaaatg

SEQ ID NO: 7839723 - DNA, 21 bp, Homo sapiens
gctgctcgagatccagtgctt

SEQ ID NO: 7839724 - DNA, 21 bp, Homo sapiens
gctgctcgagatccagtgctt

SEQ ID NO: 7839725 - DNA, 21 bp, Homo sapiens
gctgctcgagatccagtgctt

SEQ ID NO: 7839726 - DNA, 21 bp, Homo sapiens
gctgctcgagatccagtgctt

SEQ ID NO: 7839727 - DNA, 19 bp, Homo sapiens
gctgctcctggctgaccac

SEQ ID NO: 7839728 - DNA, 22 bp, Homo sapiens
gctgctccgtctgagctctggt

SEQ ID NO: 7839729 - DNA, 22 bp, Homo sapiens
gctgctccgtctgagctctggt

SEQ ID NO: 7839730 - DNA, 22 bp, Homo sapiens
gctgctccgtctgagctctggt

SEQ ID NO: 7839731 - DNA, 22 bp, Homo sapiens
gctgctccgcagagtgtgtgtg

SEQ ID NO: 7839732 - DNA, 22 bp, Homo sapiens
gctgctccgtctgagctctggt

SEQ ID NO: 7839733 - DNA, 22 bp, Homo sapiens
gctgctccgcagagtgtgtgtg

SEQ ID NO: 7839734 - DNA, 22 bp, Homo sapiens
gctgctccgcagagtgtgtgtg

SEQ ID NO: 7839735 - DNA, 22 bp, Homo sapiens
gctgctccgtctgagctctggt

SEQ ID NO: 7839736 - DNA, 22 bp, Homo sapiens
gctgctccagctgtgctgcaga

SEQ ID NO: 7839737 - DNA, 22 bp, Homo sapiens
gctgctcatttgtatcctttgt

SEQ ID NO: 7839738 - DNA, 22 bp, Homo sapiens
gctgctcagtgggcctgagcct

SEQ ID NO: 7839739 - DNA, 22 bp, Homo sapiens
gctgctccagctgtgctgcaga

SEQ ID NO: 7839740 - DNA, 22 bp, Homo sapiens
gctgctccagctgtgctgcaga

SEQ ID NO: 7839741 - DNA, 22 bp, Homo sapiens
gctgctccagtgttctgtctag

SEQ ID NO: 7839742 - DNA, 22 bp, Homo sapiens
gctgaggctcaagtcatgggtc

SEQ ID NO: 7839743 - DNA, 22 bp, Homo sapiens
gctgaggctcaagtcatgggtc

SEQ ID NO: 7839744 - DNA, 22 bp, Homo sapiens
gctgaggctcaagtcatgggtc

SEQ ID NO: 7839745 - DNA, 22 bp, Homo sapiens
gctgaggctcaagtcatgggtc

SEQ ID NO: 7839746 - DNA, 22 bp, Homo sapiens
gctgaggcggaaggattgctag

SEQ ID NO: 7839747 - DNA, 22 bp, Homo sapiens
gctgaggctcaagtcatgggtc

SEQ ID NO: 7839748 - DNA, 22 bp, Homo sapiens
gctgaggcggaaggattgctag

SEQ ID NO: 7839749 - DNA, 22 bp, Homo sapiens
gctgaggcggaaggattgctag

SEQ ID NO: 7839750 - DNA, 22 bp, Homo sapiens
gctgaggcggaaggattgctag

SEQ ID NO: 7839751 - DNA, 22 bp, Homo sapiens
gctgaggcctcagaaggctgag

SEQ ID NO: 7839752 - DNA, 22 bp, Homo sapiens
gctgaggcctcagaaggctgag

SEQ ID NO: 7839753 - DNA, 22 bp, Homo sapiens
gctgaggcctcagaaggctgag

SEQ ID NO: 7839754 - DNA, 22 bp, Homo sapiens
gctgaggcctcagaaggctgag

SEQ ID NO: 7839755 - DNA, 22 bp, Homo sapiens
gctgaggcctcagaaggctgag

SEQ ID NO: 7839756 - DNA, 22 bp, Homo sapiens
gctgaggcctcagaaggctgag

SEQ ID NO: 7839757 - DNA, 22 bp, Homo sapiens
gctgaggcctcagaaggctgag

SEQ ID NO: 7839758 - DNA, 22 bp, Homo sapiens
gctgaggcctcagaaggctgag

SEQ ID NO: 7839759 - DNA, 22 bp, Homo sapiens
gctgaggccccagggtgatggg

SEQ ID NO: 7839760 - DNA, 22 bp, Homo sapiens
gctgaggccccagggtgatggg

SEQ ID NO: 7839761 - DNA, 22 bp, Homo sapiens
gctgaggccccagggtgatggg

SEQ ID NO: 7839762 - DNA, 22 bp, Homo sapiens
gctgaggccccagggtgatggg

SEQ ID NO: 7839763 - DNA, 22 bp, Homo sapiens
gctgaggccccagggtgatggg

SEQ ID NO: 7839764 - DNA, 22 bp, Homo sapiens
gctgaggccccagggtgatggg

SEQ ID NO: 7839765 - DNA, 22 bp, Homo sapiens
gctgaggccccagggtgatggg

SEQ ID NO: 7839766 - DNA, 22 bp, Homo sapiens
gctgaggccagtttaatgagga

SEQ ID NO: 7839767 - DNA, 22 bp, Homo sapiens
gctgagagtgggtgcagtgctt

SEQ ID NO: 7839768 - DNA, 22 bp, Homo sapiens
gctgaggccaggccccaccgga

SEQ ID NO: 7839769 - DNA, 22 bp, Homo sapiens
gctgaggccagtttaatgagga

SEQ ID NO: 7839770 - DNA, 22 bp, Homo sapiens
gctgaggccagtttaatgagga

SEQ ID NO: 7839771 - DNA, 22 bp, Homo sapiens
gctgaggccagtttaatgagga

SEQ ID NO: 7839772 - DNA, 22 bp, Homo sapiens
gctgaggctgggagcagcctgt

SEQ ID NO: 7839773 - DNA, 22 bp, Homo sapiens
gctgaggctgggagcagcctgt

SEQ ID NO: 7839774 - DNA, 22 bp, Homo sapiens
gctgaggctgggagcagcctgt

SEQ ID NO: 7839775 - DNA, 22 bp, Homo sapiens
gctgaggctgggagcagcctgt

SEQ ID NO: 7839776 - DNA, 22 bp, Homo sapiens
gctgaggctgggagcagcctgt

SEQ ID NO: 7839777 - DNA, 22 bp, Homo sapiens
gctgaggctgggagcagcctgt

SEQ ID NO: 7839778 - DNA, 22 bp, Homo sapiens
gctgaggctgggagcagcctgt

SEQ ID NO: 7839779 - DNA, 22 bp, Homo sapiens
gctgaggctcctcgggaggaca

SEQ ID NO: 7839780 - DNA, 22 bp, Homo sapiens
gctgaggctcctcgggaggaca

SEQ ID NO: 7839781 - DNA, 22 bp, Homo sapiens
gctgaggctcctcgggaggaca

SEQ ID NO: 7839782 - DNA, 22 bp, Homo sapiens
gctgaggctcctcgggaggaca

SEQ ID NO: 7839783 - DNA, 22 bp, Homo sapiens
gctgaggctcctcgggaggaca

SEQ ID NO: 7839784 - DNA, 22 bp, Homo sapiens
gctgaggctcaatccccttctg

SEQ ID NO: 7839785 - DNA, 22 bp, Homo sapiens
gctgagggaggctgaactgagt

SEQ ID NO: 7839786 - DNA, 22 bp, Homo sapiens
gctgagggatagctgctcactg

SEQ ID NO: 7839787 - DNA, 22 bp, Homo sapiens
gctgagggatagctgctcactg

SEQ ID NO: 7839788 - DNA, 22 bp, Homo sapiens
gctgagggaggctgaactgagt

SEQ ID NO: 7839789 - DNA, 22 bp, Homo sapiens
gctgaggcttagctaaaaattt

SEQ ID NO: 7839790 - DNA, 22 bp, Homo sapiens
gctgaggctgggagcagcctgt

SEQ ID NO: 7839791 - DNA, 21 bp, Homo sapiens
gctgagaggttgggaagttca

SEQ ID NO: 7839792 - DNA, 21 bp, Homo sapiens
gctgagaggttgggaagttca

SEQ ID NO: 7839793 - DNA, 21 bp, Homo sapiens
gctgagaggttgggaagttca

SEQ ID NO: 7839794 - DNA, 22 bp, Homo sapiens
gctgagagtccaggaaaacatc

SEQ ID NO: 7839795 - DNA, 22 bp, Homo sapiens
gctgagagtccaggaaaacatc

SEQ ID NO: 7839796 - DNA, 22 bp, Homo sapiens
gctgagagtgagcactggatat

SEQ ID NO: 7839797 - DNA, 22 bp, Homo sapiens
gctgagagtgagcactggatat

SEQ ID NO: 7839798 - DNA, 22 bp, Homo sapiens
gctgagagtgagcactggatat

SEQ ID NO: 7839799 - DNA, 17 bp, Homo sapiens
gctgagaggcagcacag

SEQ ID NO: 7839800 - DNA, 22 bp, Homo sapiens
gctgagaggcagccagaccctc

SEQ ID NO: 7839801 - DNA, 22 bp, Homo sapiens
gctgagaggcagccagaccctc

SEQ ID NO: 7839802 - DNA, 22 bp, Homo sapiens
gctgagaggcactatctccgga

SEQ ID NO: 7839803 - DNA, 17 bp, Homo sapiens
gctgagaggcagcacag

SEQ ID NO: 7839804 - DNA, 17 bp, Homo sapiens
gctgagaggcagcacag

SEQ ID NO: 7839805 - DNA, 22 bp, Homo sapiens
gctgagaggcactatctccgga

SEQ ID NO: 7839806 - DNA, 22 bp, Homo sapiens
gctgagagcacatagaaggggc

SEQ ID NO: 7839807 - DNA, 22 bp, Homo sapiens
gctgagagcagtgtggccttaa

SEQ ID NO: 7839808 - DNA, 22 bp, Homo sapiens
gctgagagcggccagctgggaa

SEQ ID NO: 7839809 - DNA, 22 bp, Homo sapiens
gctgagagcggccagctgggaa

SEQ ID NO: 7839810 - DNA, 22 bp, Homo sapiens
gctgagagcggccagctgggaa

SEQ ID NO: 7839811 - DNA, 22 bp, Homo sapiens
gctgagagcaaagcatgtctag

SEQ ID NO: 7839812 - DNA, 22 bp, Homo sapiens
gctgagagcaaagcatgtctag

SEQ ID NO: 7839813 - DNA, 22 bp, Homo sapiens
gctgagagcaaagcatgtctag

SEQ ID NO: 7839814 - DNA, 22 bp, Homo sapiens
gctgagagcaaagcatgtctag

SEQ ID NO: 7839815 - DNA, 22 bp, Homo sapiens
gctgagagcaaagcatgtctag

SEQ ID NO: 7839816 - DNA, 22 bp, Homo sapiens
gctgagagcaaggacaaagcat

SEQ ID NO: 7839817 - DNA, 22 bp, Homo sapiens
gctgagagcaaggacaaagcat

SEQ ID NO: 7839818 - DNA, 22 bp, Homo sapiens
gctgagagcacatagaaggggc

SEQ ID NO: 7839819 - DNA, 22 bp, Homo sapiens
gctgagaatcaagatggagagg

SEQ ID NO: 7839820 - DNA, 22 bp, Homo sapiens
gctgagaagtcccatgatccgc

SEQ ID NO: 7839821 - DNA, 22 bp, Homo sapiens
gctgagaatgttcctactggta

SEQ ID NO: 7839822 - DNA, 22 bp, Homo sapiens
gctgagaatgttcctactggta

SEQ ID NO: 7839823 - DNA, 22 bp, Homo sapiens
gctgagaatgttcctactggta

SEQ ID NO: 7839824 - DNA, 22 bp, Homo sapiens
gctgaattttgttctagggttt

SEQ ID NO: 7839825 - DNA, 22 bp, Homo sapiens
gctgacaaacaaggtggtgtca

SEQ ID NO: 7839826 - DNA, 22 bp, Homo sapiens
gctgacaatgagaaagagcaaa

SEQ ID NO: 7839827 - DNA, 22 bp, Homo sapiens
gctgaattcctgctcttggatt

SEQ ID NO: 7839828 - DNA, 23 bp, Homo sapiens
gctgaattaagcaatgaagaaat

SEQ ID NO: 7839829 - DNA, 17 bp, Homo sapiens
gctgagaaggggaagag

SEQ ID NO: 7839830 - DNA, 22 bp, Homo sapiens
gctgacacttagaagtgccctg

SEQ ID NO: 7839831 - DNA, 22 bp, Homo sapiens
gctgacaagtccagagcccttc

SEQ ID NO: 7839832 - DNA, 21 bp, Homo sapiens
gctgagacgcaacctcagtga

SEQ ID NO: 7839833 - DNA, 22 bp, Homo sapiens
gctgagaagtcccatgatccgc

SEQ ID NO: 7839834 - DNA, 22 bp, Homo sapiens
gctgagactggcagcaggaagt

SEQ ID NO: 7839835 - DNA, 22 bp, Homo sapiens
gctgagactggcagcaggaagt

SEQ ID NO: 7839836 - DNA, 22 bp, Homo sapiens
gctgagacttccactgccatct

SEQ ID NO: 7839837 - DNA, 22 bp, Homo sapiens
gctgagagaaaagtgaggttct

SEQ ID NO: 7839838 - DNA, 22 bp, Homo sapiens
gctgagacttccactgccatct

SEQ ID NO: 7839839 - DNA, 22 bp, Homo sapiens
gctgagacttccactgccatct

SEQ ID NO: 7839840 - DNA, 22 bp, Homo sapiens
gctgagagaaaagtgaggttct

SEQ ID NO: 7839841 - DNA, 22 bp, Homo sapiens
gctgagagatcaaggcaggatt

SEQ ID NO: 7839842 - DNA, 22 bp, Homo sapiens
gctgagagatcaaggcaggatt

SEQ ID NO: 7839843 - DNA, 22 bp, Homo sapiens
gctgagagatcaaggcaggatt

SEQ ID NO: 7839844 - DNA, 22 bp, Homo sapiens
gctgagagatcaaggcaggatt

SEQ ID NO: 7839845 - DNA, 22 bp, Homo sapiens
gctgagagaaaagtgaggttct

SEQ ID NO: 7839846 - DNA, 22 bp, Homo sapiens
gctccctgtgctctgagtgata

SEQ ID NO: 7839847 - DNA, 22 bp, Homo sapiens
gctccctgtgggatgaggcgcc

SEQ ID NO: 7839848 - DNA, 22 bp, Homo sapiens
gctccctgttctcagccatgat

SEQ ID NO: 7839849 - DNA, 22 bp, Homo sapiens
gctcccttaggccttgccggga

SEQ ID NO: 7839850 - DNA, 22 bp, Homo sapiens
gctcccttagtccttgccggga

SEQ ID NO: 7839851 - DNA, 22 bp, Homo sapiens
gctccctgttctcagccatgat

SEQ ID NO: 7839852 - DNA, 22 bp, Homo sapiens
gctccctgttctcagccatgat

SEQ ID NO: 7839853 - DNA, 22 bp, Homo sapiens
gctccgtgggcattgctaggtg

SEQ ID NO: 7839854 - DNA, 22 bp, Homo sapiens
gctcctccaatatggactcctc

SEQ ID NO: 7839855 - DNA, 22 bp, Homo sapiens
gctccgtctttattttctctga

SEQ ID NO: 7839856 - DNA, 22 bp, Homo sapiens
gctccgccacgcccactcctac

SEQ ID NO: 7839857 - DNA, 22 bp, Homo sapiens
gctctggctcaaaccaccggct

SEQ ID NO: 7839858 - DNA, 22 bp, Homo sapiens
gctctggctagttacctcttac

SEQ ID NO: 7839859 - DNA, 22 bp, Homo sapiens
gctctggctcaaaccaccggct

SEQ ID NO: 7839860 - DNA, 22 bp, Homo sapiens
gctctggctcaaaccaccggct

SEQ ID NO: 7839861 - DNA, 22 bp, Homo sapiens
gctctggctagttacctcttac

SEQ ID NO: 7839862 - DNA, 22 bp, Homo sapiens
gctctggctagttacctcttac

SEQ ID NO: 7839863 - DNA, 22 bp, Homo sapiens
gctcctctcccagagctgcagg

SEQ ID NO: 7839864 - DNA, 22 bp, Homo sapiens
gctcctctcccagagctgcagg

SEQ ID NO: 7839865 - DNA, 22 bp, Homo sapiens
gctcctctattccccacatttt

SEQ ID NO: 7839866 - DNA, 22 bp, Homo sapiens
gctcctctattccccacatttt

SEQ ID NO: 7839867 - DNA, 22 bp, Homo sapiens
gctcctccctgtgcagacccag

SEQ ID NO: 7839868 - DNA, 22 bp, Homo sapiens
gctcctccaatatggactcctc

SEQ ID NO: 7839869 - DNA, 22 bp, Homo sapiens
gctcctccctgtgcagacccag

SEQ ID NO: 7839870 - DNA, 22 bp, Homo sapiens
gctcctccctgtgcagacccag

SEQ ID NO: 7839871 - DNA, 18 bp, Homo sapiens
gctctggctcacctccag

SEQ ID NO: 7839872 - DNA, 18 bp, Homo sapiens
gctctggctcacctccag

SEQ ID NO: 7839873 - DNA, 18 bp, Homo sapiens
gctctggctcacctccag

SEQ ID NO: 7839874 - DNA, 22 bp, Homo sapiens
gctctggctcaaaccaccggct

SEQ ID NO: 7839875 - DNA, 22 bp, Homo sapiens
gctctggctcaaaccaccggct

SEQ ID NO: 7839876 - DNA, 22 bp, Homo sapiens
gctctggctcaaaccaccggct

SEQ ID NO: 7839877 - DNA, 22 bp, Homo sapiens
gctctggcttggggcactcgtc

SEQ ID NO: 7839878 - DNA, 22 bp, Homo sapiens
gctctggcttggggcactcgtc

SEQ ID NO: 7839879 - DNA, 22 bp, Homo sapiens
gctctggcttggggcactcgtc

SEQ ID NO: 7839880 - DNA, 18 bp, Homo sapiens
gctctggctcacctccag

SEQ ID NO: 7839881 - DNA, 22 bp, Homo sapiens
gctctgggaactgactgccttc

SEQ ID NO: 7839882 - DNA, 22 bp, Homo sapiens
gctctgggaactgactgccttc

SEQ ID NO: 7839883 - DNA, 22 bp, Homo sapiens
gctctggcttggggcactcgtc

SEQ ID NO: 7839884 - DNA, 22 bp, Homo sapiens
gctctgggaattcagaaagcct

SEQ ID NO: 7839885 - DNA, 22 bp, Homo sapiens
gctctgggaattcagaaagcct

SEQ ID NO: 7839886 - DNA, 22 bp, Homo sapiens
gctctgggaagtcctttaccat

SEQ ID NO: 7839887 - DNA, 22 bp, Homo sapiens
gctctgggaagtcctttaccat

SEQ ID NO: 7839888 - DNA, 22 bp, Homo sapiens
gctctgggaaggatcgtagtga

SEQ ID NO: 7839889 - DNA, 22 bp, Homo sapiens
gctctgggaaggatcgtagtga

SEQ ID NO: 7839890 - DNA, 22 bp, Homo sapiens
gctctgggaaggatcgtagtga

SEQ ID NO: 7839891 - DNA, 22 bp, Homo sapiens
gctctgggaaggatcgtagtga

SEQ ID NO: 7839892 - DNA, 22 bp, Homo sapiens
gctctgggaactgactgccttc

SEQ ID NO: 7839893 - DNA, 22 bp, Homo sapiens
gctctgggaactgactgccttc

SEQ ID NO: 7839894 - DNA, 22 bp, Homo sapiens
gctctgggaactgactgccttc

SEQ ID NO: 7839895 - DNA, 22 bp, Homo sapiens
gctctgggccgggcaccagcct

SEQ ID NO: 7839896 - DNA, 22 bp, Homo sapiens
gctctgggccgggcaccagcct

SEQ ID NO: 7839897 - DNA, 22 bp, Homo sapiens
gctctgggccgggcaccagcct

SEQ ID NO: 7839898 - DNA, 22 bp, Homo sapiens
gctctgggccgggcaccagcct

SEQ ID NO: 7839899 - DNA, 22 bp, Homo sapiens
gctctgggccatcctggccggg

SEQ ID NO: 7839900 - DNA, 22 bp, Homo sapiens
gctctgggccatcctggccggg

SEQ ID NO: 7839901 - DNA, 22 bp, Homo sapiens
gctctgggccatcctggccggg

SEQ ID NO: 7839902 - DNA, 22 bp, Homo sapiens
gctctgggccatcctggccggg

SEQ ID NO: 7839903 - DNA, 22 bp, Homo sapiens
gctctgggccatcctggccggg

SEQ ID NO: 7839904 - DNA, 22 bp, Homo sapiens
gctctgggccatcctggccggg

SEQ ID NO: 7839905 - DNA, 22 bp, Homo sapiens
gctctgggccatcctggccggg

SEQ ID NO: 7839906 - DNA, 22 bp, Homo sapiens
gctctgggattaccagccttag

SEQ ID NO: 7839907 - DNA, 20 bp, Homo sapiens
gctctgggagggatgtgatg

SEQ ID NO: 7839908 - DNA, 20 bp, Homo sapiens
gctctgggagggatgtgatg

SEQ ID NO: 7839909 - DNA, 20 bp, Homo sapiens
gctctgggagggatgtgatg

SEQ ID NO: 7839910 - DNA, 22 bp, Homo sapiens
gctctgggaattcagaaagcct

SEQ ID NO: 7839911 - DNA, 22 bp, Homo sapiens
gctctgggaattcagaaagcct

SEQ ID NO: 7839912 - DNA, 22 bp, Homo sapiens
gctctgggaattcagaaagcct

SEQ ID NO: 7839913 - DNA, 22 bp, Homo sapiens
gctctgggattaccagccttag

SEQ ID NO: 7839914 - DNA, 22 bp, Homo sapiens
gctctgggattaccagccttag

SEQ ID NO: 7839915 - DNA, 22 bp, Homo sapiens
gctctgggattaccagccttag

SEQ ID NO: 7839916 - DNA, 22 bp, Homo sapiens
gctctgggattaccagccttag

SEQ ID NO: 7839917 - DNA, 22 bp, Homo sapiens
gctgaatgaatgtattttaaaa

SEQ ID NO: 7839918 - DNA, 23 bp, Homo sapiens
gctgaattaagcaatgaagaaat

SEQ ID NO: 7839919 - DNA, 22 bp, Homo sapiens
gctgaataggcacagagggcat

SEQ ID NO: 7839920 - DNA, 22 bp, Homo sapiens
gctgaataggggtcccaaagat

SEQ ID NO: 7839921 - DNA, 22 bp, Homo sapiens
gctctggggttggaaagtgatc

SEQ ID NO: 7839922 - DNA, 22 bp, Homo sapiens
gctctggggttggaaagtgatc

SEQ ID NO: 7839923 - DNA, 22 bp, Homo sapiens
gctctggggatgcttctgccgt

SEQ ID NO: 7839924 - DNA, 22 bp, Homo sapiens
gctctggggcccagggatcaca

SEQ ID NO: 7839925 - DNA, 22 bp, Homo sapiens
gctctggggcccagggatcaca

SEQ ID NO: 7839926 - DNA, 22 bp, Homo sapiens
gctctggggcccagggatcaca

SEQ ID NO: 7839927 - DNA, 22 bp, Homo sapiens
gctctggggcccagggatcaca

SEQ ID NO: 7839928 - DNA, 22 bp, Homo sapiens
gctctggggcccagggatcaca

SEQ ID NO: 7839929 - DNA, 22 bp, Homo sapiens
gctctgggctgccctctggaca

SEQ ID NO: 7839930 - DNA, 22 bp, Homo sapiens
gctctgggctgccctctggaca

SEQ ID NO: 7839931 - DNA, 22 bp, Homo sapiens
gctctgggctgccctctggaca

SEQ ID NO: 7839932 - DNA, 22 bp, Homo sapiens
gctctgggctgccctctggaca

SEQ ID NO: 7839933 - DNA, 22 bp, Homo sapiens
gctctgggctgaatcatttatc

SEQ ID NO: 7839934 - DNA, 22 bp, Homo sapiens
gctctgggccgggcaccagcct

SEQ ID NO: 7839935 - DNA, 22 bp, Homo sapiens
gctctgggctgaatcatttatc

SEQ ID NO: 7839936 - DNA, 22 bp, Homo sapiens
gctctgggctgaatcatttatc

SEQ ID NO: 7839937 - DNA, 22 bp, Homo sapiens
gctctggggatgcttctgccgt

SEQ ID NO: 7839938 - DNA, 22 bp, Homo sapiens
gctctggggatgcttctgccgt

SEQ ID NO: 7839939 - DNA, 22 bp, Homo sapiens
gctctgggctgccctctggaca

SEQ ID NO: 7839940 - DNA, 22 bp, Homo sapiens
gctctgggctgccctctggaca

SEQ ID NO: 7839941 - DNA, 22 bp, Homo sapiens
gctctgggctgccctctggaca

SEQ ID NO: 7839942 - DNA, 22 bp, Homo sapiens
gctctgggctgccctctggaca

SEQ ID NO: 7839943 - DNA, 22 bp, Homo sapiens
gctcagagggaacaaggggctg

SEQ ID NO: 7839944 - DNA, 22 bp, Homo sapiens
gctcagagcttgaagttccact

SEQ ID NO: 7839945 - DNA, 22 bp, Homo sapiens
gctcagaggaggcctttaccta

SEQ ID NO: 7839946 - DNA, 22 bp, Homo sapiens
gctcagaggccaagtgcccgcc

SEQ ID NO: 7839947 - DNA, 22 bp, Homo sapiens
gctcagaggccaagtgcccgcc

SEQ ID NO: 7839948 - DNA, 22 bp, Homo sapiens
gctactgattgaccttggagag

SEQ ID NO: 7839949 - DNA, 22 bp, Homo sapiens
gctactgattgaccttggagag

SEQ ID NO: 7839950 - DNA, 22 bp, Homo sapiens
gctactgattgaccttggagag

SEQ ID NO: 7839951 - DNA, 22 bp, Homo sapiens
gctcagagcttgaagttccact

SEQ ID NO: 7839952 - DNA, 22 bp, Homo sapiens
gctactttgcagctagctagga

SEQ ID NO: 7839953 - DNA, 17 bp, Homo sapiens
gctactggttacctcta

SEQ ID NO: 7839954 - DNA, 22 bp, Homo sapiens
gctacatagtaacccacaaatc

SEQ ID NO: 7839955 - DNA, 20 bp, Homo sapiens
gctaccagaacaaggccatt

SEQ ID NO: 7839956 - DNA, 22 bp, Homo sapiens
gctacaggtgacagcctctgca

SEQ ID NO: 7839957 - DNA, 22 bp, Homo sapiens
gctaccctgggaatctccctca

SEQ ID NO: 7839958 - DNA, 22 bp, Homo sapiens
gctactaggaagattccaggat

SEQ ID NO: 7839959 - DNA, 19 bp, Homo sapiens
gctactgaggcccaggacc

SEQ ID NO: 7839960 - DNA, 23 bp, Homo sapiens
gctcagaggtttttctctggatg

SEQ ID NO: 7839961 - DNA, 21 bp, Homo sapiens
gctcagagtattgcactgttt

SEQ ID NO: 7839962 - DNA, 22 bp, Homo sapiens
gctcagagtggcctggctaggg

SEQ ID NO: 7839963 - DNA, 22 bp, Homo sapiens
gctcagagtggcctggctaggg

SEQ ID NO: 7839964 - DNA, 22 bp, Homo sapiens
gctcagagtggcctggctaggg

SEQ ID NO: 7839965 - DNA, 19 bp, Homo sapiens
gctcagagtccccctgcgg

SEQ ID NO: 7839966 - DNA, 22 bp, Homo sapiens
gctcagagtggcctggctaggg

SEQ ID NO: 7839967 - DNA, 22 bp, Homo sapiens
gctcagagtggcctggctaggg

SEQ ID NO: 7839968 - DNA, 19 bp, Homo sapiens
gctcagagtccccctgcgg

SEQ ID NO: 7839969 - DNA, 23 bp, Homo sapiens
gctcagaggtttttctctggatg

SEQ ID NO: 7839970 - DNA, 23 bp, Homo sapiens
gctcagaggtttttctctggatg

SEQ ID NO: 7839971 - DNA, 23 bp, Homo sapiens
gctcagaggtttttctctggatg

SEQ ID NO: 7839972 - DNA, 22 bp, Homo sapiens
gctcagaggttgttcttgggtt

SEQ ID NO: 7839973 - DNA, 22 bp, Homo sapiens
gctcagaggttgttcttgggtt

SEQ ID NO: 7839974 - DNA, 22 bp, Homo sapiens
gctcagagggttttggccaagt

SEQ ID NO: 7839975 - DNA, 22 bp, Homo sapiens
gctcagagggttttggccaagt

SEQ ID NO: 7839976 - DNA, 22 bp, Homo sapiens
gctcagagggttttggccaagt

SEQ ID NO: 7839977 - DNA, 19 bp, Homo sapiens
gctcagagggccctgtgct

SEQ ID NO: 7839978 - DNA, 19 bp, Homo sapiens
gctcagagggccctgtgct

SEQ ID NO: 7839979 - DNA, 22 bp, Homo sapiens
gctcagagttaaatatagtgct

SEQ ID NO: 7839980 - DNA, 22 bp, Homo sapiens
gctcagagttaattggatgggt

SEQ ID NO: 7839981 - DNA, 22 bp, Homo sapiens
gctcagagttaaatatagtgct

SEQ ID NO: 7839982 - DNA, 22 bp, Homo sapiens
gctcagagttaattggatgggt

SEQ ID NO: 7839983 - DNA, 22 bp, Homo sapiens
gctcagccgaacttcagagcag

SEQ ID NO: 7839984 - DNA, 22 bp, Homo sapiens
gctcagccgaacttcagagcag

SEQ ID NO: 7839985 - DNA, 22 bp, Homo sapiens
gctcagccgaacttcagagcag

SEQ ID NO: 7839986 - DNA, 19 bp, Homo sapiens
gctcagcagacccagtgct

SEQ ID NO: 7839987 - DNA, 21 bp, Homo sapiens
gctcagcaaaggtgaggtgca

SEQ ID NO: 7839988 - DNA, 18 bp, Homo sapiens
gctcagctatgggaggtt

SEQ ID NO: 7839989 - DNA, 22 bp, Homo sapiens
gctcagctctatggacacaaag

SEQ ID NO: 7839990 - DNA, 22 bp, Homo sapiens
gctcagctgagcgaaggacatg

SEQ ID NO: 7839991 - DNA, 22 bp, Homo sapiens
gctcagctacttacaggtggct

SEQ ID NO: 7839992 - DNA, 22 bp, Homo sapiens
gctcagctatcagtgttcctga

SEQ ID NO: 7839993 - DNA, 18 bp, Homo sapiens
gctcagctatgggaggtt

SEQ ID NO: 7839994 - DNA, 22 bp, Homo sapiens
gctcagctacttacaggtggct

SEQ ID NO: 7839995 - DNA, 22 bp, Homo sapiens
gctcagctacttacaggtggct

SEQ ID NO: 7839996 - DNA, 23 bp, Homo sapiens
gctcagcctcagcaggcccagga

SEQ ID NO: 7839997 - DNA, 22 bp, Homo sapiens
gctcagccgaacttcagagcag

SEQ ID NO: 7839998 - DNA, 22 bp, Homo sapiens
gctcagccgaacttcagagcag

SEQ ID NO: 7839999 - DNA, 22 bp, Homo sapiens
gctcagccgaacttcagagcag

SEQ ID NO: 7840000 - DNA, 22 bp, Homo sapiens
gctccaggcagagcctctttcg

SEQ ID NO: 7840001 - DNA, 22 bp, Homo sapiens
gctccaggcagagcctctttcg

SEQ ID NO: 7840002 - DNA, 22 bp, Homo sapiens
gctccaggataataaagttgtt

SEQ ID NO: 7840003 - DNA, 22 bp, Homo sapiens
gctccaggataataaagttgtt

SEQ ID NO: 7840004 - DNA, 22 bp, Homo sapiens
gctcagctgagcgaaggacatg

SEQ ID NO: 7840005 - DNA, 22 bp, Homo sapiens
gctccaggaggctcccgcgtct

SEQ ID NO: 7840006 - DNA, 22 bp, Homo sapiens
gctccaggaggctcccgcgtct

SEQ ID NO: 7840007 - DNA, 22 bp, Homo sapiens
gctccagggtcagctcagaact

SEQ ID NO: 7840008 - DNA, 22 bp, Homo sapiens
gctccagggtggatgacaattc

SEQ ID NO: 7840009 - DNA, 22 bp, Homo sapiens
gctccagggtggatgacaattc

SEQ ID NO: 7840010 - DNA, 22 bp, Homo sapiens
gctccagggagtacatttatca

SEQ ID NO: 7840011 - DNA, 22 bp, Homo sapiens
gctccagggacccaagagaaaa

SEQ ID NO: 7840012 - DNA, 22 bp, Homo sapiens
gctccagggtcagctcagaact

SEQ ID NO: 7840013 - DNA, 22 bp, Homo sapiens
gctccagggtcagctcagaact

SEQ ID NO: 7840014 - DNA, 22 bp, Homo sapiens
gctccaggtgaatcctctcacc

SEQ ID NO: 7840015 - DNA, 22 bp, Homo sapiens
gctccaggtgaatcctctcacc

SEQ ID NO: 7840016 - DNA, 22 bp, Homo sapiens
gctccaggtgaatcctctcacc

SEQ ID NO: 7840017 - DNA, 22 bp, Homo sapiens
gctccaggtgaatcctctcacc

SEQ ID NO: 7840018 - DNA, 20 bp, Homo sapiens
gctccaggtcagagaggacg

SEQ ID NO: 7840019 - DNA, 20 bp, Homo sapiens
gctccaggtcagagaggacg

SEQ ID NO: 7840020 - DNA, 20 bp, Homo sapiens
gctccaggtcagagaggacg

SEQ ID NO: 7840021 - DNA, 20 bp, Homo sapiens
gctccaggtcagagaggacg

SEQ ID NO: 7840022 - DNA, 22 bp, Homo sapiens
gctccaggtatttgccctttta

SEQ ID NO: 7840023 - DNA, 22 bp, Homo sapiens
gctccagtggactgggggaggc

SEQ ID NO: 7840024 - DNA, 22 bp, Homo sapiens
gctcccaactcaggcctcctcc

SEQ ID NO: 7840025 - DNA, 22 bp, Homo sapiens
gctccaggtgtcccaggtaaaa

SEQ ID NO: 7840026 - DNA, 22 bp, Homo sapiens
gctccaggtgtcccaggtaaaa

SEQ ID NO: 7840027 - DNA, 22 bp, Homo sapiens
gctccaggtgtcccaggtaaaa

SEQ ID NO: 7840028 - DNA, 22 bp, Homo sapiens
gctccaggtggcttatttgtat

SEQ ID NO: 7840029 - DNA, 22 bp, Homo sapiens
gctcccaactcaggcctcctcc

SEQ ID NO: 7840030 - DNA, 22 bp, Homo sapiens
gctcccaccttaaccttcacat

SEQ ID NO: 7840031 - DNA, 22 bp, Homo sapiens
gctcccacctccagcctgagtt

SEQ ID NO: 7840032 - DNA, 22 bp, Homo sapiens
gctcccacctccagcctgagtt

SEQ ID NO: 7840033 - DNA, 22 bp, Homo sapiens
gctcccactgcagccctgagcc

SEQ ID NO: 7840034 - DNA, 22 bp, Homo sapiens
gctcccagaaccaaggctgggg

SEQ ID NO: 7840035 - DNA, 22 bp, Homo sapiens
gctcccagaaccaaggctgggg

SEQ ID NO: 7840036 - DNA, 22 bp, Homo sapiens
gctcccagaaccaaggctgggg

SEQ ID NO: 7840037 - DNA, 22 bp, Homo sapiens
gctcccagaaccaaggctgggg

SEQ ID NO: 7840038 - DNA, 22 bp, Homo sapiens
gctcccagaaccaaggctgggg

SEQ ID NO: 7840039 - DNA, 22 bp, Homo sapiens
gctcccagactgaccagaggtg

SEQ ID NO: 7840040 - DNA, 22 bp, Homo sapiens
gctcccagaaccaaggctgggg

SEQ ID NO: 7840041 - DNA, 22 bp, Homo sapiens
gctccctggcttttacagtgta

SEQ ID NO: 7840042 - DNA, 22 bp, Homo sapiens
gctccctggcttttacagtgta

SEQ ID NO: 7840043 - DNA, 22 bp, Homo sapiens
gctccctggcttttacagtgta

SEQ ID NO: 7840044 - DNA, 22 bp, Homo sapiens
gctccctggtagccatgctctc

SEQ ID NO: 7840045 - DNA, 20 bp, Homo sapiens
gctccctggtagaaatgttt

SEQ ID NO: 7840046 - DNA, 21 bp, Homo sapiens
gctccctgctcagctcctggg

SEQ ID NO: 7840047 - DNA, 21 bp, Homo sapiens
gctccctgctcagctcctggg

SEQ ID NO: 7840048 - DNA, 22 bp, Homo sapiens
gctccctgctccttcaccgacc

SEQ ID NO: 7840049 - DNA, 22 bp, Homo sapiens
gctccctggaatgttggctgcc

SEQ ID NO: 7840050 - DNA, 22 bp, Homo sapiens
gctccctggaatgttggctgcc

SEQ ID NO: 7840051 - DNA, 18 bp, Homo sapiens
gctccctggatgttactc

SEQ ID NO: 7840052 - DNA, 23 bp, Homo sapiens
gctccctgtccctgcacttaggc

SEQ ID NO: 7840053 - DNA, 23 bp, Homo sapiens
gctccctgtccctgcacttaggc

SEQ ID NO: 7840054 - DNA, 23 bp, Homo sapiens
gctccctgtgctccaggagatgc

SEQ ID NO: 7840055 - DNA, 23 bp, Homo sapiens
gctccctgtgctccaggagatgc

SEQ ID NO: 7840056 - DNA, 22 bp, Homo sapiens
gctccctggtagccatgctctc

SEQ ID NO: 7840057 - DNA, 22 bp, Homo sapiens
gctccctggtagccatgctctc

SEQ ID NO: 7840058 - DNA, 22 bp, Homo sapiens
gctccctggtagccatgctctc

SEQ ID NO: 7840059 - DNA, 22 bp, Homo sapiens
gctccctggtagccatgctctc

SEQ ID NO: 7840060 - DNA, 22 bp, Homo sapiens
gctccctggtattgctgccact

SEQ ID NO: 7840061 - DNA, 22 bp, Homo sapiens
gctccctggtattgctgccact

SEQ ID NO: 7840062 - DNA, 22 bp, Homo sapiens
gctccctggtattgctgccact

SEQ ID NO: 7840063 - DNA, 22 bp, Homo sapiens
gctccctggtattgctgccact

SEQ ID NO: 7840064 - DNA, 22 bp, Homo sapiens
gctccctggtattgctgccact

SEQ ID NO: 7840065 - DNA, 22 bp, Homo sapiens
gctccctggtattgctgccact

SEQ ID NO: 7840066 - DNA, 21 bp, Homo sapiens
gctccctgctcagctcctggg

SEQ ID NO: 7840067 - DNA, 21 bp, Homo sapiens
gctccctgctcagctcctggg

SEQ ID NO: 7840068 - DNA, 22 bp, Homo sapiens
gctccctgcctacacggacctt

SEQ ID NO: 7840069 - DNA, 22 bp, Homo sapiens
gctccctgcactctgcagccct

SEQ ID NO: 7840070 - DNA, 22 bp, Homo sapiens
gctccctgcactctgcagccct

SEQ ID NO: 7840071 - DNA, 22 bp, Homo sapiens
gctccctgcactctgcagccct

SEQ ID NO: 7840072 - DNA, 22 bp, Homo sapiens
gctccctgcagctgagagttcc

SEQ ID NO: 7840073 - DNA, 22 bp, Homo sapiens
gctccctgcagctgagagttcc

SEQ ID NO: 7840074 - DNA, 22 bp, Homo sapiens
gctccctgcatttcccaccctt

SEQ ID NO: 7840075 - DNA, 17 bp, Homo sapiens
gctccctgaggacagct

SEQ ID NO: 7840076 - DNA, 17 bp, Homo sapiens
gctccctgaggacagct

SEQ ID NO: 7840077 - DNA, 17 bp, Homo sapiens
gctccctgaggacagct

SEQ ID NO: 7840078 - DNA, 22 bp, Homo sapiens
gctccctgactcagttcctgag

SEQ ID NO: 7840079 - DNA, 22 bp, Homo sapiens
gctccctgactcagttcctgag

SEQ ID NO: 7840080 - DNA, 22 bp, Homo sapiens
gctccctgactcagttcctgag

SEQ ID NO: 7840081 - DNA, 22 bp, Homo sapiens
gctccctgactcagttcctgag

SEQ ID NO: 7840082 - DNA, 17 bp, Homo sapiens
gctccctgaggacagct

SEQ ID NO: 7840083 - DNA, 17 bp, Homo sapiens
gctccctgaggacagct

SEQ ID NO: 7840084 - DNA, 22 bp, Homo sapiens
gctccctgcactctgcagccct

SEQ ID NO: 7840085 - DNA, 17 bp, Homo sapiens
gctccctgaggacagct

SEQ ID NO: 7840086 - DNA, 17 bp, Homo sapiens
gctccctgaggacagct

SEQ ID NO: 7840087 - DNA, 17 bp, Homo sapiens
gctccctgaggacagct

SEQ ID NO: 7840088 - DNA, 22 bp, Homo sapiens
gcgtggggcagcccagggcttc

SEQ ID NO: 7840089 - DNA, 22 bp, Homo sapiens
gcgtggggcagcccagggcttc

SEQ ID NO: 7840090 - DNA, 22 bp, Homo sapiens
gcgtggggcagcccagggcttc

SEQ ID NO: 7840091 - DNA, 22 bp, Homo sapiens
gcgtgggctggactgggatgaa

SEQ ID NO: 7840092 - DNA, 22 bp, Homo sapiens
gcgtgggctggactgggatgaa

SEQ ID NO: 7840093 - DNA, 22 bp, Homo sapiens
gcgtggagacaactctggggtg

SEQ ID NO: 7840094 - DNA, 22 bp, Homo sapiens
gcgtggagacaactctggggtg

SEQ ID NO: 7840095 - DNA, 18 bp, Homo sapiens
gcgtggagcgggctcggt

SEQ ID NO: 7840096 - DNA, 22 bp, Homo sapiens
gcgtggcttagagtggggtacc

SEQ ID NO: 7840097 - DNA, 22 bp, Homo sapiens
gcgtggcttagagtggggtacc

SEQ ID NO: 7840098 - DNA, 22 bp, Homo sapiens
gcgtggcttagagtggggtacc

SEQ ID NO: 7840099 - DNA, 22 bp, Homo sapiens
gctacagagctctgtgaagaga

SEQ ID NO: 7840100 - DNA, 22 bp, Homo sapiens
gctacagagctctgtgaagaga

SEQ ID NO: 7840101 - DNA, 22 bp, Homo sapiens
gctacagatttatcatgttata

SEQ ID NO: 7840102 - DNA, 22 bp, Homo sapiens
gctacaggagataaaggcctct

SEQ ID NO: 7840103 - DNA, 22 bp, Homo sapiens
gctacaggagataaaggcctct

SEQ ID NO: 7840104 - DNA, 22 bp, Homo sapiens
gctacaggagctgtcacatgct

SEQ ID NO: 7840105 - DNA, 22 bp, Homo sapiens
gctacaggtatatagatgaaac

SEQ ID NO: 7840106 - DNA, 22 bp, Homo sapiens
gctacaggtgacagcctctgca

SEQ ID NO: 7840107 - DNA, 22 bp, Homo sapiens
gcggtgggggaaaggagcggtt

SEQ ID NO: 7840108 - DNA, 22 bp, Homo sapiens
gcgtccagggaaggcccagctg

SEQ ID NO: 7840109 - DNA, 23 bp, Homo sapiens
gcgtcaggactgttttgtgaccc

SEQ ID NO: 7840110 - DNA, 22 bp, Homo sapiens
gcgtctcaaggcccccaggcca

SEQ ID NO: 7840111 - DNA, 22 bp, Homo sapiens
gcgtctcaaggcccccaggcca

SEQ ID NO: 7840112 - DNA, 22 bp, Homo sapiens
gcgtctcaaggcccccaggcca

SEQ ID NO: 7840113 - DNA, 22 bp, Homo sapiens
gcgtctcaaggcccccaggcca

SEQ ID NO: 7840114 - DNA, 22 bp, Homo sapiens
gcgtgcatgcatgtatatgtgt

SEQ ID NO: 7840115 - DNA, 22 bp, Homo sapiens
gcgtgcatggccgtgtgtatgc

SEQ ID NO: 7840116 - DNA, 22 bp, Homo sapiens
gcgtggagacaactctggggtg

SEQ ID NO: 7840117 - DNA, 22 bp, Homo sapiens
gcggtgggggaaaggagcggtt

SEQ ID NO: 7840118 - DNA, 22 bp, Homo sapiens
gcggtgggggaaaggagcggtt

SEQ ID NO: 7840119 - DNA, 22 bp, Homo sapiens
gcggtgggggaaaggagcggtt

SEQ ID NO: 7840120 - DNA, 22 bp, Homo sapiens
gcggtgggggaaaggagcggtt

SEQ ID NO: 7840121 - DNA, 22 bp, Homo sapiens
gcggtggggaaaggaggtgctg

SEQ ID NO: 7840122 - DNA, 22 bp, Homo sapiens
gcggtgggggaaaggagcggtt

SEQ ID NO: 7840123 - DNA, 22 bp, Homo sapiens
gcggtggggaaaggaggtgctg

SEQ ID NO: 7840124 - DNA, 22 bp, Homo sapiens
gcggtggggaaaggaggtgctg

SEQ ID NO: 7840125 - DNA, 22 bp, Homo sapiens
gcggtggggaaaggaggtgctg

SEQ ID NO: 7840126 - DNA, 22 bp, Homo sapiens
gcggtggggaaaggaggtgctg

SEQ ID NO: 7840127 - DNA, 22 bp, Homo sapiens
gcggtggggaaaggaggtgctg

SEQ ID NO: 7840128 - DNA, 22 bp, Homo sapiens
gcggtcggcagaggggctctgc

SEQ ID NO: 7840129 - DNA, 22 bp, Homo sapiens
gcggtggagccaggcctgggct

SEQ ID NO: 7840130 - DNA, 22 bp, Homo sapiens
gcggtcggcagaggggctctgc

SEQ ID NO: 7840131 - DNA, 22 bp, Homo sapiens
gcggtcggcagaggggctctgc

SEQ ID NO: 7840132 - DNA, 22 bp, Homo sapiens
gcggtagctcaagcttgtaatc

SEQ ID NO: 7840133 - DNA, 22 bp, Homo sapiens
gccttgtttcattacacgtggt

SEQ ID NO: 7840134 - DNA, 22 bp, Homo sapiens
gccttggttggccagcaggtcc

SEQ ID NO: 7840135 - DNA, 22 bp, Homo sapiens
gccttgtttctctcccagataa

SEQ ID NO: 7840136 - DNA, 22 bp, Homo sapiens
gcctttagactttgggacttat

SEQ ID NO: 7840137 - DNA, 22 bp, Homo sapiens
gcctttaaagctggcaggcttt

SEQ ID NO: 7840138 - DNA, 22 bp, Homo sapiens
gcctttatattacatttggaag

SEQ ID NO: 7840139 - DNA, 17 bp, Homo sapiens
gcctttatacatgctgc

SEQ ID NO: 7840140 - DNA, 22 bp, Homo sapiens
gcctttatatccctgatatcta

SEQ ID NO: 7840141 - DNA, 22 bp, Homo sapiens
gcctttatatccctgatatcta

SEQ ID NO: 7840142 - DNA, 22 bp, Homo sapiens
gcctttatccctgtacaaggtg

SEQ ID NO: 7840143 - DNA, 22 bp, Homo sapiens
gcctttatccctgtacaaggtg

SEQ ID NO: 7840144 - DNA, 22 bp, Homo sapiens
gcctttatatttttctggtgtt

SEQ ID NO: 7840145 - DNA, 22 bp, Homo sapiens
gcctttatcagtttcatggctt

SEQ ID NO: 7840146 - DNA, 22 bp, Homo sapiens
gcctttatcagtttcatggctt

SEQ ID NO: 7840147 - DNA, 22 bp, Homo sapiens
gcctttcacagagatttaaaaa

SEQ ID NO: 7840148 - DNA, 23 bp, Homo sapiens
gcctttattaggcacaggggtac

SEQ ID NO: 7840149 - DNA, 22 bp, Homo sapiens
gcctttattttcaacggagtgt

SEQ ID NO: 7840150 - DNA, 22 bp, Homo sapiens
gcctttattttcaacggagtgt

SEQ ID NO: 7840151 - DNA, 22 bp, Homo sapiens
gcctttattgtttattcagtgc

SEQ ID NO: 7840152 - DNA, 22 bp, Homo sapiens
gcctttatttacgaaagggaaa

SEQ ID NO: 7840153 - DNA, 22 bp, Homo sapiens
gcctttcactggtgccggctgt

SEQ ID NO: 7840154 - DNA, 22 bp, Homo sapiens
gcctttcactggtgccggctgt

SEQ ID NO: 7840155 - DNA, 22 bp, Homo sapiens
gcctttcagtgccttctgttca

SEQ ID NO: 7840156 - DNA, 22 bp, Homo sapiens
gcctttcacagagatttaaaaa

SEQ ID NO: 7840157 - DNA, 22 bp, Homo sapiens
gcctttcagtgccttctgttca

SEQ ID NO: 7840158 - DNA, 22 bp, Homo sapiens
gcctttcatctcagctggccgg

SEQ ID NO: 7840159 - DNA, 22 bp, Homo sapiens
gcctttatgtctgaaaatcagc

SEQ ID NO: 7840160 - DNA, 22 bp, Homo sapiens
gcctttatgtctgaaaatcagc

SEQ ID NO: 7840161 - DNA, 22 bp, Homo sapiens
gcctttattgtttattcagtgc

SEQ ID NO: 7840162 - DNA, 23 bp, Homo sapiens
gcctttattaggcacaggggtac

SEQ ID NO: 7840163 - DNA, 22 bp, Homo sapiens
gcctttattgtttattcagtgc

SEQ ID NO: 7840164 - DNA, 22 bp, Homo sapiens
gcctttatccctgtacaaggtg

SEQ ID NO: 7840165 - DNA, 22 bp, Homo sapiens
gcctttatcttcctgattcaga

SEQ ID NO: 7840166 - DNA, 22 bp, Homo sapiens
gcctttatcttcctgattcaga

SEQ ID NO: 7840167 - DNA, 22 bp, Homo sapiens
gcctttatcttcctgattcaga

SEQ ID NO: 7840168 - DNA, 22 bp, Homo sapiens
gcctttatcttgggccaagttt

SEQ ID NO: 7840169 - DNA, 22 bp, Homo sapiens
gcctttgaattgttgtggtgag

SEQ ID NO: 7840170 - DNA, 18 bp, Homo sapiens
gcctttgaatgagggatt

SEQ ID NO: 7840171 - DNA, 18 bp, Homo sapiens
gcctttgaatgagggatt

SEQ ID NO: 7840172 - DNA, 22 bp, Homo sapiens
gcctttcatgcttggagggcca

SEQ ID NO: 7840173 - DNA, 22 bp, Homo sapiens
gcctttcctgctctggcattca

SEQ ID NO: 7840174 - DNA, 22 bp, Homo sapiens
gcctttcctgctctggcattca

SEQ ID NO: 7840175 - DNA, 22 bp, Homo sapiens
gcctttcatgcttggagggcca

SEQ ID NO: 7840176 - DNA, 22 bp, Homo sapiens
gcctttcagttccatcaaagga

SEQ ID NO: 7840177 - DNA, 22 bp, Homo sapiens
gcctttcatctcagctggccgg

SEQ ID NO: 7840178 - DNA, 22 bp, Homo sapiens
gcctttgctgtgacaatgctgg

SEQ ID NO: 7840179 - DNA, 18 bp, Homo sapiens
gcctttgcacaagcagct

SEQ ID NO: 7840180 - DNA, 22 bp, Homo sapiens
gcctttgaattgttgtggtgag

SEQ ID NO: 7840181 - DNA, 21 bp, Homo sapiens
gcctttggtttcttgtcctgc

SEQ ID NO: 7840182 - DNA, 18 bp, Homo sapiens
gcctttggactgctccca

SEQ ID NO: 7840183 - DNA, 22 bp, Homo sapiens
gcggggttccgtgccccagagt

SEQ ID NO: 7840184 - DNA, 22 bp, Homo sapiens
gcggggttccgtgccccagagt

SEQ ID NO: 7840185 - DNA, 22 bp, Homo sapiens
gcggggttccgtgccccagagt

SEQ ID NO: 7840186 - DNA, 22 bp, Homo sapiens
gcgggtggaacggctccacgtg

SEQ ID NO: 7840187 - DNA, 22 bp, Homo sapiens
gcgggtggaacggctccacgtg

SEQ ID NO: 7840188 - DNA, 22 bp, Homo sapiens
gcgggtggaacggctccacgtg

SEQ ID NO: 7840189 - DNA, 22 bp, Homo sapiens
gcgggtggatcatgaggtcagg

SEQ ID NO: 7840190 - DNA, 22 bp, Homo sapiens
gccttttaaggcagagggagat

SEQ ID NO: 7840191 - DNA, 22 bp, Homo sapiens
gcctttgtaactcttttattgt

SEQ ID NO: 7840192 - DNA, 22 bp, Homo sapiens
gcgggtggatcatgaggtcagg

SEQ ID NO: 7840193 - DNA, 22 bp, Homo sapiens
gcgggtggatcatgaggtcagg

SEQ ID NO: 7840194 - DNA, 22 bp, Homo sapiens
gcgggtggatcatgaggtcagg

SEQ ID NO: 7840195 - DNA, 22 bp, Homo sapiens
gcgggtggtgtccctgctcctc

SEQ ID NO: 7840196 - DNA, 22 bp, Homo sapiens
gcgggtggatcatgaggtcagg

SEQ ID NO: 7840197 - DNA, 22 bp, Homo sapiens
gcgggtggtgtccctgctcctc

SEQ ID NO: 7840198 - DNA, 22 bp, Homo sapiens
gcgggttgaagggcgcatcgaa

SEQ ID NO: 7840199 - DNA, 22 bp, Homo sapiens
gcctctggtccctcatgctgtg

SEQ ID NO: 7840200 - DNA, 22 bp, Homo sapiens
gcctctggtccctcatgctgtg

SEQ ID NO: 7840201 - DNA, 22 bp, Homo sapiens
gcctctggtccctcatgctgtg

SEQ ID NO: 7840202 - DNA, 22 bp, Homo sapiens
gcctctggtccctcatgctgtg

SEQ ID NO: 7840203 - DNA, 22 bp, Homo sapiens
gcctctggtccctcatgctgtg

SEQ ID NO: 7840204 - DNA, 22 bp, Homo sapiens
gcctctggtccctcatgctgtg

SEQ ID NO: 7840205 - DNA, 22 bp, Homo sapiens
gcctctgggttggtgacaggct

SEQ ID NO: 7840206 - DNA, 22 bp, Homo sapiens
gcctctgggttggtgacaggct

SEQ ID NO: 7840207 - DNA, 22 bp, Homo sapiens
gcctctgggttggtgacaggct

SEQ ID NO: 7840208 - DNA, 22 bp, Homo sapiens
gcctctgggttggtgacaggct

SEQ ID NO: 7840209 - DNA, 22 bp, Homo sapiens
gcctctgggttggtgacaggct

SEQ ID NO: 7840210 - DNA, 22 bp, Homo sapiens
gcctctggtccctcatgctgtg

SEQ ID NO: 7840211 - DNA, 22 bp, Homo sapiens
gcctctggtccctcatgctgtg

SEQ ID NO: 7840212 - DNA, 22 bp, Homo sapiens
gcctctgggttggtgacaggct

SEQ ID NO: 7840213 - DNA, 22 bp, Homo sapiens
gcctctggggtggagcccagca

SEQ ID NO: 7840214 - DNA, 22 bp, Homo sapiens
gcctctggggtggagcccagca

SEQ ID NO: 7840215 - DNA, 22 bp, Homo sapiens
gcctctggggtggagcccagca

SEQ ID NO: 7840216 - DNA, 22 bp, Homo sapiens
gcctctggggtggagcccagca

SEQ ID NO: 7840217 - DNA, 22 bp, Homo sapiens
gcctctggggttaatagagttt

SEQ ID NO: 7840218 - DNA, 22 bp, Homo sapiens
gcctctgggtgacgaaaggtga

SEQ ID NO: 7840219 - DNA, 22 bp, Homo sapiens
gcctctgggggctcagacctgt

SEQ ID NO: 7840220 - DNA, 22 bp, Homo sapiens
gcctctgggggctcagacctgt

SEQ ID NO: 7840221 - DNA, 22 bp, Homo sapiens
gcctctgggggctcagacctgt

SEQ ID NO: 7840222 - DNA, 22 bp, Homo sapiens
gcctctggggcagctgagtcat

SEQ ID NO: 7840223 - DNA, 22 bp, Homo sapiens
gcctctggggcagctgagtcat

SEQ ID NO: 7840224 - DNA, 22 bp, Homo sapiens
gcctctggggcagctgagtcat

SEQ ID NO: 7840225 - DNA, 22 bp, Homo sapiens
gcctgagattggacattattta

SEQ ID NO: 7840226 - DNA, 18 bp, Homo sapiens
gcctctgttgcttgcctg

SEQ ID NO: 7840227 - DNA, 22 bp, Homo sapiens
gcctgagcaggcgtggaccatg

SEQ ID NO: 7840228 - DNA, 22 bp, Homo sapiens
gcctgagcagctatacacacag

SEQ ID NO: 7840229 - DNA, 22 bp, Homo sapiens
gcctgagcaggcgtggaccatg

SEQ ID NO: 7840230 - DNA, 18 bp, Homo sapiens
gcctctgttgcttgcctg

SEQ ID NO: 7840231 - DNA, 22 bp, Homo sapiens
gcctctgtggctcagccttgct

SEQ ID NO: 7840232 - DNA, 22 bp, Homo sapiens
gcctgagattggacattattta

SEQ ID NO: 7840233 - DNA, 18 bp, Homo sapiens
gcctctgttgcttgcctg

SEQ ID NO: 7840234 - DNA, 18 bp, Homo sapiens
gcctctgttgcttgcctg

SEQ ID NO: 7840235 - DNA, 22 bp, Homo sapiens
gcctctgtggctcagccttgct

SEQ ID NO: 7840236 - DNA, 22 bp, Homo sapiens
gcctctgtcatagctcatgtga

SEQ ID NO: 7840237 - DNA, 22 bp, Homo sapiens
gcctctgtcatagctcatgtga

SEQ ID NO: 7840238 - DNA, 21 bp, Homo sapiens
gcctgagcatgtcttcaggtc

SEQ ID NO: 7840239 - DNA, 19 bp, Homo sapiens
gcctgagccagccatgcaa

SEQ ID NO: 7840240 - DNA, 22 bp, Homo sapiens
gcctgagcccaggtgtgcagag

SEQ ID NO: 7840241 - DNA, 22 bp, Homo sapiens
gcctgagccgcctgagcggcgg

SEQ ID NO: 7840242 - DNA, 22 bp, Homo sapiens
gcctgagcaggcgtggaccatg

SEQ ID NO: 7840243 - DNA, 22 bp, Homo sapiens
gcctgagcaggcgtggaccatg

SEQ ID NO: 7840244 - DNA, 22 bp, Homo sapiens
gcctgagcaggcgtggaccatg

SEQ ID NO: 7840245 - DNA, 21 bp, Homo sapiens
gcctgagcatgtcttcaggtc

SEQ ID NO: 7840246 - DNA, 21 bp, Homo sapiens
gcctgagcatgtcttcaggtc

SEQ ID NO: 7840247 - DNA, 22 bp, Homo sapiens
gcctgagcaggcgtggaccatg

SEQ ID NO: 7840248 - DNA, 19 bp, Homo sapiens
gcctgagccagccatgcaa

SEQ ID NO: 7840249 - DNA, 21 bp, Homo sapiens
gcctgagcatgtcttcaggtc

SEQ ID NO: 7840250 - DNA, 21 bp, Homo sapiens
gcctgagcatgtcttcaggtc

SEQ ID NO: 7840251 - DNA, 23 bp, Homo sapiens
gccttggcgatccgtggggcatc

SEQ ID NO: 7840252 - DNA, 22 bp, Homo sapiens
gccttggctgccaagctgctga

SEQ ID NO: 7840253 - DNA, 22 bp, Homo sapiens
gccttggctgccaagctgctga

SEQ ID NO: 7840254 - DNA, 22 bp, Homo sapiens
gccttggctgttggagcttgat

SEQ ID NO: 7840255 - DNA, 22 bp, Homo sapiens
gccttggctgttggagcttgat

SEQ ID NO: 7840256 - DNA, 19 bp, Homo sapiens
gccttggcattctctgctt

SEQ ID NO: 7840257 - DNA, 19 bp, Homo sapiens
gccttggcattctctgctt

SEQ ID NO: 7840258 - DNA, 22 bp, Homo sapiens
gccttggcccacagtgctcctg

SEQ ID NO: 7840259 - DNA, 22 bp, Homo sapiens
gccttgggaaagtgggaggaga

SEQ ID NO: 7840260 - DNA, 22 bp, Homo sapiens
gccttgggaaagtgggaggaga

SEQ ID NO: 7840261 - DNA, 22 bp, Homo sapiens
gccttgggaaagtgggaggaga

SEQ ID NO: 7840262 - DNA, 22 bp, Homo sapiens
gccttgggacggaggggtcacc

SEQ ID NO: 7840263 - DNA, 22 bp, Homo sapiens
gccttgggaaagtgggaggaga

SEQ ID NO: 7840264 - DNA, 22 bp, Homo sapiens
gccttgggattcttggatgctc

SEQ ID NO: 7840265 - DNA, 22 bp, Homo sapiens
gccttgggattcttggatgctc

SEQ ID NO: 7840266 - DNA, 22 bp, Homo sapiens
gccttgggcacaggcagggccc

SEQ ID NO: 7840267 - DNA, 22 bp, Homo sapiens
gccttgggggtgaaagaggcta

SEQ ID NO: 7840268 - DNA, 22 bp, Homo sapiens
gccttgggggtgaaagaggcta

SEQ ID NO: 7840269 - DNA, 22 bp, Homo sapiens
gccttgggccagctgctctgga

SEQ ID NO: 7840270 - DNA, 22 bp, Homo sapiens
gccttgggggtgaaagaggcta

SEQ ID NO: 7840271 - DNA, 22 bp, Homo sapiens
gccttgggggtgaaagaggcta

SEQ ID NO: 7840272 - DNA, 22 bp, Homo sapiens
gccttgggccagctgctctgga

SEQ ID NO: 7840273 - DNA, 22 bp, Homo sapiens
gccttgggcacaggcagggccc

SEQ ID NO: 7840274 - DNA, 20 bp, Homo sapiens
gcctgagctccgcctcctgt

SEQ ID NO: 7840275 - DNA, 22 bp, Homo sapiens
gcctgaggaatgctcctgactt

SEQ ID NO: 7840276 - DNA, 20 bp, Homo sapiens
gcctgagctccgcctcctgt

SEQ ID NO: 7840277 - DNA, 20 bp, Homo sapiens
gcctgagctccgcctcctgt

SEQ ID NO: 7840278 - DNA, 20 bp, Homo sapiens
gcctgagctccgcctcctgt

SEQ ID NO: 7840279 - DNA, 20 bp, Homo sapiens
gcctgagctattgccaggat

SEQ ID NO: 7840280 - DNA, 20 bp, Homo sapiens
gcctgagctattgccaggat

SEQ ID NO: 7840281 - DNA, 22 bp, Homo sapiens
gcctgagctactagggagtctg

SEQ ID NO: 7840282 - DNA, 22 bp, Homo sapiens
gcctgagccgcctgagcggcgg

SEQ ID NO: 7840283 - DNA, 22 bp, Homo sapiens
gcctgagccgcctgagcggcgg

SEQ ID NO: 7840284 - DNA, 22 bp, Homo sapiens
gcctgagctactagggagtctg

SEQ ID NO: 7840285 - DNA, 22 bp, Homo sapiens
gccttggactcgggtggactca

SEQ ID NO: 7840286 - DNA, 22 bp, Homo sapiens
gccttggactcgggtggactca

SEQ ID NO: 7840287 - DNA, 22 bp, Homo sapiens
gccttggactaccactcccaca

SEQ ID NO: 7840288 - DNA, 22 bp, Homo sapiens
gccttggaacaattattgctgc

SEQ ID NO: 7840289 - DNA, 22 bp, Homo sapiens
gccttggactaccactcccaca

SEQ ID NO: 7840290 - DNA, 22 bp, Homo sapiens
gccttggactaccactcccaca

SEQ ID NO: 7840291 - DNA, 22 bp, Homo sapiens
gccttggagatcactgctcatg

SEQ ID NO: 7840292 - DNA, 23 bp, Homo sapiens
gccttggagaagtcactcaggga

SEQ ID NO: 7840293 - DNA, 22 bp, Homo sapiens
gccttggactcgggtggactca

SEQ ID NO: 7840294 - DNA, 22 bp, Homo sapiens
gccttgcctcagccatggaaac

SEQ ID NO: 7840295 - DNA, 22 bp, Homo sapiens
gcctgaggaatgctcctgactt

SEQ ID NO: 7840296 - DNA, 22 bp, Homo sapiens
gccttgctaatttctcctcaac

SEQ ID NO: 7840297 - DNA, 22 bp, Homo sapiens
gccttgctgattaccttccttt

SEQ ID NO: 7840298 - DNA, 22 bp, Homo sapiens
gccttggaaagctggagcagtt

SEQ ID NO: 7840299 - DNA, 22 bp, Homo sapiens
gccttggaaagctggagcagtt

SEQ ID NO: 7840300 - DNA, 22 bp, Homo sapiens
gctggggagggcgtcaaggcca

SEQ ID NO: 7840301 - DNA, 22 bp, Homo sapiens
gctggggcctctgtgaggttaa

SEQ ID NO: 7840302 - DNA, 22 bp, Homo sapiens
gctggggagggcgtcaaggcca

SEQ ID NO: 7840303 - DNA, 22 bp, Homo sapiens
gctggggcctctgtgaggttaa

SEQ ID NO: 7840304 - DNA, 22 bp, Homo sapiens
gctggggcctgaacagtcagct

SEQ ID NO: 7840305 - DNA, 22 bp, Homo sapiens
gctggggcctctgtgaggttaa

SEQ ID NO: 7840306 - DNA, 22 bp, Homo sapiens
gctggggcctgaacagtcagct

SEQ ID NO: 7840307 - DNA, 22 bp, Homo sapiens
gctggggcctgaacagtcagct

SEQ ID NO: 7840308 - DNA, 22 bp, Homo sapiens
gctggggcctgaacagtcagct

SEQ ID NO: 7840309 - DNA, 22 bp, Homo sapiens
gctggggcctgaacagtcagct

SEQ ID NO: 7840310 - DNA, 22 bp, Homo sapiens
gctggggcctgaacagtcagct

SEQ ID NO: 7840311 - DNA, 22 bp, Homo sapiens
gctggggaggcagcagagaaca

SEQ ID NO: 7840312 - DNA, 22 bp, Homo sapiens
gctggggaggcagcagagaaca

SEQ ID NO: 7840313 - DNA, 22 bp, Homo sapiens
gctgggcttggtttccctgctt

SEQ ID NO: 7840314 - DNA, 22 bp, Homo sapiens
gctgggcttggtttccctgctt

SEQ ID NO: 7840315 - DNA, 22 bp, Homo sapiens
gctgggcttggtttccctgctt

SEQ ID NO: 7840316 - DNA, 22 bp, Homo sapiens
gctgggcttggtttccctgctt

SEQ ID NO: 7840317 - DNA, 22 bp, Homo sapiens
gctgggcttggtttccctgctt

SEQ ID NO: 7840318 - DNA, 22 bp, Homo sapiens
gctgggcttggtttccctgctt

SEQ ID NO: 7840319 - DNA, 19 bp, Homo sapiens
gctgggcttgggtttgtag

SEQ ID NO: 7840320 - DNA, 22 bp, Homo sapiens
gctgggcttctcaatgctgcct

SEQ ID NO: 7840321 - DNA, 22 bp, Homo sapiens
gctgggcttctcaatgctgcct

SEQ ID NO: 7840322 - DNA, 22 bp, Homo sapiens
gctgggcttctcaatgctgcct

SEQ ID NO: 7840323 - DNA, 22 bp, Homo sapiens
gctgggcttggtttccctgctt

SEQ ID NO: 7840324 - DNA, 19 bp, Homo sapiens
gctgggcttgggtttgtag

SEQ ID NO: 7840325 - DNA, 19 bp, Homo sapiens
gctgggcttgggtttgtag

SEQ ID NO: 7840326 - DNA, 19 bp, Homo sapiens
gctgggcttgggtttgtag

SEQ ID NO: 7840327 - DNA, 22 bp, Homo sapiens
gctgtgctcaacgtgccttcct

SEQ ID NO: 7840328 - DNA, 22 bp, Homo sapiens
gctgtggcggcagcagctggtg

SEQ ID NO: 7840329 - DNA, 19 bp, Homo sapiens
gctgtgcctctctcctgct

SEQ ID NO: 7840330 - DNA, 19 bp, Homo sapiens
gctgtgcctctctcctgct

SEQ ID NO: 7840331 - DNA, 22 bp, Homo sapiens
gctgtgctatatctctgagtgt

SEQ ID NO: 7840332 - DNA, 19 bp, Homo sapiens
gctgtgcccctgccgcttg

SEQ ID NO: 7840333 - DNA, 19 bp, Homo sapiens
gctgtgcccctgccgcttg

SEQ ID NO: 7840334 - DNA, 20 bp, Homo sapiens
gctgtgcctccagctggtgg

SEQ ID NO: 7840335 - DNA, 20 bp, Homo sapiens
gctgtgcctccagctggtgg

SEQ ID NO: 7840336 - DNA, 20 bp, Homo sapiens
gctgtgcctccagctggtgg

SEQ ID NO: 7840337 - DNA, 20 bp, Homo sapiens
gctgtgcctccagctggtgg

SEQ ID NO: 7840338 - DNA, 22 bp, Homo sapiens
gctggggctgggctgaggaaga

SEQ ID NO: 7840339 - DNA, 22 bp, Homo sapiens
gctggggctgggctgaggaaga

SEQ ID NO: 7840340 - DNA, 19 bp, Homo sapiens
gctgtgcccctgccgcttg

SEQ ID NO: 7840341 - DNA, 22 bp, Homo sapiens
gctggggctgggctgaggaaga

SEQ ID NO: 7840342 - DNA, 19 bp, Homo sapiens
gctgtgcccctgccgcttg

SEQ ID NO: 7840343 - DNA, 22 bp, Homo sapiens
gctggggcctgaacagtcagct

SEQ ID NO: 7840344 - DNA, 22 bp, Homo sapiens
gctggggcctgaacagtcagct

SEQ ID NO: 7840345 - DNA, 22 bp, Homo sapiens
gctggggcctgaacagtcagct

SEQ ID NO: 7840346 - DNA, 19 bp, Homo sapiens
gctggggcctgaccagaca

SEQ ID NO: 7840347 - DNA, 19 bp, Homo sapiens
gctggggcctgaccagaca

SEQ ID NO: 7840348 - DNA, 19 bp, Homo sapiens
gctggggcctgaccagaca

SEQ ID NO: 7840349 - DNA, 22 bp, Homo sapiens
gctggggctgggctgaggaaga

SEQ ID NO: 7840350 - DNA, 22 bp, Homo sapiens
gctggggctgggctgaggaaga

SEQ ID NO: 7840351 - DNA, 22 bp, Homo sapiens
gctgtgggtacaaatacacaat

SEQ ID NO: 7840352 - DNA, 22 bp, Homo sapiens
gctgtgggtaaacgctgagggt

SEQ ID NO: 7840353 - DNA, 22 bp, Homo sapiens
gctgtgggtgctggctccaccc

SEQ ID NO: 7840354 - DNA, 22 bp, Homo sapiens
gctgtgggtccggaccccacgg

SEQ ID NO: 7840355 - DNA, 22 bp, Homo sapiens
gctgtgggtgctggctccaccc

SEQ ID NO: 7840356 - DNA, 22 bp, Homo sapiens
gctgtgggtttccaatcctgga

SEQ ID NO: 7840357 - DNA, 22 bp, Homo sapiens
gctgtgggtttccaatcctgga

SEQ ID NO: 7840358 - DNA, 22 bp, Homo sapiens
gctgtgggttcctggcatttga

SEQ ID NO: 7840359 - DNA, 22 bp, Homo sapiens
gctgtggtctgtgagctccaaa

SEQ ID NO: 7840360 - DNA, 22 bp, Homo sapiens
gctgtggtctgtgagctccaaa

SEQ ID NO: 7840361 - DNA, 22 bp, Homo sapiens
gctgtgggtttccaatcctgga

SEQ ID NO: 7840362 - DNA, 22 bp, Homo sapiens
gctgtgggtttccaatcctgga

SEQ ID NO: 7840363 - DNA, 22 bp, Homo sapiens
gctgtggtccctctgtcctcat

SEQ ID NO: 7840364 - DNA, 19 bp, Homo sapiens
gctgtgggacagcagggtg

SEQ ID NO: 7840365 - DNA, 22 bp, Homo sapiens
gctgtgggacaggtccagccag

SEQ ID NO: 7840366 - DNA, 22 bp, Homo sapiens
gctgtgggccacacggctgagt

SEQ ID NO: 7840367 - DNA, 22 bp, Homo sapiens
gctgtgggccacacggctgagt

SEQ ID NO: 7840368 - DNA, 22 bp, Homo sapiens
gctgtgggtaaacgctgagggt

SEQ ID NO: 7840369 - DNA, 22 bp, Homo sapiens
gctgtgggtaaacgctgagggt

SEQ ID NO: 7840370 - DNA, 22 bp, Homo sapiens
gctgtgggtaaacgctgagggt

SEQ ID NO: 7840371 - DNA, 22 bp, Homo sapiens
gctgtgggtaaacgctgagggt

SEQ ID NO: 7840372 - DNA, 22 bp, Homo sapiens
gctgtgggtaaacgctgagggt

SEQ ID NO: 7840373 - DNA, 22 bp, Homo sapiens
gctgtgggccatggccaagtga

SEQ ID NO: 7840374 - DNA, 22 bp, Homo sapiens
gctgtggggagagaacacacaa

SEQ ID NO: 7840375 - DNA, 22 bp, Homo sapiens
gctgtggctgaccaccaggggg

SEQ ID NO: 7840376 - DNA, 22 bp, Homo sapiens
gctgtggctgacattgcagaca

SEQ ID NO: 7840377 - DNA, 22 bp, Homo sapiens
gctgtggctctcacaagcaaat

SEQ ID NO: 7840378 - DNA, 22 bp, Homo sapiens
gctgtggctgaagatgcaggga

SEQ ID NO: 7840379 - DNA, 22 bp, Homo sapiens
gctgtggcggcagcagctggtg

SEQ ID NO: 7840380 - DNA, 22 bp, Homo sapiens
gctgtggcggcagcagctggtg

SEQ ID NO: 7840381 - DNA, 22 bp, Homo sapiens
gctgtggctccaatggtgagcc

SEQ ID NO: 7840382 - DNA, 22 bp, Homo sapiens
gctgtggctccaatggtgagcc

SEQ ID NO: 7840383 - DNA, 22 bp, Homo sapiens
gctgtggctccaatggtgagcc

SEQ ID NO: 7840384 - DNA, 22 bp, Homo sapiens
gctgtggctctcacaagcaaat

SEQ ID NO: 7840385 - DNA, 22 bp, Homo sapiens
gctgtggctccaatggtgagcc

SEQ ID NO: 7840386 - DNA, 22 bp, Homo sapiens
gctgtggctgtacagagaccat

SEQ ID NO: 7840387 - DNA, 22 bp, Homo sapiens
gctgtggcttgcagctggggct

SEQ ID NO: 7840388 - DNA, 19 bp, Homo sapiens
gctgtgggacagcagggtg

SEQ ID NO: 7840389 - DNA, 19 bp, Homo sapiens
gctgtgggacagcagggtg

SEQ ID NO: 7840390 - DNA, 19 bp, Homo sapiens
gctgtgggacagcagggtg

SEQ ID NO: 7840391 - DNA, 22 bp, Homo sapiens
gctgtggctttctgtttctgtt

SEQ ID NO: 7840392 - DNA, 22 bp, Homo sapiens
gctgtggctttctgtttctgtt

SEQ ID NO: 7840393 - DNA, 22 bp, Homo sapiens
gcttgcctggcatttctggggc

SEQ ID NO: 7840394 - DNA, 23 bp, Homo sapiens
gcttgcctggtgtgtggctgacc

SEQ ID NO: 7840395 - DNA, 22 bp, Homo sapiens
gcttgctctttagccatggcca

SEQ ID NO: 7840396 - DNA, 20 bp, Homo sapiens
gcttgcccacatctgcactg

SEQ ID NO: 7840397 - DNA, 22 bp, Homo sapiens
gcttgccataccccattgactt

SEQ ID NO: 7840398 - DNA, 22 bp, Homo sapiens
gcttgcatattggaaagactca

SEQ ID NO: 7840399 - DNA, 22 bp, Homo sapiens
gcttgcaagtgtcaagctatta

SEQ ID NO: 7840400 - DNA, 22 bp, Homo sapiens
gcttgcagtggttggcatgacc

SEQ ID NO: 7840401 - DNA, 22 bp, Homo sapiens
gcttgagttttgggacaaagcc

SEQ ID NO: 7840402 - DNA, 22 bp, Homo sapiens
gcttgcaagtgtcaagctatta

SEQ ID NO: 7840403 - DNA, 22 bp, Homo sapiens
gcttgagggtctgagatccact

SEQ ID NO: 7840404 - DNA, 20 bp, Homo sapiens
gcttcttttctggcccatga

SEQ ID NO: 7840405 - DNA, 22 bp, Homo sapiens
gcttgaaaatgactcttgtgaa

SEQ ID NO: 7840406 - DNA, 22 bp, Homo sapiens
gcttctttggcaaccctgacat

SEQ ID NO: 7840407 - DNA, 22 bp, Homo sapiens
gcttctttccttgggctggaac

SEQ ID NO: 7840408 - DNA, 22 bp, Homo sapiens
gcttctttggcaaccctgacat

SEQ ID NO: 7840409 - DNA, 18 bp, Homo sapiens
gctttatttcttggggaa

SEQ ID NO: 7840410 - DNA, 18 bp, Homo sapiens
gctttatttcttggggaa

SEQ ID NO: 7840411 - DNA, 18 bp, Homo sapiens
gctttatttcttggggaa

SEQ ID NO: 7840412 - DNA, 18 bp, Homo sapiens
gctttatttcttggggaa

SEQ ID NO: 7840413 - DNA, 18 bp, Homo sapiens
gctttatttcttggggaa

SEQ ID NO: 7840414 - DNA, 18 bp, Homo sapiens
gctttatttcttggggaa

SEQ ID NO: 7840415 - DNA, 22 bp, Homo sapiens
gcttggaagtaggattgggaga

SEQ ID NO: 7840416 - DNA, 22 bp, Homo sapiens
gcttggaagtaggattgggaga

SEQ ID NO: 7840417 - DNA, 22 bp, Homo sapiens
gcttggaagtaggattgggaga

SEQ ID NO: 7840418 - DNA, 22 bp, Homo sapiens
gcttggaagtaggattgggaga

SEQ ID NO: 7840419 - DNA, 18 bp, Homo sapiens
gctttatttcttggggaa

SEQ ID NO: 7840420 - DNA, 18 bp, Homo sapiens
gctttatttcttggggaa

SEQ ID NO: 7840421 - DNA, 19 bp, Homo sapiens
gcttgctgctaggtaggga

SEQ ID NO: 7840422 - DNA, 19 bp, Homo sapiens
gcttgctggcgggggtctg

SEQ ID NO: 7840423 - DNA, 22 bp, Homo sapiens
gcttgctggtgcctgcaggctc

SEQ ID NO: 7840424 - DNA, 22 bp, Homo sapiens
gcttgcttatttgcccttctcc

SEQ ID NO: 7840425 - DNA, 20 bp, Homo sapiens
gcttgctttgtctgatgggc

SEQ ID NO: 7840426 - DNA, 20 bp, Homo sapiens
gcttgctttgtctgatgggc

SEQ ID NO: 7840427 - DNA, 22 bp, Homo sapiens
gcttgctttgtaaatatctgtg

SEQ ID NO: 7840428 - DNA, 19 bp, Homo sapiens
gcttgctttatgaaggggg

SEQ ID NO: 7840429 - DNA, 19 bp, Homo sapiens
gcttgctttatgaaggggg

SEQ ID NO: 7840430 - DNA, 19 bp, Homo sapiens
gcttctgtttgggcttaga

SEQ ID NO: 7840431 - DNA, 22 bp, Homo sapiens
gcttctgttcaaggatataagg

SEQ ID NO: 7840432 - DNA, 19 bp, Homo sapiens
gcttctgtttgggcttaga

SEQ ID NO: 7840433 - DNA, 22 bp, Homo sapiens
gcttctgttcaaggatataagg

SEQ ID NO: 7840434 - DNA, 22 bp, Homo sapiens
gcttctgtggtgaggtcacctt

SEQ ID NO: 7840435 - DNA, 22 bp, Homo sapiens
gcttctgtgagtgcagatgctg

SEQ ID NO: 7840436 - DNA, 22 bp, Homo sapiens
gcttctgtggtgcatctttgct

SEQ ID NO: 7840437 - DNA, 22 bp, Homo sapiens
gcttctgttaacttatgttccc

SEQ ID NO: 7840438 - DNA, 22 bp, Homo sapiens
gcttctgtggttgtcacgacta

SEQ ID NO: 7840439 - DNA, 22 bp, Homo sapiens
gcttctgtatttattgtccttt

SEQ ID NO: 7840440 - DNA, 21 bp, Homo sapiens
gcttctgtatctagcaggaac

SEQ ID NO: 7840441 - DNA, 22 bp, Homo sapiens
gcttctgtcttagctacctccc

SEQ ID NO: 7840442 - DNA, 22 bp, Homo sapiens
gcttctgtgagtgcagatgctg

SEQ ID NO: 7840443 - DNA, 22 bp, Homo sapiens
gcttctgtggattggctggctt

SEQ ID NO: 7840444 - DNA, 22 bp, Homo sapiens
gcttctgtggtgaggtcacctt

SEQ ID NO: 7840445 - DNA, 22 bp, Homo sapiens
gcttctgtggattggctggctt

SEQ ID NO: 7840446 - DNA, 22 bp, Homo sapiens
gctgtgtatcagatgccacggg

SEQ ID NO: 7840447 - DNA, 22 bp, Homo sapiens
gctgtgtatcagatgccacggg

SEQ ID NO: 7840448 - DNA, 22 bp, Homo sapiens
gctgtgtatcagatgccacggg

SEQ ID NO: 7840449 - DNA, 22 bp, Homo sapiens
gctgtgtatcagatgccacggg

SEQ ID NO: 7840450 - DNA, 22 bp, Homo sapiens
gctgtgtatcagatgccacggg

SEQ ID NO: 7840451 - DNA, 22 bp, Homo sapiens
gctgtggtctgtgagctccaaa

SEQ ID NO: 7840452 - DNA, 19 bp, Homo sapiens
gctgtgtcatttcttagga

SEQ ID NO: 7840453 - DNA, 19 bp, Homo sapiens
gctgtgtcatttcttagga

SEQ ID NO: 7840454 - DNA, 22 bp, Homo sapiens
gctgtgtcagaaactctgggga

SEQ ID NO: 7840455 - DNA, 22 bp, Homo sapiens
gctgtgtcagaaactctgggga

SEQ ID NO: 7840456 - DNA, 22 bp, Homo sapiens
gctgtgtcctcacacagccttt

SEQ ID NO: 7840457 - DNA, 19 bp, Homo sapiens
gctgtgtcatttcttagga

SEQ ID NO: 7840458 - DNA, 19 bp, Homo sapiens
gctgtgtcatttcttagga

SEQ ID NO: 7840459 - DNA, 22 bp, Homo sapiens
gctgtgtccaggtgggggtgac

SEQ ID NO: 7840460 - DNA, 21 bp, Homo sapiens
gcttctgtatctagcaggaac

SEQ ID NO: 7840461 - DNA, 22 bp, Homo sapiens
gctgtgtgaccctagccagtag

SEQ ID NO: 7840462 - DNA, 22 bp, Homo sapiens
gctgtgtgaaaactgggcctgg

SEQ ID NO: 7840463 - DNA, 22 bp, Homo sapiens
gctgtgtgaccctagccagtag

SEQ ID NO: 7840464 - DNA, 22 bp, Homo sapiens
gctgtgtgaccctagccagtag

SEQ ID NO: 7840465 - DNA, 22 bp, Homo sapiens
gctgtgtcctcacacagccttt

SEQ ID NO: 7840466 - DNA, 22 bp, Homo sapiens
gctgtgtcctcacacagccttt

SEQ ID NO: 7840467 - DNA, 22 bp, Homo sapiens
gctgtgtcctcacacagccttt

SEQ ID NO: 7840468 - DNA, 22 bp, Homo sapiens
gctgtgtcctcacacagccttt

SEQ ID NO: 7840469 - DNA, 22 bp, Homo sapiens
gctgtgtctgttttacgtcaag

SEQ ID NO: 7840470 - DNA, 22 bp, Homo sapiens
gctgtgtctgttttacgtcaag

SEQ ID NO: 7840471 - DNA, 22 bp, Homo sapiens
gctgtgtctgttttacgtcaag

SEQ ID NO: 7840472 - DNA, 22 bp, Homo sapiens
gctgtgtctgttttacgtcaag

SEQ ID NO: 7840473 - DNA, 22 bp, Homo sapiens
gctgtgtgaaaactgggcctgg

SEQ ID NO: 7840474 - DNA, 22 bp, Homo sapiens
gctgtgtgaaaactgggcctgg

SEQ ID NO: 7840475 - DNA, 19 bp, Homo sapiens
gctgtgtcatttcttagga

SEQ ID NO: 7840476 - DNA, 22 bp, Homo sapiens
gctggcttgacagaggcctggg

SEQ ID NO: 7840477 - DNA, 22 bp, Homo sapiens
gctggcttgatagtttctgctt

SEQ ID NO: 7840478 - DNA, 22 bp, Homo sapiens
gctggcttgatagtttctgctt

SEQ ID NO: 7840479 - DNA, 22 bp, Homo sapiens
gctggcttgtaataggaatttc

SEQ ID NO: 7840480 - DNA, 18 bp, Homo sapiens
gctggcttgctgggtttg

SEQ ID NO: 7840481 - DNA, 18 bp, Homo sapiens
gctggcttgctgggtttg

SEQ ID NO: 7840482 - DNA, 22 bp, Homo sapiens
gctggcttgtcccaggacaaag

SEQ ID NO: 7840483 - DNA, 22 bp, Homo sapiens
gctggcttccttctgcagctag

SEQ ID NO: 7840484 - DNA, 22 bp, Homo sapiens
gctggcttccttctgcagctag

SEQ ID NO: 7840485 - DNA, 17 bp, Homo sapiens
gctggcttctccttgct

SEQ ID NO: 7840486 - DNA, 17 bp, Homo sapiens
gctggcttctccttgct

SEQ ID NO: 7840487 - DNA, 22 bp, Homo sapiens
gctggcttgacagaggcctggg

SEQ ID NO: 7840488 - DNA, 22 bp, Homo sapiens
gctggcttgacagaggcctggg

SEQ ID NO: 7840489 - DNA, 21 bp, Homo sapiens
gctggcttcctgagggctgag

SEQ ID NO: 7840490 - DNA, 21 bp, Homo sapiens
gctggcttcctgagggctgag

SEQ ID NO: 7840491 - DNA, 22 bp, Homo sapiens
gctggcttccctacctgcacct

SEQ ID NO: 7840492 - DNA, 22 bp, Homo sapiens
gctggcttccatcagagggtga

SEQ ID NO: 7840493 - DNA, 22 bp, Homo sapiens
gctggcttccatgcggacatca

SEQ ID NO: 7840494 - DNA, 22 bp, Homo sapiens
gctggcttaatagggatgggct

SEQ ID NO: 7840495 - DNA, 22 bp, Homo sapiens
gctggcttaatgtagctaaaaa

SEQ ID NO: 7840496 - DNA, 22 bp, Homo sapiens
gctggcttaatagggatgggct

SEQ ID NO: 7840497 - DNA, 22 bp, Homo sapiens
gctggcttaatagggatgggct

SEQ ID NO: 7840498 - DNA, 22 bp, Homo sapiens
gctggctgttggaggtacctgc

SEQ ID NO: 7840499 - DNA, 22 bp, Homo sapiens
gctggctgttggaggtacctgc

SEQ ID NO: 7840500 - DNA, 22 bp, Homo sapiens
gctggctgttgaataatggcat

SEQ ID NO: 7840501 - DNA, 22 bp, Homo sapiens
gctggctgttgaataatggcat

SEQ ID NO: 7840502 - DNA, 22 bp, Homo sapiens
gctggctgtgtttcatctctga

SEQ ID NO: 7840503 - DNA, 22 bp, Homo sapiens
gctggctgtgtttcatctctga

SEQ ID NO: 7840504 - DNA, 22 bp, Homo sapiens
gctggctgtgtttcatctctga

SEQ ID NO: 7840505 - DNA, 22 bp, Homo sapiens
gctggctgtgtttcatctctga

SEQ ID NO: 7840506 - DNA, 22 bp, Homo sapiens
gctggctgtgttccttctgcca

SEQ ID NO: 7840507 - DNA, 22 bp, Homo sapiens
gctggctgtgttccttctgcca

SEQ ID NO: 7840508 - DNA, 22 bp, Homo sapiens
gctggctgtgttccttctgcca

SEQ ID NO: 7840509 - DNA, 22 bp, Homo sapiens
gctggctgtgttccttctgcca

SEQ ID NO: 7840510 - DNA, 22 bp, Homo sapiens
gctggctgtgttccttctgcca

SEQ ID NO: 7840511 - DNA, 22 bp, Homo sapiens
gctggctgtgttccttctgcca

SEQ ID NO: 7840512 - DNA, 22 bp, Homo sapiens
gctggctgtgttccttctgcca

SEQ ID NO: 7840513 - DNA, 22 bp, Homo sapiens
gctggctgtgtttcatctctga

SEQ ID NO: 7840514 - DNA, 22 bp, Homo sapiens
gctggctgtgtttcatctctga

SEQ ID NO: 7840515 - DNA, 21 bp, Homo sapiens
gctggctggctgaccggcctt

SEQ ID NO: 7840516 - DNA, 22 bp, Homo sapiens
gctggctggcgggtgcgtcctc

SEQ ID NO: 7840517 - DNA, 21 bp, Homo sapiens
gctggctggctgaccggcctt

SEQ ID NO: 7840518 - DNA, 22 bp, Homo sapiens
gctggctggctgtgcaaaggca

SEQ ID NO: 7840519 - DNA, 22 bp, Homo sapiens
gctggctgtgggctccacgctc

SEQ ID NO: 7840520 - DNA, 22 bp, Homo sapiens
gctggctgtgggctccacgctc

SEQ ID NO: 7840521 - DNA, 22 bp, Homo sapiens
gctggctgtgggctccacgctc

SEQ ID NO: 7840522 - DNA, 22 bp, Homo sapiens
gctggctgtgggctccacgctc

SEQ ID NO: 7840523 - DNA, 22 bp, Homo sapiens
gctggctgtgggctccacgctc

SEQ ID NO: 7840524 - DNA, 22 bp, Homo sapiens
gctggctgtggcttaagcaaac

SEQ ID NO: 7840525 - DNA, 22 bp, Homo sapiens
gctggctgtggcttaagcaaac

SEQ ID NO: 7840526 - DNA, 22 bp, Homo sapiens
gctggctgtgattttgccaaca

SEQ ID NO: 7840527 - DNA, 22 bp, Homo sapiens
gctggctgtgattttgccaaca

SEQ ID NO: 7840528 - DNA, 22 bp, Homo sapiens
gctggctgtggcttaagcaaac

SEQ ID NO: 7840529 - DNA, 22 bp, Homo sapiens
gctgggctgtagtttgctgacc

SEQ ID NO: 7840530 - DNA, 22 bp, Homo sapiens
gctgggctgtagtttgctgacc

SEQ ID NO: 7840531 - DNA, 22 bp, Homo sapiens
gctgggctgtagtttgctgacc

SEQ ID NO: 7840532 - DNA, 22 bp, Homo sapiens
gctgggctgtagtttgctgacc

SEQ ID NO: 7840533 - DNA, 22 bp, Homo sapiens
gctgggctgtagtttgctgacc

SEQ ID NO: 7840534 - DNA, 22 bp, Homo sapiens
gctgggctgtagtttgctgacc

SEQ ID NO: 7840535 - DNA, 22 bp, Homo sapiens
gctgggctggccgccgagatcg

SEQ ID NO: 7840536 - DNA, 22 bp, Homo sapiens
gctgggctggccgccgagatcg

SEQ ID NO: 7840537 - DNA, 22 bp, Homo sapiens
gctgggctggccgccgagatcg

SEQ ID NO: 7840538 - DNA, 23 bp, Homo sapiens
gctgggcttactctttcagtgag

SEQ ID NO: 7840539 - DNA, 22 bp, Homo sapiens
gctgggctgtagtttgctgacc

SEQ ID NO: 7840540 - DNA, 23 bp, Homo sapiens
gctgggcttactctttcagtgag

SEQ ID NO: 7840541 - DNA, 23 bp, Homo sapiens
gctgggcttactctttcagtgag

SEQ ID NO: 7840542 - DNA, 23 bp, Homo sapiens
gctgggcttactctttcagtgag

SEQ ID NO: 7840543 - DNA, 23 bp, Homo sapiens
gctgggcttactctttcagtgag

SEQ ID NO: 7840544 - DNA, 22 bp, Homo sapiens
gctgggcttcacagagccttta

SEQ ID NO: 7840545 - DNA, 22 bp, Homo sapiens
gctgggcttcacagagccttta

SEQ ID NO: 7840546 - DNA, 22 bp, Homo sapiens
gctgggcttcacagagccttta

SEQ ID NO: 7840547 - DNA, 22 bp, Homo sapiens
gctgggcttcacctccagagtt

SEQ ID NO: 7840548 - DNA, 22 bp, Homo sapiens
gctgggcttcacctccagagtt

SEQ ID NO: 7840549 - DNA, 22 bp, Homo sapiens
gctgggcttcacctccagagtt

SEQ ID NO: 7840550 - DNA, 22 bp, Homo sapiens
gctgggcttcacagagccttta

SEQ ID NO: 7840551 - DNA, 22 bp, Homo sapiens
gctgggcttcacagagccttta

SEQ ID NO: 7840552 - DNA, 22 bp, Homo sapiens
gctgggcttcacctccagagtt

SEQ ID NO: 7840553 - DNA, 22 bp, Homo sapiens
gctgggcttcacctccagagtt

SEQ ID NO: 7840554 - DNA, 22 bp, Homo sapiens
gctgggcttcacagagccttta

SEQ ID NO: 7840555 - DNA, 22 bp, Homo sapiens
gctgggcttcacctccagagtt

SEQ ID NO: 7840556 - DNA, 22 bp, Homo sapiens
gctgggcttcacctccagagtt

SEQ ID NO: 7840557 - DNA, 22 bp, Homo sapiens
gctgggcttcacctccagagtt

SEQ ID NO: 7840558 - DNA, 22 bp, Homo sapiens
gctgggcttctcaatgctgcct

SEQ ID NO: 7840559 - DNA, 22 bp, Homo sapiens
gctgggcttctcaatgctgcct

SEQ ID NO: 7840560 - DNA, 22 bp, Homo sapiens
gctgggcttctcaatgctgcct

SEQ ID NO: 7840561 - DNA, 22 bp, Homo sapiens
gctgggcttctcaatgctgcct

SEQ ID NO: 7840562 - DNA, 22 bp, Homo sapiens
gctgggcttctcaatgctgcct

SEQ ID NO: 7840563 - DNA, 22 bp, Homo sapiens
gctggctttgcactgggtgcat

SEQ ID NO: 7840564 - DNA, 22 bp, Homo sapiens
gctggctttgcactgggtgcat

SEQ ID NO: 7840565 - DNA, 22 bp, Homo sapiens
gctggctttgcactgggtgcat

SEQ ID NO: 7840566 - DNA, 22 bp, Homo sapiens
gctggctttgatcttcccatct

SEQ ID NO: 7840567 - DNA, 21 bp, Homo sapiens
gctggctttcctggatgtgca

SEQ ID NO: 7840568 - DNA, 22 bp, Homo sapiens
gctggctttgtggtctctcctc

SEQ ID NO: 7840569 - DNA, 22 bp, Homo sapiens
gctggctttgtcaagggcagca

SEQ ID NO: 7840570 - DNA, 20 bp, Homo sapiens
gctggctttcctaaactgct

SEQ ID NO: 7840571 - DNA, 21 bp, Homo sapiens
gctggctttattctgcgtttg

SEQ ID NO: 7840572 - DNA, 21 bp, Homo sapiens
gctggctttattctgcgtttg

SEQ ID NO: 7840573 - DNA, 22 bp, Homo sapiens
gctggctttatggggcttgtgg

SEQ ID NO: 7840574 - DNA, 22 bp, Homo sapiens
gctggcttgtcccaggacaaag

SEQ ID NO: 7840575 - DNA, 22 bp, Homo sapiens
gctggctttatcgtcagactcc

SEQ ID NO: 7840576 - DNA, 22 bp, Homo sapiens
gctgggctggaaggccaaggca

SEQ ID NO: 7840577 - DNA, 22 bp, Homo sapiens
gctgggctggaaggccaaggca

SEQ ID NO: 7840578 - DNA, 22 bp, Homo sapiens
gctgggctggaaggccaaggca

SEQ ID NO: 7840579 - DNA, 22 bp, Homo sapiens
gctgggctggaaggccaaggca

SEQ ID NO: 7840580 - DNA, 22 bp, Homo sapiens
gctgggctggaaggccaaggca

SEQ ID NO: 7840581 - DNA, 22 bp, Homo sapiens
gctgggctggccgccgagatcg

SEQ ID NO: 7840582 - DNA, 22 bp, Homo sapiens
gctgggctggaaggccaaggca

SEQ ID NO: 7840583 - DNA, 22 bp, Homo sapiens
gctgggctggccgccgagatcg

SEQ ID NO: 7840584 - DNA, 22 bp, Homo sapiens
gctgggctggaaggccaaggca

SEQ ID NO: 7840585 - DNA, 22 bp, Homo sapiens
gctgggaacacagccatgagag

SEQ ID NO: 7840586 - DNA, 22 bp, Homo sapiens
gctgggaacacagccatgagag

SEQ ID NO: 7840587 - DNA, 22 bp, Homo sapiens
gctgggaacacagccatgagag

SEQ ID NO: 7840588 - DNA, 22 bp, Homo sapiens
gctgggaacacagccatgagag

SEQ ID NO: 7840589 - DNA, 22 bp, Homo sapiens
gctggctttgtggtctctcctc

SEQ ID NO: 7840590 - DNA, 22 bp, Homo sapiens
gctggctttgtggtctctcctc

SEQ ID NO: 7840591 - DNA, 22 bp, Homo sapiens
gctggcttttgaagtctagcta

SEQ ID NO: 7840592 - DNA, 22 bp, Homo sapiens
gctggctggcgggtgcgtcctc

SEQ ID NO: 7840593 - DNA, 22 bp, Homo sapiens
gctggctggcgggtgcgtcctc

SEQ ID NO: 7840594 - DNA, 22 bp, Homo sapiens
gctggctggcgggtgcgtcctc

SEQ ID NO: 7840595 - DNA, 22 bp, Homo sapiens
gctggctggcgggtgcgtcctc

SEQ ID NO: 7840596 - DNA, 23 bp, Homo sapiens
gctggctggcagtaaaggttgtt

SEQ ID NO: 7840597 - DNA, 23 bp, Homo sapiens
gctggctggcagtaaaggttgtt

SEQ ID NO: 7840598 - DNA, 22 bp, Homo sapiens
gctggctggcgggtgcgtcctc

SEQ ID NO: 7840599 - DNA, 22 bp, Homo sapiens
gctggctggatggttggttcgc

SEQ ID NO: 7840600 - DNA, 22 bp, Homo sapiens
gctggctggcacgttcgcacgt

SEQ ID NO: 7840601 - DNA, 22 bp, Homo sapiens
gctggctggcacgttcgcacgt

SEQ ID NO: 7840602 - DNA, 22 bp, Homo sapiens
gctggctggcacgttcgcacgt

SEQ ID NO: 7840603 - DNA, 23 bp, Homo sapiens
gctggctggcagtaaaggttgtt

SEQ ID NO: 7840604 - DNA, 22 bp, Homo sapiens
gctggctggagtgagctaccct

SEQ ID NO: 7840605 - DNA, 22 bp, Homo sapiens
gctggctggagtgagctaccct

SEQ ID NO: 7840606 - DNA, 22 bp, Homo sapiens
gctggctggagtgagctaccct

SEQ ID NO: 7840607 - DNA, 22 bp, Homo sapiens
gctggctggagtgagctaccct

SEQ ID NO: 7840608 - DNA, 22 bp, Homo sapiens
gctggctggagtgagctaccct

SEQ ID NO: 7840609 - DNA, 22 bp, Homo sapiens
gctggctggagtaaggagggag

SEQ ID NO: 7840610 - DNA, 22 bp, Homo sapiens
gctggctggagtaaggagggag

SEQ ID NO: 7840611 - DNA, 22 bp, Homo sapiens
gctggctggagtaaggagggag

SEQ ID NO: 7840612 - DNA, 22 bp, Homo sapiens
gctggctggagtaaggagggag

SEQ ID NO: 7840613 - DNA, 22 bp, Homo sapiens
gctggctggagtaaggagggag

SEQ ID NO: 7840614 - DNA, 22 bp, Homo sapiens
gctggctggaggtgaggaagaa

SEQ ID NO: 7840615 - DNA, 22 bp, Homo sapiens
gctggctggaggtgaggaagaa

SEQ ID NO: 7840616 - DNA, 22 bp, Homo sapiens
gctggctggaggtgaggaagaa

SEQ ID NO: 7840617 - DNA, 22 bp, Homo sapiens
gctggctggaggtgaggaagaa

SEQ ID NO: 7840618 - DNA, 22 bp, Homo sapiens
gctggctggaggtgaggaagaa

SEQ ID NO: 7840619 - DNA, 22 bp, Homo sapiens
gctggctggaggtgaggaagaa

SEQ ID NO: 7840620 - DNA, 22 bp, Homo sapiens
gctggctggaggagggaggttg

SEQ ID NO: 7840621 - DNA, 22 bp, Homo sapiens
gctggctggaggagggaggttg

SEQ ID NO: 7840622 - DNA, 22 bp, Homo sapiens
gctggctggaggagggaggttg

SEQ ID NO: 7840623 - DNA, 22 bp, Homo sapiens
gctggctggaggagggaggttg

SEQ ID NO: 7840624 - DNA, 22 bp, Homo sapiens
gctggctggaggagggaggttg

SEQ ID NO: 7840625 - DNA, 19 bp, Homo sapiens
gctggctggaggagggaca

SEQ ID NO: 7840626 - DNA, 19 bp, Homo sapiens
gctggctggaggagggaca

SEQ ID NO: 7840627 - DNA, 22 bp, Homo sapiens
gctggctggaggagggaggttg

SEQ ID NO: 7840628 - DNA, 19 bp, Homo sapiens
gctggctggaggagggaca

SEQ ID NO: 7840629 - DNA, 22 bp, Homo sapiens
gctggctggaggagggaggttg

SEQ ID NO: 7840630 - DNA, 22 bp, Homo sapiens
gctggctggaatgggagaagaa

SEQ ID NO: 7840631 - DNA, 22 bp, Homo sapiens
gctggctggaatgggagaagaa

SEQ ID NO: 7840632 - DNA, 22 bp, Homo sapiens
gctggctggaatgggagaagaa

SEQ ID NO: 7840633 - DNA, 19 bp, Homo sapiens
gctggctggaggagggaca

SEQ ID NO: 7840634 - DNA, 22 bp, Homo sapiens
gctggctggaatgggagaagaa

SEQ ID NO: 7840635 - DNA, 22 bp, Homo sapiens
gctggctggaactagcagttgg

SEQ ID NO: 7840636 - DNA, 22 bp, Homo sapiens
gctggctggaactagcagttgg

SEQ ID NO: 7840637 - DNA, 22 bp, Homo sapiens
gctggctggaactagcagttgg

SEQ ID NO: 7840638 - DNA, 22 bp, Homo sapiens
gctggctggaactagcagttgg

SEQ ID NO: 7840639 - DNA, 22 bp, Homo sapiens
gctggctggaatgggagaagaa

SEQ ID NO: 7840640 - DNA, 22 bp, Homo sapiens
gctggctggaatgggagaagaa

SEQ ID NO: 7840641 - DNA, 22 bp, Homo sapiens
gctggctgctgttgagacttgt

SEQ ID NO: 7840642 - DNA, 22 bp, Homo sapiens
gctggctggaactagcagttgg

SEQ ID NO: 7840643 - DNA, 22 bp, Homo sapiens
gctggctgctgttgagacttgt

SEQ ID NO: 7840644 - DNA, 22 bp, Homo sapiens
gctggctgctaggacagctaca

SEQ ID NO: 7840645 - DNA, 22 bp, Homo sapiens
gctggctgctgttgagacttgt

SEQ ID NO: 7840646 - DNA, 22 bp, Homo sapiens
gctggctgctgttgagacttgt

SEQ ID NO: 7840647 - DNA, 22 bp, Homo sapiens
gctggctgctgttgagacttgt

SEQ ID NO: 7840648 - DNA, 22 bp, Homo sapiens
gctggctgctaggacagctaca

SEQ ID NO: 7840649 - DNA, 22 bp, Homo sapiens
gctggctgcgtcatcacagggc

SEQ ID NO: 7840650 - DNA, 22 bp, Homo sapiens
gctggctgcgtcatcacagggc

SEQ ID NO: 7840651 - DNA, 22 bp, Homo sapiens
gctggctgcgtcatcacagggc

SEQ ID NO: 7840652 - DNA, 22 bp, Homo sapiens
gctggctgcgtcatcacagggc

SEQ ID NO: 7840653 - DNA, 22 bp, Homo sapiens
gctggctgcgtcatcacagggc

SEQ ID NO: 7840654 - DNA, 22 bp, Homo sapiens
gctggctgcgtcatcacagggc

SEQ ID NO: 7840655 - DNA, 22 bp, Homo sapiens
gctggctgctaggacagctaca

SEQ ID NO: 7840656 - DNA, 22 bp, Homo sapiens
gctggctgctaggacagctaca

SEQ ID NO: 7840657 - DNA, 22 bp, Homo sapiens
gctggctgcgtcatcacagggc

SEQ ID NO: 7840658 - DNA, 21 bp, Homo sapiens
gctggagagccaggcaggggc

SEQ ID NO: 7840659 - DNA, 22 bp, Homo sapiens
gctggagagataggcatggggt

SEQ ID NO: 7840660 - DNA, 22 bp, Homo sapiens
gctggagagataggcatggggt

SEQ ID NO: 7840661 - DNA, 22 bp, Homo sapiens
gctggagagataggcatggggt

SEQ ID NO: 7840662 - DNA, 22 bp, Homo sapiens
gctggagagataggcatggggt

SEQ ID NO: 7840663 - DNA, 22 bp, Homo sapiens
gctggagagataggcatggggt

SEQ ID NO: 7840664 - DNA, 22 bp, Homo sapiens
gctggagacctcagagaaccca

SEQ ID NO: 7840665 - DNA, 22 bp, Homo sapiens
gctggagagataggcatggggt

SEQ ID NO: 7840666 - DNA, 22 bp, Homo sapiens
gctggagagataggcatggggt

SEQ ID NO: 7840667 - DNA, 22 bp, Homo sapiens
gctggagagataggcatggggt

SEQ ID NO: 7840668 - DNA, 22 bp, Homo sapiens
gctggagagataggcatggggt

SEQ ID NO: 7840669 - DNA, 22 bp, Homo sapiens
gctggagagataggcatggggt

SEQ ID NO: 7840670 - DNA, 22 bp, Homo sapiens
gctggagacctcagagaaccca

SEQ ID NO: 7840671 - DNA, 22 bp, Homo sapiens
gctggagaacccaggaggaaga

SEQ ID NO: 7840672 - DNA, 22 bp, Homo sapiens
gctggagaacccaggaggaaga

SEQ ID NO: 7840673 - DNA, 22 bp, Homo sapiens
gctggagaacccaggaggaaga

SEQ ID NO: 7840674 - DNA, 22 bp, Homo sapiens
gctggagaaactgcagctgagg

SEQ ID NO: 7840675 - DNA, 22 bp, Homo sapiens
gctggagaaactgcagctgagg

SEQ ID NO: 7840676 - DNA, 22 bp, Homo sapiens
gctggagaaactgcagctgagg

SEQ ID NO: 7840677 - DNA, 22 bp, Homo sapiens
gctggagaaactgcagctgagg

SEQ ID NO: 7840678 - DNA, 22 bp, Homo sapiens
gctggagaaactgcagctgagg

SEQ ID NO: 7840679 - DNA, 22 bp, Homo sapiens
gctggagaaacaggaggaggaa

SEQ ID NO: 7840680 - DNA, 22 bp, Homo sapiens
gctggagaaactgcagctgagg

SEQ ID NO: 7840681 - DNA, 22 bp, Homo sapiens
gctggagaaactgcagctgagg

SEQ ID NO: 7840682 - DNA, 22 bp, Homo sapiens
gctggagaaactgcagctgagg

SEQ ID NO: 7840683 - DNA, 22 bp, Homo sapiens
gctggagaaactgcagctgagg

SEQ ID NO: 7840684 - DNA, 20 bp, Homo sapiens
gctgctttcaaatgacacgt

SEQ ID NO: 7840685 - DNA, 22 bp, Homo sapiens
gctggagaaacaggaggaggaa

SEQ ID NO: 7840686 - DNA, 22 bp, Homo sapiens
gctggagaaacaggaggaggaa

SEQ ID NO: 7840687 - DNA, 22 bp, Homo sapiens
gctggagaaacaggaggaggaa

SEQ ID NO: 7840688 - DNA, 22 bp, Homo sapiens
gctggagaaacaggaggaggaa

SEQ ID NO: 7840689 - DNA, 22 bp, Homo sapiens
gctggagaaacaggaggaggaa

SEQ ID NO: 7840690 - DNA, 22 bp, Homo sapiens
gctgctttataatctcggcaga

SEQ ID NO: 7840691 - DNA, 20 bp, Homo sapiens
gctgctttcaaatgacacgt

SEQ ID NO: 7840692 - DNA, 20 bp, Homo sapiens
gctgctttcaaatgacacgt

SEQ ID NO: 7840693 - DNA, 20 bp, Homo sapiens
gctgctttcaaatgacacgt

SEQ ID NO: 7840694 - DNA, 22 bp, Homo sapiens
gctgctttagaattgaaacaga

SEQ ID NO: 7840695 - DNA, 22 bp, Homo sapiens
gctgctttagaattgaaacaga

SEQ ID NO: 7840696 - DNA, 22 bp, Homo sapiens
gctgctttaggttgagctcagc

SEQ ID NO: 7840697 - DNA, 22 bp, Homo sapiens
gctgctttagaattgaaacaga

SEQ ID NO: 7840698 - DNA, 22 bp, Homo sapiens
gctgctttagaattgaaacaga

SEQ ID NO: 7840699 - DNA, 22 bp, Homo sapiens
gctgctttacaggtgggggagc

SEQ ID NO: 7840700 - DNA, 22 bp, Homo sapiens
gctttggaaatatagactcaag

SEQ ID NO: 7840701 - DNA, 22 bp, Homo sapiens
gctttggaaatatagactcaag

SEQ ID NO: 7840702 - DNA, 17 bp, Homo sapiens
gctttggaaagccttcc

SEQ ID NO: 7840703 - DNA, 17 bp, Homo sapiens
gctttggaaagccttcc

SEQ ID NO: 7840704 - DNA, 22 bp, Homo sapiens
gctttggaaataagaggctaaa

SEQ ID NO: 7840705 - DNA, 22 bp, Homo sapiens
gctttggaaataagaggctaaa

SEQ ID NO: 7840706 - DNA, 22 bp, Homo sapiens
gctttggaacttaaatccttgg

SEQ ID NO: 7840707 - DNA, 22 bp, Homo sapiens
gctttggaacttaaatccttgg

SEQ ID NO: 7840708 - DNA, 22 bp, Homo sapiens
gctttggaaatatagactcaag

SEQ ID NO: 7840709 - DNA, 22 bp, Homo sapiens
gctttggaaggggctggtggag

SEQ ID NO: 7840710 - DNA, 22 bp, Homo sapiens
gctttggaacttaaatccttgg

SEQ ID NO: 7840711 - DNA, 22 bp, Homo sapiens
gctttgcttcctgttctagcct

SEQ ID NO: 7840712 - DNA, 22 bp, Homo sapiens
gctttgctgggtgcttcatgta

SEQ ID NO: 7840713 - DNA, 22 bp, Homo sapiens
gctttgctggcttgaaatgctg

SEQ ID NO: 7840714 - DNA, 22 bp, Homo sapiens
gctttgctggcttgaaatgctg

SEQ ID NO: 7840715 - DNA, 22 bp, Homo sapiens
gctttggaaactggccctgcgc

SEQ ID NO: 7840716 - DNA, 22 bp, Homo sapiens
gctttggaaactggccctgcgc

SEQ ID NO: 7840717 - DNA, 22 bp, Homo sapiens
gctttggaaactggccctgcgc

SEQ ID NO: 7840718 - DNA, 22 bp, Homo sapiens
gctttgcttccttccccttcaa

SEQ ID NO: 7840719 - DNA, 22 bp, Homo sapiens
gctttgcttccttccccttcaa

SEQ ID NO: 7840720 - DNA, 22 bp, Homo sapiens
gctttgcttcctgttctagcct

SEQ ID NO: 7840721 - DNA, 22 bp, Homo sapiens
gctttgctggcttgaaatgctg

SEQ ID NO: 7840722 - DNA, 22 bp, Homo sapiens
gctttgctgaggtctgaggatt

SEQ ID NO: 7840723 - DNA, 22 bp, Homo sapiens
gctttgctatgactcaccagca

SEQ ID NO: 7840724 - DNA, 22 bp, Homo sapiens
gctttgctatgactcaccagca

SEQ ID NO: 7840725 - DNA, 22 bp, Homo sapiens
gctttctgcctgggctccattt

SEQ ID NO: 7840726 - DNA, 22 bp, Homo sapiens
gctttctgcctgggctccattt

SEQ ID NO: 7840727 - DNA, 20 bp, Homo sapiens
gctttctatgagatggactg

SEQ ID NO: 7840728 - DNA, 18 bp, Homo sapiens
gctttctatgcgacagta

SEQ ID NO: 7840729 - DNA, 22 bp, Homo sapiens
gctttctgattgcgaaaacaaa

SEQ ID NO: 7840730 - DNA, 22 bp, Homo sapiens
gctttctgatgagcttaagaaa

SEQ ID NO: 7840731 - DNA, 22 bp, Homo sapiens
gctttctgaagcagtgtttctc

SEQ ID NO: 7840732 - DNA, 22 bp, Homo sapiens
gctttctgaagcagtgtttctc

SEQ ID NO: 7840733 - DNA, 22 bp, Homo sapiens
gctttctgaagcagtgtttctc

SEQ ID NO: 7840734 - DNA, 22 bp, Homo sapiens
gctttctcttcactgatgttca

SEQ ID NO: 7840735 - DNA, 22 bp, Homo sapiens
gctttcatgaaaataatctact

SEQ ID NO: 7840736 - DNA, 18 bp, Homo sapiens
gctttcaatttctttcct

SEQ ID NO: 7840737 - DNA, 18 bp, Homo sapiens
gctttcaatttctttcct

SEQ ID NO: 7840738 - DNA, 21 bp, Homo sapiens
gctttcagaagtctcatagtt

SEQ ID NO: 7840739 - DNA, 22 bp, Homo sapiens
gctttccctgccctcagaagga

SEQ ID NO: 7840740 - DNA, 22 bp, Homo sapiens
gctttcatgaaaataatctact

SEQ ID NO: 7840741 - DNA, 22 bp, Homo sapiens
gctttcatgaaaataatctact

SEQ ID NO: 7840742 - DNA, 22 bp, Homo sapiens
gctttctacaccaagtatgtgc

SEQ ID NO: 7840743 - DNA, 22 bp, Homo sapiens
gctttctaggcagagatgactg

SEQ ID NO: 7840744 - DNA, 22 bp, Homo sapiens
gctttctaggcagagatgactg

SEQ ID NO: 7840745 - DNA, 22 bp, Homo sapiens
gctttcctggccctgtccctgc

SEQ ID NO: 7840746 - DNA, 17 bp, Homo sapiens
gctttccttgcccctcc

SEQ ID NO: 7840747 - DNA, 22 bp, Homo sapiens
gctttattttgtgagggattac

SEQ ID NO: 7840748 - DNA, 22 bp, Homo sapiens
gctttattttgtgagggattac

SEQ ID NO: 7840749 - DNA, 22 bp, Homo sapiens
gctttattttgtgagggattac

SEQ ID NO: 7840750 - DNA, 22 bp, Homo sapiens
gctttattttgtgagggattac

SEQ ID NO: 7840751 - DNA, 22 bp, Homo sapiens
gctttattttgtgagggattac

SEQ ID NO: 7840752 - DNA, 22 bp, Homo sapiens
gctttattttgtgagggattac

SEQ ID NO: 7840753 - DNA, 22 bp, Homo sapiens
gctttattttgtgagggattac

SEQ ID NO: 7840754 - DNA, 22 bp, Homo sapiens
gctttattttgtgagggattac

SEQ ID NO: 7840755 - DNA, 22 bp, Homo sapiens
gctttcaaatcctaattccaac

SEQ ID NO: 7840756 - DNA, 20 bp, Homo sapiens
gctttcaagcttgtcattgt

SEQ ID NO: 7840757 - DNA, 22 bp, Homo sapiens
gctttcaattatgtcagcctgt

SEQ ID NO: 7840758 - DNA, 22 bp, Homo sapiens
gctttcaaggaatttggtattt

SEQ ID NO: 7840759 - DNA, 20 bp, Homo sapiens
gctttcaagcttgtcattgt

SEQ ID NO: 7840760 - DNA, 22 bp, Homo sapiens
ggaagaggctgagccaggtccc

SEQ ID NO: 7840761 - DNA, 22 bp, Homo sapiens
ggaagaggctgagccaggtccc

SEQ ID NO: 7840762 - DNA, 22 bp, Homo sapiens
ggaagaggctgaggccatgctg

SEQ ID NO: 7840763 - DNA, 22 bp, Homo sapiens
ggaagaggctgaggccatgctg

SEQ ID NO: 7840764 - DNA, 22 bp, Homo sapiens
ggaagaggctgaggccatgctg

SEQ ID NO: 7840765 - DNA, 22 bp, Homo sapiens
ggaagaggctggtagtgcccgt

SEQ ID NO: 7840766 - DNA, 22 bp, Homo sapiens
ggaagaggctgaggccatgctg

SEQ ID NO: 7840767 - DNA, 22 bp, Homo sapiens
ggaagaggctgaggccatgctg

SEQ ID NO: 7840768 - DNA, 22 bp, Homo sapiens
ggaagaggctgagccaggtccc

SEQ ID NO: 7840769 - DNA, 22 bp, Homo sapiens
ggaagaggctgaggccatgctg

SEQ ID NO: 7840770 - DNA, 22 bp, Homo sapiens
ggaagaggctctcattgagggc

SEQ ID NO: 7840771 - DNA, 22 bp, Homo sapiens
ggaagaggctctcattgagggc

SEQ ID NO: 7840772 - DNA, 22 bp, Homo sapiens
ggaagaggctctcattgagggc

SEQ ID NO: 7840773 - DNA, 22 bp, Homo sapiens
ggaagaggctgagccaggtccc

SEQ ID NO: 7840774 - DNA, 22 bp, Homo sapiens
ggaagaggctgagccaggtccc

SEQ ID NO: 7840775 - DNA, 22 bp, Homo sapiens
ggaagaggctgagccaggtccc

SEQ ID NO: 7840776 - DNA, 22 bp, Homo sapiens
ggaagaggctctcattgagggc

SEQ ID NO: 7840777 - DNA, 22 bp, Homo sapiens
ggaagaggctctcattgagggc

SEQ ID NO: 7840778 - DNA, 22 bp, Homo sapiens
ggaagaggctctcattgagggc

SEQ ID NO: 7840779 - DNA, 22 bp, Homo sapiens
ggaagaggaggagccaggcttt

SEQ ID NO: 7840780 - DNA, 22 bp, Homo sapiens
ggaagaggaggagccaggcttt

SEQ ID NO: 7840781 - DNA, 22 bp, Homo sapiens
ggaagaggaggagccaggcttt

SEQ ID NO: 7840782 - DNA, 22 bp, Homo sapiens
ggaagaggaggagccaggcttt

SEQ ID NO: 7840783 - DNA, 22 bp, Homo sapiens
ggaagaggaggagccaggcttt

SEQ ID NO: 7840784 - DNA, 22 bp, Homo sapiens
ggaagacaagcagtggctgagc

SEQ ID NO: 7840785 - DNA, 22 bp, Homo sapiens
ggaagacaagcagtggctgagc

SEQ ID NO: 7840786 - DNA, 22 bp, Homo sapiens
ggaagacagaagcctacagctt

SEQ ID NO: 7840787 - DNA, 22 bp, Homo sapiens
ggaagacaagcagtggctgagc

SEQ ID NO: 7840788 - DNA, 22 bp, Homo sapiens
ggaagacaagcagtggctgagc

SEQ ID NO: 7840789 - DNA, 22 bp, Homo sapiens
ggaagaagggtcattggcagcc

SEQ ID NO: 7840790 - DNA, 22 bp, Homo sapiens
ggaagaagggtcattggcagcc

SEQ ID NO: 7840791 - DNA, 19 bp, Homo sapiens
gctttggagggaggttcta

SEQ ID NO: 7840792 - DNA, 22 bp, Homo sapiens
gctttggagggcaagagctgtt

SEQ ID NO: 7840793 - DNA, 22 bp, Homo sapiens
gctttggagggcaagagctgtt

SEQ ID NO: 7840794 - DNA, 22 bp, Homo sapiens
gctttggagtcagaaagaccta

SEQ ID NO: 7840795 - DNA, 22 bp, Homo sapiens
gctttggagtcagaaagaccta

SEQ ID NO: 7840796 - DNA, 22 bp, Homo sapiens
gctttggagttaggactcggcc

SEQ ID NO: 7840797 - DNA, 22 bp, Homo sapiens
gctttggagttaggactcggcc

SEQ ID NO: 7840798 - DNA, 22 bp, Homo sapiens
gctttggagtcagaaagaccta

SEQ ID NO: 7840799 - DNA, 22 bp, Homo sapiens
gctttggagtcagaaagaccta

SEQ ID NO: 7840800 - DNA, 22 bp, Homo sapiens
ggaagaagcagggcatttgaat

SEQ ID NO: 7840801 - DNA, 22 bp, Homo sapiens
ggaagaagggtcattggcagcc

SEQ ID NO: 7840802 - DNA, 22 bp, Homo sapiens
gctttggagcctgtgttctgcc

SEQ ID NO: 7840803 - DNA, 22 bp, Homo sapiens
gctttggagcctgtgttctgcc

SEQ ID NO: 7840804 - DNA, 22 bp, Homo sapiens
gctttggacaataactgctttt

SEQ ID NO: 7840805 - DNA, 22 bp, Homo sapiens
gctttggacaataactgctttt

SEQ ID NO: 7840806 - DNA, 19 bp, Homo sapiens
gctttggagggaggttcta

SEQ ID NO: 7840807 - DNA, 22 bp, Homo sapiens
gctttggagcctgtgttctgcc

SEQ ID NO: 7840808 - DNA, 22 bp, Homo sapiens
gctttggaaggggctggtggag

SEQ ID NO: 7840809 - DNA, 17 bp, Homo sapiens
gctttggaagggtagac

SEQ ID NO: 7840810 - DNA, 22 bp, Homo sapiens
gctttggaatgtgctgttatag

SEQ ID NO: 7840811 - DNA, 22 bp, Homo sapiens
gctttggaatctgcatcctctt

SEQ ID NO: 7840812 - DNA, 22 bp, Homo sapiens
gctttggaatctgcatcctctt

SEQ ID NO: 7840813 - DNA, 22 bp, Homo sapiens
ggaatcagatgaggggcagagc

SEQ ID NO: 7840814 - DNA, 20 bp, Homo sapiens
ggaatcagggtaatgtactg

SEQ ID NO: 7840815 - DNA, 22 bp, Homo sapiens
ggaatccacgaatgtgcatttc

SEQ ID NO: 7840816 - DNA, 22 bp, Homo sapiens
ggaatcagatgaggggcagagc

SEQ ID NO: 7840817 - DNA, 22 bp, Homo sapiens
ggaatcagagcagaggctgtta

SEQ ID NO: 7840818 - DNA, 22 bp, Homo sapiens
ggaatcagatgaggggcagagc

SEQ ID NO: 7840819 - DNA, 22 bp, Homo sapiens
ggaatcagaattaggatttgaa

SEQ ID NO: 7840820 - DNA, 22 bp, Homo sapiens
ggaatccttgggtctgaacgtg

SEQ ID NO: 7840821 - DNA, 22 bp, Homo sapiens
ggaatcgttaggtaagcaggga

SEQ ID NO: 7840822 - DNA, 22 bp, Homo sapiens
ggaatctagaaagggagcaagg

SEQ ID NO: 7840823 - DNA, 22 bp, Homo sapiens
ggaatctagaaagggagcaagg

SEQ ID NO: 7840824 - DNA, 22 bp, Homo sapiens
ggaatcctgtgagggctgagag

SEQ ID NO: 7840825 - DNA, 22 bp, Homo sapiens
ggaatctcagcttctgccctga

SEQ ID NO: 7840826 - DNA, 22 bp, Homo sapiens
ggaatctcagtggagctgttag

SEQ ID NO: 7840827 - DNA, 15 bp, Homo sapiens
ggaatctctctgacc

SEQ ID NO: 7840828 - DNA, 22 bp, Homo sapiens
ggaatcttcagccatgccaaga

SEQ ID NO: 7840829 - DNA, 22 bp, Homo sapiens
ggaatcttaatggcatggagtt

SEQ ID NO: 7840830 - DNA, 22 bp, Homo sapiens
ggaagcagcctgaagccaaggg

SEQ ID NO: 7840831 - DNA, 22 bp, Homo sapiens
ggaagcagcctgaagccaaggg

SEQ ID NO: 7840832 - DNA, 22 bp, Homo sapiens
ggaagcagcctgaagccaaggg

SEQ ID NO: 7840833 - DNA, 20 bp, Homo sapiens
ggaagcagagaactgttttc

SEQ ID NO: 7840834 - DNA, 20 bp, Homo sapiens
ggaagcagagaactgttttc

SEQ ID NO: 7840835 - DNA, 22 bp, Homo sapiens
ggaagcaaattccagaaccaca

SEQ ID NO: 7840836 - DNA, 22 bp, Homo sapiens
ggaagcagcctgaagccaaggg

SEQ ID NO: 7840837 - DNA, 22 bp, Homo sapiens
ggaagcagcctgaagccaaggg

SEQ ID NO: 7840838 - DNA, 22 bp, Homo sapiens
ggaagcagcctgaagccaaggg

SEQ ID NO: 7840839 - DNA, 22 bp, Homo sapiens
ggaagcaggaggctggggtaaa

SEQ ID NO: 7840840 - DNA, 22 bp, Homo sapiens
ggaagcaggaggctggggtaaa

SEQ ID NO: 7840841 - DNA, 22 bp, Homo sapiens
ggaagcaggaggctggggtaaa

SEQ ID NO: 7840842 - DNA, 22 bp, Homo sapiens
ggaagcagcctgaagccaaggg

SEQ ID NO: 7840843 - DNA, 22 bp, Homo sapiens
ggaagcaggaggctggggtaaa

SEQ ID NO: 7840844 - DNA, 22 bp, Homo sapiens
ggaagaggctggtagtgcccgt

SEQ ID NO: 7840845 - DNA, 22 bp, Homo sapiens
ggaagaggctggtagtgcccgt

SEQ ID NO: 7840846 - DNA, 22 bp, Homo sapiens
ggaagaggctggtagtgcccgt

SEQ ID NO: 7840847 - DNA, 22 bp, Homo sapiens
ggaagaggctggtagtgcccgt

SEQ ID NO: 7840848 - DNA, 22 bp, Homo sapiens
ggaagagggaaccacgactgta

SEQ ID NO: 7840849 - DNA, 22 bp, Homo sapiens
ggaagagggaaccacgactgta

SEQ ID NO: 7840850 - DNA, 22 bp, Homo sapiens
ggaagagggaaccacgactgta

SEQ ID NO: 7840851 - DNA, 22 bp, Homo sapiens
ggaagagtaacaggaggtggaa

SEQ ID NO: 7840852 - DNA, 22 bp, Homo sapiens
ggaagagggaaccacgactgta

SEQ ID NO: 7840853 - DNA, 22 bp, Homo sapiens
ggaagagggaaccacgactgta

SEQ ID NO: 7840854 - DNA, 22 bp, Homo sapiens
ggaagattcagttatctcatga

SEQ ID NO: 7840855 - DNA, 22 bp, Homo sapiens
ggaagattcagcatatatgagt

SEQ ID NO: 7840856 - DNA, 22 bp, Homo sapiens
ggaagcaaaatcatcagtcatt

SEQ ID NO: 7840857 - DNA, 22 bp, Homo sapiens
ggaagcaaaatcatcagtcatt

SEQ ID NO: 7840858 - DNA, 22 bp, Homo sapiens
ggaagatgagaagtggggctcc

SEQ ID NO: 7840859 - DNA, 22 bp, Homo sapiens
ggaagatgcccaacccagcttt

SEQ ID NO: 7840860 - DNA, 22 bp, Homo sapiens
ggaagatgagaagtggggctcc

SEQ ID NO: 7840861 - DNA, 22 bp, Homo sapiens
ggaattctgtagctcttcctct

SEQ ID NO: 7840862 - DNA, 22 bp, Homo sapiens
ggaatgtttttcattgctctct

SEQ ID NO: 7840863 - DNA, 22 bp, Homo sapiens
ggaatgttttagcttgactttt

SEQ ID NO: 7840864 - DNA, 22 bp, Homo sapiens
ggaatgtttttcattgctctct

SEQ ID NO: 7840865 - DNA, 22 bp, Homo sapiens
ggaatgttttccagacctagat

SEQ ID NO: 7840866 - DNA, 22 bp, Homo sapiens
ggacaaaccaatagacactggc

SEQ ID NO: 7840867 - DNA, 22 bp, Homo sapiens
ggaatttagatgtttctcaact

SEQ ID NO: 7840868 - DNA, 22 bp, Homo sapiens
ggaatttagatgtttctcaact

SEQ ID NO: 7840869 - DNA, 18 bp, Homo sapiens
ggacacagataggtacag

SEQ ID NO: 7840870 - DNA, 18 bp, Homo sapiens
ggacacagataggtacag

SEQ ID NO: 7840871 - DNA, 22 bp, Homo sapiens
ggacacagccacttagggtacc

SEQ ID NO: 7840872 - DNA, 22 bp, Homo sapiens
ggacacagccacttagggtacc

SEQ ID NO: 7840873 - DNA, 18 bp, Homo sapiens
ggacacagataggtacag

SEQ ID NO: 7840874 - DNA, 22 bp, Homo sapiens
ggacacagataatcacacagat

SEQ ID NO: 7840875 - DNA, 22 bp, Homo sapiens
ggacaaagcctggtggcaggtg

SEQ ID NO: 7840876 - DNA, 17 bp, Homo sapiens
ggacacagctcatggct

SEQ ID NO: 7840877 - DNA, 17 bp, Homo sapiens
ggacacagctcatggct

SEQ ID NO: 7840878 - DNA, 22 bp, Homo sapiens
ggacacagctgcagccacaccc

SEQ ID NO: 7840879 - DNA, 17 bp, Homo sapiens
ggacacagctcatggct

SEQ ID NO: 7840880 - DNA, 17 bp, Homo sapiens
ggacacagctcatggct

SEQ ID NO: 7840881 - DNA, 17 bp, Homo sapiens
ggacacagctcatggct

SEQ ID NO: 7840882 - DNA, 17 bp, Homo sapiens
ggacacagctcatggct

SEQ ID NO: 7840883 - DNA, 17 bp, Homo sapiens
ggacacagctcatggct

SEQ ID NO: 7840884 - DNA, 22 bp, Homo sapiens
ggaatgagctcggagcagaagg

SEQ ID NO: 7840885 - DNA, 22 bp, Homo sapiens
ggaatgcaattttacaattctg

SEQ ID NO: 7840886 - DNA, 22 bp, Homo sapiens
ggaatgcagtaagtgatttgaa

SEQ ID NO: 7840887 - DNA, 22 bp, Homo sapiens
ggaatgcactgaaaattgtgct

SEQ ID NO: 7840888 - DNA, 22 bp, Homo sapiens
ggaatctttgaaggattttaag

SEQ ID NO: 7840889 - DNA, 22 bp, Homo sapiens
ggaatctttgaaggattttaag

SEQ ID NO: 7840890 - DNA, 22 bp, Homo sapiens
ggaatctttttcataagcctca

SEQ ID NO: 7840891 - DNA, 22 bp, Homo sapiens
ggaatgaaacacttctgattct

SEQ ID NO: 7840892 - DNA, 22 bp, Homo sapiens
ggaatgaagaaatagatggtgt

SEQ ID NO: 7840893 - DNA, 22 bp, Homo sapiens
ggaatgaatttccagctgggtc

SEQ ID NO: 7840894 - DNA, 22 bp, Homo sapiens
ggaatgaagaaatagatggtgt

SEQ ID NO: 7840895 - DNA, 22 bp, Homo sapiens
ggaatgaagaaatagatggtgt

SEQ ID NO: 7840896 - DNA, 22 bp, Homo sapiens
ggaatgttgtcatttacattat

SEQ ID NO: 7840897 - DNA, 22 bp, Homo sapiens
ggaatgtgttcttactgtattt

SEQ ID NO: 7840898 - DNA, 22 bp, Homo sapiens
ggaatgttctggtctggttcat

SEQ ID NO: 7840899 - DNA, 22 bp, Homo sapiens
ggaatgttctggaacaccgctt

SEQ ID NO: 7840900 - DNA, 22 bp, Homo sapiens
ggaatgtttgctcccttcaggg

SEQ ID NO: 7840901 - DNA, 22 bp, Homo sapiens
ggaatgttttagcttgactttt

SEQ ID NO: 7840902 - DNA, 22 bp, Homo sapiens
ggaatgtttgctcccttcaggg

SEQ ID NO: 7840903 - DNA, 22 bp, Homo sapiens
ggaatgttgtcatttacattat

SEQ ID NO: 7840904 - DNA, 23 bp, Homo sapiens
ggaatgtttacctgtgaatgtca

SEQ ID NO: 7840905 - DNA, 22 bp, Homo sapiens
ggaatgggagctattagtggaa

SEQ ID NO: 7840906 - DNA, 22 bp, Homo sapiens
ggaatgtaaatttactgttgta

SEQ ID NO: 7840907 - DNA, 22 bp, Homo sapiens
ggaatgtagtttgtgcactgta

SEQ ID NO: 7840908 - DNA, 22 bp, Homo sapiens
ggaatgtgcgtactcagtgtca

SEQ ID NO: 7840909 - DNA, 22 bp, Homo sapiens
ggaatgtgctgacacgcgagag

SEQ ID NO: 7840910 - DNA, 18 bp, Homo sapiens
ggaatgtggacaggctgg

SEQ ID NO: 7840911 - DNA, 22 bp, Homo sapiens
ggagactcaccccgcattctag

SEQ ID NO: 7840912 - DNA, 19 bp, Homo sapiens
ggagactcagcccatgcct

SEQ ID NO: 7840913 - DNA, 18 bp, Homo sapiens
ggagactaaactgttgac

SEQ ID NO: 7840914 - DNA, 22 bp, Homo sapiens
ggagactacctagcaggctgtt

SEQ ID NO: 7840915 - DNA, 22 bp, Homo sapiens
ggagacatgcagactgagatac

SEQ ID NO: 7840916 - DNA, 22 bp, Homo sapiens
ggagacatattccagagctggg

SEQ ID NO: 7840917 - DNA, 22 bp, Homo sapiens
ggagacatgcagactgagatac

SEQ ID NO: 7840918 - DNA, 22 bp, Homo sapiens
ggagaccagaaggaagcttcga

SEQ ID NO: 7840919 - DNA, 22 bp, Homo sapiens
ggagaccagaaggaagcttcga

SEQ ID NO: 7840920 - DNA, 18 bp, Homo sapiens
ggagactaaactgttgac

SEQ ID NO: 7840921 - DNA, 22 bp, Homo sapiens
ggagacccaggttaggaagtaa

SEQ ID NO: 7840922 - DNA, 22 bp, Homo sapiens
ggagaccaggtcagagatggtg

SEQ ID NO: 7840923 - DNA, 22 bp, Homo sapiens
ggagacagtggtagggcctaag

SEQ ID NO: 7840924 - DNA, 22 bp, Homo sapiens
ggagacagtggtagggcctaag

SEQ ID NO: 7840925 - DNA, 22 bp, Homo sapiens
ggagacagtggtagggcctaag

SEQ ID NO: 7840926 - DNA, 22 bp, Homo sapiens
ggagacagtggtagggcctaag

SEQ ID NO: 7840927 - DNA, 22 bp, Homo sapiens
ggagacagtggtagggcctaag

SEQ ID NO: 7840928 - DNA, 22 bp, Homo sapiens
ggagacagtgacttagagactg

SEQ ID NO: 7840929 - DNA, 22 bp, Homo sapiens
ggagacagtgacttagagactg

SEQ ID NO: 7840930 - DNA, 22 bp, Homo sapiens
ggagagaattccatggacatgt

SEQ ID NO: 7840931 - DNA, 22 bp, Homo sapiens
ggagagaattcagcttaagatt

SEQ ID NO: 7840932 - DNA, 22 bp, Homo sapiens
ggagagaattccatggacatgt

SEQ ID NO: 7840933 - DNA, 22 bp, Homo sapiens
ggagagaattccatggacatgt

SEQ ID NO: 7840934 - DNA, 22 bp, Homo sapiens
ggagagaactgacctgaaagga

SEQ ID NO: 7840935 - DNA, 22 bp, Homo sapiens
ggagagaactgacctgaaagga

SEQ ID NO: 7840936 - DNA, 22 bp, Homo sapiens
ggagagaactggctccttctag

SEQ ID NO: 7840937 - DNA, 22 bp, Homo sapiens
ggagagaactggctccttctag

SEQ ID NO: 7840938 - DNA, 22 bp, Homo sapiens
ggagagaactggctccttctag

SEQ ID NO: 7840939 - DNA, 22 bp, Homo sapiens
ggagagaagggagaatttgttc

SEQ ID NO: 7840940 - DNA, 22 bp, Homo sapiens
ggagagaagggagaatttgttc

SEQ ID NO: 7840941 - DNA, 22 bp, Homo sapiens
ggagagaactggctccttctag

SEQ ID NO: 7840942 - DNA, 22 bp, Homo sapiens
ggagagaatctgaacctgctcc

SEQ ID NO: 7840943 - DNA, 22 bp, Homo sapiens
ggagagaatctgaacctgctcc

SEQ ID NO: 7840944 - DNA, 22 bp, Homo sapiens
ggagagaatctgaacctgctcc

SEQ ID NO: 7840945 - DNA, 22 bp, Homo sapiens
ggagagaaattgaggtagcaag

SEQ ID NO: 7840946 - DNA, 22 bp, Homo sapiens
ggagagaactgacctgaaagga

SEQ ID NO: 7840947 - DNA, 22 bp, Homo sapiens
ggagagaactgacctgaaagga

SEQ ID NO: 7840948 - DNA, 22 bp, Homo sapiens
ggagagaaattgaggtagcaag

SEQ ID NO: 7840949 - DNA, 22 bp, Homo sapiens
ggagacttgagtttttgtctta

SEQ ID NO: 7840950 - DNA, 22 bp, Homo sapiens
ggagagaaattgaggtagcaag

SEQ ID NO: 7840951 - DNA, 22 bp, Homo sapiens
ggagagaaattgaggtagcaag

SEQ ID NO: 7840952 - DNA, 22 bp, Homo sapiens
ggagagaaattgaggtagcaag

SEQ ID NO: 7840953 - DNA, 22 bp, Homo sapiens
ggagagaaattgaggtagcaag

SEQ ID NO: 7840954 - DNA, 22 bp, Homo sapiens
ggagagaaattgaggtagcaag

SEQ ID NO: 7840955 - DNA, 22 bp, Homo sapiens
ggagagagagattgtgtttatt

SEQ ID NO: 7840956 - DNA, 22 bp, Homo sapiens
ggagagagagctcattagctgc

SEQ ID NO: 7840957 - DNA, 22 bp, Homo sapiens
ggagagagagctcattagctgc

SEQ ID NO: 7840958 - DNA, 22 bp, Homo sapiens
ggagagagagctcattagctgc

SEQ ID NO: 7840959 - DNA, 22 bp, Homo sapiens
ggagagagacctccatgcccag

SEQ ID NO: 7840960 - DNA, 22 bp, Homo sapiens
ggagagagagattgtgtttatt

SEQ ID NO: 7840961 - DNA, 22 bp, Homo sapiens
ggagagagagattgtgtttatt

SEQ ID NO: 7840962 - DNA, 22 bp, Homo sapiens
ggagagaattccatggacatgt

SEQ ID NO: 7840963 - DNA, 22 bp, Homo sapiens
ggagagagacctccatgcccag

SEQ ID NO: 7840964 - DNA, 22 bp, Homo sapiens
ggagagagacctccatgcccag

SEQ ID NO: 7840965 - DNA, 22 bp, Homo sapiens
ggagagagacctccatgcccag

SEQ ID NO: 7840966 - DNA, 22 bp, Homo sapiens
ggagagagacctccatgcccag

SEQ ID NO: 7840967 - DNA, 22 bp, Homo sapiens
ggagcagatgtcttcatggcct

SEQ ID NO: 7840968 - DNA, 22 bp, Homo sapiens
ggagcagcactgccacacagag

SEQ ID NO: 7840969 - DNA, 22 bp, Homo sapiens
ggagcagcactgccacacagag

SEQ ID NO: 7840970 - DNA, 22 bp, Homo sapiens
ggagcagcactgccacacagag

SEQ ID NO: 7840971 - DNA, 22 bp, Homo sapiens
ggagcaggctctgtggtttcca

SEQ ID NO: 7840972 - DNA, 22 bp, Homo sapiens
ggagcagggaattacagcgcag

SEQ ID NO: 7840973 - DNA, 22 bp, Homo sapiens
ggagcagggaattacagcgcag

SEQ ID NO: 7840974 - DNA, 22 bp, Homo sapiens
ggagcagggaattacagcgcag

SEQ ID NO: 7840975 - DNA, 22 bp, Homo sapiens
ggagcagggaattacagcgcag

SEQ ID NO: 7840976 - DNA, 22 bp, Homo sapiens
ggagcagggaattacagcgcag

SEQ ID NO: 7840977 - DNA, 22 bp, Homo sapiens
ggagcagcactgccacacagag

SEQ ID NO: 7840978 - DNA, 22 bp, Homo sapiens
ggagcaggctctgtggtttcca

SEQ ID NO: 7840979 - DNA, 22 bp, Homo sapiens
ggagcaggctctgtggtttcca

SEQ ID NO: 7840980 - DNA, 22 bp, Homo sapiens
ggagcagttgttgagcaagcca

SEQ ID NO: 7840981 - DNA, 22 bp, Homo sapiens
ggagcagtggtcattcagctgg

SEQ ID NO: 7840982 - DNA, 22 bp, Homo sapiens
ggagcatgcgctctgtgaccga

SEQ ID NO: 7840983 - DNA, 22 bp, Homo sapiens
ggagcatctgaacagggagaag

SEQ ID NO: 7840984 - DNA, 22 bp, Homo sapiens
ggagcagggcagtgaattctgg

SEQ ID NO: 7840985 - DNA, 22 bp, Homo sapiens
ggagcagtctaaatgataagag

SEQ ID NO: 7840986 - DNA, 22 bp, Homo sapiens
ggagcagggcagtgaattctgg

SEQ ID NO: 7840987 - DNA, 22 bp, Homo sapiens
ggagcagggaattacagcgcag

SEQ ID NO: 7840988 - DNA, 22 bp, Homo sapiens
ggagcagggaattacagcgcag

SEQ ID NO: 7840989 - DNA, 22 bp, Homo sapiens
ggagccagagcactggggagcc

SEQ ID NO: 7840990 - DNA, 22 bp, Homo sapiens
ggagccagagcactggggagcc

SEQ ID NO: 7840991 - DNA, 22 bp, Homo sapiens
ggagccagagcactggggagcc

SEQ ID NO: 7840992 - DNA, 22 bp, Homo sapiens
ggagccagagcactggggagcc

SEQ ID NO: 7840993 - DNA, 22 bp, Homo sapiens
ggagccagagcactggggagcc

SEQ ID NO: 7840994 - DNA, 22 bp, Homo sapiens
ggagccagagcactggggagcc

SEQ ID NO: 7840995 - DNA, 22 bp, Homo sapiens
ggagccagaaatgctgtggttg

SEQ ID NO: 7840996 - DNA, 22 bp, Homo sapiens
ggagccagaaatgctgtggttg

SEQ ID NO: 7840997 - DNA, 22 bp, Homo sapiens
ggagccagaaatgctgtggttg

SEQ ID NO: 7840998 - DNA, 22 bp, Homo sapiens
ggagccagaaatgctgtggttg

SEQ ID NO: 7840999 - DNA, 22 bp, Homo sapiens
ggagccagaaatgctgtggttg

SEQ ID NO: 7841000 - DNA, 22 bp, Homo sapiens
ggagccagaaatgctgtggttg

SEQ ID NO: 7841001 - DNA, 22 bp, Homo sapiens
ggagcatgggtcagaactcagt

SEQ ID NO: 7841002 - DNA, 22 bp, Homo sapiens
ggagcatgggtcagaactcagt

SEQ ID NO: 7841003 - DNA, 22 bp, Homo sapiens
ggagcatgtggggtgagcaggg

SEQ ID NO: 7841004 - DNA, 22 bp, Homo sapiens
ggagcatgtggggtgagcaggg

SEQ ID NO: 7841005 - DNA, 22 bp, Homo sapiens
ggagcatgtggggtgagcaggg

SEQ ID NO: 7841006 - DNA, 22 bp, Homo sapiens
ggagcatgtggggtgagcaggg

SEQ ID NO: 7841007 - DNA, 22 bp, Homo sapiens
ggagcatgtggggtgagcaggg

SEQ ID NO: 7841008 - DNA, 22 bp, Homo sapiens
ggagccagaaatgctgtggttg

SEQ ID NO: 7841009 - DNA, 22 bp, Homo sapiens
ggagcatgtggggtgagcaggg

SEQ ID NO: 7841010 - DNA, 22 bp, Homo sapiens
ggagccaaagcacctcggacgt

SEQ ID NO: 7841011 - DNA, 22 bp, Homo sapiens
ggagccaacccttgtgaagaca

SEQ ID NO: 7841012 - DNA, 22 bp, Homo sapiens
ggacagtgaatctggaggtata

SEQ ID NO: 7841013 - DNA, 22 bp, Homo sapiens
ggacagtgaatgtggggatgca

SEQ ID NO: 7841014 - DNA, 22 bp, Homo sapiens
ggacagtgaatgtggggatgca

SEQ ID NO: 7841015 - DNA, 19 bp, Homo sapiens
ggacagtctcagcctcatg

SEQ ID NO: 7841016 - DNA, 20 bp, Homo sapiens
ggacagtgagacatatctca

SEQ ID NO: 7841017 - DNA, 20 bp, Homo sapiens
ggacagtgagacatatctca

SEQ ID NO: 7841018 - DNA, 22 bp, Homo sapiens
ggacagtgcgagacacagtaac

SEQ ID NO: 7841019 - DNA, 22 bp, Homo sapiens
ggacagtgcgagacacagtaac

SEQ ID NO: 7841020 - DNA, 22 bp, Homo sapiens
ggacagtggcctggtggtatag

SEQ ID NO: 7841021 - DNA, 22 bp, Homo sapiens
ggacagtgcgagacacagtaac

SEQ ID NO: 7841022 - DNA, 22 bp, Homo sapiens
ggacatagaggccctgcatggc

SEQ ID NO: 7841023 - DNA, 19 bp, Homo sapiens
ggacatcactctaagcctt

SEQ ID NO: 7841024 - DNA, 22 bp, Homo sapiens
ggacagtgtgggccatctcact

SEQ ID NO: 7841025 - DNA, 22 bp, Homo sapiens
ggacaggtgcaaagggcacatg

SEQ ID NO: 7841026 - DNA, 22 bp, Homo sapiens
ggacaggtgtgaggctggcaca

SEQ ID NO: 7841027 - DNA, 22 bp, Homo sapiens
ggacaggtgactgcccagagtg

SEQ ID NO: 7841028 - DNA, 22 bp, Homo sapiens
ggacaggtgactgcccagagtg

SEQ ID NO: 7841029 - DNA, 22 bp, Homo sapiens
ggacagtccacctcagtgaaga

SEQ ID NO: 7841030 - DNA, 22 bp, Homo sapiens
ggacagtccacctcagtgaaga

SEQ ID NO: 7841031 - DNA, 22 bp, Homo sapiens
ggacagtagtcactaaactaga

SEQ ID NO: 7841032 - DNA, 22 bp, Homo sapiens
ggacaggttcagcagtttataa

SEQ ID NO: 7841033 - DNA, 22 bp, Homo sapiens
ggacacagctgcagccacaccc

SEQ ID NO: 7841034 - DNA, 22 bp, Homo sapiens
ggacacaggcagctgggtgggt

SEQ ID NO: 7841035 - DNA, 22 bp, Homo sapiens
ggacacaggcagctgggtgggt

SEQ ID NO: 7841036 - DNA, 22 bp, Homo sapiens
ggacacaggcagctgggtgggt

SEQ ID NO: 7841037 - DNA, 22 bp, Homo sapiens
ggacacaggcagctgggtgggt

SEQ ID NO: 7841038 - DNA, 22 bp, Homo sapiens
ggacacagctgcagccacaccc

SEQ ID NO: 7841039 - DNA, 22 bp, Homo sapiens
ggacacagctgcagccacaccc

SEQ ID NO: 7841040 - DNA, 22 bp, Homo sapiens
ggacacagctgcagccacaccc

SEQ ID NO: 7841041 - DNA, 17 bp, Homo sapiens
ggacacagctcatggct

SEQ ID NO: 7841042 - DNA, 22 bp, Homo sapiens
ggacacagctgcagccacaccc

SEQ ID NO: 7841043 - DNA, 23 bp, Homo sapiens
ggacacaggccttgtctgcgcct

SEQ ID NO: 7841044 - DNA, 22 bp, Homo sapiens
ggacacagggctcactctctct

SEQ ID NO: 7841045 - DNA, 23 bp, Homo sapiens
ggacacaggccttgtctgcgcct

SEQ ID NO: 7841046 - DNA, 22 bp, Homo sapiens
ggacacaggtaaataccactga

SEQ ID NO: 7841047 - DNA, 22 bp, Homo sapiens
ggacacagggctcactctctct

SEQ ID NO: 7841048 - DNA, 22 bp, Homo sapiens
ggacacagggctcactctctct

SEQ ID NO: 7841049 - DNA, 22 bp, Homo sapiens
ggacacagtggaagacagcttg

SEQ ID NO: 7841050 - DNA, 22 bp, Homo sapiens
ggacacagtggaagacagcttg

SEQ ID NO: 7841051 - DNA, 22 bp, Homo sapiens
ggacagggtaagtactagtgtg

SEQ ID NO: 7841052 - DNA, 22 bp, Homo sapiens
ggacagggtaagtactagtgtg

SEQ ID NO: 7841053 - DNA, 22 bp, Homo sapiens
ggacagggtaagtactagtgtg

SEQ ID NO: 7841054 - DNA, 22 bp, Homo sapiens
ggacacagtggaagacagcttg

SEQ ID NO: 7841055 - DNA, 22 bp, Homo sapiens
ggacagggtaagtactagtgtg

SEQ ID NO: 7841056 - DNA, 22 bp, Homo sapiens
ggacacaggtaaataccactga

SEQ ID NO: 7841057 - DNA, 22 bp, Homo sapiens
ggacacagtggaagacagcttg

SEQ ID NO: 7841058 - DNA, 22 bp, Homo sapiens
ggacacagtggaagacagcttg

SEQ ID NO: 7841059 - DNA, 22 bp, Homo sapiens
ggacagggtaagtactagtgtg

SEQ ID NO: 7841060 - DNA, 22 bp, Homo sapiens
ggacagggttggggcatataaa

SEQ ID NO: 7841061 - DNA, 22 bp, Homo sapiens
ggacagggttggggcatataaa

SEQ ID NO: 7841062 - DNA, 19 bp, Homo sapiens
ggaccaggtcctgggcagc

SEQ ID NO: 7841063 - DNA, 17 bp, Homo sapiens
ggaccaggggttgccat

SEQ ID NO: 7841064 - DNA, 19 bp, Homo sapiens
ggaccaggtcctgggcagc

SEQ ID NO: 7841065 - DNA, 17 bp, Homo sapiens
ggaccaggggttgccat

SEQ ID NO: 7841066 - DNA, 19 bp, Homo sapiens
ggaccaggtcctgggcagc

SEQ ID NO: 7841067 - DNA, 22 bp, Homo sapiens
ggaccaggggcgcactccctgc

SEQ ID NO: 7841068 - DNA, 22 bp, Homo sapiens
ggaccaggctgagcacctgcct

SEQ ID NO: 7841069 - DNA, 19 bp, Homo sapiens
ggaccaggtcctgggcagc

SEQ ID NO: 7841070 - DNA, 19 bp, Homo sapiens
ggaccaggtcctgggcagc

SEQ ID NO: 7841071 - DNA, 19 bp, Homo sapiens
ggaccaggtcctgggcagc

SEQ ID NO: 7841072 - DNA, 20 bp, Homo sapiens
ggaccaggtggggcggtggc

SEQ ID NO: 7841073 - DNA, 20 bp, Homo sapiens
ggaccaggtggggcggtggc

SEQ ID NO: 7841074 - DNA, 20 bp, Homo sapiens
ggaccaggtggggcggtggc

SEQ ID NO: 7841075 - DNA, 22 bp, Homo sapiens
ggaccagtttcaaactgtacca

SEQ ID NO: 7841076 - DNA, 22 bp, Homo sapiens
ggagacagtatggcttgtagct

SEQ ID NO: 7841077 - DNA, 22 bp, Homo sapiens
ggagacagggttgaaccacgca

SEQ ID NO: 7841078 - DNA, 22 bp, Homo sapiens
ggaccatgttccctctgaagct

SEQ ID NO: 7841079 - DNA, 22 bp, Homo sapiens
ggaccatgaggagatgggcctc

SEQ ID NO: 7841080 - DNA, 22 bp, Homo sapiens
ggagacagtgacttagagactg

SEQ ID NO: 7841081 - DNA, 22 bp, Homo sapiens
ggagacagtatggcttgtagct

SEQ ID NO: 7841082 - DNA, 22 bp, Homo sapiens
ggagacagtatggcttgtagct

SEQ ID NO: 7841083 - DNA, 22 bp, Homo sapiens
ggagacagtatggcttgtagct

SEQ ID NO: 7841084 - DNA, 22 bp, Homo sapiens
ggagacagtatggcttgtagct

SEQ ID NO: 7841085 - DNA, 18 bp, Homo sapiens
ggacatcatcaggtgctt

SEQ ID NO: 7841086 - DNA, 18 bp, Homo sapiens
ggacatcatcaggtgctt

SEQ ID NO: 7841087 - DNA, 19 bp, Homo sapiens
ggacatcactctaagcctt

SEQ ID NO: 7841088 - DNA, 22 bp, Homo sapiens
ggacatcatattgcccagggcc

SEQ ID NO: 7841089 - DNA, 22 bp, Homo sapiens
ggacatctcttgccagggctgc

SEQ ID NO: 7841090 - DNA, 22 bp, Homo sapiens
ggacatctgggccccaggtcta

SEQ ID NO: 7841091 - DNA, 22 bp, Homo sapiens
ggacatctgttgtggtagagga

SEQ ID NO: 7841092 - DNA, 22 bp, Homo sapiens
ggacatcgagccaatgggaact

SEQ ID NO: 7841093 - DNA, 21 bp, Homo sapiens
ggacatgaggcaggagaggct

SEQ ID NO: 7841094 - DNA, 21 bp, Homo sapiens
ggacatgaggcaggagaggct

SEQ ID NO: 7841095 - DNA, 22 bp, Homo sapiens
ggacatgaagcaaaatgggagg

SEQ ID NO: 7841096 - DNA, 22 bp, Homo sapiens
ggacatcttggttgcttccaag

SEQ ID NO: 7841097 - DNA, 22 bp, Homo sapiens
ggacatggaaatcggcttgctc

SEQ ID NO: 7841098 - DNA, 22 bp, Homo sapiens
ggacatgatatttcaggaagac

SEQ ID NO: 7841099 - DNA, 22 bp, Homo sapiens
ggacatgattagcagggagagc

SEQ ID NO: 7841100 - DNA, 20 bp, Homo sapiens
ggaccagctgtctgaggggc

SEQ ID NO: 7841101 - DNA, 22 bp, Homo sapiens
ggacatggaaatcggcttgctc

SEQ ID NO: 7841102 - DNA, 22 bp, Homo sapiens
ggaccaggactggtggtatctc

SEQ ID NO: 7841103 - DNA, 22 bp, Homo sapiens
ggaccaggagctcagagccctc

SEQ ID NO: 7841104 - DNA, 19 bp, Homo sapiens
ggaccagctttcaggaggc

SEQ ID NO: 7841105 - DNA, 22 bp, Homo sapiens
ggaccaggagctcagagccctc

SEQ ID NO: 7841106 - DNA, 22 bp, Homo sapiens
ggaccaggagctcagagccctc

SEQ ID NO: 7841107 - DNA, 22 bp, Homo sapiens
ggaccaggagctcagagccctc

SEQ ID NO: 7841108 - DNA, 22 bp, Homo sapiens
ggaccaggcaagctgaggcggg

SEQ ID NO: 7841109 - DNA, 22 bp, Homo sapiens
ggaccaggcaagctgaggcggg

SEQ ID NO: 7841110 - DNA, 22 bp, Homo sapiens
ggaccaggcaagctgaggcggg

SEQ ID NO: 7841111 - DNA, 22 bp, Homo sapiens
ggaccaggccagcctccctgcg

SEQ ID NO: 7841112 - DNA, 22 bp, Homo sapiens
ggaccaggctgagcacctgcct

SEQ ID NO: 7841113 - DNA, 22 bp, Homo sapiens
ggaccaggctgagcacctgcct

SEQ ID NO: 7841114 - DNA, 22 bp, Homo sapiens
ggaccaggctgagcacctgcct

SEQ ID NO: 7841115 - DNA, 22 bp, Homo sapiens
ggaccaggccagcctccctgcg

SEQ ID NO: 7841116 - DNA, 22 bp, Homo sapiens
ggaccaggctgagcacctgcct

SEQ ID NO: 7841117 - DNA, 22 bp, Homo sapiens
ggaccaggctgagcacctgcct

SEQ ID NO: 7841118 - DNA, 22 bp, Homo sapiens
gcacaggctccggaggagagct

SEQ ID NO: 7841119 - DNA, 22 bp, Homo sapiens
gcacaggctccggaggagagct

SEQ ID NO: 7841120 - DNA, 22 bp, Homo sapiens
gcacaggctccggaggagagct

SEQ ID NO: 7841121 - DNA, 22 bp, Homo sapiens
gcacaggccatgggaggacagc

SEQ ID NO: 7841122 - DNA, 22 bp, Homo sapiens
gcacagaaccagacatgaggca

SEQ ID NO: 7841123 - DNA, 22 bp, Homo sapiens
gcacaggccatgggaggacagc

SEQ ID NO: 7841124 - DNA, 22 bp, Homo sapiens
gcacaggccatgggaggacagc

SEQ ID NO: 7841125 - DNA, 22 bp, Homo sapiens
gcacaggccatgggaggacagc

SEQ ID NO: 7841126 - DNA, 22 bp, Homo sapiens
gcacagaacagagaaatagcca

SEQ ID NO: 7841127 - DNA, 22 bp, Homo sapiens
gcacagaacagagaaatagcca

SEQ ID NO: 7841128 - DNA, 22 bp, Homo sapiens
gcacagaacagagaaatagcca

SEQ ID NO: 7841129 - DNA, 22 bp, Homo sapiens
gcacagaacactggtgagtccc

SEQ ID NO: 7841130 - DNA, 22 bp, Homo sapiens
gcacagaacactggtgagtccc

SEQ ID NO: 7841131 - DNA, 22 bp, Homo sapiens
gcacagaaatgtctacacatgt

SEQ ID NO: 7841132 - DNA, 22 bp, Homo sapiens
gcacagaacactggtgagtccc

SEQ ID NO: 7841133 - DNA, 22 bp, Homo sapiens
gcacagaaatgtctacacatgt

SEQ ID NO: 7841134 - DNA, 22 bp, Homo sapiens
gcacactgtgaatttgcatatg

SEQ ID NO: 7841135 - DNA, 22 bp, Homo sapiens
gcacactcctggatcctagaga

SEQ ID NO: 7841136 - DNA, 22 bp, Homo sapiens
gcacactgcggtgatgtgagtc

SEQ ID NO: 7841137 - DNA, 22 bp, Homo sapiens
gcacactgcggtgatgtgagtc

SEQ ID NO: 7841138 - DNA, 22 bp, Homo sapiens
gcacactgcggtgatgtgagtc

SEQ ID NO: 7841139 - DNA, 22 bp, Homo sapiens
gcacaccctctcaccagcactg

SEQ ID NO: 7841140 - DNA, 22 bp, Homo sapiens
gcacaccttagaggggagctgc

SEQ ID NO: 7841141 - DNA, 19 bp, Homo sapiens
gcacaccctgcaccaccat

SEQ ID NO: 7841142 - DNA, 22 bp, Homo sapiens
gcacagtgataggcagttgtgc

SEQ ID NO: 7841143 - DNA, 22 bp, Homo sapiens
gcacagtgataggcagttgtgc

SEQ ID NO: 7841144 - DNA, 22 bp, Homo sapiens
gcacagtgataggcagttgtgc

SEQ ID NO: 7841145 - DNA, 22 bp, Homo sapiens
gcacagtatttagtagaatgag

SEQ ID NO: 7841146 - DNA, 22 bp, Homo sapiens
gcacagtcaacacttattcacc

SEQ ID NO: 7841147 - DNA, 22 bp, Homo sapiens
gcacagtgataggcagttgtgc

SEQ ID NO: 7841148 - DNA, 22 bp, Homo sapiens
gcacagtatttagtagaatgag

SEQ ID NO: 7841149 - DNA, 22 bp, Homo sapiens
gcacagtaggtatttacccagt

SEQ ID NO: 7841150 - DNA, 22 bp, Homo sapiens
gcacagtaggtatttacccagt

SEQ ID NO: 7841151 - DNA, 22 bp, Homo sapiens
gcacagtattgcacaactctag

SEQ ID NO: 7841152 - DNA, 22 bp, Homo sapiens
gcacagtacctgtcacagaggc

SEQ ID NO: 7841153 - DNA, 22 bp, Homo sapiens
gcacagtacctgtcacagaggc

SEQ ID NO: 7841154 - DNA, 21 bp, Homo sapiens
gcacagtaagaaaagctgcct

SEQ ID NO: 7841155 - DNA, 21 bp, Homo sapiens
gcacagtaagaaaagctgcct

SEQ ID NO: 7841156 - DNA, 20 bp, Homo sapiens
gcacagtagcagtgcaaatg

SEQ ID NO: 7841157 - DNA, 22 bp, Homo sapiens
gcacagtaggctcagctctatc

SEQ ID NO: 7841158 - DNA, 22 bp, Homo sapiens
gcacagtaggctcagctctatc

SEQ ID NO: 7841159 - DNA, 22 bp, Homo sapiens
gcacaggtcaggagatgagatt

SEQ ID NO: 7841160 - DNA, 22 bp, Homo sapiens
gcacaggttgtacttgggcacc

SEQ ID NO: 7841161 - DNA, 22 bp, Homo sapiens
gcacagggctgccaggcggctt

SEQ ID NO: 7841162 - DNA, 22 bp, Homo sapiens
gcacagggctgccaggcggctt

SEQ ID NO: 7841163 - DNA, 22 bp, Homo sapiens
gcacagggctgccaggcggctt

SEQ ID NO: 7841164 - DNA, 22 bp, Homo sapiens
gcacagggctgccaggcggctt

SEQ ID NO: 7841165 - DNA, 22 bp, Homo sapiens
gcacagggctgccaggcggctt

SEQ ID NO: 7841166 - DNA, 22 bp, Homo sapiens
gcacagggctgccaggcggctt

SEQ ID NO: 7841167 - DNA, 22 bp, Homo sapiens
gcacagggctgccaggcggctt

SEQ ID NO: 7841168 - DNA, 22 bp, Homo sapiens
gcacagggctgccaggcggctt

SEQ ID NO: 7841169 - DNA, 22 bp, Homo sapiens
gcacaggctccggaggagagct

SEQ ID NO: 7841170 - DNA, 22 bp, Homo sapiens
gcacaggctccggaggagagct

SEQ ID NO: 7841171 - DNA, 22 bp, Homo sapiens
gcacaggctccggaggagagct

SEQ ID NO: 7841172 - DNA, 22 bp, Homo sapiens
gcacaggctccggaggagagct

SEQ ID NO: 7841173 - DNA, 22 bp, Homo sapiens
gcacaggctccggaggagagct

SEQ ID NO: 7841174 - DNA, 22 bp, Homo sapiens
gcacaggctccggaggagagct

SEQ ID NO: 7841175 - DNA, 22 bp, Homo sapiens
gcacaggctctcttggggacac

SEQ ID NO: 7841176 - DNA, 22 bp, Homo sapiens
gcacagggctgccaggcggctt

SEQ ID NO: 7841177 - DNA, 22 bp, Homo sapiens
gcaaatcaccacctagctggat

SEQ ID NO: 7841178 - DNA, 22 bp, Homo sapiens
gcacacactgttttcctcacat

SEQ ID NO: 7841179 - DNA, 22 bp, Homo sapiens
gcacacactgttttcctcacat

SEQ ID NO: 7841180 - DNA, 22 bp, Homo sapiens
gcacacactgttttcctcacat

SEQ ID NO: 7841181 - DNA, 22 bp, Homo sapiens
gcaaatcaccacctagctggat

SEQ ID NO: 7841182 - DNA, 22 bp, Homo sapiens
gcaaatatttctaattcctgaa

SEQ ID NO: 7841183 - DNA, 22 bp, Homo sapiens
gcaaatattcaagacttttcca

SEQ ID NO: 7841184 - DNA, 22 bp, Homo sapiens
gcaaatattcaagacttttcca

SEQ ID NO: 7841185 - DNA, 22 bp, Homo sapiens
gcaaatattcaagacttttcca

SEQ ID NO: 7841186 - DNA, 22 bp, Homo sapiens
gcacacagaacatttggatcct

SEQ ID NO: 7841187 - DNA, 22 bp, Homo sapiens
gcacacagaatcagtgggcata

SEQ ID NO: 7841188 - DNA, 22 bp, Homo sapiens
gcacacactgttttcctcacat

SEQ ID NO: 7841189 - DNA, 22 bp, Homo sapiens
gcacacagaatcagtgggcata

SEQ ID NO: 7841190 - DNA, 22 bp, Homo sapiens
gcaaatagaagattctgttgac

SEQ ID NO: 7841191 - DNA, 22 bp, Homo sapiens
gcacacagaatcagtgggcata

SEQ ID NO: 7841192 - DNA, 22 bp, Homo sapiens
gcacacagaatcagtgggcata

SEQ ID NO: 7841193 - DNA, 22 bp, Homo sapiens
gcacacagtactatatgctaca

SEQ ID NO: 7841194 - DNA, 22 bp, Homo sapiens
gcacacagtagggattcaatga

SEQ ID NO: 7841195 - DNA, 22 bp, Homo sapiens
gcacacagtagggattcaatga

SEQ ID NO: 7841196 - DNA, 22 bp, Homo sapiens
gcacacagtagggattcaatga

SEQ ID NO: 7841197 - DNA, 22 bp, Homo sapiens
gcacacagtactatatgctaca

SEQ ID NO: 7841198 - DNA, 22 bp, Homo sapiens
gcacacagaatcagtgggcata

SEQ ID NO: 7841199 - DNA, 22 bp, Homo sapiens
gcacacaggggagttctcagaa

SEQ ID NO: 7841200 - DNA, 22 bp, Homo sapiens
gcacacagtagggattcaatga

SEQ ID NO: 7841201 - DNA, 22 bp, Homo sapiens
gcacacagtagggattcaatga

SEQ ID NO: 7841202 - DNA, 22 bp, Homo sapiens
gcacacagtagggattcaatga

SEQ ID NO: 7841203 - DNA, 19 bp, Homo sapiens
gcacacagtagggctggca

SEQ ID NO: 7841204 - DNA, 19 bp, Homo sapiens
gcacacagtagggctggca

SEQ ID NO: 7841205 - DNA, 19 bp, Homo sapiens
gcacacagtagggctggca

SEQ ID NO: 7841206 - DNA, 19 bp, Homo sapiens
gcacacagtagggctggca

SEQ ID NO: 7841207 - DNA, 19 bp, Homo sapiens
gcacacagtagggctggca

SEQ ID NO: 7841208 - DNA, 19 bp, Homo sapiens
gcacacagtagggctggca

SEQ ID NO: 7841209 - DNA, 22 bp, Homo sapiens
gcacacagtatatgctcattaa

SEQ ID NO: 7841210 - DNA, 22 bp, Homo sapiens
gcacacagtatatgctcattaa

SEQ ID NO: 7841211 - DNA, 22 bp, Homo sapiens
gcacacagtatatgctcattaa

SEQ ID NO: 7841212 - DNA, 19 bp, Homo sapiens
gcacacatacaccctttgg

SEQ ID NO: 7841213 - DNA, 20 bp, Homo sapiens
gcacacatagaaatgcatat

SEQ ID NO: 7841214 - DNA, 22 bp, Homo sapiens
gcacacatatatatgagcatgt

SEQ ID NO: 7841215 - DNA, 22 bp, Homo sapiens
gcacacatatatatgagcatgt

SEQ ID NO: 7841216 - DNA, 20 bp, Homo sapiens
gcacacatagaaatgcatat

SEQ ID NO: 7841217 - DNA, 22 bp, Homo sapiens
gcacacatatatatgagcatgt

SEQ ID NO: 7841218 - DNA, 22 bp, Homo sapiens
gcacacatcttgtaatcctgag

SEQ ID NO: 7841219 - DNA, 22 bp, Homo sapiens
gcacacatcttgtaatcctgag

SEQ ID NO: 7841220 - DNA, 22 bp, Homo sapiens
gcacacatgcatgcacaggagt

SEQ ID NO: 7841221 - DNA, 22 bp, Homo sapiens
gcacacatgcatgcacaggagt

SEQ ID NO: 7841222 - DNA, 22 bp, Homo sapiens
gcacacatgcatgcacaggagt

SEQ ID NO: 7841223 - DNA, 22 bp, Homo sapiens
gcacacatgcatgtgtgcatcc

SEQ ID NO: 7841224 - DNA, 22 bp, Homo sapiens
gcacacatgcatgtgtgcatcc

SEQ ID NO: 7841225 - DNA, 22 bp, Homo sapiens
gcacacatgcgtgtatatgggt

SEQ ID NO: 7841226 - DNA, 22 bp, Homo sapiens
gcacacattcggattcttaacc

SEQ ID NO: 7841227 - DNA, 22 bp, Homo sapiens
gcacacattctagccttttgtg

SEQ ID NO: 7841228 - DNA, 22 bp, Homo sapiens
gcacacattcggattcttaacc

SEQ ID NO: 7841229 - DNA, 22 bp, Homo sapiens
gcacacattcggattcttaacc

SEQ ID NO: 7841230 - DNA, 22 bp, Homo sapiens
gcacacatgtgagtgtcctttc

SEQ ID NO: 7841231 - DNA, 22 bp, Homo sapiens
gcacacatgcgtgtatatgggt

SEQ ID NO: 7841232 - DNA, 22 bp, Homo sapiens
gcacacatgcgtgtatatgggt

SEQ ID NO: 7841233 - DNA, 22 bp, Homo sapiens
gcaaagcaagattcagatgtag

SEQ ID NO: 7841234 - DNA, 22 bp, Homo sapiens
gcaaagcaagattcagatgtag

SEQ ID NO: 7841235 - DNA, 22 bp, Homo sapiens
gcaaagcaagattcagatgtag

SEQ ID NO: 7841236 - DNA, 22 bp, Homo sapiens
gcaaagcaaatgcctgaaggcg

SEQ ID NO: 7841237 - DNA, 22 bp, Homo sapiens
gcaaagcaagctgtcagcctca

SEQ ID NO: 7841238 - DNA, 22 bp, Homo sapiens
gcaaagcacaccctcagagttt

SEQ ID NO: 7841239 - DNA, 22 bp, Homo sapiens
gcaaagcaatcaggagtagcat

SEQ ID NO: 7841240 - DNA, 22 bp, Homo sapiens
gcaaagcacaccctcagagttt

SEQ ID NO: 7841241 - DNA, 22 bp, Homo sapiens
gcaaagcaatcaggagtagcat

SEQ ID NO: 7841242 - DNA, 22 bp, Homo sapiens
gcaaagcaatcaggagtagcat

SEQ ID NO: 7841243 - DNA, 22 bp, Homo sapiens
gcaaagcaatcaggagtagcat

SEQ ID NO: 7841244 - DNA, 22 bp, Homo sapiens
gcaaagcatcagtagaaatgtt

SEQ ID NO: 7841245 - DNA, 22 bp, Homo sapiens
gcaaagcacactggagatgtcg

SEQ ID NO: 7841246 - DNA, 22 bp, Homo sapiens
gcaaagcatcagtagaaatgtt

SEQ ID NO: 7841247 - DNA, 22 bp, Homo sapiens
gcaaagcatcagtagaaatgtt

SEQ ID NO: 7841248 - DNA, 22 bp, Homo sapiens
gcaaagctgggtgtgaatgcac

SEQ ID NO: 7841249 - DNA, 22 bp, Homo sapiens
gcaaagcattctgtggagtcta

SEQ ID NO: 7841250 - DNA, 22 bp, Homo sapiens
gcaaagttcctactttactgga

SEQ ID NO: 7841251 - DNA, 22 bp, Homo sapiens
gcaaataatatactttgatctc

SEQ ID NO: 7841252 - DNA, 22 bp, Homo sapiens
gcaaatacatgttgagcaccta

SEQ ID NO: 7841253 - DNA, 22 bp, Homo sapiens
gcaaatagaagattctgttgac

SEQ ID NO: 7841254 - DNA, 22 bp, Homo sapiens
gcaaataatatactttgatctc

SEQ ID NO: 7841255 - DNA, 22 bp, Homo sapiens
gcaaatacatgttgagcaccta

SEQ ID NO: 7841256 - DNA, 22 bp, Homo sapiens
gcaaagtattaagtattaagtt

SEQ ID NO: 7841257 - DNA, 22 bp, Homo sapiens
gcaaagtattaagtattaagtt

SEQ ID NO: 7841258 - DNA, 22 bp, Homo sapiens
gcaaagtattaagtattaagtt

SEQ ID NO: 7841259 - DNA, 21 bp, Homo sapiens
gcaaagtgtgggcataaacag

SEQ ID NO: 7841260 - DNA, 17 bp, Homo sapiens
gcaaaggtgaggagaga

SEQ ID NO: 7841261 - DNA, 22 bp, Homo sapiens
gcaaagggaaagtggcagggtc

SEQ ID NO: 7841262 - DNA, 22 bp, Homo sapiens
gcaaagggaaagtggcagggtc

SEQ ID NO: 7841263 - DNA, 22 bp, Homo sapiens
gcaaagtaaaaatagattctga

SEQ ID NO: 7841264 - DNA, 22 bp, Homo sapiens
gcaaagcatcagtagaaatgtt

SEQ ID NO: 7841265 - DNA, 22 bp, Homo sapiens
gcaaaggctagagacacaggga

SEQ ID NO: 7841266 - DNA, 22 bp, Homo sapiens
gcaaaggccactggggcgatgg

SEQ ID NO: 7841267 - DNA, 22 bp, Homo sapiens
gcaaagggaaagtggcagggtc

SEQ ID NO: 7841268 - DNA, 22 bp, Homo sapiens
gcaaaggcttcttttattctcc

SEQ ID NO: 7841269 - DNA, 22 bp, Homo sapiens
gcaaaggcttcttttattctcc

SEQ ID NO: 7841270 - DNA, 22 bp, Homo sapiens
gcaaaggctagagacacaggga

SEQ ID NO: 7841271 - DNA, 22 bp, Homo sapiens
gcaaagacaaattagaactcct

SEQ ID NO: 7841272 - DNA, 22 bp, Homo sapiens
gcaaagaatgcagatttgcctc

SEQ ID NO: 7841273 - DNA, 22 bp, Homo sapiens
gcaaagacaatttgaatagctt

SEQ ID NO: 7841274 - DNA, 22 bp, Homo sapiens
gcaaagaatgcagatttgcctc

SEQ ID NO: 7841275 - DNA, 22 bp, Homo sapiens
gcaaagaaatgtcagtgagagg

SEQ ID NO: 7841276 - DNA, 22 bp, Homo sapiens
gcaaagaaatgtcagtgagagg

SEQ ID NO: 7841277 - DNA, 23 bp, Homo sapiens
gcaaagactctgccaaaaactgc

SEQ ID NO: 7841278 - DNA, 22 bp, Homo sapiens
gcaaagatattagaatagagta

SEQ ID NO: 7841279 - DNA, 22 bp, Homo sapiens
gcaaagcaaatgcctgaaggcg

SEQ ID NO: 7841280 - DNA, 22 bp, Homo sapiens
gcaaagatattagaatagagta

SEQ ID NO: 7841281 - DNA, 23 bp, Homo sapiens
gcaaagactctgccaaaaactgc

SEQ ID NO: 7841282 - DNA, 22 bp, Homo sapiens
gcaaagaaatgtcagtgagagg

SEQ ID NO: 7841283 - DNA, 22 bp, Homo sapiens
gcaaagaaatgtcagtgagagg

SEQ ID NO: 7841284 - DNA, 22 bp, Homo sapiens
gcaaagaaatgtcagtgagagg

SEQ ID NO: 7841285 - DNA, 22 bp, Homo sapiens
gcaaagaaatgtcagtgagagg

SEQ ID NO: 7841286 - DNA, 22 bp, Homo sapiens
gcaaagaaagttttaatgaggt

SEQ ID NO: 7841287 - DNA, 22 bp, Homo sapiens
gcaaagaaagttttaatgaggt

SEQ ID NO: 7841288 - DNA, 22 bp, Homo sapiens
gcaaagaaagttttaatgaggt

SEQ ID NO: 7841289 - DNA, 22 bp, Homo sapiens
gcaaagaaagttttaatgaggt

SEQ ID NO: 7841290 - DNA, 22 bp, Homo sapiens
gcaaagaaagttttaatgaggt

SEQ ID NO: 7841291 - DNA, 22 bp, Homo sapiens
gcaaagaaagccaaggtctaac

SEQ ID NO: 7841292 - DNA, 22 bp, Homo sapiens
gcaaagaaagccaaggtctaac

SEQ ID NO: 7841293 - DNA, 22 bp, Homo sapiens
gcaaactgttggagtagagtct

SEQ ID NO: 7841294 - DNA, 22 bp, Homo sapiens
gcaaagaaagccaaggtctaac

SEQ ID NO: 7841295 - DNA, 22 bp, Homo sapiens
gcaaagaaagccaaggtctaac

SEQ ID NO: 7841296 - DNA, 22 bp, Homo sapiens
gcaaagaaagccaaggtctaac

SEQ ID NO: 7841297 - DNA, 22 bp, Homo sapiens
gaggcccagcagcgcaggtctt

SEQ ID NO: 7841298 - DNA, 22 bp, Homo sapiens
gcaaactgttggagtagagtct

SEQ ID NO: 7841299 - DNA, 22 bp, Homo sapiens
gaggccataagaagttcttggg

SEQ ID NO: 7841300 - DNA, 22 bp, Homo sapiens
gaggccagtgtgctgtgttttc

SEQ ID NO: 7841301 - DNA, 22 bp, Homo sapiens
gaggccagtgtgctgtgttttc

SEQ ID NO: 7841302 - DNA, 22 bp, Homo sapiens
gaggccattcagctgggcagca

SEQ ID NO: 7841303 - DNA, 22 bp, Homo sapiens
gaggccattcagctgggcagca

SEQ ID NO: 7841304 - DNA, 22 bp, Homo sapiens
gaggcccaaggactctgtcccg

SEQ ID NO: 7841305 - DNA, 22 bp, Homo sapiens
gaggccaggaggatctctctaa

SEQ ID NO: 7841306 - DNA, 22 bp, Homo sapiens
gaggccaggaggatctctctaa

SEQ ID NO: 7841307 - DNA, 22 bp, Homo sapiens
gaggccagtgaaatgttataaa

SEQ ID NO: 7841308 - DNA, 22 bp, Homo sapiens
gaggccagtgaaatgttataaa

SEQ ID NO: 7841309 - DNA, 22 bp, Homo sapiens
gaggccagtgtgctgtgttttc

SEQ ID NO: 7841310 - DNA, 22 bp, Homo sapiens
gaggccagtgtgctgtgttttc

SEQ ID NO: 7841311 - DNA, 22 bp, Homo sapiens
gaggcccaaggactctgtcccg

SEQ ID NO: 7841312 - DNA, 22 bp, Homo sapiens
gaggcccaatgcttccctcctt

SEQ ID NO: 7841313 - DNA, 22 bp, Homo sapiens
gaggcccacagggagtaccaag

SEQ ID NO: 7841314 - DNA, 22 bp, Homo sapiens
gaggcccacagggagtaccaag

SEQ ID NO: 7841315 - DNA, 20 bp, Homo sapiens
gaggcccagagaggtgaagc

SEQ ID NO: 7841316 - DNA, 20 bp, Homo sapiens
gaggcccagagaggtgaagc

SEQ ID NO: 7841317 - DNA, 20 bp, Homo sapiens
gaggcccagagaggtgaagc

SEQ ID NO: 7841318 - DNA, 22 bp, Homo sapiens
gaggcccacagggagtaccaag

SEQ ID NO: 7841319 - DNA, 22 bp, Homo sapiens
gaggcccagagaggttgcatga

SEQ ID NO: 7841320 - DNA, 20 bp, Homo sapiens
gaggcccagagaggtgaagc

SEQ ID NO: 7841321 - DNA, 22 bp, Homo sapiens
gaggcccagagaggttgcatga

SEQ ID NO: 7841322 - DNA, 22 bp, Homo sapiens
gaggcccagcagcgcaggtctt

SEQ ID NO: 7841323 - DNA, 22 bp, Homo sapiens
gaggcccagcagcgcaggtctt

SEQ ID NO: 7841324 - DNA, 22 bp, Homo sapiens
gcagagaacccagcagattggc

SEQ ID NO: 7841325 - DNA, 22 bp, Homo sapiens
gcagagaacccagcagattggc

SEQ ID NO: 7841326 - DNA, 22 bp, Homo sapiens
gcagagaacccagcagattggc

SEQ ID NO: 7841327 - DNA, 22 bp, Homo sapiens
gcagagaagatgcccaggcttc

SEQ ID NO: 7841328 - DNA, 22 bp, Homo sapiens
gcagagaagatgcccaggcttc

SEQ ID NO: 7841329 - DNA, 22 bp, Homo sapiens
gcagagaacccagcagattggc

SEQ ID NO: 7841330 - DNA, 22 bp, Homo sapiens
gcagagaacccagcagattggc

SEQ ID NO: 7841331 - DNA, 22 bp, Homo sapiens
gcagagaacccagcagattggc

SEQ ID NO: 7841332 - DNA, 22 bp, Homo sapiens
gcagagaaagttttgtcctcag

SEQ ID NO: 7841333 - DNA, 22 bp, Homo sapiens
gcagagaaagttttgtcctcag

SEQ ID NO: 7841334 - DNA, 22 bp, Homo sapiens
gcagagaaagttttgtcctcag

SEQ ID NO: 7841335 - DNA, 22 bp, Homo sapiens
gcagagaaagttttgtcctcag

SEQ ID NO: 7841336 - DNA, 22 bp, Homo sapiens
gcagagaaagttttgtcctcag

SEQ ID NO: 7841337 - DNA, 22 bp, Homo sapiens
gcagactgtatcaatgtcagta

SEQ ID NO: 7841338 - DNA, 22 bp, Homo sapiens
gcagagcaccctgcagtggtat

SEQ ID NO: 7841339 - DNA, 22 bp, Homo sapiens
gcagagcaccaaagtgaaagat

SEQ ID NO: 7841340 - DNA, 18 bp, Homo sapiens
gcagagcagaagctcaag

SEQ ID NO: 7841341 - DNA, 22 bp, Homo sapiens
gcagagcaccctgcagtggtat

SEQ ID NO: 7841342 - DNA, 22 bp, Homo sapiens
gcagagcaccctgcagtggtat

SEQ ID NO: 7841343 - DNA, 22 bp, Homo sapiens
gcagagcaccctgcagtggtat

SEQ ID NO: 7841344 - DNA, 22 bp, Homo sapiens
gcagagaagatgcccaggcttc

SEQ ID NO: 7841345 - DNA, 22 bp, Homo sapiens
gcagagaagatgcccaggcttc

SEQ ID NO: 7841346 - DNA, 22 bp, Homo sapiens
gcagagaagatgcccaggcttc

SEQ ID NO: 7841347 - DNA, 22 bp, Homo sapiens
gcagagaagatgcccaggcttc

SEQ ID NO: 7841348 - DNA, 22 bp, Homo sapiens
gcagagaaggattgaaaccaga

SEQ ID NO: 7841349 - DNA, 22 bp, Homo sapiens
gcagagaaggattgaaaccaga

SEQ ID NO: 7841350 - DNA, 22 bp, Homo sapiens
gcagagaagatgcccaggcttc

SEQ ID NO: 7841351 - DNA, 22 bp, Homo sapiens
gcagagattggtgcactgatga

SEQ ID NO: 7841352 - DNA, 22 bp, Homo sapiens
gcagagattgtaatgatacctg

SEQ ID NO: 7841353 - DNA, 22 bp, Homo sapiens
gcagagcaccaaagtgaaagat

SEQ ID NO: 7841354 - DNA, 22 bp, Homo sapiens
gcagagcaccaaagtgaaagat

SEQ ID NO: 7841355 - DNA, 22 bp, Homo sapiens
gcagagcaccaaagtgaaagat

SEQ ID NO: 7841356 - DNA, 22 bp, Homo sapiens
gcagagatttcagtaacagcag

SEQ ID NO: 7841357 - DNA, 22 bp, Homo sapiens
gcagactgtacctggaagaggg

SEQ ID NO: 7841358 - DNA, 22 bp, Homo sapiens
gcagactgtacactggactttg

SEQ ID NO: 7841359 - DNA, 22 bp, Homo sapiens
gcagactgtacctggaagaggg

SEQ ID NO: 7841360 - DNA, 22 bp, Homo sapiens
gcagactgtacctggaagaggg

SEQ ID NO: 7841361 - DNA, 22 bp, Homo sapiens
gcagactgtatcaatgtcagta

SEQ ID NO: 7841362 - DNA, 22 bp, Homo sapiens
gcagactgcgagcgtgctggtg

SEQ ID NO: 7841363 - DNA, 22 bp, Homo sapiens
gcagactgcgagcgtgctggtg

SEQ ID NO: 7841364 - DNA, 22 bp, Homo sapiens
gcagactgcgagcgtgctggtg

SEQ ID NO: 7841365 - DNA, 22 bp, Homo sapiens
gcagactgcgagcgtgctggtg

SEQ ID NO: 7841366 - DNA, 22 bp, Homo sapiens
gcagactgcgtgaggcgccgcc

SEQ ID NO: 7841367 - DNA, 22 bp, Homo sapiens
gcagactggtcttcagccttgg

SEQ ID NO: 7841368 - DNA, 19 bp, Homo sapiens
gcagacaggtccagagagg

SEQ ID NO: 7841369 - DNA, 22 bp, Homo sapiens
gcagacatacttctttttgtac

SEQ ID NO: 7841370 - DNA, 22 bp, Homo sapiens
gcagacatgtgttctaacagga

SEQ ID NO: 7841371 - DNA, 22 bp, Homo sapiens
gcagacatgtgttctaacagga

SEQ ID NO: 7841372 - DNA, 22 bp, Homo sapiens
gcagacatgttcctttctgtca

SEQ ID NO: 7841373 - DNA, 22 bp, Homo sapiens
gcagaccagcccctggagctgc

SEQ ID NO: 7841374 - DNA, 22 bp, Homo sapiens
gcagacctcaggacatcattag

SEQ ID NO: 7841375 - DNA, 22 bp, Homo sapiens
gcagaccagcccctggagctgc

SEQ ID NO: 7841376 - DNA, 22 bp, Homo sapiens
gcagaccagcccctggagctgc

SEQ ID NO: 7841377 - DNA, 22 bp, Homo sapiens
gcagaccagcccctggagctgc

SEQ ID NO: 7841378 - DNA, 22 bp, Homo sapiens
gcagaccagcccctggagctgc

SEQ ID NO: 7841379 - DNA, 22 bp, Homo sapiens
gcagacctcaggacatcattag

SEQ ID NO: 7841380 - DNA, 21 bp, Homo sapiens
gcagactgccctgctgtcccc

SEQ ID NO: 7841381 - DNA, 22 bp, Homo sapiens
gcagactctgagagtgagtgcc

SEQ ID NO: 7841382 - DNA, 22 bp, Homo sapiens
gcagacgtcaccgagtcgatgg

SEQ ID NO: 7841383 - DNA, 22 bp, Homo sapiens
gcagacctgaccttgggcagca

SEQ ID NO: 7841384 - DNA, 22 bp, Homo sapiens
gcagacggagtatcttgtacat

SEQ ID NO: 7841385 - DNA, 22 bp, Homo sapiens
gcacagttaaagggtcatgtga

SEQ ID NO: 7841386 - DNA, 22 bp, Homo sapiens
gcacagtgtaccacagtcccta

SEQ ID NO: 7841387 - DNA, 22 bp, Homo sapiens
gcacagtgtaccacagtcccta

SEQ ID NO: 7841388 - DNA, 22 bp, Homo sapiens
gcacagtgtaccacagtcccta

SEQ ID NO: 7841389 - DNA, 22 bp, Homo sapiens
gcacagttaaagggtcatgtga

SEQ ID NO: 7841390 - DNA, 22 bp, Homo sapiens
gcacagttgagacttcacagct

SEQ ID NO: 7841391 - DNA, 22 bp, Homo sapiens
gcacagttgagacttcacagct

SEQ ID NO: 7841392 - DNA, 22 bp, Homo sapiens
gcacagttgtgacaaccatcgc

SEQ ID NO: 7841393 - DNA, 22 bp, Homo sapiens
gcacagttgccattagccacat

SEQ ID NO: 7841394 - DNA, 22 bp, Homo sapiens
gcacagttgatttatgctggtg

SEQ ID NO: 7841395 - DNA, 20 bp, Homo sapiens
gcacagtttgggaaccatgg

SEQ ID NO: 7841396 - DNA, 22 bp, Homo sapiens
gcacataaagggcatgggaggt

SEQ ID NO: 7841397 - DNA, 22 bp, Homo sapiens
gcacataactgaccacatctaa

SEQ ID NO: 7841398 - DNA, 22 bp, Homo sapiens
gcacagtggtgaaagcatgggt

SEQ ID NO: 7841399 - DNA, 22 bp, Homo sapiens
gcacagtggtgaaagcatgggt

SEQ ID NO: 7841400 - DNA, 22 bp, Homo sapiens
gcacagtgggtggtcatgtaca

SEQ ID NO: 7841401 - DNA, 21 bp, Homo sapiens
gcacagtgccaggcacacagt

SEQ ID NO: 7841402 - DNA, 22 bp, Homo sapiens
gcacagtggagtgtgtccaggg

SEQ ID NO: 7841403 - DNA, 22 bp, Homo sapiens
gcacagtggagtgtgtccaggg

SEQ ID NO: 7841404 - DNA, 22 bp, Homo sapiens
gcacagtgataggcagttgtgc

SEQ ID NO: 7841405 - DNA, 22 bp, Homo sapiens
gcacagtgataggcagttgtgc

SEQ ID NO: 7841406 - DNA, 22 bp, Homo sapiens
gcacagtgcaccactttgaaaa

SEQ ID NO: 7841407 - DNA, 21 bp, Homo sapiens
gcacagtgccaggcacacagt

SEQ ID NO: 7841408 - DNA, 22 bp, Homo sapiens
gcacatgaggctgtctttgtct

SEQ ID NO: 7841409 - DNA, 22 bp, Homo sapiens
gcacatctggagctctgtggaa

SEQ ID NO: 7841410 - DNA, 21 bp, Homo sapiens
gcacatgagggagggcatgcc

SEQ ID NO: 7841411 - DNA, 22 bp, Homo sapiens
gcacatgcaacagagattttca

SEQ ID NO: 7841412 - DNA, 19 bp, Homo sapiens
gcagacaggtccagagagg

SEQ ID NO: 7841413 - DNA, 19 bp, Homo sapiens
gcagacaggtccagagagg

SEQ ID NO: 7841414 - DNA, 19 bp, Homo sapiens
gcagacaggtccagagagg

SEQ ID NO: 7841415 - DNA, 19 bp, Homo sapiens
gcagacaggtccagagagg

SEQ ID NO: 7841416 - DNA, 22 bp, Homo sapiens
gcacatccaatgattgttttga

SEQ ID NO: 7841417 - DNA, 22 bp, Homo sapiens
gcacatccaatgattgttttga

SEQ ID NO: 7841418 - DNA, 22 bp, Homo sapiens
gcacatatgctgtaagcacatg

SEQ ID NO: 7841419 - DNA, 22 bp, Homo sapiens
gcacatactgcaaagattacta

SEQ ID NO: 7841420 - DNA, 23 bp, Homo sapiens
gcacatagtaagtaagcagacat

SEQ ID NO: 7841421 - DNA, 22 bp, Homo sapiens
gcacatactgcaaagattacta

SEQ ID NO: 7841422 - DNA, 23 bp, Homo sapiens
gcacatactacacagaaaatggc

SEQ ID NO: 7841423 - DNA, 22 bp, Homo sapiens
gcacataccccaggaatggtag

SEQ ID NO: 7841424 - DNA, 22 bp, Homo sapiens
gcacatacccactgtcaagcac

SEQ ID NO: 7841425 - DNA, 22 bp, Homo sapiens
gcacatacatattagtgtcaca

SEQ ID NO: 7841426 - DNA, 22 bp, Homo sapiens
gcacatacatattagtgtcaca

SEQ ID NO: 7841427 - DNA, 22 bp, Homo sapiens
gcacatacatattagtgtcaca

SEQ ID NO: 7841428 - DNA, 22 bp, Homo sapiens
gcagaggtctagcaccaagaat

SEQ ID NO: 7841429 - DNA, 22 bp, Homo sapiens
gcagaggtctcttcaaaataat

SEQ ID NO: 7841430 - DNA, 22 bp, Homo sapiens
gcagaggtgaccagcagcaggg

SEQ ID NO: 7841431 - DNA, 22 bp, Homo sapiens
gcagaggtgaccagcagcaggg

SEQ ID NO: 7841432 - DNA, 22 bp, Homo sapiens
gcagaggtgaccagcagcaggg

SEQ ID NO: 7841433 - DNA, 22 bp, Homo sapiens
gcagaggtgaccagcagcaggg

SEQ ID NO: 7841434 - DNA, 22 bp, Homo sapiens
gcagagtggtttcagagttgag

SEQ ID NO: 7841435 - DNA, 22 bp, Homo sapiens
gcagagtggtttcagagttgag

SEQ ID NO: 7841436 - DNA, 22 bp, Homo sapiens
gcagagtggtttcagagttgag

SEQ ID NO: 7841437 - DNA, 22 bp, Homo sapiens
gcagaggtgagtttctcagctg

SEQ ID NO: 7841438 - DNA, 22 bp, Homo sapiens
gcagaggtgagaagggcctccc

SEQ ID NO: 7841439 - DNA, 22 bp, Homo sapiens
gcagaggtgaccagcagcaggg

SEQ ID NO: 7841440 - DNA, 22 bp, Homo sapiens
gcagatggactgtatgacctga

SEQ ID NO: 7841441 - DNA, 22 bp, Homo sapiens
gcagatggaaagtgcttgaggg

SEQ ID NO: 7841442 - DNA, 22 bp, Homo sapiens
gcagagttcctggaaagcaacc

SEQ ID NO: 7841443 - DNA, 22 bp, Homo sapiens
gcagatggactgtatgacctga

SEQ ID NO: 7841444 - DNA, 22 bp, Homo sapiens
gcagatggactgtatgacctga

SEQ ID NO: 7841445 - DNA, 22 bp, Homo sapiens
gcagatggactgtatgacctga

SEQ ID NO: 7841446 - DNA, 22 bp, Homo sapiens
gcagatggagacgaggttccgc

SEQ ID NO: 7841447 - DNA, 22 bp, Homo sapiens
gcagatggagacgaggttccgc

SEQ ID NO: 7841448 - DNA, 22 bp, Homo sapiens
gcagatggagacgaggttccgc

SEQ ID NO: 7841449 - DNA, 22 bp, Homo sapiens
gcagatggagataaatggaact

SEQ ID NO: 7841450 - DNA, 20 bp, Homo sapiens
gcagagtgtgagagggtgaa

SEQ ID NO: 7841451 - DNA, 20 bp, Homo sapiens
gcagagtgtgagagggtgaa

SEQ ID NO: 7841452 - DNA, 20 bp, Homo sapiens
gcagagtgtgagagggtgaa

SEQ ID NO: 7841453 - DNA, 20 bp, Homo sapiens
gcagagtgtgagagggtgaa

SEQ ID NO: 7841454 - DNA, 22 bp, Homo sapiens
gcagagttcctggaaagcaacc

SEQ ID NO: 7841455 - DNA, 22 bp, Homo sapiens
gcagaggccaggccaccagcaa

SEQ ID NO: 7841456 - DNA, 22 bp, Homo sapiens
gcagaggccaggccaccagcaa

SEQ ID NO: 7841457 - DNA, 22 bp, Homo sapiens
gcagaggccaggccaccagcaa

SEQ ID NO: 7841458 - DNA, 22 bp, Homo sapiens
gcagaggccaggccaccagcaa

SEQ ID NO: 7841459 - DNA, 22 bp, Homo sapiens
gcagaggcatttctgacgctgc

SEQ ID NO: 7841460 - DNA, 22 bp, Homo sapiens
gcagaggccaggccaccagcaa

SEQ ID NO: 7841461 - DNA, 22 bp, Homo sapiens
gcagaggcatttctgacgctgc

SEQ ID NO: 7841462 - DNA, 22 bp, Homo sapiens
gcagaggccaggccaccagcaa

SEQ ID NO: 7841463 - DNA, 22 bp, Homo sapiens
gcagaggccaggccaccagcaa

SEQ ID NO: 7841464 - DNA, 22 bp, Homo sapiens
gcagaggggaagctgaggaatt

SEQ ID NO: 7841465 - DNA, 22 bp, Homo sapiens
gcagaggggaagctgaggaatt

SEQ ID NO: 7841466 - DNA, 22 bp, Homo sapiens
gcagagggggtacttcggccct

SEQ ID NO: 7841467 - DNA, 22 bp, Homo sapiens
gcagaggtcctagccaggagtc

SEQ ID NO: 7841468 - DNA, 22 bp, Homo sapiens
gcagaggtcctagccaggagtc

SEQ ID NO: 7841469 - DNA, 22 bp, Homo sapiens
gcagaggtcctagccaggagtc

SEQ ID NO: 7841470 - DNA, 22 bp, Homo sapiens
gcagaggtcctagccaggagtc

SEQ ID NO: 7841471 - DNA, 22 bp, Homo sapiens
gcagagggtcctgtgccagcag

SEQ ID NO: 7841472 - DNA, 22 bp, Homo sapiens
gcagagggtcctgtgccagcag

SEQ ID NO: 7841473 - DNA, 22 bp, Homo sapiens
gcagagggtcctgtgccagcag

SEQ ID NO: 7841474 - DNA, 22 bp, Homo sapiens
gcagagggtcctgtgccagcag

SEQ ID NO: 7841475 - DNA, 22 bp, Homo sapiens
gcagagggtcctgtgccagcag

SEQ ID NO: 7841476 - DNA, 22 bp, Homo sapiens
gcagagcaggaaggaagtcagg

SEQ ID NO: 7841477 - DNA, 22 bp, Homo sapiens
gcagagcaggaaggaagtcagg

SEQ ID NO: 7841478 - DNA, 22 bp, Homo sapiens
gcagagcagcaaatggaaagga

SEQ ID NO: 7841479 - DNA, 22 bp, Homo sapiens
gcagagcagcaaatggaaagga

SEQ ID NO: 7841480 - DNA, 22 bp, Homo sapiens
gcagagcagcaaatggaaagga

SEQ ID NO: 7841481 - DNA, 22 bp, Homo sapiens
gcagagcagcaaatggaaagga

SEQ ID NO: 7841482 - DNA, 22 bp, Homo sapiens
gcagagcaggaaggaagtcagg

SEQ ID NO: 7841483 - DNA, 22 bp, Homo sapiens
gcagagcaggaaggaagtcagg

SEQ ID NO: 7841484 - DNA, 22 bp, Homo sapiens
gcagagcagagcctgcattggc

SEQ ID NO: 7841485 - DNA, 22 bp, Homo sapiens
gcagagcagagcctgcattggc

SEQ ID NO: 7841486 - DNA, 22 bp, Homo sapiens
gcagagcagagcctgcattggc

SEQ ID NO: 7841487 - DNA, 22 bp, Homo sapiens
gcagagcagagcctgcattggc

SEQ ID NO: 7841488 - DNA, 22 bp, Homo sapiens
gcagagcagagcctgcattggc

SEQ ID NO: 7841489 - DNA, 18 bp, Homo sapiens
gcagagcagaagctcaag

SEQ ID NO: 7841490 - DNA, 18 bp, Homo sapiens
gcagagcagaagctcaag

SEQ ID NO: 7841491 - DNA, 22 bp, Homo sapiens
gcagagcagcaaatggaaagga

SEQ ID NO: 7841492 - DNA, 22 bp, Homo sapiens
gcagagcagaggtgcaggttgg

SEQ ID NO: 7841493 - DNA, 22 bp, Homo sapiens
gcagagcagaggtgcaggttgg

SEQ ID NO: 7841494 - DNA, 22 bp, Homo sapiens
gcagagcagaggtgcaggttgg

SEQ ID NO: 7841495 - DNA, 22 bp, Homo sapiens
gcagagcagtactctcttgact

SEQ ID NO: 7841496 - DNA, 22 bp, Homo sapiens
gcagagcagtactctcttgact

SEQ ID NO: 7841497 - DNA, 22 bp, Homo sapiens
gcagagcagtactctcttgact

SEQ ID NO: 7841498 - DNA, 22 bp, Homo sapiens
gcagagcaggggctgaacctgg

SEQ ID NO: 7841499 - DNA, 22 bp, Homo sapiens
gcagagcagtactctcttgact

SEQ ID NO: 7841500 - DNA, 22 bp, Homo sapiens
gcagagcagtactctcttgact

SEQ ID NO: 7841501 - DNA, 22 bp, Homo sapiens
gcagagcagggattttgccata

SEQ ID NO: 7841502 - DNA, 22 bp, Homo sapiens
gcagagcagggattttgccata

SEQ ID NO: 7841503 - DNA, 22 bp, Homo sapiens
gcagagcaggggctgaacctgg

SEQ ID NO: 7841504 - DNA, 22 bp, Homo sapiens
gcagagcaggggctgaacctgg

SEQ ID NO: 7841505 - DNA, 22 bp, Homo sapiens
gcagaggatagcatatgaacct

SEQ ID NO: 7841506 - DNA, 22 bp, Homo sapiens
gcagaggatagcatatgaacct

SEQ ID NO: 7841507 - DNA, 22 bp, Homo sapiens
gcagaggagtgattatgccgtg

SEQ ID NO: 7841508 - DNA, 22 bp, Homo sapiens
gcagaggagtgattatgccgtg

SEQ ID NO: 7841509 - DNA, 22 bp, Homo sapiens
gcagaggcagggccctcctcca

SEQ ID NO: 7841510 - DNA, 22 bp, Homo sapiens
gcagaggcagggccctcctcca

SEQ ID NO: 7841511 - DNA, 22 bp, Homo sapiens
gcagaggcatttctgacgctgc

SEQ ID NO: 7841512 - DNA, 22 bp, Homo sapiens
gcagaggcatttctgacgctgc

SEQ ID NO: 7841513 - DNA, 22 bp, Homo sapiens
gcagaggcatttctgacgctgc

SEQ ID NO: 7841514 - DNA, 21 bp, Homo sapiens
gcagaggcacggcaccaaggg

SEQ ID NO: 7841515 - DNA, 21 bp, Homo sapiens
gcagaggcacggcaccaaggg

SEQ ID NO: 7841516 - DNA, 21 bp, Homo sapiens
gcagaggcacggcaccaaggg

SEQ ID NO: 7841517 - DNA, 21 bp, Homo sapiens
gcagaggcacggcaccaaggg

SEQ ID NO: 7841518 - DNA, 22 bp, Homo sapiens
gcagaggcacagccccagatga

SEQ ID NO: 7841519 - DNA, 22 bp, Homo sapiens
gcagaggcacagccccagatga

SEQ ID NO: 7841520 - DNA, 22 bp, Homo sapiens
gcagaggcacagccccagatga

SEQ ID NO: 7841521 - DNA, 21 bp, Homo sapiens
gcagaggcacggcaccaaggg

SEQ ID NO: 7841522 - DNA, 22 bp, Homo sapiens
gcagaggcacagccccagatga

SEQ ID NO: 7841523 - DNA, 22 bp, Homo sapiens
gcagaggatcaggctctggaaa

SEQ ID NO: 7841524 - DNA, 22 bp, Homo sapiens
gcagaggatcaggctctggaaa

SEQ ID NO: 7841525 - DNA, 22 bp, Homo sapiens
gcagaggatcaggctctggaaa

SEQ ID NO: 7841526 - DNA, 22 bp, Homo sapiens
gcagaggatcaggctctggaaa

SEQ ID NO: 7841527 - DNA, 22 bp, Homo sapiens
gcagaggatcaggctctggaaa

SEQ ID NO: 7841528 - DNA, 22 bp, Homo sapiens
gcagaggatcaggctctggaaa

SEQ ID NO: 7841529 - DNA, 22 bp, Homo sapiens
gcagaggatcaggctctggaaa

SEQ ID NO: 7841530 - DNA, 22 bp, Homo sapiens
gcagaggatcaggctctggaaa

SEQ ID NO: 7841531 - DNA, 21 bp, Homo sapiens
gcagatgggaagagacgaggc

SEQ ID NO: 7841532 - DNA, 22 bp, Homo sapiens
gcagatgggagccccaggggag

SEQ ID NO: 7841533 - DNA, 22 bp, Homo sapiens
gcagatgggagccccaggggag

SEQ ID NO: 7841534 - DNA, 21 bp, Homo sapiens
gcagatgggagtcatcaggct

SEQ ID NO: 7841535 - DNA, 21 bp, Homo sapiens
gcagatgggagtcatcaggct

SEQ ID NO: 7841536 - DNA, 22 bp, Homo sapiens
gcagatgggagccccaggggag

SEQ ID NO: 7841537 - DNA, 22 bp, Homo sapiens
gcagatgggagccccaggggag

SEQ ID NO: 7841538 - DNA, 22 bp, Homo sapiens
gcagatgggagccccaggggag

SEQ ID NO: 7841539 - DNA, 22 bp, Homo sapiens
gcagatggctgagcctgcagat

SEQ ID NO: 7841540 - DNA, 22 bp, Homo sapiens
gcagatggctgagcctgcagat

SEQ ID NO: 7841541 - DNA, 22 bp, Homo sapiens
gcagatggctgagcctgcagat

SEQ ID NO: 7841542 - DNA, 21 bp, Homo sapiens
gcagatgggaagagacgaggc

SEQ ID NO: 7841543 - DNA, 22 bp, Homo sapiens
gcagatggctcagacactgggg

SEQ ID NO: 7841544 - DNA, 22 bp, Homo sapiens
gcagatggctcagacactgggg

SEQ ID NO: 7841545 - DNA, 22 bp, Homo sapiens
gcagatggctgagcctgcagat

SEQ ID NO: 7841546 - DNA, 22 bp, Homo sapiens
gcagatggctgagcctgcagat

SEQ ID NO: 7841547 - DNA, 21 bp, Homo sapiens
gcagatgggagtcatcaggct

SEQ ID NO: 7841548 - DNA, 21 bp, Homo sapiens
gcagatgggagtcatcaggct

SEQ ID NO: 7841549 - DNA, 21 bp, Homo sapiens
gcagatgggagtcatcaggct

SEQ ID NO: 7841550 - DNA, 22 bp, Homo sapiens
gcagatggtgccatgtcttgtg

SEQ ID NO: 7841551 - DNA, 22 bp, Homo sapiens
gcagatggtgccatgtcttgtg

SEQ ID NO: 7841552 - DNA, 22 bp, Homo sapiens
gcagatggtgccatgtcttgtg

SEQ ID NO: 7841553 - DNA, 22 bp, Homo sapiens
gcagatggtgccatgtcttgtg

SEQ ID NO: 7841554 - DNA, 22 bp, Homo sapiens
gcagatggtgggggaggagtac

SEQ ID NO: 7841555 - DNA, 22 bp, Homo sapiens
gcagatggtggggcaggaaaat

SEQ ID NO: 7841556 - DNA, 15 bp, Homo sapiens
gcagatgggggtgat

SEQ ID NO: 7841557 - DNA, 22 bp, Homo sapiens
gcagatggtggaggcaagaggc

SEQ ID NO: 7841558 - DNA, 22 bp, Homo sapiens
gcagatggtggaggcaagaggc

SEQ ID NO: 7841559 - DNA, 22 bp, Homo sapiens
gcagatggtggaggcaagaggc

SEQ ID NO: 7841560 - DNA, 22 bp, Homo sapiens
gcagatggtggaggcaagaggc

SEQ ID NO: 7841561 - DNA, 23 bp, Homo sapiens
gcagatggccccagagtgctgcc

SEQ ID NO: 7841562 - DNA, 23 bp, Homo sapiens
gcagatggccccagagtgctgcc

SEQ ID NO: 7841563 - DNA, 23 bp, Homo sapiens
gcagatggccccagagtgctgcc

SEQ ID NO: 7841564 - DNA, 23 bp, Homo sapiens
gcagatggccccagagtgctgcc

SEQ ID NO: 7841565 - DNA, 22 bp, Homo sapiens
gcagatggctcagacactgggg

SEQ ID NO: 7841566 - DNA, 22 bp, Homo sapiens
gcagatggcgcagtggaagttc

SEQ ID NO: 7841567 - DNA, 22 bp, Homo sapiens
gcagatggcgcagtggaagttc

SEQ ID NO: 7841568 - DNA, 22 bp, Homo sapiens
gcagatggcagcccaggctggg

SEQ ID NO: 7841569 - DNA, 22 bp, Homo sapiens
gcagatggcagcccaggctggg

SEQ ID NO: 7841570 - DNA, 22 bp, Homo sapiens
gcagatggcagcccaggctggg

SEQ ID NO: 7841571 - DNA, 22 bp, Homo sapiens
gcagatggcagcccaggctggg

SEQ ID NO: 7841572 - DNA, 23 bp, Homo sapiens
gcagatggccccagagtgctgcc

SEQ ID NO: 7841573 - DNA, 23 bp, Homo sapiens
gcagatggccccagagtgctgcc

SEQ ID NO: 7841574 - DNA, 23 bp, Homo sapiens
gcagatggccccagagtgctgcc

SEQ ID NO: 7841575 - DNA, 23 bp, Homo sapiens
gcagatggccccagagtgctgcc

SEQ ID NO: 7841576 - DNA, 23 bp, Homo sapiens
gcagatggccccagagtgctgcc

SEQ ID NO: 7841577 - DNA, 23 bp, Homo sapiens
gcagatggccccagagtgctgcc

SEQ ID NO: 7841578 - DNA, 18 bp, Homo sapiens
gcagatggagattcaggg

SEQ ID NO: 7841579 - DNA, 18 bp, Homo sapiens
gcagatggagattcaggg

SEQ ID NO: 7841580 - DNA, 22 bp, Homo sapiens
gcagatggatcacctgaggtcg

SEQ ID NO: 7841581 - DNA, 22 bp, Homo sapiens
gcagatggatcacctgaggtcg

SEQ ID NO: 7841582 - DNA, 22 bp, Homo sapiens
gcagatggatcacctgaggtcg

SEQ ID NO: 7841583 - DNA, 22 bp, Homo sapiens
gcagatggatgtggacggcgcc

SEQ ID NO: 7841584 - DNA, 22 bp, Homo sapiens
gcagatggcagcccaggctggg

SEQ ID NO: 7841585 - DNA, 22 bp, Homo sapiens
gcagatggcagcccaggctggg

SEQ ID NO: 7841586 - DNA, 22 bp, Homo sapiens
gcagatggcagcccaggctggg

SEQ ID NO: 7841587 - DNA, 22 bp, Homo sapiens
gcagatggcagcccaggctggg

SEQ ID NO: 7841588 - DNA, 22 bp, Homo sapiens
gcagatggcagcccaggctggg

SEQ ID NO: 7841589 - DNA, 22 bp, Homo sapiens
gcagatggcagcccaggctggg

SEQ ID NO: 7841590 - DNA, 22 bp, Homo sapiens
gcagatggcagcccaggctggg

SEQ ID NO: 7841591 - DNA, 22 bp, Homo sapiens
gcagatggcagcccaggctggg

SEQ ID NO: 7841592 - DNA, 22 bp, Homo sapiens
gcagatggcagcccaggctggg

SEQ ID NO: 7841593 - DNA, 22 bp, Homo sapiens
gcagatggcagcccaggctggg

SEQ ID NO: 7841594 - DNA, 22 bp, Homo sapiens
gcagatggcagcccaggctggg

SEQ ID NO: 7841595 - DNA, 22 bp, Homo sapiens
gcagatggtgggggaggagtac

SEQ ID NO: 7841596 - DNA, 22 bp, Homo sapiens
gcagatggtgggggaggagtac

SEQ ID NO: 7841597 - DNA, 22 bp, Homo sapiens
gcagatggtgggggaggagtac

SEQ ID NO: 7841598 - DNA, 22 bp, Homo sapiens
gcagatgtaatggctggaggtc

SEQ ID NO: 7841599 - DNA, 22 bp, Homo sapiens
gcagatgtaatggctggaggtc

SEQ ID NO: 7841600 - DNA, 22 bp, Homo sapiens
gcagatgtaatggctggaggtc

SEQ ID NO: 7841601 - DNA, 22 bp, Homo sapiens
gcagatgtaatggctggaggtc

SEQ ID NO: 7841602 - DNA, 22 bp, Homo sapiens
gcagatgtgtcctggagggagg

SEQ ID NO: 7841603 - DNA, 22 bp, Homo sapiens
gcagatgttcgcgttaatgcat

SEQ ID NO: 7841604 - DNA, 22 bp, Homo sapiens
gcagcccacagctggaggccta

SEQ ID NO: 7841605 - DNA, 22 bp, Homo sapiens
gcagcccagcagggcccggagc

SEQ ID NO: 7841606 - DNA, 22 bp, Homo sapiens
gcagcccaggaccctggacaga

SEQ ID NO: 7841607 - DNA, 22 bp, Homo sapiens
gcagcccaggaccctggacaga

SEQ ID NO: 7841608 - DNA, 22 bp, Homo sapiens
gcagcccaggaccctggacaga

SEQ ID NO: 7841609 - DNA, 22 bp, Homo sapiens
gcagcccaggtggagtaatcta

SEQ ID NO: 7841610 - DNA, 22 bp, Homo sapiens
gcagcccaggagcaggcgaccc

SEQ ID NO: 7841611 - DNA, 22 bp, Homo sapiens
gcagcccaggaggcgggagccc

SEQ ID NO: 7841612 - DNA, 22 bp, Homo sapiens
gcagccctgcagctccacaccg

SEQ ID NO: 7841613 - DNA, 22 bp, Homo sapiens
gcagccctgcagctccacaccg

SEQ ID NO: 7841614 - DNA, 22 bp, Homo sapiens
gcagccctgcagctccacaccg

SEQ ID NO: 7841615 - DNA, 22 bp, Homo sapiens
gcagccctgcagctccacaccg

SEQ ID NO: 7841616 - DNA, 22 bp, Homo sapiens
gcagccctcttggtcactaggc

SEQ ID NO: 7841617 - DNA, 22 bp, Homo sapiens
gcagccctcttggtcactaggc

SEQ ID NO: 7841618 - DNA, 22 bp, Homo sapiens
gcagccctcgggtactcacgtg

SEQ ID NO: 7841619 - DNA, 22 bp, Homo sapiens
gcagccctcgggtactcacgtg

SEQ ID NO: 7841620 - DNA, 22 bp, Homo sapiens
gcagccctcgggtactcacgtg

SEQ ID NO: 7841621 - DNA, 22 bp, Homo sapiens
gcagccctcgggtactcacgtg

SEQ ID NO: 7841622 - DNA, 22 bp, Homo sapiens
gcagccctcgctagctctcccc

SEQ ID NO: 7841623 - DNA, 22 bp, Homo sapiens
gcagccctcgctagctctcccc

SEQ ID NO: 7841624 - DNA, 22 bp, Homo sapiens
gcagccctcgctagctctcccc

SEQ ID NO: 7841625 - DNA, 22 bp, Homo sapiens
gcagccctcgctagctctcccc

SEQ ID NO: 7841626 - DNA, 22 bp, Homo sapiens
gcagccctcgctagctctcccc

SEQ ID NO: 7841627 - DNA, 22 bp, Homo sapiens
gcagccctcgctagctctcccc

SEQ ID NO: 7841628 - DNA, 22 bp, Homo sapiens
gcagcccataacatttgaggcc

SEQ ID NO: 7841629 - DNA, 22 bp, Homo sapiens
gcagccccaggagacgcccagg

SEQ ID NO: 7841630 - DNA, 22 bp, Homo sapiens
gcagcccaggtgtagctctttg

SEQ ID NO: 7841631 - DNA, 18 bp, Homo sapiens
gcagcccctcttccttcc

SEQ ID NO: 7841632 - DNA, 18 bp, Homo sapiens
gcagcccctcttccttcc

SEQ ID NO: 7841633 - DNA, 22 bp, Homo sapiens
gcagccccaggagacgcccagg

SEQ ID NO: 7841634 - DNA, 22 bp, Homo sapiens
gcagccctccctgggtgtgtct

SEQ ID NO: 7841635 - DNA, 22 bp, Homo sapiens
gcagccctagcgacaaattgat

SEQ ID NO: 7841636 - DNA, 22 bp, Homo sapiens
gcagccctagcgacaaattgat

SEQ ID NO: 7841637 - DNA, 22 bp, Homo sapiens
gcagccctagcgacaaattgat

SEQ ID NO: 7841638 - DNA, 22 bp, Homo sapiens
gcagccctaacctgtcatagtg

SEQ ID NO: 7841639 - DNA, 18 bp, Homo sapiens
gcagcccctcttccttcc

SEQ ID NO: 7841640 - DNA, 22 bp, Homo sapiens
gcagccctaacctgtcatagtg

SEQ ID NO: 7841641 - DNA, 18 bp, Homo sapiens
gcagcccctcttccttcc

SEQ ID NO: 7841642 - DNA, 22 bp, Homo sapiens
gcaggaagggaaaggttgactc

SEQ ID NO: 7841643 - DNA, 22 bp, Homo sapiens
gcaggaagggaaaggttgactc

SEQ ID NO: 7841644 - DNA, 22 bp, Homo sapiens
gcaggaagggaaaggttgactc

SEQ ID NO: 7841645 - DNA, 22 bp, Homo sapiens
gcaggaagggaaaggttgactc

SEQ ID NO: 7841646 - DNA, 22 bp, Homo sapiens
gcaggaatatagtatttcgagg

SEQ ID NO: 7841647 - DNA, 22 bp, Homo sapiens
gcaggacaaaatttccagggtg

SEQ ID NO: 7841648 - DNA, 22 bp, Homo sapiens
gcaggaatctaacccaaggaga

SEQ ID NO: 7841649 - DNA, 22 bp, Homo sapiens
gcaggacaaaatttccagggtg

SEQ ID NO: 7841650 - DNA, 22 bp, Homo sapiens
gcaggacaaaatttccagggtg

SEQ ID NO: 7841651 - DNA, 23 bp, Homo sapiens
gcaggacaacagagtgggaaggc

SEQ ID NO: 7841652 - DNA, 23 bp, Homo sapiens
gcaggacaacagagtgggaaggc

SEQ ID NO: 7841653 - DNA, 22 bp, Homo sapiens
gcaggacaaaatttccagggtg

SEQ ID NO: 7841654 - DNA, 23 bp, Homo sapiens
gcaggacaacagagtgggaaggc

SEQ ID NO: 7841655 - DNA, 22 bp, Homo sapiens
gcaggacacagatgcaaggcca

SEQ ID NO: 7841656 - DNA, 22 bp, Homo sapiens
gcaggacacagatgcaaggcca

SEQ ID NO: 7841657 - DNA, 22 bp, Homo sapiens
gcaggacacagatgcaaggcca

SEQ ID NO: 7841658 - DNA, 22 bp, Homo sapiens
gcaggaagatgagctcaggtaa

SEQ ID NO: 7841659 - DNA, 22 bp, Homo sapiens
gcaggaagcatagaagaatgcc

SEQ ID NO: 7841660 - DNA, 22 bp, Homo sapiens
gcaggaagcatagaagaatgcc

SEQ ID NO: 7841661 - DNA, 22 bp, Homo sapiens
gcaggaagcatagaagaatgcc

SEQ ID NO: 7841662 - DNA, 22 bp, Homo sapiens
gcaggaagcatagaagaatgcc

SEQ ID NO: 7841663 - DNA, 22 bp, Homo sapiens
gcaggaagccttaccaagccca

SEQ ID NO: 7841664 - DNA, 22 bp, Homo sapiens
gcaggaagcatagaagaatgcc

SEQ ID NO: 7841665 - DNA, 22 bp, Homo sapiens
gcaggaagccttaccaagccca

SEQ ID NO: 7841666 - DNA, 22 bp, Homo sapiens
gcaggaagccttaccaagccca

SEQ ID NO: 7841667 - DNA, 22 bp, Homo sapiens
gcaggaagccttaccaagccca

SEQ ID NO: 7841668 - DNA, 22 bp, Homo sapiens
gcaggaaaaccttcccatgttt

SEQ ID NO: 7841669 - DNA, 22 bp, Homo sapiens
gcaggaaaaccttcccatgttt

SEQ ID NO: 7841670 - DNA, 22 bp, Homo sapiens
gcaggaaaggttgagactttgc

SEQ ID NO: 7841671 - DNA, 18 bp, Homo sapiens
gcagcttttgattcaccc

SEQ ID NO: 7841672 - DNA, 19 bp, Homo sapiens
gcaggaaatgagtgattgc

SEQ ID NO: 7841673 - DNA, 19 bp, Homo sapiens
gcaggaaatgagtgattgc

SEQ ID NO: 7841674 - DNA, 22 bp, Homo sapiens
gcaggaacagggcttcaagctt

SEQ ID NO: 7841675 - DNA, 22 bp, Homo sapiens
gcaggaacagtttatctctggc

SEQ ID NO: 7841676 - DNA, 21 bp, Homo sapiens
gcaggaacaggtcatgatctg

SEQ ID NO: 7841677 - DNA, 22 bp, Homo sapiens
gcaggaaccccgggaggctggc

SEQ ID NO: 7841678 - DNA, 22 bp, Homo sapiens
gcaggaacccagacaaccaggg

SEQ ID NO: 7841679 - DNA, 22 bp, Homo sapiens
gcaggaaccactgcccccctgt

SEQ ID NO: 7841680 - DNA, 22 bp, Homo sapiens
gcaggaagatgagctcaggtaa

SEQ ID NO: 7841681 - DNA, 22 bp, Homo sapiens
gcaggaagatgagctcaggtaa

SEQ ID NO: 7841682 - DNA, 22 bp, Homo sapiens
gcaggaagatgagctcaggtaa

SEQ ID NO: 7841683 - DNA, 22 bp, Homo sapiens
gcaggaagatgagctcaggtaa

SEQ ID NO: 7841684 - DNA, 22 bp, Homo sapiens
gcaggaagatgagctcaggtaa

SEQ ID NO: 7841685 - DNA, 22 bp, Homo sapiens
gcaggaagaggctcgaagcccc

SEQ ID NO: 7841686 - DNA, 22 bp, Homo sapiens
gcaggaagaggctcgaagcccc

SEQ ID NO: 7841687 - DNA, 22 bp, Homo sapiens
gcaggaacttgcaaaatgagca

SEQ ID NO: 7841688 - DNA, 22 bp, Homo sapiens
gcaggaacttgggtgaagtcag

SEQ ID NO: 7841689 - DNA, 22 bp, Homo sapiens
gcaggaagaggctcgaagcccc

SEQ ID NO: 7841690 - DNA, 22 bp, Homo sapiens
gcaggaagaggctcgaagcccc

SEQ ID NO: 7841691 - DNA, 22 bp, Homo sapiens
gcaggaagaggctcgaagcccc

SEQ ID NO: 7841692 - DNA, 22 bp, Homo sapiens
gcaggaacttgggtgaagtcag

SEQ ID NO: 7841693 - DNA, 22 bp, Homo sapiens
gcaggaactggagctggatgtt

SEQ ID NO: 7841694 - DNA, 23 bp, Homo sapiens
gcaggaactcagggtaggcagca

SEQ ID NO: 7841695 - DNA, 22 bp, Homo sapiens
gcaggaacctggtaagcttcac

SEQ ID NO: 7841696 - DNA, 22 bp, Homo sapiens
gcaggaacccggccgccctggc

SEQ ID NO: 7841697 - DNA, 22 bp, Homo sapiens
gcagctttctacttcctacagc

SEQ ID NO: 7841698 - DNA, 22 bp, Homo sapiens
gcagctttctgcaatgtcatcc

SEQ ID NO: 7841699 - DNA, 22 bp, Homo sapiens
gcagctttctgcaatgtcatcc

SEQ ID NO: 7841700 - DNA, 22 bp, Homo sapiens
gcagctttctaagctttattgc

SEQ ID NO: 7841701 - DNA, 20 bp, Homo sapiens
gcagctgtgcattcttagga

SEQ ID NO: 7841702 - DNA, 22 bp, Homo sapiens
gcagctgtcggaaagctaagtg

SEQ ID NO: 7841703 - DNA, 22 bp, Homo sapiens
gcagctgtcggaaagctaagtg

SEQ ID NO: 7841704 - DNA, 19 bp, Homo sapiens
gcagctgtgggaagagcca

SEQ ID NO: 7841705 - DNA, 20 bp, Homo sapiens
gcagctgtgcattcttagga

SEQ ID NO: 7841706 - DNA, 22 bp, Homo sapiens
gcagctttgaagacttatttgc

SEQ ID NO: 7841707 - DNA, 22 bp, Homo sapiens
gcagctttgaagacttatttgc

SEQ ID NO: 7841708 - DNA, 22 bp, Homo sapiens
gcagctttcttgccctaatctt

SEQ ID NO: 7841709 - DNA, 22 bp, Homo sapiens
gcagctttctttttgcatgtct

SEQ ID NO: 7841710 - DNA, 22 bp, Homo sapiens
gcagctttcttgccctaatctt

SEQ ID NO: 7841711 - DNA, 22 bp, Homo sapiens
gcagctttctgggacagaaagg

SEQ ID NO: 7841712 - DNA, 22 bp, Homo sapiens
gcagcctccgcactgcgagtcc

SEQ ID NO: 7841713 - DNA, 22 bp, Homo sapiens
gcagcctccgcactgcgagtcc

SEQ ID NO: 7841714 - DNA, 22 bp, Homo sapiens
gcagcctcagggcactcagatg

SEQ ID NO: 7841715 - DNA, 22 bp, Homo sapiens
gcagcctcagggcactcagatg

SEQ ID NO: 7841716 - DNA, 22 bp, Homo sapiens
gcagcctccgcactgcgagtcc

SEQ ID NO: 7841717 - DNA, 22 bp, Homo sapiens
gcagcctctgatgatggccgta

SEQ ID NO: 7841718 - DNA, 22 bp, Homo sapiens
gcagctgtcgctaggagctgtg

SEQ ID NO: 7841719 - DNA, 22 bp, Homo sapiens
gcagctgtcgctaggagctgtg

SEQ ID NO: 7841720 - DNA, 22 bp, Homo sapiens
gcagctgtcggaaagctaagtg

SEQ ID NO: 7841721 - DNA, 22 bp, Homo sapiens
gcagctgtcgctaggagctgtg

SEQ ID NO: 7841722 - DNA, 22 bp, Homo sapiens
gcagctgtcatttacaacaggg

SEQ ID NO: 7841723 - DNA, 22 bp, Homo sapiens
gcagctgtcatttacaacaggg

SEQ ID NO: 7841724 - DNA, 22 bp, Homo sapiens
gcagctgtcgctaggagctgtg

SEQ ID NO: 7841725 - DNA, 22 bp, Homo sapiens
gcagctgtcatttacaacaggg

SEQ ID NO: 7841726 - DNA, 22 bp, Homo sapiens
gcagctgtcatttacaacaggg

SEQ ID NO: 7841727 - DNA, 22 bp, Homo sapiens
gcagcctcaaactccccagctc

SEQ ID NO: 7841728 - DNA, 22 bp, Homo sapiens
gcagcctcaaactccccagctc

SEQ ID NO: 7841729 - DNA, 20 bp, Homo sapiens
gcagcctcaacaggcacagc

SEQ ID NO: 7841730 - DNA, 20 bp, Homo sapiens
gcagcctcaacaggcacagc

SEQ ID NO: 7841731 - DNA, 20 bp, Homo sapiens
gcagcctcaacaggcacagc

SEQ ID NO: 7841732 - DNA, 22 bp, Homo sapiens
gcagcctcagggcactcagatg

SEQ ID NO: 7841733 - DNA, 22 bp, Homo sapiens
gcagcctcagggcactcagatg

SEQ ID NO: 7841734 - DNA, 20 bp, Homo sapiens
gcagcctcaacaggcacagc

SEQ ID NO: 7841735 - DNA, 20 bp, Homo sapiens
gcagcctcaacaggcacagc

SEQ ID NO: 7841736 - DNA, 20 bp, Homo sapiens
gcagccgtggagactaggag

SEQ ID NO: 7841737 - DNA, 22 bp, Homo sapiens
gcagccctttctgggcagggga

SEQ ID NO: 7841738 - DNA, 22 bp, Homo sapiens
gcagcccttcaggtgaggggca

SEQ ID NO: 7841739 - DNA, 22 bp, Homo sapiens
gcagcccttcaggtgaggggca

SEQ ID NO: 7841740 - DNA, 22 bp, Homo sapiens
gcagccctttctgggcagggga

SEQ ID NO: 7841741 - DNA, 22 bp, Homo sapiens
gcagccctttctgggcagggga

SEQ ID NO: 7841742 - DNA, 22 bp, Homo sapiens
gcagccctggcctggcctactt

SEQ ID NO: 7841743 - DNA, 22 bp, Homo sapiens
gcagccctgcaggcagctccag

SEQ ID NO: 7841744 - DNA, 22 bp, Homo sapiens
gcagccctggcctggcctactt

SEQ ID NO: 7841745 - DNA, 22 bp, Homo sapiens
gcagccctgcaggcagctccag

SEQ ID NO: 7841746 - DNA, 22 bp, Homo sapiens
gcagccctgcaggcagctccag

SEQ ID NO: 7841747 - DNA, 22 bp, Homo sapiens
gcagccctgcaggcagctccag

SEQ ID NO: 7841748 - DNA, 22 bp, Homo sapiens
gcagccctgcaggcagctccag

SEQ ID NO: 7841749 - DNA, 22 bp, Homo sapiens
gcagggctgtggacactttggt

SEQ ID NO: 7841750 - DNA, 22 bp, Homo sapiens
gcagggctgtggacactttggt

SEQ ID NO: 7841751 - DNA, 22 bp, Homo sapiens
gcagggctgtggacactttggt

SEQ ID NO: 7841752 - DNA, 22 bp, Homo sapiens
gcagggctgttcaggagggtgg

SEQ ID NO: 7841753 - DNA, 22 bp, Homo sapiens
gcagggctgttcaggagggtgg

SEQ ID NO: 7841754 - DNA, 22 bp, Homo sapiens
gcagggctgttcaggagggtgg

SEQ ID NO: 7841755 - DNA, 22 bp, Homo sapiens
gcagggctgttcaggagggtgg

SEQ ID NO: 7841756 - DNA, 22 bp, Homo sapiens
gcagggctgttcaggagggtgg

SEQ ID NO: 7841757 - DNA, 22 bp, Homo sapiens
gcagggctgttcaggagggtgg

SEQ ID NO: 7841758 - DNA, 22 bp, Homo sapiens
gcagggctgttcaggagggtgg

SEQ ID NO: 7841759 - DNA, 22 bp, Homo sapiens
gcagggctgttcaggagggtgg

SEQ ID NO: 7841760 - DNA, 22 bp, Homo sapiens
gcagggcttagaaatggtggct

SEQ ID NO: 7841761 - DNA, 22 bp, Homo sapiens
gcagggctgtttagtgaatagg

SEQ ID NO: 7841762 - DNA, 22 bp, Homo sapiens
gcagggctgttcaggagggtgg

SEQ ID NO: 7841763 - DNA, 22 bp, Homo sapiens
gcagggctgttcaggagggtgg

SEQ ID NO: 7841764 - DNA, 22 bp, Homo sapiens
gcagggctgttcaggagggtgg

SEQ ID NO: 7841765 - DNA, 22 bp, Homo sapiens
gcagggcttagaaatggtggct

SEQ ID NO: 7841766 - DNA, 22 bp, Homo sapiens
gcagggcttagaaatggtggct

SEQ ID NO: 7841767 - DNA, 22 bp, Homo sapiens
gcagggcttagaaatggtggct

SEQ ID NO: 7841768 - DNA, 22 bp, Homo sapiens
gcagggcttagaaatggtggct

SEQ ID NO: 7841769 - DNA, 22 bp, Homo sapiens
gcagggcttgcagcagctagac

SEQ ID NO: 7841770 - DNA, 22 bp, Homo sapiens
gcagggcttgcagcagctagac

SEQ ID NO: 7841771 - DNA, 22 bp, Homo sapiens
gcagggcttagaaatggtggct

SEQ ID NO: 7841772 - DNA, 22 bp, Homo sapiens
gcagggcttagaaatggtggct

SEQ ID NO: 7841773 - DNA, 22 bp, Homo sapiens
gcagggctttttgaaacatggt

SEQ ID NO: 7841774 - DNA, 22 bp, Homo sapiens
gcagggcttgcagcagctagac

SEQ ID NO: 7841775 - DNA, 22 bp, Homo sapiens
gcagggcttgcagcagctagac

SEQ ID NO: 7841776 - DNA, 22 bp, Homo sapiens
gcagggctgtggacactttggt

SEQ ID NO: 7841777 - DNA, 22 bp, Homo sapiens
gcagggctgtaatttgagcctg

SEQ ID NO: 7841778 - DNA, 22 bp, Homo sapiens
gcagggctgtaatttgagcctg

SEQ ID NO: 7841779 - DNA, 22 bp, Homo sapiens
gcagggctgtaatttgagcctg

SEQ ID NO: 7841780 - DNA, 22 bp, Homo sapiens
gcagggctgggtgggagacaga

SEQ ID NO: 7841781 - DNA, 22 bp, Homo sapiens
gcagggctgggtgggagacaga

SEQ ID NO: 7841782 - DNA, 22 bp, Homo sapiens
gcagggctgggtgggagacaga

SEQ ID NO: 7841783 - DNA, 22 bp, Homo sapiens
gcagggctgggtgggagacaga

SEQ ID NO: 7841784 - DNA, 22 bp, Homo sapiens
gcagggctgggtgggagacaga

SEQ ID NO: 7841785 - DNA, 22 bp, Homo sapiens
gcagggctgggtgggagacaga

SEQ ID NO: 7841786 - DNA, 22 bp, Homo sapiens
gcagggctgggtgggagacaga

SEQ ID NO: 7841787 - DNA, 22 bp, Homo sapiens
gcagggctgggtgggagacaga

SEQ ID NO: 7841788 - DNA, 22 bp, Homo sapiens
gcagggctgggtgggagacaga

SEQ ID NO: 7841789 - DNA, 22 bp, Homo sapiens
gcagggctgggtcctgtctcat

SEQ ID NO: 7841790 - DNA, 22 bp, Homo sapiens
gcagggctgggtcctgtctcat

SEQ ID NO: 7841791 - DNA, 22 bp, Homo sapiens
gcagggctggggctgctcctga

SEQ ID NO: 7841792 - DNA, 22 bp, Homo sapiens
gcagggctgggtcctgtctcat

SEQ ID NO: 7841793 - DNA, 22 bp, Homo sapiens
gcagggctggggctgctcctga

SEQ ID NO: 7841794 - DNA, 22 bp, Homo sapiens
gcagggctggggctgctcctga

SEQ ID NO: 7841795 - DNA, 22 bp, Homo sapiens
gcagggctggggctgctcctga

SEQ ID NO: 7841796 - DNA, 22 bp, Homo sapiens
gcagggctggggctgctcctga

SEQ ID NO: 7841797 - DNA, 22 bp, Homo sapiens
gcagggctggggctgctcctga

SEQ ID NO: 7841798 - DNA, 22 bp, Homo sapiens
gcagggctggggctgctcctga

SEQ ID NO: 7841799 - DNA, 22 bp, Homo sapiens
gcagggctggggctgctcctga

SEQ ID NO: 7841800 - DNA, 22 bp, Homo sapiens
gcagggctgaaggtcccaggcc

SEQ ID NO: 7841801 - DNA, 22 bp, Homo sapiens
gcagggctgaaggtcccaggcc

SEQ ID NO: 7841802 - DNA, 22 bp, Homo sapiens
gcagggctgactcagccaccct

SEQ ID NO: 7841803 - DNA, 22 bp, Homo sapiens
gcagggctgaaggtcccaggcc

SEQ ID NO: 7841804 - DNA, 22 bp, Homo sapiens
gcagggacatcttcagatcact

SEQ ID NO: 7841805 - DNA, 22 bp, Homo sapiens
gcagggacatcttcagatcact

SEQ ID NO: 7841806 - DNA, 22 bp, Homo sapiens
gcagggacatcttcagatcact

SEQ ID NO: 7841807 - DNA, 22 bp, Homo sapiens
gcagggacatctttgtctagta

SEQ ID NO: 7841808 - DNA, 22 bp, Homo sapiens
gcagggaccaaaagaggcagta

SEQ ID NO: 7841809 - DNA, 22 bp, Homo sapiens
gcagggacagggcagggccttt

SEQ ID NO: 7841810 - DNA, 22 bp, Homo sapiens
gcagggacagggcagggccttt

SEQ ID NO: 7841811 - DNA, 22 bp, Homo sapiens
gcagggacagggcagggccttt

SEQ ID NO: 7841812 - DNA, 22 bp, Homo sapiens
gcagggacagggcagggccttt

SEQ ID NO: 7841813 - DNA, 22 bp, Homo sapiens
gcagggacagggcagggccttt

SEQ ID NO: 7841814 - DNA, 22 bp, Homo sapiens
gcagggacagggcagggccttt

SEQ ID NO: 7841815 - DNA, 22 bp, Homo sapiens
gcagggacaactgtgcacctga

SEQ ID NO: 7841816 - DNA, 22 bp, Homo sapiens
gcagggacaactgtgcacctga

SEQ ID NO: 7841817 - DNA, 22 bp, Homo sapiens
gcagggacaaggcaggtgttct

SEQ ID NO: 7841818 - DNA, 22 bp, Homo sapiens
gcagggacaaggcaggtgttct

SEQ ID NO: 7841819 - DNA, 18 bp, Homo sapiens
gcagggacacagggtcac

SEQ ID NO: 7841820 - DNA, 22 bp, Homo sapiens
gcagggacacctttgtgaagct

SEQ ID NO: 7841821 - DNA, 22 bp, Homo sapiens
gcagggacacctttgtgaagct

SEQ ID NO: 7841822 - DNA, 18 bp, Homo sapiens
gcagggacacagggtcac

SEQ ID NO: 7841823 - DNA, 18 bp, Homo sapiens
gcagggacacagggtcac

SEQ ID NO: 7841824 - DNA, 18 bp, Homo sapiens
gcagggacacagggtcac

SEQ ID NO: 7841825 - DNA, 22 bp, Homo sapiens
gcagggaccagggccagatcca

SEQ ID NO: 7841826 - DNA, 21 bp, Homo sapiens
gcagggaccgcgacttctggg

SEQ ID NO: 7841827 - DNA, 22 bp, Homo sapiens
gcagggacctatgacgatggaa

SEQ ID NO: 7841828 - DNA, 21 bp, Homo sapiens
gcagggaccgcgacttctggg

SEQ ID NO: 7841829 - DNA, 22 bp, Homo sapiens
gcagggaccaaaagaggcagta

SEQ ID NO: 7841830 - DNA, 22 bp, Homo sapiens
gcagggaccaaaagaggcagta

SEQ ID NO: 7841831 - DNA, 22 bp, Homo sapiens
gcagggaccaaaagaggcagta

SEQ ID NO: 7841832 - DNA, 22 bp, Homo sapiens
gcagggaccaaaagaggcagta

SEQ ID NO: 7841833 - DNA, 22 bp, Homo sapiens
gcagggaccaaaagaggcagta

SEQ ID NO: 7841834 - DNA, 22 bp, Homo sapiens
gcagggaccaaaagaggcagta

SEQ ID NO: 7841835 - DNA, 22 bp, Homo sapiens
gcagggaccaaaagaggcagta

SEQ ID NO: 7841836 - DNA, 22 bp, Homo sapiens
gcagggaccaaaagaggcagta

SEQ ID NO: 7841837 - DNA, 22 bp, Homo sapiens
gcagggacctcactacccccag

SEQ ID NO: 7841838 - DNA, 22 bp, Homo sapiens
gcagggacctatgacgatggaa

SEQ ID NO: 7841839 - DNA, 22 bp, Homo sapiens
gcagggacctatgacgatggaa

SEQ ID NO: 7841840 - DNA, 22 bp, Homo sapiens
gcagggacctgccactgctgtc

SEQ ID NO: 7841841 - DNA, 22 bp, Homo sapiens
gcagggacctgccactgctgtc

SEQ ID NO: 7841842 - DNA, 22 bp, Homo sapiens
gcagggacctgccactgctgtc

SEQ ID NO: 7841843 - DNA, 22 bp, Homo sapiens
gcagggctctgctgtagtccta

SEQ ID NO: 7841844 - DNA, 22 bp, Homo sapiens
gcagggctgaaggtcccaggcc

SEQ ID NO: 7841845 - DNA, 22 bp, Homo sapiens
gcagggctgaaggtcccaggcc

SEQ ID NO: 7841846 - DNA, 22 bp, Homo sapiens
gcagggctgaaggtcccaggcc

SEQ ID NO: 7841847 - DNA, 22 bp, Homo sapiens
gcagggacctgccactgctgtc

SEQ ID NO: 7841848 - DNA, 22 bp, Homo sapiens
gcagggacctgccactgctgtc

SEQ ID NO: 7841849 - DNA, 22 bp, Homo sapiens
gcaggcagatcacctgtcagga

SEQ ID NO: 7841850 - DNA, 22 bp, Homo sapiens
gcaggcagatcacctgtcagga

SEQ ID NO: 7841851 - DNA, 22 bp, Homo sapiens
gcaggcagatcacctgtcagga

SEQ ID NO: 7841852 - DNA, 22 bp, Homo sapiens
gcaggcagatcacctgtcagga

SEQ ID NO: 7841853 - DNA, 22 bp, Homo sapiens
gcaggcagatcacctgtcagga

SEQ ID NO: 7841854 - DNA, 22 bp, Homo sapiens
gcaggcagatcacctgtcagga

SEQ ID NO: 7841855 - DNA, 22 bp, Homo sapiens
gcaggcagatcacctgtcagga

SEQ ID NO: 7841856 - DNA, 14 bp, Homo sapiens
gcaggcagatcact

SEQ ID NO: 7841857 - DNA, 14 bp, Homo sapiens
gcaggcagatcact

SEQ ID NO: 7841858 - DNA, 22 bp, Homo sapiens
gcaggcagatcacctgtcagga

SEQ ID NO: 7841859 - DNA, 14 bp, Homo sapiens
gcaggcagatcact

SEQ ID NO: 7841860 - DNA, 14 bp, Homo sapiens
gcaggcagatcact

SEQ ID NO: 7841861 - DNA, 19 bp, Homo sapiens
gcaggcagctggggtatcc

SEQ ID NO: 7841862 - DNA, 19 bp, Homo sapiens
gcaggcagctggggtatcc

SEQ ID NO: 7841863 - DNA, 19 bp, Homo sapiens
gcaggcagctggggtatcc

SEQ ID NO: 7841864 - DNA, 19 bp, Homo sapiens
gcaggcagctggggtatcc

SEQ ID NO: 7841865 - DNA, 19 bp, Homo sapiens
gcaggcagctggggtatcc

SEQ ID NO: 7841866 - DNA, 22 bp, Homo sapiens
gcaggcagccacgattcccttg

SEQ ID NO: 7841867 - DNA, 19 bp, Homo sapiens
gcaggcagctggggtatcc

SEQ ID NO: 7841868 - DNA, 22 bp, Homo sapiens
gcaggcagccacgattcccttg

SEQ ID NO: 7841869 - DNA, 22 bp, Homo sapiens
gcaggcagccacgattcccttg

SEQ ID NO: 7841870 - DNA, 14 bp, Homo sapiens
gcaggcagatcatt

SEQ ID NO: 7841871 - DNA, 14 bp, Homo sapiens
gcaggcagatcatt

SEQ ID NO: 7841872 - DNA, 14 bp, Homo sapiens
gcaggcagatcatt

SEQ ID NO: 7841873 - DNA, 14 bp, Homo sapiens
gcaggcagatcatt

SEQ ID NO: 7841874 - DNA, 22 bp, Homo sapiens
gcaggcagccacgattcccttg

SEQ ID NO: 7841875 - DNA, 22 bp, Homo sapiens
gcaggcagccacgattcccttg

SEQ ID NO: 7841876 - DNA, 22 bp, Homo sapiens
gcaggcagccacgattcccttg

SEQ ID NO: 7841877 - DNA, 22 bp, Homo sapiens
gcaggcagccacgattcccttg

SEQ ID NO: 7841878 - DNA, 22 bp, Homo sapiens
gcaggcagccacgattcccttg

SEQ ID NO: 7841879 - DNA, 16 bp, Homo sapiens
gcaggcagatcacatg

SEQ ID NO: 7841880 - DNA, 16 bp, Homo sapiens
gcaggcagatcacatg

SEQ ID NO: 7841881 - DNA, 16 bp, Homo sapiens
gcaggcagatcacatg

SEQ ID NO: 7841882 - DNA, 16 bp, Homo sapiens
gcaggcagatcacatg

SEQ ID NO: 7841883 - DNA, 16 bp, Homo sapiens
gcaggcagatcacatg

SEQ ID NO: 7841884 - DNA, 22 bp, Homo sapiens
gcaggcagagtcaatttgatcc

SEQ ID NO: 7841885 - DNA, 22 bp, Homo sapiens
gcaggcagaggtggaggagaca

SEQ ID NO: 7841886 - DNA, 22 bp, Homo sapiens
gcaggcagagtcaatttgatcc

SEQ ID NO: 7841887 - DNA, 22 bp, Homo sapiens
gcaggcagaggtggaggagaca

SEQ ID NO: 7841888 - DNA, 22 bp, Homo sapiens
gcaggcagagtcaatttgatcc

SEQ ID NO: 7841889 - DNA, 22 bp, Homo sapiens
gcaggcagagtcaatttgatcc

SEQ ID NO: 7841890 - DNA, 22 bp, Homo sapiens
gcaggcagagtcaatttgatcc

SEQ ID NO: 7841891 - DNA, 22 bp, Homo sapiens
gcaggcagagtcaatttgatcc

SEQ ID NO: 7841892 - DNA, 22 bp, Homo sapiens
gcaggcagagtcaatttgatcc

SEQ ID NO: 7841893 - DNA, 14 bp, Homo sapiens
gcaggcagatcacc

SEQ ID NO: 7841894 - DNA, 14 bp, Homo sapiens
gcaggcagatcacc

SEQ ID NO: 7841895 - DNA, 14 bp, Homo sapiens
gcaggcagatcacc

SEQ ID NO: 7841896 - DNA, 14 bp, Homo sapiens
gcaggcagatcacc

SEQ ID NO: 7841897 - DNA, 22 bp, Homo sapiens
gcaggcagatcacctgtcagga

SEQ ID NO: 7841898 - DNA, 22 bp, Homo sapiens
gcaggcagatcacctgtcagga

SEQ ID NO: 7841899 - DNA, 15 bp, Homo sapiens
gcaggcagatcaccg

SEQ ID NO: 7841900 - DNA, 15 bp, Homo sapiens
gcaggcagatcaccg

SEQ ID NO: 7841901 - DNA, 15 bp, Homo sapiens
gcaggcagatcaccg

SEQ ID NO: 7841902 - DNA, 15 bp, Homo sapiens
gcaggcagatcaccg

SEQ ID NO: 7841903 - DNA, 22 bp, Homo sapiens
gcaggacacagatgcaaggcca

SEQ ID NO: 7841904 - DNA, 22 bp, Homo sapiens
gcaggacacagatgcaaggcca

SEQ ID NO: 7841905 - DNA, 16 bp, Homo sapiens
gcaggacactcagaca

SEQ ID NO: 7841906 - DNA, 22 bp, Homo sapiens
gcaggacacagatgcaaggcca

SEQ ID NO: 7841907 - DNA, 22 bp, Homo sapiens
gcaggcagaggtggaggagaca

SEQ ID NO: 7841908 - DNA, 22 bp, Homo sapiens
gcaggcagaggtggaggagaca

SEQ ID NO: 7841909 - DNA, 22 bp, Homo sapiens
gcaggcagaggtggaggagaca

SEQ ID NO: 7841910 - DNA, 22 bp, Homo sapiens
gcagggaaggggcatgctggag

SEQ ID NO: 7841911 - DNA, 22 bp, Homo sapiens
gcagggaagttgtaatgtaatg

SEQ ID NO: 7841912 - DNA, 22 bp, Homo sapiens
gcagggaagttgtaatgtaatg

SEQ ID NO: 7841913 - DNA, 22 bp, Homo sapiens
gcagggaagtttgatctttttc

SEQ ID NO: 7841914 - DNA, 22 bp, Homo sapiens
gcagggaaggggcatgctggag

SEQ ID NO: 7841915 - DNA, 22 bp, Homo sapiens
gcagggaaggggcatgctggag

SEQ ID NO: 7841916 - DNA, 22 bp, Homo sapiens
gcagggaaggggcatgctggag

SEQ ID NO: 7841917 - DNA, 21 bp, Homo sapiens
gcagggacaaagcttcaggag

SEQ ID NO: 7841918 - DNA, 21 bp, Homo sapiens
gcagggacaaagcttcaggag

SEQ ID NO: 7841919 - DNA, 21 bp, Homo sapiens
gcagggacaaagcttcaggag

SEQ ID NO: 7841920 - DNA, 21 bp, Homo sapiens
gcagggacaaagcttcaggag

SEQ ID NO: 7841921 - DNA, 22 bp, Homo sapiens
gcagggacaactgtgcacctga

SEQ ID NO: 7841922 - DNA, 22 bp, Homo sapiens
gcagggacaactgtgcacctga

SEQ ID NO: 7841923 - DNA, 22 bp, Homo sapiens
gcagggaagatcttggagctgc

SEQ ID NO: 7841924 - DNA, 22 bp, Homo sapiens
gcagggaagatcttggagctgc

SEQ ID NO: 7841925 - DNA, 22 bp, Homo sapiens
gcagggaagatcttggagctgc

SEQ ID NO: 7841926 - DNA, 22 bp, Homo sapiens
gcagggaagacccggagcagcg

SEQ ID NO: 7841927 - DNA, 22 bp, Homo sapiens
gcagggaagacccggagcagcg

SEQ ID NO: 7841928 - DNA, 22 bp, Homo sapiens
gcagggaagatcttggagctgc

SEQ ID NO: 7841929 - DNA, 22 bp, Homo sapiens
gcagggaagggaaacagagacc

SEQ ID NO: 7841930 - DNA, 22 bp, Homo sapiens
gcagggaagggaaacagagacc

SEQ ID NO: 7841931 - DNA, 22 bp, Homo sapiens
gcaggcagtcatctttcatatt

SEQ ID NO: 7841932 - DNA, 22 bp, Homo sapiens
gcaggcagtcatctttcatatt

SEQ ID NO: 7841933 - DNA, 22 bp, Homo sapiens
gcaggcagtcatctttcatatt

SEQ ID NO: 7841934 - DNA, 22 bp, Homo sapiens
gcaggcagtcatctttcatatt

SEQ ID NO: 7841935 - DNA, 22 bp, Homo sapiens
gcaggcagtcatctttcatatt

SEQ ID NO: 7841936 - DNA, 19 bp, Homo sapiens
gcaggcagtggcattcgga

SEQ ID NO: 7841937 - DNA, 19 bp, Homo sapiens
gcaggcagtggcattcgga

SEQ ID NO: 7841938 - DNA, 19 bp, Homo sapiens
gcaggcagtggcattcgga

SEQ ID NO: 7841939 - DNA, 19 bp, Homo sapiens
gcaggcagtggcattcgga

SEQ ID NO: 7841940 - DNA, 19 bp, Homo sapiens
gcaggcagtggcattcgga

SEQ ID NO: 7841941 - DNA, 19 bp, Homo sapiens
gcaggcagtggcattcgga

SEQ ID NO: 7841942 - DNA, 19 bp, Homo sapiens
gcaggcagtggcattcgga

SEQ ID NO: 7841943 - DNA, 22 bp, Homo sapiens
gcaggcagttgcagttttctag

SEQ ID NO: 7841944 - DNA, 22 bp, Homo sapiens
gcaggcagttgcagttttctag

SEQ ID NO: 7841945 - DNA, 22 bp, Homo sapiens
gcaggcagttgcagttttctag

SEQ ID NO: 7841946 - DNA, 22 bp, Homo sapiens
gcaggcagttgcagttttctag

SEQ ID NO: 7841947 - DNA, 22 bp, Homo sapiens
gcaggcagttgcagttttctag

SEQ ID NO: 7841948 - DNA, 22 bp, Homo sapiens
gcaggcagttgcagttttctag

SEQ ID NO: 7841949 - DNA, 22 bp, Homo sapiens
gcagggaagacccggagcagcg

SEQ ID NO: 7841950 - DNA, 22 bp, Homo sapiens
gcagggaagacccggagcagcg

SEQ ID NO: 7841951 - DNA, 22 bp, Homo sapiens
gcagggaagacccggagcagcg

SEQ ID NO: 7841952 - DNA, 22 bp, Homo sapiens
gcagggaagacccggagcagcg

SEQ ID NO: 7841953 - DNA, 22 bp, Homo sapiens
gcaggcagttatttagtagaat

SEQ ID NO: 7841954 - DNA, 22 bp, Homo sapiens
gcaggcagttatttagtagaat

SEQ ID NO: 7841955 - DNA, 22 bp, Homo sapiens
gcaggcagttatttagtagaat

SEQ ID NO: 7841956 - DNA, 22 bp, Homo sapiens
gcaggcagttatttagtagaat

SEQ ID NO: 7841957 - DNA, 22 bp, Homo sapiens
gcaggcagttatttagtagaat

SEQ ID NO: 7841958 - DNA, 22 bp, Homo sapiens
gcaggcagttatttagtagaat

SEQ ID NO: 7841959 - DNA, 22 bp, Homo sapiens
gcaggcagttatttagtagaat

SEQ ID NO: 7841960 - DNA, 22 bp, Homo sapiens
gccacaggcttaggagggaggt

SEQ ID NO: 7841961 - DNA, 22 bp, Homo sapiens
gcatggcttcggggtgctgcct

SEQ ID NO: 7841962 - DNA, 22 bp, Homo sapiens
gccacaggcttaggagggaggt

SEQ ID NO: 7841963 - DNA, 22 bp, Homo sapiens
gccacaggcttaggagggaggt

SEQ ID NO: 7841964 - DNA, 22 bp, Homo sapiens
gccacaggcttaggagggaggt

SEQ ID NO: 7841965 - DNA, 22 bp, Homo sapiens
gccacaggcttaggagggaggt

SEQ ID NO: 7841966 - DNA, 22 bp, Homo sapiens
gccacatagaggaggatattaa

SEQ ID NO: 7841967 - DNA, 19 bp, Homo sapiens
gccacatctgtaccccttt

SEQ ID NO: 7841968 - DNA, 22 bp, Homo sapiens
gccacaggcttaggagggaggt

SEQ ID NO: 7841969 - DNA, 22 bp, Homo sapiens
gccacaggcttaggagggaggt

SEQ ID NO: 7841970 - DNA, 22 bp, Homo sapiens
gccacatgtcatgtgctcagta

SEQ ID NO: 7841971 - DNA, 22 bp, Homo sapiens
gccacatgtcatgtgctcagta

SEQ ID NO: 7841972 - DNA, 22 bp, Homo sapiens
gccacatgtcatgtgctcagta

SEQ ID NO: 7841973 - DNA, 22 bp, Homo sapiens
gccacatgcaattgcagcacgt

SEQ ID NO: 7841974 - DNA, 22 bp, Homo sapiens
gccacatgtcatgtgctcagta

SEQ ID NO: 7841975 - DNA, 22 bp, Homo sapiens
gccacatgtcatgtgctcagta

SEQ ID NO: 7841976 - DNA, 22 bp, Homo sapiens
gccacatgcaattgcagcacgt

SEQ ID NO: 7841977 - DNA, 19 bp, Homo sapiens
gccacatcttttccagagt

SEQ ID NO: 7841978 - DNA, 22 bp, Homo sapiens
gccaccagcagaaaaggggcca

SEQ ID NO: 7841979 - DNA, 22 bp, Homo sapiens
gccaccagccccatgcgctgtg

SEQ ID NO: 7841980 - DNA, 22 bp, Homo sapiens
gccaccagcagaaaaggggcca

SEQ ID NO: 7841981 - DNA, 22 bp, Homo sapiens
gccaccagcagaaaaggggcca

SEQ ID NO: 7841982 - DNA, 22 bp, Homo sapiens
gccaccaggttctgggttaagc

SEQ ID NO: 7841983 - DNA, 22 bp, Homo sapiens
gccaccaggttagatccagcct

SEQ ID NO: 7841984 - DNA, 22 bp, Homo sapiens
gccaccaggttagatccagcct

SEQ ID NO: 7841985 - DNA, 22 bp, Homo sapiens
gccaccagggggctccagtgag

SEQ ID NO: 7841986 - DNA, 22 bp, Homo sapiens
gccaccagggggtgcaaggtcc

SEQ ID NO: 7841987 - DNA, 22 bp, Homo sapiens
gccaccagggggtgcaaggtcc

SEQ ID NO: 7841988 - DNA, 22 bp, Homo sapiens
gccaccagggggtgcaaggtcc

SEQ ID NO: 7841989 - DNA, 22 bp, Homo sapiens
gccaccagtgggggcctgggca

SEQ ID NO: 7841990 - DNA, 22 bp, Homo sapiens
gccaccagtgggggcctgggca

SEQ ID NO: 7841991 - DNA, 22 bp, Homo sapiens
gccaccagtagctaacaacagt

SEQ ID NO: 7841992 - DNA, 22 bp, Homo sapiens
gccaccagtagctaacaacagt

SEQ ID NO: 7841993 - DNA, 22 bp, Homo sapiens
gccaccagtgggggcctgggca

SEQ ID NO: 7841994 - DNA, 22 bp, Homo sapiens
gccaccagtgggggcctgggca

SEQ ID NO: 7841995 - DNA, 22 bp, Homo sapiens
gccaccagtgggggcctgggca

SEQ ID NO: 7841996 - DNA, 22 bp, Homo sapiens
gccaccaggagcccagtccaaa

SEQ ID NO: 7841997 - DNA, 22 bp, Homo sapiens
gccaccaggagcccagtccaaa

SEQ ID NO: 7841998 - DNA, 22 bp, Homo sapiens
gccaccaggagcccagtccaaa

SEQ ID NO: 7841999 - DNA, 22 bp, Homo sapiens
gccaccagccccatgcgctgtg

SEQ ID NO: 7842000 - DNA, 22 bp, Homo sapiens
gccaccaggagcccagtccaaa

SEQ ID NO: 7842001 - DNA, 22 bp, Homo sapiens
gccaccagggggctccagtgag

SEQ ID NO: 7842002 - DNA, 22 bp, Homo sapiens
gccaccagggggctccagtgag

SEQ ID NO: 7842003 - DNA, 22 bp, Homo sapiens
gccaccagggggctccagtgag

SEQ ID NO: 7842004 - DNA, 22 bp, Homo sapiens
gccaccagggggctccagtgag

SEQ ID NO: 7842005 - DNA, 22 bp, Homo sapiens
gccaccagggggctccagtgag

SEQ ID NO: 7842006 - DNA, 22 bp, Homo sapiens
gcatggccaggaaaggtagaaa

SEQ ID NO: 7842007 - DNA, 22 bp, Homo sapiens
gcatggctattatgaggcagaa

SEQ ID NO: 7842008 - DNA, 20 bp, Homo sapiens
gcatggctaatctgtactga

SEQ ID NO: 7842009 - DNA, 22 bp, Homo sapiens
gcatggccttgctgtagtggta

SEQ ID NO: 7842010 - DNA, 22 bp, Homo sapiens
gcatggctggtgtcctgaggga

SEQ ID NO: 7842011 - DNA, 22 bp, Homo sapiens
gcatggctgtgagcaccctgcc

SEQ ID NO: 7842012 - DNA, 22 bp, Homo sapiens
gcatggctgtgagcaccctgcc

SEQ ID NO: 7842013 - DNA, 22 bp, Homo sapiens
gcatggctgttgaagtcagctc

SEQ ID NO: 7842014 - DNA, 22 bp, Homo sapiens
gcatggcttccaaaagtgctaa

SEQ ID NO: 7842015 - DNA, 22 bp, Homo sapiens
gcatggcttacagaggctgcag

SEQ ID NO: 7842016 - DNA, 22 bp, Homo sapiens
gcatggcttacagaggctgcag

SEQ ID NO: 7842017 - DNA, 22 bp, Homo sapiens
gcatggctctggcctcagtgtg

SEQ ID NO: 7842018 - DNA, 22 bp, Homo sapiens
gcatggctgctccctggctgca

SEQ ID NO: 7842019 - DNA, 22 bp, Homo sapiens
gcatggctgctccctggctgca

SEQ ID NO: 7842020 - DNA, 22 bp, Homo sapiens
gcatggctgctccctggctgca

SEQ ID NO: 7842021 - DNA, 22 bp, Homo sapiens
gcatggctggtgtcctgaggga

SEQ ID NO: 7842022 - DNA, 22 bp, Homo sapiens
gcatgctgctgaggctggaata

SEQ ID NO: 7842023 - DNA, 22 bp, Homo sapiens
gcatgctgctgaggctggaata

SEQ ID NO: 7842024 - DNA, 22 bp, Homo sapiens
gcatgctgctgaggctggaata

SEQ ID NO: 7842025 - DNA, 22 bp, Homo sapiens
gcatgctgcccagggactctct

SEQ ID NO: 7842026 - DNA, 21 bp, Homo sapiens
gcatgcctgcatcttagtgtt

SEQ ID NO: 7842027 - DNA, 21 bp, Homo sapiens
gcatgcctgcatcttagtgtt

SEQ ID NO: 7842028 - DNA, 22 bp, Homo sapiens
gcatgctgagcccacgcctggg

SEQ ID NO: 7842029 - DNA, 22 bp, Homo sapiens
gcatgctgcaccagagcctctc

SEQ ID NO: 7842030 - DNA, 22 bp, Homo sapiens
gcatgcatgtgtgcagacagtc

SEQ ID NO: 7842031 - DNA, 22 bp, Homo sapiens
gcatgcagtaaaattcagcaac

SEQ ID NO: 7842032 - DNA, 22 bp, Homo sapiens
gcatgcagtaaaattcagcaac

SEQ ID NO: 7842033 - DNA, 22 bp, Homo sapiens
gcatgcagtaaaattcagcaac

SEQ ID NO: 7842034 - DNA, 22 bp, Homo sapiens
gcatgcagtaaaattcagcaac

SEQ ID NO: 7842035 - DNA, 22 bp, Homo sapiens
gcatgcagtaaaattcagcaac

SEQ ID NO: 7842036 - DNA, 22 bp, Homo sapiens
gcatgcagtaaaattcagcaac

SEQ ID NO: 7842037 - DNA, 22 bp, Homo sapiens
gcatgcagtgcaattcaatgta

SEQ ID NO: 7842038 - DNA, 22 bp, Homo sapiens
gcatgcagtgcaattcaatgta

SEQ ID NO: 7842039 - DNA, 22 bp, Homo sapiens
gcatgcagtgcaattcaatgta

SEQ ID NO: 7842040 - DNA, 22 bp, Homo sapiens
gcatgcagtcaaccagtaaggg

SEQ ID NO: 7842041 - DNA, 22 bp, Homo sapiens
gcatgcaatctatccttaggaa

SEQ ID NO: 7842042 - DNA, 22 bp, Homo sapiens
gcatgcaatgtatcagtgatag

SEQ ID NO: 7842043 - DNA, 22 bp, Homo sapiens
gcatgcaattatggtattagat

SEQ ID NO: 7842044 - DNA, 22 bp, Homo sapiens
gcatgcaattatggtattagat

SEQ ID NO: 7842045 - DNA, 22 bp, Homo sapiens
gcatgcacacactttctcacta

SEQ ID NO: 7842046 - DNA, 22 bp, Homo sapiens
gcatgcacacctgtgcacattt

SEQ ID NO: 7842047 - DNA, 22 bp, Homo sapiens
gcatgcacggggcatatgggac

SEQ ID NO: 7842048 - DNA, 22 bp, Homo sapiens
gcatgcacagtttttcacctca

SEQ ID NO: 7842049 - DNA, 22 bp, Homo sapiens
gcatgcagaaaatgaacaacga

SEQ ID NO: 7842050 - DNA, 22 bp, Homo sapiens
gcatgcagaaaatgaacaacga

SEQ ID NO: 7842051 - DNA, 22 bp, Homo sapiens
gcatgcactgtatttaagtatc

SEQ ID NO: 7842052 - DNA, 22 bp, Homo sapiens
gcatgcacggggcatatgggac

SEQ ID NO: 7842053 - DNA, 22 bp, Homo sapiens
gcatgcagacagtctgagacca

SEQ ID NO: 7842054 - DNA, 22 bp, Homo sapiens
gcatgcaggaagggcttgggga

SEQ ID NO: 7842055 - DNA, 22 bp, Homo sapiens
gcatgcaggaagggcttgggga

SEQ ID NO: 7842056 - DNA, 22 bp, Homo sapiens
gcatgcagagtccctctgcatt

SEQ ID NO: 7842057 - DNA, 22 bp, Homo sapiens
gcatgcagagtccctctgcatt

SEQ ID NO: 7842058 - DNA, 22 bp, Homo sapiens
gcatgcagagaatacctgtgat

SEQ ID NO: 7842059 - DNA, 22 bp, Homo sapiens
gcatgcagagaatacctgtgat

SEQ ID NO: 7842060 - DNA, 19 bp, Homo sapiens
gcatgcagagtaagaaggt

SEQ ID NO: 7842061 - DNA, 22 bp, Homo sapiens
gcatgcaggagagaaagacggc

SEQ ID NO: 7842062 - DNA, 22 bp, Homo sapiens
gcatgcaggaagttttttggga

SEQ ID NO: 7842063 - DNA, 22 bp, Homo sapiens
gcatgcaggaagttttttggga

SEQ ID NO: 7842064 - DNA, 22 bp, Homo sapiens
gcatgcaggataggttgagctc

SEQ ID NO: 7842065 - DNA, 22 bp, Homo sapiens
gcatgcaggataggttgagctc

SEQ ID NO: 7842066 - DNA, 22 bp, Homo sapiens
gcatgcaggagagaaagacggc

SEQ ID NO: 7842067 - DNA, 22 bp, Homo sapiens
gcatgcagggagggtctggctg

SEQ ID NO: 7842068 - DNA, 22 bp, Homo sapiens
gcatgcagggagggtctggctg

SEQ ID NO: 7842069 - DNA, 22 bp, Homo sapiens
gcatgcagggagggtctggctg

SEQ ID NO: 7842070 - DNA, 22 bp, Homo sapiens
gcatgcagggagggtctggctg

SEQ ID NO: 7842071 - DNA, 22 bp, Homo sapiens
gcagtggccacatggaggagga

SEQ ID NO: 7842072 - DNA, 22 bp, Homo sapiens
gcagtggccacatggaggagga

SEQ ID NO: 7842073 - DNA, 22 bp, Homo sapiens
gcagtggcccagcttgcaggct

SEQ ID NO: 7842074 - DNA, 22 bp, Homo sapiens
gcagtggccacatggaggagga

SEQ ID NO: 7842075 - DNA, 22 bp, Homo sapiens
gcagtggccacatggaggagga

SEQ ID NO: 7842076 - DNA, 22 bp, Homo sapiens
gcagtggccacatggaggagga

SEQ ID NO: 7842077 - DNA, 22 bp, Homo sapiens
gcagtggcatgatgtgggctca

SEQ ID NO: 7842078 - DNA, 22 bp, Homo sapiens
gcagtggccacatggaggagga

SEQ ID NO: 7842079 - DNA, 22 bp, Homo sapiens
gcagtggctaagctcgcatgca

SEQ ID NO: 7842080 - DNA, 22 bp, Homo sapiens
gcagtggctaggagtctggcgt

SEQ ID NO: 7842081 - DNA, 22 bp, Homo sapiens
gcagtggctaagctcgcatgca

SEQ ID NO: 7842082 - DNA, 22 bp, Homo sapiens
gcagtggccacatggaggagga

SEQ ID NO: 7842083 - DNA, 22 bp, Homo sapiens
gcagtggcccagcttgcaggct

SEQ ID NO: 7842084 - DNA, 22 bp, Homo sapiens
gcagtgggagcttaggcagtgc

SEQ ID NO: 7842085 - DNA, 22 bp, Homo sapiens
gcagtgggagcttaggcagtgc

SEQ ID NO: 7842086 - DNA, 22 bp, Homo sapiens
gcagtgggagcttaggcagtgc

SEQ ID NO: 7842087 - DNA, 22 bp, Homo sapiens
gcagtgggagcttaggcagtgc

SEQ ID NO: 7842088 - DNA, 22 bp, Homo sapiens
gcagtgggagcttaggcagtgc

SEQ ID NO: 7842089 - DNA, 22 bp, Homo sapiens
gcagtgggagcttaggcagtgc

SEQ ID NO: 7842090 - DNA, 22 bp, Homo sapiens
gcagtgggaaggttggcacatg

SEQ ID NO: 7842091 - DNA, 22 bp, Homo sapiens
gcagtgggaaggttggcacatg

SEQ ID NO: 7842092 - DNA, 22 bp, Homo sapiens
gcagtgggaaggttggcacatg

SEQ ID NO: 7842093 - DNA, 22 bp, Homo sapiens
gcagtgggaaggttggcacatg

SEQ ID NO: 7842094 - DNA, 22 bp, Homo sapiens
gcagtggctaggagtctggcgt

SEQ ID NO: 7842095 - DNA, 22 bp, Homo sapiens
gcagtggctaggagtctggcgt

SEQ ID NO: 7842096 - DNA, 22 bp, Homo sapiens
gcagtggcagctgagggggtat

SEQ ID NO: 7842097 - DNA, 22 bp, Homo sapiens
gcagtggcatgatgtgggctca

SEQ ID NO: 7842098 - DNA, 22 bp, Homo sapiens
gcagtggcatgatgtgggctca

SEQ ID NO: 7842099 - DNA, 22 bp, Homo sapiens
gcagtggcatgatgtgggctca

SEQ ID NO: 7842100 - DNA, 22 bp, Homo sapiens
gcagtggcagctgagggggtat

SEQ ID NO: 7842101 - DNA, 22 bp, Homo sapiens
gcagtggcagagacagcaccaa

SEQ ID NO: 7842102 - DNA, 22 bp, Homo sapiens
gcagtggcagctgagggggtat

SEQ ID NO: 7842103 - DNA, 22 bp, Homo sapiens
gcagtggcagctgagggggtat

SEQ ID NO: 7842104 - DNA, 22 bp, Homo sapiens
gcagtggcagctgagggggtat

SEQ ID NO: 7842105 - DNA, 22 bp, Homo sapiens
gcagtggcagagacagcaccaa

SEQ ID NO: 7842106 - DNA, 22 bp, Homo sapiens
gcagtggcagagacagcaccaa

SEQ ID NO: 7842107 - DNA, 22 bp, Homo sapiens
gcagtggcaccgctggctctgg

SEQ ID NO: 7842108 - DNA, 22 bp, Homo sapiens
gcagtggcaccgctggctctgg

SEQ ID NO: 7842109 - DNA, 22 bp, Homo sapiens
gcagtggatggccagcaggggc

SEQ ID NO: 7842110 - DNA, 22 bp, Homo sapiens
gcagtggatggccagcaggggc

SEQ ID NO: 7842111 - DNA, 22 bp, Homo sapiens
gcagtggatggccagcaggggc

SEQ ID NO: 7842112 - DNA, 22 bp, Homo sapiens
gcagtggatccaatggtatctt

SEQ ID NO: 7842113 - DNA, 22 bp, Homo sapiens
gcagtggatggccagcaggggc

SEQ ID NO: 7842114 - DNA, 22 bp, Homo sapiens
gcagtggatggccagcaggggc

SEQ ID NO: 7842115 - DNA, 22 bp, Homo sapiens
gcagtggcaccgctggctctgg

SEQ ID NO: 7842116 - DNA, 22 bp, Homo sapiens
gcagtggcaccgctggctctgg

SEQ ID NO: 7842117 - DNA, 22 bp, Homo sapiens
gcagtggatccaatggtatctt

SEQ ID NO: 7842118 - DNA, 17 bp, Homo sapiens
gcagtggaggggtagtt

SEQ ID NO: 7842119 - DNA, 22 bp, Homo sapiens
gcagtggatggccagcaggggc

SEQ ID NO: 7842120 - DNA, 22 bp, Homo sapiens
gcagtggatccaatggtatctt

SEQ ID NO: 7842121 - DNA, 23 bp, Homo sapiens
gcagtggaatgtctctgtttgga

SEQ ID NO: 7842122 - DNA, 23 bp, Homo sapiens
gcagtggaatgtctctgtttgga

SEQ ID NO: 7842123 - DNA, 23 bp, Homo sapiens
gcagtggaatgtctctgtttgga

SEQ ID NO: 7842124 - DNA, 17 bp, Homo sapiens
gcagtggaggggtagtt

SEQ ID NO: 7842125 - DNA, 17 bp, Homo sapiens
gcagtggaggggtagtt

SEQ ID NO: 7842126 - DNA, 17 bp, Homo sapiens
gcagtggaggggtagtt

SEQ ID NO: 7842127 - DNA, 22 bp, Homo sapiens
gcagtggaagcctctttaagca

SEQ ID NO: 7842128 - DNA, 22 bp, Homo sapiens
gcagtggaagcctctttaagca

SEQ ID NO: 7842129 - DNA, 18 bp, Homo sapiens
gcagtgactatggggatc

SEQ ID NO: 7842130 - DNA, 22 bp, Homo sapiens
gcagtgattggatcagagatgg

SEQ ID NO: 7842131 - DNA, 22 bp, Homo sapiens
gcagtgacatacctggagggca

SEQ ID NO: 7842132 - DNA, 22 bp, Homo sapiens
gcagtgacatacctggagggca

SEQ ID NO: 7842133 - DNA, 22 bp, Homo sapiens
gcagtgacatacctggagggca

SEQ ID NO: 7842134 - DNA, 22 bp, Homo sapiens
gcagtgacagggctgctgcctt

SEQ ID NO: 7842135 - DNA, 22 bp, Homo sapiens
gcagtgacagggctgctgcctt

SEQ ID NO: 7842136 - DNA, 22 bp, Homo sapiens
gcagtgaagccagatctgaaat

SEQ ID NO: 7842137 - DNA, 22 bp, Homo sapiens
gcagtgaagccagatctgaaat

SEQ ID NO: 7842138 - DNA, 22 bp, Homo sapiens
gcagtgaatctggcaagaattt

SEQ ID NO: 7842139 - DNA, 22 bp, Homo sapiens
gcagtgaatctggcaagaattt

SEQ ID NO: 7842140 - DNA, 22 bp, Homo sapiens
gcaggggagtggatgatggatt

SEQ ID NO: 7842141 - DNA, 22 bp, Homo sapiens
gcaggggagtggatgatggatt

SEQ ID NO: 7842142 - DNA, 22 bp, Homo sapiens
gcaggggagtggcaggcccgga

SEQ ID NO: 7842143 - DNA, 22 bp, Homo sapiens
gcaggggagtggcaggcccgga

SEQ ID NO: 7842144 - DNA, 22 bp, Homo sapiens
gcaggggagtggcaggcccgga

SEQ ID NO: 7842145 - DNA, 22 bp, Homo sapiens
gcaggggagtggcaggcccgga

SEQ ID NO: 7842146 - DNA, 22 bp, Homo sapiens
gcaggggagtggcaggcccgga

SEQ ID NO: 7842147 - DNA, 22 bp, Homo sapiens
gcaggggagtccactctatgca

SEQ ID NO: 7842148 - DNA, 22 bp, Homo sapiens
gcaggggagtggatgatggatt

SEQ ID NO: 7842149 - DNA, 22 bp, Homo sapiens
gcaggggagtggatgatggatt

SEQ ID NO: 7842150 - DNA, 22 bp, Homo sapiens
gcaggggagtggatgatggatt

SEQ ID NO: 7842151 - DNA, 22 bp, Homo sapiens
gcaggggagtggatgatggatt

SEQ ID NO: 7842152 - DNA, 22 bp, Homo sapiens
gcaggggagtggatgatggatt

SEQ ID NO: 7842153 - DNA, 22 bp, Homo sapiens
gccaggcagcagcgaggatggt

SEQ ID NO: 7842154 - DNA, 22 bp, Homo sapiens
gccaggcagcaggaagccagtg

SEQ ID NO: 7842155 - DNA, 22 bp, Homo sapiens
gccaggcagcaggaagccagtg

SEQ ID NO: 7842156 - DNA, 22 bp, Homo sapiens
gccaggcagcaggaagccagtg

SEQ ID NO: 7842157 - DNA, 22 bp, Homo sapiens
gccaggcagcaggaagccagtg

SEQ ID NO: 7842158 - DNA, 22 bp, Homo sapiens
gccaggcagcagcgaggatggt

SEQ ID NO: 7842159 - DNA, 22 bp, Homo sapiens
gccaggcagcagcgaggatggt

SEQ ID NO: 7842160 - DNA, 22 bp, Homo sapiens
gccaggcagcagcgaggatggt

SEQ ID NO: 7842161 - DNA, 22 bp, Homo sapiens
gccaggcagcagcgaggatggt

SEQ ID NO: 7842162 - DNA, 22 bp, Homo sapiens
gccaggcagccaccctctgcga

SEQ ID NO: 7842163 - DNA, 22 bp, Homo sapiens
gccaggcagccaccctctgcga

SEQ ID NO: 7842164 - DNA, 22 bp, Homo sapiens
gccaggcagccaccctctgcga

SEQ ID NO: 7842165 - DNA, 22 bp, Homo sapiens
gccaggcagccaccctctgcga

SEQ ID NO: 7842166 - DNA, 22 bp, Homo sapiens
gccaggcagccaccctctgcga

SEQ ID NO: 7842167 - DNA, 22 bp, Homo sapiens
gccaggcagccaccctctgcga

SEQ ID NO: 7842168 - DNA, 22 bp, Homo sapiens
gccaggcagatatgtgagctta

SEQ ID NO: 7842169 - DNA, 22 bp, Homo sapiens
gccaggcagatatgtgagctta

SEQ ID NO: 7842170 - DNA, 22 bp, Homo sapiens
gccaggcagatatgtgagctta

SEQ ID NO: 7842171 - DNA, 22 bp, Homo sapiens
gccaggcagatatgtgagctta

SEQ ID NO: 7842172 - DNA, 22 bp, Homo sapiens
gccaggcagatatgtgagctta

SEQ ID NO: 7842173 - DNA, 22 bp, Homo sapiens
gccaggcagatatgtgagctta

SEQ ID NO: 7842174 - DNA, 22 bp, Homo sapiens
gccaggcagatatgtgagctta

SEQ ID NO: 7842175 - DNA, 22 bp, Homo sapiens
gccaggcagagccccgtgcagc

SEQ ID NO: 7842176 - DNA, 22 bp, Homo sapiens
gccaggcagcagcgaggatggt

SEQ ID NO: 7842177 - DNA, 22 bp, Homo sapiens
gccaggcagcagcgaggatggt

SEQ ID NO: 7842178 - DNA, 22 bp, Homo sapiens
gccaggcagcagcgaggatggt

SEQ ID NO: 7842179 - DNA, 22 bp, Homo sapiens
gccaggcagatatgtgagctta

SEQ ID NO: 7842180 - DNA, 22 bp, Homo sapiens
gccaggcagatatgtgagctta

SEQ ID NO: 7842181 - DNA, 22 bp, Homo sapiens
gccaggcagcagcgaggatggt

SEQ ID NO: 7842182 - DNA, 22 bp, Homo sapiens
gccaggcaggccacgctgtgtt

SEQ ID NO: 7842183 - DNA, 22 bp, Homo sapiens
gccaggcagctgggagggtgcc

SEQ ID NO: 7842184 - DNA, 22 bp, Homo sapiens
gccaggcaggccacgctgtgtt

SEQ ID NO: 7842185 - DNA, 22 bp, Homo sapiens
gccaggcaggccacgctgtgtt

SEQ ID NO: 7842186 - DNA, 22 bp, Homo sapiens
gccaggcagctgggagggtgcc

SEQ ID NO: 7842187 - DNA, 22 bp, Homo sapiens
gccaggcagctgggagggtgcc

SEQ ID NO: 7842188 - DNA, 22 bp, Homo sapiens
gccaggcaggccacgctgtgtt

SEQ ID NO: 7842189 - DNA, 22 bp, Homo sapiens
gccaggcagctagcaacccctg

SEQ ID NO: 7842190 - DNA, 22 bp, Homo sapiens
gccaggcagctagcaacccctg

SEQ ID NO: 7842191 - DNA, 22 bp, Homo sapiens
gccaggcagctagcaacccctg

SEQ ID NO: 7842192 - DNA, 22 bp, Homo sapiens
gccaggcagctagcaacccctg

SEQ ID NO: 7842193 - DNA, 22 bp, Homo sapiens
gccaggcagctgggagggtgcc

SEQ ID NO: 7842194 - DNA, 22 bp, Homo sapiens
gccaggcagctgggagggtgcc

SEQ ID NO: 7842195 - DNA, 22 bp, Homo sapiens
gccaggcaggtgtcggagccct

SEQ ID NO: 7842196 - DNA, 22 bp, Homo sapiens
gccaggcagttcaagtacacca

SEQ ID NO: 7842197 - DNA, 22 bp, Homo sapiens
gccaggcagttcaagtacacca

SEQ ID NO: 7842198 - DNA, 22 bp, Homo sapiens
gccaggcagttcaagtacacca

SEQ ID NO: 7842199 - DNA, 22 bp, Homo sapiens
gccaggcaggtgtcggagccct

SEQ ID NO: 7842200 - DNA, 22 bp, Homo sapiens
gccaggcaggtgtcggagccct

SEQ ID NO: 7842201 - DNA, 22 bp, Homo sapiens
gccaggcaggtgtcggagccct

SEQ ID NO: 7842202 - DNA, 18 bp, Homo sapiens
gccaggcagggtggggaa

SEQ ID NO: 7842203 - DNA, 18 bp, Homo sapiens
gccaggcagggtggggaa

SEQ ID NO: 7842204 - DNA, 18 bp, Homo sapiens
gccaggcagggtggggaa

SEQ ID NO: 7842205 - DNA, 18 bp, Homo sapiens
gccaggcagggtggggaa

SEQ ID NO: 7842206 - DNA, 18 bp, Homo sapiens
gccaggcagggtggggaa

SEQ ID NO: 7842207 - DNA, 22 bp, Homo sapiens
gccaggcaggtgtcggagccct

SEQ ID NO: 7842208 - DNA, 18 bp, Homo sapiens
gccaggcagggtggggaa

SEQ ID NO: 7842209 - DNA, 18 bp, Homo sapiens
gccaggcagggtggggaa

SEQ ID NO: 7842210 - DNA, 22 bp, Homo sapiens
gccaggcatgggcttctgggcg

SEQ ID NO: 7842211 - DNA, 22 bp, Homo sapiens
gccaggcatgggcttctgggcg

SEQ ID NO: 7842212 - DNA, 22 bp, Homo sapiens
gccaggcatgggcttctgggcg

SEQ ID NO: 7842213 - DNA, 22 bp, Homo sapiens
gccaggcatgtcctctgcagaa

SEQ ID NO: 7842214 - DNA, 22 bp, Homo sapiens
gccaggcatgtcctctgcagaa

SEQ ID NO: 7842215 - DNA, 22 bp, Homo sapiens
gccaggcatgtcctctgcagaa

SEQ ID NO: 7842216 - DNA, 22 bp, Homo sapiens
gccagggaacccaagggcctca

SEQ ID NO: 7842217 - DNA, 22 bp, Homo sapiens
gccagggaacccaagggcctca

SEQ ID NO: 7842218 - DNA, 22 bp, Homo sapiens
gccagggaacccaagggcctca

SEQ ID NO: 7842219 - DNA, 22 bp, Homo sapiens
gccaggcatgtcctctgcagaa

SEQ ID NO: 7842220 - DNA, 22 bp, Homo sapiens
gccaggcatgtcctctgcagaa

SEQ ID NO: 7842221 - DNA, 22 bp, Homo sapiens
gccagggaacccaagggcctca

SEQ ID NO: 7842222 - DNA, 22 bp, Homo sapiens
gccagggaacccaagggcctca

SEQ ID NO: 7842223 - DNA, 22 bp, Homo sapiens
gccagggaacccaagggcctca

SEQ ID NO: 7842224 - DNA, 21 bp, Homo sapiens
gccagggaagagagttggctg

SEQ ID NO: 7842225 - DNA, 21 bp, Homo sapiens
gccagggaagagagttggctg

SEQ ID NO: 7842226 - DNA, 21 bp, Homo sapiens
gccagggaagagagttggctg

SEQ ID NO: 7842227 - DNA, 21 bp, Homo sapiens
gccagggaagagagttggctg

SEQ ID NO: 7842228 - DNA, 21 bp, Homo sapiens
gccagggaagagagttggctg

SEQ ID NO: 7842229 - DNA, 21 bp, Homo sapiens
gccagggaagagagttggctg

SEQ ID NO: 7842230 - DNA, 17 bp, Homo sapiens
gccagggagaggaagcc

SEQ ID NO: 7842231 - DNA, 17 bp, Homo sapiens
gccagggagaggaagcc

SEQ ID NO: 7842232 - DNA, 17 bp, Homo sapiens
gccagggagaggaagcc

SEQ ID NO: 7842233 - DNA, 21 bp, Homo sapiens
gccagggaagagagttggctg

SEQ ID NO: 7842234 - DNA, 22 bp, Homo sapiens
gccagggaggctgtagggtcct

SEQ ID NO: 7842235 - DNA, 22 bp, Homo sapiens
gccagggaggctgtagggtcct

SEQ ID NO: 7842236 - DNA, 22 bp, Homo sapiens
gccagggaggctgtagggtcct

SEQ ID NO: 7842237 - DNA, 22 bp, Homo sapiens
gccagggaggctgtagggtcct

SEQ ID NO: 7842238 - DNA, 22 bp, Homo sapiens
gccagggaggctgtagggtcct

SEQ ID NO: 7842239 - DNA, 17 bp, Homo sapiens
gccagggagaggaagcc

SEQ ID NO: 7842240 - DNA, 17 bp, Homo sapiens
gccagggagaggaagcc

SEQ ID NO: 7842241 - DNA, 17 bp, Homo sapiens
gccagggagaggaagcc

SEQ ID NO: 7842242 - DNA, 22 bp, Homo sapiens
gccagggcaggggagcatctgc

SEQ ID NO: 7842243 - DNA, 22 bp, Homo sapiens
gccagggcaggggagcatctgc

SEQ ID NO: 7842244 - DNA, 22 bp, Homo sapiens
gccagggcaggggagcatctgc

SEQ ID NO: 7842245 - DNA, 22 bp, Homo sapiens
gccagggcaggggagcatctgc

SEQ ID NO: 7842246 - DNA, 21 bp, Homo sapiens
gccagggagttaaagagtctt

SEQ ID NO: 7842247 - DNA, 21 bp, Homo sapiens
gccagggagttaaagagtctt

SEQ ID NO: 7842248 - DNA, 21 bp, Homo sapiens
gccagggagttaaagagtctt

SEQ ID NO: 7842249 - DNA, 22 bp, Homo sapiens
gccagggcaggggagcatctgc

SEQ ID NO: 7842250 - DNA, 22 bp, Homo sapiens
gccagggcaggggagcatctgc

SEQ ID NO: 7842251 - DNA, 22 bp, Homo sapiens
gccagggagtctgggccacaga

SEQ ID NO: 7842252 - DNA, 22 bp, Homo sapiens
gccagggaggctgtagggtcct

SEQ ID NO: 7842253 - DNA, 22 bp, Homo sapiens
gccagggagtctgggccacaga

SEQ ID NO: 7842254 - DNA, 22 bp, Homo sapiens
gccagggagtctgggccacaga

SEQ ID NO: 7842255 - DNA, 21 bp, Homo sapiens
gccagggagttaaagagtctt

SEQ ID NO: 7842256 - DNA, 21 bp, Homo sapiens
gccagggagttaaagagtctt

SEQ ID NO: 7842257 - DNA, 22 bp, Homo sapiens
gccagggagtctgggccacaga

SEQ ID NO: 7842258 - DNA, 22 bp, Homo sapiens
gccagggctgtgcaggtttgtt

SEQ ID NO: 7842259 - DNA, 22 bp, Homo sapiens
gccagggctgtgcaggtttgtt

SEQ ID NO: 7842260 - DNA, 22 bp, Homo sapiens
gccagggctgtgcaggtttgtt

SEQ ID NO: 7842261 - DNA, 22 bp, Homo sapiens
gccagggctgtgcaggtttgtt

SEQ ID NO: 7842262 - DNA, 22 bp, Homo sapiens
gccagggctgtgcaggtttgtt

SEQ ID NO: 7842263 - DNA, 22 bp, Homo sapiens
gccagggctgtgcaggtttgtt

SEQ ID NO: 7842264 - DNA, 22 bp, Homo sapiens
gccagggctcgcggtccctcgt

SEQ ID NO: 7842265 - DNA, 22 bp, Homo sapiens
gccagggctcgcggtccctcgt

SEQ ID NO: 7842266 - DNA, 22 bp, Homo sapiens
gccagggcaggggagcatctgc

SEQ ID NO: 7842267 - DNA, 22 bp, Homo sapiens
gccagggcaggggagcatctgc

SEQ ID NO: 7842268 - DNA, 22 bp, Homo sapiens
gccagggcaggggagcatctgc

SEQ ID NO: 7842269 - DNA, 22 bp, Homo sapiens
gccagggctcgcggtccctcgt

SEQ ID NO: 7842270 - DNA, 22 bp, Homo sapiens
gccagggctcgcggtccctcgt

SEQ ID NO: 7842271 - DNA, 22 bp, Homo sapiens
gccagggctcgcggtccctcgt

SEQ ID NO: 7842272 - DNA, 22 bp, Homo sapiens
gccagggctcgcggtccctcgt

SEQ ID NO: 7842273 - DNA, 22 bp, Homo sapiens
gccagggctcgcggtccctcgt

SEQ ID NO: 7842274 - DNA, 22 bp, Homo sapiens
gccagggctcgcggtccctcgt

SEQ ID NO: 7842275 - DNA, 22 bp, Homo sapiens
gccacccccaagtaggtggtct

SEQ ID NO: 7842276 - DNA, 22 bp, Homo sapiens
gccaccccataggtgttaggtg

SEQ ID NO: 7842277 - DNA, 22 bp, Homo sapiens
gccaccccataggtgttaggtg

SEQ ID NO: 7842278 - DNA, 22 bp, Homo sapiens
gccaccccataggtgttaggtg

SEQ ID NO: 7842279 - DNA, 21 bp, Homo sapiens
gccacccctggcacaggtgct

SEQ ID NO: 7842280 - DNA, 22 bp, Homo sapiens
gccacccccaagtaggtggtct

SEQ ID NO: 7842281 - DNA, 21 bp, Homo sapiens
gccacccctggcacaggtgct

SEQ ID NO: 7842282 - DNA, 21 bp, Homo sapiens
gccacccctggcacaggtgct

SEQ ID NO: 7842283 - DNA, 21 bp, Homo sapiens
gccacccctggcacaggtgct

SEQ ID NO: 7842284 - DNA, 22 bp, Homo sapiens
gccaccccaacctccctaagtt

SEQ ID NO: 7842285 - DNA, 22 bp, Homo sapiens
gccaccccaacctccctaagtt

SEQ ID NO: 7842286 - DNA, 22 bp, Homo sapiens
gccaccccaacctccctaagtt

SEQ ID NO: 7842287 - DNA, 22 bp, Homo sapiens
gccaccccaacctccctaagtt

SEQ ID NO: 7842288 - DNA, 22 bp, Homo sapiens
gccaccccaacctccctaagtt

SEQ ID NO: 7842289 - DNA, 22 bp, Homo sapiens
gccaccatgtctggctgagttt

SEQ ID NO: 7842290 - DNA, 22 bp, Homo sapiens
gccaccatgtagcccattagag

SEQ ID NO: 7842291 - DNA, 22 bp, Homo sapiens
gccaccagtgggggcctgggca

SEQ ID NO: 7842292 - DNA, 22 bp, Homo sapiens
gccaccatgtagcccattagag

SEQ ID NO: 7842293 - DNA, 22 bp, Homo sapiens
gccaccatgtattgacttggcc

SEQ ID NO: 7842294 - DNA, 21 bp, Homo sapiens
gccacccctggcacaggtgct

SEQ ID NO: 7842295 - DNA, 18 bp, Homo sapiens
gccagccctccaacctcc

SEQ ID NO: 7842296 - DNA, 18 bp, Homo sapiens
gccagccctccaacctcc

SEQ ID NO: 7842297 - DNA, 18 bp, Homo sapiens
gccagccctccaacctcc

SEQ ID NO: 7842298 - DNA, 18 bp, Homo sapiens
gccagccctccaacctcc

SEQ ID NO: 7842299 - DNA, 20 bp, Homo sapiens
gccagccctgacacaggagc

SEQ ID NO: 7842300 - DNA, 20 bp, Homo sapiens
gccagccctgacacaggagc

SEQ ID NO: 7842301 - DNA, 22 bp, Homo sapiens
gccagccctgggagacttatgg

SEQ ID NO: 7842302 - DNA, 20 bp, Homo sapiens
gccagccctgacacaggagc

SEQ ID NO: 7842303 - DNA, 22 bp, Homo sapiens
gccagccctgggagacttatgg

SEQ ID NO: 7842304 - DNA, 22 bp, Homo sapiens
gccagccttctgtggcctgcaa

SEQ ID NO: 7842305 - DNA, 22 bp, Homo sapiens
gccagccttctgtggcctgcaa

SEQ ID NO: 7842306 - DNA, 22 bp, Homo sapiens
gccagccttctgtggcctgcaa

SEQ ID NO: 7842307 - DNA, 22 bp, Homo sapiens
gccagccttctgtggcctgcaa

SEQ ID NO: 7842308 - DNA, 23 bp, Homo sapiens
gccagccttgctctcctgcagcc

SEQ ID NO: 7842309 - DNA, 22 bp, Homo sapiens
gccagccttctgtggcctgcaa

SEQ ID NO: 7842310 - DNA, 22 bp, Homo sapiens
gccagccttctgtggcctgcaa

SEQ ID NO: 7842311 - DNA, 23 bp, Homo sapiens
gccagccttgctctcctgcagcc

SEQ ID NO: 7842312 - DNA, 21 bp, Homo sapiens
gccagcctgtttacctgtggt

SEQ ID NO: 7842313 - DNA, 21 bp, Homo sapiens
gccagcctgtttacctgtggt

SEQ ID NO: 7842314 - DNA, 21 bp, Homo sapiens
gccagcctgtttacctgtggt

SEQ ID NO: 7842315 - DNA, 22 bp, Homo sapiens
gccagcctgtgggggctctgtg

SEQ ID NO: 7842316 - DNA, 22 bp, Homo sapiens
gccagcctgtgggggctctgtg

SEQ ID NO: 7842317 - DNA, 22 bp, Homo sapiens
gccagcctgtgcttggccaggc

SEQ ID NO: 7842318 - DNA, 22 bp, Homo sapiens
gccagcctgtgcttggccaggc

SEQ ID NO: 7842319 - DNA, 22 bp, Homo sapiens
gccagcctgtgcttggccaggc

SEQ ID NO: 7842320 - DNA, 22 bp, Homo sapiens
gccagcctgtgggggctctgtg

SEQ ID NO: 7842321 - DNA, 22 bp, Homo sapiens
gccagcctgtgcttggccaggc

SEQ ID NO: 7842322 - DNA, 22 bp, Homo sapiens
gccagcctgtgcttggccaggc

SEQ ID NO: 7842323 - DNA, 22 bp, Homo sapiens
gccagctccgcaggatggcgcg

SEQ ID NO: 7842324 - DNA, 22 bp, Homo sapiens
gccagctctgtggctgtacttg

SEQ ID NO: 7842325 - DNA, 22 bp, Homo sapiens
gccagctctgtggctgtacttg

SEQ ID NO: 7842326 - DNA, 22 bp, Homo sapiens
gccagctcccaagtgagcccct

SEQ ID NO: 7842327 - DNA, 22 bp, Homo sapiens
gccagctcagtttcaaagtagg

SEQ ID NO: 7842328 - DNA, 22 bp, Homo sapiens
gccagctcccaagtgagcccct

SEQ ID NO: 7842329 - DNA, 22 bp, Homo sapiens
gccagctcccaagtgagcccct

SEQ ID NO: 7842330 - DNA, 22 bp, Homo sapiens
gccagctccgcaggatggcgcg

SEQ ID NO: 7842331 - DNA, 22 bp, Homo sapiens
gccagctcagatgcaggaagga

SEQ ID NO: 7842332 - DNA, 22 bp, Homo sapiens
gccagctcagatgcaggaagga

SEQ ID NO: 7842333 - DNA, 22 bp, Homo sapiens
gccagctcagatgcaggaagga

SEQ ID NO: 7842334 - DNA, 21 bp, Homo sapiens
gccagcggccgccctccagga

SEQ ID NO: 7842335 - DNA, 23 bp, Homo sapiens
gccagccttgctctcctgcagcc

SEQ ID NO: 7842336 - DNA, 23 bp, Homo sapiens
gccagccttgctctcctgcagcc

SEQ ID NO: 7842337 - DNA, 22 bp, Homo sapiens
gccagctcagatgcaggaagga

SEQ ID NO: 7842338 - DNA, 22 bp, Homo sapiens
gccagctcagatgcaggaagga

SEQ ID NO: 7842339 - DNA, 22 bp, Homo sapiens
gccagctcagatgcaggaagga

SEQ ID NO: 7842340 - DNA, 22 bp, Homo sapiens
gccagctcagatgcaggaagga

SEQ ID NO: 7842341 - DNA, 22 bp, Homo sapiens
gccagctcagtgccaggcccct

SEQ ID NO: 7842342 - DNA, 22 bp, Homo sapiens
gccagctcagtgccaggcccct

SEQ ID NO: 7842343 - DNA, 22 bp, Homo sapiens
gccaggcagagccccgtgcagc

SEQ ID NO: 7842344 - DNA, 22 bp, Homo sapiens
gccaggcagagccccgtgcagc

SEQ ID NO: 7842345 - DNA, 22 bp, Homo sapiens
gccaggcagacaggtcatcagg

SEQ ID NO: 7842346 - DNA, 22 bp, Homo sapiens
gccaggcagacaggtcatcagg

SEQ ID NO: 7842347 - DNA, 22 bp, Homo sapiens
gccaggcagacaggtcatcagg

SEQ ID NO: 7842348 - DNA, 22 bp, Homo sapiens
gccaggcagacaggtcatcagg

SEQ ID NO: 7842349 - DNA, 22 bp, Homo sapiens
gccaggcagacaggtcatcagg

SEQ ID NO: 7842350 - DNA, 20 bp, Homo sapiens
gccaggcactgttctcaata

SEQ ID NO: 7842351 - DNA, 22 bp, Homo sapiens
gccaggcactgctctaagccct

SEQ ID NO: 7842352 - DNA, 20 bp, Homo sapiens
gccaggcactgttctcaata

SEQ ID NO: 7842353 - DNA, 20 bp, Homo sapiens
gccaggcactgttctcaata

SEQ ID NO: 7842354 - DNA, 22 bp, Homo sapiens
gccaggcactgctctaagccct

SEQ ID NO: 7842355 - DNA, 22 bp, Homo sapiens
gccaggcactgctctaagccct

SEQ ID NO: 7842356 - DNA, 22 bp, Homo sapiens
gccaggcactgctctaagccct

SEQ ID NO: 7842357 - DNA, 22 bp, Homo sapiens
gccaggcactgctctaagccct

SEQ ID NO: 7842358 - DNA, 22 bp, Homo sapiens
gccagctgacaccttgattttg

SEQ ID NO: 7842359 - DNA, 22 bp, Homo sapiens
gccaggcactgctctaagccct

SEQ ID NO: 7842360 - DNA, 22 bp, Homo sapiens
gccaggcactgctctaagccct

SEQ ID NO: 7842361 - DNA, 22 bp, Homo sapiens
gccagctgaatttccaactgtt

SEQ ID NO: 7842362 - DNA, 22 bp, Homo sapiens
gccagctgaatttccaactgtt

SEQ ID NO: 7842363 - DNA, 22 bp, Homo sapiens
gccagctgaagggaagctcctg

SEQ ID NO: 7842364 - DNA, 22 bp, Homo sapiens
gccagctgaagggaagctcctg

SEQ ID NO: 7842365 - DNA, 22 bp, Homo sapiens
gccagctgaagccctggtggaa

SEQ ID NO: 7842366 - DNA, 22 bp, Homo sapiens
gccagctgaagccctggtggaa

SEQ ID NO: 7842367 - DNA, 22 bp, Homo sapiens
gccagctgaaatttcagttctg

SEQ ID NO: 7842368 - DNA, 22 bp, Homo sapiens
gccagctgaaatttcagttctg

SEQ ID NO: 7842369 - DNA, 22 bp, Homo sapiens
gccagctgaagggaagctcctg

SEQ ID NO: 7842370 - DNA, 22 bp, Homo sapiens
gccagctgaagggaagctcctg

SEQ ID NO: 7842371 - DNA, 22 bp, Homo sapiens
gccagctgaagccctggtggaa

SEQ ID NO: 7842372 - DNA, 22 bp, Homo sapiens
gccctggccttcatctcagaca

SEQ ID NO: 7842373 - DNA, 22 bp, Homo sapiens
gccctggccttcatctcagaca

SEQ ID NO: 7842374 - DNA, 22 bp, Homo sapiens
gccctggcctggcgcgttgtca

SEQ ID NO: 7842375 - DNA, 22 bp, Homo sapiens
gccctggcctcctggaacaggc

SEQ ID NO: 7842376 - DNA, 22 bp, Homo sapiens
gccctggcctcctggaacaggc

SEQ ID NO: 7842377 - DNA, 22 bp, Homo sapiens
gccctgggattgggtggaggct

SEQ ID NO: 7842378 - DNA, 22 bp, Homo sapiens
gccctgggattgggtggaggct

SEQ ID NO: 7842379 - DNA, 22 bp, Homo sapiens
gccctggccttcatctcagaca

SEQ ID NO: 7842380 - DNA, 22 bp, Homo sapiens
gccctggccttcatctcagaca

SEQ ID NO: 7842381 - DNA, 22 bp, Homo sapiens
gccctgggattgggtggaggct

SEQ ID NO: 7842382 - DNA, 22 bp, Homo sapiens
gccctgggattgggtggaggct

SEQ ID NO: 7842383 - DNA, 22 bp, Homo sapiens
gccctgggattgggtggaggct

SEQ ID NO: 7842384 - DNA, 22 bp, Homo sapiens
gccctggatggcaggagccatc

SEQ ID NO: 7842385 - DNA, 22 bp, Homo sapiens
gccctggatggcaggagccatc

SEQ ID NO: 7842386 - DNA, 22 bp, Homo sapiens
gccctggatggcaggagccatc

SEQ ID NO: 7842387 - DNA, 22 bp, Homo sapiens
gccctggatggcaggagccatc

SEQ ID NO: 7842388 - DNA, 22 bp, Homo sapiens
gccctggatgctcatggcatca

SEQ ID NO: 7842389 - DNA, 22 bp, Homo sapiens
gccctggatgctcatggcatca

SEQ ID NO: 7842390 - DNA, 22 bp, Homo sapiens
gccctggagggccagcgactgg

SEQ ID NO: 7842391 - DNA, 22 bp, Homo sapiens
gccctggatggcaggagccatc

SEQ ID NO: 7842392 - DNA, 22 bp, Homo sapiens
gccctggatgtacaggcatgtt

SEQ ID NO: 7842393 - DNA, 22 bp, Homo sapiens
gccctggatgtacaggcatgtt

SEQ ID NO: 7842394 - DNA, 22 bp, Homo sapiens
gccctggcacctcgttgcccag

SEQ ID NO: 7842395 - DNA, 22 bp, Homo sapiens
gccctggcacctcgttgcccag

SEQ ID NO: 7842396 - DNA, 22 bp, Homo sapiens
gccctggatgtacaggcatgtt

SEQ ID NO: 7842397 - DNA, 22 bp, Homo sapiens
gccctggatgtacaggcatgtt

SEQ ID NO: 7842398 - DNA, 22 bp, Homo sapiens
gccctgggattgggtggaggct

SEQ ID NO: 7842399 - DNA, 22 bp, Homo sapiens
gccctgggattgggtggaggct

SEQ ID NO: 7842400 - DNA, 22 bp, Homo sapiens
gccctgggcaaggttctggcca

SEQ ID NO: 7842401 - DNA, 22 bp, Homo sapiens
gccctgggcaaggttctggcca

SEQ ID NO: 7842402 - DNA, 22 bp, Homo sapiens
gccctgggcaaggttctggcca

SEQ ID NO: 7842403 - DNA, 22 bp, Homo sapiens
gccctgtgcgctgagttcaggg

SEQ ID NO: 7842404 - DNA, 22 bp, Homo sapiens
gccctgtgcgactctagaggtt

SEQ ID NO: 7842405 - DNA, 22 bp, Homo sapiens
gccctgggctccctgctccaca

SEQ ID NO: 7842406 - DNA, 22 bp, Homo sapiens
gccctgtggacagtgagaagtg

SEQ ID NO: 7842407 - DNA, 22 bp, Homo sapiens
gccctgtggacccaggaactct

SEQ ID NO: 7842408 - DNA, 22 bp, Homo sapiens
gccctgtggccccagtgggctc

SEQ ID NO: 7842409 - DNA, 22 bp, Homo sapiens
gccctgtggattaatgagcagg

SEQ ID NO: 7842410 - DNA, 22 bp, Homo sapiens
gccctgtggacccaggaactct

SEQ ID NO: 7842411 - DNA, 22 bp, Homo sapiens
gccctgtggattaatgagcagg

SEQ ID NO: 7842412 - DNA, 22 bp, Homo sapiens
gccctgtgcgctgagttcaggg

SEQ ID NO: 7842413 - DNA, 22 bp, Homo sapiens
gccctgtgctcatgggaacatc

SEQ ID NO: 7842414 - DNA, 22 bp, Homo sapiens
gccctgtgctcatgggaacatc

SEQ ID NO: 7842415 - DNA, 22 bp, Homo sapiens
gccctgtgctataggttagggc

SEQ ID NO: 7842416 - DNA, 22 bp, Homo sapiens
gccctgtgcttggatggcagat

SEQ ID NO: 7842417 - DNA, 22 bp, Homo sapiens
gccctgtgcttggatggcagat

SEQ ID NO: 7842418 - DNA, 22 bp, Homo sapiens
gccctgtgcttggatggcagat

SEQ ID NO: 7842419 - DNA, 22 bp, Homo sapiens
gccctggagggccagcgactgg

SEQ ID NO: 7842420 - DNA, 22 bp, Homo sapiens
gccctggagggccagcgactgg

SEQ ID NO: 7842421 - DNA, 22 bp, Homo sapiens
gccctggagctagactaggaca

SEQ ID NO: 7842422 - DNA, 17 bp, Homo sapiens
gccctggagccaggcta

SEQ ID NO: 7842423 - DNA, 17 bp, Homo sapiens
gccctggagccaggcta

SEQ ID NO: 7842424 - DNA, 17 bp, Homo sapiens
gccctggagccaggcta

SEQ ID NO: 7842425 - DNA, 22 bp, Homo sapiens
gccctggagctagactaggaca

SEQ ID NO: 7842426 - DNA, 22 bp, Homo sapiens
gccctggagctagactaggaca

SEQ ID NO: 7842427 - DNA, 22 bp, Homo sapiens
gccccaggggaggtgccctgca

SEQ ID NO: 7842428 - DNA, 22 bp, Homo sapiens
gccccaggggaggtgccctgca

SEQ ID NO: 7842429 - DNA, 22 bp, Homo sapiens
gccctggagagggatatggcat

SEQ ID NO: 7842430 - DNA, 22 bp, Homo sapiens
gccccaggggaggtgccctgca

SEQ ID NO: 7842431 - DNA, 22 bp, Homo sapiens
gccccaggggaggtgccctgca

SEQ ID NO: 7842432 - DNA, 17 bp, Homo sapiens
gccctggagccaggcta

SEQ ID NO: 7842433 - DNA, 17 bp, Homo sapiens
gccctggagccaggcta

SEQ ID NO: 7842434 - DNA, 17 bp, Homo sapiens
gccctggagccaggcta

SEQ ID NO: 7842435 - DNA, 17 bp, Homo sapiens
gccctggagccaggcta

SEQ ID NO: 7842436 - DNA, 15 bp, Homo sapiens
gccccaggaatcaaa

SEQ ID NO: 7842437 - DNA, 15 bp, Homo sapiens
gccccaggaatcaaa

SEQ ID NO: 7842438 - DNA, 22 bp, Homo sapiens
gccccaggataaatttgtaaga

SEQ ID NO: 7842439 - DNA, 22 bp, Homo sapiens
gccccaggataaatttgtaaga

SEQ ID NO: 7842440 - DNA, 22 bp, Homo sapiens
gccccaggggaggtgccctgca

SEQ ID NO: 7842441 - DNA, 22 bp, Homo sapiens
gccccaggggaggtgccctgca

SEQ ID NO: 7842442 - DNA, 22 bp, Homo sapiens
gccccagcctgggaactggagg

SEQ ID NO: 7842443 - DNA, 22 bp, Homo sapiens
gccccagcctgggaactggagg

SEQ ID NO: 7842444 - DNA, 22 bp, Homo sapiens
gccccagctctgccacaactag

SEQ ID NO: 7842445 - DNA, 22 bp, Homo sapiens
gccccagccctgtggaccatgg

SEQ ID NO: 7842446 - DNA, 22 bp, Homo sapiens
gccccagccctgtggaccatgg

SEQ ID NO: 7842447 - DNA, 22 bp, Homo sapiens
gccccagcctagttttctttca

SEQ ID NO: 7842448 - DNA, 22 bp, Homo sapiens
gccccagcctagttttctttca

SEQ ID NO: 7842449 - DNA, 22 bp, Homo sapiens
gccccagccaaggtgacacgaa

SEQ ID NO: 7842450 - DNA, 22 bp, Homo sapiens
gccccagccctgtggaccatgg

SEQ ID NO: 7842451 - DNA, 22 bp, Homo sapiens
gccccagcctcccgagtagctg

SEQ ID NO: 7842452 - DNA, 22 bp, Homo sapiens
gccccagcctcccgagtagctg

SEQ ID NO: 7842453 - DNA, 22 bp, Homo sapiens
gccccagcctcccgagtagctg

SEQ ID NO: 7842454 - DNA, 22 bp, Homo sapiens
gccccagcctcccgagtagctg

SEQ ID NO: 7842455 - DNA, 22 bp, Homo sapiens
gccccagcctcccgagtagctg

SEQ ID NO: 7842456 - DNA, 22 bp, Homo sapiens
gccccagcctcccgagtagctg

SEQ ID NO: 7842457 - DNA, 22 bp, Homo sapiens
gccccagcctcccgagtagctg

SEQ ID NO: 7842458 - DNA, 22 bp, Homo sapiens
gccccagcctcccgagtagctg

SEQ ID NO: 7842459 - DNA, 22 bp, Homo sapiens
gccccagcctcccgagtagctg

SEQ ID NO: 7842460 - DNA, 22 bp, Homo sapiens
gccccagaaagttcaaggcaca

SEQ ID NO: 7842461 - DNA, 22 bp, Homo sapiens
gccccagaaagttcaaggcaca

SEQ ID NO: 7842462 - DNA, 22 bp, Homo sapiens
gccccagatggaggaagctggg

SEQ ID NO: 7842463 - DNA, 22 bp, Homo sapiens
gccccagatggaggaagctggg

SEQ ID NO: 7842464 - DNA, 22 bp, Homo sapiens
gccccagatggaggaagctggg

SEQ ID NO: 7842465 - DNA, 22 bp, Homo sapiens
gccccagcagcaatgcggttga

SEQ ID NO: 7842466 - DNA, 22 bp, Homo sapiens
gccccagccaaggtgacacgaa

SEQ ID NO: 7842467 - DNA, 22 bp, Homo sapiens
gccccagccaaggtgacacgaa

SEQ ID NO: 7842468 - DNA, 22 bp, Homo sapiens
gccccagccaaggtgacacgaa

SEQ ID NO: 7842469 - DNA, 22 bp, Homo sapiens
gccctgtgtgtttgcactgatt

SEQ ID NO: 7842470 - DNA, 22 bp, Homo sapiens
gccctgtgtgatctgctgttag

SEQ ID NO: 7842471 - DNA, 22 bp, Homo sapiens
gccctgtgtgtttgcactgatt

SEQ ID NO: 7842472 - DNA, 22 bp, Homo sapiens
gccctgtgtgatctgctgttag

SEQ ID NO: 7842473 - DNA, 22 bp, Homo sapiens
gccctgtgtgtttgcactgatt

SEQ ID NO: 7842474 - DNA, 22 bp, Homo sapiens
gccctgtgtgtttgcactgatt

SEQ ID NO: 7842475 - DNA, 22 bp, Homo sapiens
gccctgtgtgtttgcactgatt

SEQ ID NO: 7842476 - DNA, 22 bp, Homo sapiens
gccctgtgtgatcacatgaaca

SEQ ID NO: 7842477 - DNA, 22 bp, Homo sapiens
gccctgtgtgatcacatgaaca

SEQ ID NO: 7842478 - DNA, 22 bp, Homo sapiens
gccctgtgtatcccctgtgctt

SEQ ID NO: 7842479 - DNA, 22 bp, Homo sapiens
gccctgtgtatcccctgtgctt

SEQ ID NO: 7842480 - DNA, 22 bp, Homo sapiens
gccctgtggttccaggaagcaa

SEQ ID NO: 7842481 - DNA, 22 bp, Homo sapiens
gccctgtgtatcccctgtgctt

SEQ ID NO: 7842482 - DNA, 22 bp, Homo sapiens
gccctgtgtatcccctgtgctt

SEQ ID NO: 7842483 - DNA, 22 bp, Homo sapiens
gccctgtgtatcccctgtgctt

SEQ ID NO: 7842484 - DNA, 22 bp, Homo sapiens
gcctccggagtcacagtgtctt

SEQ ID NO: 7842485 - DNA, 22 bp, Homo sapiens
gcctcccttggtgtctcccggg

SEQ ID NO: 7842486 - DNA, 22 bp, Homo sapiens
gcctccggagtcacagtgtctt

SEQ ID NO: 7842487 - DNA, 22 bp, Homo sapiens
gcctccggagtcacagtgtctt

SEQ ID NO: 7842488 - DNA, 22 bp, Homo sapiens
gcctccggagttgcagtgtctt

SEQ ID NO: 7842489 - DNA, 22 bp, Homo sapiens
gcctccggagtcacagtgtctt

SEQ ID NO: 7842490 - DNA, 22 bp, Homo sapiens
gcctccggagttgcagtgtctt

SEQ ID NO: 7842491 - DNA, 22 bp, Homo sapiens
gcctccggagttgcagtgtctt

SEQ ID NO: 7842492 - DNA, 22 bp, Homo sapiens
gcctcctgaaaggaagagctcc

SEQ ID NO: 7842493 - DNA, 22 bp, Homo sapiens
gcctcctgaaaggaagagctcc

SEQ ID NO: 7842494 - DNA, 22 bp, Homo sapiens
gcctcctgaaaggaagagctcc

SEQ ID NO: 7842495 - DNA, 22 bp, Homo sapiens
gcctcctgaaaggaagagctcc

SEQ ID NO: 7842496 - DNA, 22 bp, Homo sapiens
gcctcctcttgagggtcaggga

SEQ ID NO: 7842497 - DNA, 22 bp, Homo sapiens
gcctcctcttgagggtcaggga

SEQ ID NO: 7842498 - DNA, 22 bp, Homo sapiens
gcctcctgacttacactgagct

SEQ ID NO: 7842499 - DNA, 22 bp, Homo sapiens
gcctcctgacttacactgagct

SEQ ID NO: 7842500 - DNA, 22 bp, Homo sapiens
gcctcctgaagtgctgggatta

SEQ ID NO: 7842501 - DNA, 22 bp, Homo sapiens
gcctcctgaagtgctgggatta

SEQ ID NO: 7842502 - DNA, 22 bp, Homo sapiens
gcctcctgaagtgctgggatta

SEQ ID NO: 7842503 - DNA, 22 bp, Homo sapiens
gcctcctgaagtgctgggatta

SEQ ID NO: 7842504 - DNA, 22 bp, Homo sapiens
gcctcctgaagtgctgggatta

SEQ ID NO: 7842505 - DNA, 22 bp, Homo sapiens
gcctccggagttgcagtgtctt

SEQ ID NO: 7842506 - DNA, 22 bp, Homo sapiens
gcctcctcacaatgtacccacg

SEQ ID NO: 7842507 - DNA, 22 bp, Homo sapiens
gcctcctcacaatgtacccacg

SEQ ID NO: 7842508 - DNA, 22 bp, Homo sapiens
gcctcctaattgccactctgga

SEQ ID NO: 7842509 - DNA, 22 bp, Homo sapiens
gcctcctccttcccgagggtct

SEQ ID NO: 7842510 - DNA, 22 bp, Homo sapiens
gcctcctcacaatgtacccacg

SEQ ID NO: 7842511 - DNA, 22 bp, Homo sapiens
gcctcctccttcccgagggtct

SEQ ID NO: 7842512 - DNA, 22 bp, Homo sapiens
gcctcctcttgagggtcaggga

SEQ ID NO: 7842513 - DNA, 22 bp, Homo sapiens
gcctcctggttgcttctccaac

SEQ ID NO: 7842514 - DNA, 22 bp, Homo sapiens
gcctctggagtcgcagcgtctt

SEQ ID NO: 7842515 - DNA, 22 bp, Homo sapiens
gcctctggagtcgcagcgtctt

SEQ ID NO: 7842516 - DNA, 22 bp, Homo sapiens
gcctcctgggttcatgccattc

SEQ ID NO: 7842517 - DNA, 22 bp, Homo sapiens
gcctcctggttgcttctccaac

SEQ ID NO: 7842518 - DNA, 22 bp, Homo sapiens
gcctcctgggttcatgccattc

SEQ ID NO: 7842519 - DNA, 22 bp, Homo sapiens
gcctcctgggttcatgccattc

SEQ ID NO: 7842520 - DNA, 22 bp, Homo sapiens
gcctcctgggttcatgccattc

SEQ ID NO: 7842521 - DNA, 22 bp, Homo sapiens
gcctcctggcctttgctcctca

SEQ ID NO: 7842522 - DNA, 22 bp, Homo sapiens
gcctcctggcctttgctcctca

SEQ ID NO: 7842523 - DNA, 22 bp, Homo sapiens
gcctcctggggtgccatcatct

SEQ ID NO: 7842524 - DNA, 22 bp, Homo sapiens
gcctcctggggtgccatcatct

SEQ ID NO: 7842525 - DNA, 22 bp, Homo sapiens
gcctcctggggtgccatcatct

SEQ ID NO: 7842526 - DNA, 22 bp, Homo sapiens
gcctcctggggtgccatcatct

SEQ ID NO: 7842527 - DNA, 22 bp, Homo sapiens
gcctctgggctctgcccctggc

SEQ ID NO: 7842528 - DNA, 22 bp, Homo sapiens
gcctctgggctctgcccctggc

SEQ ID NO: 7842529 - DNA, 22 bp, Homo sapiens
gcctctggcttctgcatcagtg

SEQ ID NO: 7842530 - DNA, 22 bp, Homo sapiens
gcctctggagttgcttgtaaat

SEQ ID NO: 7842531 - DNA, 22 bp, Homo sapiens
gcctctggcttctgcatcagtg

SEQ ID NO: 7842532 - DNA, 22 bp, Homo sapiens
gcctctggcttctgcatcagtg

SEQ ID NO: 7842533 - DNA, 22 bp, Homo sapiens
gcctctggagttgcttgtaaat

SEQ ID NO: 7842534 - DNA, 22 bp, Homo sapiens
gcctctggcttctgcatcagtg

SEQ ID NO: 7842535 - DNA, 22 bp, Homo sapiens
gcctctggcttctgcatcagtg

SEQ ID NO: 7842536 - DNA, 22 bp, Homo sapiens
gcctctggagtcgcagcgtctt

SEQ ID NO: 7842537 - DNA, 22 bp, Homo sapiens
gcctctggagtcgcagcgtctt

SEQ ID NO: 7842538 - DNA, 22 bp, Homo sapiens
gcctctggagttgcttgtaaat

SEQ ID NO: 7842539 - DNA, 22 bp, Homo sapiens
gcctctggagtcgcagcgtctt

SEQ ID NO: 7842540 - DNA, 22 bp, Homo sapiens
gcctcctggaagtcacatgttt

SEQ ID NO: 7842541 - DNA, 22 bp, Homo sapiens
gcctcctggattttagtgccat

SEQ ID NO: 7842542 - DNA, 22 bp, Homo sapiens
gcctcctggattttagtgccat

SEQ ID NO: 7842543 - DNA, 22 bp, Homo sapiens
gcctcctggattttagtgccat

SEQ ID NO: 7842544 - DNA, 22 bp, Homo sapiens
gcctcctggcctttgctcctca

SEQ ID NO: 7842545 - DNA, 22 bp, Homo sapiens
gcctcctggcctttgctcctca

SEQ ID NO: 7842546 - DNA, 22 bp, Homo sapiens
gcctcctggattttagtgccat

SEQ ID NO: 7842547 - DNA, 22 bp, Homo sapiens
gcctcctgagtagctgggattg

SEQ ID NO: 7842548 - DNA, 22 bp, Homo sapiens
gcctcctgagtagctgggattg

SEQ ID NO: 7842549 - DNA, 22 bp, Homo sapiens
gcctcctgcccagatgagtgat

SEQ ID NO: 7842550 - DNA, 22 bp, Homo sapiens
gcctcctgcccagatgagtgat

SEQ ID NO: 7842551 - DNA, 22 bp, Homo sapiens
gcctcctgcccagatgagtgat

SEQ ID NO: 7842552 - DNA, 22 bp, Homo sapiens
gcctcctggaagtcacatgttt

SEQ ID NO: 7842553 - DNA, 22 bp, Homo sapiens
gcctcctggaagtcacatgttt

SEQ ID NO: 7842554 - DNA, 22 bp, Homo sapiens
gcctcctggaagtcacatgttt

SEQ ID NO: 7842555 - DNA, 22 bp, Homo sapiens
gcctcctgcccagatgagtgat

SEQ ID NO: 7842556 - DNA, 22 bp, Homo sapiens
gcctcctgcccagatgagtgat

SEQ ID NO: 7842557 - DNA, 22 bp, Homo sapiens
gcctcctgacttacactgagct

SEQ ID NO: 7842558 - DNA, 22 bp, Homo sapiens
gcctcctgacttacactgagct

SEQ ID NO: 7842559 - DNA, 22 bp, Homo sapiens
gcctcctgacttacactgagct

SEQ ID NO: 7842560 - DNA, 22 bp, Homo sapiens
gcctcctgacttacactgagct

SEQ ID NO: 7842561 - DNA, 22 bp, Homo sapiens
gcctcctgagaagccacaggct

SEQ ID NO: 7842562 - DNA, 22 bp, Homo sapiens
gcctcctgagaagccacaggct

SEQ ID NO: 7842563 - DNA, 22 bp, Homo sapiens
gcctcctgagaagccacaggct

SEQ ID NO: 7842564 - DNA, 22 bp, Homo sapiens
gcctcctgagaagccacaggct

SEQ ID NO: 7842565 - DNA, 22 bp, Homo sapiens
gcctcctgagaagccacaggct

SEQ ID NO: 7842566 - DNA, 22 bp, Homo sapiens
gcctcctgagtagctgggattg

SEQ ID NO: 7842567 - DNA, 22 bp, Homo sapiens
gcctcctgagtagctgggattg

SEQ ID NO: 7842568 - DNA, 22 bp, Homo sapiens
gcctcctgagtagctgggattg

SEQ ID NO: 7842569 - DNA, 22 bp, Homo sapiens
gcctcctgagaagccacaggct

SEQ ID NO: 7842570 - DNA, 22 bp, Homo sapiens
gcctcctgagaagccacaggct

SEQ ID NO: 7842571 - DNA, 22 bp, Homo sapiens
gcctcctgagaagccacaggct

SEQ ID NO: 7842572 - DNA, 22 bp, Homo sapiens
gcctcctgagaagccacaggct

SEQ ID NO: 7842573 - DNA, 22 bp, Homo sapiens
gcccagcacattgctgaggacc

SEQ ID NO: 7842574 - DNA, 22 bp, Homo sapiens
gcccagcacattgctgaggacc

SEQ ID NO: 7842575 - DNA, 22 bp, Homo sapiens
gcccagcacattgctgaggacc

SEQ ID NO: 7842576 - DNA, 22 bp, Homo sapiens
gcccagcacattgctgaggacc

SEQ ID NO: 7842577 - DNA, 22 bp, Homo sapiens
gcccagcacattgctgaggacc

SEQ ID NO: 7842578 - DNA, 22 bp, Homo sapiens
gcccagcacattgctgaggacc

SEQ ID NO: 7842579 - DNA, 22 bp, Homo sapiens
gcccagcacatctggccttgaa

SEQ ID NO: 7842580 - DNA, 22 bp, Homo sapiens
gcccagcacatctggccttgaa

SEQ ID NO: 7842581 - DNA, 22 bp, Homo sapiens
gcccagcacattgctgaggacc

SEQ ID NO: 7842582 - DNA, 22 bp, Homo sapiens
gcccagcacagctggaagagtc

SEQ ID NO: 7842583 - DNA, 22 bp, Homo sapiens
gcccagcacagctggaagagtc

SEQ ID NO: 7842584 - DNA, 22 bp, Homo sapiens
gcccagcacatctggccttgaa

SEQ ID NO: 7842585 - DNA, 22 bp, Homo sapiens
gcccagcacatctggccttgaa

SEQ ID NO: 7842586 - DNA, 22 bp, Homo sapiens
gccagggttcgaatccgtatgg

SEQ ID NO: 7842587 - DNA, 22 bp, Homo sapiens
gccagggttgccaatgggggca

SEQ ID NO: 7842588 - DNA, 22 bp, Homo sapiens
gccagggttgccaatgggggca

SEQ ID NO: 7842589 - DNA, 22 bp, Homo sapiens
gccagggttgccaatgggggca

SEQ ID NO: 7842590 - DNA, 22 bp, Homo sapiens
gccaggtatagactccagttct

SEQ ID NO: 7842591 - DNA, 23 bp, Homo sapiens
gccaggtattctgataggcactg

SEQ ID NO: 7842592 - DNA, 22 bp, Homo sapiens
gcccagcaaggaccaagggccg

SEQ ID NO: 7842593 - DNA, 21 bp, Homo sapiens
gcccagcaaggtgagaaggcc

SEQ ID NO: 7842594 - DNA, 21 bp, Homo sapiens
gcccagcaaggtgagaaggcc

SEQ ID NO: 7842595 - DNA, 21 bp, Homo sapiens
gcccagcaaggtgagaaggcc

SEQ ID NO: 7842596 - DNA, 21 bp, Homo sapiens
gcccagcaaggtgagaaggcc

SEQ ID NO: 7842597 - DNA, 21 bp, Homo sapiens
gcccagcaaggtgagaaggcc

SEQ ID NO: 7842598 - DNA, 22 bp, Homo sapiens
gcccagcacagctggaagagtc

SEQ ID NO: 7842599 - DNA, 22 bp, Homo sapiens
gcccagcacagctggaagagtc

SEQ ID NO: 7842600 - DNA, 22 bp, Homo sapiens
gcccagcacagctggaagagtc

SEQ ID NO: 7842601 - DNA, 22 bp, Homo sapiens
gcccagcacagctggaagagtc

SEQ ID NO: 7842602 - DNA, 22 bp, Homo sapiens
gccagggtgtgcagggacagga

SEQ ID NO: 7842603 - DNA, 22 bp, Homo sapiens
gccagggtgtgcagggacagga

SEQ ID NO: 7842604 - DNA, 22 bp, Homo sapiens
gccagggtgtgcagggacagga

SEQ ID NO: 7842605 - DNA, 22 bp, Homo sapiens
gccagggttcaagctattctcc

SEQ ID NO: 7842606 - DNA, 22 bp, Homo sapiens
gccagggttcgaatccgtatgg

SEQ ID NO: 7842607 - DNA, 22 bp, Homo sapiens
gccagggttcgaatccgtatgg

SEQ ID NO: 7842608 - DNA, 22 bp, Homo sapiens
gccagggttcgaatccgtatgg

SEQ ID NO: 7842609 - DNA, 22 bp, Homo sapiens
gccagggttcgaatccgtatgg

SEQ ID NO: 7842610 - DNA, 22 bp, Homo sapiens
gccagggtggcagaaggcccca

SEQ ID NO: 7842611 - DNA, 22 bp, Homo sapiens
gccagggtgagggctgagaggt

SEQ ID NO: 7842612 - DNA, 22 bp, Homo sapiens
gccagggtgtgcagggacagga

SEQ ID NO: 7842613 - DNA, 22 bp, Homo sapiens
gccagggtcctgaagaccaagt

SEQ ID NO: 7842614 - DNA, 22 bp, Homo sapiens
gccaggggtgcccacccaagga

SEQ ID NO: 7842615 - DNA, 22 bp, Homo sapiens
gccagggggtcagcaggcactt

SEQ ID NO: 7842616 - DNA, 22 bp, Homo sapiens
gccagggggtcagcaggcactt

SEQ ID NO: 7842617 - DNA, 22 bp, Homo sapiens
gccagggggtcagcaggcactt

SEQ ID NO: 7842618 - DNA, 22 bp, Homo sapiens
gccagggggtcagcaggcactt

SEQ ID NO: 7842619 - DNA, 22 bp, Homo sapiens
gccagggggtcagcaggcactt

SEQ ID NO: 7842620 - DNA, 22 bp, Homo sapiens
gccagggggtcagcaggcactt

SEQ ID NO: 7842621 - DNA, 22 bp, Homo sapiens
gccagggggtcagcaggcactt

SEQ ID NO: 7842622 - DNA, 22 bp, Homo sapiens
gccaggggacgcggagcgacga

SEQ ID NO: 7842623 - DNA, 22 bp, Homo sapiens
gccaggggacgcggagcgacga

SEQ ID NO: 7842624 - DNA, 22 bp, Homo sapiens
gccaggggacgcggagcgacga

SEQ ID NO: 7842625 - DNA, 22 bp, Homo sapiens
gccaggggacgcggagcgacga

SEQ ID NO: 7842626 - DNA, 22 bp, Homo sapiens
gccaggggacgcggagcgacga

SEQ ID NO: 7842627 - DNA, 22 bp, Homo sapiens
gccaggggacgcggagcgacga

SEQ ID NO: 7842628 - DNA, 22 bp, Homo sapiens
gcccagcactcctctctgacat

SEQ ID NO: 7842629 - DNA, 22 bp, Homo sapiens
gcccagcactcctctctgacat

SEQ ID NO: 7842630 - DNA, 22 bp, Homo sapiens
gcccagcactcctctctgacat

SEQ ID NO: 7842631 - DNA, 22 bp, Homo sapiens
gcccagcactcctctctgacat

SEQ ID NO: 7842632 - DNA, 22 bp, Homo sapiens
gcccagcactcctctctgacat

SEQ ID NO: 7842633 - DNA, 22 bp, Homo sapiens
gcccagcactcctctctgacat

SEQ ID NO: 7842634 - DNA, 22 bp, Homo sapiens
gcccagcactaaaagctttgct

SEQ ID NO: 7842635 - DNA, 22 bp, Homo sapiens
gcccagcactcctctctgacat

SEQ ID NO: 7842636 - DNA, 22 bp, Homo sapiens
gcccagcactaaaagctttgct

SEQ ID NO: 7842637 - DNA, 22 bp, Homo sapiens
gcccagcacctctctcagggtt

SEQ ID NO: 7842638 - DNA, 22 bp, Homo sapiens
gcccagcacctctctcagggtt

SEQ ID NO: 7842639 - DNA, 22 bp, Homo sapiens
gcccagcacctctctcagggtt

SEQ ID NO: 7842640 - DNA, 22 bp, Homo sapiens
gcccagcacctctctcagggtt

SEQ ID NO: 7842641 - DNA, 22 bp, Homo sapiens
gcccagcacctctctcagggtt

SEQ ID NO: 7842642 - DNA, 22 bp, Homo sapiens
gcccagcacctctctcagggtt

SEQ ID NO: 7842643 - DNA, 22 bp, Homo sapiens
gcccagcacctctctcagggtt

SEQ ID NO: 7842644 - DNA, 22 bp, Homo sapiens
gcccagcagctggtggagaagg

SEQ ID NO: 7842645 - DNA, 22 bp, Homo sapiens
gcccagcccctgggtggacgtg

SEQ ID NO: 7842646 - DNA, 22 bp, Homo sapiens
gcccagcagctggtggagaagg

SEQ ID NO: 7842647 - DNA, 22 bp, Homo sapiens
gcccagccctgaggtcacagct

SEQ ID NO: 7842648 - DNA, 22 bp, Homo sapiens
gcccagcagatctcagtgtctc

SEQ ID NO: 7842649 - DNA, 22 bp, Homo sapiens
gcccagcagatctcagtgtctc

SEQ ID NO: 7842650 - DNA, 22 bp, Homo sapiens
gcccagcagatctcagtgtctc

SEQ ID NO: 7842651 - DNA, 22 bp, Homo sapiens
gcccagcagctccacttggctt

SEQ ID NO: 7842652 - DNA, 22 bp, Homo sapiens
gcccagcagctccacttggctt

SEQ ID NO: 7842653 - DNA, 22 bp, Homo sapiens
gcccagcagatctcagtgtctc

SEQ ID NO: 7842654 - DNA, 22 bp, Homo sapiens
gcccagcagatctcagtgtctc

SEQ ID NO: 7842655 - DNA, 22 bp, Homo sapiens
gcccagcagatctcagtgtctc

SEQ ID NO: 7842656 - DNA, 22 bp, Homo sapiens
gcccagcagatctcagtgtctc

SEQ ID NO: 7842657 - DNA, 22 bp, Homo sapiens
gcccagctggcttccagcacat

SEQ ID NO: 7842658 - DNA, 22 bp, Homo sapiens
gcccagctggcttccagcacat

SEQ ID NO: 7842659 - DNA, 22 bp, Homo sapiens
gcccagctgcaccctggtgggt

SEQ ID NO: 7842660 - DNA, 22 bp, Homo sapiens
gcccagctgcaccctggtgggt

SEQ ID NO: 7842661 - DNA, 22 bp, Homo sapiens
gcccagctgcaccctggtgggt

SEQ ID NO: 7842662 - DNA, 22 bp, Homo sapiens
gcccagctgagaagcgcggggc

SEQ ID NO: 7842663 - DNA, 22 bp, Homo sapiens
gcccagctgagaagcgcggggc

SEQ ID NO: 7842664 - DNA, 22 bp, Homo sapiens
gcccagctgagaagcgcggggc

SEQ ID NO: 7842665 - DNA, 22 bp, Homo sapiens
gcccagctccattcttggtgag

SEQ ID NO: 7842666 - DNA, 22 bp, Homo sapiens
gcccagctcctctgcagaccct

SEQ ID NO: 7842667 - DNA, 22 bp, Homo sapiens
gcccagctccattcttggtgag

SEQ ID NO: 7842668 - DNA, 22 bp, Homo sapiens
gcccagctgagaagcgcggggc

SEQ ID NO: 7842669 - DNA, 22 bp, Homo sapiens
gcccagctcctctgcagaccct

SEQ ID NO: 7842670 - DNA, 22 bp, Homo sapiens
gcccagctcctctgcagaccct

SEQ ID NO: 7842671 - DNA, 22 bp, Homo sapiens
gcccagccctgaggtcacagct

SEQ ID NO: 7842672 - DNA, 22 bp, Homo sapiens
gcccagccctgaggtcacagct

SEQ ID NO: 7842673 - DNA, 22 bp, Homo sapiens
gcccagccctgaggtcacagct

SEQ ID NO: 7842674 - DNA, 22 bp, Homo sapiens
gcccagcctccaagctccaagg

SEQ ID NO: 7842675 - DNA, 22 bp, Homo sapiens
gcccagcctccaagctccaagg

SEQ ID NO: 7842676 - DNA, 22 bp, Homo sapiens
gcccagcctccaagctccaagg

SEQ ID NO: 7842677 - DNA, 22 bp, Homo sapiens
gcccagcctccaagctccaagg

SEQ ID NO: 7842678 - DNA, 22 bp, Homo sapiens
gcccagcctccaagctccaagg

SEQ ID NO: 7842679 - DNA, 22 bp, Homo sapiens
gcccagcctccaagctccaagg

SEQ ID NO: 7842680 - DNA, 22 bp, Homo sapiens
gcccagctccattcttggtgag

SEQ ID NO: 7842681 - DNA, 22 bp, Homo sapiens
gcccagcgagcagaggtggacg

SEQ ID NO: 7842682 - DNA, 22 bp, Homo sapiens
gcccagctttttgaggcaggca

SEQ ID NO: 7842683 - DNA, 22 bp, Homo sapiens
gcccagctttttgaggcaggca

SEQ ID NO: 7842684 - DNA, 22 bp, Homo sapiens
gcccagctttttgaggcaggca

SEQ ID NO: 7842685 - DNA, 22 bp, Homo sapiens
gcccagctttttgaggcaggca

SEQ ID NO: 7842686 - DNA, 22 bp, Homo sapiens
gcccagctgtctggcagggatg

SEQ ID NO: 7842687 - DNA, 22 bp, Homo sapiens
gcccagcttttcacttccacac

SEQ ID NO: 7842688 - DNA, 22 bp, Homo sapiens
gcccagctgcaccctggtgggt

SEQ ID NO: 7842689 - DNA, 22 bp, Homo sapiens
gcccagctggcttccagcacat

SEQ ID NO: 7842690 - DNA, 22 bp, Homo sapiens
gcccagctgtctggcagggatg

SEQ ID NO: 7842691 - DNA, 22 bp, Homo sapiens
gcccagctgtctggcagggatg

SEQ ID NO: 7842692 - DNA, 22 bp, Homo sapiens
gcccagctgtctggcagggatg

SEQ ID NO: 7842693 - DNA, 22 bp, Homo sapiens
gcccagctttttgaggcaggca

SEQ ID NO: 7842694 - DNA, 22 bp, Homo sapiens
gcccaggaaagatagggcctca

SEQ ID NO: 7842695 - DNA, 22 bp, Homo sapiens
gcccaggaaagatagggcctca

SEQ ID NO: 7842696 - DNA, 22 bp, Homo sapiens
gcccagctttttgaggcaggca

SEQ ID NO: 7842697 - DNA, 22 bp, Homo sapiens
gcccaggaaagatagggcctca

SEQ ID NO: 7842698 - DNA, 22 bp, Homo sapiens
gcccaggaaagatagggcctca

SEQ ID NO: 7842699 - DNA, 22 bp, Homo sapiens
gcccaggaaagatagggcctca

SEQ ID NO: 7842700 - DNA, 22 bp, Homo sapiens
gcccaggaaataaaagtgggct

SEQ ID NO: 7842701 - DNA, 22 bp, Homo sapiens
gcccaggaaataaaagtgggct

SEQ ID NO: 7842702 - DNA, 22 bp, Homo sapiens
gcccaggaaatgccccgtggtg

SEQ ID NO: 7842703 - DNA, 22 bp, Homo sapiens
gcccaggaaatgccccgtggtg

SEQ ID NO: 7842704 - DNA, 22 bp, Homo sapiens
gcccaggaagttgaggctgccg

SEQ ID NO: 7842705 - DNA, 22 bp, Homo sapiens
gcccaggaagttgaggctgccg

SEQ ID NO: 7842706 - DNA, 22 bp, Homo sapiens
gcccaggaagttgaggctgccg

SEQ ID NO: 7842707 - DNA, 22 bp, Homo sapiens
gcccaggaagttgaggctgccg

SEQ ID NO: 7842708 - DNA, 22 bp, Homo sapiens
gcccaggaagttgaggctgccg

SEQ ID NO: 7842709 - DNA, 16 bp, Homo sapiens
gcccaggacgggaggc

SEQ ID NO: 7842710 - DNA, 16 bp, Homo sapiens
gcccaggacgggaggc

SEQ ID NO: 7842711 - DNA, 16 bp, Homo sapiens
gcccaggacgggaggc

SEQ ID NO: 7842712 - DNA, 20 bp, Homo sapiens
gcccaggaatttgcatttct

SEQ ID NO: 7842713 - DNA, 20 bp, Homo sapiens
gcccaggaatttgcatttct

SEQ ID NO: 7842714 - DNA, 22 bp, Homo sapiens
gcccaggaagttgaggctgccg

SEQ ID NO: 7842715 - DNA, 22 bp, Homo sapiens
gcccaggaagttgaggctgccg

SEQ ID NO: 7842716 - DNA, 20 bp, Homo sapiens
gcccaggaatttgcatttct

SEQ ID NO: 7842717 - DNA, 22 bp, Homo sapiens
gcccaggaagtgactcagatgt

SEQ ID NO: 7842718 - DNA, 22 bp, Homo sapiens
gcccaggaagtgactcagatgt

SEQ ID NO: 7842719 - DNA, 17 bp, Homo sapiens
gcccaggaaggacggcc

SEQ ID NO: 7842720 - DNA, 17 bp, Homo sapiens
gcccaggaaggacggcc

SEQ ID NO: 7842721 - DNA, 22 bp, Homo sapiens
gcccaggaagccaccgggaagt

SEQ ID NO: 7842722 - DNA, 22 bp, Homo sapiens
gcccaggaagccaccgggaagt

SEQ ID NO: 7842723 - DNA, 22 bp, Homo sapiens
gcccaggaagccaccgggaagt

SEQ ID NO: 7842724 - DNA, 22 bp, Homo sapiens
gcccaggaaatgccccgtggtg

SEQ ID NO: 7842725 - DNA, 17 bp, Homo sapiens
gcccaggaaggacggcc

SEQ ID NO: 7842726 - DNA, 17 bp, Homo sapiens
gcccaggaaggacggcc

SEQ ID NO: 7842727 - DNA, 17 bp, Homo sapiens
gcccaggaaggacggcc

SEQ ID NO: 7842728 - DNA, 22 bp, Homo sapiens
gccccacctgctaccttccagc

SEQ ID NO: 7842729 - DNA, 22 bp, Homo sapiens
gccccacctgctaccttccagc

SEQ ID NO: 7842730 - DNA, 22 bp, Homo sapiens
gccccaccttgagagcagaaac

SEQ ID NO: 7842731 - DNA, 22 bp, Homo sapiens
gccccactttcctaggcagtat

SEQ ID NO: 7842732 - DNA, 22 bp, Homo sapiens
gccccacctgctaccttccagc

SEQ ID NO: 7842733 - DNA, 22 bp, Homo sapiens
gccccacctgctaccttccagc

SEQ ID NO: 7842734 - DNA, 22 bp, Homo sapiens
gccccaccgagggtgcagtcct

SEQ ID NO: 7842735 - DNA, 22 bp, Homo sapiens
gccccacagcctgcggtctcag

SEQ ID NO: 7842736 - DNA, 22 bp, Homo sapiens
gccccacagcctgcggtctcag

SEQ ID NO: 7842737 - DNA, 22 bp, Homo sapiens
gccccaccgagggtgcagtcct

SEQ ID NO: 7842738 - DNA, 22 bp, Homo sapiens
gccccaccgagggtgcagtcct

SEQ ID NO: 7842739 - DNA, 22 bp, Homo sapiens
gcccatggtcagggaggcaggg

SEQ ID NO: 7842740 - DNA, 22 bp, Homo sapiens
gcccatggtcagggaggcaggg

SEQ ID NO: 7842741 - DNA, 22 bp, Homo sapiens
gcccatggtcagggaggcaggg

SEQ ID NO: 7842742 - DNA, 22 bp, Homo sapiens
gcccatggtgaggttgttggtg

SEQ ID NO: 7842743 - DNA, 22 bp, Homo sapiens
gcccatggtggcgttcggtgca

SEQ ID NO: 7842744 - DNA, 22 bp, Homo sapiens
gcccatgttcagtcccaggagg

SEQ ID NO: 7842745 - DNA, 22 bp, Homo sapiens
gcccatgtctgacagggtgggg

SEQ ID NO: 7842746 - DNA, 22 bp, Homo sapiens
gcccatgtgatttcctgggagt

SEQ ID NO: 7842747 - DNA, 22 bp, Homo sapiens
gcccatggttacttttctggct

SEQ ID NO: 7842748 - DNA, 22 bp, Homo sapiens
gccccaagggagcccagcacac

SEQ ID NO: 7842749 - DNA, 22 bp, Homo sapiens
gccccaagggagcccagcacac

SEQ ID NO: 7842750 - DNA, 22 bp, Homo sapiens
gcccaggagaggccagggctga

SEQ ID NO: 7842751 - DNA, 22 bp, Homo sapiens
gcccaggagaggccagggctga

SEQ ID NO: 7842752 - DNA, 22 bp, Homo sapiens
gcccaggagaggccagggctga

SEQ ID NO: 7842753 - DNA, 22 bp, Homo sapiens
gcccaggagaggccagggctga

SEQ ID NO: 7842754 - DNA, 22 bp, Homo sapiens
gcccaggactcagggtgtcgcg

SEQ ID NO: 7842755 - DNA, 22 bp, Homo sapiens
gcccaggactcagggtgtcgcg

SEQ ID NO: 7842756 - DNA, 16 bp, Homo sapiens
gcccaggacgggaggc

SEQ ID NO: 7842757 - DNA, 22 bp, Homo sapiens
gcccaggagcctggagatgtgt

SEQ ID NO: 7842758 - DNA, 22 bp, Homo sapiens
gcccaggagcctggagatgtgt

SEQ ID NO: 7842759 - DNA, 22 bp, Homo sapiens
gcccaggagcctggagatgtgt

SEQ ID NO: 7842760 - DNA, 22 bp, Homo sapiens
gcccaggagaggccagggctga

SEQ ID NO: 7842761 - DNA, 22 bp, Homo sapiens
gcccaggagaggccagggctga

SEQ ID NO: 7842762 - DNA, 22 bp, Homo sapiens
gcccaggagcctggagatgtgt

SEQ ID NO: 7842763 - DNA, 22 bp, Homo sapiens
gcccatggcttccctaggcaca

SEQ ID NO: 7842764 - DNA, 22 bp, Homo sapiens
gcccatggcttccctaggcaca

SEQ ID NO: 7842765 - DNA, 22 bp, Homo sapiens
gcccatggcagaactgtgagca

SEQ ID NO: 7842766 - DNA, 22 bp, Homo sapiens
gcccatgggcctgaggccctag

SEQ ID NO: 7842767 - DNA, 22 bp, Homo sapiens
gcccatgggcctgaggccctag

SEQ ID NO: 7842768 - DNA, 22 bp, Homo sapiens
gcccatggcttccctaggcaca

SEQ ID NO: 7842769 - DNA, 22 bp, Homo sapiens
ggctctgctgcacccttggctc

SEQ ID NO: 7842770 - DNA, 22 bp, Homo sapiens
ggctctgctgcacccttggctc

SEQ ID NO: 7842771 - DNA, 22 bp, Homo sapiens
ggctctggaatgtgtagtcagg

SEQ ID NO: 7842772 - DNA, 22 bp, Homo sapiens
ggctctggagacatgtggagag

SEQ ID NO: 7842773 - DNA, 22 bp, Homo sapiens
ggctctggagacatgtggagag

SEQ ID NO: 7842774 - DNA, 22 bp, Homo sapiens
ggctctggagacatgtggagag

SEQ ID NO: 7842775 - DNA, 22 bp, Homo sapiens
ggctctggagacatgtggagag

SEQ ID NO: 7842776 - DNA, 23 bp, Homo sapiens
ggctccaggcctgacgggcgcgg

SEQ ID NO: 7842777 - DNA, 22 bp, Homo sapiens
ggctctgctcctggtgccagtg

SEQ ID NO: 7842778 - DNA, 22 bp, Homo sapiens
ggctctgctcctggtgccagtg

SEQ ID NO: 7842779 - DNA, 22 bp, Homo sapiens
ggctctgctcctggtgccagtg

SEQ ID NO: 7842780 - DNA, 22 bp, Homo sapiens
ggctctgctcctggtgccagtg

SEQ ID NO: 7842781 - DNA, 22 bp, Homo sapiens
ggctctgctgcaagtcttcctc

SEQ ID NO: 7842782 - DNA, 22 bp, Homo sapiens
ggctctgctgcaagtcttcctc

SEQ ID NO: 7842783 - DNA, 22 bp, Homo sapiens
ggctccaggagggccttggcca

SEQ ID NO: 7842784 - DNA, 22 bp, Homo sapiens
ggctccaggagggccttggcca

SEQ ID NO: 7842785 - DNA, 22 bp, Homo sapiens
ggctccaggagggccttggcca

SEQ ID NO: 7842786 - DNA, 22 bp, Homo sapiens
ggctccaggagatgctgggcag

SEQ ID NO: 7842787 - DNA, 22 bp, Homo sapiens
ggctccaggagatgctgggcag

SEQ ID NO: 7842788 - DNA, 22 bp, Homo sapiens
ggctccaggagatgctgggcag

SEQ ID NO: 7842789 - DNA, 22 bp, Homo sapiens
ggctccaggagggccttggcca

SEQ ID NO: 7842790 - DNA, 22 bp, Homo sapiens
ggctccaggagggccttggcca

SEQ ID NO: 7842791 - DNA, 22 bp, Homo sapiens
ggctccaggagggccttggcca

SEQ ID NO: 7842792 - DNA, 22 bp, Homo sapiens
ggctccaggagggccttggcca

SEQ ID NO: 7842793 - DNA, 22 bp, Homo sapiens
ggctccaggagggccttggcca

SEQ ID NO: 7842794 - DNA, 23 bp, Homo sapiens
ggctccaggcctgacgggcgcgg

SEQ ID NO: 7842795 - DNA, 23 bp, Homo sapiens
ggctccaggcctgacgggcgcgg

SEQ ID NO: 7842796 - DNA, 22 bp, Homo sapiens
ggctccagccctggctcttcac

SEQ ID NO: 7842797 - DNA, 22 bp, Homo sapiens
ggctccagccctggctcttcac

SEQ ID NO: 7842798 - DNA, 22 bp, Homo sapiens
ggctccagccctggctcttcac

SEQ ID NO: 7842799 - DNA, 22 bp, Homo sapiens
ggctccagctaatggtttctat

SEQ ID NO: 7842800 - DNA, 22 bp, Homo sapiens
ggctccagctaatggtttctat

SEQ ID NO: 7842801 - DNA, 22 bp, Homo sapiens
ggctccagccctggctcttcac

SEQ ID NO: 7842802 - DNA, 22 bp, Homo sapiens
ggctccagccctggctcttcac

SEQ ID NO: 7842803 - DNA, 22 bp, Homo sapiens
ggctccagccctggctcttcac

SEQ ID NO: 7842804 - DNA, 22 bp, Homo sapiens
ggctccagatgtctcctggcaa

SEQ ID NO: 7842805 - DNA, 22 bp, Homo sapiens
ggctccagatgtctcctggcaa

SEQ ID NO: 7842806 - DNA, 22 bp, Homo sapiens
ggctccagatgtctcctggcaa

SEQ ID NO: 7842807 - DNA, 22 bp, Homo sapiens
ggctccagatgtctcctggcaa

SEQ ID NO: 7842808 - DNA, 22 bp, Homo sapiens
ggctccagatgtctcctggcaa

SEQ ID NO: 7842809 - DNA, 22 bp, Homo sapiens
ggctccagatgtctcctggcaa

SEQ ID NO: 7842810 - DNA, 22 bp, Homo sapiens
ggctccagccctggctcttcac

SEQ ID NO: 7842811 - DNA, 22 bp, Homo sapiens
ggctccagccctggctcttcac

SEQ ID NO: 7842812 - DNA, 22 bp, Homo sapiens
ggctccaggaacctcctctcct

SEQ ID NO: 7842813 - DNA, 22 bp, Homo sapiens
ggctccaggaacctcctctcct

SEQ ID NO: 7842814 - DNA, 22 bp, Homo sapiens
ggctccaggaacctcctctcct

SEQ ID NO: 7842815 - DNA, 22 bp, Homo sapiens
ggctccaggaacctcctctcct

SEQ ID NO: 7842816 - DNA, 22 bp, Homo sapiens
ggctccaggaacctcctctcct

SEQ ID NO: 7842817 - DNA, 18 bp, Homo sapiens
ggctccaggacctaccca

SEQ ID NO: 7842818 - DNA, 18 bp, Homo sapiens
ggctccaggacctaccca

SEQ ID NO: 7842819 - DNA, 18 bp, Homo sapiens
ggctccaggacctaccca

SEQ ID NO: 7842820 - DNA, 18 bp, Homo sapiens
ggctccaggacctaccca

SEQ ID NO: 7842821 - DNA, 18 bp, Homo sapiens
ggctccaggacctaccca

SEQ ID NO: 7842822 - DNA, 18 bp, Homo sapiens
ggctccaggacctaccca

SEQ ID NO: 7842823 - DNA, 22 bp, Homo sapiens
ggctccaggagatgctgggcag

SEQ ID NO: 7842824 - DNA, 22 bp, Homo sapiens
ggctccaggagatgctgggcag

SEQ ID NO: 7842825 - DNA, 22 bp, Homo sapiens
ggctccaggagatgctgggcag

SEQ ID NO: 7842826 - DNA, 22 bp, Homo sapiens
ggcgggaagttcttgcccactt

SEQ ID NO: 7842827 - DNA, 22 bp, Homo sapiens
ggcgggaagttcttgcccactt

SEQ ID NO: 7842828 - DNA, 22 bp, Homo sapiens
ggcgggaagttcttgcccactt

SEQ ID NO: 7842829 - DNA, 22 bp, Homo sapiens
ggcggctactcctcctggtgag

SEQ ID NO: 7842830 - DNA, 22 bp, Homo sapiens
ggcggctactcctcctggtgag

SEQ ID NO: 7842831 - DNA, 22 bp, Homo sapiens
ggcggcgcgtagccggagactt

SEQ ID NO: 7842832 - DNA, 22 bp, Homo sapiens
ggcggcgcctgctgcgtgacct

SEQ ID NO: 7842833 - DNA, 22 bp, Homo sapiens
ggcgggagcagcagctctgagc

SEQ ID NO: 7842834 - DNA, 22 bp, Homo sapiens
ggcgggagcagcagctctgagc

SEQ ID NO: 7842835 - DNA, 22 bp, Homo sapiens
ggcgggaagttcttgcccactt

SEQ ID NO: 7842836 - DNA, 22 bp, Homo sapiens
ggcggaggttgcagtaagccga

SEQ ID NO: 7842837 - DNA, 22 bp, Homo sapiens
ggcggaggttgcagtaagccga

SEQ ID NO: 7842838 - DNA, 22 bp, Homo sapiens
ggcggaggttgcagtaagccga

SEQ ID NO: 7842839 - DNA, 22 bp, Homo sapiens
ggcggaggttgcagtaagccga

SEQ ID NO: 7842840 - DNA, 22 bp, Homo sapiens
ggcggagcttgcagtgagccga

SEQ ID NO: 7842841 - DNA, 22 bp, Homo sapiens
ggcggccgcagctcttgctctg

SEQ ID NO: 7842842 - DNA, 22 bp, Homo sapiens
ggcggccgccttcggccacggc

SEQ ID NO: 7842843 - DNA, 21 bp, Homo sapiens
ggcggcgcagagctgcggctc

SEQ ID NO: 7842844 - DNA, 22 bp, Homo sapiens
ggcgggaggctgaggagttggt

SEQ ID NO: 7842845 - DNA, 22 bp, Homo sapiens
ggcgggaggctgaggagttggt

SEQ ID NO: 7842846 - DNA, 22 bp, Homo sapiens
ggcgggagcagcagctctgagc

SEQ ID NO: 7842847 - DNA, 22 bp, Homo sapiens
ggcgggaggctgaggagttggt

SEQ ID NO: 7842848 - DNA, 22 bp, Homo sapiens
ggcgggaggctgaggagttggt

SEQ ID NO: 7842849 - DNA, 22 bp, Homo sapiens
ggcgggagcagcagctctgagc

SEQ ID NO: 7842850 - DNA, 22 bp, Homo sapiens
ggcgggaggctgaggagttggt

SEQ ID NO: 7842851 - DNA, 22 bp, Homo sapiens
ggcgggcagatgcggacacgcg

SEQ ID NO: 7842852 - DNA, 22 bp, Homo sapiens
ggcgggaggctgaggagttggt

SEQ ID NO: 7842853 - DNA, 22 bp, Homo sapiens
ggcggggcctcgcgaacggcct

SEQ ID NO: 7842854 - DNA, 23 bp, Homo sapiens
ggcggggataacagccccttgtc

SEQ ID NO: 7842855 - DNA, 22 bp, Homo sapiens
ggcgggcagcgtcttgctggcc

SEQ ID NO: 7842856 - DNA, 23 bp, Homo sapiens
ggcggggataacagccccttgtc

SEQ ID NO: 7842857 - DNA, 22 bp, Homo sapiens
ggcgggggtccaggagcctgca

SEQ ID NO: 7842858 - DNA, 22 bp, Homo sapiens
ggcgggggtccaggagcctgca

SEQ ID NO: 7842859 - DNA, 22 bp, Homo sapiens
ggcggggcctcgcgaacggcct

SEQ ID NO: 7842860 - DNA, 22 bp, Homo sapiens
ggctccaccctgcttccagaag

SEQ ID NO: 7842861 - DNA, 22 bp, Homo sapiens
ggctccaccctgcttccagaag

SEQ ID NO: 7842862 - DNA, 22 bp, Homo sapiens
ggctccactgctgaccactcca

SEQ ID NO: 7842863 - DNA, 22 bp, Homo sapiens
ggctccaccctgcttccagaag

SEQ ID NO: 7842864 - DNA, 22 bp, Homo sapiens
ggctccagaaacttcagtccat

SEQ ID NO: 7842865 - DNA, 22 bp, Homo sapiens
ggctccagaaacttcagtccat

SEQ ID NO: 7842866 - DNA, 22 bp, Homo sapiens
ggctccagaaacttcagtccat

SEQ ID NO: 7842867 - DNA, 22 bp, Homo sapiens
ggctccagaaacttcagtccat

SEQ ID NO: 7842868 - DNA, 22 bp, Homo sapiens
ggctccagaaatcatagagcag

SEQ ID NO: 7842869 - DNA, 22 bp, Homo sapiens
ggctccagaaatcatagagcag

SEQ ID NO: 7842870 - DNA, 22 bp, Homo sapiens
ggctccagaaacttcagtccat

SEQ ID NO: 7842871 - DNA, 22 bp, Homo sapiens
ggctccagaaatcatagagcag

SEQ ID NO: 7842872 - DNA, 22 bp, Homo sapiens
ggctccagatgtcccctggcaa

SEQ ID NO: 7842873 - DNA, 22 bp, Homo sapiens
ggctccagatgtcccctggcaa

SEQ ID NO: 7842874 - DNA, 22 bp, Homo sapiens
ggctccagatgtcccctggcaa

SEQ ID NO: 7842875 - DNA, 22 bp, Homo sapiens
ggctccagatgtcccctggcaa

SEQ ID NO: 7842876 - DNA, 22 bp, Homo sapiens
ggctccagatgtctcctggcaa

SEQ ID NO: 7842877 - DNA, 22 bp, Homo sapiens
ggctccagatgtctcctggcaa

SEQ ID NO: 7842878 - DNA, 22 bp, Homo sapiens
ggctccagatgtcccctggcaa

SEQ ID NO: 7842879 - DNA, 22 bp, Homo sapiens
ggctccagatgtcccctggcaa

SEQ ID NO: 7842880 - DNA, 22 bp, Homo sapiens
ggctccagatgtcccctggcaa

SEQ ID NO: 7842881 - DNA, 22 bp, Homo sapiens
ggctccagatgtcccctggcaa

SEQ ID NO: 7842882 - DNA, 22 bp, Homo sapiens
ggctccagaggccttacctgca

SEQ ID NO: 7842883 - DNA, 22 bp, Homo sapiens
ggctccagaggccttacctgca

SEQ ID NO: 7842884 - DNA, 16 bp, Homo sapiens
ggctccagaatagcga

SEQ ID NO: 7842885 - DNA, 23 bp, Homo sapiens
ggctgagaagtcccatgataggt

SEQ ID NO: 7842886 - DNA, 22 bp, Homo sapiens
ggctgagaaggagtgggtgagg

SEQ ID NO: 7842887 - DNA, 22 bp, Homo sapiens
ggctgagaaggagtgggtgagg

SEQ ID NO: 7842888 - DNA, 22 bp, Homo sapiens
ggctgagaatcaacaacctgct

SEQ ID NO: 7842889 - DNA, 22 bp, Homo sapiens
ggctgagacaacctgggaccca

SEQ ID NO: 7842890 - DNA, 22 bp, Homo sapiens
ggctgagaatcaacaacctgct

SEQ ID NO: 7842891 - DNA, 22 bp, Homo sapiens
ggctgagacaacctgggaccca

SEQ ID NO: 7842892 - DNA, 22 bp, Homo sapiens
ggctgagactagagtgaggcat

SEQ ID NO: 7842893 - DNA, 22 bp, Homo sapiens
ggctgagactagagtgaggcat

SEQ ID NO: 7842894 - DNA, 22 bp, Homo sapiens
ggctgagactagagtgaggcat

SEQ ID NO: 7842895 - DNA, 22 bp, Homo sapiens
ggctgagactagagtgaggcat

SEQ ID NO: 7842896 - DNA, 22 bp, Homo sapiens
ggctgagactagagtgaggcat

SEQ ID NO: 7842897 - DNA, 22 bp, Homo sapiens
ggctgagactagagtgaggcat

SEQ ID NO: 7842898 - DNA, 23 bp, Homo sapiens
ggctgagactacaggcgcttgcc

SEQ ID NO: 7842899 - DNA, 23 bp, Homo sapiens
ggctgagactacaggcgcttgcc

SEQ ID NO: 7842900 - DNA, 22 bp, Homo sapiens
ggctgaagtgtagtggctcact

SEQ ID NO: 7842901 - DNA, 22 bp, Homo sapiens
ggctgaaggatgaaagctgcag

SEQ ID NO: 7842902 - DNA, 22 bp, Homo sapiens
ggctgaaggaactttttccatg

SEQ ID NO: 7842903 - DNA, 22 bp, Homo sapiens
ggctgaaggatgaaagctgcag

SEQ ID NO: 7842904 - DNA, 22 bp, Homo sapiens
ggctgaagtgtagtggctcact

SEQ ID NO: 7842905 - DNA, 22 bp, Homo sapiens
ggctgaagtgtagtggctcact

SEQ ID NO: 7842906 - DNA, 22 bp, Homo sapiens
ggctgaagtgtagtggctcact

SEQ ID NO: 7842907 - DNA, 22 bp, Homo sapiens
ggctgaagtgtagtggctcact

SEQ ID NO: 7842908 - DNA, 22 bp, Homo sapiens
ggctgaagtgtagtggctcact

SEQ ID NO: 7842909 - DNA, 22 bp, Homo sapiens
ggctgaagtgtagtggctcact

SEQ ID NO: 7842910 - DNA, 22 bp, Homo sapiens
ggctgaagttctttttgttcag

SEQ ID NO: 7842911 - DNA, 22 bp, Homo sapiens
ggctgaatgttggacacttacg

SEQ ID NO: 7842912 - DNA, 22 bp, Homo sapiens
ggctgacttctccagatctaaa

SEQ ID NO: 7842913 - DNA, 22 bp, Homo sapiens
ggctgacttttatgcacactaa

SEQ ID NO: 7842914 - DNA, 22 bp, Homo sapiens
ggctgacttttatgcacactaa

SEQ ID NO: 7842915 - DNA, 22 bp, Homo sapiens
ggctgacttctccagatctaaa

SEQ ID NO: 7842916 - DNA, 22 bp, Homo sapiens
ggctgagaacaggcccagcctc

SEQ ID NO: 7842917 - DNA, 22 bp, Homo sapiens
ggctgagaagacagtggggtgg

SEQ ID NO: 7842918 - DNA, 22 bp, Homo sapiens
ggctgagaagacagtggggtgg

SEQ ID NO: 7842919 - DNA, 22 bp, Homo sapiens
ggctgagaagacagtggggtgg

SEQ ID NO: 7842920 - DNA, 22 bp, Homo sapiens
ggctgagaaggagtgggtgagg

SEQ ID NO: 7842921 - DNA, 22 bp, Homo sapiens
ggctgagaaggagtgggtgagg

SEQ ID NO: 7842922 - DNA, 22 bp, Homo sapiens
ggctgagaaggagtgggtgagg

SEQ ID NO: 7842923 - DNA, 22 bp, Homo sapiens
ggctgagaaggagtgggtgagg

SEQ ID NO: 7842924 - DNA, 22 bp, Homo sapiens
ggctcttgagaggcacaggttt

SEQ ID NO: 7842925 - DNA, 22 bp, Homo sapiens
ggctcttctgtttcacaggcca

SEQ ID NO: 7842926 - DNA, 22 bp, Homo sapiens
ggctcttctgtttcacaggcca

SEQ ID NO: 7842927 - DNA, 22 bp, Homo sapiens
ggctcttgcccgcccaggctgg

SEQ ID NO: 7842928 - DNA, 22 bp, Homo sapiens
ggctctgggccagagttggctt

SEQ ID NO: 7842929 - DNA, 22 bp, Homo sapiens
ggctctgggccagagttggctt

SEQ ID NO: 7842930 - DNA, 22 bp, Homo sapiens
ggctcttctacttcagatgggg

SEQ ID NO: 7842931 - DNA, 22 bp, Homo sapiens
ggctctgggccagagttggctt

SEQ ID NO: 7842932 - DNA, 22 bp, Homo sapiens
ggctcttctgtggcagccaagg

SEQ ID NO: 7842933 - DNA, 22 bp, Homo sapiens
ggctcttctgtggcagccaagg

SEQ ID NO: 7842934 - DNA, 22 bp, Homo sapiens
ggctcttctggttgtcacattt

SEQ ID NO: 7842935 - DNA, 22 bp, Homo sapiens
ggctcttctggttgtcacattt

SEQ ID NO: 7842936 - DNA, 22 bp, Homo sapiens
ggctcttctggttgtcacattt

SEQ ID NO: 7842937 - DNA, 22 bp, Homo sapiens
ggctctgggccagagttggctt

SEQ ID NO: 7842938 - DNA, 22 bp, Homo sapiens
ggctctttggcgggccttgaac

SEQ ID NO: 7842939 - DNA, 22 bp, Homo sapiens
ggctgaaaggtgggaggatggc

SEQ ID NO: 7842940 - DNA, 20 bp, Homo sapiens
ggctgaaagtagaaagtatt

SEQ ID NO: 7842941 - DNA, 22 bp, Homo sapiens
ggctgaagaactgggagtctca

SEQ ID NO: 7842942 - DNA, 22 bp, Homo sapiens
ggctgaagaactgggagtctca

SEQ ID NO: 7842943 - DNA, 22 bp, Homo sapiens
ggctgaagaactgggagtctca

SEQ ID NO: 7842944 - DNA, 22 bp, Homo sapiens
ggctgaaggatgaaagctgcag

SEQ ID NO: 7842945 - DNA, 22 bp, Homo sapiens
ggctctggctcctggctttgtg

SEQ ID NO: 7842946 - DNA, 22 bp, Homo sapiens
ggctctgggaaatggtcttcct

SEQ ID NO: 7842947 - DNA, 22 bp, Homo sapiens
ggctctgggaaatggtcttcct

SEQ ID NO: 7842948 - DNA, 22 bp, Homo sapiens
ggctctgggaaatggtcttcct

SEQ ID NO: 7842949 - DNA, 22 bp, Homo sapiens
ggctctggctcctggctttgtg

SEQ ID NO: 7842950 - DNA, 22 bp, Homo sapiens
ggctctggctcctggctttgtg

SEQ ID NO: 7842951 - DNA, 22 bp, Homo sapiens
ggctctggctcctggctttgtg

SEQ ID NO: 7842952 - DNA, 22 bp, Homo sapiens
ggctctggctcctggctttgtg

SEQ ID NO: 7842953 - DNA, 22 bp, Homo sapiens
ggctctggctactccaccctgt

SEQ ID NO: 7842954 - DNA, 22 bp, Homo sapiens
ggctctgggcatagaaggaagc

SEQ ID NO: 7842955 - DNA, 22 bp, Homo sapiens
ggctctgggcatagaaggaagc

SEQ ID NO: 7842956 - DNA, 22 bp, Homo sapiens
ggctctgggccagagttggctt

SEQ ID NO: 7842957 - DNA, 22 bp, Homo sapiens
ggctctgggcatagaaggaagc

SEQ ID NO: 7842958 - DNA, 22 bp, Homo sapiens
ggctctgggccagagttggctt

SEQ ID NO: 7842959 - DNA, 22 bp, Homo sapiens
ggctctgggaaatggtcttcct

SEQ ID NO: 7842960 - DNA, 22 bp, Homo sapiens
ggctctgggcatagaaggaagc

SEQ ID NO: 7842961 - DNA, 19 bp, Homo sapiens
ggctctggcggctgtagcc

SEQ ID NO: 7842962 - DNA, 19 bp, Homo sapiens
ggctctggcggctgtagcc

SEQ ID NO: 7842963 - DNA, 19 bp, Homo sapiens
ggctctggcggctgtagcc

SEQ ID NO: 7842964 - DNA, 19 bp, Homo sapiens
ggctctggcggctgtagcc

SEQ ID NO: 7842965 - DNA, 19 bp, Homo sapiens
ggctctggcggctgtagcc

SEQ ID NO: 7842966 - DNA, 19 bp, Homo sapiens
ggctctggcggctgtagcc

SEQ ID NO: 7842967 - DNA, 22 bp, Homo sapiens
ggctctggctactccaccctgt

SEQ ID NO: 7842968 - DNA, 22 bp, Homo sapiens
ggctctggctactccaccctgt

SEQ ID NO: 7842969 - DNA, 22 bp, Homo sapiens
ggctctggctactccaccctgt

SEQ ID NO: 7842970 - DNA, 22 bp, Homo sapiens
ggctctggcgtccaatggagcg

SEQ ID NO: 7842971 - DNA, 22 bp, Homo sapiens
ggctctggcgtccaatggagcg

SEQ ID NO: 7842972 - DNA, 22 bp, Homo sapiens
ggctctggcgtccaatggagcg

SEQ ID NO: 7842973 - DNA, 22 bp, Homo sapiens
ggctctggcgtccaatggagcg

SEQ ID NO: 7842974 - DNA, 22 bp, Homo sapiens
ggctctggcgtccaatggagcg

SEQ ID NO: 7842975 - DNA, 22 bp, Homo sapiens
ggctctggagacatgtggagag

SEQ ID NO: 7842976 - DNA, 22 bp, Homo sapiens
ggctctggagacatgtggagag

SEQ ID NO: 7842977 - DNA, 22 bp, Homo sapiens
ggctctggagacatgtggagag

SEQ ID NO: 7842978 - DNA, 22 bp, Homo sapiens
ggctctggagatgtccgacctg

SEQ ID NO: 7842979 - DNA, 22 bp, Homo sapiens
ggctctggagatgtccgacctg

SEQ ID NO: 7842980 - DNA, 22 bp, Homo sapiens
ggctctggagatgtccgacctg

SEQ ID NO: 7842981 - DNA, 22 bp, Homo sapiens
ggctctggagacatgtggagag

SEQ ID NO: 7842982 - DNA, 22 bp, Homo sapiens
ggctctggagacatgtggagag

SEQ ID NO: 7842983 - DNA, 22 bp, Homo sapiens
ggctctggagatgtccgacctg

SEQ ID NO: 7842984 - DNA, 22 bp, Homo sapiens
ggctctggagatgtccgacctg

SEQ ID NO: 7842985 - DNA, 22 bp, Homo sapiens
ggctctggagcacagacgtctg

SEQ ID NO: 7842986 - DNA, 22 bp, Homo sapiens
ggctctggagcacagacgtctg

SEQ ID NO: 7842987 - DNA, 22 bp, Homo sapiens
ggctctggagcacagacgtctg

SEQ ID NO: 7842988 - DNA, 22 bp, Homo sapiens
ggctctggagcacagacgtctg

SEQ ID NO: 7842989 - DNA, 22 bp, Homo sapiens
ggctctggcggctctttcaata

SEQ ID NO: 7842990 - DNA, 22 bp, Homo sapiens
ggctctggcgagctttagtaca

SEQ ID NO: 7842991 - DNA, 22 bp, Homo sapiens
ggctctggcggctctttcaata

SEQ ID NO: 7842992 - DNA, 22 bp, Homo sapiens
ggctctggcggctctttcaata

SEQ ID NO: 7842993 - DNA, 22 bp, Homo sapiens
ggctctggcgagctttagtaca

SEQ ID NO: 7842994 - DNA, 22 bp, Homo sapiens
ggctctggcgagctttagtaca

SEQ ID NO: 7842995 - DNA, 22 bp, Homo sapiens
ggctctggcgagctttagtaca

SEQ ID NO: 7842996 - DNA, 22 bp, Homo sapiens
ggctctggcaaggggaggctac

SEQ ID NO: 7842997 - DNA, 22 bp, Homo sapiens
ggctctggcaaggggaggctac

SEQ ID NO: 7842998 - DNA, 22 bp, Homo sapiens
ggctctggcaaggggaggctac

SEQ ID NO: 7842999 - DNA, 22 bp, Homo sapiens
ggctctggcaaggggaggctac

SEQ ID NO: 7843000 - DNA, 22 bp, Homo sapiens
ggctctggcaaggggaggctac

SEQ ID NO: 7843001 - DNA, 22 bp, Homo sapiens
ggctctggcaaggggaggctac

SEQ ID NO: 7843002 - DNA, 22 bp, Homo sapiens
ggctctggcaaggggaggctac

SEQ ID NO: 7843003 - DNA, 22 bp, Homo sapiens
ggctctggagcacagacgtctg

SEQ ID NO: 7843004 - DNA, 22 bp, Homo sapiens
ggctctggagcacagacgtctg

SEQ ID NO: 7843005 - DNA, 22 bp, Homo sapiens
ggctctggcaaggggaggctac

SEQ ID NO: 7843006 - DNA, 22 bp, Homo sapiens
ggctctggcaaggggaggctac

SEQ ID NO: 7843007 - DNA, 22 bp, Homo sapiens
ggctgggcaaacaagactcttc

SEQ ID NO: 7843008 - DNA, 22 bp, Homo sapiens
ggctgggcaaacaagactcttc

SEQ ID NO: 7843009 - DNA, 22 bp, Homo sapiens
ggctgggcaaacaagactcttc

SEQ ID NO: 7843010 - DNA, 22 bp, Homo sapiens
ggctgggcaaacaagactcttc

SEQ ID NO: 7843011 - DNA, 22 bp, Homo sapiens
ggctgggcagcagctgttaagc

SEQ ID NO: 7843012 - DNA, 22 bp, Homo sapiens
ggctgggcaaacaagactcttc

SEQ ID NO: 7843013 - DNA, 22 bp, Homo sapiens
ggctgggcagcagctgttaagc

SEQ ID NO: 7843014 - DNA, 22 bp, Homo sapiens
ggctgggcagcagctgttaagc

SEQ ID NO: 7843015 - DNA, 22 bp, Homo sapiens
ggctgggcagcagctgttaagc

SEQ ID NO: 7843016 - DNA, 21 bp, Homo sapiens
ggctgggcaggacccacccct

SEQ ID NO: 7843017 - DNA, 22 bp, Homo sapiens
ggctgggaggccgtgctgacct

SEQ ID NO: 7843018 - DNA, 22 bp, Homo sapiens
ggctggcttggtgagctgtcac

SEQ ID NO: 7843019 - DNA, 22 bp, Homo sapiens
ggctgggaggccgtgctgacct

SEQ ID NO: 7843020 - DNA, 22 bp, Homo sapiens
ggctgggaggccgtgctgacct

SEQ ID NO: 7843021 - DNA, 22 bp, Homo sapiens
ggctgggcaaacaagactcttc

SEQ ID NO: 7843022 - DNA, 22 bp, Homo sapiens
ggctggcttgcggagtcacaga

SEQ ID NO: 7843023 - DNA, 22 bp, Homo sapiens
ggctgctggggacgtgggagag

SEQ ID NO: 7843024 - DNA, 21 bp, Homo sapiens
ggctgctgggagagctgcgtg

SEQ ID NO: 7843025 - DNA, 21 bp, Homo sapiens
ggctgctgggagagctgcgtg

SEQ ID NO: 7843026 - DNA, 21 bp, Homo sapiens
ggctgctgggagagctgcgtg

SEQ ID NO: 7843027 - DNA, 22 bp, Homo sapiens
ggctggcttggtgagctgtcac

SEQ ID NO: 7843028 - DNA, 22 bp, Homo sapiens
ggctggcttggtgagctgtcac

SEQ ID NO: 7843029 - DNA, 22 bp, Homo sapiens
ggctggcttggtgagctgtcac

SEQ ID NO: 7843030 - DNA, 22 bp, Homo sapiens
ggctggcttggtgagctgtcac

SEQ ID NO: 7843031 - DNA, 22 bp, Homo sapiens
ggctggcttggtgagctgtcac

SEQ ID NO: 7843032 - DNA, 22 bp, Homo sapiens
ggctggcttgcggagtcacaga

SEQ ID NO: 7843033 - DNA, 22 bp, Homo sapiens
ggctggcttggtgagctgtcac

SEQ ID NO: 7843034 - DNA, 22 bp, Homo sapiens
ggctggcttgcggagtcacaga

SEQ ID NO: 7843035 - DNA, 22 bp, Homo sapiens
ggctggcttgcggagtcacaga

SEQ ID NO: 7843036 - DNA, 22 bp, Homo sapiens
ggctgctggcagatgtagttta

SEQ ID NO: 7843037 - DNA, 22 bp, Homo sapiens
ggctgctggcagatgtagttta

SEQ ID NO: 7843038 - DNA, 22 bp, Homo sapiens
ggctgctggcagatgtagttta

SEQ ID NO: 7843039 - DNA, 22 bp, Homo sapiens
ggctgctggattgtgtatctgt

SEQ ID NO: 7843040 - DNA, 22 bp, Homo sapiens
ggctgctggattgtgtatctgt

SEQ ID NO: 7843041 - DNA, 22 bp, Homo sapiens
ggctgctggagttgggtctctc

SEQ ID NO: 7843042 - DNA, 22 bp, Homo sapiens
ggctgctggagttgggtctctc

SEQ ID NO: 7843043 - DNA, 22 bp, Homo sapiens
ggctgctggagttgggtctctc

SEQ ID NO: 7843044 - DNA, 22 bp, Homo sapiens
ggctgctggagttgggtctctc

SEQ ID NO: 7843045 - DNA, 22 bp, Homo sapiens
ggctgctggagttgggtctctc

SEQ ID NO: 7843046 - DNA, 22 bp, Homo sapiens
ggctgctggagttgggtctctc

SEQ ID NO: 7843047 - DNA, 22 bp, Homo sapiens
ggctgctggcattgaggtaggt

SEQ ID NO: 7843048 - DNA, 22 bp, Homo sapiens
ggctgctggcattgaggtaggt

SEQ ID NO: 7843049 - DNA, 22 bp, Homo sapiens
ggctgctggcattgaggtaggt

SEQ ID NO: 7843050 - DNA, 22 bp, Homo sapiens
ggctgctggcattgaggtaggt

SEQ ID NO: 7843051 - DNA, 22 bp, Homo sapiens
ggctgctggcattgaggtaggt

SEQ ID NO: 7843052 - DNA, 22 bp, Homo sapiens
ggctgctggcattgaggtaggt

SEQ ID NO: 7843053 - DNA, 22 bp, Homo sapiens
ggctgctggcattgaggtaggt

SEQ ID NO: 7843054 - DNA, 22 bp, Homo sapiens
ggctgctggccagcctaggagt

SEQ ID NO: 7843055 - DNA, 22 bp, Homo sapiens
ggctgctgggaatatgccagct

SEQ ID NO: 7843056 - DNA, 22 bp, Homo sapiens
ggctgctggcctctccccggcc

SEQ ID NO: 7843057 - DNA, 22 bp, Homo sapiens
ggctgctggcctctccccggcc

SEQ ID NO: 7843058 - DNA, 22 bp, Homo sapiens
ggctgctggcctctccccggcc

SEQ ID NO: 7843059 - DNA, 22 bp, Homo sapiens
ggctgctggccagcctaggagt

SEQ ID NO: 7843060 - DNA, 22 bp, Homo sapiens
ggctgctggccagcctaggagt

SEQ ID NO: 7843061 - DNA, 22 bp, Homo sapiens
ggctgctggccagcctaggagt

SEQ ID NO: 7843062 - DNA, 22 bp, Homo sapiens
ggctgctggccagcctaggagt

SEQ ID NO: 7843063 - DNA, 22 bp, Homo sapiens
ggctgctggccagcctaggagt

SEQ ID NO: 7843064 - DNA, 22 bp, Homo sapiens
ggctgctgggaatatgccagct

SEQ ID NO: 7843065 - DNA, 22 bp, Homo sapiens
ggctgctgggaatatgccagct

SEQ ID NO: 7843066 - DNA, 22 bp, Homo sapiens
ggctgctgggaatatgccagct

SEQ ID NO: 7843067 - DNA, 22 bp, Homo sapiens
ggctgctgggaatatgccagct

SEQ ID NO: 7843068 - DNA, 22 bp, Homo sapiens
ggctgctgggaatatgccagct

SEQ ID NO: 7843069 - DNA, 22 bp, Homo sapiens
ggctgctgggaatatgccagct

SEQ ID NO: 7843070 - DNA, 22 bp, Homo sapiens
ggctgctgggaatatgccagct

SEQ ID NO: 7843071 - DNA, 22 bp, Homo sapiens
ggctgctgggaatatgccagct

SEQ ID NO: 7843072 - DNA, 22 bp, Homo sapiens
ggctgctgagttggccaggaga

SEQ ID NO: 7843073 - DNA, 22 bp, Homo sapiens
ggctgctgagttggccaggaga

SEQ ID NO: 7843074 - DNA, 22 bp, Homo sapiens
ggctgctgcccacccctgcatg

SEQ ID NO: 7843075 - DNA, 22 bp, Homo sapiens
ggctgctgcccacccctgcatg

SEQ ID NO: 7843076 - DNA, 22 bp, Homo sapiens
ggctgctgcccacccctgcatg

SEQ ID NO: 7843077 - DNA, 22 bp, Homo sapiens
ggctgctgcccacccctgcatg

SEQ ID NO: 7843078 - DNA, 22 bp, Homo sapiens
ggctgctgagtcacgacagtga

SEQ ID NO: 7843079 - DNA, 22 bp, Homo sapiens
ggctgctgacttcatccagctt

SEQ ID NO: 7843080 - DNA, 22 bp, Homo sapiens
ggctgctgagtcacgacagtga

SEQ ID NO: 7843081 - DNA, 22 bp, Homo sapiens
ggctgctgagtcacgacagtga

SEQ ID NO: 7843082 - DNA, 22 bp, Homo sapiens
ggctgctgagtcacgacagtga

SEQ ID NO: 7843083 - DNA, 22 bp, Homo sapiens
ggctgctgagttggccaggaga

SEQ ID NO: 7843084 - DNA, 22 bp, Homo sapiens
ggctgctgagttggccaggaga

SEQ ID NO: 7843085 - DNA, 22 bp, Homo sapiens
ggctgctgagttggccaggaga

SEQ ID NO: 7843086 - DNA, 22 bp, Homo sapiens
ggctgctgagttggccaggaga

SEQ ID NO: 7843087 - DNA, 22 bp, Homo sapiens
ggctgctgagttggccaggaga

SEQ ID NO: 7843088 - DNA, 22 bp, Homo sapiens
ggctgctggaagactgaacaag

SEQ ID NO: 7843089 - DNA, 22 bp, Homo sapiens
ggctgctggaagactgaacaag

SEQ ID NO: 7843090 - DNA, 22 bp, Homo sapiens
ggctgctggaagactgaacaag

SEQ ID NO: 7843091 - DNA, 22 bp, Homo sapiens
ggctgctgctgtgtaggcctgt

SEQ ID NO: 7843092 - DNA, 22 bp, Homo sapiens
ggctgctgctgtgtaggcctgt

SEQ ID NO: 7843093 - DNA, 22 bp, Homo sapiens
ggctgctgctgtgtaggcctgt

SEQ ID NO: 7843094 - DNA, 22 bp, Homo sapiens
ggctgctgcccacccctgcatg

SEQ ID NO: 7843095 - DNA, 22 bp, Homo sapiens
ggctgctgcccacccctgcatg

SEQ ID NO: 7843096 - DNA, 22 bp, Homo sapiens
ggctgctgcccacccctgcatg

SEQ ID NO: 7843097 - DNA, 22 bp, Homo sapiens
ggctgctgccctcctaagtgca

SEQ ID NO: 7843098 - DNA, 22 bp, Homo sapiens
ggctgctgccctcctaagtgca

SEQ ID NO: 7843099 - DNA, 22 bp, Homo sapiens
ggctgctgccctcctaagtgca

SEQ ID NO: 7843100 - DNA, 22 bp, Homo sapiens
ggctgagcactttaggcaggag

SEQ ID NO: 7843101 - DNA, 22 bp, Homo sapiens
ggctgagcactttaggcaggag

SEQ ID NO: 7843102 - DNA, 22 bp, Homo sapiens
ggctgagcactttaggcaggag

SEQ ID NO: 7843103 - DNA, 22 bp, Homo sapiens
ggctgagcaattttgatgacat

SEQ ID NO: 7843104 - DNA, 22 bp, Homo sapiens
ggctgagcactttaggcaggag

SEQ ID NO: 7843105 - DNA, 22 bp, Homo sapiens
ggctgagcaattttgatgacat

SEQ ID NO: 7843106 - DNA, 21 bp, Homo sapiens
ggctgagatggcagaatcacc

SEQ ID NO: 7843107 - DNA, 22 bp, Homo sapiens
ggctgagagtttcctctggggc

SEQ ID NO: 7843108 - DNA, 22 bp, Homo sapiens
ggctgagcaattttgatgacat

SEQ ID NO: 7843109 - DNA, 22 bp, Homo sapiens
ggctgagcaattttgatgacat

SEQ ID NO: 7843110 - DNA, 22 bp, Homo sapiens
ggctgagaggacgtcgggctca

SEQ ID NO: 7843111 - DNA, 22 bp, Homo sapiens
ggctgagaggacgtcgggctca

SEQ ID NO: 7843112 - DNA, 22 bp, Homo sapiens
ggctgagagtggatcccaggga

SEQ ID NO: 7843113 - DNA, 22 bp, Homo sapiens
ggctgagagtggatcccaggga

SEQ ID NO: 7843114 - DNA, 22 bp, Homo sapiens
ggctgagaggacgtcgggctca

SEQ ID NO: 7843115 - DNA, 22 bp, Homo sapiens
ggctgagagtttcctctggggc

SEQ ID NO: 7843116 - DNA, 21 bp, Homo sapiens
ggctgagatggcagaatcacc

SEQ ID NO: 7843117 - DNA, 22 bp, Homo sapiens
ggctgagagtttcctctggggc

SEQ ID NO: 7843118 - DNA, 19 bp, Homo sapiens
ggctgctgaagagaattac

SEQ ID NO: 7843119 - DNA, 22 bp, Homo sapiens
ggctgctgaagtgtggcaatct

SEQ ID NO: 7843120 - DNA, 22 bp, Homo sapiens
ggctgctgaagtgtggcaatct

SEQ ID NO: 7843121 - DNA, 22 bp, Homo sapiens
ggctgctgaagtgtggcaatct

SEQ ID NO: 7843122 - DNA, 19 bp, Homo sapiens
ggctgctgaagagaattac

SEQ ID NO: 7843123 - DNA, 22 bp, Homo sapiens
ggctgagcactttaggcaggag

SEQ ID NO: 7843124 - DNA, 22 bp, Homo sapiens
ggctgctgacttcatccagctt

SEQ ID NO: 7843125 - DNA, 22 bp, Homo sapiens
ggctgctgacttcatccagctt

SEQ ID NO: 7843126 - DNA, 22 bp, Homo sapiens
ggctgctgacttcatccagctt

SEQ ID NO: 7843127 - DNA, 22 bp, Homo sapiens
ggctgctgacttcatccagctt

SEQ ID NO: 7843128 - DNA, 22 bp, Homo sapiens
ggctgctgacttcatccagctt

SEQ ID NO: 7843129 - DNA, 22 bp, Homo sapiens
ggctgctgacttcatccagctt

SEQ ID NO: 7843130 - DNA, 22 bp, Homo sapiens
ggctgctgacaaacatgatcat

SEQ ID NO: 7843131 - DNA, 22 bp, Homo sapiens
ggctgctgacaaacatgatcat

SEQ ID NO: 7843132 - DNA, 22 bp, Homo sapiens
ggctgctgacaaacatgatcat

SEQ ID NO: 7843133 - DNA, 22 bp, Homo sapiens
ggctgctgacaaacatgatcat

SEQ ID NO: 7843134 - DNA, 22 bp, Homo sapiens
ggctgctgacaaacatgatcat

SEQ ID NO: 7843135 - DNA, 22 bp, Homo sapiens
ggctgctgacaaacatgatcat

SEQ ID NO: 7843136 - DNA, 22 bp, Homo sapiens
ggctgctgacaaacatgatcat

SEQ ID NO: 7843137 - DNA, 22 bp, Homo sapiens
ggctgctgacaaacatgatcat

SEQ ID NO: 7843138 - DNA, 22 bp, Homo sapiens
ggctgctgacaaacatgatcat

SEQ ID NO: 7843139 - DNA, 22 bp, Homo sapiens
ggctgggctccgggagcatgcg

SEQ ID NO: 7843140 - DNA, 22 bp, Homo sapiens
ggctgggctccgggagcatgcg

SEQ ID NO: 7843141 - DNA, 22 bp, Homo sapiens
ggctgggctccgggagcatgcg

SEQ ID NO: 7843142 - DNA, 22 bp, Homo sapiens
ggctgggctccgggagcatgcg

SEQ ID NO: 7843143 - DNA, 22 bp, Homo sapiens
ggctgggctccgggagcatgcg

SEQ ID NO: 7843144 - DNA, 22 bp, Homo sapiens
ggctgggctccgggagcatgcg

SEQ ID NO: 7843145 - DNA, 22 bp, Homo sapiens
ggctgggctccgggagcatgcg

SEQ ID NO: 7843146 - DNA, 22 bp, Homo sapiens
ggctgggctcgctgattggctg

SEQ ID NO: 7843147 - DNA, 22 bp, Homo sapiens
ggctgggctcgctgattggctg

SEQ ID NO: 7843148 - DNA, 22 bp, Homo sapiens
ggctgggctcgctgattggctg

SEQ ID NO: 7843149 - DNA, 22 bp, Homo sapiens
ggctgggctcgctgattggctg

SEQ ID NO: 7843150 - DNA, 22 bp, Homo sapiens
ggctgggctcgctgattggctg

SEQ ID NO: 7843151 - DNA, 22 bp, Homo sapiens
ggctgggctcgctgattggctg

SEQ ID NO: 7843152 - DNA, 22 bp, Homo sapiens
ggctgggctccgggagcatgcg

SEQ ID NO: 7843153 - DNA, 22 bp, Homo sapiens
ggctgggctccgggagcatgcg

SEQ ID NO: 7843154 - DNA, 22 bp, Homo sapiens
ggctgggcctctccctcagctg

SEQ ID NO: 7843155 - DNA, 22 bp, Homo sapiens
ggctgggcctctccctcagctg

SEQ ID NO: 7843156 - DNA, 22 bp, Homo sapiens
ggctgggcctctccctcagctg

SEQ ID NO: 7843157 - DNA, 22 bp, Homo sapiens
ggctgggcctctccctcagctg

SEQ ID NO: 7843158 - DNA, 22 bp, Homo sapiens
ggctgggcctctccctcagctg

SEQ ID NO: 7843159 - DNA, 22 bp, Homo sapiens
ggctgggctccgggagcatgcg

SEQ ID NO: 7843160 - DNA, 22 bp, Homo sapiens
ggctgggctccgggagcatgcg

SEQ ID NO: 7843161 - DNA, 22 bp, Homo sapiens
ggctgggctccgggagcatgcg

SEQ ID NO: 7843162 - DNA, 22 bp, Homo sapiens
ggctgggccgcggctacccaga

SEQ ID NO: 7843163 - DNA, 22 bp, Homo sapiens
ggctgggccgcggctacccaga

SEQ ID NO: 7843164 - DNA, 19 bp, Homo sapiens
ggctgggccctgtttctcc

SEQ ID NO: 7843165 - DNA, 22 bp, Homo sapiens
ggctgggccgcggctacccaga

SEQ ID NO: 7843166 - DNA, 22 bp, Homo sapiens
ggctgggccgcggctacccaga

SEQ ID NO: 7843167 - DNA, 22 bp, Homo sapiens
ggctgggccgcggctacccaga

SEQ ID NO: 7843168 - DNA, 22 bp, Homo sapiens
ggctgggcctctccctcagctg

SEQ ID NO: 7843169 - DNA, 22 bp, Homo sapiens
ggctgggcaggtctgcacaggg

SEQ ID NO: 7843170 - DNA, 22 bp, Homo sapiens
ggctgggcaggtctgcacaggg

SEQ ID NO: 7843171 - DNA, 22 bp, Homo sapiens
ggctgggcaggtctgcacaggg

SEQ ID NO: 7843172 - DNA, 22 bp, Homo sapiens
ggctgggcaggtctgcacaggg

SEQ ID NO: 7843173 - DNA, 22 bp, Homo sapiens
ggctgggcaggtctgcacaggg

SEQ ID NO: 7843174 - DNA, 22 bp, Homo sapiens
ggctgggcaggtctgcacaggg

SEQ ID NO: 7843175 - DNA, 22 bp, Homo sapiens
ggctgggcaggtctgcacaggg

SEQ ID NO: 7843176 - DNA, 22 bp, Homo sapiens
ggctgggcatccatccatgaga

SEQ ID NO: 7843177 - DNA, 21 bp, Homo sapiens
ggctgggcaggacccacccct

SEQ ID NO: 7843178 - DNA, 21 bp, Homo sapiens
ggctgggcaggacccacccct

SEQ ID NO: 7843179 - DNA, 21 bp, Homo sapiens
ggctgggcaggacccacccct

SEQ ID NO: 7843180 - DNA, 21 bp, Homo sapiens
ggctgggcaggacccacccct

SEQ ID NO: 7843181 - DNA, 22 bp, Homo sapiens
ggctgggcaggtctgcacaggg

SEQ ID NO: 7843182 - DNA, 22 bp, Homo sapiens
ggctgggcaggtctgcacaggg

SEQ ID NO: 7843183 - DNA, 22 bp, Homo sapiens
ggctgggcaggtctgcacaggg

SEQ ID NO: 7843184 - DNA, 22 bp, Homo sapiens
ggctgggcaggtctgcacaggg

SEQ ID NO: 7843185 - DNA, 22 bp, Homo sapiens
ggctgggccagggcctgtggac

SEQ ID NO: 7843186 - DNA, 22 bp, Homo sapiens
ggctgggccagggcctgtggac

SEQ ID NO: 7843187 - DNA, 22 bp, Homo sapiens
ggctgggccagggcctgtggac

SEQ ID NO: 7843188 - DNA, 19 bp, Homo sapiens
ggctgggccctgtttctcc

SEQ ID NO: 7843189 - DNA, 19 bp, Homo sapiens
ggctgggccctgtttctcc

SEQ ID NO: 7843190 - DNA, 19 bp, Homo sapiens
ggctgggccctgtttctcc

SEQ ID NO: 7843191 - DNA, 19 bp, Homo sapiens
ggctgggccctgtttctcc

SEQ ID NO: 7843192 - DNA, 22 bp, Homo sapiens
ggctgggccagggcctgtggac

SEQ ID NO: 7843193 - DNA, 22 bp, Homo sapiens
ggctgggcatccatccatgaga

SEQ ID NO: 7843194 - DNA, 22 bp, Homo sapiens
ggctgggcatccatccatgaga

SEQ ID NO: 7843195 - DNA, 22 bp, Homo sapiens
ggctgggcatccatccatgaga

SEQ ID NO: 7843196 - DNA, 22 bp, Homo sapiens
ggctgggcatccatccatgaga

SEQ ID NO: 7843197 - DNA, 22 bp, Homo sapiens
ggctgggcatccatccatgaga

SEQ ID NO: 7843198 - DNA, 22 bp, Homo sapiens
ggctgggccagggcctgtggac

SEQ ID NO: 7843199 - DNA, 22 bp, Homo sapiens
ggctgggccagggcctgtggac

SEQ ID NO: 7843200 - DNA, 22 bp, Homo sapiens
ggcttctcccctttgagtcttc

SEQ ID NO: 7843201 - DNA, 22 bp, Homo sapiens
ggcttctcccctttgagtcttc

SEQ ID NO: 7843202 - DNA, 22 bp, Homo sapiens
ggcttctctcttcacatggctt

SEQ ID NO: 7843203 - DNA, 22 bp, Homo sapiens
ggctgggctgctgggtcagagc

SEQ ID NO: 7843204 - DNA, 22 bp, Homo sapiens
ggctgggctgctgggtcagagc

SEQ ID NO: 7843205 - DNA, 22 bp, Homo sapiens
ggctgggctgctgggtcagagc

SEQ ID NO: 7843206 - DNA, 22 bp, Homo sapiens
ggctgggctgcggctgtacctg

SEQ ID NO: 7843207 - DNA, 22 bp, Homo sapiens
ggctgggctgcggctgtacctg

SEQ ID NO: 7843208 - DNA, 22 bp, Homo sapiens
ggctgggctgcggctgtacctg

SEQ ID NO: 7843209 - DNA, 22 bp, Homo sapiens
ggctgggctcgctgattggctg

SEQ ID NO: 7843210 - DNA, 22 bp, Homo sapiens
ggctgggctgcggctgtacctg

SEQ ID NO: 7843211 - DNA, 22 bp, Homo sapiens
ggctgggctgcggctgtacctg

SEQ ID NO: 7843212 - DNA, 22 bp, Homo sapiens
ggctgggctgctgggtcagagc

SEQ ID NO: 7843213 - DNA, 22 bp, Homo sapiens
ggctgggctgctgggtcagagc

SEQ ID NO: 7843214 - DNA, 22 bp, Homo sapiens
ggctgggctgctgggtcagagc

SEQ ID NO: 7843215 - DNA, 22 bp, Homo sapiens
ggcttctccaggtactgagcat

SEQ ID NO: 7843216 - DNA, 22 bp, Homo sapiens
ggcttctggtgggagcatgact

SEQ ID NO: 7843217 - DNA, 18 bp, Homo sapiens
ggcttctgggacatttta

SEQ ID NO: 7843218 - DNA, 18 bp, Homo sapiens
ggcttctgggacatttta

SEQ ID NO: 7843219 - DNA, 22 bp, Homo sapiens
ggcttctgtcctctggatctgt

SEQ ID NO: 7843220 - DNA, 22 bp, Homo sapiens
ggcttctgtcctctggatctgt

SEQ ID NO: 7843221 - DNA, 22 bp, Homo sapiens
ggcttcttaatcatgagagtga

SEQ ID NO: 7843222 - DNA, 22 bp, Homo sapiens
ggcttctgctcagcctgcacgc

SEQ ID NO: 7843223 - DNA, 22 bp, Homo sapiens
ggcttctgccttgccagttctt

SEQ ID NO: 7843224 - DNA, 22 bp, Homo sapiens
ggcttctgccttgccagttctt

SEQ ID NO: 7843225 - DNA, 22 bp, Homo sapiens
ggcttctgccacgagagggaag

SEQ ID NO: 7843226 - DNA, 22 bp, Homo sapiens
ggcttctgccttgccagttctt

SEQ ID NO: 7843227 - DNA, 22 bp, Homo sapiens
ggcttctgctcagcctgcacgc

SEQ ID NO: 7843228 - DNA, 22 bp, Homo sapiens
ggcttctgagtgctctgctgtt

SEQ ID NO: 7843229 - DNA, 22 bp, Homo sapiens
ggcttctgagtgctctgctgtt

SEQ ID NO: 7843230 - DNA, 22 bp, Homo sapiens
ggcttctgccacgagagggaag

SEQ ID NO: 7843231 - DNA, 22 bp, Homo sapiens
ggcttctgaaccaggccctgga

SEQ ID NO: 7843232 - DNA, 22 bp, Homo sapiens
ggcttctgaaccaggccctgga

SEQ ID NO: 7843233 - DNA, 22 bp, Homo sapiens
ggcttctgagtgctctgctgtt

SEQ ID NO: 7843234 - DNA, 22 bp, Homo sapiens
ggcttctgaaccaggccctgga

SEQ ID NO: 7843235 - DNA, 22 bp, Homo sapiens
ggcttctgaaatctctgtgcgt

SEQ ID NO: 7843236 - DNA, 22 bp, Homo sapiens
ggcttctgaaatctctgtgcgt

SEQ ID NO: 7843237 - DNA, 22 bp, Homo sapiens
ggcttctgaaatctctgtgcgt

SEQ ID NO: 7843238 - DNA, 22 bp, Homo sapiens
ggcttctgaaactgtattgaga

SEQ ID NO: 7843239 - DNA, 22 bp, Homo sapiens
ggcttctctcttcacatggctt

SEQ ID NO: 7843240 - DNA, 20 bp, Homo sapiens
ggcttcttcaggtgtctatt

SEQ ID NO: 7843241 - DNA, 22 bp, Homo sapiens
ggcttggctacaagccatgggc

SEQ ID NO: 7843242 - DNA, 22 bp, Homo sapiens
ggcttggctacaagccatgggc

SEQ ID NO: 7843243 - DNA, 22 bp, Homo sapiens
ggcttcttagaatttgacttac

SEQ ID NO: 7843244 - DNA, 22 bp, Homo sapiens
ggcttcttaatcatgagagtga

SEQ ID NO: 7843245 - DNA, 22 bp, Homo sapiens
ggcttcttaatcatgagagtga

SEQ ID NO: 7843246 - DNA, 20 bp, Homo sapiens
ggcttggctgcctggggagg

SEQ ID NO: 7843247 - DNA, 22 bp, Homo sapiens
ggcttggctacaagccatgggc

SEQ ID NO: 7843248 - DNA, 22 bp, Homo sapiens
ggcttggctgtagctttagcgc

SEQ ID NO: 7843249 - DNA, 22 bp, Homo sapiens
ggcttggcttgggctcagaggc

SEQ ID NO: 7843250 - DNA, 22 bp, Homo sapiens
ggcttgggagcaggcatgtgac

SEQ ID NO: 7843251 - DNA, 22 bp, Homo sapiens
ggcttgggagcaggcatgtgac

SEQ ID NO: 7843252 - DNA, 20 bp, Homo sapiens
ggcttgtctgagtccctggc

SEQ ID NO: 7843253 - DNA, 22 bp, Homo sapiens
ggcttgttgaaacacagattgt

SEQ ID NO: 7843254 - DNA, 20 bp, Homo sapiens
ggcttgtctgagtccctggc

SEQ ID NO: 7843255 - DNA, 22 bp, Homo sapiens
ggctttaaggagtaaaaatgcc

SEQ ID NO: 7843256 - DNA, 19 bp, Homo sapiens
ggctttaactcttgtagct

SEQ ID NO: 7843257 - DNA, 22 bp, Homo sapiens
ggctttaacagcagctttgctg

SEQ ID NO: 7843258 - DNA, 22 bp, Homo sapiens
ggctttaacaacagaaatttat

SEQ ID NO: 7843259 - DNA, 21 bp, Homo sapiens
ggctttaaagcagaggagtga

SEQ ID NO: 7843260 - DNA, 22 bp, Homo sapiens
ggctttaaacactgaaattgca

SEQ ID NO: 7843261 - DNA, 22 bp, Homo sapiens
ggcttgggagcaggcatgtgac

SEQ ID NO: 7843262 - DNA, 22 bp, Homo sapiens
ggcttgtcatgttgatgttctt

SEQ ID NO: 7843263 - DNA, 21 bp, Homo sapiens
ggcttgtcaccatagctactg

SEQ ID NO: 7843264 - DNA, 22 bp, Homo sapiens
ggcttgggagcaggcatgtgac

SEQ ID NO: 7843265 - DNA, 22 bp, Homo sapiens
ggcttgtccttgggctgtgcat

SEQ ID NO: 7843266 - DNA, 22 bp, Homo sapiens
ggcttgtccttctggttgtctt

SEQ ID NO: 7843267 - DNA, 22 bp, Homo sapiens
ggcttgtccttctggttgtctt

SEQ ID NO: 7843268 - DNA, 22 bp, Homo sapiens
ggcttgtcatgttgatgttctt

SEQ ID NO: 7843269 - DNA, 22 bp, Homo sapiens
ggcttgtcatgttgatgttctt

SEQ ID NO: 7843270 - DNA, 22 bp, Homo sapiens
ggcttgtccttgggctgtgcat

SEQ ID NO: 7843271 - DNA, 19 bp, Homo sapiens
ggcttgtctcggcagccgc

SEQ ID NO: 7843272 - DNA, 22 bp, Homo sapiens
gggacaggcaaaggtatgcttc

SEQ ID NO: 7843273 - DNA, 22 bp, Homo sapiens
gggacagccatgtgcagatgcc

SEQ ID NO: 7843274 - DNA, 22 bp, Homo sapiens
gggacaggcaaaggtatgcttc

SEQ ID NO: 7843275 - DNA, 22 bp, Homo sapiens
gggacagctggtctacctggta

SEQ ID NO: 7843276 - DNA, 22 bp, Homo sapiens
gggacagctggtctacctggta

SEQ ID NO: 7843277 - DNA, 22 bp, Homo sapiens
gggacagctgtagtgcttggct

SEQ ID NO: 7843278 - DNA, 22 bp, Homo sapiens
gggacagctgtagtgcttggct

SEQ ID NO: 7843279 - DNA, 22 bp, Homo sapiens
gggacagctgtagtgcttggct

SEQ ID NO: 7843280 - DNA, 22 bp, Homo sapiens
gggacagccatgtgcagatgcc

SEQ ID NO: 7843281 - DNA, 22 bp, Homo sapiens
gggacagccatgtgcagatgcc

SEQ ID NO: 7843282 - DNA, 22 bp, Homo sapiens
gggacagccatgtgcagatgcc

SEQ ID NO: 7843283 - DNA, 22 bp, Homo sapiens
gggacagccatgtgcagatgcc

SEQ ID NO: 7843284 - DNA, 22 bp, Homo sapiens
gggacagccatgtgcagatgcc

SEQ ID NO: 7843285 - DNA, 22 bp, Homo sapiens
gggacagctggtctacctggta

SEQ ID NO: 7843286 - DNA, 22 bp, Homo sapiens
gggacagcagaaagaaggcaag

SEQ ID NO: 7843287 - DNA, 22 bp, Homo sapiens
gggacagcagaaagaaggcaag

SEQ ID NO: 7843288 - DNA, 22 bp, Homo sapiens
gggaatgtaattaatctccttc

SEQ ID NO: 7843289 - DNA, 22 bp, Homo sapiens
gggaatgtaattaatctccttc

SEQ ID NO: 7843290 - DNA, 22 bp, Homo sapiens
gggaatgtacagaggacacagg

SEQ ID NO: 7843291 - DNA, 22 bp, Homo sapiens
gggaatgtacagaggacacagg

SEQ ID NO: 7843292 - DNA, 22 bp, Homo sapiens
gggaatgtagcaaatctgcaat

SEQ ID NO: 7843293 - DNA, 22 bp, Homo sapiens
gggaatgtgaaacagtaaggga

SEQ ID NO: 7843294 - DNA, 22 bp, Homo sapiens
gggaatgtgagtagggtgagtt

SEQ ID NO: 7843295 - DNA, 22 bp, Homo sapiens
gggaatgtgattgttgttttaa

SEQ ID NO: 7843296 - DNA, 22 bp, Homo sapiens
gggaatgtgcagccacagtgag

SEQ ID NO: 7843297 - DNA, 22 bp, Homo sapiens
gggaatgtgcaggatcgtgggc

SEQ ID NO: 7843298 - DNA, 20 bp, Homo sapiens
gggaatgtgccccttacccc

SEQ ID NO: 7843299 - DNA, 22 bp, Homo sapiens
gggacagcagaaagaaggcaag

SEQ ID NO: 7843300 - DNA, 22 bp, Homo sapiens
gggaatgtgcctggagtgttca

SEQ ID NO: 7843301 - DNA, 22 bp, Homo sapiens
ggctttaatagataaggtttct

SEQ ID NO: 7843302 - DNA, 22 bp, Homo sapiens
ggctttaaggtttaggaagcaa

SEQ ID NO: 7843303 - DNA, 22 bp, Homo sapiens
ggctttaaggtttaggaagcaa

SEQ ID NO: 7843304 - DNA, 16 bp, Homo sapiens
ggctttaatttatccc

SEQ ID NO: 7843305 - DNA, 22 bp, Homo sapiens
ggctttagggcaggcagtgtta

SEQ ID NO: 7843306 - DNA, 22 bp, Homo sapiens
ggctttagggcaggcagtgtta

SEQ ID NO: 7843307 - DNA, 17 bp, Homo sapiens
ggctttagggacaccac

SEQ ID NO: 7843308 - DNA, 22 bp, Homo sapiens
ggctttatagggtagaggatca

SEQ ID NO: 7843309 - DNA, 22 bp, Homo sapiens
ggctttagtgtaggtttctgtt

SEQ ID NO: 7843310 - DNA, 22 bp, Homo sapiens
gggaatgtaatcatggaatgct

SEQ ID NO: 7843311 - DNA, 22 bp, Homo sapiens
gggacatggctaggattccaat

SEQ ID NO: 7843312 - DNA, 22 bp, Homo sapiens
gggacatgcccctcagtgggtg

SEQ ID NO: 7843313 - DNA, 22 bp, Homo sapiens
gggacatggaggcgcgcaggca

SEQ ID NO: 7843314 - DNA, 22 bp, Homo sapiens
gggaccagaagaaggatggtga

SEQ ID NO: 7843315 - DNA, 22 bp, Homo sapiens
gggaccactccgacatgtaggg

SEQ ID NO: 7843316 - DNA, 22 bp, Homo sapiens
gggaccagaagaaggatggtga

SEQ ID NO: 7843317 - DNA, 22 bp, Homo sapiens
gggaccagaagaaggatggtga

SEQ ID NO: 7843318 - DNA, 22 bp, Homo sapiens
gggaccagaagaaggatggtga

SEQ ID NO: 7843319 - DNA, 22 bp, Homo sapiens
gggaccagaggctgtgcacaat

SEQ ID NO: 7843320 - DNA, 22 bp, Homo sapiens
gggaccagaggctgtgcacaat

SEQ ID NO: 7843321 - DNA, 22 bp, Homo sapiens
gggaccagaggctgtgcacaat

SEQ ID NO: 7843322 - DNA, 23 bp, Homo sapiens
gggaccagctagggctgtgacct

SEQ ID NO: 7843323 - DNA, 23 bp, Homo sapiens
gggaccagctagggctgtgacct

SEQ ID NO: 7843324 - DNA, 23 bp, Homo sapiens
gggaccagctagggctgtgacct

SEQ ID NO: 7843325 - DNA, 23 bp, Homo sapiens
gggaccagctagggctgtgacct

SEQ ID NO: 7843326 - DNA, 23 bp, Homo sapiens
gggagaatatgaggatgatggtg

SEQ ID NO: 7843327 - DNA, 22 bp, Homo sapiens
gggagacaaaggtgaggttctt

SEQ ID NO: 7843328 - DNA, 22 bp, Homo sapiens
gggagacaaaggtgaggttctt

SEQ ID NO: 7843329 - DNA, 22 bp, Homo sapiens
gggagaagtggaaatctcatta

SEQ ID NO: 7843330 - DNA, 22 bp, Homo sapiens
gggagaagtggaaatctcatta

SEQ ID NO: 7843331 - DNA, 22 bp, Homo sapiens
gggacatgcccctcagtgggtg

SEQ ID NO: 7843332 - DNA, 22 bp, Homo sapiens
gggacatgaggccatagtgatt

SEQ ID NO: 7843333 - DNA, 22 bp, Homo sapiens
gggacatctttctagtcagggt

SEQ ID NO: 7843334 - DNA, 22 bp, Homo sapiens
gggacagtggctgtgtcagttt

SEQ ID NO: 7843335 - DNA, 22 bp, Homo sapiens
gggacatctttctagtcagggt

SEQ ID NO: 7843336 - DNA, 22 bp, Homo sapiens
gggacaggctgagacttgagct

SEQ ID NO: 7843337 - DNA, 22 bp, Homo sapiens
gggacagtggctgtgtcagttt

SEQ ID NO: 7843338 - DNA, 22 bp, Homo sapiens
gggacagtggctgtgtcagttt

SEQ ID NO: 7843339 - DNA, 22 bp, Homo sapiens
gggacaggctgagacttgagct

SEQ ID NO: 7843340 - DNA, 22 bp, Homo sapiens
gggacaggctgagacttgagct

SEQ ID NO: 7843341 - DNA, 22 bp, Homo sapiens
gggacaggctgagacttgagct

SEQ ID NO: 7843342 - DNA, 22 bp, Homo sapiens
gggacaggctgagacttgagct

SEQ ID NO: 7843343 - DNA, 22 bp, Homo sapiens
gggacaggctgagacttgagct

SEQ ID NO: 7843344 - DNA, 22 bp, Homo sapiens
gggacaggcaaaggtatgcttc

SEQ ID NO: 7843345 - DNA, 22 bp, Homo sapiens
gggacaggcccctcgctagctt

SEQ ID NO: 7843346 - DNA, 22 bp, Homo sapiens
gggacaggcccctcgctagctt

SEQ ID NO: 7843347 - DNA, 22 bp, Homo sapiens
gggacaggcccctcgctagctt

SEQ ID NO: 7843348 - DNA, 22 bp, Homo sapiens
gggacaggcccctcgctagctt

SEQ ID NO: 7843349 - DNA, 22 bp, Homo sapiens
gggacaggctgagacttgagct

SEQ ID NO: 7843350 - DNA, 22 bp, Homo sapiens
gggacaggcccctcgctagctt

SEQ ID NO: 7843351 - DNA, 22 bp, Homo sapiens
gggagagaattattgccagacc

SEQ ID NO: 7843352 - DNA, 22 bp, Homo sapiens
gggagagagaaaacgtggcgca

SEQ ID NO: 7843353 - DNA, 22 bp, Homo sapiens
gggagagagaaaacgtggcgca

SEQ ID NO: 7843354 - DNA, 22 bp, Homo sapiens
gggagagagaaaacgtggcgca

SEQ ID NO: 7843355 - DNA, 22 bp, Homo sapiens
gggagagagagctcatgttgaa

SEQ ID NO: 7843356 - DNA, 22 bp, Homo sapiens
gggagagagagctcatgttgaa

SEQ ID NO: 7843357 - DNA, 22 bp, Homo sapiens
gggagagatgctgattgccaat

SEQ ID NO: 7843358 - DNA, 19 bp, Homo sapiens
gggagagccaggctcaccc

SEQ ID NO: 7843359 - DNA, 19 bp, Homo sapiens
gggagagccaggctcaccc

SEQ ID NO: 7843360 - DNA, 19 bp, Homo sapiens
gggagagccaggctcaccc

SEQ ID NO: 7843361 - DNA, 22 bp, Homo sapiens
gggagagcgcgctagggccgag

SEQ ID NO: 7843362 - DNA, 22 bp, Homo sapiens
gggagagcgcgctagggccgag

SEQ ID NO: 7843363 - DNA, 22 bp, Homo sapiens
gggagagcgcgctagggccgag

SEQ ID NO: 7843364 - DNA, 22 bp, Homo sapiens
gggagagcgcgctagggccgag

SEQ ID NO: 7843365 - DNA, 22 bp, Homo sapiens
gggagagcgcgctagggccgag

SEQ ID NO: 7843366 - DNA, 22 bp, Homo sapiens
gggagaggttacccgagcaact

SEQ ID NO: 7843367 - DNA, 22 bp, Homo sapiens
gggagaggttacccgagcaact

SEQ ID NO: 7843368 - DNA, 22 bp, Homo sapiens
gggagaggttacccgagcaact

SEQ ID NO: 7843369 - DNA, 22 bp, Homo sapiens
gggagaggttacccgagcaact

SEQ ID NO: 7843370 - DNA, 22 bp, Homo sapiens
gggagagcgggaggtgccacag

SEQ ID NO: 7843371 - DNA, 22 bp, Homo sapiens
gggagagcgggaggtgccacag

SEQ ID NO: 7843372 - DNA, 22 bp, Homo sapiens
gggagagcgggaggtgccacag

SEQ ID NO: 7843373 - DNA, 22 bp, Homo sapiens
gggagagcgggaggtgccacag

SEQ ID NO: 7843374 - DNA, 22 bp, Homo sapiens
gggagagaattattgccagacc

SEQ ID NO: 7843375 - DNA, 22 bp, Homo sapiens
gggagagaattattgccagacc

SEQ ID NO: 7843376 - DNA, 22 bp, Homo sapiens
gggagagaattattgccagacc

SEQ ID NO: 7843377 - DNA, 22 bp, Homo sapiens
gggagagaattattgccagacc

SEQ ID NO: 7843378 - DNA, 22 bp, Homo sapiens
gggagagaattattgccagacc

SEQ ID NO: 7843379 - DNA, 22 bp, Homo sapiens
gggagagaattattgccagacc

SEQ ID NO: 7843380 - DNA, 22 bp, Homo sapiens
gggagagaagggcatgtacact

SEQ ID NO: 7843381 - DNA, 22 bp, Homo sapiens
gggagagaaattatagcaatga

SEQ ID NO: 7843382 - DNA, 22 bp, Homo sapiens
gggagacccccaatgccaggtc

SEQ ID NO: 7843383 - DNA, 22 bp, Homo sapiens
gggagacccccaatgccaggtc

SEQ ID NO: 7843384 - DNA, 20 bp, Homo sapiens
gggagacagggccagtgtcc

SEQ ID NO: 7843385 - DNA, 20 bp, Homo sapiens
gggagacagggccagtgtcc

SEQ ID NO: 7843386 - DNA, 20 bp, Homo sapiens
gggagacagggccagtgtcc

SEQ ID NO: 7843387 - DNA, 19 bp, Homo sapiens
gggagacagctctgggctg

SEQ ID NO: 7843388 - DNA, 19 bp, Homo sapiens
gggagacagctctgggctg

SEQ ID NO: 7843389 - DNA, 19 bp, Homo sapiens
gggagacagctctgggctg

SEQ ID NO: 7843390 - DNA, 22 bp, Homo sapiens
gggagacacgctgcaggcataa

SEQ ID NO: 7843391 - DNA, 22 bp, Homo sapiens
gggagacacgctgcaggcataa

SEQ ID NO: 7843392 - DNA, 22 bp, Homo sapiens
gggagacacgctgcaggcataa

SEQ ID NO: 7843393 - DNA, 22 bp, Homo sapiens
gggagacacgctgcaggcataa

SEQ ID NO: 7843394 - DNA, 22 bp, Homo sapiens
gggagacaagaagtagcctgct

SEQ ID NO: 7843395 - DNA, 22 bp, Homo sapiens
gggagacaaaggtgaggttctt

SEQ ID NO: 7843396 - DNA, 22 bp, Homo sapiens
gggagacaagaagtagcctgct

SEQ ID NO: 7843397 - DNA, 22 bp, Homo sapiens
gggagacaagaagtagcctgct

SEQ ID NO: 7843398 - DNA, 22 bp, Homo sapiens
gggagacaagaagtagcctgct

SEQ ID NO: 7843399 - DNA, 22 bp, Homo sapiens
gggagacaaggagaaccaaaga

SEQ ID NO: 7843400 - DNA, 22 bp, Homo sapiens
gggagacacgctgcaggcataa

SEQ ID NO: 7843401 - DNA, 22 bp, Homo sapiens
gggagacacgctgcaggcataa

SEQ ID NO: 7843402 - DNA, 22 bp, Homo sapiens
gggagacacgctgcaggcataa

SEQ ID NO: 7843403 - DNA, 22 bp, Homo sapiens
gggagacacgctgcaggcataa

SEQ ID NO: 7843404 - DNA, 22 bp, Homo sapiens
gggagctgtaagggacaggtag

SEQ ID NO: 7843405 - DNA, 22 bp, Homo sapiens
gggagctgtaagggacaggtag

SEQ ID NO: 7843406 - DNA, 22 bp, Homo sapiens
gggagctgtaagggacaggtag

SEQ ID NO: 7843407 - DNA, 22 bp, Homo sapiens
gggagctgtaagggacaggtag

SEQ ID NO: 7843408 - DNA, 22 bp, Homo sapiens
gggagctggttcctgccctcca

SEQ ID NO: 7843409 - DNA, 22 bp, Homo sapiens
gggagctggttcctgccctcca

SEQ ID NO: 7843410 - DNA, 22 bp, Homo sapiens
gggagctggttcctgccctcca

SEQ ID NO: 7843411 - DNA, 22 bp, Homo sapiens
gggagctggggcatttataccc

SEQ ID NO: 7843412 - DNA, 22 bp, Homo sapiens
gggagctgtcatcagtgttgtc

SEQ ID NO: 7843413 - DNA, 22 bp, Homo sapiens
gggagctgtcatcagtgttgtc

SEQ ID NO: 7843414 - DNA, 22 bp, Homo sapiens
gggagctgtagtccagataccg

SEQ ID NO: 7843415 - DNA, 19 bp, Homo sapiens
gggagctgtctgcccgtgg

SEQ ID NO: 7843416 - DNA, 19 bp, Homo sapiens
gggagctgtctgcccgtgg

SEQ ID NO: 7843417 - DNA, 22 bp, Homo sapiens
gggagctgtaagggacaggtag

SEQ ID NO: 7843418 - DNA, 22 bp, Homo sapiens
gggagctgtaagggacaggtag

SEQ ID NO: 7843419 - DNA, 22 bp, Homo sapiens
gggagctgtaagggacaggtag

SEQ ID NO: 7843420 - DNA, 22 bp, Homo sapiens
gggagctgtagtccagataccg

SEQ ID NO: 7843421 - DNA, 22 bp, Homo sapiens
gggagctgtagtccagataccg

SEQ ID NO: 7843422 - DNA, 22 bp, Homo sapiens
gggagaggttacccgagcaact

SEQ ID NO: 7843423 - DNA, 22 bp, Homo sapiens
gggagaggttacccgagcaact

SEQ ID NO: 7843424 - DNA, 22 bp, Homo sapiens
gggagagtagctggaaggttct

SEQ ID NO: 7843425 - DNA, 22 bp, Homo sapiens
gggagaggttacccgagcaact

SEQ ID NO: 7843426 - DNA, 22 bp, Homo sapiens
gggagaggttacccgagcaact

SEQ ID NO: 7843427 - DNA, 22 bp, Homo sapiens
gggagaggttacccgagcaact

SEQ ID NO: 7843428 - DNA, 22 bp, Homo sapiens
gggagaggttacccgagcaact

SEQ ID NO: 7843429 - DNA, 22 bp, Homo sapiens
gggagaggttacccgagcaact

SEQ ID NO: 7843430 - DNA, 22 bp, Homo sapiens
gggagaggttacccgagcaact

SEQ ID NO: 7843431 - DNA, 22 bp, Homo sapiens
gggagaggttacccgagcaact

SEQ ID NO: 7843432 - DNA, 22 bp, Homo sapiens
gggagaggttacccgagcaact

SEQ ID NO: 7843433 - DNA, 18 bp, Homo sapiens
gggagctgggaagctggt

SEQ ID NO: 7843434 - DNA, 18 bp, Homo sapiens
gggagctgggaagctggt

SEQ ID NO: 7843435 - DNA, 18 bp, Homo sapiens
gggagctgggaagctggt

SEQ ID NO: 7843436 - DNA, 18 bp, Homo sapiens
gggagctgggaagctggt

SEQ ID NO: 7843437 - DNA, 18 bp, Homo sapiens
gggagctgggaagctggt

SEQ ID NO: 7843438 - DNA, 22 bp, Homo sapiens
gggagagtagctggaaggttct

SEQ ID NO: 7843439 - DNA, 17 bp, Homo sapiens
gggagatgaagggatat

SEQ ID NO: 7843440 - DNA, 17 bp, Homo sapiens
gggagatgaagggatat

SEQ ID NO: 7843441 - DNA, 17 bp, Homo sapiens
gggagatgaagggatat

SEQ ID NO: 7843442 - DNA, 22 bp, Homo sapiens
gggcaaaatacttataaaggct

SEQ ID NO: 7843443 - DNA, 22 bp, Homo sapiens
gggcaaaggcagaaagcggtgt

SEQ ID NO: 7843444 - DNA, 19 bp, Homo sapiens
gggcaaagtgatcgtcctg

SEQ ID NO: 7843445 - DNA, 22 bp, Homo sapiens
gggcaaaacctgggcatcatga

SEQ ID NO: 7843446 - DNA, 22 bp, Homo sapiens
gggatttgtgggatggccagtg

SEQ ID NO: 7843447 - DNA, 22 bp, Homo sapiens
gggatttgaatcttgagttgag

SEQ ID NO: 7843448 - DNA, 22 bp, Homo sapiens
gggatttggaatctcctaatgc

SEQ ID NO: 7843449 - DNA, 22 bp, Homo sapiens
gggatttagtaggatagtatac

SEQ ID NO: 7843450 - DNA, 22 bp, Homo sapiens
gggattcatcaactgttttaca

SEQ ID NO: 7843451 - DNA, 22 bp, Homo sapiens
gggatgtcgtgggtggcagctg

SEQ ID NO: 7843452 - DNA, 22 bp, Homo sapiens
gggatggggtcgggaccctgct

SEQ ID NO: 7843453 - DNA, 22 bp, Homo sapiens
gggatggggtcgggaccctgct

SEQ ID NO: 7843454 - DNA, 22 bp, Homo sapiens
gggatggtggcttgcatctgta

SEQ ID NO: 7843455 - DNA, 22 bp, Homo sapiens
gggatggtggcttgcatctgta

SEQ ID NO: 7843456 - DNA, 22 bp, Homo sapiens
gggatggggtcaacatgtacct

SEQ ID NO: 7843457 - DNA, 22 bp, Homo sapiens
gggatggggtcaacatgtacct

SEQ ID NO: 7843458 - DNA, 22 bp, Homo sapiens
gggatggggtcaacatgtacct

SEQ ID NO: 7843459 - DNA, 22 bp, Homo sapiens
gggatggggtcgggaccctgct

SEQ ID NO: 7843460 - DNA, 22 bp, Homo sapiens
gggatggggtcgggaccctgct

SEQ ID NO: 7843461 - DNA, 22 bp, Homo sapiens
gggcacagcctaactatggaga

SEQ ID NO: 7843462 - DNA, 22 bp, Homo sapiens
gggcacagcctaactatggaga

SEQ ID NO: 7843463 - DNA, 19 bp, Homo sapiens
gggcacagcctccccccag

SEQ ID NO: 7843464 - DNA, 19 bp, Homo sapiens
gggcacagcctccccccag

SEQ ID NO: 7843465 - DNA, 22 bp, Homo sapiens
gggcacagctgctacccagtgc

SEQ ID NO: 7843466 - DNA, 19 bp, Homo sapiens
gggcacagcctccccccag

SEQ ID NO: 7843467 - DNA, 22 bp, Homo sapiens
gggcacagctgctacccagtgc

SEQ ID NO: 7843468 - DNA, 22 bp, Homo sapiens
gggcacagcctaactatggaga

SEQ ID NO: 7843469 - DNA, 22 bp, Homo sapiens
gggcacagcctaactatggaga

SEQ ID NO: 7843470 - DNA, 22 bp, Homo sapiens
gggcacagcctaactatggaga

SEQ ID NO: 7843471 - DNA, 22 bp, Homo sapiens
gggcacagcccagtggggtccc

SEQ ID NO: 7843472 - DNA, 22 bp, Homo sapiens
gggcacagcccagtggggtccc

SEQ ID NO: 7843473 - DNA, 22 bp, Homo sapiens
gggcacagcctaactatggaga

SEQ ID NO: 7843474 - DNA, 22 bp, Homo sapiens
gggcacagcctaactatggaga

SEQ ID NO: 7843475 - DNA, 22 bp, Homo sapiens
gggcaagaagctggaagcattc

SEQ ID NO: 7843476 - DNA, 22 bp, Homo sapiens
gggcaaagtggtggaggcagtt

SEQ ID NO: 7843477 - DNA, 22 bp, Homo sapiens
gggcaaagtggtggaggcagtt

SEQ ID NO: 7843478 - DNA, 22 bp, Homo sapiens
gggcaagcagtgaggacagcac

SEQ ID NO: 7843479 - DNA, 22 bp, Homo sapiens
gggcacagcccagtggggtccc

SEQ ID NO: 7843480 - DNA, 22 bp, Homo sapiens
gggcacagcccagtggggtccc

SEQ ID NO: 7843481 - DNA, 22 bp, Homo sapiens
gggcaagcacagcgagcgtgcg

SEQ ID NO: 7843482 - DNA, 22 bp, Homo sapiens
gggaggaaagagaagtggtcca

SEQ ID NO: 7843483 - DNA, 22 bp, Homo sapiens
gggaggaaatgtgcagcgaatt

SEQ ID NO: 7843484 - DNA, 22 bp, Homo sapiens
gggaggaaagagaagtggtcca

SEQ ID NO: 7843485 - DNA, 22 bp, Homo sapiens
gggaggaaagagaagtggtcca

SEQ ID NO: 7843486 - DNA, 22 bp, Homo sapiens
gggagctgtgggattggttgag

SEQ ID NO: 7843487 - DNA, 19 bp, Homo sapiens
gggagctgtctgcccgtgg

SEQ ID NO: 7843488 - DNA, 23 bp, Homo sapiens
gggagctgtggtgaaaagaggtg

SEQ ID NO: 7843489 - DNA, 23 bp, Homo sapiens
gggagctgtggtgaaaagaggtg

SEQ ID NO: 7843490 - DNA, 22 bp, Homo sapiens
gggaggaaggcttgggtgagta

SEQ ID NO: 7843491 - DNA, 22 bp, Homo sapiens
gggaggaaggcttgggtgagta

SEQ ID NO: 7843492 - DNA, 22 bp, Homo sapiens
gggaggaaggcttgggtgagta

SEQ ID NO: 7843493 - DNA, 22 bp, Homo sapiens
gggaggaatgcaacttatttag

SEQ ID NO: 7843494 - DNA, 22 bp, Homo sapiens
gggaggacggtccagggcaaag

SEQ ID NO: 7843495 - DNA, 22 bp, Homo sapiens
gggaggaaatgtgcagcgaatt

SEQ ID NO: 7843496 - DNA, 22 bp, Homo sapiens
gggaggaaatgtgcagcgaatt

SEQ ID NO: 7843497 - DNA, 22 bp, Homo sapiens
gggaggaaatgtgcagcgaatt

SEQ ID NO: 7843498 - DNA, 22 bp, Homo sapiens
gggaggaaggcttgggtgagta

SEQ ID NO: 7843499 - DNA, 22 bp, Homo sapiens
gggaggaaggcttgggtgagta

SEQ ID NO: 7843500 - DNA, 22 bp, Homo sapiens
gggaggagctgagtgtgtgtgc

SEQ ID NO: 7843501 - DNA, 22 bp, Homo sapiens
gggaggagctgagtgtgtgtgc

SEQ ID NO: 7843502 - DNA, 22 bp, Homo sapiens
gggaggagctgagtgtgtgtgc

SEQ ID NO: 7843503 - DNA, 22 bp, Homo sapiens
gggaggagctgagtgtgtgtgc

SEQ ID NO: 7843504 - DNA, 22 bp, Homo sapiens
gggaggagctgagtgtgtgtgc

SEQ ID NO: 7843505 - DNA, 22 bp, Homo sapiens
gggaggagctgagtgtgtgtgc

SEQ ID NO: 7843506 - DNA, 22 bp, Homo sapiens
gggaggacggtccagggcaaag

SEQ ID NO: 7843507 - DNA, 22 bp, Homo sapiens
gggaggacggtccagggcaaag

SEQ ID NO: 7843508 - DNA, 22 bp, Homo sapiens
gggaggacggtccagggcaaag

SEQ ID NO: 7843509 - DNA, 22 bp, Homo sapiens
gggaggagcttggagattcact

SEQ ID NO: 7843510 - DNA, 22 bp, Homo sapiens
gggaggagcttggagattcact

SEQ ID NO: 7843511 - DNA, 22 bp, Homo sapiens
gggaggagcttggagattcact

SEQ ID NO: 7843512 - DNA, 22 bp, Homo sapiens
gggaggagcttggagattcact

SEQ ID NO: 7843513 - DNA, 22 bp, Homo sapiens
gggaggagcttggagattcact

SEQ ID NO: 7843514 - DNA, 22 bp, Homo sapiens
gggaggagctgagtgtgtgtgc

SEQ ID NO: 7843515 - DNA, 22 bp, Homo sapiens
gggaggagctgagtgtgtgtgc

SEQ ID NO: 7843516 - DNA, 22 bp, Homo sapiens
gggatggggagctggaaagggg

SEQ ID NO: 7843517 - DNA, 22 bp, Homo sapiens
gggatggggagctggaaagggg

SEQ ID NO: 7843518 - DNA, 22 bp, Homo sapiens
gggatggggagctggaaagggg

SEQ ID NO: 7843519 - DNA, 22 bp, Homo sapiens
gggatggggagctggaaagggg

SEQ ID NO: 7843520 - DNA, 22 bp, Homo sapiens
gggatggggagctggaaagggg

SEQ ID NO: 7843521 - DNA, 22 bp, Homo sapiens
gggatggggggaagcgtccatg

SEQ ID NO: 7843522 - DNA, 22 bp, Homo sapiens
gggatggggggaagcgtccatg

SEQ ID NO: 7843523 - DNA, 22 bp, Homo sapiens
gggatggggggaagcgtccatg

SEQ ID NO: 7843524 - DNA, 22 bp, Homo sapiens
gggcaggagaaggtggatgtcc

SEQ ID NO: 7843525 - DNA, 22 bp, Homo sapiens
gggcaggagaaggtggatgtcc

SEQ ID NO: 7843526 - DNA, 16 bp, Homo sapiens
gggcaggaatcagggt

SEQ ID NO: 7843527 - DNA, 16 bp, Homo sapiens
gggcaggaatcagggt

SEQ ID NO: 7843528 - DNA, 16 bp, Homo sapiens
gggcaggaatcagggt

SEQ ID NO: 7843529 - DNA, 16 bp, Homo sapiens
gggcaggaatcagggt

SEQ ID NO: 7843530 - DNA, 22 bp, Homo sapiens
gggcaggagaaggtggatgtcc

SEQ ID NO: 7843531 - DNA, 22 bp, Homo sapiens
gggcaggagaaggtggatgtcc

SEQ ID NO: 7843532 - DNA, 22 bp, Homo sapiens
gggcaggagaaggtggatgtcc

SEQ ID NO: 7843533 - DNA, 22 bp, Homo sapiens
gggcaggagaaggtggatgtcc

SEQ ID NO: 7843534 - DNA, 22 bp, Homo sapiens
gggcaggagaaggtggatgtcc

SEQ ID NO: 7843535 - DNA, 22 bp, Homo sapiens
gggcaggagagaacagtcatgg

SEQ ID NO: 7843536 - DNA, 22 bp, Homo sapiens
gggcaggagagaacagtcatgg

SEQ ID NO: 7843537 - DNA, 22 bp, Homo sapiens
gggcaggaggctaattctgcat

SEQ ID NO: 7843538 - DNA, 22 bp, Homo sapiens
gggcaggaggctaattctgcat

SEQ ID NO: 7843539 - DNA, 22 bp, Homo sapiens
gggcaggagagggccacctgga

SEQ ID NO: 7843540 - DNA, 22 bp, Homo sapiens
gggcaggagagggccacctgga

SEQ ID NO: 7843541 - DNA, 22 bp, Homo sapiens
gggcaggagagggccacctgga

SEQ ID NO: 7843542 - DNA, 22 bp, Homo sapiens
gggcaggagagaacagtcatgg

SEQ ID NO: 7843543 - DNA, 22 bp, Homo sapiens
gggcaggagagaacagtcatgg

SEQ ID NO: 7843544 - DNA, 22 bp, Homo sapiens
gggcaggagagaacagtcatgg

SEQ ID NO: 7843545 - DNA, 22 bp, Homo sapiens
gggcaggagagaacagtcatgg

SEQ ID NO: 7843546 - DNA, 22 bp, Homo sapiens
gggcaggagagaacagtcatgg

SEQ ID NO: 7843547 - DNA, 22 bp, Homo sapiens
gggcaggagagaacagtcatgg

SEQ ID NO: 7843548 - DNA, 22 bp, Homo sapiens
gggcaggagagggccacctgga

SEQ ID NO: 7843549 - DNA, 22 bp, Homo sapiens
gggcaggctgagcatgtcacct

SEQ ID NO: 7843550 - DNA, 22 bp, Homo sapiens
gggcaggctgagcatgtcacct

SEQ ID NO: 7843551 - DNA, 22 bp, Homo sapiens
gggcaggctgagcatgtcacct

SEQ ID NO: 7843552 - DNA, 22 bp, Homo sapiens
gggcaggatgcagtttcagaga

SEQ ID NO: 7843553 - DNA, 22 bp, Homo sapiens
gggcaggatgcagtttcagaga

SEQ ID NO: 7843554 - DNA, 22 bp, Homo sapiens
gggcaggaggctaattctgcat

SEQ ID NO: 7843555 - DNA, 22 bp, Homo sapiens
gggcatgcctgcgcagtgcatg

SEQ ID NO: 7843556 - DNA, 22 bp, Homo sapiens
gggcatgcctgcgcagtgcatg

SEQ ID NO: 7843557 - DNA, 22 bp, Homo sapiens
gggcaggctgagcatgtcacct

SEQ ID NO: 7843558 - DNA, 17 bp, Homo sapiens
gggcagggactcctggg

SEQ ID NO: 7843559 - DNA, 22 bp, Homo sapiens
gggcaggctgagcatgtcacct

SEQ ID NO: 7843560 - DNA, 23 bp, Homo sapiens
gggcatggagtgtaggtggaagg

SEQ ID NO: 7843561 - DNA, 23 bp, Homo sapiens
gggcatggagtgtaggtggaagg

SEQ ID NO: 7843562 - DNA, 23 bp, Homo sapiens
gggcatggagtgtaggtggaagg

SEQ ID NO: 7843563 - DNA, 22 bp, Homo sapiens
gggcatggaggtctgtctgcag

SEQ ID NO: 7843564 - DNA, 23 bp, Homo sapiens
gggcatggagtgtaggtggaagg

SEQ ID NO: 7843565 - DNA, 23 bp, Homo sapiens
gggcatggagtgtaggtggaagg

SEQ ID NO: 7843566 - DNA, 22 bp, Homo sapiens
gggcatgcttccttgcttgctt

SEQ ID NO: 7843567 - DNA, 18 bp, Homo sapiens
gggcatggatgcagcatc

SEQ ID NO: 7843568 - DNA, 18 bp, Homo sapiens
gggcatggatgcagcatc

SEQ ID NO: 7843569 - DNA, 18 bp, Homo sapiens
gggcatggatgcagcatc

SEQ ID NO: 7843570 - DNA, 19 bp, Homo sapiens
gggcatggatgagcttacc

SEQ ID NO: 7843571 - DNA, 23 bp, Homo sapiens
gggcatggagtgtaggtggaagg

SEQ ID NO: 7843572 - DNA, 19 bp, Homo sapiens
gggcatggatgagcttacc

SEQ ID NO: 7843573 - DNA, 22 bp, Homo sapiens
gggcagctctgcccatcagagg

SEQ ID NO: 7843574 - DNA, 22 bp, Homo sapiens
gggcagctctgcccatcagagg

SEQ ID NO: 7843575 - DNA, 22 bp, Homo sapiens
gggcagctctgcccatcagagg

SEQ ID NO: 7843576 - DNA, 22 bp, Homo sapiens
gggcagctctgcccatcagagg

SEQ ID NO: 7843577 - DNA, 22 bp, Homo sapiens
gggcagctctggctgtgggaag

SEQ ID NO: 7843578 - DNA, 22 bp, Homo sapiens
gggcagctctggctgtgggaag

SEQ ID NO: 7843579 - DNA, 22 bp, Homo sapiens
gggcagctctggctgtgggaag

SEQ ID NO: 7843580 - DNA, 22 bp, Homo sapiens
gggcagctctggctgtgggaag

SEQ ID NO: 7843581 - DNA, 22 bp, Homo sapiens
gggcagctctttggtatccttc

SEQ ID NO: 7843582 - DNA, 22 bp, Homo sapiens
gggcagctctttggtatccttc

SEQ ID NO: 7843583 - DNA, 22 bp, Homo sapiens
gggcagctctggctgtgggaag

SEQ ID NO: 7843584 - DNA, 21 bp, Homo sapiens
gggcagctctgttttattttc

SEQ ID NO: 7843585 - DNA, 21 bp, Homo sapiens
gggcagctctgttttattttc

SEQ ID NO: 7843586 - DNA, 22 bp, Homo sapiens
gggcagctgcagggatggtgac

SEQ ID NO: 7843587 - DNA, 22 bp, Homo sapiens
gggcagctgcagggatggtgac

SEQ ID NO: 7843588 - DNA, 22 bp, Homo sapiens
gggcagctgcagggatggtgac

SEQ ID NO: 7843589 - DNA, 22 bp, Homo sapiens
gggcagctgcagggatggtgac

SEQ ID NO: 7843590 - DNA, 22 bp, Homo sapiens
gggcagctgcagggatggtgac

SEQ ID NO: 7843591 - DNA, 22 bp, Homo sapiens
gggcacaggagaaggatctggc

SEQ ID NO: 7843592 - DNA, 22 bp, Homo sapiens
gggcacaggagaaggatctggc

SEQ ID NO: 7843593 - DNA, 22 bp, Homo sapiens
gggcacaggagaaggatctggc

SEQ ID NO: 7843594 - DNA, 22 bp, Homo sapiens
gggcacaggagaaggatctggc

SEQ ID NO: 7843595 - DNA, 22 bp, Homo sapiens
gggcacaggagaaggatctggc

SEQ ID NO: 7843596 - DNA, 22 bp, Homo sapiens
gggcacaggaatttgggatgtg

SEQ ID NO: 7843597 - DNA, 22 bp, Homo sapiens
gggcacaggaatttgggatgtg

SEQ ID NO: 7843598 - DNA, 22 bp, Homo sapiens
gggcacaggaatttgggatgtg

SEQ ID NO: 7843599 - DNA, 22 bp, Homo sapiens
gggcacaggaatttgggatgtg

SEQ ID NO: 7843600 - DNA, 22 bp, Homo sapiens
gggcacaggaatttgggatgtg

SEQ ID NO: 7843601 - DNA, 22 bp, Homo sapiens
gggcacagctgctacccagtgc

SEQ ID NO: 7843602 - DNA, 22 bp, Homo sapiens
gggcacaggaatttgggatgtg

SEQ ID NO: 7843603 - DNA, 22 bp, Homo sapiens
gggcagctgccagaggccatgg

SEQ ID NO: 7843604 - DNA, 22 bp, Homo sapiens
gggcagctgccagaggccatgg

SEQ ID NO: 7843605 - DNA, 22 bp, Homo sapiens
gggcagctgccagaggccatgg

SEQ ID NO: 7843606 - DNA, 22 bp, Homo sapiens
gggcagctgccagaggccatgg

SEQ ID NO: 7843607 - DNA, 22 bp, Homo sapiens
gggcagctgccagaggccatgg

SEQ ID NO: 7843608 - DNA, 22 bp, Homo sapiens
gggcagctgccagaggccatgg

SEQ ID NO: 7843609 - DNA, 22 bp, Homo sapiens
gggcagctgcccctctctgggc

SEQ ID NO: 7843610 - DNA, 22 bp, Homo sapiens
gggcagctgcccctctctgggc

SEQ ID NO: 7843611 - DNA, 22 bp, Homo sapiens
gggcagctgcccctctctgggc

SEQ ID NO: 7843612 - DNA, 22 bp, Homo sapiens
gggcagctgcccctctctgggc

SEQ ID NO: 7843613 - DNA, 22 bp, Homo sapiens
gggcagctgcagggatggtgac

SEQ ID NO: 7843614 - DNA, 22 bp, Homo sapiens
gggcagctgccaagtgcatcgc

SEQ ID NO: 7843615 - DNA, 22 bp, Homo sapiens
gggcagctgccaagtgcatcgc

SEQ ID NO: 7843616 - DNA, 22 bp, Homo sapiens
gggcagctgccactccgcttgc

SEQ ID NO: 7843617 - DNA, 22 bp, Homo sapiens
gggcagctgccactccgcttgc

SEQ ID NO: 7843618 - DNA, 22 bp, Homo sapiens
gggcagctgccactccgcttgc

SEQ ID NO: 7843619 - DNA, 22 bp, Homo sapiens
gggcagctgccaagtgcatcgc

SEQ ID NO: 7843620 - DNA, 22 bp, Homo sapiens
gggcagctgcagggatggtgac

SEQ ID NO: 7843621 - DNA, 22 bp, Homo sapiens
gggcagctgccaagtgcatcgc

SEQ ID NO: 7843622 - DNA, 22 bp, Homo sapiens
gggcagctgccaagtgcatcgc

SEQ ID NO: 7843623 - DNA, 22 bp, Homo sapiens
gggcagctgtatctgagcttat

SEQ ID NO: 7843624 - DNA, 22 bp, Homo sapiens
gggcagctgtatctgagcttat

SEQ ID NO: 7843625 - DNA, 22 bp, Homo sapiens
gggcagctgtatctgagcttat

SEQ ID NO: 7843626 - DNA, 22 bp, Homo sapiens
gggcagctgtatctgagcttat

SEQ ID NO: 7843627 - DNA, 22 bp, Homo sapiens
gggcagctgtcttggttctcaa

SEQ ID NO: 7843628 - DNA, 22 bp, Homo sapiens
gggcaggaacaaatcaaatgat

SEQ ID NO: 7843629 - DNA, 22 bp, Homo sapiens
gggcaggaacaaatcaaatgat

SEQ ID NO: 7843630 - DNA, 23 bp, Homo sapiens
gggcagcttaagcttgtttttct

SEQ ID NO: 7843631 - DNA, 22 bp, Homo sapiens
gggcagctgtcttggttctcaa

SEQ ID NO: 7843632 - DNA, 23 bp, Homo sapiens
gggcagcttaagcttgtttttct

SEQ ID NO: 7843633 - DNA, 23 bp, Homo sapiens
gggcagcttaagcttgtttttct

SEQ ID NO: 7843634 - DNA, 22 bp, Homo sapiens
gggcagctggatagttttaaat

SEQ ID NO: 7843635 - DNA, 22 bp, Homo sapiens
gggcagctgcccctctctgggc

SEQ ID NO: 7843636 - DNA, 22 bp, Homo sapiens
gggcagctggccaggtattctg

SEQ ID NO: 7843637 - DNA, 22 bp, Homo sapiens
gggcagctggccaggtattctg

SEQ ID NO: 7843638 - DNA, 22 bp, Homo sapiens
gggcagctggatagttttaaat

SEQ ID NO: 7843639 - DNA, 22 bp, Homo sapiens
gggcagctggatagttttaaat

SEQ ID NO: 7843640 - DNA, 22 bp, Homo sapiens
gggcagctggccaggtattctg

SEQ ID NO: 7843641 - DNA, 22 bp, Homo sapiens
gggcagctggccaggtattctg

SEQ ID NO: 7843642 - DNA, 22 bp, Homo sapiens
gggcagctggcttataggtttg

SEQ ID NO: 7843643 - DNA, 22 bp, Homo sapiens
gggcagctggcttataggtttg

SEQ ID NO: 7843644 - DNA, 22 bp, Homo sapiens
gggcagctggcttataggtttg

SEQ ID NO: 7843645 - DNA, 22 bp, Homo sapiens
ggcaaggaagaagccatgatgt

SEQ ID NO: 7843646 - DNA, 22 bp, Homo sapiens
ggcacagccactttggagaact

SEQ ID NO: 7843647 - DNA, 22 bp, Homo sapiens
ggcacagcaggagctatgtgaa

SEQ ID NO: 7843648 - DNA, 22 bp, Homo sapiens
ggcacagcaggagctatgtgaa

SEQ ID NO: 7843649 - DNA, 22 bp, Homo sapiens
ggcacagccactttggagaact

SEQ ID NO: 7843650 - DNA, 22 bp, Homo sapiens
ggcacagcaggagctatgtgaa

SEQ ID NO: 7843651 - DNA, 22 bp, Homo sapiens
ggcacagccactttggagaact

SEQ ID NO: 7843652 - DNA, 22 bp, Homo sapiens
ggcacagccactttggagaact

SEQ ID NO: 7843653 - DNA, 22 bp, Homo sapiens
ggcacagccactttggagaact

SEQ ID NO: 7843654 - DNA, 22 bp, Homo sapiens
ggcacagccactttggagaact

SEQ ID NO: 7843655 - DNA, 22 bp, Homo sapiens
ggcacagccctctctgtggaca

SEQ ID NO: 7843656 - DNA, 22 bp, Homo sapiens
ggcacagccctctctgtggaca

SEQ ID NO: 7843657 - DNA, 22 bp, Homo sapiens
ggcacagccctctctgtggaca

SEQ ID NO: 7843658 - DNA, 22 bp, Homo sapiens
ggcacagccctctctgtggaca

SEQ ID NO: 7843659 - DNA, 22 bp, Homo sapiens
ggcacagccctctctgtggaca

SEQ ID NO: 7843660 - DNA, 21 bp, Homo sapiens
ggcacagcctgaaatgcctca

SEQ ID NO: 7843661 - DNA, 22 bp, Homo sapiens
ggcacagccctctctgtggaca

SEQ ID NO: 7843662 - DNA, 22 bp, Homo sapiens
ggcacagcgactaccatcgaaa

SEQ ID NO: 7843663 - DNA, 22 bp, Homo sapiens
ggcacagcgactaccatcgaaa

SEQ ID NO: 7843664 - DNA, 22 bp, Homo sapiens
ggcacagcgactaccatcgaaa

SEQ ID NO: 7843665 - DNA, 22 bp, Homo sapiens
ggcacagcgactaccatcgaaa

SEQ ID NO: 7843666 - DNA, 22 bp, Homo sapiens
ggcacagcgactaccatcgaaa

SEQ ID NO: 7843667 - DNA, 22 bp, Homo sapiens
ggcacagcgactaccatcgaaa

SEQ ID NO: 7843668 - DNA, 21 bp, Homo sapiens
ggcacagcctgaaatgcctca

SEQ ID NO: 7843669 - DNA, 21 bp, Homo sapiens
ggcacagcctgaaatgcctca

SEQ ID NO: 7843670 - DNA, 22 bp, Homo sapiens
ggcacagcgactaccatcgaaa

SEQ ID NO: 7843671 - DNA, 22 bp, Homo sapiens
ggcacagctcaggtcccagctc

SEQ ID NO: 7843672 - DNA, 22 bp, Homo sapiens
ggcacagctcaggtcccagctc

SEQ ID NO: 7843673 - DNA, 22 bp, Homo sapiens
ggcacagctcaggtcccagctc

SEQ ID NO: 7843674 - DNA, 22 bp, Homo sapiens
ggcacagctacttgctcactct

SEQ ID NO: 7843675 - DNA, 22 bp, Homo sapiens
ggcacagctacttgctcactct

SEQ ID NO: 7843676 - DNA, 22 bp, Homo sapiens
ggcacagctacttgctcactct

SEQ ID NO: 7843677 - DNA, 22 bp, Homo sapiens
ggcacagctacttgctcactct

SEQ ID NO: 7843678 - DNA, 22 bp, Homo sapiens
ggcacagcgactaccatcgaaa

SEQ ID NO: 7843679 - DNA, 22 bp, Homo sapiens
ggcacagctacttgctcactct

SEQ ID NO: 7843680 - DNA, 22 bp, Homo sapiens
ggcacagctcaggtcccagctc

SEQ ID NO: 7843681 - DNA, 22 bp, Homo sapiens
ggcacagctcaggtcccagctc

SEQ ID NO: 7843682 - DNA, 22 bp, Homo sapiens
ggcacagctacttgctcactct

SEQ ID NO: 7843683 - DNA, 22 bp, Homo sapiens
ggcacagctgatgcagacacac

SEQ ID NO: 7843684 - DNA, 22 bp, Homo sapiens
ggcacagctgatgcagacacac

SEQ ID NO: 7843685 - DNA, 22 bp, Homo sapiens
ggcacagctgatgcagacacac

SEQ ID NO: 7843686 - DNA, 22 bp, Homo sapiens
ggcacagctcaggtcccagctc

SEQ ID NO: 7843687 - DNA, 22 bp, Homo sapiens
ggcacaggaatctgtgaagtgc

SEQ ID NO: 7843688 - DNA, 22 bp, Homo sapiens
ggcacaggaatctgtgaagtgc

SEQ ID NO: 7843689 - DNA, 22 bp, Homo sapiens
ggcacaggaatctgtgaagtgc

SEQ ID NO: 7843690 - DNA, 22 bp, Homo sapiens
ggcacagctgatgcagacacac

SEQ ID NO: 7843691 - DNA, 22 bp, Homo sapiens
ggcacaggaatctgtgaagtgc

SEQ ID NO: 7843692 - DNA, 22 bp, Homo sapiens
ggcacagctgatgcagacacac

SEQ ID NO: 7843693 - DNA, 22 bp, Homo sapiens
ggcacaggaatctgtgaagtgc

SEQ ID NO: 7843694 - DNA, 17 bp, Homo sapiens
ggcaccagacggagagt

SEQ ID NO: 7843695 - DNA, 22 bp, Homo sapiens
ggcaccagcacttgggatggct

SEQ ID NO: 7843696 - DNA, 22 bp, Homo sapiens
ggcaccagccacctatttctag

SEQ ID NO: 7843697 - DNA, 22 bp, Homo sapiens
ggcaccagcaggcaccgatgcc

SEQ ID NO: 7843698 - DNA, 22 bp, Homo sapiens
ggcaccagcaggcaccgatgcc

SEQ ID NO: 7843699 - DNA, 17 bp, Homo sapiens
ggcaccagacggagagt

SEQ ID NO: 7843700 - DNA, 17 bp, Homo sapiens
ggcaccagacggagagt

SEQ ID NO: 7843701 - DNA, 17 bp, Homo sapiens
ggcaccagacggagagt

SEQ ID NO: 7843702 - DNA, 17 bp, Homo sapiens
ggcaccagacggagagt

SEQ ID NO: 7843703 - DNA, 22 bp, Homo sapiens
ggcacaggagctagtcaaagcc

SEQ ID NO: 7843704 - DNA, 22 bp, Homo sapiens
ggcacaggagctagtcaaagcc

SEQ ID NO: 7843705 - DNA, 22 bp, Homo sapiens
ggcacatgtatgtgggagtgtg

SEQ ID NO: 7843706 - DNA, 20 bp, Homo sapiens
ggcagagggcctgggagaag

SEQ ID NO: 7843707 - DNA, 20 bp, Homo sapiens
ggcagagggcctgggagaag

SEQ ID NO: 7843708 - DNA, 20 bp, Homo sapiens
ggcagagggcctgggagaag

SEQ ID NO: 7843709 - DNA, 20 bp, Homo sapiens
ggcagagggcctgggagaag

SEQ ID NO: 7843710 - DNA, 20 bp, Homo sapiens
ggcagagggcctgggagaag

SEQ ID NO: 7843711 - DNA, 20 bp, Homo sapiens
ggcagagggcctgggagaag

SEQ ID NO: 7843712 - DNA, 20 bp, Homo sapiens
ggcagagggcctgggagaag

SEQ ID NO: 7843713 - DNA, 20 bp, Homo sapiens
ggcagagggcctgggagaag

SEQ ID NO: 7843714 - DNA, 20 bp, Homo sapiens
ggcagagggcctgggagaag

SEQ ID NO: 7843715 - DNA, 22 bp, Homo sapiens
ggcagaggaggggtgaatttgc

SEQ ID NO: 7843716 - DNA, 22 bp, Homo sapiens
ggcagaggagctggaaacatgg

SEQ ID NO: 7843717 - DNA, 22 bp, Homo sapiens
ggcagaggaggggtgaatttgc

SEQ ID NO: 7843718 - DNA, 20 bp, Homo sapiens
ggcagagggcctgggagaag

SEQ ID NO: 7843719 - DNA, 22 bp, Homo sapiens
ggcagaggaggggtgaatttgc

SEQ ID NO: 7843720 - DNA, 22 bp, Homo sapiens
ggcagaggaggggtgaatttgc

SEQ ID NO: 7843721 - DNA, 22 bp, Homo sapiens
ggcagaggagctggaaacatgg

SEQ ID NO: 7843722 - DNA, 22 bp, Homo sapiens
ggcagaggagctggaaacatgg

SEQ ID NO: 7843723 - DNA, 22 bp, Homo sapiens
ggcagaggagctggaaacatgg

SEQ ID NO: 7843724 - DNA, 22 bp, Homo sapiens
ggcagaggagctggaaacatgg

SEQ ID NO: 7843725 - DNA, 22 bp, Homo sapiens
ggcagaggagctggaaacatgg

SEQ ID NO: 7843726 - DNA, 22 bp, Homo sapiens
ggcagaggaggggtgaatttgc

SEQ ID NO: 7843727 - DNA, 22 bp, Homo sapiens
ggcagaggagctggaaacatgg

SEQ ID NO: 7843728 - DNA, 22 bp, Homo sapiens
ggcagaggagctggaaacatgg

SEQ ID NO: 7843729 - DNA, 22 bp, Homo sapiens
ggcagaggagctggaaacatgg

SEQ ID NO: 7843730 - DNA, 22 bp, Homo sapiens
ggcagaggaaggatgaattcac

SEQ ID NO: 7843731 - DNA, 22 bp, Homo sapiens
ggcagaggaaggatgaattcac

SEQ ID NO: 7843732 - DNA, 22 bp, Homo sapiens
ggcagaggagctggaaacatgg

SEQ ID NO: 7843733 - DNA, 22 bp, Homo sapiens
ggcagaggaaggatgaattcac

SEQ ID NO: 7843734 - DNA, 22 bp, Homo sapiens
ggcagaggaaggatgaattcac

SEQ ID NO: 7843735 - DNA, 22 bp, Homo sapiens
ggcagaggaagctggaagtggg

SEQ ID NO: 7843736 - DNA, 22 bp, Homo sapiens
ggcagaggaaggatgaattcac

SEQ ID NO: 7843737 - DNA, 22 bp, Homo sapiens
ggcagaggaagctggaagtggg

SEQ ID NO: 7843738 - DNA, 22 bp, Homo sapiens
ggcagaggaagctggaagtggg

SEQ ID NO: 7843739 - DNA, 22 bp, Homo sapiens
ggcaccaggatcagtctgtcat

SEQ ID NO: 7843740 - DNA, 23 bp, Homo sapiens
ggcaccaggccatggagcgggag

SEQ ID NO: 7843741 - DNA, 23 bp, Homo sapiens
ggcaccaggccatggagcgggag

SEQ ID NO: 7843742 - DNA, 22 bp, Homo sapiens
ggcaccaggacatgactcccag

SEQ ID NO: 7843743 - DNA, 22 bp, Homo sapiens
ggcaccaggacatgactcccag

SEQ ID NO: 7843744 - DNA, 23 bp, Homo sapiens
ggcaccaggccatggagcgggag

SEQ ID NO: 7843745 - DNA, 20 bp, Homo sapiens
ggcaccaggctaggattgga

SEQ ID NO: 7843746 - DNA, 20 bp, Homo sapiens
ggcaccaggctaggattgga

SEQ ID NO: 7843747 - DNA, 22 bp, Homo sapiens
ggcaccaggctgggcataggcc

SEQ ID NO: 7843748 - DNA, 22 bp, Homo sapiens
ggcaccaggctgggcataggcc

SEQ ID NO: 7843749 - DNA, 22 bp, Homo sapiens
ggcagaggtagctggaaccagg

SEQ ID NO: 7843750 - DNA, 22 bp, Homo sapiens
ggcagaggtagctggaaccagg

SEQ ID NO: 7843751 - DNA, 22 bp, Homo sapiens
ggcagaggtagctggaaccagg

SEQ ID NO: 7843752 - DNA, 22 bp, Homo sapiens
ggcagaggtagctggaaccagg

SEQ ID NO: 7843753 - DNA, 22 bp, Homo sapiens
ggcagaggtagctggaaccagg

SEQ ID NO: 7843754 - DNA, 22 bp, Homo sapiens
ggcagaggtagctggaaccagg

SEQ ID NO: 7843755 - DNA, 22 bp, Homo sapiens
ggcagaggtagctggaaccagg

SEQ ID NO: 7843756 - DNA, 22 bp, Homo sapiens
ggcagaggtagctggaaccagg

SEQ ID NO: 7843757 - DNA, 22 bp, Homo sapiens
ggcagaggtagctggaaccagg

SEQ ID NO: 7843758 - DNA, 22 bp, Homo sapiens
ggcagaggtagctggaaccagg

SEQ ID NO: 7843759 - DNA, 22 bp, Homo sapiens
ggcagaggtagctggaaccagg

SEQ ID NO: 7843760 - DNA, 22 bp, Homo sapiens
ggcagaggtagctggaaccagg

SEQ ID NO: 7843761 - DNA, 22 bp, Homo sapiens
ggcagaggtagctggaaccagg

SEQ ID NO: 7843762 - DNA, 22 bp, Homo sapiens
ggcagaggtagctggaaccagg

SEQ ID NO: 7843763 - DNA, 22 bp, Homo sapiens
ggcagaggtagctggaaccagg

SEQ ID NO: 7843764 - DNA, 22 bp, Homo sapiens
ggcagaggtagctggaaccagg

SEQ ID NO: 7843765 - DNA, 22 bp, Homo sapiens
ggcagaggtagctggaaccagg

SEQ ID NO: 7843766 - DNA, 22 bp, Homo sapiens
ggcagaggtagctggaaccagg

SEQ ID NO: 7843767 - DNA, 20 bp, Homo sapiens
ggcagagggcctgggagaag

SEQ ID NO: 7843768 - DNA, 20 bp, Homo sapiens
ggcagagggcctgggagaag

SEQ ID NO: 7843769 - DNA, 20 bp, Homo sapiens
ggcagagggcctgggagaag

SEQ ID NO: 7843770 - DNA, 20 bp, Homo sapiens
ggcagagggcctgggagaag

SEQ ID NO: 7843771 - DNA, 20 bp, Homo sapiens
ggcagagggcctgggagaag

SEQ ID NO: 7843772 - DNA, 20 bp, Homo sapiens
ggcagagggcctgggagaag

SEQ ID NO: 7843773 - DNA, 22 bp, Homo sapiens
ggcaggagggcggacaatgacc

SEQ ID NO: 7843774 - DNA, 22 bp, Homo sapiens
ggcaggagggcggacaatgacc

SEQ ID NO: 7843775 - DNA, 22 bp, Homo sapiens
ggcaggaggaagagttagcacc

SEQ ID NO: 7843776 - DNA, 22 bp, Homo sapiens
ggcaggagggcggacaatgacc

SEQ ID NO: 7843777 - DNA, 22 bp, Homo sapiens
ggcaggaggaagagttagcacc

SEQ ID NO: 7843778 - DNA, 22 bp, Homo sapiens
ggcagaggtgaagttcacaagg

SEQ ID NO: 7843779 - DNA, 22 bp, Homo sapiens
ggcagaggtagctggaaccagg

SEQ ID NO: 7843780 - DNA, 22 bp, Homo sapiens
ggcagaggtagctggaaccagg

SEQ ID NO: 7843781 - DNA, 22 bp, Homo sapiens
ggcagaggtagctggaaccagg

SEQ ID NO: 7843782 - DNA, 22 bp, Homo sapiens
ggcagaggtagctggaaccagg

SEQ ID NO: 7843783 - DNA, 22 bp, Homo sapiens
ggcaggaggtgagtggcgggtg

SEQ ID NO: 7843784 - DNA, 22 bp, Homo sapiens
ggcaggaggtgagtggcgggtg

SEQ ID NO: 7843785 - DNA, 22 bp, Homo sapiens
ggcaggaggtgagtggcgggtg

SEQ ID NO: 7843786 - DNA, 22 bp, Homo sapiens
ggcaggaggtgagtggcgggtg

SEQ ID NO: 7843787 - DNA, 22 bp, Homo sapiens
ggcaggaggtgagtggcgggtg

SEQ ID NO: 7843788 - DNA, 22 bp, Homo sapiens
ggcaggagggcggacaatgacc

SEQ ID NO: 7843789 - DNA, 22 bp, Homo sapiens
ggcaggagggcggacaatgacc

SEQ ID NO: 7843790 - DNA, 22 bp, Homo sapiens
ggcaggagggcggacaatgacc

SEQ ID NO: 7843791 - DNA, 22 bp, Homo sapiens
ggcaggagggcggacaatgacc

SEQ ID NO: 7843792 - DNA, 22 bp, Homo sapiens
ggcaggaggtgagtggcgggtg

SEQ ID NO: 7843793 - DNA, 22 bp, Homo sapiens
ggcaggaggtgagtggcgggtg

SEQ ID NO: 7843794 - DNA, 22 bp, Homo sapiens
ggcaggaggtgagtggcgggtg

SEQ ID NO: 7843795 - DNA, 22 bp, Homo sapiens
ggcaggcaaggcagcctggtga

SEQ ID NO: 7843796 - DNA, 22 bp, Homo sapiens
ggcaggcaaggcagcctggtga

SEQ ID NO: 7843797 - DNA, 22 bp, Homo sapiens
ggcaggcaacggaccactagtc

SEQ ID NO: 7843798 - DNA, 22 bp, Homo sapiens
ggcaggcaacggaccactagtc

SEQ ID NO: 7843799 - DNA, 18 bp, Homo sapiens
ggcaggatttcaactttc

SEQ ID NO: 7843800 - DNA, 22 bp, Homo sapiens
ggcaggcaacggaccactagtc

SEQ ID NO: 7843801 - DNA, 22 bp, Homo sapiens
ggcaggaggtgagtggcgggtg

SEQ ID NO: 7843802 - DNA, 21 bp, Homo sapiens
ggcaggatggcagtggacccc

SEQ ID NO: 7843803 - DNA, 22 bp, Homo sapiens
ggcaggcaacggaccactagtc

SEQ ID NO: 7843804 - DNA, 18 bp, Homo sapiens
ggcaggatttcaactttc

SEQ ID NO: 7843805 - DNA, 22 bp, Homo sapiens
ggcaggcaaggcagcctggtga

SEQ ID NO: 7843806 - DNA, 22 bp, Homo sapiens
ggcaggcaaggcagcctggtga

SEQ ID NO: 7843807 - DNA, 22 bp, Homo sapiens
ggcaggcaaggcagcctggtga

SEQ ID NO: 7843808 - DNA, 22 bp, Homo sapiens
ggcaggcaaggcagcctggtga

SEQ ID NO: 7843809 - DNA, 22 bp, Homo sapiens
ggcaggcaagtctgctctgtga

SEQ ID NO: 7843810 - DNA, 22 bp, Homo sapiens
ggcaggcaagtctgctctgtga

SEQ ID NO: 7843811 - DNA, 22 bp, Homo sapiens
ggcaggcaagtctgctctgtga

SEQ ID NO: 7843812 - DNA, 22 bp, Homo sapiens
ggcaggcaagtctgctctgtga

SEQ ID NO: 7843813 - DNA, 22 bp, Homo sapiens
ggcaggcaagtctgctctgtga

SEQ ID NO: 7843814 - DNA, 22 bp, Homo sapiens
ggcaggcaagtctgctctgtga

SEQ ID NO: 7843815 - DNA, 22 bp, Homo sapiens
ggcaggcaatgaggatgggaag

SEQ ID NO: 7843816 - DNA, 22 bp, Homo sapiens
ggcaggcaatgaggatgggaag

SEQ ID NO: 7843817 - DNA, 22 bp, Homo sapiens
ggcaggcaatgaggatgggaag

SEQ ID NO: 7843818 - DNA, 22 bp, Homo sapiens
ggcaggcactgtgttttgtgtt

SEQ ID NO: 7843819 - DNA, 22 bp, Homo sapiens
ggcaggcagaaaaatagaatat

SEQ ID NO: 7843820 - DNA, 22 bp, Homo sapiens
ggcaggcagaaaaatagaatat

SEQ ID NO: 7843821 - DNA, 22 bp, Homo sapiens
ggcaggcactgtgttttgtgtt

SEQ ID NO: 7843822 - DNA, 22 bp, Homo sapiens
ggcaggcagaaaaatagaatat

SEQ ID NO: 7843823 - DNA, 22 bp, Homo sapiens
ggcaggcagaggctgagacagg

SEQ ID NO: 7843824 - DNA, 22 bp, Homo sapiens
ggcaggcagaaaaatagaatat

SEQ ID NO: 7843825 - DNA, 22 bp, Homo sapiens
ggcaggcactgtgctaggcgct

SEQ ID NO: 7843826 - DNA, 22 bp, Homo sapiens
ggcaggcactgtgctaggcgct

SEQ ID NO: 7843827 - DNA, 22 bp, Homo sapiens
ggcaggcactgtgctaggcgct

SEQ ID NO: 7843828 - DNA, 22 bp, Homo sapiens
ggcaggcactgtgctaggcgct

SEQ ID NO: 7843829 - DNA, 22 bp, Homo sapiens
ggcaggcactgtgctaggcgct

SEQ ID NO: 7843830 - DNA, 22 bp, Homo sapiens
ggcaggcactgtgatagattct

SEQ ID NO: 7843831 - DNA, 22 bp, Homo sapiens
ggcaggcactgtgctaggcgct

SEQ ID NO: 7843832 - DNA, 22 bp, Homo sapiens
ggcaggcaatgaggatgggaag

SEQ ID NO: 7843833 - DNA, 22 bp, Homo sapiens
ggcaggcaatgaggatgggaag

SEQ ID NO: 7843834 - DNA, 22 bp, Homo sapiens
ggcaggcacagtaatacatgtt

SEQ ID NO: 7843835 - DNA, 22 bp, Homo sapiens
ggcaggcacagtaatacatgtt

SEQ ID NO: 7843836 - DNA, 22 bp, Homo sapiens
ggcaggcacatttgggggccgt

SEQ ID NO: 7843837 - DNA, 22 bp, Homo sapiens
ggcaggcaccagctcagcaata

SEQ ID NO: 7843838 - DNA, 22 bp, Homo sapiens
ggcaggcaccagctcagcaata

SEQ ID NO: 7843839 - DNA, 22 bp, Homo sapiens
ggcaggcactgtgatagattct

SEQ ID NO: 7843840 - DNA, 22 bp, Homo sapiens
ggcaggcactgtgatagattct

SEQ ID NO: 7843841 - DNA, 22 bp, Homo sapiens
ggcaggcactgtgatagattct

SEQ ID NO: 7843842 - DNA, 22 bp, Homo sapiens
ggcaggcaccagctcagcaata

SEQ ID NO: 7843843 - DNA, 22 bp, Homo sapiens
ggcaggcaccagctcagcaata

SEQ ID NO: 7843844 - DNA, 22 bp, Homo sapiens
ggcaaagcggccctgtggccag

SEQ ID NO: 7843845 - DNA, 22 bp, Homo sapiens
ggcaaaggaaaacgtctcagct

SEQ ID NO: 7843846 - DNA, 22 bp, Homo sapiens
ggcaaaggaaaacgtctcagct

SEQ ID NO: 7843847 - DNA, 22 bp, Homo sapiens
ggcaaagctgggattcaaaccc

SEQ ID NO: 7843848 - DNA, 22 bp, Homo sapiens
ggcaaagccttccagctgttac

SEQ ID NO: 7843849 - DNA, 22 bp, Homo sapiens
ggcaaaggaaccaggccacact

SEQ ID NO: 7843850 - DNA, 22 bp, Homo sapiens
ggcaaatattatctttgctggt

SEQ ID NO: 7843851 - DNA, 22 bp, Homo sapiens
ggcaacaactggacatagctgg

SEQ ID NO: 7843852 - DNA, 22 bp, Homo sapiens
ggcaagaaggcttcaggtagct

SEQ ID NO: 7843853 - DNA, 22 bp, Homo sapiens
ggcaagagggcagatggagtgc

SEQ ID NO: 7843854 - DNA, 22 bp, Homo sapiens
ggcaagagggcagatggagtgc

SEQ ID NO: 7843855 - DNA, 22 bp, Homo sapiens
ggcaagagggcagatggagtgc

SEQ ID NO: 7843856 - DNA, 22 bp, Homo sapiens
ggcaagaaccacaattactttt

SEQ ID NO: 7843857 - DNA, 22 bp, Homo sapiens
ggcaactcttcttgcaatgggg

SEQ ID NO: 7843858 - DNA, 21 bp, Homo sapiens
ggcaagaaacacaatcaagta

SEQ ID NO: 7843859 - DNA, 17 bp, Homo sapiens
ggcaacatgttcttctg

SEQ ID NO: 7843860 - DNA, 22 bp, Homo sapiens
ggcaacattctccagatccttt

SEQ ID NO: 7843861 - DNA, 22 bp, Homo sapiens
ggcaagatccaaggggctagga

SEQ ID NO: 7843862 - DNA, 20 bp, Homo sapiens
ggcaagcaactgagggagga

SEQ ID NO: 7843863 - DNA, 22 bp, Homo sapiens
ggcaagagttgaagctccagga

SEQ ID NO: 7843864 - DNA, 22 bp, Homo sapiens
ggcaagagtgaggagtgtctct

SEQ ID NO: 7843865 - DNA, 22 bp, Homo sapiens
ggcaagagttgaagctccagga

SEQ ID NO: 7843866 - DNA, 19 bp, Homo sapiens
ggcaagcacaaaagctttg

SEQ ID NO: 7843867 - DNA, 19 bp, Homo sapiens
ggcaagcacaaaagctttg

SEQ ID NO: 7843868 - DNA, 22 bp, Homo sapiens
ggcacagcaggagctatgtgaa

SEQ ID NO: 7843869 - DNA, 22 bp, Homo sapiens
ggcacagcaggagctatgtgaa

SEQ ID NO: 7843870 - DNA, 22 bp, Homo sapiens
ggcaagctcaggcctcaggtgt

SEQ ID NO: 7843871 - DNA, 21 bp, Homo sapiens
ggcaagcctatgagatttcgc

SEQ ID NO: 7843872 - DNA, 22 bp, Homo sapiens
ggcaagaggtccaagaggtctc

SEQ ID NO: 7843873 - DNA, 22 bp, Homo sapiens
ggcaagaggtccaagaggtctc

SEQ ID NO: 7843874 - DNA, 22 bp, Homo sapiens
ggcaagaggtccaagaggtctc

SEQ ID NO: 7843875 - DNA, 22 bp, Homo sapiens
ggcaagaggtccaagaggtctc

SEQ ID NO: 7843876 - DNA, 22 bp, Homo sapiens
ggcaagaggtccaagaggtctc

SEQ ID NO: 7843877 - DNA, 22 bp, Homo sapiens
ggcaagaggtccaagaggtctc

SEQ ID NO: 7843878 - DNA, 22 bp, Homo sapiens
ggcaagaggtccaagaggtctc

SEQ ID NO: 7843879 - DNA, 22 bp, Homo sapiens
ggcaagaggtccaagaggtctc

SEQ ID NO: 7843880 - DNA, 22 bp, Homo sapiens
ggcaagagtgaggagtgtctct

SEQ ID NO: 7843881 - DNA, 22 bp, Homo sapiens
ggcaagagtgaggagtgtctct

SEQ ID NO: 7843882 - DNA, 22 bp, Homo sapiens
ggcaagagtgaggagtgtctct

SEQ ID NO: 7843883 - DNA, 22 bp, Homo sapiens
ggcaagagtgaggagtgtctct

SEQ ID NO: 7843884 - DNA, 22 bp, Homo sapiens
ggcaagagtgaggagtgtctct

SEQ ID NO: 7843885 - DNA, 22 bp, Homo sapiens
ggcaagaggtccaagaggtctc

SEQ ID NO: 7843886 - DNA, 22 bp, Homo sapiens
ggcaagaggtccaagaggtctc

SEQ ID NO: 7843887 - DNA, 22 bp, Homo sapiens
ggcaagaggtccaagaggtctc

SEQ ID NO: 7843888 - DNA, 22 bp, Homo sapiens
ggcaaacaggagagtaaagaga

SEQ ID NO: 7843889 - DNA, 22 bp, Homo sapiens
ggcaaacaggagagtaaagaga

SEQ ID NO: 7843890 - DNA, 22 bp, Homo sapiens
ggcaaagccttccagctgttac

SEQ ID NO: 7843891 - DNA, 22 bp, Homo sapiens
ggcaaagccttactctaactga

SEQ ID NO: 7843892 - DNA, 22 bp, Homo sapiens
ggcaaacacacctcggtgagaa

SEQ ID NO: 7843893 - DNA, 22 bp, Homo sapiens
ggcaaaaatcacccctggttca

SEQ ID NO: 7843894 - DNA, 22 bp, Homo sapiens
ggcaaaaatcacccctggttca

SEQ ID NO: 7843895 - DNA, 22 bp, Homo sapiens
ggcaaaaatcacccctggttca

SEQ ID NO: 7843896 - DNA, 22 bp, Homo sapiens
ggcaaacagacttgaccatctt

SEQ ID NO: 7843897 - DNA, 22 bp, Homo sapiens
ggcaaacaccaggcgagggagc

SEQ ID NO: 7843898 - DNA, 22 bp, Homo sapiens
ggcaaacagacttgaccatctt

SEQ ID NO: 7843899 - DNA, 22 bp, Homo sapiens
ggcaaacagacttgaccatctt

SEQ ID NO: 7843900 - DNA, 22 bp, Homo sapiens
ggcaaaaacagcaatgactttt

SEQ ID NO: 7843901 - DNA, 22 bp, Homo sapiens
ggcaaaaacagcaatgactttt

SEQ ID NO: 7843902 - DNA, 22 bp, Homo sapiens
ggcaaaaacagcaatgactttt

SEQ ID NO: 7843903 - DNA, 22 bp, Homo sapiens
ggcaaaaaccacaattactttt

SEQ ID NO: 7843904 - DNA, 22 bp, Homo sapiens
ggcaaaaaccacaattactttt

SEQ ID NO: 7843905 - DNA, 22 bp, Homo sapiens
ggcaaaaacagcaatgactttt

SEQ ID NO: 7843906 - DNA, 22 bp, Homo sapiens
ggattttagagtacctaagtgt

SEQ ID NO: 7843907 - DNA, 22 bp, Homo sapiens
ggagtgctgggccgctgccaac

SEQ ID NO: 7843908 - DNA, 22 bp, Homo sapiens
ggagtgctcctctccccagtgc

SEQ ID NO: 7843909 - DNA, 22 bp, Homo sapiens
ggcaaaaaccgcaataacttct

SEQ ID NO: 7843910 - DNA, 22 bp, Homo sapiens
ggcaaaaaccgcaataacttct

SEQ ID NO: 7843911 - DNA, 22 bp, Homo sapiens
ggcaaaaaccgcaataacttct

SEQ ID NO: 7843912 - DNA, 22 bp, Homo sapiens
ggcaaaaagttcccatcagtgt

SEQ ID NO: 7843913 - DNA, 22 bp, Homo sapiens
ggcaaaaagttcccatcagtgt

SEQ ID NO: 7843914 - DNA, 22 bp, Homo sapiens
ggcaaaaagttcccatcagtgt

SEQ ID NO: 7843915 - DNA, 22 bp, Homo sapiens
ggcaaaaaccataattactttt

SEQ ID NO: 7843916 - DNA, 22 bp, Homo sapiens
ggcaaaaaccacaattactttt

SEQ ID NO: 7843917 - DNA, 22 bp, Homo sapiens
ggcaaaaaccataattactttt

SEQ ID NO: 7843918 - DNA, 22 bp, Homo sapiens
ggcaaaaaccataattactttt

SEQ ID NO: 7843919 - DNA, 22 bp, Homo sapiens
ggcaaaaaccgcaataacttct

SEQ ID NO: 7843920 - DNA, 23 bp, Homo sapiens
ggagtgcaatggcgccatctcgg

SEQ ID NO: 7843921 - DNA, 23 bp, Homo sapiens
ggagtgcaatggcgccatctcgg

SEQ ID NO: 7843922 - DNA, 22 bp, Homo sapiens
ggagtgcagctcacaggacatc

SEQ ID NO: 7843923 - DNA, 22 bp, Homo sapiens
ggagtgcagctcacaggacatc

SEQ ID NO: 7843924 - DNA, 22 bp, Homo sapiens
ggagtgcaatggcgtgatctca

SEQ ID NO: 7843925 - DNA, 23 bp, Homo sapiens
ggagtgcaatggcgccatctcgg

SEQ ID NO: 7843926 - DNA, 23 bp, Homo sapiens
ggagtgcaatggcgccatctcgg

SEQ ID NO: 7843927 - DNA, 22 bp, Homo sapiens
ggagtgcaggtagcacaggaaa

SEQ ID NO: 7843928 - DNA, 22 bp, Homo sapiens
ggagtgcagtggcgtgagctcg

SEQ ID NO: 7843929 - DNA, 22 bp, Homo sapiens
ggagtgcagtggcgtgagctcg

SEQ ID NO: 7843930 - DNA, 22 bp, Homo sapiens
ggagtgcagtggcgtgatctca

SEQ ID NO: 7843931 - DNA, 22 bp, Homo sapiens
ggagtgcagtggcgtgatctcg

SEQ ID NO: 7843932 - DNA, 22 bp, Homo sapiens
ggagtgcggtggcaccatctca

SEQ ID NO: 7843933 - DNA, 22 bp, Homo sapiens
ggagtgcggtggcaccatctca

SEQ ID NO: 7843934 - DNA, 22 bp, Homo sapiens
ggagtgctcagcgccaacctgg

SEQ ID NO: 7843935 - DNA, 22 bp, Homo sapiens
ggagtgccgaggtgttcaagga

SEQ ID NO: 7843936 - DNA, 22 bp, Homo sapiens
ggagtgcagtggtgggatctca

SEQ ID NO: 7843937 - DNA, 22 bp, Homo sapiens
ggagtgcagtggtgggatctca

SEQ ID NO: 7843938 - DNA, 23 bp, Homo sapiens
ggagtgcaatggcgccatctcgg

SEQ ID NO: 7843939 - DNA, 23 bp, Homo sapiens
ggagtgcaatggcgccatctcgg

SEQ ID NO: 7843940 - DNA, 23 bp, Homo sapiens
ggagtgcaatggcgccatctcgg

SEQ ID NO: 7843941 - DNA, 23 bp, Homo sapiens
ggagtgcaatggcgccatctcgg

SEQ ID NO: 7843942 - DNA, 23 bp, Homo sapiens
ggagtgcaatggcgccatctcgg

SEQ ID NO: 7843943 - DNA, 22 bp, Homo sapiens
ggagtgagtactggagtagctg

SEQ ID NO: 7843944 - DNA, 22 bp, Homo sapiens
ggagtgagtactggagtagctg

SEQ ID NO: 7843945 - DNA, 22 bp, Homo sapiens
ggagtgagtactggagtagctg

SEQ ID NO: 7843946 - DNA, 22 bp, Homo sapiens
ggagtgagtactggagtagctg

SEQ ID NO: 7843947 - DNA, 22 bp, Homo sapiens
ggagtgagtactggagtagctg

SEQ ID NO: 7843948 - DNA, 22 bp, Homo sapiens
ggagtgagtggccttgtcactg

SEQ ID NO: 7843949 - DNA, 22 bp, Homo sapiens
ggagtgagtggccttgtcactg

SEQ ID NO: 7843950 - DNA, 22 bp, Homo sapiens
ggagtaggccccgggagagagt

SEQ ID NO: 7843951 - DNA, 17 bp, Homo sapiens
ggagccaggagcccacc

SEQ ID NO: 7843952 - DNA, 22 bp, Homo sapiens
ggagtaggccccgggagagagt

SEQ ID NO: 7843953 - DNA, 22 bp, Homo sapiens
ggagtcaaggaaggctctgtga

SEQ ID NO: 7843954 - DNA, 22 bp, Homo sapiens
ggagtatatcgtgtatcatatg

SEQ ID NO: 7843955 - DNA, 19 bp, Homo sapiens
ggagccagctgtggaaggc

SEQ ID NO: 7843956 - DNA, 19 bp, Homo sapiens
ggagccagctgtggaaggc

SEQ ID NO: 7843957 - DNA, 19 bp, Homo sapiens
ggagccagctgtggaaggc

SEQ ID NO: 7843958 - DNA, 19 bp, Homo sapiens
ggagccagctgtggaaggc

SEQ ID NO: 7843959 - DNA, 19 bp, Homo sapiens
ggagccagctgtggaaggc

SEQ ID NO: 7843960 - DNA, 19 bp, Homo sapiens
ggagccagctgtggaaggc

SEQ ID NO: 7843961 - DNA, 17 bp, Homo sapiens
ggagccaggagcccacc

SEQ ID NO: 7843962 - DNA, 17 bp, Homo sapiens
ggagccaggagcccacc

SEQ ID NO: 7843963 - DNA, 17 bp, Homo sapiens
ggagccaggagcccacc

SEQ ID NO: 7843964 - DNA, 19 bp, Homo sapiens
ggagccagctgtggaaggc

SEQ ID NO: 7843965 - DNA, 19 bp, Homo sapiens
ggagccagctgtggaaggc

SEQ ID NO: 7843966 - DNA, 19 bp, Homo sapiens
ggagccagctgtggaaggc

SEQ ID NO: 7843967 - DNA, 22 bp, Homo sapiens
ggagccagctccctccttgtga

SEQ ID NO: 7843968 - DNA, 22 bp, Homo sapiens
ggagccagctccctccttgtga

SEQ ID NO: 7843969 - DNA, 23 bp, Homo sapiens
ggagccagcctgtggggagcggg

SEQ ID NO: 7843970 - DNA, 23 bp, Homo sapiens
ggagccagcctgtggggagcggg

SEQ ID NO: 7843971 - DNA, 23 bp, Homo sapiens
ggagccagcctgtggggagcggg

SEQ ID NO: 7843972 - DNA, 22 bp, Homo sapiens
ggagccagcagggtgacactga

SEQ ID NO: 7843973 - DNA, 22 bp, Homo sapiens
ggagccagcagggtgacactga

SEQ ID NO: 7843974 - DNA, 23 bp, Homo sapiens
ggagccagcctgtggggagcggg

SEQ ID NO: 7843975 - DNA, 23 bp, Homo sapiens
ggagccagcctgtggggagcggg

SEQ ID NO: 7843976 - DNA, 23 bp, Homo sapiens
ggagccagcctgtggggagcggg

SEQ ID NO: 7843977 - DNA, 22 bp, Homo sapiens
ggagccagcagggtgacactga

SEQ ID NO: 7843978 - DNA, 22 bp, Homo sapiens
ggagccagaggctgctgctgtg

SEQ ID NO: 7843979 - DNA, 22 bp, Homo sapiens
ggagccagagcactggggagcc

SEQ ID NO: 7843980 - DNA, 22 bp, Homo sapiens
ggagccagagcactggggagcc

SEQ ID NO: 7843981 - DNA, 22 bp, Homo sapiens
ggagccagagcactggggagcc

SEQ ID NO: 7843982 - DNA, 22 bp, Homo sapiens
ggagccagagcactggggagcc

SEQ ID NO: 7843983 - DNA, 22 bp, Homo sapiens
ggagccagaggctgctgctgtg

SEQ ID NO: 7843984 - DNA, 22 bp, Homo sapiens
ggagccagaggctgctgctgtg

SEQ ID NO: 7843985 - DNA, 22 bp, Homo sapiens
ggagccagaggctgctgctgtg

SEQ ID NO: 7843986 - DNA, 22 bp, Homo sapiens
ggagccagaggctgctgctgtg

SEQ ID NO: 7843987 - DNA, 22 bp, Homo sapiens
ggagccagaggctgctgctgtg

SEQ ID NO: 7843988 - DNA, 22 bp, Homo sapiens
ggagccagagtctgcagtgtaa

SEQ ID NO: 7843989 - DNA, 22 bp, Homo sapiens
ggagccagagtctgcagtgtaa

SEQ ID NO: 7843990 - DNA, 22 bp, Homo sapiens
ggagccagagtctgcagtgtaa

SEQ ID NO: 7843991 - DNA, 22 bp, Homo sapiens
ggagccagagggatgcagttga

SEQ ID NO: 7843992 - DNA, 22 bp, Homo sapiens
ggagccagagggatgcagttga

SEQ ID NO: 7843993 - DNA, 22 bp, Homo sapiens
ggagccagagggatgcagttga

SEQ ID NO: 7843994 - DNA, 22 bp, Homo sapiens
ggagccagagggatgcagttga

SEQ ID NO: 7843995 - DNA, 22 bp, Homo sapiens
ggagccagagtctgcagtgtaa

SEQ ID NO: 7843996 - DNA, 22 bp, Homo sapiens
ggagccagagtctgcagtgtaa

SEQ ID NO: 7843997 - DNA, 22 bp, Homo sapiens
ggagccagagtctgcagtgtaa

SEQ ID NO: 7843998 - DNA, 22 bp, Homo sapiens
ggagccagagtttaatgtggag

SEQ ID NO: 7843999 - DNA, 22 bp, Homo sapiens
ggagccagagtttaatgtggag

SEQ ID NO: 7844000 - DNA, 22 bp, Homo sapiens
ggagccagagtttaatgtggag

SEQ ID NO: 7844001 - DNA, 22 bp, Homo sapiens
ggagccagagtttaatgtggag

SEQ ID NO: 7844002 - DNA, 22 bp, Homo sapiens
ggagtgaggcatttgtagctga

SEQ ID NO: 7844003 - DNA, 22 bp, Homo sapiens
ggagtgaggcatttgtagctga

SEQ ID NO: 7844004 - DNA, 22 bp, Homo sapiens
ggagtgaggcatttgtagctga

SEQ ID NO: 7844005 - DNA, 22 bp, Homo sapiens
ggagtgaggcatttgtagctga

SEQ ID NO: 7844006 - DNA, 22 bp, Homo sapiens
ggagtctgattttttatgggtg

SEQ ID NO: 7844007 - DNA, 22 bp, Homo sapiens
ggagtgaggcatttgtagctga

SEQ ID NO: 7844008 - DNA, 22 bp, Homo sapiens
ggagtctgatactgagttcctc

SEQ ID NO: 7844009 - DNA, 22 bp, Homo sapiens
ggagtctgagcttgtgtcctgg

SEQ ID NO: 7844010 - DNA, 22 bp, Homo sapiens
ggagtctgagtcctcatagaca

SEQ ID NO: 7844011 - DNA, 21 bp, Homo sapiens
ggagtctgaggaagaaaactg

SEQ ID NO: 7844012 - DNA, 19 bp, Homo sapiens
ggagtctgagcccaggtat

SEQ ID NO: 7844013 - DNA, 19 bp, Homo sapiens
ggagtctgagcccaggtat

SEQ ID NO: 7844014 - DNA, 19 bp, Homo sapiens
ggagtctgagcccaggtat

SEQ ID NO: 7844015 - DNA, 22 bp, Homo sapiens
ggagtcccagcaaagccttccc

SEQ ID NO: 7844016 - DNA, 22 bp, Homo sapiens
ggagtccatgcagcttgagaca

SEQ ID NO: 7844017 - DNA, 22 bp, Homo sapiens
ggagtctgactctgaccctgga

SEQ ID NO: 7844018 - DNA, 22 bp, Homo sapiens
ggagtctagggtcctgggcctg

SEQ ID NO: 7844019 - DNA, 18 bp, Homo sapiens
ggagtctcaggagaggaa

SEQ ID NO: 7844020 - DNA, 22 bp, Homo sapiens
ggagtcctggactccatctcac

SEQ ID NO: 7844021 - DNA, 19 bp, Homo sapiens
ggagtcactagaagccatc

SEQ ID NO: 7844022 - DNA, 19 bp, Homo sapiens
ggagtcactagaagccatc

SEQ ID NO: 7844023 - DNA, 22 bp, Homo sapiens
ggagtcagaatggcagggtggt

SEQ ID NO: 7844024 - DNA, 22 bp, Homo sapiens
ggagtcagaacccaggcttcta

SEQ ID NO: 7844025 - DNA, 22 bp, Homo sapiens
ggagtcagaacccaggcttcta

SEQ ID NO: 7844026 - DNA, 22 bp, Homo sapiens
ggagtcagaggaaggcttgctc

SEQ ID NO: 7844027 - DNA, 22 bp, Homo sapiens
ggagtcagaatggcagggtggt

SEQ ID NO: 7844028 - DNA, 22 bp, Homo sapiens
ggagtcagaatggcagggtggt

SEQ ID NO: 7844029 - DNA, 22 bp, Homo sapiens
ggagtcagaatggcagggtggt

SEQ ID NO: 7844030 - DNA, 22 bp, Homo sapiens
ggagtcagaatggcagggtggt

SEQ ID NO: 7844031 - DNA, 22 bp, Homo sapiens
ggagtcacctgggaggactggg

SEQ ID NO: 7844032 - DNA, 22 bp, Homo sapiens
ggagtcaccaagtaggagtctt

SEQ ID NO: 7844033 - DNA, 22 bp, Homo sapiens
ggagtcaccaagtaggagtctt

SEQ ID NO: 7844034 - DNA, 22 bp, Homo sapiens
ggagtcagcctgtcagagtgta

SEQ ID NO: 7844035 - DNA, 22 bp, Homo sapiens
ggagtcagcctgtcagagtgta

SEQ ID NO: 7844036 - DNA, 22 bp, Homo sapiens
ggagtcagcctgtcagagtgta

SEQ ID NO: 7844037 - DNA, 22 bp, Homo sapiens
ggagtcagcctgtcagagtgta

SEQ ID NO: 7844038 - DNA, 22 bp, Homo sapiens
ggagtcagcctgtcagagtgta

SEQ ID NO: 7844039 - DNA, 22 bp, Homo sapiens
ggagtcagcctgtcagagtgta

SEQ ID NO: 7844040 - DNA, 22 bp, Homo sapiens
ggagtcagaggaaggcttgctc

SEQ ID NO: 7844041 - DNA, 22 bp, Homo sapiens
ggagtcagaggaaggcttgctc

SEQ ID NO: 7844042 - DNA, 22 bp, Homo sapiens
ggagtcagtgatcgcgtgtctc

SEQ ID NO: 7844043 - DNA, 21 bp, Homo sapiens
ggagtcagggtctggctgggg

SEQ ID NO: 7844044 - DNA, 21 bp, Homo sapiens
ggagtcagggtctggctgggg

SEQ ID NO: 7844045 - DNA, 22 bp, Homo sapiens
ggagtcaggcagacctagttat

SEQ ID NO: 7844046 - DNA, 22 bp, Homo sapiens
ggagtcaggatcctggggatgg

SEQ ID NO: 7844047 - DNA, 22 bp, Homo sapiens
ggagtcaggagcaggctgggct

SEQ ID NO: 7844048 - DNA, 22 bp, Homo sapiens
ggcaggtggacgtgctaaagct

SEQ ID NO: 7844049 - DNA, 22 bp, Homo sapiens
ggcaggtggacgtgctaaagct

SEQ ID NO: 7844050 - DNA, 22 bp, Homo sapiens
ggcaggtggaagttggcagagc

SEQ ID NO: 7844051 - DNA, 22 bp, Homo sapiens
ggcaggtggacgtgctaaagct

SEQ ID NO: 7844052 - DNA, 22 bp, Homo sapiens
ggcaggtggattttctactcta

SEQ ID NO: 7844053 - DNA, 22 bp, Homo sapiens
ggcaggtggcactgctgctccc

SEQ ID NO: 7844054 - DNA, 22 bp, Homo sapiens
ggcaggtggcactgctgctccc

SEQ ID NO: 7844055 - DNA, 22 bp, Homo sapiens
ggcaggtggcactgctgctccc

SEQ ID NO: 7844056 - DNA, 22 bp, Homo sapiens
ggcaggtggcactgctgctccc

SEQ ID NO: 7844057 - DNA, 22 bp, Homo sapiens
ggcaggcagaggctgagacagg

SEQ ID NO: 7844058 - DNA, 22 bp, Homo sapiens
ggcaggcagatggctgcaccaa

SEQ ID NO: 7844059 - DNA, 22 bp, Homo sapiens
ggcaggtggaagttggcagagc

SEQ ID NO: 7844060 - DNA, 22 bp, Homo sapiens
ggcaggtggaagttggcagagc

SEQ ID NO: 7844061 - DNA, 22 bp, Homo sapiens
ggcaggtggaagttggcagagc

SEQ ID NO: 7844062 - DNA, 22 bp, Homo sapiens
ggcaggtggaagttggcagagc

SEQ ID NO: 7844063 - DNA, 22 bp, Homo sapiens
ggcaggtggaagttggcagagc

SEQ ID NO: 7844064 - DNA, 22 bp, Homo sapiens
ggcaggcagaggctgagacagg

SEQ ID NO: 7844065 - DNA, 22 bp, Homo sapiens
ggcaggcagaggctgagacagg

SEQ ID NO: 7844066 - DNA, 22 bp, Homo sapiens
ggcaggcagaggctgagacagg

SEQ ID NO: 7844067 - DNA, 22 bp, Homo sapiens
ggcaggcagaggctgagacagg

SEQ ID NO: 7844068 - DNA, 22 bp, Homo sapiens
ggcaggcagaggctgagacagg

SEQ ID NO: 7844069 - DNA, 22 bp, Homo sapiens
ggcaggtggcactgctgctccc

SEQ ID NO: 7844070 - DNA, 22 bp, Homo sapiens
ggcaggtggccaagtgtctaag

SEQ ID NO: 7844071 - DNA, 22 bp, Homo sapiens
ggcaggtggccaagtgtctaag

SEQ ID NO: 7844072 - DNA, 22 bp, Homo sapiens
ggcaggtggccaagtgtctaag

SEQ ID NO: 7844073 - DNA, 22 bp, Homo sapiens
ggcaggtggccaagtgtctaag

SEQ ID NO: 7844074 - DNA, 21 bp, Homo sapiens
ggcaggtgggtctctgttgct

SEQ ID NO: 7844075 - DNA, 21 bp, Homo sapiens
ggcaggtgggtctctgttgct

SEQ ID NO: 7844076 - DNA, 21 bp, Homo sapiens
ggcaggtgggtctctgttgct

SEQ ID NO: 7844077 - DNA, 22 bp, Homo sapiens
ggcaggtgggaaccctccccac

SEQ ID NO: 7844078 - DNA, 22 bp, Homo sapiens
ggcaggtgggaaccctccccac

SEQ ID NO: 7844079 - DNA, 22 bp, Homo sapiens
ggcaggtggtaaggatttcata

SEQ ID NO: 7844080 - DNA, 22 bp, Homo sapiens
ggcaggtggtaaggatttcata

SEQ ID NO: 7844081 - DNA, 22 bp, Homo sapiens
ggcaggtgtgagatcgaggcca

SEQ ID NO: 7844082 - DNA, 22 bp, Homo sapiens
ggcaggtgtgagatcgaggcca

SEQ ID NO: 7844083 - DNA, 22 bp, Homo sapiens
ggcaggtgtgagatcgaggcca

SEQ ID NO: 7844084 - DNA, 22 bp, Homo sapiens
ggcagtcacttttgcttgtgcc

SEQ ID NO: 7844085 - DNA, 22 bp, Homo sapiens
ggcagtcacttttgcttgtgcc

SEQ ID NO: 7844086 - DNA, 22 bp, Homo sapiens
ggcagtcccagcccagaggcgc

SEQ ID NO: 7844087 - DNA, 22 bp, Homo sapiens
ggcagtcccagcccagaggcgc

SEQ ID NO: 7844088 - DNA, 22 bp, Homo sapiens
ggcagtcccaggctgcatgttg

SEQ ID NO: 7844089 - DNA, 22 bp, Homo sapiens
ggcagtcccagcccagaggcgc

SEQ ID NO: 7844090 - DNA, 22 bp, Homo sapiens
ggcagtcatttaatccctgcat

SEQ ID NO: 7844091 - DNA, 22 bp, Homo sapiens
ggcagtcagtgtggttcataaa

SEQ ID NO: 7844092 - DNA, 22 bp, Homo sapiens
ggcagtcagtttggagatggat

SEQ ID NO: 7844093 - DNA, 22 bp, Homo sapiens
ggcagtcatcccacttggaacc

SEQ ID NO: 7844094 - DNA, 22 bp, Homo sapiens
ggcagtcagtttggagatggat

SEQ ID NO: 7844095 - DNA, 22 bp, Homo sapiens
ggcagtcagtttggagatggat

SEQ ID NO: 7844096 - DNA, 22 bp, Homo sapiens
ggcatgggccgaggtgcctcct

SEQ ID NO: 7844097 - DNA, 22 bp, Homo sapiens
ggcatgggccgaggtgcctcct

SEQ ID NO: 7844098 - DNA, 22 bp, Homo sapiens
ggcatgggccgaggtgcctcct

SEQ ID NO: 7844099 - DNA, 22 bp, Homo sapiens
ggcatgggccgaggtgcctcct

SEQ ID NO: 7844100 - DNA, 22 bp, Homo sapiens
ggcatggggtgtatgtggcacg

SEQ ID NO: 7844101 - DNA, 22 bp, Homo sapiens
ggcatggggtgtatgtggcacg

SEQ ID NO: 7844102 - DNA, 19 bp, Homo sapiens
ggcatggggtccggggacc

SEQ ID NO: 7844103 - DNA, 19 bp, Homo sapiens
ggcatggggtccggggacc

SEQ ID NO: 7844104 - DNA, 22 bp, Homo sapiens
ggcatggggtgtatgtggcacg

SEQ ID NO: 7844105 - DNA, 22 bp, Homo sapiens
ggcatggggtgtatgtggcacg

SEQ ID NO: 7844106 - DNA, 22 bp, Homo sapiens
ggcatggggtgtatgtggcacg

SEQ ID NO: 7844107 - DNA, 21 bp, Homo sapiens
ggcatggcacctctgggcagg

SEQ ID NO: 7844108 - DNA, 21 bp, Homo sapiens
ggcatggcacctctgggcagg

SEQ ID NO: 7844109 - DNA, 22 bp, Homo sapiens
ggcatggcctgtaagacggaga

SEQ ID NO: 7844110 - DNA, 22 bp, Homo sapiens
ggcatggctcggagtcagaaca

SEQ ID NO: 7844111 - DNA, 22 bp, Homo sapiens
ggcatggctcggagtcagaaca

SEQ ID NO: 7844112 - DNA, 22 bp, Homo sapiens
ggcatggcctgtaagacggaga

SEQ ID NO: 7844113 - DNA, 22 bp, Homo sapiens
ggcatggctgggttctggtgag

SEQ ID NO: 7844114 - DNA, 22 bp, Homo sapiens
ggcatggctgttggggatagag

SEQ ID NO: 7844115 - DNA, 22 bp, Homo sapiens
ggcatgggccgaggtgcctcct

SEQ ID NO: 7844116 - DNA, 22 bp, Homo sapiens
ggcatggctgttggggatagag

SEQ ID NO: 7844117 - DNA, 22 bp, Homo sapiens
ggcatgggagtgagcaacctta

SEQ ID NO: 7844118 - DNA, 22 bp, Homo sapiens
ggcatgggagtgagcaacctta

SEQ ID NO: 7844119 - DNA, 22 bp, Homo sapiens
ggcagtgaaaaagtatgtttcc

SEQ ID NO: 7844120 - DNA, 22 bp, Homo sapiens
ggcagtgaacagaaatgcagaa

SEQ ID NO: 7844121 - DNA, 22 bp, Homo sapiens
ggcagtgaacagaaatgcagaa

SEQ ID NO: 7844122 - DNA, 22 bp, Homo sapiens
ggcagtgaacagaaatgcagaa

SEQ ID NO: 7844123 - DNA, 22 bp, Homo sapiens
ggcagtcttatcagcattggac

SEQ ID NO: 7844124 - DNA, 22 bp, Homo sapiens
ggcagtctcctgccctctaacc

SEQ ID NO: 7844125 - DNA, 22 bp, Homo sapiens
ggcagtctgcaatttcattagc

SEQ ID NO: 7844126 - DNA, 22 bp, Homo sapiens
ggcagtccccatttggtgtttt

SEQ ID NO: 7844127 - DNA, 22 bp, Homo sapiens
ggcagtcccaggctgcatgttg

SEQ ID NO: 7844128 - DNA, 22 bp, Homo sapiens
ggcagtctagctaggatgtcac

SEQ ID NO: 7844129 - DNA, 19 bp, Homo sapiens
ggcagtctcaagcagcaca

SEQ ID NO: 7844130 - DNA, 22 bp, Homo sapiens
ggcagtctagtgtccttgggcc

SEQ ID NO: 7844131 - DNA, 22 bp, Homo sapiens
ggcagtgaatgaaacagaggct

SEQ ID NO: 7844132 - DNA, 22 bp, Homo sapiens
ggcagtgaatctgagagcctgg

SEQ ID NO: 7844133 - DNA, 22 bp, Homo sapiens
ggcagtgaatgaaacagaggct

SEQ ID NO: 7844134 - DNA, 22 bp, Homo sapiens
ggcagtgaatctgagagcctgg

SEQ ID NO: 7844135 - DNA, 22 bp, Homo sapiens
ggcagtgaatctgagagcctgg

SEQ ID NO: 7844136 - DNA, 22 bp, Homo sapiens
ggcagtgaacagaaatgcagaa

SEQ ID NO: 7844137 - DNA, 22 bp, Homo sapiens
ggcagtgaatctgagagcctgg

SEQ ID NO: 7844138 - DNA, 22 bp, Homo sapiens
ggcagtgaatgaaacagaggct

SEQ ID NO: 7844139 - DNA, 22 bp, Homo sapiens
ggcatggacgtctctgaggcca

SEQ ID NO: 7844140 - DNA, 22 bp, Homo sapiens
ggcatggacgtctctgaggcca

SEQ ID NO: 7844141 - DNA, 22 bp, Homo sapiens
ggcagtgaatgaaacagaggct

SEQ ID NO: 7844142 - DNA, 21 bp, Homo sapiens
ggcatggcacctctgggcagg

SEQ ID NO: 7844143 - DNA, 22 bp, Homo sapiens
ggcatggacgtctctgaggcca

SEQ ID NO: 7844144 - DNA, 20 bp, Homo sapiens
ggcatggcaaatgttcttgc

SEQ ID NO: 7844145 - DNA, 22 bp, Homo sapiens
ggccaggttgggtggaagtggc

SEQ ID NO: 7844146 - DNA, 22 bp, Homo sapiens
ggccagtcccctaatccagggc

SEQ ID NO: 7844147 - DNA, 22 bp, Homo sapiens
ggccagtcccctaatccagggc

SEQ ID NO: 7844148 - DNA, 22 bp, Homo sapiens
ggccagtcccctaatccagggc

SEQ ID NO: 7844149 - DNA, 22 bp, Homo sapiens
ggccagtctgggccacggtcgg

SEQ ID NO: 7844150 - DNA, 22 bp, Homo sapiens
ggccagtcccctaatccagggc

SEQ ID NO: 7844151 - DNA, 22 bp, Homo sapiens
ggccagtctgggccacggtcgg

SEQ ID NO: 7844152 - DNA, 22 bp, Homo sapiens
ggccagtgtgcaggtcagagat

SEQ ID NO: 7844153 - DNA, 22 bp, Homo sapiens
ggccagtgtgcaggtcagagat

SEQ ID NO: 7844154 - DNA, 22 bp, Homo sapiens
ggccagtggctctgtgcttggg

SEQ ID NO: 7844155 - DNA, 22 bp, Homo sapiens
ggccagtggctctgtgcttggg

SEQ ID NO: 7844156 - DNA, 22 bp, Homo sapiens
ggccagtggctctgtgcttggg

SEQ ID NO: 7844157 - DNA, 22 bp, Homo sapiens
ggccagtggctctgtgcttggg

SEQ ID NO: 7844158 - DNA, 22 bp, Homo sapiens
ggccagtggctctgtgcttggg

SEQ ID NO: 7844159 - DNA, 22 bp, Homo sapiens
ggccagtgtgcaggtcagagat

SEQ ID NO: 7844160 - DNA, 22 bp, Homo sapiens
ggccagtttccatgcactattt

SEQ ID NO: 7844161 - DNA, 21 bp, Homo sapiens
ggccatcctgggaagggctgc

SEQ ID NO: 7844162 - DNA, 19 bp, Homo sapiens
ggccatctctgccccagca

SEQ ID NO: 7844163 - DNA, 22 bp, Homo sapiens
ggccagtgtgggagtagttctt

SEQ ID NO: 7844164 - DNA, 22 bp, Homo sapiens
ggccatgcaggtcagaggtggg

SEQ ID NO: 7844165 - DNA, 22 bp, Homo sapiens
ggccatgagaatgtgcaggtcc

SEQ ID NO: 7844166 - DNA, 22 bp, Homo sapiens
ggccatgagcagccctgtggga

SEQ ID NO: 7844167 - DNA, 21 bp, Homo sapiens
ggccatcctgggaagggctgc

SEQ ID NO: 7844168 - DNA, 22 bp, Homo sapiens
ggccatgagaatgtgcaggtcc

SEQ ID NO: 7844169 - DNA, 22 bp, Homo sapiens
ggccatgcctgtgggtgcaggc

SEQ ID NO: 7844170 - DNA, 22 bp, Homo sapiens
ggccatgccaggctgcctggga

SEQ ID NO: 7844171 - DNA, 22 bp, Homo sapiens
ggccagggggcttcagactcca

SEQ ID NO: 7844172 - DNA, 22 bp, Homo sapiens
ggccagggggcttcagactcca

SEQ ID NO: 7844173 - DNA, 22 bp, Homo sapiens
ggccagggggcttcagactcca

SEQ ID NO: 7844174 - DNA, 22 bp, Homo sapiens
ggccaggtaagagtgcagccgc

SEQ ID NO: 7844175 - DNA, 22 bp, Homo sapiens
ggccaggtaagagtgcagccgc

SEQ ID NO: 7844176 - DNA, 22 bp, Homo sapiens
ggccaggtccagtggaaggccc

SEQ ID NO: 7844177 - DNA, 22 bp, Homo sapiens
ggccaggtggctgtcctggcgt

SEQ ID NO: 7844178 - DNA, 22 bp, Homo sapiens
ggccaggtgcggtggctcacac

SEQ ID NO: 7844179 - DNA, 22 bp, Homo sapiens
ggccaggtggctgtcctggcgt

SEQ ID NO: 7844180 - DNA, 22 bp, Homo sapiens
ggccaggtgcggtggctcacac

SEQ ID NO: 7844181 - DNA, 22 bp, Homo sapiens
ggccaggtgcggtggctcacac

SEQ ID NO: 7844182 - DNA, 22 bp, Homo sapiens
ggccaggtgcggtggctcacac

SEQ ID NO: 7844183 - DNA, 23 bp, Homo sapiens
ggccaggtgcaccttagagagcc

SEQ ID NO: 7844184 - DNA, 23 bp, Homo sapiens
ggccaggtgcaccttagagagcc

SEQ ID NO: 7844185 - DNA, 22 bp, Homo sapiens
ggccagggggcttcagactcca

SEQ ID NO: 7844186 - DNA, 22 bp, Homo sapiens
ggccagggggcttcagactcca

SEQ ID NO: 7844187 - DNA, 22 bp, Homo sapiens
ggccagggggcttcagactcca

SEQ ID NO: 7844188 - DNA, 22 bp, Homo sapiens
ggccagggggcttcagactcca

SEQ ID NO: 7844189 - DNA, 22 bp, Homo sapiens
ggccagggcctggggactgtcc

SEQ ID NO: 7844190 - DNA, 22 bp, Homo sapiens
ggccagggcctggggactgtcc

SEQ ID NO: 7844191 - DNA, 22 bp, Homo sapiens
ggccagggggcttcagactcca

SEQ ID NO: 7844192 - DNA, 22 bp, Homo sapiens
ggccagggcctggggactgtcc

SEQ ID NO: 7844193 - DNA, 22 bp, Homo sapiens
ggccagggcctggggactgtcc

SEQ ID NO: 7844194 - DNA, 22 bp, Homo sapiens
ggccagggcctggggactgtcc

SEQ ID NO: 7844195 - DNA, 19 bp, Homo sapiens
ggccaggctgactgtggtc

SEQ ID NO: 7844196 - DNA, 19 bp, Homo sapiens
ggcatggtcggaagagctc

SEQ ID NO: 7844197 - DNA, 22 bp, Homo sapiens
ggcatggtctttgcttgcagga

SEQ ID NO: 7844198 - DNA, 20 bp, Homo sapiens
ggcatgggtggggctcccag

SEQ ID NO: 7844199 - DNA, 20 bp, Homo sapiens
ggcatgggtggggctcccag

SEQ ID NO: 7844200 - DNA, 20 bp, Homo sapiens
ggcatgggtggggctcccag

SEQ ID NO: 7844201 - DNA, 20 bp, Homo sapiens
ggcatgggtggggctcccag

SEQ ID NO: 7844202 - DNA, 18 bp, Homo sapiens
ggcatgtgagtgctgagg

SEQ ID NO: 7844203 - DNA, 22 bp, Homo sapiens
ggcatggtggtacacatctgta

SEQ ID NO: 7844204 - DNA, 22 bp, Homo sapiens
ggcatggtttaagtggtgggga

SEQ ID NO: 7844205 - DNA, 22 bp, Homo sapiens
ggcatgtgcctgaggtcacaca

SEQ ID NO: 7844206 - DNA, 22 bp, Homo sapiens
ggcatgtgcctgaggtcacaca

SEQ ID NO: 7844207 - DNA, 22 bp, Homo sapiens
ggccaaggctcttgagggctga

SEQ ID NO: 7844208 - DNA, 22 bp, Homo sapiens
ggccaaggctcttgagggctga

SEQ ID NO: 7844209 - DNA, 22 bp, Homo sapiens
ggccaaggctcttgagggctga

SEQ ID NO: 7844210 - DNA, 22 bp, Homo sapiens
ggccaaggctcttgagggctga

SEQ ID NO: 7844211 - DNA, 22 bp, Homo sapiens
ggccaaggtggagaaggcactg

SEQ ID NO: 7844212 - DNA, 22 bp, Homo sapiens
ggccaaggtggagaaggcactg

SEQ ID NO: 7844213 - DNA, 22 bp, Homo sapiens
ggccaaggtggagaaggcactg

SEQ ID NO: 7844214 - DNA, 22 bp, Homo sapiens
ggcatgtttcatcacatcaaga

SEQ ID NO: 7844215 - DNA, 22 bp, Homo sapiens
ggcattaactctgtttcaattt

SEQ ID NO: 7844216 - DNA, 22 bp, Homo sapiens
ggcattagcgttgaattttatt

SEQ ID NO: 7844217 - DNA, 20 bp, Homo sapiens
ggcattagattttaaatgtc

SEQ ID NO: 7844218 - DNA, 22 bp, Homo sapiens
ggccaaggatggtggctctggt

SEQ ID NO: 7844219 - DNA, 19 bp, Homo sapiens
ggccaggctgactgtggtc

SEQ ID NO: 7844220 - DNA, 19 bp, Homo sapiens
ggccaggctgactgtggtc

SEQ ID NO: 7844221 - DNA, 19 bp, Homo sapiens
ggccaggctgactgtggtc

SEQ ID NO: 7844222 - DNA, 19 bp, Homo sapiens
ggccaggctgactgtggtc

SEQ ID NO: 7844223 - DNA, 22 bp, Homo sapiens
ggccacagaacagctacaggac

SEQ ID NO: 7844224 - DNA, 17 bp, Homo sapiens
ggccacagagcttgggg

SEQ ID NO: 7844225 - DNA, 22 bp, Homo sapiens
ggccacagaacagctacaggac

SEQ ID NO: 7844226 - DNA, 22 bp, Homo sapiens
ggccacagaacagctacaggac

SEQ ID NO: 7844227 - DNA, 22 bp, Homo sapiens
ggccacagaacagctacaggac

SEQ ID NO: 7844228 - DNA, 22 bp, Homo sapiens
ggccacagaacagctacaggac

SEQ ID NO: 7844229 - DNA, 22 bp, Homo sapiens
ggccacagaacagctacaggac

SEQ ID NO: 7844230 - DNA, 22 bp, Homo sapiens
ggccacagaacagctacaggac

SEQ ID NO: 7844231 - DNA, 22 bp, Homo sapiens
ggccacagaacagctacaggac

SEQ ID NO: 7844232 - DNA, 22 bp, Homo sapiens
ggccaaggtgttctgatatgcc

SEQ ID NO: 7844233 - DNA, 22 bp, Homo sapiens
ggccaaggtgttctgatatgcc

SEQ ID NO: 7844234 - DNA, 22 bp, Homo sapiens
ggccaaggtgttctgatatgcc

SEQ ID NO: 7844235 - DNA, 22 bp, Homo sapiens
ggccaaggtggagaaggcactg

SEQ ID NO: 7844236 - DNA, 22 bp, Homo sapiens
ggccaaggtgttctgatatgcc

SEQ ID NO: 7844237 - DNA, 22 bp, Homo sapiens
ggccaattccaggagccggcgg

SEQ ID NO: 7844238 - DNA, 22 bp, Homo sapiens
ggccaatgggaatggccagtag

SEQ ID NO: 7844239 - DNA, 22 bp, Homo sapiens
ggccaattccaggagccggcgg

SEQ ID NO: 7844240 - DNA, 21 bp, Homo sapiens
ggccacaagcggaggagccgc

SEQ ID NO: 7844241 - DNA, 21 bp, Homo sapiens
ggccacaagcggaggagccgc

SEQ ID NO: 7844242 - DNA, 22 bp, Homo sapiens
ggcctcagggtcactctgtaga

SEQ ID NO: 7844243 - DNA, 22 bp, Homo sapiens
ggcctcagggtcactctgtaga

SEQ ID NO: 7844244 - DNA, 22 bp, Homo sapiens
ggcctcagggtcactctgtaga

SEQ ID NO: 7844245 - DNA, 22 bp, Homo sapiens
ggcctcagggtcactctgtaga

SEQ ID NO: 7844246 - DNA, 22 bp, Homo sapiens
ggcctcagggttgggcccatta

SEQ ID NO: 7844247 - DNA, 22 bp, Homo sapiens
ggcctcagggttgggcccatta

SEQ ID NO: 7844248 - DNA, 22 bp, Homo sapiens
ggcctcagggttgggcccatta

SEQ ID NO: 7844249 - DNA, 22 bp, Homo sapiens
ggcctcagggtcactctgtaga

SEQ ID NO: 7844250 - DNA, 23 bp, Homo sapiens
ggcctcagcgcacagaaactgct

SEQ ID NO: 7844251 - DNA, 23 bp, Homo sapiens
ggcctcagcgcacagaaactgct

SEQ ID NO: 7844252 - DNA, 22 bp, Homo sapiens
ggcctcagggtcactctgtaga

SEQ ID NO: 7844253 - DNA, 22 bp, Homo sapiens
ggcctcagggtcactctgtaga

SEQ ID NO: 7844254 - DNA, 18 bp, Homo sapiens
ggcctcagcctggccgga

SEQ ID NO: 7844255 - DNA, 18 bp, Homo sapiens
ggcctcagcctggccgga

SEQ ID NO: 7844256 - DNA, 18 bp, Homo sapiens
ggcctcagcctggccgga

SEQ ID NO: 7844257 - DNA, 18 bp, Homo sapiens
ggcctcagcctggccgga

SEQ ID NO: 7844258 - DNA, 18 bp, Homo sapiens
ggcctcagcctggccgga

SEQ ID NO: 7844259 - DNA, 21 bp, Homo sapiens
ggcctcagccacctggctctg

SEQ ID NO: 7844260 - DNA, 21 bp, Homo sapiens
ggcctcagccacctggctctg

SEQ ID NO: 7844261 - DNA, 21 bp, Homo sapiens
ggcctcagccacctggctctg

SEQ ID NO: 7844262 - DNA, 21 bp, Homo sapiens
ggcctcagccacctggctctg

SEQ ID NO: 7844263 - DNA, 21 bp, Homo sapiens
ggcctcagccacctggctctg

SEQ ID NO: 7844264 - DNA, 21 bp, Homo sapiens
ggcctcagccacctggctctg

SEQ ID NO: 7844265 - DNA, 21 bp, Homo sapiens
ggcctcagccacctggctctg

SEQ ID NO: 7844266 - DNA, 22 bp, Homo sapiens
ggcctcagaggaggtgtgagtc

SEQ ID NO: 7844267 - DNA, 22 bp, Homo sapiens
ggcctcagaggaggtgtgagtc

SEQ ID NO: 7844268 - DNA, 22 bp, Homo sapiens
ggcctcagaggaggtgtgagtc

SEQ ID NO: 7844269 - DNA, 22 bp, Homo sapiens
ggccatggaccccgagctgacc

SEQ ID NO: 7844270 - DNA, 23 bp, Homo sapiens
ggccatggagacttagaatgggc

SEQ ID NO: 7844271 - DNA, 22 bp, Homo sapiens
ggccatggaccccgagctgacc

SEQ ID NO: 7844272 - DNA, 23 bp, Homo sapiens
ggccatggagacttagaatgggc

SEQ ID NO: 7844273 - DNA, 22 bp, Homo sapiens
ggccatgctgttgcctgctggt

SEQ ID NO: 7844274 - DNA, 22 bp, Homo sapiens
ggccatgctgttgcctgctggt

SEQ ID NO: 7844275 - DNA, 22 bp, Homo sapiens
ggccatggaccccgagctgacc

SEQ ID NO: 7844276 - DNA, 22 bp, Homo sapiens
ggcctcagagaaggctgtgcgg

SEQ ID NO: 7844277 - DNA, 22 bp, Homo sapiens
ggcctcagagaaggctgtgcgg

SEQ ID NO: 7844278 - DNA, 22 bp, Homo sapiens
ggcctcagagaaggctgtgcgg

SEQ ID NO: 7844279 - DNA, 22 bp, Homo sapiens
ggcctcagagaaggctgtgcgg

SEQ ID NO: 7844280 - DNA, 22 bp, Homo sapiens
ggcctcagagaaggctgtgcgg

SEQ ID NO: 7844281 - DNA, 22 bp, Homo sapiens
ggcctcagagaaggctgtgcgg

SEQ ID NO: 7844282 - DNA, 22 bp, Homo sapiens
ggcctcagagaaggctgtgcgg

SEQ ID NO: 7844283 - DNA, 22 bp, Homo sapiens
ggcctcagagaaggctgtgcgg

SEQ ID NO: 7844284 - DNA, 22 bp, Homo sapiens
ggcctcagaccggagctggcca

SEQ ID NO: 7844285 - DNA, 22 bp, Homo sapiens
ggcctcagaccggagctggcca

SEQ ID NO: 7844286 - DNA, 22 bp, Homo sapiens
ggcctcagaccggagctggcca

SEQ ID NO: 7844287 - DNA, 19 bp, Homo sapiens
ggccatggcgggggtcaca

SEQ ID NO: 7844288 - DNA, 22 bp, Homo sapiens
ggccatggcgggagccggcgtc

SEQ ID NO: 7844289 - DNA, 20 bp, Homo sapiens
ggcctcagtgtccttgtttg

SEQ ID NO: 7844290 - DNA, 22 bp, Homo sapiens
ggcctcagtttctccatgggtt

SEQ ID NO: 7844291 - DNA, 20 bp, Homo sapiens
ggcctcagtgtccttgtttg

SEQ ID NO: 7844292 - DNA, 22 bp, Homo sapiens
ggcctcagtttctccatgggtt

SEQ ID NO: 7844293 - DNA, 22 bp, Homo sapiens
ggcctcagtttctccatgggtt

SEQ ID NO: 7844294 - DNA, 22 bp, Homo sapiens
ggcctcagtttctccatgggtt

SEQ ID NO: 7844295 - DNA, 22 bp, Homo sapiens
ggcctcagtttctccatgggtt

SEQ ID NO: 7844296 - DNA, 22 bp, Homo sapiens
ggcctcagtttctccatgggtt

SEQ ID NO: 7844297 - DNA, 22 bp, Homo sapiens
ggcctcagtttctccatgggtt

SEQ ID NO: 7844298 - DNA, 22 bp, Homo sapiens
ggcctcagtttcttcaactgta

SEQ ID NO: 7844299 - DNA, 22 bp, Homo sapiens
ggcctcagtttcttcaactgta

SEQ ID NO: 7844300 - DNA, 22 bp, Homo sapiens
ggcctcagtttcttcaactgta

SEQ ID NO: 7844301 - DNA, 22 bp, Homo sapiens
ggcctcagtttcttcaactgta

SEQ ID NO: 7844302 - DNA, 22 bp, Homo sapiens
ggcctcatcacagtgcattagt

SEQ ID NO: 7844303 - DNA, 22 bp, Homo sapiens
ggcctcagtttcttcaactgta

SEQ ID NO: 7844304 - DNA, 22 bp, Homo sapiens
ggcctcagtttcttcaactgta

SEQ ID NO: 7844305 - DNA, 22 bp, Homo sapiens
ggcctcagggttgggcccatta

SEQ ID NO: 7844306 - DNA, 22 bp, Homo sapiens
ggcctcagggttgggcccatta

SEQ ID NO: 7844307 - DNA, 22 bp, Homo sapiens
ggcctcagggttgggcccatta

SEQ ID NO: 7844308 - DNA, 22 bp, Homo sapiens
ggcctcagggttgggcccatta

SEQ ID NO: 7844309 - DNA, 23 bp, Homo sapiens
ggcctcagtgatgatgggttaaa

SEQ ID NO: 7844310 - DNA, 22 bp, Homo sapiens
ggcctcagggttgggcccatta

SEQ ID NO: 7844311 - DNA, 22 bp, Homo sapiens
ggcctcagtgggccgctgcagg

SEQ ID NO: 7844312 - DNA, 22 bp, Homo sapiens
ggcctcagtgggccgctgcagg

SEQ ID NO: 7844313 - DNA, 23 bp, Homo sapiens
ggcctcagtgatgatgggttaaa

SEQ ID NO: 7844314 - DNA, 22 bp, Homo sapiens
ggcctcagtgggccgctgcagg

SEQ ID NO: 7844315 - DNA, 22 bp, Homo sapiens
ggcctcagtgggccgctgcagg

SEQ ID NO: 7844316 - DNA, 22 bp, Homo sapiens
ggcctcagtgggccgctgcagg

SEQ ID NO: 7844317 - DNA, 22 bp, Homo sapiens
ggcctcagtgggccgctgcagg

SEQ ID NO: 7844318 - DNA, 20 bp, Homo sapiens
ggcctcagtgtccttgtttg

SEQ ID NO: 7844319 - DNA, 22 bp, Homo sapiens
ggcctcagtgggccgctgcagg

SEQ ID NO: 7844320 - DNA, 22 bp, Homo sapiens
ggcctcagtgggccgctgcagg

SEQ ID NO: 7844321 - DNA, 22 bp, Homo sapiens
ggcctcagtgggccgctgcagg

SEQ ID NO: 7844322 - DNA, 22 bp, Homo sapiens
ggcctcagtgggccgctgcagg

SEQ ID NO: 7844323 - DNA, 22 bp, Homo sapiens
ggcctctggttcgtggtgacct

SEQ ID NO: 7844324 - DNA, 22 bp, Homo sapiens
ggcctctggttcgtggtgacct

SEQ ID NO: 7844325 - DNA, 22 bp, Homo sapiens
ggcctctggttcgtggtgacct

SEQ ID NO: 7844326 - DNA, 22 bp, Homo sapiens
ggcctctggttcacagggagga

SEQ ID NO: 7844327 - DNA, 22 bp, Homo sapiens
ggcctctggttcacagggagga

SEQ ID NO: 7844328 - DNA, 22 bp, Homo sapiens
ggcctctggttcacagggagga

SEQ ID NO: 7844329 - DNA, 22 bp, Homo sapiens
ggcctctggttcgtggtgacct

SEQ ID NO: 7844330 - DNA, 21 bp, Homo sapiens
ggcctctgtcatcctgggaag

SEQ ID NO: 7844331 - DNA, 21 bp, Homo sapiens
ggcctctgtcatcctgggaag

SEQ ID NO: 7844332 - DNA, 21 bp, Homo sapiens
ggcctctgtcatcctgggaag

SEQ ID NO: 7844333 - DNA, 22 bp, Homo sapiens
ggcctctggttcgtggtgacct

SEQ ID NO: 7844334 - DNA, 23 bp, Homo sapiens
ggcctctgtgttctgcccacatg

SEQ ID NO: 7844335 - DNA, 23 bp, Homo sapiens
ggcctctgtgttctgcccacatg

SEQ ID NO: 7844336 - DNA, 22 bp, Homo sapiens
ggcctctgttctgcattcctcc

SEQ ID NO: 7844337 - DNA, 22 bp, Homo sapiens
ggcctctgtttggagccaggat

SEQ ID NO: 7844338 - DNA, 22 bp, Homo sapiens
ggcctctgtttggagccaggat

SEQ ID NO: 7844339 - DNA, 22 bp, Homo sapiens
ggcctctgttctgcattcctcc

SEQ ID NO: 7844340 - DNA, 23 bp, Homo sapiens
ggcctctgtgttctgcccacatg

SEQ ID NO: 7844341 - DNA, 22 bp, Homo sapiens
ggcctcttatctggctcctgca

SEQ ID NO: 7844342 - DNA, 22 bp, Homo sapiens
ggcctcttatctggctcctgca

SEQ ID NO: 7844343 - DNA, 22 bp, Homo sapiens
ggcctcttagagttaactgctt

SEQ ID NO: 7844344 - DNA, 22 bp, Homo sapiens
ggcctcttatctggctcctgca

SEQ ID NO: 7844345 - DNA, 22 bp, Homo sapiens
ggcctctgtttggagccaggat

SEQ ID NO: 7844346 - DNA, 22 bp, Homo sapiens
ggcctctgtttggagccaggat

SEQ ID NO: 7844347 - DNA, 22 bp, Homo sapiens
ggcctcttatctggctcctgca

SEQ ID NO: 7844348 - DNA, 22 bp, Homo sapiens
ggcctcttatctggctcctgca

SEQ ID NO: 7844349 - DNA, 21 bp, Homo sapiens
ggcctgaaaaagtgaatgctt

SEQ ID NO: 7844350 - DNA, 22 bp, Homo sapiens
ggcctgaaataaagtagcagaa

SEQ ID NO: 7844351 - DNA, 22 bp, Homo sapiens
ggcctgaaatagctctgaggtt

SEQ ID NO: 7844352 - DNA, 22 bp, Homo sapiens
ggcctgaatgcctgagtgtggg

SEQ ID NO: 7844353 - DNA, 22 bp, Homo sapiens
ggcctgaatgcctgagtgtggg

SEQ ID NO: 7844354 - DNA, 22 bp, Homo sapiens
ggcctgagaaccatggggccaa

SEQ ID NO: 7844355 - DNA, 22 bp, Homo sapiens
ggcctgagaaccatggggccaa

SEQ ID NO: 7844356 - DNA, 22 bp, Homo sapiens
ggcctgagaaccatggggccaa

SEQ ID NO: 7844357 - DNA, 22 bp, Homo sapiens
ggcctgagggtgggctctcagt

SEQ ID NO: 7844358 - DNA, 21 bp, Homo sapiens
ggcctgagtataggacaggcc

SEQ ID NO: 7844359 - DNA, 22 bp, Homo sapiens
ggcctgaggcgtcccagctgtg

SEQ ID NO: 7844360 - DNA, 22 bp, Homo sapiens
ggcctgaggcgtcccagctgtg

SEQ ID NO: 7844361 - DNA, 22 bp, Homo sapiens
ggcctgagggtgggctctcagt

SEQ ID NO: 7844362 - DNA, 22 bp, Homo sapiens
ggcctgagggtgggctctcagt

SEQ ID NO: 7844363 - DNA, 22 bp, Homo sapiens
ggcctgagggtgggctctcagt

SEQ ID NO: 7844364 - DNA, 21 bp, Homo sapiens
ggcctgagcacctgtccacct

SEQ ID NO: 7844365 - DNA, 21 bp, Homo sapiens
ggcctgagcacctgtccacct

SEQ ID NO: 7844366 - DNA, 21 bp, Homo sapiens
ggcctgagcacctgtccacct

SEQ ID NO: 7844367 - DNA, 22 bp, Homo sapiens
ggcctgagaatgtaccagatct

SEQ ID NO: 7844368 - DNA, 22 bp, Homo sapiens
ggcctgagaatgtaccagatct

SEQ ID NO: 7844369 - DNA, 22 bp, Homo sapiens
ggcctgagtcccacctggctgt

SEQ ID NO: 7844370 - DNA, 22 bp, Homo sapiens
ggcctgagtcccacctggctgt

SEQ ID NO: 7844371 - DNA, 22 bp, Homo sapiens
ggcctgagtcacatcaggagag

SEQ ID NO: 7844372 - DNA, 22 bp, Homo sapiens
ggcctgagtcacatcaggagag

SEQ ID NO: 7844373 - DNA, 22 bp, Homo sapiens
ggcctgagtcccacctggctgt

SEQ ID NO: 7844374 - DNA, 22 bp, Homo sapiens
ggcctgagtcccacctggctgt

SEQ ID NO: 7844375 - DNA, 22 bp, Homo sapiens
ggcctgagtcccacctggctgt

SEQ ID NO: 7844376 - DNA, 22 bp, Homo sapiens
ggcctgagtcacatcaggagag

SEQ ID NO: 7844377 - DNA, 22 bp, Homo sapiens
ggcctgagtcacatcaggagag

SEQ ID NO: 7844378 - DNA, 22 bp, Homo sapiens
ggcctgagtcacatcaggagag

SEQ ID NO: 7844379 - DNA, 22 bp, Homo sapiens
ggcctgagtcacatcaggagag

SEQ ID NO: 7844380 - DNA, 22 bp, Homo sapiens
ggcctgagtcacatcaggagag

SEQ ID NO: 7844381 - DNA, 21 bp, Homo sapiens
ggcctgagtataggacaggcc

SEQ ID NO: 7844382 - DNA, 21 bp, Homo sapiens
ggcctgagtataggacaggcc

SEQ ID NO: 7844383 - DNA, 21 bp, Homo sapiens
ggcctgagtataggacaggcc

SEQ ID NO: 7844384 - DNA, 21 bp, Homo sapiens
ggcctgagtataggacaggcc

SEQ ID NO: 7844385 - DNA, 21 bp, Homo sapiens
ggcctgagtataggacaggcc

SEQ ID NO: 7844386 - DNA, 21 bp, Homo sapiens
ggcctgagtataggacaggcc

SEQ ID NO: 7844387 - DNA, 21 bp, Homo sapiens
ggcctgagtataggacaggcc

SEQ ID NO: 7844388 - DNA, 17 bp, Homo sapiens
ggcctgcacctcctgct

SEQ ID NO: 7844389 - DNA, 17 bp, Homo sapiens
ggcctgcacctcctgct

SEQ ID NO: 7844390 - DNA, 18 bp, Homo sapiens
ggcctgcagtgaagcaag

SEQ ID NO: 7844391 - DNA, 20 bp, Homo sapiens
ggcctgcagctcccagcaag

SEQ ID NO: 7844392 - DNA, 22 bp, Homo sapiens
ggcctgcacagaggtggctcta

SEQ ID NO: 7844393 - DNA, 22 bp, Homo sapiens
ggcctgcacagaggtggctcta

SEQ ID NO: 7844394 - DNA, 17 bp, Homo sapiens
ggcctgcaagaacgaga

SEQ ID NO: 7844395 - DNA, 22 bp, Homo sapiens
ggcctgcacagaggtggctcta

SEQ ID NO: 7844396 - DNA, 22 bp, Homo sapiens
ggcctgcacagaggtggctcta

SEQ ID NO: 7844397 - DNA, 22 bp, Homo sapiens
ggccttgggatgtggctgcagc

SEQ ID NO: 7844398 - DNA, 18 bp, Homo sapiens
ggcctgcagtgaagcaag

SEQ ID NO: 7844399 - DNA, 19 bp, Homo sapiens
ggcctgcccaatgtctgct

SEQ ID NO: 7844400 - DNA, 22 bp, Homo sapiens
ggccttgggatgtggctgcagc

SEQ ID NO: 7844401 - DNA, 22 bp, Homo sapiens
ggcctttgcgtccacgccgctt

SEQ ID NO: 7844402 - DNA, 22 bp, Homo sapiens
ggcctttgcgtccacgccgctt

SEQ ID NO: 7844403 - DNA, 22 bp, Homo sapiens
ggcctttgctggccctcaggct

SEQ ID NO: 7844404 - DNA, 22 bp, Homo sapiens
ggcctttagtggttctggagtc

SEQ ID NO: 7844405 - DNA, 22 bp, Homo sapiens
ggcctttaagcaattgaaaaga

SEQ ID NO: 7844406 - DNA, 22 bp, Homo sapiens
ggccttggttctgtcacagccg

SEQ ID NO: 7844407 - DNA, 22 bp, Homo sapiens
ggccttggttctgtcacagccg

SEQ ID NO: 7844408 - DNA, 22 bp, Homo sapiens
ggccttggttctgtcacagccg

SEQ ID NO: 7844409 - DNA, 22 bp, Homo sapiens
ggccttggttctgtcacagccg

SEQ ID NO: 7844410 - DNA, 22 bp, Homo sapiens
ggccttggtggctttgctgatg

SEQ ID NO: 7844411 - DNA, 22 bp, Homo sapiens
ggccttggttccaaagcaggca

SEQ ID NO: 7844412 - DNA, 22 bp, Homo sapiens
ggccttggttccaaagcaggca

SEQ ID NO: 7844413 - DNA, 22 bp, Homo sapiens
ggccttggttccaaagcaggca

SEQ ID NO: 7844414 - DNA, 22 bp, Homo sapiens
ggcgagcagagcactgccagga

SEQ ID NO: 7844415 - DNA, 22 bp, Homo sapiens
ggcgagcagagccattgcctat

SEQ ID NO: 7844416 - DNA, 22 bp, Homo sapiens
ggcgagcagcgctgtgtcaggt

SEQ ID NO: 7844417 - DNA, 22 bp, Homo sapiens
ggcgagcagcgctgtgtcaggt

SEQ ID NO: 7844418 - DNA, 22 bp, Homo sapiens
ggcgagcagttcccagggaggt

SEQ ID NO: 7844419 - DNA, 22 bp, Homo sapiens
ggcgaggccgggacaggctgga

SEQ ID NO: 7844420 - DNA, 22 bp, Homo sapiens
ggcgaggccgggacaggctgga

SEQ ID NO: 7844421 - DNA, 22 bp, Homo sapiens
ggcgagcatgagtcactctggg

SEQ ID NO: 7844422 - DNA, 22 bp, Homo sapiens
ggcgagcatgagtcactctggg

SEQ ID NO: 7844423 - DNA, 22 bp, Homo sapiens
ggcgaggccgggacaggctgga

SEQ ID NO: 7844424 - DNA, 22 bp, Homo sapiens
ggcgctggccacggtggctctg

SEQ ID NO: 7844425 - DNA, 22 bp, Homo sapiens
ggcgctggtggtcttgcgagcg

SEQ ID NO: 7844426 - DNA, 22 bp, Homo sapiens
ggcgctggtggtcttgcgagcg

SEQ ID NO: 7844427 - DNA, 22 bp, Homo sapiens
ggcgctggccacggtggctctg

SEQ ID NO: 7844428 - DNA, 22 bp, Homo sapiens
ggccttggtaaagggatgcatg

SEQ ID NO: 7844429 - DNA, 22 bp, Homo sapiens
ggccttggtaaagggatgcatg

SEQ ID NO: 7844430 - DNA, 22 bp, Homo sapiens
ggccttggtaaagggatgcatg

SEQ ID NO: 7844431 - DNA, 22 bp, Homo sapiens
ggccttggtgccatggccagtt

SEQ ID NO: 7844432 - DNA, 22 bp, Homo sapiens
ggccttggtgccatggccagtt

SEQ ID NO: 7844433 - DNA, 22 bp, Homo sapiens
ggccttggtggctttgctgatg

SEQ ID NO: 7844434 - DNA, 22 bp, Homo sapiens
ggccttggggtggccttgtccc

SEQ ID NO: 7844435 - DNA, 22 bp, Homo sapiens
ggccttggggaggatggtgtcc

SEQ ID NO: 7844436 - DNA, 22 bp, Homo sapiens
ggccttgggtataggtgggtat

SEQ ID NO: 7844437 - DNA, 22 bp, Homo sapiens
ggccttgggcagacacgtcaca

SEQ ID NO: 7844438 - DNA, 22 bp, Homo sapiens
ggggctggctcactaagagact

SEQ ID NO: 7844439 - DNA, 22 bp, Homo sapiens
ggggctgggatttgaacccagg

SEQ ID NO: 7844440 - DNA, 22 bp, Homo sapiens
ggggctgggatttgaacccagg

SEQ ID NO: 7844441 - DNA, 22 bp, Homo sapiens
ggggctggctcactaagagact

SEQ ID NO: 7844442 - DNA, 22 bp, Homo sapiens
ggggctggctcactaagagact

SEQ ID NO: 7844443 - DNA, 22 bp, Homo sapiens
ggggctggctcactaagagact

SEQ ID NO: 7844444 - DNA, 22 bp, Homo sapiens
ggggctggctcactaagagact

SEQ ID NO: 7844445 - DNA, 22 bp, Homo sapiens
ggggctggctcactaagagact

SEQ ID NO: 7844446 - DNA, 22 bp, Homo sapiens
ggggctggctcactaagagact

SEQ ID NO: 7844447 - DNA, 22 bp, Homo sapiens
ggggctggctcactaagagact

SEQ ID NO: 7844448 - DNA, 22 bp, Homo sapiens
ggggctgctcgccgcgcgtttc

SEQ ID NO: 7844449 - DNA, 22 bp, Homo sapiens
ggggctgctggtatttccagtt

SEQ ID NO: 7844450 - DNA, 22 bp, Homo sapiens
ggggctgagtcagtgggaagag

SEQ ID NO: 7844451 - DNA, 22 bp, Homo sapiens
ggggctgatggaactcaggcct

SEQ ID NO: 7844452 - DNA, 22 bp, Homo sapiens
ggggctgatggaactcaggcct

SEQ ID NO: 7844453 - DNA, 22 bp, Homo sapiens
ggggctgatggaactcaggcct

SEQ ID NO: 7844454 - DNA, 22 bp, Homo sapiens
ggggctgagtcagtgggaagag

SEQ ID NO: 7844455 - DNA, 22 bp, Homo sapiens
ggggctgatggaactcaggcct

SEQ ID NO: 7844456 - DNA, 22 bp, Homo sapiens
ggggctgctcccacccctgagg

SEQ ID NO: 7844457 - DNA, 22 bp, Homo sapiens
ggggctcagttcggacagcctg

SEQ ID NO: 7844458 - DNA, 22 bp, Homo sapiens
ggggctcagttcggacagcctg

SEQ ID NO: 7844459 - DNA, 22 bp, Homo sapiens
ggggctcaggggaagtgtccag

SEQ ID NO: 7844460 - DNA, 22 bp, Homo sapiens
ggggctcaggggaagtgtccag

SEQ ID NO: 7844461 - DNA, 22 bp, Homo sapiens
ggggctccagtcttcacatttt

SEQ ID NO: 7844462 - DNA, 22 bp, Homo sapiens
ggggctctcaggtctccccaaa

SEQ ID NO: 7844463 - DNA, 22 bp, Homo sapiens
ggggctgacgggcatgtggctt

SEQ ID NO: 7844464 - DNA, 22 bp, Homo sapiens
ggggctgacgggcatgtggctt

SEQ ID NO: 7844465 - DNA, 22 bp, Homo sapiens
ggggctgaacctggaggtggtc

SEQ ID NO: 7844466 - DNA, 22 bp, Homo sapiens
ggggctgaacctggaggtggtc

SEQ ID NO: 7844467 - DNA, 22 bp, Homo sapiens
ggggctgacgggcatgtggctt

SEQ ID NO: 7844468 - DNA, 22 bp, Homo sapiens
ggggctctggagaaaggccagt

SEQ ID NO: 7844469 - DNA, 22 bp, Homo sapiens
ggggctctgctctgagccgtgt

SEQ ID NO: 7844470 - DNA, 22 bp, Homo sapiens
ggggctgaacctggaggtggtc

SEQ ID NO: 7844471 - DNA, 22 bp, Homo sapiens
ggggctcttagagagcctagtg

SEQ ID NO: 7844472 - DNA, 22 bp, Homo sapiens
ggggaaggatatgattagacta

SEQ ID NO: 7844473 - DNA, 22 bp, Homo sapiens
ggggaaggatatgattagacta

SEQ ID NO: 7844474 - DNA, 22 bp, Homo sapiens
ggggccgaccgcggttcaggcc

SEQ ID NO: 7844475 - DNA, 22 bp, Homo sapiens
ggggccgaccgcggttcaggcc

SEQ ID NO: 7844476 - DNA, 22 bp, Homo sapiens
ggggccgaccgcggttcaggcc

SEQ ID NO: 7844477 - DNA, 22 bp, Homo sapiens
ggggaaggattgagttgaccca

SEQ ID NO: 7844478 - DNA, 22 bp, Homo sapiens
ggggaaggaaagttattagcag

SEQ ID NO: 7844479 - DNA, 22 bp, Homo sapiens
ggggaaggatatgattagacta

SEQ ID NO: 7844480 - DNA, 22 bp, Homo sapiens
ggggaagatttttaattagtaa

SEQ ID NO: 7844481 - DNA, 22 bp, Homo sapiens
ggggaaggaaagttattagcag

SEQ ID NO: 7844482 - DNA, 22 bp, Homo sapiens
ggggaagatttttaattagtaa

SEQ ID NO: 7844483 - DNA, 22 bp, Homo sapiens
ggggaagatggccctccatgtg

SEQ ID NO: 7844484 - DNA, 22 bp, Homo sapiens
ggggaagatggccctccatgtg

SEQ ID NO: 7844485 - DNA, 22 bp, Homo sapiens
ggggccgaccgcggttcaggcc

SEQ ID NO: 7844486 - DNA, 22 bp, Homo sapiens
ggggcctccagcactaggcagc

SEQ ID NO: 7844487 - DNA, 22 bp, Homo sapiens
ggggccgaccgcggttcaggcc

SEQ ID NO: 7844488 - DNA, 22 bp, Homo sapiens
ggggccgaccgcggttcaggcc

SEQ ID NO: 7844489 - DNA, 22 bp, Homo sapiens
ggggccgaccgcggttcaggcc

SEQ ID NO: 7844490 - DNA, 22 bp, Homo sapiens
ggggccgaccgcggttcaggcc

SEQ ID NO: 7844491 - DNA, 22 bp, Homo sapiens
ggggctcacacctccctaaggg

SEQ ID NO: 7844492 - DNA, 22 bp, Homo sapiens
ggggctaactttctgagggtag

SEQ ID NO: 7844493 - DNA, 22 bp, Homo sapiens
ggggctcacacctccctaaggg

SEQ ID NO: 7844494 - DNA, 21 bp, Homo sapiens
ggggcgtggcctgccagttgc

SEQ ID NO: 7844495 - DNA, 22 bp, Homo sapiens
ggggcggggctctgagaagcat

SEQ ID NO: 7844496 - DNA, 22 bp, Homo sapiens
ggggcggggctctgagaagcat

SEQ ID NO: 7844497 - DNA, 22 bp, Homo sapiens
gggcttggtggagagaatgctg

SEQ ID NO: 7844498 - DNA, 22 bp, Homo sapiens
gggctttaacacccagtcaggg

SEQ ID NO: 7844499 - DNA, 22 bp, Homo sapiens
gggcttggtggagagaatgctg

SEQ ID NO: 7844500 - DNA, 22 bp, Homo sapiens
gggcttggtggagagaatgctg

SEQ ID NO: 7844501 - DNA, 22 bp, Homo sapiens
gggctttaatcttgttaactag

SEQ ID NO: 7844502 - DNA, 18 bp, Homo sapiens
gggctttacagagtggag

SEQ ID NO: 7844503 - DNA, 19 bp, Homo sapiens
gggctttactccaagtggg

SEQ ID NO: 7844504 - DNA, 22 bp, Homo sapiens
gggctttagattgcagaggatt

SEQ ID NO: 7844505 - DNA, 22 bp, Homo sapiens
ggggaagaatggcagaaaacat

SEQ ID NO: 7844506 - DNA, 22 bp, Homo sapiens
ggggaagaatggcagaaaacat

SEQ ID NO: 7844507 - DNA, 22 bp, Homo sapiens
ggggaagaatgctctctagaga

SEQ ID NO: 7844508 - DNA, 22 bp, Homo sapiens
ggggaagaatggcagaaaacat

SEQ ID NO: 7844509 - DNA, 22 bp, Homo sapiens
gggctttaggggccagtgacca

SEQ ID NO: 7844510 - DNA, 17 bp, Homo sapiens
gggctttaggtggtgta

SEQ ID NO: 7844511 - DNA, 22 bp, Homo sapiens
ggggaagaggcgtgatggatcc

SEQ ID NO: 7844512 - DNA, 22 bp, Homo sapiens
ggggaagaggcgtgatggatcc

SEQ ID NO: 7844513 - DNA, 22 bp, Homo sapiens
ggggaagatggccctccatgtg

SEQ ID NO: 7844514 - DNA, 22 bp, Homo sapiens
ggggaagatggccctccatgtg

SEQ ID NO: 7844515 - DNA, 22 bp, Homo sapiens
ggggaagatggccctccatgtg

SEQ ID NO: 7844516 - DNA, 22 bp, Homo sapiens
ggggaagagcattgcacggtgt

SEQ ID NO: 7844517 - DNA, 22 bp, Homo sapiens
ggggaagacctggcactacagc

SEQ ID NO: 7844518 - DNA, 22 bp, Homo sapiens
ggggaagaatggcagaaaacat

SEQ ID NO: 7844519 - DNA, 22 bp, Homo sapiens
ggggaagacctggcactacagc

SEQ ID NO: 7844520 - DNA, 22 bp, Homo sapiens
ggggaagaggcgtgatggatcc

SEQ ID NO: 7844521 - DNA, 22 bp, Homo sapiens
ggggaagaggcgtgatggatcc

SEQ ID NO: 7844522 - DNA, 22 bp, Homo sapiens
ggggaagagcattgcacggtgt

SEQ ID NO: 7844523 - DNA, 22 bp, Homo sapiens
gggtggagcttggacaccagta

SEQ ID NO: 7844524 - DNA, 22 bp, Homo sapiens
gggtggagcttggacaccagta

SEQ ID NO: 7844525 - DNA, 22 bp, Homo sapiens
gggtggagcttggacaccagta

SEQ ID NO: 7844526 - DNA, 22 bp, Homo sapiens
gggtagtgtggtctctgggctg

SEQ ID NO: 7844527 - DNA, 22 bp, Homo sapiens
gggtggagcctgagaatttgca

SEQ ID NO: 7844528 - DNA, 22 bp, Homo sapiens
gggtggaggagaacaggcccca

SEQ ID NO: 7844529 - DNA, 22 bp, Homo sapiens
gggtggagcttggacaccagta

SEQ ID NO: 7844530 - DNA, 22 bp, Homo sapiens
gggtggaggagaacaggcccca

SEQ ID NO: 7844531 - DNA, 22 bp, Homo sapiens
gggtggaggagaacaggcccca

SEQ ID NO: 7844532 - DNA, 20 bp, Homo sapiens
gggtggagttgcggtctgtg

SEQ ID NO: 7844533 - DNA, 20 bp, Homo sapiens
gggtggagttgcggtctgtg

SEQ ID NO: 7844534 - DNA, 20 bp, Homo sapiens
gggtggagttgcggtctgtg

SEQ ID NO: 7844535 - DNA, 20 bp, Homo sapiens
gggtggagttgcggtctgtg

SEQ ID NO: 7844536 - DNA, 22 bp, Homo sapiens
gggtggagtgtgaaatctggct

SEQ ID NO: 7844537 - DNA, 22 bp, Homo sapiens
gggtggagtagaaagatgaatt

SEQ ID NO: 7844538 - DNA, 22 bp, Homo sapiens
gggtggagtagaaagatgaatt

SEQ ID NO: 7844539 - DNA, 22 bp, Homo sapiens
gggtggagtgtgaaatctggct

SEQ ID NO: 7844540 - DNA, 22 bp, Homo sapiens
gggtggagtgtgaaatctggct

SEQ ID NO: 7844541 - DNA, 22 bp, Homo sapiens
gggtggagtgtgaaatctggct

SEQ ID NO: 7844542 - DNA, 22 bp, Homo sapiens
gggtggagtagaaagatgaatt

SEQ ID NO: 7844543 - DNA, 22 bp, Homo sapiens
gggtggagtagaaagatgaatt

SEQ ID NO: 7844544 - DNA, 22 bp, Homo sapiens
gggtggagtagaaagatgaatt

SEQ ID NO: 7844545 - DNA, 22 bp, Homo sapiens
gggtggagtagaaagatgaatt

SEQ ID NO: 7844546 - DNA, 22 bp, Homo sapiens
gggtggaggtgggttttgagat

SEQ ID NO: 7844547 - DNA, 22 bp, Homo sapiens
gggtggaggtgggttttgagat

SEQ ID NO: 7844548 - DNA, 22 bp, Homo sapiens
gggtggaggtgggttttgagat

SEQ ID NO: 7844549 - DNA, 22 bp, Homo sapiens
gggtaggcagtgcgtcctgcct

SEQ ID NO: 7844550 - DNA, 22 bp, Homo sapiens
gggtaggcagtgcgtcctgcct

SEQ ID NO: 7844551 - DNA, 22 bp, Homo sapiens
gggtaggcaaagcaatgacgtt

SEQ ID NO: 7844552 - DNA, 22 bp, Homo sapiens
gggtaggcaaagcaatgacgtt

SEQ ID NO: 7844553 - DNA, 22 bp, Homo sapiens
gggtaggatggtagaagggacc

SEQ ID NO: 7844554 - DNA, 22 bp, Homo sapiens
gggtaggatggtagaagggacc

SEQ ID NO: 7844555 - DNA, 22 bp, Homo sapiens
gggtaggatggtagaagggacc

SEQ ID NO: 7844556 - DNA, 22 bp, Homo sapiens
gggtaggatggtagaagggacc

SEQ ID NO: 7844557 - DNA, 22 bp, Homo sapiens
gggtaggagaggtgtctgtgtg

SEQ ID NO: 7844558 - DNA, 22 bp, Homo sapiens
gggtaggaaatccagaggtggc

SEQ ID NO: 7844559 - DNA, 22 bp, Homo sapiens
gggtaggaaatccagaggtggc

SEQ ID NO: 7844560 - DNA, 22 bp, Homo sapiens
gggtagggtgacttaggctggc

SEQ ID NO: 7844561 - DNA, 22 bp, Homo sapiens
gggtagggtgacttaggctggc

SEQ ID NO: 7844562 - DNA, 22 bp, Homo sapiens
gggtagggtgacttaggctggc

SEQ ID NO: 7844563 - DNA, 22 bp, Homo sapiens
gggtaggctgctcctggggccc

SEQ ID NO: 7844564 - DNA, 22 bp, Homo sapiens
gggtaggctgctcctggggccc

SEQ ID NO: 7844565 - DNA, 22 bp, Homo sapiens
gggtaggctgctcctggggccc

SEQ ID NO: 7844566 - DNA, 22 bp, Homo sapiens
gggtagggtgacttaggctggc

SEQ ID NO: 7844567 - DNA, 22 bp, Homo sapiens
gggtagggtgacttaggctggc

SEQ ID NO: 7844568 - DNA, 22 bp, Homo sapiens
gggtaggctctgcaggctgggt

SEQ ID NO: 7844569 - DNA, 22 bp, Homo sapiens
gggtaggctctgcaggctgggt

SEQ ID NO: 7844570 - DNA, 22 bp, Homo sapiens
gggtaggctctgcaggctgggt

SEQ ID NO: 7844571 - DNA, 22 bp, Homo sapiens
gggtaggctgctcctggggccc

SEQ ID NO: 7844572 - DNA, 22 bp, Homo sapiens
gggtaggctctgcaggctgggt

SEQ ID NO: 7844573 - DNA, 22 bp, Homo sapiens
gggtaggccgtgggtcaccagg

SEQ ID NO: 7844574 - DNA, 22 bp, Homo sapiens
gggtaggcccctcttgcttggg

SEQ ID NO: 7844575 - DNA, 22 bp, Homo sapiens
gggtaggcccctcttgcttggg

SEQ ID NO: 7844576 - DNA, 22 bp, Homo sapiens
gggtaggccagaagggcctgga

SEQ ID NO: 7844577 - DNA, 22 bp, Homo sapiens
gggtaggccagaagggcctgga

SEQ ID NO: 7844578 - DNA, 22 bp, Homo sapiens
gggtaggcagtgcgtcctgcct

SEQ ID NO: 7844579 - DNA, 22 bp, Homo sapiens
ggggtgggcgtgcagggacacc

SEQ ID NO: 7844580 - DNA, 22 bp, Homo sapiens
ggggtgggcgtgcagggacacc

SEQ ID NO: 7844581 - DNA, 22 bp, Homo sapiens
ggggtgggcgtgcagggacacc

SEQ ID NO: 7844582 - DNA, 22 bp, Homo sapiens
ggggtgggcgtgcagggacacc

SEQ ID NO: 7844583 - DNA, 22 bp, Homo sapiens
ggggtgggcgtgcagggacacc

SEQ ID NO: 7844584 - DNA, 22 bp, Homo sapiens
ggggtgggcgtgcagggacacc

SEQ ID NO: 7844585 - DNA, 22 bp, Homo sapiens
ggggctggtggtggtttctcca

SEQ ID NO: 7844586 - DNA, 22 bp, Homo sapiens
ggggctggtggtggtttctcca

SEQ ID NO: 7844587 - DNA, 22 bp, Homo sapiens
ggggtgggcgtgcagggacacc

SEQ ID NO: 7844588 - DNA, 22 bp, Homo sapiens
ggggtgggcgtgcagggacacc

SEQ ID NO: 7844589 - DNA, 22 bp, Homo sapiens
ggggctggtggtggtttctcca

SEQ ID NO: 7844590 - DNA, 22 bp, Homo sapiens
ggggctggtggtggtttctcca

SEQ ID NO: 7844591 - DNA, 22 bp, Homo sapiens
ggggctgggatttgaacccagg

SEQ ID NO: 7844592 - DNA, 22 bp, Homo sapiens
ggggctggtggtggtttctcca

SEQ ID NO: 7844593 - DNA, 22 bp, Homo sapiens
ggggctgggatttgaacccagg

SEQ ID NO: 7844594 - DNA, 22 bp, Homo sapiens
ggggctgggatttgaacccagg

SEQ ID NO: 7844595 - DNA, 22 bp, Homo sapiens
ggggtgggcgtgcagggacacc

SEQ ID NO: 7844596 - DNA, 22 bp, Homo sapiens
ggggtgggcgtgcagggacacc

SEQ ID NO: 7844597 - DNA, 22 bp, Homo sapiens
ggggtgggcgtgcagggacacc

SEQ ID NO: 7844598 - DNA, 22 bp, Homo sapiens
ggggtgggcgtgcagggacacc

SEQ ID NO: 7844599 - DNA, 22 bp, Homo sapiens
ggggtgggcgtgcagggacacc

SEQ ID NO: 7844600 - DNA, 22 bp, Homo sapiens
ggggtgggcgtgcagggacacc

SEQ ID NO: 7844601 - DNA, 22 bp, Homo sapiens
ggggtgggcgtgcagggacacc

SEQ ID NO: 7844602 - DNA, 22 bp, Homo sapiens
ggggtgggcgtgcagggacacc

SEQ ID NO: 7844603 - DNA, 22 bp, Homo sapiens
ggggtgggcgtgcagggacacc

SEQ ID NO: 7844604 - DNA, 22 bp, Homo sapiens
ggggtgggcgtgcagggacacc

SEQ ID NO: 7844605 - DNA, 22 bp, Homo sapiens
ggggtgggcgtgcagggacacc

SEQ ID NO: 7844606 - DNA, 22 bp, Homo sapiens
ggggtgggcgtgcagggacacc

SEQ ID NO: 7844607 - DNA, 21 bp, Homo sapiens
ggggttggcaagagcagagac

SEQ ID NO: 7844608 - DNA, 21 bp, Homo sapiens
ggggttggcaagagcagagac

SEQ ID NO: 7844609 - DNA, 22 bp, Homo sapiens
gggtaggaaatccagaggtggc

SEQ ID NO: 7844610 - DNA, 21 bp, Homo sapiens
ggggttggcaagagcagagac

SEQ ID NO: 7844611 - DNA, 21 bp, Homo sapiens
ggggttggcaagagcagagac

SEQ ID NO: 7844612 - DNA, 22 bp, Homo sapiens
ggggtgtggacggctgtgccag

SEQ ID NO: 7844613 - DNA, 22 bp, Homo sapiens
ggggtgtggacggctgtgccag

SEQ ID NO: 7844614 - DNA, 22 bp, Homo sapiens
ggggtggggttactcattgtgc

SEQ ID NO: 7844615 - DNA, 22 bp, Homo sapiens
ggggtggggttactcattgtgc

SEQ ID NO: 7844616 - DNA, 22 bp, Homo sapiens
ggggtggggttactcattgtgc

SEQ ID NO: 7844617 - DNA, 22 bp, Homo sapiens
ggggtggggttactcattgtgc

SEQ ID NO: 7844618 - DNA, 22 bp, Homo sapiens
ggggtgggcgtgcagggacacc

SEQ ID NO: 7844619 - DNA, 22 bp, Homo sapiens
ggggtgggcgtgcagggacacc

SEQ ID NO: 7844620 - DNA, 22 bp, Homo sapiens
ggggtgtgagtagagctgggga

SEQ ID NO: 7844621 - DNA, 22 bp, Homo sapiens
ggggtgtgagtagagctgggga

SEQ ID NO: 7844622 - DNA, 22 bp, Homo sapiens
ggggtgtgagtagagctgggga

SEQ ID NO: 7844623 - DNA, 22 bp, Homo sapiens
ggggtgtgagtagagctgggga

SEQ ID NO: 7844624 - DNA, 22 bp, Homo sapiens
ggggtggggttactcattgtgc

SEQ ID NO: 7844625 - DNA, 22 bp, Homo sapiens
ggggtgtctgtgttcttcagtt

SEQ ID NO: 7844626 - DNA, 22 bp, Homo sapiens
ggggtgtctgtgttcttcagtt

SEQ ID NO: 7844627 - DNA, 22 bp, Homo sapiens
ggggtgtcagcaccagcccctg

SEQ ID NO: 7844628 - DNA, 22 bp, Homo sapiens
ggggtggggttactcattgtgc

SEQ ID NO: 7844629 - DNA, 22 bp, Homo sapiens
gggcttcttgcaggggcaacat

SEQ ID NO: 7844630 - DNA, 22 bp, Homo sapiens
gggcttcttgagctgccggccc

SEQ ID NO: 7844631 - DNA, 22 bp, Homo sapiens
gggctgctgtgttcctgaggca

SEQ ID NO: 7844632 - DNA, 22 bp, Homo sapiens
gggctgctgtgttcctgaggca

SEQ ID NO: 7844633 - DNA, 22 bp, Homo sapiens
gggctgctgtgttcctgaggca

SEQ ID NO: 7844634 - DNA, 22 bp, Homo sapiens
gggcttcttgccatggggacgg

SEQ ID NO: 7844635 - DNA, 22 bp, Homo sapiens
gggcttgaacaacttggaggtg

SEQ ID NO: 7844636 - DNA, 22 bp, Homo sapiens
gggcttcttgccatggggacgg

SEQ ID NO: 7844637 - DNA, 22 bp, Homo sapiens
gggcttcttgccatggggacgg

SEQ ID NO: 7844638 - DNA, 22 bp, Homo sapiens
gggcttgaggtgaaggtaggga

SEQ ID NO: 7844639 - DNA, 22 bp, Homo sapiens
gggcttgctaagaagagcgcat

SEQ ID NO: 7844640 - DNA, 22 bp, Homo sapiens
gggcttgaggtgaaggtaggga

SEQ ID NO: 7844641 - DNA, 22 bp, Homo sapiens
gggctgctgccaccaggtggat

SEQ ID NO: 7844642 - DNA, 22 bp, Homo sapiens
gggctgctgccaccaggtggat

SEQ ID NO: 7844643 - DNA, 22 bp, Homo sapiens
gggctgctgcccaggaggcacc

SEQ ID NO: 7844644 - DNA, 22 bp, Homo sapiens
gggctgctgcccaggaggcacc

SEQ ID NO: 7844645 - DNA, 22 bp, Homo sapiens
gggctgctgcccaggaggcacc

SEQ ID NO: 7844646 - DNA, 22 bp, Homo sapiens
gggctgctgggcaagaaacatt

SEQ ID NO: 7844647 - DNA, 22 bp, Homo sapiens
gggctgctgggcaagaaacatt

SEQ ID NO: 7844648 - DNA, 22 bp, Homo sapiens
gggctgctgtagagaacatgtt

SEQ ID NO: 7844649 - DNA, 22 bp, Homo sapiens
gggctgctgggcaagaaacatt

SEQ ID NO: 7844650 - DNA, 22 bp, Homo sapiens
gggctgctgctgccagcgacac

SEQ ID NO: 7844651 - DNA, 22 bp, Homo sapiens
gggctgctgctgccagcgacac

SEQ ID NO: 7844652 - DNA, 22 bp, Homo sapiens
gggctgctgctgccagcgacac

SEQ ID NO: 7844653 - DNA, 22 bp, Homo sapiens
gggcttggccccagaagagcta

SEQ ID NO: 7844654 - DNA, 22 bp, Homo sapiens
gggcttggccccagaagagcta

SEQ ID NO: 7844655 - DNA, 22 bp, Homo sapiens
gggcttggccccagaagagcta

SEQ ID NO: 7844656 - DNA, 22 bp, Homo sapiens
gggcttggctcataagtggatg

SEQ ID NO: 7844657 - DNA, 22 bp, Homo sapiens
gggcttggctggggccaccaga

SEQ ID NO: 7844658 - DNA, 22 bp, Homo sapiens
gggcttggctcataagtggatg

SEQ ID NO: 7844659 - DNA, 22 bp, Homo sapiens
gggcttggctcataagtggatg

SEQ ID NO: 7844660 - DNA, 19 bp, Homo sapiens
gggcttggggctgaagcct

SEQ ID NO: 7844661 - DNA, 22 bp, Homo sapiens
gggcttgggtattgtgagaggt

SEQ ID NO: 7844662 - DNA, 22 bp, Homo sapiens
gggcttgggtattgtgagaggt

SEQ ID NO: 7844663 - DNA, 22 bp, Homo sapiens
gggcttgggtattgtgagaggt

SEQ ID NO: 7844664 - DNA, 22 bp, Homo sapiens
gggcttgggtattgtgagaggt

SEQ ID NO: 7844665 - DNA, 22 bp, Homo sapiens
gggcttgggtattgtgagaggt

SEQ ID NO: 7844666 - DNA, 22 bp, Homo sapiens
gggcttgggtattgtgagaggt

SEQ ID NO: 7844667 - DNA, 22 bp, Homo sapiens
gggcttgggtattgtgagaggt

SEQ ID NO: 7844668 - DNA, 22 bp, Homo sapiens
gggcttggcacatgggctcagc

SEQ ID NO: 7844669 - DNA, 22 bp, Homo sapiens
gggcttggcacatgggctcagc

SEQ ID NO: 7844670 - DNA, 22 bp, Homo sapiens
gggcttggcacatgggctcagc

SEQ ID NO: 7844671 - DNA, 22 bp, Homo sapiens
gggcttggcacatgggctcagc

SEQ ID NO: 7844672 - DNA, 22 bp, Homo sapiens
gggcttggcacatgggctcagc

SEQ ID NO: 7844673 - DNA, 22 bp, Homo sapiens
gggcttggagtaggctgatgaa

SEQ ID NO: 7844674 - DNA, 22 bp, Homo sapiens
gggcttggagtaggctgatgaa

SEQ ID NO: 7844675 - DNA, 22 bp, Homo sapiens
gggcttggagtaggctgatgaa

SEQ ID NO: 7844676 - DNA, 22 bp, Homo sapiens
gggcttggagtaggctgatgaa

SEQ ID NO: 7844677 - DNA, 22 bp, Homo sapiens
gggcttggagtaggctgatgaa

SEQ ID NO: 7844678 - DNA, 22 bp, Homo sapiens
gggcttggagtaggctgatgaa

SEQ ID NO: 7844679 - DNA, 22 bp, Homo sapiens
gggcttggagtaggctgatgaa

SEQ ID NO: 7844680 - DNA, 20 bp, Homo sapiens
gggcttggaggactcgaggg

SEQ ID NO: 7844681 - DNA, 20 bp, Homo sapiens
gggcttggaggactcgaggg

SEQ ID NO: 7844682 - DNA, 22 bp, Homo sapiens
gggcttgctgatttgggcagga

SEQ ID NO: 7844683 - DNA, 22 bp, Homo sapiens
gggcttgctgtttagttccatt

SEQ ID NO: 7844684 - DNA, 20 bp, Homo sapiens
gggcttggaggactcgaggg

SEQ ID NO: 7844685 - DNA, 22 bp, Homo sapiens
gggctgattcgatgggggtaga

SEQ ID NO: 7844686 - DNA, 22 bp, Homo sapiens
gggctgcaatgcttcagttgtt

SEQ ID NO: 7844687 - DNA, 22 bp, Homo sapiens
gggctgcacagatcttcaaggg

SEQ ID NO: 7844688 - DNA, 22 bp, Homo sapiens
gggctgcacgtattctgctcac

SEQ ID NO: 7844689 - DNA, 22 bp, Homo sapiens
gggctgcatcagcaggacccgg

SEQ ID NO: 7844690 - DNA, 22 bp, Homo sapiens
gggctgcatcagcaggacccgg

SEQ ID NO: 7844691 - DNA, 22 bp, Homo sapiens
gggctgcactagggcaaggtga

SEQ ID NO: 7844692 - DNA, 22 bp, Homo sapiens
gggctgccaagcctgcctgcct

SEQ ID NO: 7844693 - DNA, 22 bp, Homo sapiens
gggctgccaagcctgcctgcct

SEQ ID NO: 7844694 - DNA, 22 bp, Homo sapiens
gggctgcctttcttctgggagc

SEQ ID NO: 7844695 - DNA, 22 bp, Homo sapiens
gggctgcctttcttctgggagc

SEQ ID NO: 7844696 - DNA, 22 bp, Homo sapiens
gggctgccttttaattcttccc

SEQ ID NO: 7844697 - DNA, 22 bp, Homo sapiens
gggctgcctgagcatctcctcc

SEQ ID NO: 7844698 - DNA, 22 bp, Homo sapiens
gggctgccaagcctgcctgcct

SEQ ID NO: 7844699 - DNA, 22 bp, Homo sapiens
gggctgcctttcttctgggagc

SEQ ID NO: 7844700 - DNA, 22 bp, Homo sapiens
gggctgctgccaatcacagcct

SEQ ID NO: 7844701 - DNA, 22 bp, Homo sapiens
gggctgctgccaatcacagcct

SEQ ID NO: 7844702 - DNA, 22 bp, Homo sapiens
gggctgctgccaatcacagcct

SEQ ID NO: 7844703 - DNA, 23 bp, Homo sapiens
gggctgctccaggccaaggctgg

SEQ ID NO: 7844704 - DNA, 22 bp, Homo sapiens
gggctgctacgagaactgaata

SEQ ID NO: 7844705 - DNA, 22 bp, Homo sapiens
gggctgcgtgtggaggatgtaa

SEQ ID NO: 7844706 - DNA, 22 bp, Homo sapiens
gggctgaggctaccactggtct

SEQ ID NO: 7844707 - DNA, 22 bp, Homo sapiens
gggctgaggctaccactggtct

SEQ ID NO: 7844708 - DNA, 22 bp, Homo sapiens
gggctgaggctaccactggtct

SEQ ID NO: 7844709 - DNA, 22 bp, Homo sapiens
gggctgaggctaccactggtct

SEQ ID NO: 7844710 - DNA, 22 bp, Homo sapiens
gggctgagggccaattcctact

SEQ ID NO: 7844711 - DNA, 22 bp, Homo sapiens
gggctgagggccaattcctact

SEQ ID NO: 7844712 - DNA, 22 bp, Homo sapiens
gggctgagggccaattcctact

SEQ ID NO: 7844713 - DNA, 22 bp, Homo sapiens
gggctgagtgtcccaggccgaa

SEQ ID NO: 7844714 - DNA, 22 bp, Homo sapiens
gggctgagtgtcccaggccgaa

SEQ ID NO: 7844715 - DNA, 22 bp, Homo sapiens
gggctgagtgtcccaggccgaa

SEQ ID NO: 7844716 - DNA, 22 bp, Homo sapiens
gggctgagtgtcccaggccgaa

SEQ ID NO: 7844717 - DNA, 22 bp, Homo sapiens
gggctgagtgggcctcttactt

SEQ ID NO: 7844718 - DNA, 22 bp, Homo sapiens
gggctgagtgtcccaggccgaa

SEQ ID NO: 7844719 - DNA, 22 bp, Homo sapiens
gggctgagggccaattcctact

SEQ ID NO: 7844720 - DNA, 22 bp, Homo sapiens
gggctgagttcctgcctcactc

SEQ ID NO: 7844721 - DNA, 22 bp, Homo sapiens
gggctgagttcctgcctcactc

SEQ ID NO: 7844722 - DNA, 22 bp, Homo sapiens
gggctgagttcctgcctcactc

SEQ ID NO: 7844723 - DNA, 22 bp, Homo sapiens
gggctgagttcctgcctcactc

SEQ ID NO: 7844724 - DNA, 22 bp, Homo sapiens
gggctgagttcctgcctcactc

SEQ ID NO: 7844725 - DNA, 22 bp, Homo sapiens
gggctgagttcctgcctcactc

SEQ ID NO: 7844726 - DNA, 22 bp, Homo sapiens
gggctgagttcctgcctcactc

SEQ ID NO: 7844727 - DNA, 22 bp, Homo sapiens
gggctgagttcctgcctcactc

SEQ ID NO: 7844728 - DNA, 22 bp, Homo sapiens
gggctgagtgtcccaggccgaa

SEQ ID NO: 7844729 - DNA, 22 bp, Homo sapiens
gggctgagtgtcccaggccgaa

SEQ ID NO: 7844730 - DNA, 22 bp, Homo sapiens
gggctgagagctggaatctgag

SEQ ID NO: 7844731 - DNA, 22 bp, Homo sapiens
gggctgagagctggaatctgag

SEQ ID NO: 7844732 - DNA, 22 bp, Homo sapiens
gggctgagagctggaatctgag

SEQ ID NO: 7844733 - DNA, 21 bp, Homo sapiens
gggccacaccttctgcagacc

SEQ ID NO: 7844734 - DNA, 21 bp, Homo sapiens
gggccacaccttctgcagacc

SEQ ID NO: 7844735 - DNA, 22 bp, Homo sapiens
gggctgagagctggaatctgag

SEQ ID NO: 7844736 - DNA, 22 bp, Homo sapiens
gggctgagagctggaatctgag

SEQ ID NO: 7844737 - DNA, 22 bp, Homo sapiens
gggctgagagctggaatctgag

SEQ ID NO: 7844738 - DNA, 22 bp, Homo sapiens
gggctgagagctggaatctgag

SEQ ID NO: 7844739 - DNA, 22 bp, Homo sapiens
gggctgagagctggaatctgag

SEQ ID NO: 7844740 - DNA, 22 bp, Homo sapiens
gggctgagagtgactgttctgt

SEQ ID NO: 7844741 - DNA, 22 bp, Homo sapiens
gggctgagagctggaatctgag

SEQ ID NO: 7844742 - DNA, 22 bp, Homo sapiens
gggctgagagctggaatctgag

SEQ ID NO: 7844743 - DNA, 22 bp, Homo sapiens
gggctgagagctggaatctgag

SEQ ID NO: 7844744 - DNA, 22 bp, Homo sapiens
gggctgagagtgactgttctgt

SEQ ID NO: 7844745 - DNA, 22 bp, Homo sapiens
gggctgagagtgactgttctgt

SEQ ID NO: 7844746 - DNA, 22 bp, Homo sapiens
gggctgagagtgactgttctgt

SEQ ID NO: 7844747 - DNA, 22 bp, Homo sapiens
gggctgagagtgactgttctgt

SEQ ID NO: 7844748 - DNA, 22 bp, Homo sapiens
gggctgagagtgactgttctgt

SEQ ID NO: 7844749 - DNA, 22 bp, Homo sapiens
gggctgagattggtgccctgtc

SEQ ID NO: 7844750 - DNA, 22 bp, Homo sapiens
gggctgagattggtgccctgtc

SEQ ID NO: 7844751 - DNA, 22 bp, Homo sapiens
gggctgagattggtgccctgtc

SEQ ID NO: 7844752 - DNA, 22 bp, Homo sapiens
gggctgagattggtgccctgtc

SEQ ID NO: 7844753 - DNA, 22 bp, Homo sapiens
gggctgagattggtgccctgtc

SEQ ID NO: 7844754 - DNA, 22 bp, Homo sapiens
gggctgagattggtgccctgtc

SEQ ID NO: 7844755 - DNA, 22 bp, Homo sapiens
gggctgagattggtgccctgtc

SEQ ID NO: 7844756 - DNA, 22 bp, Homo sapiens
gggctgagcacatactgacagc

SEQ ID NO: 7844757 - DNA, 22 bp, Homo sapiens
gggctgagcacatactgacagc

SEQ ID NO: 7844758 - DNA, 22 bp, Homo sapiens
gggctgagattggtgccctgtc

SEQ ID NO: 7844759 - DNA, 22 bp, Homo sapiens
gggctgagcacatactgacagc

SEQ ID NO: 7844760 - DNA, 22 bp, Homo sapiens
gggctgagattggtgccctgtc

SEQ ID NO: 7844761 - DNA, 22 bp, Homo sapiens
gggctgagattggtgccctgtc

SEQ ID NO: 7844762 - DNA, 22 bp, Homo sapiens
gggctgagattggtgccctgtc

SEQ ID NO: 7844763 - DNA, 22 bp, Homo sapiens
gggctgaggaacatattttgtt

SEQ ID NO: 7844764 - DNA, 22 bp, Homo sapiens
gggctgagctgttctgagttta

SEQ ID NO: 7844765 - DNA, 22 bp, Homo sapiens
gggctgagctgttctgagttta

SEQ ID NO: 7844766 - DNA, 22 bp, Homo sapiens
gggctgaggctaccactggtct

SEQ ID NO: 7844767 - DNA, 22 bp, Homo sapiens
gggctgaggctaccactggtct

SEQ ID NO: 7844768 - DNA, 22 bp, Homo sapiens
gggctgaggaacatattttgtt

SEQ ID NO: 7844769 - DNA, 22 bp, Homo sapiens
gggctgaggaacatattttgtt

SEQ ID NO: 7844770 - DNA, 22 bp, Homo sapiens
gggctgagctaagctgggttga

SEQ ID NO: 7844771 - DNA, 22 bp, Homo sapiens
gggctgagctaagctgggttga

SEQ ID NO: 7844772 - DNA, 22 bp, Homo sapiens
gggctgagctaagctgggttga

SEQ ID NO: 7844773 - DNA, 22 bp, Homo sapiens
gggctgagctaagctgggttga

SEQ ID NO: 7844774 - DNA, 22 bp, Homo sapiens
gggctgagctaagctgggttga

SEQ ID NO: 7844775 - DNA, 22 bp, Homo sapiens
gggctgagctaagctgggttga

SEQ ID NO: 7844776 - DNA, 22 bp, Homo sapiens
gggctgagctgttctgagttta

SEQ ID NO: 7844777 - DNA, 22 bp, Homo sapiens
gggctgagctgttctgagttta

SEQ ID NO: 7844778 - DNA, 22 bp, Homo sapiens
gggctgagctgttctgagttta

SEQ ID NO: 7844779 - DNA, 22 bp, Homo sapiens
gggctgagccatttgaaccttg

SEQ ID NO: 7844780 - DNA, 22 bp, Homo sapiens
gggctgagccatttgaaccttg

SEQ ID NO: 7844781 - DNA, 22 bp, Homo sapiens
gggctgagccatttgaaccttg

SEQ ID NO: 7844782 - DNA, 22 bp, Homo sapiens
gggctgagccacagcttttgtt

SEQ ID NO: 7844783 - DNA, 22 bp, Homo sapiens
gggctgagccatttgaaccttg

SEQ ID NO: 7844784 - DNA, 22 bp, Homo sapiens
gggctgagctaagctgggttga

SEQ ID NO: 7844785 - DNA, 22 bp, Homo sapiens
gggctgagccatttgaaccttg

SEQ ID NO: 7844786 - DNA, 22 bp, Homo sapiens
gggctgagccacagcttttgtt

SEQ ID NO: 7844787 - DNA, 22 bp, Homo sapiens
gggctgagccacagcttttgtt

SEQ ID NO: 7844788 - DNA, 22 bp, Homo sapiens
gggctgagccacagcttttgtt

SEQ ID NO: 7844789 - DNA, 22 bp, Homo sapiens
gggctgagccacagcttttgtt

SEQ ID NO: 7844790 - DNA, 22 bp, Homo sapiens
gggctgagcacatactgacagc

SEQ ID NO: 7844791 - DNA, 22 bp, Homo sapiens
gggctgagcacatactgacagc

SEQ ID NO: 7844792 - DNA, 22 bp, Homo sapiens
gggctgagcacatactgacagc

SEQ ID NO: 7844793 - DNA, 22 bp, Homo sapiens
gggctgagcacatactgacagc

SEQ ID NO: 7844794 - DNA, 22 bp, Homo sapiens
gggctgagcacatactgacagc

SEQ ID NO: 7844795 - DNA, 22 bp, Homo sapiens
gggccaaggggagctggaaggg

SEQ ID NO: 7844796 - DNA, 22 bp, Homo sapiens
gggccaaggggagctggaaggg

SEQ ID NO: 7844797 - DNA, 22 bp, Homo sapiens
gggccaaggggagctggaaggg

SEQ ID NO: 7844798 - DNA, 22 bp, Homo sapiens
gggccaaggggagctggaaggg

SEQ ID NO: 7844799 - DNA, 22 bp, Homo sapiens
gggccaaggggagctggaaggg

SEQ ID NO: 7844800 - DNA, 22 bp, Homo sapiens
gggcatgtcccgctgtgcaccg

SEQ ID NO: 7844801 - DNA, 22 bp, Homo sapiens
gggcatggtggcaggcacctgt

SEQ ID NO: 7844802 - DNA, 22 bp, Homo sapiens
gggcatggtggcaggcacctgt

SEQ ID NO: 7844803 - DNA, 22 bp, Homo sapiens
gggcatgtaggaatccatggag

SEQ ID NO: 7844804 - DNA, 22 bp, Homo sapiens
gggccaagggtgcgtggcagga

SEQ ID NO: 7844805 - DNA, 22 bp, Homo sapiens
gggccaaggggagctggaaggg

SEQ ID NO: 7844806 - DNA, 22 bp, Homo sapiens
gggccacacagaacctcctggt

SEQ ID NO: 7844807 - DNA, 22 bp, Homo sapiens
gggccaagggtgcgtggcagga

SEQ ID NO: 7844808 - DNA, 22 bp, Homo sapiens
gggccaagggtgcgtggcagga

SEQ ID NO: 7844809 - DNA, 22 bp, Homo sapiens
gggccaagggtgcgtggcagga

SEQ ID NO: 7844810 - DNA, 22 bp, Homo sapiens
gggccaagggtgcgtggcagga

SEQ ID NO: 7844811 - DNA, 22 bp, Homo sapiens
gggccaagggtgcgtggcagga

SEQ ID NO: 7844812 - DNA, 22 bp, Homo sapiens
gggccacacagaacctcctggt

SEQ ID NO: 7844813 - DNA, 22 bp, Homo sapiens
gggccacacagaacctcctggt

SEQ ID NO: 7844814 - DNA, 22 bp, Homo sapiens
gggccacacagggcagctccct

SEQ ID NO: 7844815 - DNA, 22 bp, Homo sapiens
gggccacacagggcagctccct

SEQ ID NO: 7844816 - DNA, 22 bp, Homo sapiens
gggccacacagggcagctccct

SEQ ID NO: 7844817 - DNA, 22 bp, Homo sapiens
gggccacacagggcagctccct

SEQ ID NO: 7844818 - DNA, 21 bp, Homo sapiens
gggccacaccttctgcagacc

SEQ ID NO: 7844819 - DNA, 22 bp, Homo sapiens
gggcatggccaggtgaggggtc

SEQ ID NO: 7844820 - DNA, 22 bp, Homo sapiens
gggcatggccaggtgaggggtc

SEQ ID NO: 7844821 - DNA, 22 bp, Homo sapiens
gggcatggccaggtgaggggtc

SEQ ID NO: 7844822 - DNA, 22 bp, Homo sapiens
gggcatggccaggtgaggggtc

SEQ ID NO: 7844823 - DNA, 18 bp, Homo sapiens
gggcatggatgcagcatc

SEQ ID NO: 7844824 - DNA, 18 bp, Homo sapiens
gggcatggatgcagcatc

SEQ ID NO: 7844825 - DNA, 22 bp, Homo sapiens
gggcatggccaggtgaggggtc

SEQ ID NO: 7844826 - DNA, 22 bp, Homo sapiens
gggcatggccaggtgaggggtc

SEQ ID NO: 7844827 - DNA, 22 bp, Homo sapiens
gggcatggccaggtgaggggtc

SEQ ID NO: 7844828 - DNA, 22 bp, Homo sapiens
gggcatggccaggtgaggggtc

SEQ ID NO: 7844829 - DNA, 22 bp, Homo sapiens
gggcatggcgtgtgctggattc

SEQ ID NO: 7844830 - DNA, 22 bp, Homo sapiens
gggcatggcgtgtgctggattc

SEQ ID NO: 7844831 - DNA, 22 bp, Homo sapiens
gggcatggcgtgtgctggattc

SEQ ID NO: 7844832 - DNA, 22 bp, Homo sapiens
gggcatggtggcaggcacctgt

SEQ ID NO: 7844833 - DNA, 22 bp, Homo sapiens
gggcatggtggcaggcacctgt

SEQ ID NO: 7844834 - DNA, 22 bp, Homo sapiens
gggcatggtgctggtgttcatg

SEQ ID NO: 7844835 - DNA, 22 bp, Homo sapiens
gggcatggtgatgtgcacctgt

SEQ ID NO: 7844836 - DNA, 22 bp, Homo sapiens
gggcatggggcggacctggttc

SEQ ID NO: 7844837 - DNA, 22 bp, Homo sapiens
gggcatggcgtgtgctggattc

SEQ ID NO: 7844838 - DNA, 22 bp, Homo sapiens
gggcatggcgtgtgctggattc

SEQ ID NO: 7844839 - DNA, 22 bp, Homo sapiens
gggcatggggcggacctggttc

SEQ ID NO: 7844840 - DNA, 22 bp, Homo sapiens
gggcatggtgagggatatgaag

SEQ ID NO: 7844841 - DNA, 22 bp, Homo sapiens
gggcatggtgatgtgcacctgt

SEQ ID NO: 7844842 - DNA, 22 bp, Homo sapiens
gggcatggtgagggatatgaag

SEQ ID NO: 7844843 - DNA, 22 bp, Homo sapiens
ggtgtggtttgaagggagatgg

SEQ ID NO: 7844844 - DNA, 22 bp, Homo sapiens
ggtgtggtttgaagggagatgg

SEQ ID NO: 7844845 - DNA, 22 bp, Homo sapiens
ggtgtgtctgccaggaactgca

SEQ ID NO: 7844846 - DNA, 22 bp, Homo sapiens
ggtgtgtgaggagtcacttagt

SEQ ID NO: 7844847 - DNA, 22 bp, Homo sapiens
ggtgtgtgaggagtcacttagt

SEQ ID NO: 7844848 - DNA, 22 bp, Homo sapiens
ggtgtgtgaggagtcacttagt

SEQ ID NO: 7844849 - DNA, 19 bp, Homo sapiens
ggtgtgtgctggggcctgt

SEQ ID NO: 7844850 - DNA, 19 bp, Homo sapiens
ggtgtgtgctggggcctgt

SEQ ID NO: 7844851 - DNA, 19 bp, Homo sapiens
ggtgtgtgctggggcctgt

SEQ ID NO: 7844852 - DNA, 19 bp, Homo sapiens
ggtgtgtgctggggcctgt

SEQ ID NO: 7844853 - DNA, 22 bp, Homo sapiens
ggtgtgtgaggagtcacttagt

SEQ ID NO: 7844854 - DNA, 19 bp, Homo sapiens
ggtgtgtgctggggcctgt

SEQ ID NO: 7844855 - DNA, 22 bp, Homo sapiens
ggtgtgtggttttgatacagtc

SEQ ID NO: 7844856 - DNA, 22 bp, Homo sapiens
ggtgtgtggttttgatacagtc

SEQ ID NO: 7844857 - DNA, 22 bp, Homo sapiens
ggtgtgtggtcctctcacttag

SEQ ID NO: 7844858 - DNA, 22 bp, Homo sapiens
ggtgtgtggttttgatacagtc

SEQ ID NO: 7844859 - DNA, 22 bp, Homo sapiens
ggtgtgtggtcctctcacttag

SEQ ID NO: 7844860 - DNA, 22 bp, Homo sapiens
ggtgtgtggtcctctcacttag

SEQ ID NO: 7844861 - DNA, 22 bp, Homo sapiens
ggtgtgtgtggattagcatgcc

SEQ ID NO: 7844862 - DNA, 22 bp, Homo sapiens
ggtgtgtgtggattagcatgcc

SEQ ID NO: 7844863 - DNA, 20 bp, Homo sapiens
ggtgtgttggttcagcatgg

SEQ ID NO: 7844864 - DNA, 22 bp, Homo sapiens
ggtgtgtggttttgatacagtc

SEQ ID NO: 7844865 - DNA, 22 bp, Homo sapiens
ggtgtgtgtggattagcatgcc

SEQ ID NO: 7844866 - DNA, 22 bp, Homo sapiens
ggtttcaaattaaagtcttaag

SEQ ID NO: 7844867 - DNA, 22 bp, Homo sapiens
ggtttattgttaataagtttga

SEQ ID NO: 7844868 - DNA, 22 bp, Homo sapiens
ggtttattgttaataagtttga

SEQ ID NO: 7844869 - DNA, 22 bp, Homo sapiens
ggtttattgttaataagtttga

SEQ ID NO: 7844870 - DNA, 22 bp, Homo sapiens
ggtttattgttaataagtttga

SEQ ID NO: 7844871 - DNA, 22 bp, Homo sapiens
ggtttattgaaggccaccccac

SEQ ID NO: 7844872 - DNA, 22 bp, Homo sapiens
ggtttattgaaggccaccccac

SEQ ID NO: 7844873 - DNA, 22 bp, Homo sapiens
ggtttattgaaggccaccccac

SEQ ID NO: 7844874 - DNA, 22 bp, Homo sapiens
ggtttattgaaggccaccccac

SEQ ID NO: 7844875 - DNA, 22 bp, Homo sapiens
ggtttattaatgtgaactgtat

SEQ ID NO: 7844876 - DNA, 22 bp, Homo sapiens
ggtttattaatgtgaactgtat

SEQ ID NO: 7844877 - DNA, 22 bp, Homo sapiens
ggtttattaatgtgaactgtat

SEQ ID NO: 7844878 - DNA, 22 bp, Homo sapiens
ggtttattaatgtgaactgtat

SEQ ID NO: 7844879 - DNA, 22 bp, Homo sapiens
ggtttatcaatacatattgcta

SEQ ID NO: 7844880 - DNA, 19 bp, Homo sapiens
ggtttatctgtttcttctc

SEQ ID NO: 7844881 - DNA, 22 bp, Homo sapiens
ggtttaattggtccaggatggg

SEQ ID NO: 7844882 - DNA, 22 bp, Homo sapiens
ggtgttcaaatgaacacatgca

SEQ ID NO: 7844883 - DNA, 22 bp, Homo sapiens
ggtgttcttagtggcactggca

SEQ ID NO: 7844884 - DNA, 22 bp, Homo sapiens
ggtgttcttagtggcactggca

SEQ ID NO: 7844885 - DNA, 22 bp, Homo sapiens
ggtgttgcagttgaagactggt

SEQ ID NO: 7844886 - DNA, 22 bp, Homo sapiens
ggtgttaacttgtttatgacaa

SEQ ID NO: 7844887 - DNA, 22 bp, Homo sapiens
ggtgttgcagttgaagactggt

SEQ ID NO: 7844888 - DNA, 22 bp, Homo sapiens
ggtgttggaacatggtgagatt

SEQ ID NO: 7844889 - DNA, 22 bp, Homo sapiens
ggtgttgggctcactggtcctt

SEQ ID NO: 7844890 - DNA, 22 bp, Homo sapiens
ggtttaattacctgcatctcaa

SEQ ID NO: 7844891 - DNA, 22 bp, Homo sapiens
ggtgttgtacattctgtggatt

SEQ ID NO: 7844892 - DNA, 22 bp, Homo sapiens
ggtgtgggggcaagtttgagat

SEQ ID NO: 7844893 - DNA, 22 bp, Homo sapiens
ggtgtgggccctgatgtcagca

SEQ ID NO: 7844894 - DNA, 22 bp, Homo sapiens
ggtgtggggaggttctgcttct

SEQ ID NO: 7844895 - DNA, 22 bp, Homo sapiens
ggtgtggggaggttctgcttct

SEQ ID NO: 7844896 - DNA, 22 bp, Homo sapiens
ggtgtggggaggttctgcttct

SEQ ID NO: 7844897 - DNA, 22 bp, Homo sapiens
ggtgtggggaggttctgcttct

SEQ ID NO: 7844898 - DNA, 22 bp, Homo sapiens
ggtgtgggggcagctctgatat

SEQ ID NO: 7844899 - DNA, 22 bp, Homo sapiens
ggtgtgggtccttgtgcttgct

SEQ ID NO: 7844900 - DNA, 22 bp, Homo sapiens
ggtgtgggtccttgtgcttgct

SEQ ID NO: 7844901 - DNA, 22 bp, Homo sapiens
ggtgtgggtccttgtgcttgct

SEQ ID NO: 7844902 - DNA, 22 bp, Homo sapiens
ggtgtgggtccttgtgcttgct

SEQ ID NO: 7844903 - DNA, 22 bp, Homo sapiens
ggtgtgggaactacaggttttt

SEQ ID NO: 7844904 - DNA, 22 bp, Homo sapiens
ggtgtgggaactacaggttttt

SEQ ID NO: 7844905 - DNA, 22 bp, Homo sapiens
ggtgtgggaactacaggttttt

SEQ ID NO: 7844906 - DNA, 22 bp, Homo sapiens
ggtgtgggccctgatgtcagca

SEQ ID NO: 7844907 - DNA, 22 bp, Homo sapiens
ggtgtgggcagatgccctactt

SEQ ID NO: 7844908 - DNA, 22 bp, Homo sapiens
ggtgtgggccctgatgtcagca

SEQ ID NO: 7844909 - DNA, 22 bp, Homo sapiens
ggtgtgggccctgatgtcagca

SEQ ID NO: 7844910 - DNA, 22 bp, Homo sapiens
ggtgtgggagagattctttcct

SEQ ID NO: 7844911 - DNA, 22 bp, Homo sapiens
ggtggctctcaggcttctcgga

SEQ ID NO: 7844912 - DNA, 22 bp, Homo sapiens
ggtggctctcaggcttctcgga

SEQ ID NO: 7844913 - DNA, 22 bp, Homo sapiens
ggtggctctcaggcttctcgga

SEQ ID NO: 7844914 - DNA, 22 bp, Homo sapiens
ggtggctctcaggcttctcgga

SEQ ID NO: 7844915 - DNA, 19 bp, Homo sapiens
ggtggctctccctcaggga

SEQ ID NO: 7844916 - DNA, 19 bp, Homo sapiens
ggtggctctccctcaggga

SEQ ID NO: 7844917 - DNA, 22 bp, Homo sapiens
ggtggctctccctggactcagc

SEQ ID NO: 7844918 - DNA, 22 bp, Homo sapiens
ggtggctctccctggactcagc

SEQ ID NO: 7844919 - DNA, 19 bp, Homo sapiens
ggtggctctccctcaggga

SEQ ID NO: 7844920 - DNA, 22 bp, Homo sapiens
ggtggctcggccagtgcaggcc

SEQ ID NO: 7844921 - DNA, 22 bp, Homo sapiens
ggtggctccgcttccatgggct

SEQ ID NO: 7844922 - DNA, 22 bp, Homo sapiens
ggtggctcggccagtgcaggcc

SEQ ID NO: 7844923 - DNA, 22 bp, Homo sapiens
ggtggctcggccagtgcaggcc

SEQ ID NO: 7844924 - DNA, 22 bp, Homo sapiens
ggtggctcggccagtgcaggcc

SEQ ID NO: 7844925 - DNA, 22 bp, Homo sapiens
ggtggctcggccagtgcaggcc

SEQ ID NO: 7844926 - DNA, 17 bp, Homo sapiens
ggtggctcgggcgcggc

SEQ ID NO: 7844927 - DNA, 22 bp, Homo sapiens
ggtggctcgtttttcttgaaag

SEQ ID NO: 7844928 - DNA, 17 bp, Homo sapiens
ggtggctcgggcgcggc

SEQ ID NO: 7844929 - DNA, 22 bp, Homo sapiens
ggtggctctctgtcagtgacag

SEQ ID NO: 7844930 - DNA, 22 bp, Homo sapiens
ggtggctctctgtcagtgacag

SEQ ID NO: 7844931 - DNA, 22 bp, Homo sapiens
ggtggctctcttaagggcagcg

SEQ ID NO: 7844932 - DNA, 22 bp, Homo sapiens
ggtggctctcttaagggcagcg

SEQ ID NO: 7844933 - DNA, 22 bp, Homo sapiens
ggtggctctcttaagggcagcg

SEQ ID NO: 7844934 - DNA, 22 bp, Homo sapiens
ggtggctctctgtcagtgacag

SEQ ID NO: 7844935 - DNA, 22 bp, Homo sapiens
ggtggctctctgtcagtgacag

SEQ ID NO: 7844936 - DNA, 22 bp, Homo sapiens
ggtggctctccctggactcagc

SEQ ID NO: 7844937 - DNA, 22 bp, Homo sapiens
ggtggctctccctggactcagc

SEQ ID NO: 7844938 - DNA, 22 bp, Homo sapiens
ggtggctctccctggactcagc

SEQ ID NO: 7844939 - DNA, 22 bp, Homo sapiens
ggtggctctccctggactcagc

SEQ ID NO: 7844940 - DNA, 22 bp, Homo sapiens
ggtggctctcttaagggcagcg

SEQ ID NO: 7844941 - DNA, 22 bp, Homo sapiens
ggtgtccttagaaagcagacct

SEQ ID NO: 7844942 - DNA, 22 bp, Homo sapiens
ggtggcctcggtggtgcacagg

SEQ ID NO: 7844943 - DNA, 22 bp, Homo sapiens
ggtggcctcggtggtgcacagg

SEQ ID NO: 7844944 - DNA, 22 bp, Homo sapiens
ggtggcctctcatgcaaggtag

SEQ ID NO: 7844945 - DNA, 22 bp, Homo sapiens
ggtggcctctcatgcaaggtag

SEQ ID NO: 7844946 - DNA, 22 bp, Homo sapiens
ggtggcctcttgtttagccagc

SEQ ID NO: 7844947 - DNA, 22 bp, Homo sapiens
ggtggcctgaattagctcaggg

SEQ ID NO: 7844948 - DNA, 22 bp, Homo sapiens
ggtggcctctgcaggcctcgac

SEQ ID NO: 7844949 - DNA, 22 bp, Homo sapiens
ggtggcctctgcaggcctcgac

SEQ ID NO: 7844950 - DNA, 22 bp, Homo sapiens
ggtggcctctgcaggcctcgac

SEQ ID NO: 7844951 - DNA, 22 bp, Homo sapiens
ggtggcctccagggcataggtg

SEQ ID NO: 7844952 - DNA, 22 bp, Homo sapiens
ggtggcctcagcaaggctggca

SEQ ID NO: 7844953 - DNA, 22 bp, Homo sapiens
ggtggcctccagggcataggtg

SEQ ID NO: 7844954 - DNA, 22 bp, Homo sapiens
ggtggcctcggtggtgcacagg

SEQ ID NO: 7844955 - DNA, 22 bp, Homo sapiens
ggtggcctcggtggtgcacagg

SEQ ID NO: 7844956 - DNA, 22 bp, Homo sapiens
ggtggcctcgccgcggctctgc

SEQ ID NO: 7844957 - DNA, 22 bp, Homo sapiens
ggtggcctgaattagctcaggg

SEQ ID NO: 7844958 - DNA, 22 bp, Homo sapiens
ggtggcctgaattagctcaggg

SEQ ID NO: 7844959 - DNA, 22 bp, Homo sapiens
ggtggcctgaattagctcaggg

SEQ ID NO: 7844960 - DNA, 22 bp, Homo sapiens
ggtggcctgcaagtgcagatgg

SEQ ID NO: 7844961 - DNA, 17 bp, Homo sapiens
ggtggcctgcagtggct

SEQ ID NO: 7844962 - DNA, 17 bp, Homo sapiens
ggtggcctgcagtggct

SEQ ID NO: 7844963 - DNA, 17 bp, Homo sapiens
ggtggcctgcagtggct

SEQ ID NO: 7844964 - DNA, 17 bp, Homo sapiens
ggtggcctgcagtggct

SEQ ID NO: 7844965 - DNA, 17 bp, Homo sapiens
ggtggcctgcagtggct

SEQ ID NO: 7844966 - DNA, 22 bp, Homo sapiens
ggtggcctggaatcttaacaag

SEQ ID NO: 7844967 - DNA, 22 bp, Homo sapiens
ggtggccttttatgagcagggt

SEQ ID NO: 7844968 - DNA, 22 bp, Homo sapiens
ggtggccttttatgagcagggt

SEQ ID NO: 7844969 - DNA, 21 bp, Homo sapiens
ggtggccttggtgagagacct

SEQ ID NO: 7844970 - DNA, 18 bp, Homo sapiens
ggtggcggggatggaggt

SEQ ID NO: 7844971 - DNA, 18 bp, Homo sapiens
ggtggcggggatggaggt

SEQ ID NO: 7844972 - DNA, 22 bp, Homo sapiens
ggtggctcaaagagagcacaga

SEQ ID NO: 7844973 - DNA, 22 bp, Homo sapiens
ggtggcggccacttcagccctg

SEQ ID NO: 7844974 - DNA, 18 bp, Homo sapiens
ggtggcggggatggaggt

SEQ ID NO: 7844975 - DNA, 18 bp, Homo sapiens
ggtggcggggatggaggt

SEQ ID NO: 7844976 - DNA, 22 bp, Homo sapiens
ggtggctcacgcctgtaagccc

SEQ ID NO: 7844977 - DNA, 22 bp, Homo sapiens
ggtggctcacgcctgtaagccc

SEQ ID NO: 7844978 - DNA, 19 bp, Homo sapiens
ggtggctcagggcccagcc

SEQ ID NO: 7844979 - DNA, 19 bp, Homo sapiens
ggtggctcagggcccagcc

SEQ ID NO: 7844980 - DNA, 21 bp, Homo sapiens
ggtggctcacctgattggata

SEQ ID NO: 7844981 - DNA, 21 bp, Homo sapiens
ggtggctcacctgattggata

SEQ ID NO: 7844982 - DNA, 21 bp, Homo sapiens
ggtggctcacctgattggata

SEQ ID NO: 7844983 - DNA, 22 bp, Homo sapiens
ggtggctcacgcctgtaagccc

SEQ ID NO: 7844984 - DNA, 22 bp, Homo sapiens
ggtggctcaaagagagcacaga

SEQ ID NO: 7844985 - DNA, 22 bp, Homo sapiens
ggtggctcaaagagagcacaga

SEQ ID NO: 7844986 - DNA, 18 bp, Homo sapiens
ggtggctcagtcatgggg

SEQ ID NO: 7844987 - DNA, 18 bp, Homo sapiens
ggtggctcagtcatgggg

SEQ ID NO: 7844988 - DNA, 18 bp, Homo sapiens
ggtggctcagtcatgggg

SEQ ID NO: 7844989 - DNA, 22 bp, Homo sapiens
ggtggctcagggctccaagcat

SEQ ID NO: 7844990 - DNA, 19 bp, Homo sapiens
ggtggctcagggcccagcc

SEQ ID NO: 7844991 - DNA, 19 bp, Homo sapiens
ggtggctcagggcccagcc

SEQ ID NO: 7844992 - DNA, 22 bp, Homo sapiens
ggtggctcagggctccaagcat

SEQ ID NO: 7844993 - DNA, 22 bp, Homo sapiens
ggtggctcagtgtcaggccctg

SEQ ID NO: 7844994 - DNA, 22 bp, Homo sapiens
ggtggctcagtgtcaggccctg

SEQ ID NO: 7844995 - DNA, 22 bp, Homo sapiens
ggtggctcagtgtcaggccctg

SEQ ID NO: 7844996 - DNA, 22 bp, Homo sapiens
ggtggctcccacccagctttga

SEQ ID NO: 7844997 - DNA, 22 bp, Homo sapiens
ggtggctccgcttccatgggct

SEQ ID NO: 7844998 - DNA, 22 bp, Homo sapiens
ggtggctccgcttccatgggct

SEQ ID NO: 7844999 - DNA, 22 bp, Homo sapiens
ggtggctcccacccagctttga

SEQ ID NO: 7845000 - DNA, 22 bp, Homo sapiens
ggtggctcatttgatcttcata

SEQ ID NO: 7845001 - DNA, 22 bp, Homo sapiens
ggtggctcatttgatcttcata

SEQ ID NO: 7845002 - DNA, 22 bp, Homo sapiens
ggtggccctaaccgcagcctcc

SEQ ID NO: 7845003 - DNA, 20 bp, Homo sapiens
ggtggccgtagcgggcggcg

SEQ ID NO: 7845004 - DNA, 22 bp, Homo sapiens
ggtggcctcagcaaggctggca

SEQ ID NO: 7845005 - DNA, 22 bp, Homo sapiens
ggtggcctcagcaaggctggca

SEQ ID NO: 7845006 - DNA, 22 bp, Homo sapiens
ggtggcctcagcaaggctggca

SEQ ID NO: 7845007 - DNA, 22 bp, Homo sapiens
ggtctggcactcatgcagcagg

SEQ ID NO: 7845008 - DNA, 22 bp, Homo sapiens
ggtctggcaggtgaggactcag

SEQ ID NO: 7845009 - DNA, 22 bp, Homo sapiens
ggtctggcactcatgcagcagg

SEQ ID NO: 7845010 - DNA, 22 bp, Homo sapiens
ggtctggattttgaacaaaatt

SEQ ID NO: 7845011 - DNA, 22 bp, Homo sapiens
ggtctggccaatagacagcccc

SEQ ID NO: 7845012 - DNA, 22 bp, Homo sapiens
ggtctggcaggtgaggactcag

SEQ ID NO: 7845013 - DNA, 22 bp, Homo sapiens
ggtctggataattccagtacct

SEQ ID NO: 7845014 - DNA, 22 bp, Homo sapiens
ggtctgaattccagcccctctg

SEQ ID NO: 7845015 - DNA, 22 bp, Homo sapiens
ggtctggaccctcctggagtgg

SEQ ID NO: 7845016 - DNA, 22 bp, Homo sapiens
ggtctctgttgcctccatcaag

SEQ ID NO: 7845017 - DNA, 22 bp, Homo sapiens
ggtctctgtttggggctggcaa

SEQ ID NO: 7845018 - DNA, 22 bp, Homo sapiens
ggtctctgtttggggctggcaa

SEQ ID NO: 7845019 - DNA, 22 bp, Homo sapiens
ggtctctgtttggggctggcaa

SEQ ID NO: 7845020 - DNA, 22 bp, Homo sapiens
ggtctcttagtgcaacatacta

SEQ ID NO: 7845021 - DNA, 22 bp, Homo sapiens
ggtctctgtttggggctggcaa

SEQ ID NO: 7845022 - DNA, 22 bp, Homo sapiens
ggtctctgtttggggctggcaa

SEQ ID NO: 7845023 - DNA, 22 bp, Homo sapiens
ggtctgaaaatggtgaccacca

SEQ ID NO: 7845024 - DNA, 22 bp, Homo sapiens
ggtctctttgcttcagctacag

SEQ ID NO: 7845025 - DNA, 22 bp, Homo sapiens
ggtctctttgcttcagctacag

SEQ ID NO: 7845026 - DNA, 22 bp, Homo sapiens
ggtctctttccttggcttgcac

SEQ ID NO: 7845027 - DNA, 22 bp, Homo sapiens
ggtctcttgtccaaggtcacac

SEQ ID NO: 7845028 - DNA, 22 bp, Homo sapiens
ggtctcttccagctttatcact

SEQ ID NO: 7845029 - DNA, 21 bp, Homo sapiens
ggtctcttcatctgtaacctg

SEQ ID NO: 7845030 - DNA, 22 bp, Homo sapiens
ggtctcttcaggagcttgagcg

SEQ ID NO: 7845031 - DNA, 22 bp, Homo sapiens
gggtggcagctgttgccaaggt

SEQ ID NO: 7845032 - DNA, 22 bp, Homo sapiens
gggtggcacaggtgcagagggt

SEQ ID NO: 7845033 - DNA, 22 bp, Homo sapiens
gggtggcactgataatgagacg

SEQ ID NO: 7845034 - DNA, 22 bp, Homo sapiens
gggtggcaggattggcaggagt

SEQ ID NO: 7845035 - DNA, 22 bp, Homo sapiens
gggtggcaggattggcaggagt

SEQ ID NO: 7845036 - DNA, 22 bp, Homo sapiens
gggtggcaggattggcaggagt

SEQ ID NO: 7845037 - DNA, 22 bp, Homo sapiens
gggtggcaggattggcaggagt

SEQ ID NO: 7845038 - DNA, 22 bp, Homo sapiens
gggtggcaggattggcaggagt

SEQ ID NO: 7845039 - DNA, 22 bp, Homo sapiens
gggtggcagctgttgccaaggt

SEQ ID NO: 7845040 - DNA, 22 bp, Homo sapiens
gggtggcaggattggcaggagt

SEQ ID NO: 7845041 - DNA, 22 bp, Homo sapiens
gggtggcaggattggcaggagt

SEQ ID NO: 7845042 - DNA, 22 bp, Homo sapiens
gggtggcacaggtgcagagggt

SEQ ID NO: 7845043 - DNA, 22 bp, Homo sapiens
gggtggcacaggtgcagagggt

SEQ ID NO: 7845044 - DNA, 22 bp, Homo sapiens
gggtggcacaggtgcagagggt

SEQ ID NO: 7845045 - DNA, 22 bp, Homo sapiens
gggtggcacaggtgcagagggt

SEQ ID NO: 7845046 - DNA, 22 bp, Homo sapiens
gggtggcacaggtgcagagggt

SEQ ID NO: 7845047 - DNA, 22 bp, Homo sapiens
gggtggcacaggtgcagagggt

SEQ ID NO: 7845048 - DNA, 22 bp, Homo sapiens
gggtggcacaggtgcagagggt

SEQ ID NO: 7845049 - DNA, 22 bp, Homo sapiens
gggtggcacaggtgcagagggt

SEQ ID NO: 7845050 - DNA, 20 bp, Homo sapiens
gggtggagttgcggtctgtg

SEQ ID NO: 7845051 - DNA, 20 bp, Homo sapiens
gggtggagttgcggtctgtg

SEQ ID NO: 7845052 - DNA, 20 bp, Homo sapiens
gggtggagttgcggtctgtg

SEQ ID NO: 7845053 - DNA, 22 bp, Homo sapiens
gggtggcacaggtgcagagggt

SEQ ID NO: 7845054 - DNA, 22 bp, Homo sapiens
gggtggcaaaggcgctgaaagg

SEQ ID NO: 7845055 - DNA, 22 bp, Homo sapiens
gggtggcaaaggcgctgaaagg

SEQ ID NO: 7845056 - DNA, 21 bp, Homo sapiens
gggtggccgcatgggtgcgtg

SEQ ID NO: 7845057 - DNA, 21 bp, Homo sapiens
gggtggccgcatgggtgcgtg

SEQ ID NO: 7845058 - DNA, 21 bp, Homo sapiens
gggtggccgcatgggtgcgtg

SEQ ID NO: 7845059 - DNA, 21 bp, Homo sapiens
gggtggccgcatgggtgcgtg

SEQ ID NO: 7845060 - DNA, 22 bp, Homo sapiens
gggtggccttaggcaagtcact

SEQ ID NO: 7845061 - DNA, 22 bp, Homo sapiens
gggtggccttcatagctcaggg

SEQ ID NO: 7845062 - DNA, 22 bp, Homo sapiens
gggtggccttcatagctcaggg

SEQ ID NO: 7845063 - DNA, 22 bp, Homo sapiens
gggtggcatagggtgatggctt

SEQ ID NO: 7845064 - DNA, 22 bp, Homo sapiens
gggtggcatagggtgatggctt

SEQ ID NO: 7845065 - DNA, 22 bp, Homo sapiens
gggtggcatagggtgatggctt

SEQ ID NO: 7845066 - DNA, 22 bp, Homo sapiens
gggtggcatagggtgatggctt

SEQ ID NO: 7845067 - DNA, 22 bp, Homo sapiens
gggtggcatagggtgatggctt

SEQ ID NO: 7845068 - DNA, 22 bp, Homo sapiens
gggtggcatctctctgagctgt

SEQ ID NO: 7845069 - DNA, 22 bp, Homo sapiens
ggtaggggaagacaagtgaaaa

SEQ ID NO: 7845070 - DNA, 22 bp, Homo sapiens
ggtaggggaagacaagtgaaaa

SEQ ID NO: 7845071 - DNA, 22 bp, Homo sapiens
ggtaggggcagggccaagctgt

SEQ ID NO: 7845072 - DNA, 22 bp, Homo sapiens
ggtaggggaagacaagtgaaaa

SEQ ID NO: 7845073 - DNA, 22 bp, Homo sapiens
gggtggctgagaacaggacccc

SEQ ID NO: 7845074 - DNA, 22 bp, Homo sapiens
ggtagggcaaagtagggcacct

SEQ ID NO: 7845075 - DNA, 22 bp, Homo sapiens
gggtggctaggtatcccccatt

SEQ ID NO: 7845076 - DNA, 22 bp, Homo sapiens
gggtggctcctatgggcatagc

SEQ ID NO: 7845077 - DNA, 22 bp, Homo sapiens
gggtggctaggtatcccccatt

SEQ ID NO: 7845078 - DNA, 22 bp, Homo sapiens
gggtggctgactgttttgtgga

SEQ ID NO: 7845079 - DNA, 22 bp, Homo sapiens
gggtggctcctatgggcatagc

SEQ ID NO: 7845080 - DNA, 22 bp, Homo sapiens
gggtggctcctatgggcatagc

SEQ ID NO: 7845081 - DNA, 22 bp, Homo sapiens
gggtggctcctatgggcatagc

SEQ ID NO: 7845082 - DNA, 18 bp, Homo sapiens
ggtcactgagatgctact

SEQ ID NO: 7845083 - DNA, 22 bp, Homo sapiens
ggtcactgccctcccttttgca

SEQ ID NO: 7845084 - DNA, 22 bp, Homo sapiens
ggtcactgatgtgttccctggg

SEQ ID NO: 7845085 - DNA, 22 bp, Homo sapiens
ggtcactgagctgtaattctgt

SEQ ID NO: 7845086 - DNA, 22 bp, Homo sapiens
ggtcactggtctctgcttccat

SEQ ID NO: 7845087 - DNA, 22 bp, Homo sapiens
ggtcactggtctctgcttccat

SEQ ID NO: 7845088 - DNA, 23 bp, Homo sapiens
ggtcactggcaagcagtgcagag

SEQ ID NO: 7845089 - DNA, 23 bp, Homo sapiens
ggtcactggcaagcagtgcagag

SEQ ID NO: 7845090 - DNA, 22 bp, Homo sapiens
ggtcacttcagataactggtgt

SEQ ID NO: 7845091 - DNA, 22 bp, Homo sapiens
ggtcacttctttcatcgaaact

SEQ ID NO: 7845092 - DNA, 22 bp, Homo sapiens
ggtcactgtcttctgggctctg

SEQ ID NO: 7845093 - DNA, 22 bp, Homo sapiens
ggtcacccatgatcacatcacc

SEQ ID NO: 7845094 - DNA, 22 bp, Homo sapiens
ggtcacgtgaccgcacctgcct

SEQ ID NO: 7845095 - DNA, 22 bp, Homo sapiens
ggtcacccatgatcacatcacc

SEQ ID NO: 7845096 - DNA, 22 bp, Homo sapiens
ggtagtcagtgttagtttgatt

SEQ ID NO: 7845097 - DNA, 22 bp, Homo sapiens
ggtagtcatggatagctatgag

SEQ ID NO: 7845098 - DNA, 22 bp, Homo sapiens
ggtcagaagtgcaaaatcagtt

SEQ ID NO: 7845099 - DNA, 22 bp, Homo sapiens
ggtcagaaggcctcggcaggaa

SEQ ID NO: 7845100 - DNA, 22 bp, Homo sapiens
ggtcagaaggcagttaaacaaa

SEQ ID NO: 7845101 - DNA, 22 bp, Homo sapiens
ggtcagaaggattctgggaaat

SEQ ID NO: 7845102 - DNA, 22 bp, Homo sapiens
ggtcagaattaggtctagagta

SEQ ID NO: 7845103 - DNA, 22 bp, Homo sapiens
ggtcagagaaaagtagggtgtt

SEQ ID NO: 7845104 - DNA, 22 bp, Homo sapiens
ggtcagagaaaagtagggtgtt

SEQ ID NO: 7845105 - DNA, 19 bp, Homo sapiens
ggtcagagagatccaggct

SEQ ID NO: 7845106 - DNA, 19 bp, Homo sapiens
ggtcagagagatccaggct

SEQ ID NO: 7845107 - DNA, 22 bp, Homo sapiens
ggtcagagatgaggtctaaagt

SEQ ID NO: 7845108 - DNA, 22 bp, Homo sapiens
ggtcagagatgaggtctaaagt

SEQ ID NO: 7845109 - DNA, 22 bp, Homo sapiens
ggtcagagaaagtggtagtaga

SEQ ID NO: 7845110 - DNA, 22 bp, Homo sapiens
ggtcagagccgttagcattcag

SEQ ID NO: 7845111 - DNA, 22 bp, Homo sapiens
ggtcagagctggagagataggg

SEQ ID NO: 7845112 - DNA, 22 bp, Homo sapiens
ggtcagagctggagagataggg

SEQ ID NO: 7845113 - DNA, 22 bp, Homo sapiens
ggtcagagccgttagcattcag

SEQ ID NO: 7845114 - DNA, 22 bp, Homo sapiens
ggtcagagggtgggctgcctgt

SEQ ID NO: 7845115 - DNA, 22 bp, Homo sapiens
ggtcagagggtgggctgcctgt

SEQ ID NO: 7845116 - DNA, 22 bp, Homo sapiens
ggtcagagggtgggctgcctgt

SEQ ID NO: 7845117 - DNA, 22 bp, Homo sapiens
ggtcagaggtcacaagctggca

SEQ ID NO: 7845118 - DNA, 22 bp, Homo sapiens
ggtcagaggggattccttggga

SEQ ID NO: 7845119 - DNA, 22 bp, Homo sapiens
ggtcagaggggattccttggga

SEQ ID NO: 7845120 - DNA, 22 bp, Homo sapiens
ggtcagaggggattccttggga

SEQ ID NO: 7845121 - DNA, 22 bp, Homo sapiens
ggtcagaggaggaataggacat

SEQ ID NO: 7845122 - DNA, 22 bp, Homo sapiens
ggtcagaggaggaataggacat

SEQ ID NO: 7845123 - DNA, 22 bp, Homo sapiens
ggtcagaggaggaataggacat

SEQ ID NO: 7845124 - DNA, 22 bp, Homo sapiens
ggtctagaggatgttcctttcc

SEQ ID NO: 7845125 - DNA, 22 bp, Homo sapiens
ggtctagagtggggcctggaaa

SEQ ID NO: 7845126 - DNA, 22 bp, Homo sapiens
ggtctagagtggggcctggaaa

SEQ ID NO: 7845127 - DNA, 22 bp, Homo sapiens
ggtctagagcttgattggcagc

SEQ ID NO: 7845128 - DNA, 22 bp, Homo sapiens
ggtctagacgaattcctatcag

SEQ ID NO: 7845129 - DNA, 22 bp, Homo sapiens
ggtcggggatggccaggctccc

SEQ ID NO: 7845130 - DNA, 22 bp, Homo sapiens
ggtcggggatggccaggctccc

SEQ ID NO: 7845131 - DNA, 22 bp, Homo sapiens
ggtcggggatggccaggctccc

SEQ ID NO: 7845132 - DNA, 22 bp, Homo sapiens
ggtctagatgaaattaaatgtt

SEQ ID NO: 7845133 - DNA, 22 bp, Homo sapiens
ggtctagatttctgttataggg

SEQ ID NO: 7845134 - DNA, 22 bp, Homo sapiens
ggtctagatcaagaacagaact

SEQ ID NO: 7845135 - DNA, 22 bp, Homo sapiens
ggtctagatgaaattaaatgtt

SEQ ID NO: 7845136 - DNA, 22 bp, Homo sapiens
ggtctagatcaagaacagaact

SEQ ID NO: 7845137 - DNA, 22 bp, Homo sapiens
ggtctcagactggcaggcagtg

SEQ ID NO: 7845138 - DNA, 22 bp, Homo sapiens
ggtctcagactggcaggcagtg

SEQ ID NO: 7845139 - DNA, 22 bp, Homo sapiens
ggtctcagactggcaggcagtg

SEQ ID NO: 7845140 - DNA, 20 bp, Homo sapiens
ggtccttgtcacaaggagag

SEQ ID NO: 7845141 - DNA, 22 bp, Homo sapiens
ggtccttgggtctcctgtgttt

SEQ ID NO: 7845142 - DNA, 22 bp, Homo sapiens
ggtccttgggtctcctgtgttt

SEQ ID NO: 7845143 - DNA, 22 bp, Homo sapiens
ggtccttgggtctcctgtgttt

SEQ ID NO: 7845144 - DNA, 22 bp, Homo sapiens
ggtcctttgccatctctccacc

SEQ ID NO: 7845145 - DNA, 22 bp, Homo sapiens
ggtcgagtcacttgttgccttt

SEQ ID NO: 7845146 - DNA, 22 bp, Homo sapiens
ggtcgagtcacttgttgccttt

SEQ ID NO: 7845147 - DNA, 22 bp, Homo sapiens
ggtcgagtcacttgttgccttt

SEQ ID NO: 7845148 - DNA, 22 bp, Homo sapiens
ggtcgctgtgtaggttcagcta

SEQ ID NO: 7845149 - DNA, 22 bp, Homo sapiens
ggtcgctgtgtaggttcagcta

SEQ ID NO: 7845150 - DNA, 22 bp, Homo sapiens
ggtcgctgtgtaggttcagcta

SEQ ID NO: 7845151 - DNA, 22 bp, Homo sapiens
ggtcgctgtgtaggttcagcta

SEQ ID NO: 7845152 - DNA, 22 bp, Homo sapiens
ggtcgctgagctagcatctgca

SEQ ID NO: 7845153 - DNA, 22 bp, Homo sapiens
ggtcgcggctccggagacgccc

SEQ ID NO: 7845154 - DNA, 22 bp, Homo sapiens
ggtcgccagccctagtctgctg

SEQ ID NO: 7845155 - DNA, 22 bp, Homo sapiens
ggtcgctgtgtaggttcagcta

SEQ ID NO: 7845156 - DNA, 22 bp, Homo sapiens
ggtcctgtctgacatcactgct

SEQ ID NO: 7845157 - DNA, 22 bp, Homo sapiens
ggtccttggcgaatcattccag

SEQ ID NO: 7845158 - DNA, 20 bp, Homo sapiens
ggtcctgtactctcattgaa

SEQ ID NO: 7845159 - DNA, 22 bp, Homo sapiens
ggtcctgtctgacatcactgct

SEQ ID NO: 7845160 - DNA, 22 bp, Homo sapiens
ggtccctggttccctctgagct

SEQ ID NO: 7845161 - DNA, 22 bp, Homo sapiens
ggtccctgggtcttcttacgtc

SEQ ID NO: 7845162 - DNA, 22 bp, Homo sapiens
ggtccctggggaactaggctgt

SEQ ID NO: 7845163 - DNA, 22 bp, Homo sapiens
ggtccctggttccctctgagct

SEQ ID NO: 7845164 - DNA, 22 bp, Homo sapiens
ggtccctggttccctctgagct

SEQ ID NO: 7845165 - DNA, 18 bp, Homo sapiens
ggtcctgggcctggctca

SEQ ID NO: 7845166 - DNA, 18 bp, Homo sapiens
ggtcctgggcctggctca

SEQ ID NO: 7845167 - DNA, 18 bp, Homo sapiens
ggtcctgggcctggctca

SEQ ID NO: 7845168 - DNA, 22 bp, Homo sapiens
ggtccctggggaactaggctgt

SEQ ID NO: 7845169 - DNA, 22 bp, Homo sapiens
ggtccctggggaactaggctgt

SEQ ID NO: 7845170 - DNA, 22 bp, Homo sapiens
ggtccctggaagtccctcttct

SEQ ID NO: 7845171 - DNA, 22 bp, Homo sapiens
ggtccctggggaactaggctgt

SEQ ID NO: 7845172 - DNA, 22 bp, Homo sapiens
ggtcagcagtgcagggcagagc

SEQ ID NO: 7845173 - DNA, 22 bp, Homo sapiens
ggtccctggaagtccctcttct

SEQ ID NO: 7845174 - DNA, 19 bp, Homo sapiens
ggtcagcagtttagggtct

SEQ ID NO: 7845175 - DNA, 22 bp, Homo sapiens
ggtcagcagtgcagggcagagc

SEQ ID NO: 7845176 - DNA, 22 bp, Homo sapiens
ggtcagaggtcccagaagaagc

SEQ ID NO: 7845177 - DNA, 22 bp, Homo sapiens
ggtcagcagccatgccatgaat

SEQ ID NO: 7845178 - DNA, 22 bp, Homo sapiens
ggtcagaggtcacaagctggca

SEQ ID NO: 7845179 - DNA, 22 bp, Homo sapiens
ggtcagaggtcacaagctggca

SEQ ID NO: 7845180 - DNA, 22 bp, Homo sapiens
ggtcagcaggtccagccagtgc

SEQ ID NO: 7845181 - DNA, 22 bp, Homo sapiens
ggtcagcaggtccagccagtgc

SEQ ID NO: 7845182 - DNA, 22 bp, Homo sapiens
ggtcagcagtgcagggcagagc

SEQ ID NO: 7845183 - DNA, 22 bp, Homo sapiens
ggtctcagaggtttctgctcag

SEQ ID NO: 7845184 - DNA, 22 bp, Homo sapiens
ggtctcagatctttattaaggc

SEQ ID NO: 7845185 - DNA, 22 bp, Homo sapiens
ggtctcagccctcgccagcagc

SEQ ID NO: 7845186 - DNA, 22 bp, Homo sapiens
ggtctcagccctcgccagcagc

SEQ ID NO: 7845187 - DNA, 22 bp, Homo sapiens
ggtctcagccctcgccagcagc

SEQ ID NO: 7845188 - DNA, 22 bp, Homo sapiens
ggtctcagcagttgctttgact

SEQ ID NO: 7845189 - DNA, 22 bp, Homo sapiens
ggtctcagcagttgctttgact

SEQ ID NO: 7845190 - DNA, 22 bp, Homo sapiens
ggtctcaggtagggcctaggaa

SEQ ID NO: 7845191 - DNA, 22 bp, Homo sapiens
ggtctcaggagactggagagca

SEQ ID NO: 7845192 - DNA, 22 bp, Homo sapiens
ggtctcaggagactggagagca

SEQ ID NO: 7845193 - DNA, 22 bp, Homo sapiens
ggtctcaggagactggagagca

SEQ ID NO: 7845194 - DNA, 22 bp, Homo sapiens
ggtctcagctggagtccttggt

SEQ ID NO: 7845195 - DNA, 22 bp, Homo sapiens
ggtctcagctggagtccttggt

SEQ ID NO: 7845196 - DNA, 22 bp, Homo sapiens
ggtctcagctggagtccttggt

SEQ ID NO: 7845197 - DNA, 22 bp, Homo sapiens
ggtctcagctggagtccttggt

SEQ ID NO: 7845198 - DNA, 19 bp, Homo sapiens
ggtctcagtgcagctgcag

SEQ ID NO: 7845199 - DNA, 22 bp, Homo sapiens
ggtctccaaagctgcattgatg

SEQ ID NO: 7845200 - DNA, 22 bp, Homo sapiens
ggtctccaaagctgcattgatg

SEQ ID NO: 7845201 - DNA, 22 bp, Homo sapiens
ggtctccaaagcttaggactac

SEQ ID NO: 7845202 - DNA, 22 bp, Homo sapiens
ggtctccaaagcttaggactac

SEQ ID NO: 7845203 - DNA, 22 bp, Homo sapiens
ggtctccaaagcttaggactac

SEQ ID NO: 7845204 - DNA, 22 bp, Homo sapiens
ggtctcaggtagggcctaggaa

SEQ ID NO: 7845205 - DNA, 22 bp, Homo sapiens
ggtctcaggtagggcctaggaa

SEQ ID NO: 7845206 - DNA, 22 bp, Homo sapiens
ggtctcaggtagggcctaggaa

SEQ ID NO: 7845207 - DNA, 22 bp, Homo sapiens
ggtctcaggtagggcctaggaa

SEQ ID NO: 7845208 - DNA, 22 bp, Homo sapiens
ggtctcagtgaaggagtgtgct

SEQ ID NO: 7845209 - DNA, 22 bp, Homo sapiens
ggtctcagtgaaggagtgtgct

SEQ ID NO: 7845210 - DNA, 22 bp, Homo sapiens
ggtctcagtgaaggagtgtgct

SEQ ID NO: 7845211 - DNA, 19 bp, Homo sapiens
ggtctcagtgcagctgcag

SEQ ID NO: 7845212 - DNA, 19 bp, Homo sapiens
ggtctcagtgcagctgcag

SEQ ID NO: 7845213 - DNA, 22 bp, Homo sapiens
ggtctctctgctttcccccaga

SEQ ID NO: 7845214 - DNA, 22 bp, Homo sapiens
ggtctctctgctttcccccaga

SEQ ID NO: 7845215 - DNA, 22 bp, Homo sapiens
ggtctcctgggttgaccagctg

SEQ ID NO: 7845216 - DNA, 22 bp, Homo sapiens
ggtctcctgggttgaccagctg

SEQ ID NO: 7845217 - DNA, 22 bp, Homo sapiens
ggtctctgaacttccactgcgc

SEQ ID NO: 7845218 - DNA, 22 bp, Homo sapiens
ggtctctgaacttccactgcgc

SEQ ID NO: 7845219 - DNA, 20 bp, Homo sapiens
ggtctctgacagctggttgc

SEQ ID NO: 7845220 - DNA, 20 bp, Homo sapiens
ggtctctgacagctggttgc

SEQ ID NO: 7845221 - DNA, 22 bp, Homo sapiens
ggtctctgaagcttttagtccc

SEQ ID NO: 7845222 - DNA, 22 bp, Homo sapiens
ggtctcctgaggctgccacacc

SEQ ID NO: 7845223 - DNA, 22 bp, Homo sapiens
ggtctcctgaggctgccacacc

SEQ ID NO: 7845224 - DNA, 22 bp, Homo sapiens
ggtctcctgaggctgccacacc

SEQ ID NO: 7845225 - DNA, 22 bp, Homo sapiens
ggtctcctgacctttagtccct

SEQ ID NO: 7845226 - DNA, 22 bp, Homo sapiens
ggtctccattccttcatctcac

SEQ ID NO: 7845227 - DNA, 22 bp, Homo sapiens
ggtctccagctgggaccctgca

SEQ ID NO: 7845228 - DNA, 22 bp, Homo sapiens
ggtctccagctgggaccctgca

SEQ ID NO: 7845229 - DNA, 20 bp, Homo sapiens
ggtctctgacagctggttgc

SEQ ID NO: 7845230 - DNA, 22 bp, Homo sapiens
ggtctctgagtgaggacctggg

SEQ ID NO: 7845231 - DNA, 22 bp, Homo sapiens
ggtctctgacttagagatggat

SEQ ID NO: 7845232 - DNA, 22 bp, Homo sapiens
ggtctctgacttagagatggat

SEQ ID NO: 7845233 - DNA, 22 bp, Homo sapiens
ggtctctgagtgaggacctggg

SEQ ID NO: 7845234 - DNA, 22 bp, Homo sapiens
ggtctctgcagctcccggcccc

SEQ ID NO: 7845235 - DNA, 22 bp, Homo sapiens
ggtctctgcagctcccggcccc

SEQ ID NO: 7845236 - DNA, 22 bp, Homo sapiens
ggtctctgtcactgagtggccc

SEQ ID NO: 7845237 - DNA, 22 bp, Homo sapiens
ggtctctgtcactgagtggccc

SEQ ID NO: 7845238 - DNA, 22 bp, Homo sapiens
ggtctctgtcactgagtggccc

SEQ ID NO: 7845239 - DNA, 22 bp, Homo sapiens
ggtctctgctcagatgccactt

SEQ ID NO: 7845240 - DNA, 22 bp, Homo sapiens
ggtctctgctcagatgccactt

SEQ ID NO: 7845241 - DNA, 22 bp, Homo sapiens
ggtctctggccttggagattga

SEQ ID NO: 7845242 - DNA, 22 bp, Homo sapiens
ggtctctggccttggagattga

SEQ ID NO: 7845243 - DNA, 22 bp, Homo sapiens
gtgactgtgaactgtttctgat

SEQ ID NO: 7845244 - DNA, 22 bp, Homo sapiens
gtgactgtgagtcgctgtgaca

SEQ ID NO: 7845245 - DNA, 22 bp, Homo sapiens
gtgactgtgatcttatttgcaa

SEQ ID NO: 7845246 - DNA, 22 bp, Homo sapiens
gtgactcttacctacccagcct

SEQ ID NO: 7845247 - DNA, 18 bp, Homo sapiens
gtgactgccccaaaaggc

SEQ ID NO: 7845248 - DNA, 22 bp, Homo sapiens
gtgactctcactttacctgact

SEQ ID NO: 7845249 - DNA, 22 bp, Homo sapiens
gtgacgtgaggggctcctgttg

SEQ ID NO: 7845250 - DNA, 22 bp, Homo sapiens
gtgactcacacaggcctgggct

SEQ ID NO: 7845251 - DNA, 22 bp, Homo sapiens
gtgactatttcacatagtcttt

SEQ ID NO: 7845252 - DNA, 22 bp, Homo sapiens
gtgacgtgaggggctcctgttg

SEQ ID NO: 7845253 - DNA, 22 bp, Homo sapiens
gtgaccatcctggtaatgaatc

SEQ ID NO: 7845254 - DNA, 22 bp, Homo sapiens
gtgacccatgcagtggttttgg

SEQ ID NO: 7845255 - DNA, 22 bp, Homo sapiens
gtgacccatgcagtggttttgg

SEQ ID NO: 7845256 - DNA, 22 bp, Homo sapiens
gtgagaaattgaatggctccca

SEQ ID NO: 7845257 - DNA, 22 bp, Homo sapiens
gtgagaataccagcagtgagaa

SEQ ID NO: 7845258 - DNA, 22 bp, Homo sapiens
gtgagacaagatttgtaggcag

SEQ ID NO: 7845259 - DNA, 22 bp, Homo sapiens
gtgagaaatgacaaatgtgtcg

SEQ ID NO: 7845260 - DNA, 22 bp, Homo sapiens
gtgagaaatgacaaatgtgtcg

SEQ ID NO: 7845261 - DNA, 22 bp, Homo sapiens
gtgagaaatggaacttcatacg

SEQ ID NO: 7845262 - DNA, 22 bp, Homo sapiens
gtgagaaatgacaaatgtgtcg

SEQ ID NO: 7845263 - DNA, 22 bp, Homo sapiens
gtgagaaaattgcctaattttg

SEQ ID NO: 7845264 - DNA, 22 bp, Homo sapiens
gtgagaaaattgcctaattttg

SEQ ID NO: 7845265 - DNA, 22 bp, Homo sapiens
gtgagaagataagtattgcaaa

SEQ ID NO: 7845266 - DNA, 22 bp, Homo sapiens
gtgagaaattgaatggctccca

SEQ ID NO: 7845267 - DNA, 22 bp, Homo sapiens
gtgagaaatggaacttcatacg

SEQ ID NO: 7845268 - DNA, 22 bp, Homo sapiens
gtgagaaatggaacttcatacg

SEQ ID NO: 7845269 - DNA, 22 bp, Homo sapiens
gtgagaaatggaacttcatacg

SEQ ID NO: 7845270 - DNA, 22 bp, Homo sapiens
gtgagaaattgaatggctccca

SEQ ID NO: 7845271 - DNA, 22 bp, Homo sapiens
gtgagcaggataggggctccct

SEQ ID NO: 7845272 - DNA, 22 bp, Homo sapiens
gtgagcaggataggggctccct

SEQ ID NO: 7845273 - DNA, 22 bp, Homo sapiens
gtgagcaggataggggctccct

SEQ ID NO: 7845274 - DNA, 22 bp, Homo sapiens
gtgagcaggataggggctccct

SEQ ID NO: 7845275 - DNA, 22 bp, Homo sapiens
gtgagcagctcagggtggtctc

SEQ ID NO: 7845276 - DNA, 22 bp, Homo sapiens
gtgagcagctcagggtggtctc

SEQ ID NO: 7845277 - DNA, 22 bp, Homo sapiens
gtgagcagctcagggtggtctc

SEQ ID NO: 7845278 - DNA, 22 bp, Homo sapiens
gtgagcaggataggggctccct

SEQ ID NO: 7845279 - DNA, 23 bp, Homo sapiens
gtgagcagcccactaggaatgcc

SEQ ID NO: 7845280 - DNA, 23 bp, Homo sapiens
gtgagcagcccactaggaatgcc

SEQ ID NO: 7845281 - DNA, 22 bp, Homo sapiens
gtgagcagcctcacctgagggt

SEQ ID NO: 7845282 - DNA, 22 bp, Homo sapiens
gtgagcagctcagggtggtctc

SEQ ID NO: 7845283 - DNA, 22 bp, Homo sapiens
gtgagcagctcagggtggtctc

SEQ ID NO: 7845284 - DNA, 22 bp, Homo sapiens
gtgagcagcctcacctgagggt

SEQ ID NO: 7845285 - DNA, 19 bp, Homo sapiens
gtgagaccctgcatagggc

SEQ ID NO: 7845286 - DNA, 22 bp, Homo sapiens
gtgagacctccttgggctgact

SEQ ID NO: 7845287 - DNA, 19 bp, Homo sapiens
gtgagaccctgcatagggc

SEQ ID NO: 7845288 - DNA, 22 bp, Homo sapiens
gtgagacctccttgggctgact

SEQ ID NO: 7845289 - DNA, 22 bp, Homo sapiens
gtgagactcgcctttgtgtagc

SEQ ID NO: 7845290 - DNA, 22 bp, Homo sapiens
gtgagactcgcctttgtgtagc

SEQ ID NO: 7845291 - DNA, 23 bp, Homo sapiens
gtgagcagcccactaggaatgcc

SEQ ID NO: 7845292 - DNA, 22 bp, Homo sapiens
gtgagagatcccccactcatct

SEQ ID NO: 7845293 - DNA, 22 bp, Homo sapiens
gtgagagaaattggagggaatg

SEQ ID NO: 7845294 - DNA, 22 bp, Homo sapiens
gtgcacaggtgggaaaatgagt

SEQ ID NO: 7845295 - DNA, 21 bp, Homo sapiens
gtgcacagtcctgcacacagg

SEQ ID NO: 7845296 - DNA, 22 bp, Homo sapiens
gtgcacatcgtgcaggtttgtt

SEQ ID NO: 7845297 - DNA, 22 bp, Homo sapiens
gtgcacatcgtgcaggtttgtt

SEQ ID NO: 7845298 - DNA, 22 bp, Homo sapiens
gtgcacatcgtgcaggtttgtt

SEQ ID NO: 7845299 - DNA, 21 bp, Homo sapiens
gtgcacagtcctgcacacagg

SEQ ID NO: 7845300 - DNA, 22 bp, Homo sapiens
gtgcacatatttgtgcatgcat

SEQ ID NO: 7845301 - DNA, 22 bp, Homo sapiens
gtgcacagaagcagaagctaga

SEQ ID NO: 7845302 - DNA, 22 bp, Homo sapiens
gtgagcagggcaggactgggga

SEQ ID NO: 7845303 - DNA, 22 bp, Homo sapiens
gtgcacagatttaattttattc

SEQ ID NO: 7845304 - DNA, 22 bp, Homo sapiens
gtgagcagggcaggactgggga

SEQ ID NO: 7845305 - DNA, 22 bp, Homo sapiens
gtgagcagggcaggactgggga

SEQ ID NO: 7845306 - DNA, 22 bp, Homo sapiens
gtgagcaggatttcatggtgta

SEQ ID NO: 7845307 - DNA, 22 bp, Homo sapiens
gtgagcaggatttcatggtgta

SEQ ID NO: 7845308 - DNA, 22 bp, Homo sapiens
gtgagcaggatttcatggtgta

SEQ ID NO: 7845309 - DNA, 22 bp, Homo sapiens
gtgagcaggatttcatggtgta

SEQ ID NO: 7845310 - DNA, 22 bp, Homo sapiens
gtgagcaggatttcatggtgta

SEQ ID NO: 7845311 - DNA, 22 bp, Homo sapiens
gtgcactgtctggtcaagagca

SEQ ID NO: 7845312 - DNA, 22 bp, Homo sapiens
gtgcacttgatctagacagatt

SEQ ID NO: 7845313 - DNA, 22 bp, Homo sapiens
gtgcactgtctggtcaagagca

SEQ ID NO: 7845314 - DNA, 22 bp, Homo sapiens
gtgcactgtctggtcaagagca

SEQ ID NO: 7845315 - DNA, 22 bp, Homo sapiens
gtgcactgtctggtcaagagca

SEQ ID NO: 7845316 - DNA, 22 bp, Homo sapiens
gtgcactggagttcgtacagat

SEQ ID NO: 7845317 - DNA, 22 bp, Homo sapiens
gtgcactttgggagtctcagtg

SEQ ID NO: 7845318 - DNA, 22 bp, Homo sapiens
gtgcactttgggagtctcagtg

SEQ ID NO: 7845319 - DNA, 22 bp, Homo sapiens
gtgcagagaggaccttggggag

SEQ ID NO: 7845320 - DNA, 22 bp, Homo sapiens
gtgcagagaggtggagggactt

SEQ ID NO: 7845321 - DNA, 22 bp, Homo sapiens
gtgcagagaggaccttggggag

SEQ ID NO: 7845322 - DNA, 22 bp, Homo sapiens
gtgcagagcaagggctgagggc

SEQ ID NO: 7845323 - DNA, 22 bp, Homo sapiens
gtgcagagaaatgagaagtcga

SEQ ID NO: 7845324 - DNA, 22 bp, Homo sapiens
gtgcagagaaggagcagtagtt

SEQ ID NO: 7845325 - DNA, 22 bp, Homo sapiens
gtgcagagaaggagcagtagtt

SEQ ID NO: 7845326 - DNA, 22 bp, Homo sapiens
gtgcagagaaggagcagtagtt

SEQ ID NO: 7845327 - DNA, 22 bp, Homo sapiens
gtgcagagaaggagcagtagtt

SEQ ID NO: 7845328 - DNA, 22 bp, Homo sapiens
gtgcagagaaggagcagtagtt

SEQ ID NO: 7845329 - DNA, 22 bp, Homo sapiens
gtgcagtggcagatcctagctc

SEQ ID NO: 7845330 - DNA, 22 bp, Homo sapiens
gtgcagtggcagatcctagctc

SEQ ID NO: 7845331 - DNA, 22 bp, Homo sapiens
gtgcagtgaccctggagagctg

SEQ ID NO: 7845332 - DNA, 22 bp, Homo sapiens
gtgcagtgagcagtgcagcacc

SEQ ID NO: 7845333 - DNA, 22 bp, Homo sapiens
gtgcagtgaccctggagagctg

SEQ ID NO: 7845334 - DNA, 22 bp, Homo sapiens
gtgcagtgaccctggagagctg

SEQ ID NO: 7845335 - DNA, 22 bp, Homo sapiens
gtgcagtactagagcaccagga

SEQ ID NO: 7845336 - DNA, 22 bp, Homo sapiens
gtgcagtgaccctggagagctg

SEQ ID NO: 7845337 - DNA, 22 bp, Homo sapiens
gtgcaggtgttttggctgccag

SEQ ID NO: 7845338 - DNA, 22 bp, Homo sapiens
gtgcaggtgttttggctgccag

SEQ ID NO: 7845339 - DNA, 22 bp, Homo sapiens
gtgcaggtgttttggctgccag

SEQ ID NO: 7845340 - DNA, 22 bp, Homo sapiens
gtgcaggtgttttggctgccag

SEQ ID NO: 7845341 - DNA, 22 bp, Homo sapiens
gtgcaggtggctggtggcaccc

SEQ ID NO: 7845342 - DNA, 22 bp, Homo sapiens
gtgcaggtggatttgggctcaa

SEQ ID NO: 7845343 - DNA, 22 bp, Homo sapiens
gtgcaggtggatttgggctcaa

SEQ ID NO: 7845344 - DNA, 18 bp, Homo sapiens
gtgcagattgcggagccc

SEQ ID NO: 7845345 - DNA, 22 bp, Homo sapiens
gtgcagggtagcgacggcagga

SEQ ID NO: 7845346 - DNA, 22 bp, Homo sapiens
gtgcagggtcctaattgttaag

SEQ ID NO: 7845347 - DNA, 22 bp, Homo sapiens
gtgcagatcctgattgcagttc

SEQ ID NO: 7845348 - DNA, 22 bp, Homo sapiens
gtgcagagtgtctgtggactga

SEQ ID NO: 7845349 - DNA, 22 bp, Homo sapiens
gtgcagagtgtctgtggactga

SEQ ID NO: 7845350 - DNA, 22 bp, Homo sapiens
gtgcagagtgtctgtggactga

SEQ ID NO: 7845351 - DNA, 22 bp, Homo sapiens
gtgcagatgttatgtttcaaaa

SEQ ID NO: 7845352 - DNA, 22 bp, Homo sapiens
gtgcagattcccgggcctctcc

SEQ ID NO: 7845353 - DNA, 20 bp, Homo sapiens
gtgcagatgtcctttcacac

SEQ ID NO: 7845354 - DNA, 22 bp, Homo sapiens
gtgcagatcctgattgcagttc

SEQ ID NO: 7845355 - DNA, 20 bp, Homo sapiens
gtgcagaggcagcctgtggg

SEQ ID NO: 7845356 - DNA, 20 bp, Homo sapiens
gtgcagaggcagcctgtggg

SEQ ID NO: 7845357 - DNA, 20 bp, Homo sapiens
gtgcagaggcagcctgtggg

SEQ ID NO: 7845358 - DNA, 20 bp, Homo sapiens
gtgcagaggcagcctgtggg

SEQ ID NO: 7845359 - DNA, 22 bp, Homo sapiens
gtgcagaggtcacaaaagtgaa

SEQ ID NO: 7845360 - DNA, 22 bp, Homo sapiens
gtgcagagtgctacattttatt

SEQ ID NO: 7845361 - DNA, 22 bp, Homo sapiens
gtgcagaggacgtggcggcctc

SEQ ID NO: 7845362 - DNA, 22 bp, Homo sapiens
gtgcagaggacgtggcggcctc

SEQ ID NO: 7845363 - DNA, 22 bp, Homo sapiens
gtgcagaggacgtggcggcctc

SEQ ID NO: 7845364 - DNA, 22 bp, Homo sapiens
gtgcagaggacgtggcggcctc

SEQ ID NO: 7845365 - DNA, 22 bp, Homo sapiens
gtgcagaggacgtggcggcctc

SEQ ID NO: 7845366 - DNA, 22 bp, Homo sapiens
gtgcagaggacgtggcggcctc

SEQ ID NO: 7845367 - DNA, 21 bp, Homo sapiens
gtgcagaggaatgtagggggc

SEQ ID NO: 7845368 - DNA, 22 bp, Homo sapiens
gtgcagagcaagggctgagggc

SEQ ID NO: 7845369 - DNA, 22 bp, Homo sapiens
gtgcagagcaagggctgagggc

SEQ ID NO: 7845370 - DNA, 22 bp, Homo sapiens
gtgcagagcaagggctgagggc

SEQ ID NO: 7845371 - DNA, 22 bp, Homo sapiens
gtgcagagcaagggctgagggc

SEQ ID NO: 7845372 - DNA, 22 bp, Homo sapiens
gtgcatatgtacctgtgatcat

SEQ ID NO: 7845373 - DNA, 22 bp, Homo sapiens
gtgcatatgtgtgtatacaaac

SEQ ID NO: 7845374 - DNA, 22 bp, Homo sapiens
gtgcatttaggtcacatgatgt

SEQ ID NO: 7845375 - DNA, 22 bp, Homo sapiens
gtgcatttatatttgcctttgg

SEQ ID NO: 7845376 - DNA, 22 bp, Homo sapiens
gtgcatttatatttgcctttgg

SEQ ID NO: 7845377 - DNA, 22 bp, Homo sapiens
gtgcagtgtgtaatccaggaac

SEQ ID NO: 7845378 - DNA, 19 bp, Homo sapiens
gtgcagttcagagttcaat

SEQ ID NO: 7845379 - DNA, 22 bp, Homo sapiens
gtgcagttgaagcatggggaga

SEQ ID NO: 7845380 - DNA, 22 bp, Homo sapiens
gtgcagttcccaaggtcacaca

SEQ ID NO: 7845381 - DNA, 22 bp, Homo sapiens
gtgcagttcttgtaacatgctg

SEQ ID NO: 7845382 - DNA, 22 bp, Homo sapiens
gtgcagttgaagcatggggaga

SEQ ID NO: 7845383 - DNA, 22 bp, Homo sapiens
gtgcagttgatagttttagtga

SEQ ID NO: 7845384 - DNA, 22 bp, Homo sapiens
gtgcagttgtggacatgacaac

SEQ ID NO: 7845385 - DNA, 22 bp, Homo sapiens
gtgcagttgagacaataggctg

SEQ ID NO: 7845386 - DNA, 22 bp, Homo sapiens
gtgcatatggttacagcaccgc

SEQ ID NO: 7845387 - DNA, 22 bp, Homo sapiens
gtgcatatatgtgcagcatcaa

SEQ ID NO: 7845388 - DNA, 22 bp, Homo sapiens
gtgcatatatgcacatatgtgt

SEQ ID NO: 7845389 - DNA, 22 bp, Homo sapiens
gtgcatatatatgggagggagc

SEQ ID NO: 7845390 - DNA, 22 bp, Homo sapiens
gtgcataaatagcagagctgtg

SEQ ID NO: 7845391 - DNA, 22 bp, Homo sapiens
gtgcataaatagcagagctgtg

SEQ ID NO: 7845392 - DNA, 22 bp, Homo sapiens
gtgcataatttggcaatagaat

SEQ ID NO: 7845393 - DNA, 22 bp, Homo sapiens
gtgctagggacaaagcagtgaa

SEQ ID NO: 7845394 - DNA, 22 bp, Homo sapiens
gtgctatccctggagccttaga

SEQ ID NO: 7845395 - DNA, 22 bp, Homo sapiens
gtgctaggattacaggcatggg

SEQ ID NO: 7845396 - DNA, 22 bp, Homo sapiens
gtgccacctctgccccagaggg

SEQ ID NO: 7845397 - DNA, 22 bp, Homo sapiens
gtgccaatgcactctagcctgg

SEQ ID NO: 7845398 - DNA, 22 bp, Homo sapiens
gtgccaccagatgctgttgcta

SEQ ID NO: 7845399 - DNA, 22 bp, Homo sapiens
gtgccacatggcctaatagaga

SEQ ID NO: 7845400 - DNA, 22 bp, Homo sapiens
gtgccacagaccaccgtgctgg

SEQ ID NO: 7845401 - DNA, 22 bp, Homo sapiens
gtgccaaagaacataaggctga

SEQ ID NO: 7845402 - DNA, 19 bp, Homo sapiens
gtgccaaatgtgttataca

SEQ ID NO: 7845403 - DNA, 22 bp, Homo sapiens
gtgccaaggtgctaagggcatg

SEQ ID NO: 7845404 - DNA, 22 bp, Homo sapiens
gtgccaatcgtgcattatattg

SEQ ID NO: 7845405 - DNA, 22 bp, Homo sapiens
gtgccaatgatatcctataatg

SEQ ID NO: 7845406 - DNA, 22 bp, Homo sapiens
gtgccaatgcactctagcctgg

SEQ ID NO: 7845407 - DNA, 20 bp, Homo sapiens
gtgcatttcacctgtactgt

SEQ ID NO: 7845408 - DNA, 20 bp, Homo sapiens
gtgcatttcacctgtactgt

SEQ ID NO: 7845409 - DNA, 22 bp, Homo sapiens
gtgcatttcaaggcacagctaa

SEQ ID NO: 7845410 - DNA, 22 bp, Homo sapiens
gtgcatttgacgaatactcact

SEQ ID NO: 7845411 - DNA, 22 bp, Homo sapiens
gtgcatttggtgactctcaccc

SEQ ID NO: 7845412 - DNA, 22 bp, Homo sapiens
gtgcatttggtgactctcaccc

SEQ ID NO: 7845413 - DNA, 22 bp, Homo sapiens
gtgcatttgtgcatgcacatgt

SEQ ID NO: 7845414 - DNA, 22 bp, Homo sapiens
gtgcatttgtgcatgcacatgt

SEQ ID NO: 7845415 - DNA, 22 bp, Homo sapiens
gtgcatttgtgcatgcacatgt

SEQ ID NO: 7845416 - DNA, 22 bp, Homo sapiens
gtgaaatatttaacgtccaggt

SEQ ID NO: 7845417 - DNA, 22 bp, Homo sapiens
gtgaaatatttaacgtccaggt

SEQ ID NO: 7845418 - DNA, 22 bp, Homo sapiens
gtgaaatatttaacgtccaggt

SEQ ID NO: 7845419 - DNA, 22 bp, Homo sapiens
gtgaaagtaagaaagtaggact

SEQ ID NO: 7845420 - DNA, 22 bp, Homo sapiens
gtgaaagagatgcagcataatg

SEQ ID NO: 7845421 - DNA, 22 bp, Homo sapiens
gtgaaagacagcattaatggct

SEQ ID NO: 7845422 - DNA, 18 bp, Homo sapiens
gtgaaagagacagggcag

SEQ ID NO: 7845423 - DNA, 22 bp, Homo sapiens
gtgaaatgaatctggaaatatt

SEQ ID NO: 7845424 - DNA, 22 bp, Homo sapiens
gtgaaatgaatctggaaatatt

SEQ ID NO: 7845425 - DNA, 22 bp, Homo sapiens
gtgaaatatttaacgtccaggt

SEQ ID NO: 7845426 - DNA, 22 bp, Homo sapiens
gtgaacagataatagaaatgaa

SEQ ID NO: 7845427 - DNA, 22 bp, Homo sapiens
gtgaacaggagaaagtgatgga

SEQ ID NO: 7845428 - DNA, 22 bp, Homo sapiens
gtgaacatcagattacatgaga

SEQ ID NO: 7845429 - DNA, 22 bp, Homo sapiens
gtgaacattgaggcagaaagga

SEQ ID NO: 7845430 - DNA, 22 bp, Homo sapiens
gtgaacattgaggcagaaagga

SEQ ID NO: 7845431 - DNA, 22 bp, Homo sapiens
gtgaactaaggattcaaacttc

SEQ ID NO: 7845432 - DNA, 22 bp, Homo sapiens
gtgaactattgggtatcataaa

SEQ ID NO: 7845433 - DNA, 22 bp, Homo sapiens
gtgaaccaagaagtcaaagcga

SEQ ID NO: 7845434 - DNA, 22 bp, Homo sapiens
gtgaaaataaggctggttcttg

SEQ ID NO: 7845435 - DNA, 22 bp, Homo sapiens
gtgaaaagcaacattgtggacc

SEQ ID NO: 7845436 - DNA, 22 bp, Homo sapiens
gtgaaaagcaacattgtggacc

SEQ ID NO: 7845437 - DNA, 22 bp, Homo sapiens
gtgaaaagagagcctgtgtcag

SEQ ID NO: 7845438 - DNA, 22 bp, Homo sapiens
gtctggagtggtggatttaaag

SEQ ID NO: 7845439 - DNA, 22 bp, Homo sapiens
gtctggagtggggcctgagaat

SEQ ID NO: 7845440 - DNA, 22 bp, Homo sapiens
gtctggagtggggcctgagaat

SEQ ID NO: 7845441 - DNA, 22 bp, Homo sapiens
gtgaaacaccctccaatgcaca

SEQ ID NO: 7845442 - DNA, 22 bp, Homo sapiens
gtgaaacaccctccaatgcaca

SEQ ID NO: 7845443 - DNA, 22 bp, Homo sapiens
gtgaaaataaggctggttcttg

SEQ ID NO: 7845444 - DNA, 22 bp, Homo sapiens
gtgaaaataaggctggttcttg

SEQ ID NO: 7845445 - DNA, 22 bp, Homo sapiens
gtgaaactgctttgtaaactgt

SEQ ID NO: 7845446 - DNA, 22 bp, Homo sapiens
gtgaaacagaagctcctggaat

SEQ ID NO: 7845447 - DNA, 22 bp, Homo sapiens
gtgaaacaccctccaatgcaca

SEQ ID NO: 7845448 - DNA, 17 bp, Homo sapiens
gtctggagtggccttca

SEQ ID NO: 7845449 - DNA, 17 bp, Homo sapiens
gtctggagtggccttca

SEQ ID NO: 7845450 - DNA, 22 bp, Homo sapiens
gtctggagtaccataaaaagga

SEQ ID NO: 7845451 - DNA, 18 bp, Homo sapiens
gtctggaggtcaggagct

SEQ ID NO: 7845452 - DNA, 18 bp, Homo sapiens
gtctggaggtcaggagct

SEQ ID NO: 7845453 - DNA, 18 bp, Homo sapiens
gtctggaggtcaggagct

SEQ ID NO: 7845454 - DNA, 18 bp, Homo sapiens
gtctggaggtcaggagct

SEQ ID NO: 7845455 - DNA, 22 bp, Homo sapiens
gtctggagggaagagatgtcag

SEQ ID NO: 7845456 - DNA, 22 bp, Homo sapiens
gtctggagggaagagatgtcag

SEQ ID NO: 7845457 - DNA, 22 bp, Homo sapiens
gtctggagggtgggtagagacc

SEQ ID NO: 7845458 - DNA, 22 bp, Homo sapiens
gtctggaggggagatttgggtt

SEQ ID NO: 7845459 - DNA, 22 bp, Homo sapiens
gtgaaggactagcatggagggc

SEQ ID NO: 7845460 - DNA, 22 bp, Homo sapiens
gtgaaggactagcatggagggc

SEQ ID NO: 7845461 - DNA, 22 bp, Homo sapiens
gtgaaggactgaatgaaaatgt

SEQ ID NO: 7845462 - DNA, 22 bp, Homo sapiens
gtgaaggaggggccacagatat

SEQ ID NO: 7845463 - DNA, 22 bp, Homo sapiens
gtgaaggagttatcagtggtta

SEQ ID NO: 7845464 - DNA, 22 bp, Homo sapiens
gtgaaggaggggccacagatat

SEQ ID NO: 7845465 - DNA, 22 bp, Homo sapiens
gtgaaggaggggccacagatat

SEQ ID NO: 7845466 - DNA, 22 bp, Homo sapiens
gtgaaggaccaatatgactcat

SEQ ID NO: 7845467 - DNA, 22 bp, Homo sapiens
gtgaaggactagcatggagggc

SEQ ID NO: 7845468 - DNA, 22 bp, Homo sapiens
gtgaaggaccaatatgactcat

SEQ ID NO: 7845469 - DNA, 18 bp, Homo sapiens
gtgaagctttattgaatg

SEQ ID NO: 7845470 - DNA, 22 bp, Homo sapiens
gtgaagccacagagccacgccg

SEQ ID NO: 7845471 - DNA, 22 bp, Homo sapiens
gtgaagcctcggaaccaagctc

SEQ ID NO: 7845472 - DNA, 22 bp, Homo sapiens
gtgaagcctcggaaccaagctc

SEQ ID NO: 7845473 - DNA, 19 bp, Homo sapiens
gtgaagctaagtatttgga

SEQ ID NO: 7845474 - DNA, 22 bp, Homo sapiens
gtgaaggataaggatctaaatt

SEQ ID NO: 7845475 - DNA, 22 bp, Homo sapiens
gtgaaggattggagggcatctt

SEQ ID NO: 7845476 - DNA, 22 bp, Homo sapiens
gtgaaggataaggatctaaatt

SEQ ID NO: 7845477 - DNA, 22 bp, Homo sapiens
gtgaaggagttatcagtggtta

SEQ ID NO: 7845478 - DNA, 22 bp, Homo sapiens
gtgaaggagttatcagtggtta

SEQ ID NO: 7845479 - DNA, 22 bp, Homo sapiens
gtgaccatcatctcagctagtt

SEQ ID NO: 7845480 - DNA, 22 bp, Homo sapiens
gtgaccatcatctcagctagtt

SEQ ID NO: 7845481 - DNA, 22 bp, Homo sapiens
gtgaccatcagagaataacaaa

SEQ ID NO: 7845482 - DNA, 22 bp, Homo sapiens
gtgaccatcatctcagctagtt

SEQ ID NO: 7845483 - DNA, 22 bp, Homo sapiens
gtgacccaggacactgtgtatc

SEQ ID NO: 7845484 - DNA, 22 bp, Homo sapiens
gtgacccaggacactgtgtatc

SEQ ID NO: 7845485 - DNA, 22 bp, Homo sapiens
gtgacccaggtaggtaagcaat

SEQ ID NO: 7845486 - DNA, 22 bp, Homo sapiens
gtgacccagaggctgactaaca

SEQ ID NO: 7845487 - DNA, 22 bp, Homo sapiens
gtgacccaggtaggtaagcaat

SEQ ID NO: 7845488 - DNA, 22 bp, Homo sapiens
gtgaccatttgacatatccttg

SEQ ID NO: 7845489 - DNA, 23 bp, Homo sapiens
gtgacccaaggaccttccagaat

SEQ ID NO: 7845490 - DNA, 22 bp, Homo sapiens
gtgacccagaggctgactaaca

SEQ ID NO: 7845491 - DNA, 23 bp, Homo sapiens
gtgacccaaggaccttccagaat

SEQ ID NO: 7845492 - DNA, 22 bp, Homo sapiens
gtgaagcagttgcgtgggttcc

SEQ ID NO: 7845493 - DNA, 22 bp, Homo sapiens
gtgaagcataactgaaggattt

SEQ ID NO: 7845494 - DNA, 22 bp, Homo sapiens
gtgaagcatatgcttctctgcc

SEQ ID NO: 7845495 - DNA, 23 bp, Homo sapiens
gtgaagatgtattatggattggc

SEQ ID NO: 7845496 - DNA, 22 bp, Homo sapiens
gtgaagcacatgggcgttgggt

SEQ ID NO: 7845497 - DNA, 22 bp, Homo sapiens
gtgaagcagggaaggaaaggat

SEQ ID NO: 7845498 - DNA, 22 bp, Homo sapiens
gtgaagcacgctgccgcactgg

SEQ ID NO: 7845499 - DNA, 22 bp, Homo sapiens
gtgaagcagagtgtggaagcaa

SEQ ID NO: 7845500 - DNA, 17 bp, Homo sapiens
gtgaagagtcattgaat

SEQ ID NO: 7845501 - DNA, 17 bp, Homo sapiens
gtgaagagtcattgaat

SEQ ID NO: 7845502 - DNA, 22 bp, Homo sapiens
gtgaagagctgttgcagagatt

SEQ ID NO: 7845503 - DNA, 17 bp, Homo sapiens
gtgaagagtcattgaat

SEQ ID NO: 7845504 - DNA, 17 bp, Homo sapiens
gtgaagagtcattgaat

SEQ ID NO: 7845505 - DNA, 22 bp, Homo sapiens
gtgaagagctgttgcagagatt

SEQ ID NO: 7845506 - DNA, 22 bp, Homo sapiens
gtgaagagctgttgcagagatt

SEQ ID NO: 7845507 - DNA, 22 bp, Homo sapiens
gtgaagagctgttgcagagatt

SEQ ID NO: 7845508 - DNA, 22 bp, Homo sapiens
gtgaagaccagggaacgctggc

SEQ ID NO: 7845509 - DNA, 22 bp, Homo sapiens
gtgaagaaggcaatacaaagaa

SEQ ID NO: 7845510 - DNA, 22 bp, Homo sapiens
gtgaagaaggcaatacaaagaa

SEQ ID NO: 7845511 - DNA, 22 bp, Homo sapiens
gtgaacttccagatgataaaca

SEQ ID NO: 7845512 - DNA, 22 bp, Homo sapiens
gtgaactgctgagttttatcat

SEQ ID NO: 7845513 - DNA, 22 bp, Homo sapiens
gtcctgggcggagggctgctgt

SEQ ID NO: 7845514 - DNA, 22 bp, Homo sapiens
gtcctgggcggagggctgctgt

SEQ ID NO: 7845515 - DNA, 22 bp, Homo sapiens
gtcctggggaatacagaagccg

SEQ ID NO: 7845516 - DNA, 22 bp, Homo sapiens
gtcctggggaatacagaagccg

SEQ ID NO: 7845517 - DNA, 22 bp, Homo sapiens
gtcctgggcggagggctgctgt

SEQ ID NO: 7845518 - DNA, 22 bp, Homo sapiens
gtcctgggcctgctgaggctga

SEQ ID NO: 7845519 - DNA, 22 bp, Homo sapiens
gtcctgggcggagggctgctgt

SEQ ID NO: 7845520 - DNA, 22 bp, Homo sapiens
gtcctgggcggagggctgctgt

SEQ ID NO: 7845521 - DNA, 22 bp, Homo sapiens
gtcctggggattatagagtgtt

SEQ ID NO: 7845522 - DNA, 22 bp, Homo sapiens
gtcctggggattatagagtgtt

SEQ ID NO: 7845523 - DNA, 22 bp, Homo sapiens
gtcctggggatacagaagtgaa

SEQ ID NO: 7845524 - DNA, 22 bp, Homo sapiens
gtcctggggatacagaagtgaa

SEQ ID NO: 7845525 - DNA, 22 bp, Homo sapiens
gtcctggggattatagagtgtt

SEQ ID NO: 7845526 - DNA, 22 bp, Homo sapiens
gtcctggggaatacagaagccg

SEQ ID NO: 7845527 - DNA, 22 bp, Homo sapiens
gtcctggggaatacagaagccg

SEQ ID NO: 7845528 - DNA, 22 bp, Homo sapiens
gtcctggggatacagaagtgaa

SEQ ID NO: 7845529 - DNA, 22 bp, Homo sapiens
gtcctggggatacagaagtgaa

SEQ ID NO: 7845530 - DNA, 22 bp, Homo sapiens
gtcctggggatacagaagtgaa

SEQ ID NO: 7845531 - DNA, 22 bp, Homo sapiens
gtcctggggatacagaagtgaa

SEQ ID NO: 7845532 - DNA, 22 bp, Homo sapiens
gtcctgggggcagctgtgtcca

SEQ ID NO: 7845533 - DNA, 22 bp, Homo sapiens
gtcctgggggcagctgtgtcca

SEQ ID NO: 7845534 - DNA, 22 bp, Homo sapiens
gtcctgggggcagctgtgtcca

SEQ ID NO: 7845535 - DNA, 22 bp, Homo sapiens
gtcctgggggcagctgtgtcca

SEQ ID NO: 7845536 - DNA, 22 bp, Homo sapiens
gtcctgggggcagctgtgtcca

SEQ ID NO: 7845537 - DNA, 22 bp, Homo sapiens
gtcctgggtccccgcaggtcag

SEQ ID NO: 7845538 - DNA, 22 bp, Homo sapiens
gtctgcccggccttcctccacc

SEQ ID NO: 7845539 - DNA, 22 bp, Homo sapiens
gtctgccccagaccctgaccca

SEQ ID NO: 7845540 - DNA, 22 bp, Homo sapiens
gtctgcccttggcctgggactt

SEQ ID NO: 7845541 - DNA, 22 bp, Homo sapiens
gtctgcccttggcctgggactt

SEQ ID NO: 7845542 - DNA, 22 bp, Homo sapiens
gtctgcccttcctctccacgat

SEQ ID NO: 7845543 - DNA, 22 bp, Homo sapiens
gtctgccctgctgatctcaccc

SEQ ID NO: 7845544 - DNA, 22 bp, Homo sapiens
gtctgccctgcagacatgcctc

SEQ ID NO: 7845545 - DNA, 22 bp, Homo sapiens
gtctgccctcacatgcactctt

SEQ ID NO: 7845546 - DNA, 22 bp, Homo sapiens
gtctgccctcacatgcactctt

SEQ ID NO: 7845547 - DNA, 22 bp, Homo sapiens
gtctgctgcagagcatggcttt

SEQ ID NO: 7845548 - DNA, 22 bp, Homo sapiens
gtctgctgcagagcatggcttt

SEQ ID NO: 7845549 - DNA, 22 bp, Homo sapiens
gtctgctgcagagcatggcttt

SEQ ID NO: 7845550 - DNA, 22 bp, Homo sapiens
gtctgctgacagagcatggacc

SEQ ID NO: 7845551 - DNA, 22 bp, Homo sapiens
gtctgctgacagagcatggacc

SEQ ID NO: 7845552 - DNA, 22 bp, Homo sapiens
gtctgctgcagtcgtggctcta

SEQ ID NO: 7845553 - DNA, 22 bp, Homo sapiens
gtctgctgcagtcgtggctcta

SEQ ID NO: 7845554 - DNA, 22 bp, Homo sapiens
gtctgctgcagtcgtggctcta

SEQ ID NO: 7845555 - DNA, 22 bp, Homo sapiens
gtctgctgcagagcatggcttt

SEQ ID NO: 7845556 - DNA, 22 bp, Homo sapiens
gtctgctgcagagcatggcttt

SEQ ID NO: 7845557 - DNA, 22 bp, Homo sapiens
gtctgctcatgctaccgcgggc

SEQ ID NO: 7845558 - DNA, 22 bp, Homo sapiens
gtctgctcatgctaccgcgggc

SEQ ID NO: 7845559 - DNA, 22 bp, Homo sapiens
gtctgctcatgctaccgcgggc

SEQ ID NO: 7845560 - DNA, 22 bp, Homo sapiens
gtctgctcatgctaccgcgggc

SEQ ID NO: 7845561 - DNA, 22 bp, Homo sapiens
gtctgcctggaggcagctgctg

SEQ ID NO: 7845562 - DNA, 22 bp, Homo sapiens
gtctgcctgggacgctgggagt

SEQ ID NO: 7845563 - DNA, 22 bp, Homo sapiens
gtctgcctgctagtggctgcct

SEQ ID NO: 7845564 - DNA, 22 bp, Homo sapiens
gtctgcctggaggcagctgctg

SEQ ID NO: 7845565 - DNA, 22 bp, Homo sapiens
gtctgcctgctagtggctgcct

SEQ ID NO: 7845566 - DNA, 22 bp, Homo sapiens
gtctgcctctttctttctgggt

SEQ ID NO: 7845567 - DNA, 22 bp, Homo sapiens
gtctgcctctttctttctgggt

SEQ ID NO: 7845568 - DNA, 22 bp, Homo sapiens
gtctgcccttggctcagccata

SEQ ID NO: 7845569 - DNA, 22 bp, Homo sapiens
gtctgcccttggctcagccata

SEQ ID NO: 7845570 - DNA, 22 bp, Homo sapiens
gtctgcctcagccgggggccgc

SEQ ID NO: 7845571 - DNA, 22 bp, Homo sapiens
gtctgctggcacgtcacagata

SEQ ID NO: 7845572 - DNA, 22 bp, Homo sapiens
gtctgctggtgcctggcctgcg

SEQ ID NO: 7845573 - DNA, 22 bp, Homo sapiens
gtctgctggtgcctggcctgcg

SEQ ID NO: 7845574 - DNA, 22 bp, Homo sapiens
gtctgctggtgcctggcctgcg

SEQ ID NO: 7845575 - DNA, 22 bp, Homo sapiens
gtctgctgcagtcgtggctcta

SEQ ID NO: 7845576 - DNA, 22 bp, Homo sapiens
gtctgctgcagtcgtggctcta

SEQ ID NO: 7845577 - DNA, 22 bp, Homo sapiens
gtctgctgcttctgttgaagca

SEQ ID NO: 7845578 - DNA, 22 bp, Homo sapiens
gtctgctggcacgtcacagata

SEQ ID NO: 7845579 - DNA, 22 bp, Homo sapiens
gtctgctggcacgtcacagata

SEQ ID NO: 7845580 - DNA, 22 bp, Homo sapiens
gtctgctgtgccttggggaaaa

SEQ ID NO: 7845581 - DNA, 22 bp, Homo sapiens
gtctgctgtgccttggggaaaa

SEQ ID NO: 7845582 - DNA, 22 bp, Homo sapiens
gtctgctgtgggtccccaggag

SEQ ID NO: 7845583 - DNA, 22 bp, Homo sapiens
gtctgctgtgggtccccaggag

SEQ ID NO: 7845584 - DNA, 22 bp, Homo sapiens
gtctgctgtaggtaggacagca

SEQ ID NO: 7845585 - DNA, 22 bp, Homo sapiens
gtctgctgtaggtaggacagca

SEQ ID NO: 7845586 - DNA, 22 bp, Homo sapiens
gtctgctgtaggtaggacagca

SEQ ID NO: 7845587 - DNA, 22 bp, Homo sapiens
gtctgctggtgcctggcctgcg

SEQ ID NO: 7845588 - DNA, 22 bp, Homo sapiens
gtctgctgtaggtaggacagca

SEQ ID NO: 7845589 - DNA, 22 bp, Homo sapiens
gtctggaggcccgtcagcccta

SEQ ID NO: 7845590 - DNA, 22 bp, Homo sapiens
gtctggaggcccgtcagcccta

SEQ ID NO: 7845591 - DNA, 22 bp, Homo sapiens
gtctggaggcactttctcatga

SEQ ID NO: 7845592 - DNA, 22 bp, Homo sapiens
gtctggaggcactttctcatga

SEQ ID NO: 7845593 - DNA, 22 bp, Homo sapiens
gtctggaggagggctctgcggc

SEQ ID NO: 7845594 - DNA, 22 bp, Homo sapiens
gtctggaggagggctctgcggc

SEQ ID NO: 7845595 - DNA, 22 bp, Homo sapiens
gtctggaggaggaagaaggcac

SEQ ID NO: 7845596 - DNA, 22 bp, Homo sapiens
gtctggagcctgggtccctgct

SEQ ID NO: 7845597 - DNA, 22 bp, Homo sapiens
gtctggagcctgggtccctgct

SEQ ID NO: 7845598 - DNA, 22 bp, Homo sapiens
gtctggaggaggaagaaggcac

SEQ ID NO: 7845599 - DNA, 22 bp, Homo sapiens
gtctggaggaaaaggttaaatg

SEQ ID NO: 7845600 - DNA, 22 bp, Homo sapiens
gtattgtattgggatgagctct

SEQ ID NO: 7845601 - DNA, 22 bp, Homo sapiens
gtattgtatatttgcaaataca

SEQ ID NO: 7845602 - DNA, 22 bp, Homo sapiens
gtattgtattgaacacatgtga

SEQ ID NO: 7845603 - DNA, 22 bp, Homo sapiens
gtattgtatttatttatgtgac

SEQ ID NO: 7845604 - DNA, 22 bp, Homo sapiens
gtattgtattgaacacatgtga

SEQ ID NO: 7845605 - DNA, 22 bp, Homo sapiens
gtattgtatatttgcaaataca

SEQ ID NO: 7845606 - DNA, 22 bp, Homo sapiens
gtatttataggggaatgagagt

SEQ ID NO: 7845607 - DNA, 22 bp, Homo sapiens
gtatttcacatatggatatgct

SEQ ID NO: 7845608 - DNA, 22 bp, Homo sapiens
gtatttcacatatggatatgct

SEQ ID NO: 7845609 - DNA, 22 bp, Homo sapiens
gtatttaattctgtgcttctag

SEQ ID NO: 7845610 - DNA, 22 bp, Homo sapiens
gtattgcaattactcttcttct

SEQ ID NO: 7845611 - DNA, 22 bp, Homo sapiens
gtattgcaattactcttcttct

SEQ ID NO: 7845612 - DNA, 22 bp, Homo sapiens
gtattgcaattactcttcttct

SEQ ID NO: 7845613 - DNA, 21 bp, Homo sapiens
gtattgcagagttatgtgctc

SEQ ID NO: 7845614 - DNA, 22 bp, Homo sapiens
gtattgcatagacctgggatga

SEQ ID NO: 7845615 - DNA, 21 bp, Homo sapiens
gtattgcagagttatgtgctc

SEQ ID NO: 7845616 - DNA, 22 bp, Homo sapiens
gtattgcattttgaatgcatgg

SEQ ID NO: 7845617 - DNA, 22 bp, Homo sapiens
gtattgcattttgaatgcatgg

SEQ ID NO: 7845618 - DNA, 22 bp, Homo sapiens
gtattgcattttgaatgcatgg

SEQ ID NO: 7845619 - DNA, 22 bp, Homo sapiens
gtattgcattttaatatgtgca

SEQ ID NO: 7845620 - DNA, 22 bp, Homo sapiens
gtattgcattgtttcaagctgt

SEQ ID NO: 7845621 - DNA, 22 bp, Homo sapiens
gtattgtagctacaatagacgt

SEQ ID NO: 7845622 - DNA, 22 bp, Homo sapiens
gtattgggtgagggcaaagggt

SEQ ID NO: 7845623 - DNA, 22 bp, Homo sapiens
gtattgggtgagggcaaagggt

SEQ ID NO: 7845624 - DNA, 20 bp, Homo sapiens
gtattggggcctggaggaag

SEQ ID NO: 7845625 - DNA, 20 bp, Homo sapiens
gtattggggcctggaggaag

SEQ ID NO: 7845626 - DNA, 22 bp, Homo sapiens
gtattgggattatgggtgtgag

SEQ ID NO: 7845627 - DNA, 22 bp, Homo sapiens
gtattgggattatgggtgtgag

SEQ ID NO: 7845628 - DNA, 22 bp, Homo sapiens
gtattcttgagtggcaactagg

SEQ ID NO: 7845629 - DNA, 22 bp, Homo sapiens
gtattcttaaggattgagcaaa

SEQ ID NO: 7845630 - DNA, 21 bp, Homo sapiens
gtattctttatgaagtgaaaa

SEQ ID NO: 7845631 - DNA, 22 bp, Homo sapiens
gtattctgggccgattacaaaa

SEQ ID NO: 7845632 - DNA, 22 bp, Homo sapiens
gtattcccagagtgttacatac

SEQ ID NO: 7845633 - DNA, 22 bp, Homo sapiens
gtattctcaggtggttcctcga

SEQ ID NO: 7845634 - DNA, 22 bp, Homo sapiens
gtattccttcagaagacgttta

SEQ ID NO: 7845635 - DNA, 22 bp, Homo sapiens
gtattcatttatttactcatcc

SEQ ID NO: 7845636 - DNA, 22 bp, Homo sapiens
gtattccattagtgttaatatc

SEQ ID NO: 7845637 - DNA, 22 bp, Homo sapiens
gtattccattagtgttaatatc

SEQ ID NO: 7845638 - DNA, 22 bp, Homo sapiens
gtattcctaagtcatgacaaat

SEQ ID NO: 7845639 - DNA, 22 bp, Homo sapiens
gtattcctaagtcatgacaaat

SEQ ID NO: 7845640 - DNA, 22 bp, Homo sapiens
gtattcaaggattttgttctac

SEQ ID NO: 7845641 - DNA, 22 bp, Homo sapiens
gtattcaagcgagcagatgtct

SEQ ID NO: 7845642 - DNA, 22 bp, Homo sapiens
gtattcatattaaacatatcaa

SEQ ID NO: 7845643 - DNA, 22 bp, Homo sapiens
gtattagctggataaagtaggt

SEQ ID NO: 7845644 - DNA, 22 bp, Homo sapiens
gtagacagcaaccaaaccaggt

SEQ ID NO: 7845645 - DNA, 23 bp, Homo sapiens
gtagacagatgggccaaggtaat

SEQ ID NO: 7845646 - DNA, 22 bp, Homo sapiens
gtagacagaaagcggaatcata

SEQ ID NO: 7845647 - DNA, 23 bp, Homo sapiens
gtagacagatgggccaaggtaat

SEQ ID NO: 7845648 - DNA, 22 bp, Homo sapiens
gtagacaaatttcttctctcaa

SEQ ID NO: 7845649 - DNA, 22 bp, Homo sapiens
gtagacaagcacaggactcaga

SEQ ID NO: 7845650 - DNA, 22 bp, Homo sapiens
gtattagtcaattacagtgggg

SEQ ID NO: 7845651 - DNA, 22 bp, Homo sapiens
gtattagttatctactgctgtg

SEQ ID NO: 7845652 - DNA, 22 bp, Homo sapiens
gtattattaagtgtatttgacc

SEQ ID NO: 7845653 - DNA, 22 bp, Homo sapiens
gtattattaagtgtatttgacc

SEQ ID NO: 7845654 - DNA, 18 bp, Homo sapiens
gtattagttttcagagag

SEQ ID NO: 7845655 - DNA, 22 bp, Homo sapiens
gtattagtcaattacagtgggg

SEQ ID NO: 7845656 - DNA, 22 bp, Homo sapiens
gtattattgtcatgaaataata

SEQ ID NO: 7845657 - DNA, 22 bp, Homo sapiens
gtattattgtcatgaaataata

SEQ ID NO: 7845658 - DNA, 22 bp, Homo sapiens
gtattattgtcatgaaataata

SEQ ID NO: 7845659 - DNA, 22 bp, Homo sapiens
gtattattgtcatgaaataata

SEQ ID NO: 7845660 - DNA, 22 bp, Homo sapiens
gtattattaagtgtatttgacc

SEQ ID NO: 7845661 - DNA, 22 bp, Homo sapiens
gtattattctcagctttgggat

SEQ ID NO: 7845662 - DNA, 22 bp, Homo sapiens
gtattattaagtgtatttgacc

SEQ ID NO: 7845663 - DNA, 22 bp, Homo sapiens
gtattattctcagctttgggat

SEQ ID NO: 7845664 - DNA, 22 bp, Homo sapiens
gtattattgggtagtatggtaa

SEQ ID NO: 7845665 - DNA, 22 bp, Homo sapiens
gtagaatattttgttctactat

SEQ ID NO: 7845666 - DNA, 22 bp, Homo sapiens
gtagaatcccagtggctatatt

SEQ ID NO: 7845667 - DNA, 22 bp, Homo sapiens
gtagaattacctctctatgtcc

SEQ ID NO: 7845668 - DNA, 22 bp, Homo sapiens
gtagacaaatttcttctctcaa

SEQ ID NO: 7845669 - DNA, 22 bp, Homo sapiens
gtagaattttaataatggagat

SEQ ID NO: 7845670 - DNA, 22 bp, Homo sapiens
gtagaattttaataatggagat

SEQ ID NO: 7845671 - DNA, 22 bp, Homo sapiens
gtagaataggggtattgcttca

SEQ ID NO: 7845672 - DNA, 22 bp, Homo sapiens
gtagaataggggtattgcttca

SEQ ID NO: 7845673 - DNA, 22 bp, Homo sapiens
gtagaataaatgtacacatctg

SEQ ID NO: 7845674 - DNA, 22 bp, Homo sapiens
gtagaataaatgtacacatctg

SEQ ID NO: 7845675 - DNA, 20 bp, Homo sapiens
gtagaaccatgtgtgctggg

SEQ ID NO: 7845676 - DNA, 22 bp, Homo sapiens
gtagaaccttctttactagagt

SEQ ID NO: 7845677 - DNA, 22 bp, Homo sapiens
gtacctgagcacgcggtccgag

SEQ ID NO: 7845678 - DNA, 22 bp, Homo sapiens
gtactaaaaaatgatcagtttg

SEQ ID NO: 7845679 - DNA, 22 bp, Homo sapiens
gtactaaaaaatgatcagtttg

SEQ ID NO: 7845680 - DNA, 22 bp, Homo sapiens
gtacgtgcatgcacgtgtgcct

SEQ ID NO: 7845681 - DNA, 22 bp, Homo sapiens
gtagaaatgtaaccaggagata

SEQ ID NO: 7845682 - DNA, 22 bp, Homo sapiens
gtagaaatgtaaccaggagata

SEQ ID NO: 7845683 - DNA, 22 bp, Homo sapiens
gtagaaatggtgtgtttcttct

SEQ ID NO: 7845684 - DNA, 22 bp, Homo sapiens
gtactaaaaaatgatcagtttg

SEQ ID NO: 7845685 - DNA, 22 bp, Homo sapiens
gtagaaatggtgtgtttcttct

SEQ ID NO: 7845686 - DNA, 22 bp, Homo sapiens
gtagaacactggggctctgttg

SEQ ID NO: 7845687 - DNA, 22 bp, Homo sapiens
gtagaaatgtaaccaggagata

SEQ ID NO: 7845688 - DNA, 22 bp, Homo sapiens
gtagaaatgtaaccaggagata

SEQ ID NO: 7845689 - DNA, 22 bp, Homo sapiens
gtagaaattccatttactttga

SEQ ID NO: 7845690 - DNA, 22 bp, Homo sapiens
gtagaaattccatttactttga

SEQ ID NO: 7845691 - DNA, 22 bp, Homo sapiens
gtagaaattccatttactttga

SEQ ID NO: 7845692 - DNA, 22 bp, Homo sapiens
ggttttggaagtgtgtctgcag

SEQ ID NO: 7845693 - DNA, 22 bp, Homo sapiens
ggttttggagcatggagagcct

SEQ ID NO: 7845694 - DNA, 18 bp, Homo sapiens
ggttttggcatgtgtgcc

SEQ ID NO: 7845695 - DNA, 22 bp, Homo sapiens
ggttttggctagaaatgcttaa

SEQ ID NO: 7845696 - DNA, 22 bp, Homo sapiens
gtaaaacaagctttatggttcc

SEQ ID NO: 7845697 - DNA, 22 bp, Homo sapiens
gtaaaaaggccaagcccttgtg

SEQ ID NO: 7845698 - DNA, 22 bp, Homo sapiens
gtaaaacaagctttatggttcc

SEQ ID NO: 7845699 - DNA, 22 bp, Homo sapiens
gtaaaacatgttttaactagga

SEQ ID NO: 7845700 - DNA, 22 bp, Homo sapiens
gtaaaacatgttttaactagga

SEQ ID NO: 7845701 - DNA, 22 bp, Homo sapiens
gtaaaacaagctttatggttcc

SEQ ID NO: 7845702 - DNA, 22 bp, Homo sapiens
gtaaaacaagctttatggttcc

SEQ ID NO: 7845703 - DNA, 22 bp, Homo sapiens
gtaaaacatgttttaactagga

SEQ ID NO: 7845704 - DNA, 22 bp, Homo sapiens
gtaaaacatgttttaactagga

SEQ ID NO: 7845705 - DNA, 22 bp, Homo sapiens
ggttttatagcagtactatcag

SEQ ID NO: 7845706 - DNA, 22 bp, Homo sapiens
ggttttattaactttaacatca

SEQ ID NO: 7845707 - DNA, 22 bp, Homo sapiens
ggttttattaactttaacatca

SEQ ID NO: 7845708 - DNA, 22 bp, Homo sapiens
ggttttggaagtataaagatgt

SEQ ID NO: 7845709 - DNA, 22 bp, Homo sapiens
ggttttcaaagaggcatttcat

SEQ ID NO: 7845710 - DNA, 22 bp, Homo sapiens
ggtttcaacttttgtgaggaat

SEQ ID NO: 7845711 - DNA, 22 bp, Homo sapiens
ggtttcaatgagaagtgcttgt

SEQ ID NO: 7845712 - DNA, 22 bp, Homo sapiens
ggtttcaactaaatcaagaagg

SEQ ID NO: 7845713 - DNA, 22 bp, Homo sapiens
ggtttcaacttcaacctctcca

SEQ ID NO: 7845714 - DNA, 22 bp, Homo sapiens
ggtttccaaagatagagtagta

SEQ ID NO: 7845715 - DNA, 22 bp, Homo sapiens
ggtttccaagtggttgaaaagt

SEQ ID NO: 7845716 - DNA, 22 bp, Homo sapiens
ggtttcagccctgctgttcctg

SEQ ID NO: 7845717 - DNA, 22 bp, Homo sapiens
ggtttcctgcattgggaaattt

SEQ ID NO: 7845718 - DNA, 22 bp, Homo sapiens
ggttttaactacagaattgcaa

SEQ ID NO: 7845719 - DNA, 22 bp, Homo sapiens
ggttttaaccattcacaagtga

SEQ ID NO: 7845720 - DNA, 22 bp, Homo sapiens
ggtttgttggggtccaggccca

SEQ ID NO: 7845721 - DNA, 22 bp, Homo sapiens
ggtttgttggggtccaggccca

SEQ ID NO: 7845722 - DNA, 22 bp, Homo sapiens
ggtttggttttggccatcttcc

SEQ ID NO: 7845723 - DNA, 22 bp, Homo sapiens
ggtttggttctgagagttggca

SEQ ID NO: 7845724 - DNA, 22 bp, Homo sapiens
ggtttctcaccttcagcactac

SEQ ID NO: 7845725 - DNA, 22 bp, Homo sapiens
ggtttctctgggtgtgggtgct

SEQ ID NO: 7845726 - DNA, 22 bp, Homo sapiens
ggtttgaacagctttggagaag

SEQ ID NO: 7845727 - DNA, 22 bp, Homo sapiens
ggtttgcattctgaaaggctca

SEQ ID NO: 7845728 - DNA, 22 bp, Homo sapiens
ggtttgacagcttggggctgtc

SEQ ID NO: 7845729 - DNA, 22 bp, Homo sapiens
ggtttgacagcttggggctgtc

SEQ ID NO: 7845730 - DNA, 22 bp, Homo sapiens
gtacatttctcttgttcttatt

SEQ ID NO: 7845731 - DNA, 22 bp, Homo sapiens
gtacatttctcttgttcttatt

SEQ ID NO: 7845732 - DNA, 22 bp, Homo sapiens
gtacattttactttgtttgaat

SEQ ID NO: 7845733 - DNA, 22 bp, Homo sapiens
gtacattttactttgtttgaat

SEQ ID NO: 7845734 - DNA, 22 bp, Homo sapiens
gtacatttctcccaacactaaa

SEQ ID NO: 7845735 - DNA, 22 bp, Homo sapiens
gtacatttctcccaacactaaa

SEQ ID NO: 7845736 - DNA, 22 bp, Homo sapiens
gtacatttctcccaacactaaa

SEQ ID NO: 7845737 - DNA, 22 bp, Homo sapiens
gtacatttctcttgttcttatt

SEQ ID NO: 7845738 - DNA, 20 bp, Homo sapiens
gtacattttcaggaggggat

SEQ ID NO: 7845739 - DNA, 22 bp, Homo sapiens
gtacattttgaggttaaaacaa

SEQ ID NO: 7845740 - DNA, 22 bp, Homo sapiens
gtacattttgaggttaaaacaa

SEQ ID NO: 7845741 - DNA, 22 bp, Homo sapiens
gtacattttgaggttaaaacaa

SEQ ID NO: 7845742 - DNA, 22 bp, Homo sapiens
gtaccagtctctgtgggcacct

SEQ ID NO: 7845743 - DNA, 23 bp, Homo sapiens
gtacccactcccatatgtccatc

SEQ ID NO: 7845744 - DNA, 22 bp, Homo sapiens
gtacccactatcctgagttttt

SEQ ID NO: 7845745 - DNA, 22 bp, Homo sapiens
gtaccctgtggccagccagcca

SEQ ID NO: 7845746 - DNA, 22 bp, Homo sapiens
gtaccctgtggccagccagcca

SEQ ID NO: 7845747 - DNA, 22 bp, Homo sapiens
gtaccctggggacttcctttta

SEQ ID NO: 7845748 - DNA, 22 bp, Homo sapiens
gtacccaaagcccattgggcca

SEQ ID NO: 7845749 - DNA, 22 bp, Homo sapiens
gtacatttcatttaaatgatgt

SEQ ID NO: 7845750 - DNA, 22 bp, Homo sapiens
gtacatttcatttaaatgatgt

SEQ ID NO: 7845751 - DNA, 22 bp, Homo sapiens
gtacatttcatttaaatgatgt

SEQ ID NO: 7845752 - DNA, 22 bp, Homo sapiens
gtacatttcatttaaatgatgt

SEQ ID NO: 7845753 - DNA, 22 bp, Homo sapiens
gtacatttcatttaaatgatgt

SEQ ID NO: 7845754 - DNA, 22 bp, Homo sapiens
gtacatttatttttgcagcata

SEQ ID NO: 7845755 - DNA, 22 bp, Homo sapiens
gtacatttcagtttccttaaga

SEQ ID NO: 7845756 - DNA, 22 bp, Homo sapiens
gtacatttcagtttccttaaga

SEQ ID NO: 7845757 - DNA, 22 bp, Homo sapiens
gtacatttcagtttccttaaga

SEQ ID NO: 7845758 - DNA, 22 bp, Homo sapiens
gtacatttaggattcattgaaa

SEQ ID NO: 7845759 - DNA, 22 bp, Homo sapiens
gtacatttatttttgcagcata

SEQ ID NO: 7845760 - DNA, 22 bp, Homo sapiens
gtacatttaggattcattgaaa

SEQ ID NO: 7845761 - DNA, 23 bp, Homo sapiens
gtaaaatacgcagtgcagtgtga

SEQ ID NO: 7845762 - DNA, 23 bp, Homo sapiens
gtaaaatacgcagtgcagtgtga

SEQ ID NO: 7845763 - DNA, 23 bp, Homo sapiens
gtaaaatacgcagtgcagtgtga

SEQ ID NO: 7845764 - DNA, 22 bp, Homo sapiens
gtaaaactgtctaatggtatat

SEQ ID NO: 7845765 - DNA, 22 bp, Homo sapiens
gtaaaactgtctaatggtatat

SEQ ID NO: 7845766 - DNA, 22 bp, Homo sapiens
gtaaaactgtctaatggtatat

SEQ ID NO: 7845767 - DNA, 22 bp, Homo sapiens
gtaaaactgtctaatggtatat

SEQ ID NO: 7845768 - DNA, 22 bp, Homo sapiens
gtaaaactgcagaacttggagg

SEQ ID NO: 7845769 - DNA, 22 bp, Homo sapiens
gtaaaacctgcttttcaacacc

SEQ ID NO: 7845770 - DNA, 22 bp, Homo sapiens
gtaaaactgcagaacttggagg

SEQ ID NO: 7845771 - DNA, 22 bp, Homo sapiens
gtaaaactgcagaacttggagg

SEQ ID NO: 7845772 - DNA, 23 bp, Homo sapiens
gtatttcagcattctcagttaaa

SEQ ID NO: 7845773 - DNA, 23 bp, Homo sapiens
gtatttcagcattctcagttaaa

SEQ ID NO: 7845774 - DNA, 23 bp, Homo sapiens
gtatttcagcattctcagttaaa

SEQ ID NO: 7845775 - DNA, 23 bp, Homo sapiens
gtatttcagcattctcagttaaa

SEQ ID NO: 7845776 - DNA, 19 bp, Homo sapiens
gtatttcaggacaagacgt

SEQ ID NO: 7845777 - DNA, 19 bp, Homo sapiens
gtatttcaggacaagacgt

SEQ ID NO: 7845778 - DNA, 19 bp, Homo sapiens
gtatttcaggacaagacgt

SEQ ID NO: 7845779 - DNA, 22 bp, Homo sapiens
gtatttcagttcctcttgtgac

SEQ ID NO: 7845780 - DNA, 22 bp, Homo sapiens
gtatttcagttcctcttgtgac

SEQ ID NO: 7845781 - DNA, 22 bp, Homo sapiens
gtatttcagttcctcttgtgac

SEQ ID NO: 7845782 - DNA, 22 bp, Homo sapiens
gtatttcatcttgaaaaccagt

SEQ ID NO: 7845783 - DNA, 22 bp, Homo sapiens
gtatttcatcttgaaaaccagt

SEQ ID NO: 7845784 - DNA, 22 bp, Homo sapiens
gtcattttatgggaacagattt

SEQ ID NO: 7845785 - DNA, 22 bp, Homo sapiens
gtcattttctagaattatttga

SEQ ID NO: 7845786 - DNA, 22 bp, Homo sapiens
gtatttccattagtgtgtgcac

SEQ ID NO: 7845787 - DNA, 22 bp, Homo sapiens
gtcatttttcactgcatataga

SEQ ID NO: 7845788 - DNA, 22 bp, Homo sapiens
gtcatttttcactgcatataga

SEQ ID NO: 7845789 - DNA, 22 bp, Homo sapiens
gtcatttttgactttgaagtga

SEQ ID NO: 7845790 - DNA, 22 bp, Homo sapiens
gtcatttttgactttgaagtga

SEQ ID NO: 7845791 - DNA, 22 bp, Homo sapiens
gtcatttttttcgtaatagtgg

SEQ ID NO: 7845792 - DNA, 22 bp, Homo sapiens
gtcatttttttcgtaatagtgg

SEQ ID NO: 7845793 - DNA, 22 bp, Homo sapiens
gtcatttttgactttgaagtga

SEQ ID NO: 7845794 - DNA, 22 bp, Homo sapiens
gtcattttctagaattatttga

SEQ ID NO: 7845795 - DNA, 22 bp, Homo sapiens
gtcattttctagaattatttga

SEQ ID NO: 7845796 - DNA, 22 bp, Homo sapiens
gtcatttttcactgcatataga

SEQ ID NO: 7845797 - DNA, 22 bp, Homo sapiens
gtcattttgctgcatatttaga

SEQ ID NO: 7845798 - DNA, 22 bp, Homo sapiens
gtcattttgctgcatatttaga

SEQ ID NO: 7845799 - DNA, 22 bp, Homo sapiens
gtcatttttttcgtaatagtgg

SEQ ID NO: 7845800 - DNA, 22 bp, Homo sapiens
gtccaaaagagccagccgggcg

SEQ ID NO: 7845801 - DNA, 22 bp, Homo sapiens
gtccaaaagagccagccgggcg

SEQ ID NO: 7845802 - DNA, 22 bp, Homo sapiens
gtccaaaagagccagccgggcg

SEQ ID NO: 7845803 - DNA, 22 bp, Homo sapiens
gtccaaataagttgcaaaatag

SEQ ID NO: 7845804 - DNA, 22 bp, Homo sapiens
gtccaaaagagccagccgggcg

SEQ ID NO: 7845805 - DNA, 22 bp, Homo sapiens
gtccaaaagagccagccgggcg

SEQ ID NO: 7845806 - DNA, 22 bp, Homo sapiens
gtccaaaagagccagccgggcg

SEQ ID NO: 7845807 - DNA, 22 bp, Homo sapiens
gtccaagagtcaagaagggggc

SEQ ID NO: 7845808 - DNA, 22 bp, Homo sapiens
gtccaagagaactgaaatagga

SEQ ID NO: 7845809 - DNA, 22 bp, Homo sapiens
gtccaagagtcaagaagggggc

SEQ ID NO: 7845810 - DNA, 22 bp, Homo sapiens
gtccaaggcaagtgtgcagagt

SEQ ID NO: 7845811 - DNA, 22 bp, Homo sapiens
gtccaaggcaagtgtgcagagt

SEQ ID NO: 7845812 - DNA, 22 bp, Homo sapiens
gtccaagggtgcacaactagta

SEQ ID NO: 7845813 - DNA, 22 bp, Homo sapiens
gtccaagggtgcacaactagta

SEQ ID NO: 7845814 - DNA, 22 bp, Homo sapiens
gtccaaggatgcaggatgctgt

SEQ ID NO: 7845815 - DNA, 22 bp, Homo sapiens
gtccaaggatgcaggatgctgt

SEQ ID NO: 7845816 - DNA, 22 bp, Homo sapiens
gtccaaggatggggtctcccag

SEQ ID NO: 7845817 - DNA, 22 bp, Homo sapiens
gtccaaggatggggtctcccag

SEQ ID NO: 7845818 - DNA, 22 bp, Homo sapiens
gtccacaaaattactatcttac

SEQ ID NO: 7845819 - DNA, 22 bp, Homo sapiens
gtccaaggtctttggagataga

SEQ ID NO: 7845820 - DNA, 22 bp, Homo sapiens
gtccaaggtctttggagataga

SEQ ID NO: 7845821 - DNA, 22 bp, Homo sapiens
gtccaaggtctttggagataga

SEQ ID NO: 7845822 - DNA, 22 bp, Homo sapiens
gtccaagtacatgtgtgtacat

SEQ ID NO: 7845823 - DNA, 22 bp, Homo sapiens
gtccacaacatcagactaactg

SEQ ID NO: 7845824 - DNA, 22 bp, Homo sapiens
gtccacaagcaggaagtgagcc

SEQ ID NO: 7845825 - DNA, 22 bp, Homo sapiens
gtccacactgaggccttctcca

SEQ ID NO: 7845826 - DNA, 22 bp, Homo sapiens
gtccacaaaattactatcttac

SEQ ID NO: 7845827 - DNA, 22 bp, Homo sapiens
gtccacaacatcagactaactg

SEQ ID NO: 7845828 - DNA, 22 bp, Homo sapiens
gtccaccttcttggtcaggccc

SEQ ID NO: 7845829 - DNA, 22 bp, Homo sapiens
gtccaccttcttggtcaggccc

SEQ ID NO: 7845830 - DNA, 22 bp, Homo sapiens
gtccactcccagtgcctgaggc

SEQ ID NO: 7845831 - DNA, 22 bp, Homo sapiens
gtccactcccagtgcctgaggc

SEQ ID NO: 7845832 - DNA, 19 bp, Homo sapiens
gtccactccactcggtctc

SEQ ID NO: 7845833 - DNA, 22 bp, Homo sapiens
gtccacagggatggccacacat

SEQ ID NO: 7845834 - DNA, 22 bp, Homo sapiens
gtccacagctggccagggcctc

SEQ ID NO: 7845835 - DNA, 22 bp, Homo sapiens
gtccacagggatggccacacat

SEQ ID NO: 7845836 - DNA, 22 bp, Homo sapiens
gtccacagtgaggtgtttaaat

SEQ ID NO: 7845837 - DNA, 22 bp, Homo sapiens
gtccacaagcaggaagtgagcc

SEQ ID NO: 7845838 - DNA, 22 bp, Homo sapiens
gtccacagatctcttgttgacc

SEQ ID NO: 7845839 - DNA, 22 bp, Homo sapiens
gtccacagagggctgggcaggc

SEQ ID NO: 7845840 - DNA, 22 bp, Homo sapiens
gtccacagagggctgggcaggc

SEQ ID NO: 7845841 - DNA, 22 bp, Homo sapiens
gtccacagagggctgggcaggc

SEQ ID NO: 7845842 - DNA, 22 bp, Homo sapiens
gtccacagagggctgggcaggc

SEQ ID NO: 7845843 - DNA, 18 bp, Homo sapiens
gtccacagattcttcact

SEQ ID NO: 7845844 - DNA, 18 bp, Homo sapiens
gtccacagattcttcact

SEQ ID NO: 7845845 - DNA, 22 bp, Homo sapiens
gtccacagctggccagggcctc

SEQ ID NO: 7845846 - DNA, 22 bp, Homo sapiens
gtccacagctggccagggcctc

SEQ ID NO: 7845847 - DNA, 22 bp, Homo sapiens
gtccacagctggccagggcctc

SEQ ID NO: 7845848 - DNA, 22 bp, Homo sapiens
gtccacagctctgaggtctccc

SEQ ID NO: 7845849 - DNA, 22 bp, Homo sapiens
gtccacagctggccagggcctc

SEQ ID NO: 7845850 - DNA, 22 bp, Homo sapiens
gtccacagctggccagggcctc

SEQ ID NO: 7845851 - DNA, 22 bp, Homo sapiens
gtccacagctctgaggtctccc

SEQ ID NO: 7845852 - DNA, 22 bp, Homo sapiens
gtccacagctctgaggtctccc

SEQ ID NO: 7845853 - DNA, 18 bp, Homo sapiens
gtccacagccctcacagc

SEQ ID NO: 7845854 - DNA, 18 bp, Homo sapiens
gtccacagccctcacagc

SEQ ID NO: 7845855 - DNA, 18 bp, Homo sapiens
gtccacagccctcacagc

SEQ ID NO: 7845856 - DNA, 23 bp, Homo sapiens
gtccagaacccaggctggggtgg

SEQ ID NO: 7845857 - DNA, 23 bp, Homo sapiens
gtccagaacccaggctggggtgg

SEQ ID NO: 7845858 - DNA, 23 bp, Homo sapiens
gtccagaacccaggctggggtgg

SEQ ID NO: 7845859 - DNA, 22 bp, Homo sapiens
gtccagaaagggcagtgatttg

SEQ ID NO: 7845860 - DNA, 22 bp, Homo sapiens
gtccagaaagggcagtgatttg

SEQ ID NO: 7845861 - DNA, 22 bp, Homo sapiens
gtcccattcatctccctaggga

SEQ ID NO: 7845862 - DNA, 23 bp, Homo sapiens
gtccagaacccaggctggggtgg

SEQ ID NO: 7845863 - DNA, 23 bp, Homo sapiens
gtccagaacccaggctggggtgg

SEQ ID NO: 7845864 - DNA, 22 bp, Homo sapiens
gtccagaagcagtgcacatcac

SEQ ID NO: 7845865 - DNA, 22 bp, Homo sapiens
gtccagaagcagtgcacatcac

SEQ ID NO: 7845866 - DNA, 22 bp, Homo sapiens
gtccactgctgtgtgcttcacc

SEQ ID NO: 7845867 - DNA, 22 bp, Homo sapiens
gtccactgctgtgtgcttcacc

SEQ ID NO: 7845868 - DNA, 22 bp, Homo sapiens
gtccactctctgccgtgcctgt

SEQ ID NO: 7845869 - DNA, 22 bp, Homo sapiens
gtccccagagctggtggtggtt

SEQ ID NO: 7845870 - DNA, 22 bp, Homo sapiens
gtccccagctaatctctttgcc

SEQ ID NO: 7845871 - DNA, 22 bp, Homo sapiens
gtccccagagctggtggtggtt

SEQ ID NO: 7845872 - DNA, 22 bp, Homo sapiens
gtccccagagctggtggtggtt

SEQ ID NO: 7845873 - DNA, 22 bp, Homo sapiens
gtccccagaaaggtgaggcagg

SEQ ID NO: 7845874 - DNA, 22 bp, Homo sapiens
gtccccagaaaggtgaggcagg

SEQ ID NO: 7845875 - DNA, 22 bp, Homo sapiens
gtccccagaaaggtgaggcagg

SEQ ID NO: 7845876 - DNA, 22 bp, Homo sapiens
gtccccagaaaggtgaggcagg

SEQ ID NO: 7845877 - DNA, 22 bp, Homo sapiens
gtcccattttctactatggaat

SEQ ID NO: 7845878 - DNA, 22 bp, Homo sapiens
gtcccattttgcagatagagca

SEQ ID NO: 7845879 - DNA, 22 bp, Homo sapiens
gtcccatttcaagaaattcatg

SEQ ID NO: 7845880 - DNA, 22 bp, Homo sapiens
gtcccattgttctgggcttggc

SEQ ID NO: 7845881 - DNA, 22 bp, Homo sapiens
gtcccattccctgtatcttaga

SEQ ID NO: 7845882 - DNA, 22 bp, Homo sapiens
gtcccattgctcattagctttc

SEQ ID NO: 7845883 - DNA, 22 bp, Homo sapiens
gtccctctgtgtccctgcagtc

SEQ ID NO: 7845884 - DNA, 22 bp, Homo sapiens
gtccctgagcctggcatttccc

SEQ ID NO: 7845885 - DNA, 22 bp, Homo sapiens
gtccctgcatcaccacgggact

SEQ ID NO: 7845886 - DNA, 22 bp, Homo sapiens
gtccctgcatcaccacgggact

SEQ ID NO: 7845887 - DNA, 22 bp, Homo sapiens
gtccctgcatcaccacgggact

SEQ ID NO: 7845888 - DNA, 22 bp, Homo sapiens
gtccctctgtgtccctgcagtc

SEQ ID NO: 7845889 - DNA, 22 bp, Homo sapiens
gtccctctgtgtccctgcagtc

SEQ ID NO: 7845890 - DNA, 22 bp, Homo sapiens
gtccctctgctctagagagcca

SEQ ID NO: 7845891 - DNA, 22 bp, Homo sapiens
gtccctctgctctagagagcca

SEQ ID NO: 7845892 - DNA, 22 bp, Homo sapiens
gtccctcagtagtgcacagtgg

SEQ ID NO: 7845893 - DNA, 22 bp, Homo sapiens
gtccctcagtagtgcacagtgg

SEQ ID NO: 7845894 - DNA, 22 bp, Homo sapiens
gtccctcactggaccatatgaa

SEQ ID NO: 7845895 - DNA, 22 bp, Homo sapiens
gtccctcactggaccatatgaa

SEQ ID NO: 7845896 - DNA, 22 bp, Homo sapiens
gtccctcactggaccatatgaa

SEQ ID NO: 7845897 - DNA, 22 bp, Homo sapiens
gtcccgcattgggcattcctgg

SEQ ID NO: 7845898 - DNA, 22 bp, Homo sapiens
gtccctagtggaaagacatgat

SEQ ID NO: 7845899 - DNA, 22 bp, Homo sapiens
gtccctcaaggtccagtcatgg

SEQ ID NO: 7845900 - DNA, 22 bp, Homo sapiens
gtcccctcagccacccatgggg

SEQ ID NO: 7845901 - DNA, 22 bp, Homo sapiens
gtcccctcattttagagaaaga

SEQ ID NO: 7845902 - DNA, 22 bp, Homo sapiens
gtcccctggcccccagcgtcgg

SEQ ID NO: 7845903 - DNA, 22 bp, Homo sapiens
gtcccctggcccccagcgtcgg

SEQ ID NO: 7845904 - DNA, 22 bp, Homo sapiens
gtcccctggcccccagcgtcgg

SEQ ID NO: 7845905 - DNA, 22 bp, Homo sapiens
gtcccctggtggctggagctgc

SEQ ID NO: 7845906 - DNA, 22 bp, Homo sapiens
gtcccctgtccagggccagcca

SEQ ID NO: 7845907 - DNA, 22 bp, Homo sapiens
gtccccttaaacatgctctctt

SEQ ID NO: 7845908 - DNA, 22 bp, Homo sapiens
gtccccttaaacatgctctctt

SEQ ID NO: 7845909 - DNA, 22 bp, Homo sapiens
gtcccctgtccagggccagcca

SEQ ID NO: 7845910 - DNA, 22 bp, Homo sapiens
gtccccttggtaaccttcagct

SEQ ID NO: 7845911 - DNA, 22 bp, Homo sapiens
gtccccttggtaaccttcagct

SEQ ID NO: 7845912 - DNA, 22 bp, Homo sapiens
gtcccctcaaaattcatatgtt

SEQ ID NO: 7845913 - DNA, 22 bp, Homo sapiens
gtccccgccgtcgctcaggctg

SEQ ID NO: 7845914 - DNA, 22 bp, Homo sapiens
gtcccctcaaaattcatatgtt

SEQ ID NO: 7845915 - DNA, 22 bp, Homo sapiens
gtccccagctgtgacgagagcc

SEQ ID NO: 7845916 - DNA, 22 bp, Homo sapiens
gtccccagctaatctctttgcc

SEQ ID NO: 7845917 - DNA, 22 bp, Homo sapiens
gtccccagctaatctctttgcc

SEQ ID NO: 7845918 - DNA, 22 bp, Homo sapiens
gtccccagctgtgacgagagcc

SEQ ID NO: 7845919 - DNA, 22 bp, Homo sapiens
gtccccagctgtgacgagagcc

SEQ ID NO: 7845920 - DNA, 22 bp, Homo sapiens
gtccccagctgtgacgagagcc

SEQ ID NO: 7845921 - DNA, 22 bp, Homo sapiens
gtcctgggcctgctgaggctga

SEQ ID NO: 7845922 - DNA, 22 bp, Homo sapiens
gtcctgggcccaggggctgcct

SEQ ID NO: 7845923 - DNA, 22 bp, Homo sapiens
gtcctgggaggggctggtcctg

SEQ ID NO: 7845924 - DNA, 22 bp, Homo sapiens
gtcctgggcatgcagggctttc

SEQ ID NO: 7845925 - DNA, 22 bp, Homo sapiens
gtcctgggcatgcagggctttc

SEQ ID NO: 7845926 - DNA, 22 bp, Homo sapiens
gtcctgggcatgcagggctttc

SEQ ID NO: 7845927 - DNA, 22 bp, Homo sapiens
gtcctgggcccaggggctgcct

SEQ ID NO: 7845928 - DNA, 17 bp, Homo sapiens
gtcctgggaggagagag

SEQ ID NO: 7845929 - DNA, 17 bp, Homo sapiens
gtcctgggaggagagag

SEQ ID NO: 7845930 - DNA, 17 bp, Homo sapiens
gtcctgggaggagagag

SEQ ID NO: 7845931 - DNA, 22 bp, Homo sapiens
gtcctgggaggggctggtcctg

SEQ ID NO: 7845932 - DNA, 22 bp, Homo sapiens
gtcctgggaggggctggtcctg

SEQ ID NO: 7845933 - DNA, 22 bp, Homo sapiens
gtcctgggaggggctggtcctg

SEQ ID NO: 7845934 - DNA, 17 bp, Homo sapiens
gtcctgggaggagagag

SEQ ID NO: 7845935 - DNA, 17 bp, Homo sapiens
gtcctgggaggagagag

SEQ ID NO: 7845936 - DNA, 20 bp, Homo sapiens
gtcctgggagccacagcaca

SEQ ID NO: 7845937 - DNA, 20 bp, Homo sapiens
gtcctgggagccacagcaca

SEQ ID NO: 7845938 - DNA, 17 bp, Homo sapiens
gtcctgggaggagagag

SEQ ID NO: 7845939 - DNA, 22 bp, Homo sapiens
gtcctgggagatgggaccctga

SEQ ID NO: 7845940 - DNA, 22 bp, Homo sapiens
gtcctgggagatgggaccctga

SEQ ID NO: 7845941 - DNA, 20 bp, Homo sapiens
gtcctgggagccacagcaca

SEQ ID NO: 7845942 - DNA, 20 bp, Homo sapiens
gtcctgggagccacagcaca

SEQ ID NO: 7845943 - DNA, 22 bp, Homo sapiens
gtcctgggaaggaagccaggga

SEQ ID NO: 7845944 - DNA, 22 bp, Homo sapiens
gtcctgggaactggacagctaa

SEQ ID NO: 7845945 - DNA, 22 bp, Homo sapiens
gtcctgggaaggaagccaggga

SEQ ID NO: 7845946 - DNA, 22 bp, Homo sapiens
gtcctgggaaggaagccaggga

SEQ ID NO: 7845947 - DNA, 22 bp, Homo sapiens
gtcctgggaaggaagccaggga

SEQ ID NO: 7845948 - DNA, 22 bp, Homo sapiens
gtcctgggaaggaagccaggga

SEQ ID NO: 7845949 - DNA, 22 bp, Homo sapiens
gtccctgcatctgcaggccatg

SEQ ID NO: 7845950 - DNA, 22 bp, Homo sapiens
gtccctgccctcctgggactca

SEQ ID NO: 7845951 - DNA, 22 bp, Homo sapiens
gtccctgccctcctgggactca

SEQ ID NO: 7845952 - DNA, 22 bp, Homo sapiens
gtccctggaaaagagctggtga

SEQ ID NO: 7845953 - DNA, 22 bp, Homo sapiens
gtccctgcatctgcaggccatg

SEQ ID NO: 7845954 - DNA, 22 bp, Homo sapiens
gtccctgcatctgcaggccatg

SEQ ID NO: 7845955 - DNA, 22 bp, Homo sapiens
gtccctgcatctgcaggccatg

SEQ ID NO: 7845956 - DNA, 22 bp, Homo sapiens
gtccctgcatctgcaggccatg

SEQ ID NO: 7845957 - DNA, 22 bp, Homo sapiens
gtcctgggaactggacagctaa

SEQ ID NO: 7845958 - DNA, 22 bp, Homo sapiens
gtcctgggaactggacagctaa

SEQ ID NO: 7845959 - DNA, 22 bp, Homo sapiens
gtcctgggaactggacagctaa

SEQ ID NO: 7845960 - DNA, 22 bp, Homo sapiens
gtcctgggaactggacagctaa

SEQ ID NO: 7845961 - DNA, 22 bp, Homo sapiens
ctggctcttgcgactcagcttg

SEQ ID NO: 7845962 - DNA, 22 bp, Homo sapiens
ctggctcttgcgactcagcttg

SEQ ID NO: 7845963 - DNA, 22 bp, Homo sapiens
ctggctcttgcgactcagcttg

SEQ ID NO: 7845964 - DNA, 22 bp, Homo sapiens
ctggctcttctgggttctgtgt

SEQ ID NO: 7845965 - DNA, 21 bp, Homo sapiens
ctggctctgttgtcacccggc

SEQ ID NO: 7845966 - DNA, 22 bp, Homo sapiens
ctggctcttcagtgcttggttc

SEQ ID NO: 7845967 - DNA, 22 bp, Homo sapiens
ctggctccaaggaagaggtttt

SEQ ID NO: 7845968 - DNA, 22 bp, Homo sapiens
ctggctccaaggaagaggtttt

SEQ ID NO: 7845969 - DNA, 22 bp, Homo sapiens
ctggctccaaggaagaggtttt

SEQ ID NO: 7845970 - DNA, 22 bp, Homo sapiens
ctggctccaaggaagaggtttt

SEQ ID NO: 7845971 - DNA, 22 bp, Homo sapiens
ctggctccaaggaagaggtttt

SEQ ID NO: 7845972 - DNA, 22 bp, Homo sapiens
ctggctccaaggaagaggtttt

SEQ ID NO: 7845973 - DNA, 22 bp, Homo sapiens
ctggctccaaattctgatgttc

SEQ ID NO: 7845974 - DNA, 22 bp, Homo sapiens
ctggctcattttagcatcaggt

SEQ ID NO: 7845975 - DNA, 22 bp, Homo sapiens
ctggctccaaattctgatgttc

SEQ ID NO: 7845976 - DNA, 22 bp, Homo sapiens
ctggctgcaggaaggagtgggc

SEQ ID NO: 7845977 - DNA, 22 bp, Homo sapiens
ctggctcttgcgactcagcttg

SEQ ID NO: 7845978 - DNA, 22 bp, Homo sapiens
ctggctcttgcgactcagcttg

SEQ ID NO: 7845979 - DNA, 22 bp, Homo sapiens
ctggctgcaggatgaggctgcc

SEQ ID NO: 7845980 - DNA, 22 bp, Homo sapiens
ctggctgcaggatgaggctgcc

SEQ ID NO: 7845981 - DNA, 22 bp, Homo sapiens
ctggctgcaggatgaggctgcc

SEQ ID NO: 7845982 - DNA, 22 bp, Homo sapiens
ctggctgcaggatgaggctgcc

SEQ ID NO: 7845983 - DNA, 22 bp, Homo sapiens
ctggctgcaggatgaggctgcc

SEQ ID NO: 7845984 - DNA, 22 bp, Homo sapiens
ctggctgcaggatgaggctgcc

SEQ ID NO: 7845985 - DNA, 22 bp, Homo sapiens
ctggctgcagtagcaagagact

SEQ ID NO: 7845986 - DNA, 22 bp, Homo sapiens
ctggctgcagtagcaagagact

SEQ ID NO: 7845987 - DNA, 22 bp, Homo sapiens
ctggctcatgtgatgagggcaa

SEQ ID NO: 7845988 - DNA, 22 bp, Homo sapiens
ctggctcatgtgatgagggcaa

SEQ ID NO: 7845989 - DNA, 22 bp, Homo sapiens
ctggctcatgtgatgagggcaa

SEQ ID NO: 7845990 - DNA, 22 bp, Homo sapiens
ctggctcattttagcatcaggt

SEQ ID NO: 7845991 - DNA, 22 bp, Homo sapiens
ctggctcatgtgatgagggcaa

SEQ ID NO: 7845992 - DNA, 22 bp, Homo sapiens
ctggctcattttagcatcaggt

SEQ ID NO: 7845993 - DNA, 22 bp, Homo sapiens
ctggctcattttagcatcaggt

SEQ ID NO: 7845994 - DNA, 22 bp, Homo sapiens
ctggctcattttagcatcaggt

SEQ ID NO: 7845995 - DNA, 22 bp, Homo sapiens
ctggctcattttagcatcaggt

SEQ ID NO: 7845996 - DNA, 23 bp, Homo sapiens
ctggctcatcctggttgcagtgg

SEQ ID NO: 7845997 - DNA, 22 bp, Homo sapiens
ctggctcatgtgatgagggcaa

SEQ ID NO: 7845998 - DNA, 23 bp, Homo sapiens
ctggctcatcctggttgcagtgg

SEQ ID NO: 7845999 - DNA, 23 bp, Homo sapiens
ctggctcatcctggttgcagtgg

SEQ ID NO: 7846000 - DNA, 22 bp, Homo sapiens
ctggctcatccaggtgttgctc

SEQ ID NO: 7846001 - DNA, 22 bp, Homo sapiens
ctggctcatccaggtgttgctc

SEQ ID NO: 7846002 - DNA, 22 bp, Homo sapiens
ctggctcatccaggtgttgctc

SEQ ID NO: 7846003 - DNA, 23 bp, Homo sapiens
ctggctcatcctggttgcagtgg

SEQ ID NO: 7846004 - DNA, 23 bp, Homo sapiens
ctggctcatcctggttgcagtgg

SEQ ID NO: 7846005 - DNA, 23 bp, Homo sapiens
ctggctcatcctggttgcagtgg

SEQ ID NO: 7846006 - DNA, 22 bp, Homo sapiens
ctggctcagttcttggttttca

SEQ ID NO: 7846007 - DNA, 22 bp, Homo sapiens
ctggctcagtgccttcagaagt

SEQ ID NO: 7846008 - DNA, 22 bp, Homo sapiens
ctggctcagggtggtctgggtc

SEQ ID NO: 7846009 - DNA, 22 bp, Homo sapiens
ctggctcagtgccttcagaagt

SEQ ID NO: 7846010 - DNA, 22 bp, Homo sapiens
ctggctcatagagcagctccaa

SEQ ID NO: 7846011 - DNA, 22 bp, Homo sapiens
ctggctcagttcttggttttca

SEQ ID NO: 7846012 - DNA, 22 bp, Homo sapiens
ctggctcagttcttggttttca

SEQ ID NO: 7846013 - DNA, 22 bp, Homo sapiens
ctggctcagttcttggttttca

SEQ ID NO: 7846014 - DNA, 22 bp, Homo sapiens
ctggctcatccaggtgttgctc

SEQ ID NO: 7846015 - DNA, 22 bp, Homo sapiens
ctggctcatccaggtgttgctc

SEQ ID NO: 7846016 - DNA, 22 bp, Homo sapiens
ctggctcatagagcagctccaa

SEQ ID NO: 7846017 - DNA, 22 bp, Homo sapiens
ctggctcatagagcagctccaa

SEQ ID NO: 7846018 - DNA, 22 bp, Homo sapiens
ctggctcatagagcagctccaa

SEQ ID NO: 7846019 - DNA, 22 bp, Homo sapiens
ctggctcatagagcagctccaa

SEQ ID NO: 7846020 - DNA, 22 bp, Homo sapiens
ctggctggagaaatgaaattct

SEQ ID NO: 7846021 - DNA, 22 bp, Homo sapiens
ctggctggagaaatgaaattct

SEQ ID NO: 7846022 - DNA, 22 bp, Homo sapiens
ctggctggacttgtgcatgtca

SEQ ID NO: 7846023 - DNA, 22 bp, Homo sapiens
ctggctggacttgtgcatgtca

SEQ ID NO: 7846024 - DNA, 22 bp, Homo sapiens
ctggctggagcaggcatcttgt

SEQ ID NO: 7846025 - DNA, 22 bp, Homo sapiens
ctggctggagcaggcatcttgt

SEQ ID NO: 7846026 - DNA, 22 bp, Homo sapiens
ctggctggagcaggcatcttgt

SEQ ID NO: 7846027 - DNA, 22 bp, Homo sapiens
ctggctggagcaggcatcttgt

SEQ ID NO: 7846028 - DNA, 22 bp, Homo sapiens
ctggctggacttgtgcatgtca

SEQ ID NO: 7846029 - DNA, 22 bp, Homo sapiens
ctggctggacttgtgcatgtca

SEQ ID NO: 7846030 - DNA, 22 bp, Homo sapiens
ctggctggaagttagagaactt

SEQ ID NO: 7846031 - DNA, 22 bp, Homo sapiens
ctggctggaagttagagaactt

SEQ ID NO: 7846032 - DNA, 22 bp, Homo sapiens
ctggctggacttgtgcatgtca

SEQ ID NO: 7846033 - DNA, 22 bp, Homo sapiens
ctggctggacttgtgcatgtca

SEQ ID NO: 7846034 - DNA, 22 bp, Homo sapiens
ctggctgtgcagtcttccagaa

SEQ ID NO: 7846035 - DNA, 22 bp, Homo sapiens
ctggctgtgcagtcttccagaa

SEQ ID NO: 7846036 - DNA, 22 bp, Homo sapiens
ctggctgtgcagtcttccagaa

SEQ ID NO: 7846037 - DNA, 22 bp, Homo sapiens
ctggctggagcaggcatcttgt

SEQ ID NO: 7846038 - DNA, 22 bp, Homo sapiens
ctggctggagcaggcatcttgt

SEQ ID NO: 7846039 - DNA, 22 bp, Homo sapiens
ctggctggagctgttgtaggct

SEQ ID NO: 7846040 - DNA, 22 bp, Homo sapiens
ctggctgtgcagtcttccagaa

SEQ ID NO: 7846041 - DNA, 16 bp, Homo sapiens
ctggctggaagcctgg

SEQ ID NO: 7846042 - DNA, 22 bp, Homo sapiens
ctggctggaacgccgaggcggc

SEQ ID NO: 7846043 - DNA, 22 bp, Homo sapiens
ctggctggaacgccgaggcggc

SEQ ID NO: 7846044 - DNA, 22 bp, Homo sapiens
ctggctggaacgccgaggcggc

SEQ ID NO: 7846045 - DNA, 22 bp, Homo sapiens
ctggctggaacgccgaggcggc

SEQ ID NO: 7846046 - DNA, 20 bp, Homo sapiens
ctggctggaaacttagcctt

SEQ ID NO: 7846047 - DNA, 20 bp, Homo sapiens
ctggctggaaacttagcctt

SEQ ID NO: 7846048 - DNA, 20 bp, Homo sapiens
ctggctggaaacttagcctt

SEQ ID NO: 7846049 - DNA, 20 bp, Homo sapiens
ctggctggaaacttagcctt

SEQ ID NO: 7846050 - DNA, 20 bp, Homo sapiens
ctggctggaaacttagcctt

SEQ ID NO: 7846051 - DNA, 22 bp, Homo sapiens
ctggctgcttgttttgatgggt

SEQ ID NO: 7846052 - DNA, 22 bp, Homo sapiens
ctggctgcttgttttgatgggt

SEQ ID NO: 7846053 - DNA, 22 bp, Homo sapiens
ctggctgcttgtagactcgact

SEQ ID NO: 7846054 - DNA, 22 bp, Homo sapiens
ctggctgcttgttttgatgggt

SEQ ID NO: 7846055 - DNA, 22 bp, Homo sapiens
ctggctgcctatagtctccctt

SEQ ID NO: 7846056 - DNA, 22 bp, Homo sapiens
ctggctgcctatagtctccctt

SEQ ID NO: 7846057 - DNA, 22 bp, Homo sapiens
ctggctgcctatagtctccctt

SEQ ID NO: 7846058 - DNA, 22 bp, Homo sapiens
ctggctgcctatagtctccctt

SEQ ID NO: 7846059 - DNA, 22 bp, Homo sapiens
ctggctgcctatagtctccctt

SEQ ID NO: 7846060 - DNA, 22 bp, Homo sapiens
ctggctgcctggagtgagggag

SEQ ID NO: 7846061 - DNA, 22 bp, Homo sapiens
ctggctgccacttcagggtctt

SEQ ID NO: 7846062 - DNA, 22 bp, Homo sapiens
ctggctgcattggcaagtcaat

SEQ ID NO: 7846063 - DNA, 22 bp, Homo sapiens
ctggctgcattggcaagtcaat

SEQ ID NO: 7846064 - DNA, 22 bp, Homo sapiens
ctggctgcagtagcaagagact

SEQ ID NO: 7846065 - DNA, 22 bp, Homo sapiens
ctggctgcagtagcaagagact

SEQ ID NO: 7846066 - DNA, 22 bp, Homo sapiens
ctggctgccagcatttggggga

SEQ ID NO: 7846067 - DNA, 22 bp, Homo sapiens
ctggctgccacttcagggtctt

SEQ ID NO: 7846068 - DNA, 22 bp, Homo sapiens
ctggctgccacttcagggtctt

SEQ ID NO: 7846069 - DNA, 22 bp, Homo sapiens
ctggctgcgtctgctctgacag

SEQ ID NO: 7846070 - DNA, 22 bp, Homo sapiens
ctggctgcgtctgctctgacag

SEQ ID NO: 7846071 - DNA, 22 bp, Homo sapiens
ctggctgcgtctgctctgacag

SEQ ID NO: 7846072 - DNA, 22 bp, Homo sapiens
ctggctgcgtctgctctgacag

SEQ ID NO: 7846073 - DNA, 22 bp, Homo sapiens
ctggctgctggcctgaggatgc

SEQ ID NO: 7846074 - DNA, 22 bp, Homo sapiens
ctggctgctggcctgaggatgc

SEQ ID NO: 7846075 - DNA, 22 bp, Homo sapiens
ctggctgcgtctgctctgacag

SEQ ID NO: 7846076 - DNA, 22 bp, Homo sapiens
ctggctgctggcctgaggatgc

SEQ ID NO: 7846077 - DNA, 22 bp, Homo sapiens
ctggctgcttgggacagccatg

SEQ ID NO: 7846078 - DNA, 22 bp, Homo sapiens
ctggctgcttgggacagccatg

SEQ ID NO: 7846079 - DNA, 22 bp, Homo sapiens
ctggctgcttgggacagccatg

SEQ ID NO: 7846080 - DNA, 22 bp, Homo sapiens
ctggctgcttgggacagccatg

SEQ ID NO: 7846081 - DNA, 22 bp, Homo sapiens
ctggctgcttgtagactcgact

SEQ ID NO: 7846082 - DNA, 22 bp, Homo sapiens
ctggctgcttgtagactcgact

SEQ ID NO: 7846083 - DNA, 22 bp, Homo sapiens
ctggctgcttgggacagccatg

SEQ ID NO: 7846084 - DNA, 22 bp, Homo sapiens
ctggccctcggagtccagctgc

SEQ ID NO: 7846085 - DNA, 22 bp, Homo sapiens
ctggccctcggagtccagctgc

SEQ ID NO: 7846086 - DNA, 22 bp, Homo sapiens
ctggccctcggagtccagctgc

SEQ ID NO: 7846087 - DNA, 22 bp, Homo sapiens
ctggccctcggagtccagctgc

SEQ ID NO: 7846088 - DNA, 22 bp, Homo sapiens
ctggccctcagactcatgggca

SEQ ID NO: 7846089 - DNA, 22 bp, Homo sapiens
ctggccctcggagtccagctgc

SEQ ID NO: 7846090 - DNA, 22 bp, Homo sapiens
ctggccctcagactcatgggca

SEQ ID NO: 7846091 - DNA, 22 bp, Homo sapiens
ctggccctcagactcatgggca

SEQ ID NO: 7846092 - DNA, 22 bp, Homo sapiens
ctggccctcagactcatgggca

SEQ ID NO: 7846093 - DNA, 22 bp, Homo sapiens
ctggccctcggagtccagctgc

SEQ ID NO: 7846094 - DNA, 22 bp, Homo sapiens
ctggccctcggagtccagctgc

SEQ ID NO: 7846095 - DNA, 22 bp, Homo sapiens
ctggccctcggagtccagctgc

SEQ ID NO: 7846096 - DNA, 22 bp, Homo sapiens
ctggccctcgtcagtttcactg

SEQ ID NO: 7846097 - DNA, 22 bp, Homo sapiens
ctggccctcgtcagtttcactg

SEQ ID NO: 7846098 - DNA, 22 bp, Homo sapiens
ctggccctcggagtccagctgc

SEQ ID NO: 7846099 - DNA, 22 bp, Homo sapiens
ctggccctggagggctgtgcga

SEQ ID NO: 7846100 - DNA, 22 bp, Homo sapiens
ctggccctggagggctgtgcga

SEQ ID NO: 7846101 - DNA, 22 bp, Homo sapiens
ctggccctggagggctgtgcga

SEQ ID NO: 7846102 - DNA, 22 bp, Homo sapiens
ctggccctggagggctgtgcga

SEQ ID NO: 7846103 - DNA, 22 bp, Homo sapiens
ctggccctggagggctgtgcga

SEQ ID NO: 7846104 - DNA, 16 bp, Homo sapiens
ctggccctggctctgg

SEQ ID NO: 7846105 - DNA, 22 bp, Homo sapiens
ctggccctggagggctgtgcga

SEQ ID NO: 7846106 - DNA, 22 bp, Homo sapiens
ctggccctgcctaatgtacttg

SEQ ID NO: 7846107 - DNA, 22 bp, Homo sapiens
ctggccctgcctaatgtacttg

SEQ ID NO: 7846108 - DNA, 22 bp, Homo sapiens
ctggccctcgtcagtttcactg

SEQ ID NO: 7846109 - DNA, 22 bp, Homo sapiens
ctggccctgccagagatcaaca

SEQ ID NO: 7846110 - DNA, 22 bp, Homo sapiens
ctggccctgctccgcgccgcgg

SEQ ID NO: 7846111 - DNA, 22 bp, Homo sapiens
ctggccctgctccgcgccgcgg

SEQ ID NO: 7846112 - DNA, 22 bp, Homo sapiens
ctggccctgctccgcgccgcgg

SEQ ID NO: 7846113 - DNA, 22 bp, Homo sapiens
ctggccctgcctaatgtacttg

SEQ ID NO: 7846114 - DNA, 19 bp, Homo sapiens
ctggccaggccaggggccc

SEQ ID NO: 7846115 - DNA, 19 bp, Homo sapiens
ctggccaggccaggggccc

SEQ ID NO: 7846116 - DNA, 19 bp, Homo sapiens
ctggccaggccaggggccc

SEQ ID NO: 7846117 - DNA, 19 bp, Homo sapiens
ctggccaggccaggggccc

SEQ ID NO: 7846118 - DNA, 19 bp, Homo sapiens
ctggccaggccaggggccc

SEQ ID NO: 7846119 - DNA, 22 bp, Homo sapiens
ctggccaggcatcccctgatcc

SEQ ID NO: 7846120 - DNA, 22 bp, Homo sapiens
ctggccaggcatcccctgatcc

SEQ ID NO: 7846121 - DNA, 22 bp, Homo sapiens
ctggccaggcatcccctgatcc

SEQ ID NO: 7846122 - DNA, 22 bp, Homo sapiens
ctggccaggcatcccctgatcc

SEQ ID NO: 7846123 - DNA, 22 bp, Homo sapiens
ctggccaggcatcccctgatcc

SEQ ID NO: 7846124 - DNA, 19 bp, Homo sapiens
ctggccaggccaggggccc

SEQ ID NO: 7846125 - DNA, 22 bp, Homo sapiens
ctggccaggccccttgcagggc

SEQ ID NO: 7846126 - DNA, 22 bp, Homo sapiens
ctggccaggccccttgcagggc

SEQ ID NO: 7846127 - DNA, 19 bp, Homo sapiens
ctggccaggccaggggccc

SEQ ID NO: 7846128 - DNA, 19 bp, Homo sapiens
ctggccaggccaggggccc

SEQ ID NO: 7846129 - DNA, 19 bp, Homo sapiens
ctggccaggccaggggccc

SEQ ID NO: 7846130 - DNA, 22 bp, Homo sapiens
ctggcccagtctcagagtgtca

SEQ ID NO: 7846131 - DNA, 22 bp, Homo sapiens
ctggcccagtctcagagtgtca

SEQ ID NO: 7846132 - DNA, 22 bp, Homo sapiens
ctggcccagtctcagagtgtca

SEQ ID NO: 7846133 - DNA, 22 bp, Homo sapiens
ctggcccagtctcagagtgtca

SEQ ID NO: 7846134 - DNA, 22 bp, Homo sapiens
ctggcccaggtggtcgttgagg

SEQ ID NO: 7846135 - DNA, 22 bp, Homo sapiens
ctggccaggccccttgcagggc

SEQ ID NO: 7846136 - DNA, 22 bp, Homo sapiens
ctggcccaggtggtcgttgagg

SEQ ID NO: 7846137 - DNA, 22 bp, Homo sapiens
ctggccaggccccttgcagggc

SEQ ID NO: 7846138 - DNA, 22 bp, Homo sapiens
ctggcccagtctcagagtgtca

SEQ ID NO: 7846139 - DNA, 22 bp, Homo sapiens
ctggccctatgagcctcctgat

SEQ ID NO: 7846140 - DNA, 22 bp, Homo sapiens
ctggccctattccaggccttcc

SEQ ID NO: 7846141 - DNA, 22 bp, Homo sapiens
ctggccctatgagcctcctgat

SEQ ID NO: 7846142 - DNA, 22 bp, Homo sapiens
ctggccctattccaggccttcc

SEQ ID NO: 7846143 - DNA, 22 bp, Homo sapiens
ctggctcagacagctgtgcagt

SEQ ID NO: 7846144 - DNA, 22 bp, Homo sapiens
ctggctcagacagctgtgcagt

SEQ ID NO: 7846145 - DNA, 22 bp, Homo sapiens
ctggctcagacagctgtgcagt

SEQ ID NO: 7846146 - DNA, 22 bp, Homo sapiens
ctggctcactagccctgccctg

SEQ ID NO: 7846147 - DNA, 22 bp, Homo sapiens
ctggctcagacagctgtgcagt

SEQ ID NO: 7846148 - DNA, 22 bp, Homo sapiens
ctggctcagacagctgtgcagt

SEQ ID NO: 7846149 - DNA, 22 bp, Homo sapiens
ctggctcactagccctgccctg

SEQ ID NO: 7846150 - DNA, 22 bp, Homo sapiens
ctggctcaggaaagttgctgct

SEQ ID NO: 7846151 - DNA, 22 bp, Homo sapiens
ctggctcaggaaagttgctgct

SEQ ID NO: 7846152 - DNA, 22 bp, Homo sapiens
ctggctcagggtggtctgggtc

SEQ ID NO: 7846153 - DNA, 22 bp, Homo sapiens
ctggctcagggtggtctgggtc

SEQ ID NO: 7846154 - DNA, 22 bp, Homo sapiens
ctggctcagacagctgtgcagt

SEQ ID NO: 7846155 - DNA, 22 bp, Homo sapiens
ctggctcagacagctgtgcagt

SEQ ID NO: 7846156 - DNA, 22 bp, Homo sapiens
ctggctcaggaaagttgctgct

SEQ ID NO: 7846157 - DNA, 22 bp, Homo sapiens
ctggctcactagccctgccctg

SEQ ID NO: 7846158 - DNA, 22 bp, Homo sapiens
ctggctcaggaaagttgctgct

SEQ ID NO: 7846159 - DNA, 22 bp, Homo sapiens
ctggctcacctccgctccagca

SEQ ID NO: 7846160 - DNA, 22 bp, Homo sapiens
ctggctcacctccgctccagca

SEQ ID NO: 7846161 - DNA, 22 bp, Homo sapiens
ctggctcacctccgctccagca

SEQ ID NO: 7846162 - DNA, 22 bp, Homo sapiens
ctggctcactagccctgccctg

SEQ ID NO: 7846163 - DNA, 22 bp, Homo sapiens
ctggctcactagccctgccctg

SEQ ID NO: 7846164 - DNA, 22 bp, Homo sapiens
ctggctcactagccctgccctg

SEQ ID NO: 7846165 - DNA, 22 bp, Homo sapiens
ctggctcacctccgctccagca

SEQ ID NO: 7846166 - DNA, 22 bp, Homo sapiens
ctggcctgtcctgacccagcct

SEQ ID NO: 7846167 - DNA, 22 bp, Homo sapiens
ctggcctgtcctgacccagcct

SEQ ID NO: 7846168 - DNA, 22 bp, Homo sapiens
ctggcctgtcctgacccagcct

SEQ ID NO: 7846169 - DNA, 22 bp, Homo sapiens
ctggcctgtcctgacccagcct

SEQ ID NO: 7846170 - DNA, 22 bp, Homo sapiens
ctggcctgtcctgacccagcct

SEQ ID NO: 7846171 - DNA, 22 bp, Homo sapiens
ctggcctgtgggctgtctccgg

SEQ ID NO: 7846172 - DNA, 22 bp, Homo sapiens
ctggcctgtgggctgtctccgg

SEQ ID NO: 7846173 - DNA, 22 bp, Homo sapiens
ctggcctgtgggctgtctccgg

SEQ ID NO: 7846174 - DNA, 22 bp, Homo sapiens
ctggctcacctccgctccagca

SEQ ID NO: 7846175 - DNA, 22 bp, Homo sapiens
ctggcctgtgggctgtctccgg

SEQ ID NO: 7846176 - DNA, 22 bp, Homo sapiens
ctggcctgtgggctgtctccgg

SEQ ID NO: 7846177 - DNA, 22 bp, Homo sapiens
ctggccctggctggagcccagg

SEQ ID NO: 7846178 - DNA, 22 bp, Homo sapiens
ctggccctggctggagcccagg

SEQ ID NO: 7846179 - DNA, 22 bp, Homo sapiens
ctggccctggctggagcccagg

SEQ ID NO: 7846180 - DNA, 23 bp, Homo sapiens
ctggccctggctctgtgatcatg

SEQ ID NO: 7846181 - DNA, 23 bp, Homo sapiens
ctggccctggctctgtgatcatg

SEQ ID NO: 7846182 - DNA, 23 bp, Homo sapiens
ctggccctggctctgtgatcatg

SEQ ID NO: 7846183 - DNA, 16 bp, Homo sapiens
ctggccctggctctgg

SEQ ID NO: 7846184 - DNA, 22 bp, Homo sapiens
ctggccctggctggagcccagg

SEQ ID NO: 7846185 - DNA, 22 bp, Homo sapiens
ctggccctggtaaggacaccca

SEQ ID NO: 7846186 - DNA, 22 bp, Homo sapiens
ctggccctggtaaggacaccca

SEQ ID NO: 7846187 - DNA, 22 bp, Homo sapiens
ctggccctggtaaggacaccca

SEQ ID NO: 7846188 - DNA, 22 bp, Homo sapiens
ctggccctggtaaggacaccca

SEQ ID NO: 7846189 - DNA, 22 bp, Homo sapiens
ctggccctgtaggatgtgagtt

SEQ ID NO: 7846190 - DNA, 22 bp, Homo sapiens
ctggccctgtaggatgtgagtt

SEQ ID NO: 7846191 - DNA, 22 bp, Homo sapiens
ctggccctgtcagcacagaatc

SEQ ID NO: 7846192 - DNA, 22 bp, Homo sapiens
ctggccctgtcagcacagaatc

SEQ ID NO: 7846193 - DNA, 22 bp, Homo sapiens
ctggccctgtggaggcaggaac

SEQ ID NO: 7846194 - DNA, 22 bp, Homo sapiens
ctggccctgtggaggcaggaac

SEQ ID NO: 7846195 - DNA, 22 bp, Homo sapiens
ctggccctgtggaggcaggaac

SEQ ID NO: 7846196 - DNA, 22 bp, Homo sapiens
ctggcctggtctggcctctcca

SEQ ID NO: 7846197 - DNA, 22 bp, Homo sapiens
ctggccctgtggaggcaggaac

SEQ ID NO: 7846198 - DNA, 22 bp, Homo sapiens
ctggccctgtggaggcaggaac

SEQ ID NO: 7846199 - DNA, 21 bp, Homo sapiens
ctggccactgcacctcttcct

SEQ ID NO: 7846200 - DNA, 22 bp, Homo sapiens
ctggccactgattcctcccctg

SEQ ID NO: 7846201 - DNA, 21 bp, Homo sapiens
ctggccactgcacctcttcct

SEQ ID NO: 7846202 - DNA, 21 bp, Homo sapiens
ctggccactgcacctcttcct

SEQ ID NO: 7846203 - DNA, 21 bp, Homo sapiens
ctggccactgcacctcttcct

SEQ ID NO: 7846204 - DNA, 22 bp, Homo sapiens
ctggccactgcacctcttcctt

SEQ ID NO: 7846205 - DNA, 22 bp, Homo sapiens
ctggccactgcacctcttcctt

SEQ ID NO: 7846206 - DNA, 22 bp, Homo sapiens
ctggccactgcacctcttcctt

SEQ ID NO: 7846207 - DNA, 22 bp, Homo sapiens
ctggccactgcacctcttcctt

SEQ ID NO: 7846208 - DNA, 22 bp, Homo sapiens
ctggccagagttggagggtgtg

SEQ ID NO: 7846209 - DNA, 22 bp, Homo sapiens
ctggccagagttggagggtgtg

SEQ ID NO: 7846210 - DNA, 22 bp, Homo sapiens
ctggccagagttggagggtgtg

SEQ ID NO: 7846211 - DNA, 22 bp, Homo sapiens
ctggccagagttggagggtgtg

SEQ ID NO: 7846212 - DNA, 22 bp, Homo sapiens
ctggccagagttggagggtgtg

SEQ ID NO: 7846213 - DNA, 22 bp, Homo sapiens
ctggccagatgttacgtccaat

SEQ ID NO: 7846214 - DNA, 22 bp, Homo sapiens
ctggccagatgttacgtccaat

SEQ ID NO: 7846215 - DNA, 22 bp, Homo sapiens
ctggccagatgttacgtccaat

SEQ ID NO: 7846216 - DNA, 22 bp, Homo sapiens
ctggccagatgttacgtccaat

SEQ ID NO: 7846217 - DNA, 22 bp, Homo sapiens
ctggccagcatggctgaagtac

SEQ ID NO: 7846218 - DNA, 22 bp, Homo sapiens
ctggccagcatggctgaagtac

SEQ ID NO: 7846219 - DNA, 22 bp, Homo sapiens
ctggccagcatggctgaagtac

SEQ ID NO: 7846220 - DNA, 22 bp, Homo sapiens
ctggccagcatggctgaagtac

SEQ ID NO: 7846221 - DNA, 22 bp, Homo sapiens
ctggccagcatggctgaagtac

SEQ ID NO: 7846222 - DNA, 22 bp, Homo sapiens
ctggccagcatggctgaagtac

SEQ ID NO: 7846223 - DNA, 22 bp, Homo sapiens
ctggccagcctcccaggtaccc

SEQ ID NO: 7846224 - DNA, 22 bp, Homo sapiens
ctggccagcctcccaggtaccc

SEQ ID NO: 7846225 - DNA, 22 bp, Homo sapiens
ctggccagcatttttgctttag

SEQ ID NO: 7846226 - DNA, 22 bp, Homo sapiens
ctggccagcatggctgaagtac

SEQ ID NO: 7846227 - DNA, 22 bp, Homo sapiens
ctggccagcatggctgaagtac

SEQ ID NO: 7846228 - DNA, 22 bp, Homo sapiens
ctggccagcatggctgaagtac

SEQ ID NO: 7846229 - DNA, 22 bp, Homo sapiens
ctggccagcatggctgaagtac

SEQ ID NO: 7846230 - DNA, 22 bp, Homo sapiens
ctggccagctgacagcagggct

SEQ ID NO: 7846231 - DNA, 22 bp, Homo sapiens
ctggccaggaggtaaccagatg

SEQ ID NO: 7846232 - DNA, 22 bp, Homo sapiens
ctggccaggaggtaaccagatg

SEQ ID NO: 7846233 - DNA, 22 bp, Homo sapiens
ctggccaggaggtaaccagatg

SEQ ID NO: 7846234 - DNA, 22 bp, Homo sapiens
ctggccaggaggtaaccagatg

SEQ ID NO: 7846235 - DNA, 22 bp, Homo sapiens
ctggccaggcatcccctgatcc

SEQ ID NO: 7846236 - DNA, 22 bp, Homo sapiens
ctggccaggcatcccctgatcc

SEQ ID NO: 7846237 - DNA, 22 bp, Homo sapiens
ctggccagctgacagcagggct

SEQ ID NO: 7846238 - DNA, 22 bp, Homo sapiens
ctggccagctgacagcagggct

SEQ ID NO: 7846239 - DNA, 22 bp, Homo sapiens
ctggccagctgacagcagggct

SEQ ID NO: 7846240 - DNA, 22 bp, Homo sapiens
ctggccagctgacagcagggct

SEQ ID NO: 7846241 - DNA, 22 bp, Homo sapiens
ctggccagctgacagcagggct

SEQ ID NO: 7846242 - DNA, 22 bp, Homo sapiens
ctggccagctgacagcagggct

SEQ ID NO: 7846243 - DNA, 22 bp, Homo sapiens
ctggccagctgacagcagggct

SEQ ID NO: 7846244 - DNA, 22 bp, Homo sapiens
ctggccagcctcccaggtaccc

SEQ ID NO: 7846245 - DNA, 22 bp, Homo sapiens
ctggccagcctgtcgatgccct

SEQ ID NO: 7846246 - DNA, 22 bp, Homo sapiens
ctggccagcctgtcgatgccct

SEQ ID NO: 7846247 - DNA, 22 bp, Homo sapiens
ctggccagcctgtcgatgccct

SEQ ID NO: 7846248 - DNA, 22 bp, Homo sapiens
ctggccagcctgtcgatgccct

SEQ ID NO: 7846249 - DNA, 22 bp, Homo sapiens
ctggccagcctcccaggtaccc

SEQ ID NO: 7846250 - DNA, 22 bp, Homo sapiens
ctggccagcctcccaggtaccc

SEQ ID NO: 7846251 - DNA, 22 bp, Homo sapiens
ctggccagcctcccaggtaccc

SEQ ID NO: 7846252 - DNA, 22 bp, Homo sapiens
ctggccagcctcccaggtaccc

SEQ ID NO: 7846253 - DNA, 22 bp, Homo sapiens
ctggccagcctgtcgatgccct

SEQ ID NO: 7846254 - DNA, 22 bp, Homo sapiens
ctggccagcctgtcgatgccct

SEQ ID NO: 7846255 - DNA, 22 bp, Homo sapiens
ctggccagcctgtcgatgccct

SEQ ID NO: 7846256 - DNA, 22 bp, Homo sapiens
ctggccagcctgtcgatgccct

SEQ ID NO: 7846257 - DNA, 22 bp, Homo sapiens
ctggccagcctgtcgatgccct

SEQ ID NO: 7846258 - DNA, 22 bp, Homo sapiens
ctggccagctgacagcagggct

SEQ ID NO: 7846259 - DNA, 22 bp, Homo sapiens
ctggccactgattcctcccctg

SEQ ID NO: 7846260 - DNA, 22 bp, Homo sapiens
ctggccactgattcctcccctg

SEQ ID NO: 7846261 - DNA, 22 bp, Homo sapiens
ctggccactgattcctcccctg

SEQ ID NO: 7846262 - DNA, 22 bp, Homo sapiens
ctggcagggcaggggtttgtgc

SEQ ID NO: 7846263 - DNA, 22 bp, Homo sapiens
ctggccacccatgcctccctga

SEQ ID NO: 7846264 - DNA, 22 bp, Homo sapiens
ctggcagggctctttgggtgct

SEQ ID NO: 7846265 - DNA, 22 bp, Homo sapiens
ctggcaggctctctggtcggtt

SEQ ID NO: 7846266 - DNA, 22 bp, Homo sapiens
ctggcaggctctctggtcggtt

SEQ ID NO: 7846267 - DNA, 22 bp, Homo sapiens
ctggcaggcggcagagcccagg

SEQ ID NO: 7846268 - DNA, 22 bp, Homo sapiens
ctggcaggcagacttctgcaag

SEQ ID NO: 7846269 - DNA, 22 bp, Homo sapiens
ctggcaggcggaggttgcagtg

SEQ ID NO: 7846270 - DNA, 22 bp, Homo sapiens
ctggcaggcagacttctgcaag

SEQ ID NO: 7846271 - DNA, 22 bp, Homo sapiens
ctggcaggcactcatgaaataa

SEQ ID NO: 7846272 - DNA, 22 bp, Homo sapiens
ctggcaggcggaggttgcagtg

SEQ ID NO: 7846273 - DNA, 22 bp, Homo sapiens
ctggcaggcggaggttgcagtg

SEQ ID NO: 7846274 - DNA, 22 bp, Homo sapiens
ctggcaggcggaggttgcagtg

SEQ ID NO: 7846275 - DNA, 22 bp, Homo sapiens
ctggcaggcggaggttgcagtg

SEQ ID NO: 7846276 - DNA, 22 bp, Homo sapiens
ctggcaggcggaggttgcagtg

SEQ ID NO: 7846277 - DNA, 22 bp, Homo sapiens
ctggcaggcggaggttgcagtg

SEQ ID NO: 7846278 - DNA, 22 bp, Homo sapiens
ctggcaggcggaggttgcagtg

SEQ ID NO: 7846279 - DNA, 22 bp, Homo sapiens
ctggcaggcggcagagcccagg

SEQ ID NO: 7846280 - DNA, 22 bp, Homo sapiens
ctggcaggcggcagagcccagg

SEQ ID NO: 7846281 - DNA, 22 bp, Homo sapiens
ctggcaggcggcagagcccagg

SEQ ID NO: 7846282 - DNA, 22 bp, Homo sapiens
ctggcaggcggcagagcccagg

SEQ ID NO: 7846283 - DNA, 22 bp, Homo sapiens
ctggcaggcggcagagcccagg

SEQ ID NO: 7846284 - DNA, 22 bp, Homo sapiens
ctggcaggcggaggttgcagtg

SEQ ID NO: 7846285 - DNA, 22 bp, Homo sapiens
ctggcaggcggaggttgcagtg

SEQ ID NO: 7846286 - DNA, 22 bp, Homo sapiens
ctggcaggcggaggttgcagtg

SEQ ID NO: 7846287 - DNA, 22 bp, Homo sapiens
ctggcaggcggaggttgcagtg

SEQ ID NO: 7846288 - DNA, 22 bp, Homo sapiens
ctggcaggcactcatgaaataa

SEQ ID NO: 7846289 - DNA, 22 bp, Homo sapiens
ctggcaggcactcatgaaataa

SEQ ID NO: 7846290 - DNA, 22 bp, Homo sapiens
ctggcaggcagacttctgcaag

SEQ ID NO: 7846291 - DNA, 22 bp, Homo sapiens
ctggcaggcaaattggtgggag

SEQ ID NO: 7846292 - DNA, 22 bp, Homo sapiens
ctggcaggcaaattggtgggag

SEQ ID NO: 7846293 - DNA, 22 bp, Homo sapiens
ctggcaggcaaattggtgggag

SEQ ID NO: 7846294 - DNA, 22 bp, Homo sapiens
ctggcaggcaaattggtgggag

SEQ ID NO: 7846295 - DNA, 22 bp, Homo sapiens
ctggcaggcaaattggtgggag

SEQ ID NO: 7846296 - DNA, 22 bp, Homo sapiens
ctggcaggcaaattggtgggag

SEQ ID NO: 7846297 - DNA, 22 bp, Homo sapiens
ctggcaggatctaaccagggaa

SEQ ID NO: 7846298 - DNA, 22 bp, Homo sapiens
ctggcaggatctaaccagggaa

SEQ ID NO: 7846299 - DNA, 22 bp, Homo sapiens
ctggcaggagcattcacagagg

SEQ ID NO: 7846300 - DNA, 22 bp, Homo sapiens
ctggcaggagcattcacagagg

SEQ ID NO: 7846301 - DNA, 20 bp, Homo sapiens
ctggcaggagcgagtctacc

SEQ ID NO: 7846302 - DNA, 20 bp, Homo sapiens
ctggcaggagcgagtctacc

SEQ ID NO: 7846303 - DNA, 20 bp, Homo sapiens
ctggcaggagcgagtctacc

SEQ ID NO: 7846304 - DNA, 22 bp, Homo sapiens
ctggcaggatctaaccagggaa

SEQ ID NO: 7846305 - DNA, 22 bp, Homo sapiens
ctggcaggatctaaccagggaa

SEQ ID NO: 7846306 - DNA, 22 bp, Homo sapiens
ctggcaggagttgggattttga

SEQ ID NO: 7846307 - DNA, 22 bp, Homo sapiens
ctggcaggatctaaccagggaa

SEQ ID NO: 7846308 - DNA, 22 bp, Homo sapiens
ctggcaggagttgggattttga

SEQ ID NO: 7846309 - DNA, 22 bp, Homo sapiens
ctggcaggagctgtggccgtag

SEQ ID NO: 7846310 - DNA, 22 bp, Homo sapiens
ctggcaggagctgtggccgtag

SEQ ID NO: 7846311 - DNA, 22 bp, Homo sapiens
ctggcaggagctgtggccgtag

SEQ ID NO: 7846312 - DNA, 22 bp, Homo sapiens
ctggcaggaagaggaaaggtca

SEQ ID NO: 7846313 - DNA, 22 bp, Homo sapiens
ctggcagcttcctttgcatctg

SEQ ID NO: 7846314 - DNA, 22 bp, Homo sapiens
ctggcagcttcctttgcatctg

SEQ ID NO: 7846315 - DNA, 22 bp, Homo sapiens
ctggcagcttcctttgcatctg

SEQ ID NO: 7846316 - DNA, 22 bp, Homo sapiens
ctggcagcttcaggacactcgg

SEQ ID NO: 7846317 - DNA, 22 bp, Homo sapiens
ctggcagcttcctttgcatctg

SEQ ID NO: 7846318 - DNA, 22 bp, Homo sapiens
ctggcagcttcaggacactcgg

SEQ ID NO: 7846319 - DNA, 19 bp, Homo sapiens
ctggcagcctgtctgtgtc

SEQ ID NO: 7846320 - DNA, 22 bp, Homo sapiens
ctggcagcccaacctagagtct

SEQ ID NO: 7846321 - DNA, 22 bp, Homo sapiens
ctggcagcccaacctagagtct

SEQ ID NO: 7846322 - DNA, 19 bp, Homo sapiens
ctggcagcctgtctgtgtc

SEQ ID NO: 7846323 - DNA, 22 bp, Homo sapiens
ctggcaggaagaggaaaggtca

SEQ ID NO: 7846324 - DNA, 22 bp, Homo sapiens
ctggcaggaagaggaaaggtca

SEQ ID NO: 7846325 - DNA, 22 bp, Homo sapiens
ctggcaggaagaggaaaggtca

SEQ ID NO: 7846326 - DNA, 22 bp, Homo sapiens
ctggcaggaagttagatggtaa

SEQ ID NO: 7846327 - DNA, 22 bp, Homo sapiens
ctggcaggaagttagatggtaa

SEQ ID NO: 7846328 - DNA, 22 bp, Homo sapiens
ctggcaggaagttagatggtaa

SEQ ID NO: 7846329 - DNA, 22 bp, Homo sapiens
ctggcaggaagttagatggtaa

SEQ ID NO: 7846330 - DNA, 22 bp, Homo sapiens
ctggcaggaagttagatggtaa

SEQ ID NO: 7846331 - DNA, 22 bp, Homo sapiens
ctggcaggaagttagatggtaa

SEQ ID NO: 7846332 - DNA, 22 bp, Homo sapiens
ctggcaggaagttagatggtaa

SEQ ID NO: 7846333 - DNA, 22 bp, Homo sapiens
ctggcaggagcattcacagagg

SEQ ID NO: 7846334 - DNA, 22 bp, Homo sapiens
ctggcaggagcattcacagagg

SEQ ID NO: 7846335 - DNA, 22 bp, Homo sapiens
ctggcaggagcattcacagagg

SEQ ID NO: 7846336 - DNA, 22 bp, Homo sapiens
ctggcaggaagttagatggtaa

SEQ ID NO: 7846337 - DNA, 22 bp, Homo sapiens
ctggcaggagcattcacagagg

SEQ ID NO: 7846338 - DNA, 22 bp, Homo sapiens
ctgccagctcaccggctcagac

SEQ ID NO: 7846339 - DNA, 22 bp, Homo sapiens
ctgccagctcaccggctcagac

SEQ ID NO: 7846340 - DNA, 22 bp, Homo sapiens
ctgccagctcaccggctcagac

SEQ ID NO: 7846341 - DNA, 22 bp, Homo sapiens
ctgccagctcaaagcgcagcta

SEQ ID NO: 7846342 - DNA, 22 bp, Homo sapiens
ctgccagctcaaagcgcagcta

SEQ ID NO: 7846343 - DNA, 22 bp, Homo sapiens
ctgccagctagctcctagttga

SEQ ID NO: 7846344 - DNA, 22 bp, Homo sapiens
ctgccagctagctcctagttga

SEQ ID NO: 7846345 - DNA, 22 bp, Homo sapiens
ctggcagccaagtgggatactc

SEQ ID NO: 7846346 - DNA, 22 bp, Homo sapiens
ctggcagcccaacctagagtct

SEQ ID NO: 7846347 - DNA, 22 bp, Homo sapiens
ctggcagcccaacctagagtct

SEQ ID NO: 7846348 - DNA, 22 bp, Homo sapiens
ctggcagcatttttttcagaag

SEQ ID NO: 7846349 - DNA, 22 bp, Homo sapiens
ctgccagctcgccacaatgaca

SEQ ID NO: 7846350 - DNA, 22 bp, Homo sapiens
ctgccagcagaggccagcgctg

SEQ ID NO: 7846351 - DNA, 22 bp, Homo sapiens
ctgccagccaggccaggtaggc

SEQ ID NO: 7846352 - DNA, 22 bp, Homo sapiens
ctgccagcagaggccagcgctg

SEQ ID NO: 7846353 - DNA, 22 bp, Homo sapiens
ctgccagccaggccaggtaggc

SEQ ID NO: 7846354 - DNA, 22 bp, Homo sapiens
ctgccagcactgcctcctgagg

SEQ ID NO: 7846355 - DNA, 22 bp, Homo sapiens
ctgccagcaatgtgaccatgct

SEQ ID NO: 7846356 - DNA, 22 bp, Homo sapiens
ctgccagcaagctaccctggca

SEQ ID NO: 7846357 - DNA, 22 bp, Homo sapiens
ctgccagcagaggccagcgctg

SEQ ID NO: 7846358 - DNA, 22 bp, Homo sapiens
ctgccagcactgcctcctgagg

SEQ ID NO: 7846359 - DNA, 22 bp, Homo sapiens
ctgccacaagctggccctgtgt

SEQ ID NO: 7846360 - DNA, 22 bp, Homo sapiens
ctgccacaggggagcaggcaga

SEQ ID NO: 7846361 - DNA, 22 bp, Homo sapiens
ctgccacaggggagcaggcaga

SEQ ID NO: 7846362 - DNA, 22 bp, Homo sapiens
ctgccacaggggagcaggcaga

SEQ ID NO: 7846363 - DNA, 22 bp, Homo sapiens
ctgccaccaaatagctgcatga

SEQ ID NO: 7846364 - DNA, 22 bp, Homo sapiens
ctgccaccaaatagctgcatga

SEQ ID NO: 7846365 - DNA, 22 bp, Homo sapiens
ctgccacaggggagcaggcaga

SEQ ID NO: 7846366 - DNA, 22 bp, Homo sapiens
ctgccacaggggagcaggcaga

SEQ ID NO: 7846367 - DNA, 22 bp, Homo sapiens
ctgccaccatgccccagcagag

SEQ ID NO: 7846368 - DNA, 22 bp, Homo sapiens
ctgccaccatgccccagcagag

SEQ ID NO: 7846369 - DNA, 22 bp, Homo sapiens
ctgccaccatgccccagcagag

SEQ ID NO: 7846370 - DNA, 22 bp, Homo sapiens
ctgccaccaaatagctgcatga

SEQ ID NO: 7846371 - DNA, 22 bp, Homo sapiens
ctgccaccaaatagctgcatga

SEQ ID NO: 7846372 - DNA, 22 bp, Homo sapiens
ctgccaccatgccccagcagag

SEQ ID NO: 7846373 - DNA, 22 bp, Homo sapiens
ctgccaccaaatagctgcatga

SEQ ID NO: 7846374 - DNA, 22 bp, Homo sapiens
ctgccaccatgccccagcagag

SEQ ID NO: 7846375 - DNA, 22 bp, Homo sapiens
ctgccaccatgccccagcagag

SEQ ID NO: 7846376 - DNA, 21 bp, Homo sapiens
ctgccacctgctccatcagca

SEQ ID NO: 7846377 - DNA, 22 bp, Homo sapiens
ctgcatccatgttgctgcaaag

SEQ ID NO: 7846378 - DNA, 22 bp, Homo sapiens
ctgcatcattttcagacaatgg

SEQ ID NO: 7846379 - DNA, 22 bp, Homo sapiens
ctgcatccatgttgctgcaaag

SEQ ID NO: 7846380 - DNA, 22 bp, Homo sapiens
ctgcatccatgttgctgcaaag

SEQ ID NO: 7846381 - DNA, 22 bp, Homo sapiens
ctgccaaggctggggaggacaa

SEQ ID NO: 7846382 - DNA, 20 bp, Homo sapiens
ctgcatcatggttaagaaca

SEQ ID NO: 7846383 - DNA, 22 bp, Homo sapiens
ctgcatcataaaatttagagtt

SEQ ID NO: 7846384 - DNA, 22 bp, Homo sapiens
ctgcatcagtggatatgatggt

SEQ ID NO: 7846385 - DNA, 22 bp, Homo sapiens
ctgcatcaggccaattaagaat

SEQ ID NO: 7846386 - DNA, 20 bp, Homo sapiens
ctgcatcatggttaagaaca

SEQ ID NO: 7846387 - DNA, 22 bp, Homo sapiens
ctgcatcattggtgattcagga

SEQ ID NO: 7846388 - DNA, 22 bp, Homo sapiens
ctgcatcattttcagacaatgg

SEQ ID NO: 7846389 - DNA, 22 bp, Homo sapiens
ctgccagacacgttatgctcat

SEQ ID NO: 7846390 - DNA, 22 bp, Homo sapiens
ctgccagacacgttatgctcat

SEQ ID NO: 7846391 - DNA, 22 bp, Homo sapiens
ctgccagaaggttcctgctgca

SEQ ID NO: 7846392 - DNA, 22 bp, Homo sapiens
ctgccagagatctgggcagagt

SEQ ID NO: 7846393 - DNA, 22 bp, Homo sapiens
ctgccagagatctgggcagagt

SEQ ID NO: 7846394 - DNA, 22 bp, Homo sapiens
ctgccagagtcacttgccacct

SEQ ID NO: 7846395 - DNA, 22 bp, Homo sapiens
ctgccagagtacttgtaagaat

SEQ ID NO: 7846396 - DNA, 22 bp, Homo sapiens
ctgccagagatttggtgaacaa

SEQ ID NO: 7846397 - DNA, 22 bp, Homo sapiens
ctgccagatcattggattcaca

SEQ ID NO: 7846398 - DNA, 22 bp, Homo sapiens
ctgccagatcattggattcaca

SEQ ID NO: 7846399 - DNA, 22 bp, Homo sapiens
ctgccagaaggttcctgctgca

SEQ ID NO: 7846400 - DNA, 22 bp, Homo sapiens
ctgccagaaggttcctgctgca

SEQ ID NO: 7846401 - DNA, 22 bp, Homo sapiens
ctgccagaaggttcctgctgca

SEQ ID NO: 7846402 - DNA, 22 bp, Homo sapiens
ctgccactttggagtgctcaga

SEQ ID NO: 7846403 - DNA, 22 bp, Homo sapiens
ctgccactttggagtgctcaga

SEQ ID NO: 7846404 - DNA, 22 bp, Homo sapiens
ctgccagaagagaacaccagtt

SEQ ID NO: 7846405 - DNA, 22 bp, Homo sapiens
ctgccagaagagaacaccagtt

SEQ ID NO: 7846406 - DNA, 22 bp, Homo sapiens
ctgccagaagagaacaccagtt

SEQ ID NO: 7846407 - DNA, 22 bp, Homo sapiens
ctgccagaagagaacaccagtt

SEQ ID NO: 7846408 - DNA, 22 bp, Homo sapiens
ctgccactttcacccagtgctc

SEQ ID NO: 7846409 - DNA, 22 bp, Homo sapiens
ctgccacttactaggcatggtg

SEQ ID NO: 7846410 - DNA, 22 bp, Homo sapiens
ctgccactttggagtgctcaga

SEQ ID NO: 7846411 - DNA, 22 bp, Homo sapiens
ctgccactttcacccagtgctc

SEQ ID NO: 7846412 - DNA, 22 bp, Homo sapiens
ctgccactttcacccagtgctc

SEQ ID NO: 7846413 - DNA, 22 bp, Homo sapiens
ctgccactctgggtgggcctgg

SEQ ID NO: 7846414 - DNA, 22 bp, Homo sapiens
ctgccactagctttcacatctt

SEQ ID NO: 7846415 - DNA, 21 bp, Homo sapiens
ctgccacctgctccatcagca

SEQ ID NO: 7846416 - DNA, 21 bp, Homo sapiens
ctgccacctgctccatcagca

SEQ ID NO: 7846417 - DNA, 21 bp, Homo sapiens
ctgccacctgctccatcagca

SEQ ID NO: 7846418 - DNA, 22 bp, Homo sapiens
ctgccactagctttcacatctt

SEQ ID NO: 7846419 - DNA, 22 bp, Homo sapiens
ctgggcaggagaggtggttgga

SEQ ID NO: 7846420 - DNA, 22 bp, Homo sapiens
ctgggcaggagaggtggttgga

SEQ ID NO: 7846421 - DNA, 22 bp, Homo sapiens
ctgggcaggagaggtggttgga

SEQ ID NO: 7846422 - DNA, 22 bp, Homo sapiens
ctgggaggcggagcttgcagtg

SEQ ID NO: 7846423 - DNA, 22 bp, Homo sapiens
ctgggaggcggagcttgcagtg

SEQ ID NO: 7846424 - DNA, 22 bp, Homo sapiens
ctgggaggcggagcttgcagtg

SEQ ID NO: 7846425 - DNA, 22 bp, Homo sapiens
ctgggaggcggagcttgcagtg

SEQ ID NO: 7846426 - DNA, 22 bp, Homo sapiens
ctgggaggcggagcttgcagtg

SEQ ID NO: 7846427 - DNA, 22 bp, Homo sapiens
ctgggaggcggagcttgcagtg

SEQ ID NO: 7846428 - DNA, 22 bp, Homo sapiens
ctgggaggcggagcttgcagtg

SEQ ID NO: 7846429 - DNA, 22 bp, Homo sapiens
ctgggaggcggagcttgcagtg

SEQ ID NO: 7846430 - DNA, 22 bp, Homo sapiens
ctgggaggcggagcttgcagtg

SEQ ID NO: 7846431 - DNA, 22 bp, Homo sapiens
ctgggaggcccacgttgggaag

SEQ ID NO: 7846432 - DNA, 22 bp, Homo sapiens
ctgggaggcccacgttgggaag

SEQ ID NO: 7846433 - DNA, 22 bp, Homo sapiens
ctgggaggcccacgttgggaag

SEQ ID NO: 7846434 - DNA, 22 bp, Homo sapiens
ctgggaggcccacgttgggaag

SEQ ID NO: 7846435 - DNA, 22 bp, Homo sapiens
ctgggaggcccacgttgggaag

SEQ ID NO: 7846436 - DNA, 22 bp, Homo sapiens
ctgggaggcccacgttgggaag

SEQ ID NO: 7846437 - DNA, 22 bp, Homo sapiens
ctgggaggcccacgttgggaag

SEQ ID NO: 7846438 - DNA, 22 bp, Homo sapiens
ctgggaggcccacgttgggaag

SEQ ID NO: 7846439 - DNA, 22 bp, Homo sapiens
ctgggaggcagtctctctagaa

SEQ ID NO: 7846440 - DNA, 22 bp, Homo sapiens
ctgggaggcagtctctctagaa

SEQ ID NO: 7846441 - DNA, 22 bp, Homo sapiens
ctgggaggcagtctctctagaa

SEQ ID NO: 7846442 - DNA, 22 bp, Homo sapiens
ctgggaggcagtctctctagaa

SEQ ID NO: 7846443 - DNA, 22 bp, Homo sapiens
ctgggaggcagtctctctagaa

SEQ ID NO: 7846444 - DNA, 22 bp, Homo sapiens
ctgggaggcactattcaggagg

SEQ ID NO: 7846445 - DNA, 22 bp, Homo sapiens
ctgggaggcactattcaggagg

SEQ ID NO: 7846446 - DNA, 22 bp, Homo sapiens
ctgggaggcactattcaggagg

SEQ ID NO: 7846447 - DNA, 22 bp, Homo sapiens
ctgggaggcactattcaggagg

SEQ ID NO: 7846448 - DNA, 22 bp, Homo sapiens
ctgggaggcagaggttgcagtg

SEQ ID NO: 7846449 - DNA, 22 bp, Homo sapiens
ctgggaggcagaggttgcagtg

SEQ ID NO: 7846450 - DNA, 22 bp, Homo sapiens
ctgggaggcagaggttgcagtg

SEQ ID NO: 7846451 - DNA, 22 bp, Homo sapiens
ctgggaggcactattcaggagg

SEQ ID NO: 7846452 - DNA, 22 bp, Homo sapiens
ctgggaggcagaggttgcagtg

SEQ ID NO: 7846453 - DNA, 22 bp, Homo sapiens
ctgggaggcactattcaggagg

SEQ ID NO: 7846454 - DNA, 22 bp, Homo sapiens
ctgggaggcagaggttgtagtg

SEQ ID NO: 7846455 - DNA, 22 bp, Homo sapiens
ctgggaggcagaggttgtagtg

SEQ ID NO: 7846456 - DNA, 22 bp, Homo sapiens
ctgggaggcagaggttgtagtg

SEQ ID NO: 7846457 - DNA, 22 bp, Homo sapiens
ctgggaggcagaggttgtagtg

SEQ ID NO: 7846458 - DNA, 22 bp, Homo sapiens
ctgggaggcagaggttgtagtg

SEQ ID NO: 7846459 - DNA, 22 bp, Homo sapiens
ctgggaggcagtctctctagaa

SEQ ID NO: 7846460 - DNA, 22 bp, Homo sapiens
ctgggaggcagaggttgtagtg

SEQ ID NO: 7846461 - DNA, 22 bp, Homo sapiens
ctgggaggcagaggttgtagtg

SEQ ID NO: 7846462 - DNA, 22 bp, Homo sapiens
ctgggaggcagaggttgcagtg

SEQ ID NO: 7846463 - DNA, 22 bp, Homo sapiens
ctgggaggcagaggttgcagtg

SEQ ID NO: 7846464 - DNA, 22 bp, Homo sapiens
ctgggaggcagaggttgcagtg

SEQ ID NO: 7846465 - DNA, 22 bp, Homo sapiens
ctgggaggcagaggttgcagtg

SEQ ID NO: 7846466 - DNA, 22 bp, Homo sapiens
ctgggccactccagatgcccac

SEQ ID NO: 7846467 - DNA, 22 bp, Homo sapiens
ctgggccactccagatgcccac

SEQ ID NO: 7846468 - DNA, 22 bp, Homo sapiens
ctgggccacttcctcaggggaa

SEQ ID NO: 7846469 - DNA, 22 bp, Homo sapiens
ctgggccactccagatgcccac

SEQ ID NO: 7846470 - DNA, 22 bp, Homo sapiens
ctgggccacatcagatgaagac

SEQ ID NO: 7846471 - DNA, 22 bp, Homo sapiens
ctgggccactccagatgcccac

SEQ ID NO: 7846472 - DNA, 22 bp, Homo sapiens
ctgggccacttcctcaggggaa

SEQ ID NO: 7846473 - DNA, 22 bp, Homo sapiens
ctgggccacttcctcaggggaa

SEQ ID NO: 7846474 - DNA, 19 bp, Homo sapiens
ctgggccagaatcagctca

SEQ ID NO: 7846475 - DNA, 22 bp, Homo sapiens
ctgggccacaagcctgtgtgat

SEQ ID NO: 7846476 - DNA, 22 bp, Homo sapiens
ctgggccacagactcaaggcag

SEQ ID NO: 7846477 - DNA, 22 bp, Homo sapiens
ctgggccacaagcctgtgtgat

SEQ ID NO: 7846478 - DNA, 22 bp, Homo sapiens
ctgggccacaagcctgtgtgat

SEQ ID NO: 7846479 - DNA, 22 bp, Homo sapiens
ctgggccacagactcaaggcag

SEQ ID NO: 7846480 - DNA, 22 bp, Homo sapiens
ctgggccacagactcaaggcag

SEQ ID NO: 7846481 - DNA, 22 bp, Homo sapiens
ctgggccacagactcaaggcag

SEQ ID NO: 7846482 - DNA, 22 bp, Homo sapiens
ctgggccacagactcaaggcag

SEQ ID NO: 7846483 - DNA, 22 bp, Homo sapiens
ctgggccacatcagatgaagac

SEQ ID NO: 7846484 - DNA, 22 bp, Homo sapiens
ctgggccacatcagatgaagac

SEQ ID NO: 7846485 - DNA, 22 bp, Homo sapiens
ctgggccacatcagatgaagac

SEQ ID NO: 7846486 - DNA, 22 bp, Homo sapiens
ctgggccacatcagatgaagac

SEQ ID NO: 7846487 - DNA, 22 bp, Homo sapiens
ctgggcatttttctctgttaca

SEQ ID NO: 7846488 - DNA, 23 bp, Homo sapiens
ctgggcatggagcttcagaggct

SEQ ID NO: 7846489 - DNA, 22 bp, Homo sapiens
ctgggcatggacagctgcacag

SEQ ID NO: 7846490 - DNA, 23 bp, Homo sapiens
ctgggcatggagcttcagaggct

SEQ ID NO: 7846491 - DNA, 23 bp, Homo sapiens
ctgggcatggagcttcagaggct

SEQ ID NO: 7846492 - DNA, 22 bp, Homo sapiens
ctgggcatgaaaaggatgccag

SEQ ID NO: 7846493 - DNA, 22 bp, Homo sapiens
ctgggccacaaaaaactcctgt

SEQ ID NO: 7846494 - DNA, 22 bp, Homo sapiens
ctgggccacaaaaaactcctgt

SEQ ID NO: 7846495 - DNA, 22 bp, Homo sapiens
ctgggccaagaagttgtgtatg

SEQ ID NO: 7846496 - DNA, 22 bp, Homo sapiens
ctgggcagtttattcagttctg

SEQ ID NO: 7846497 - DNA, 22 bp, Homo sapiens
ctgggcagtttattcagttctg

SEQ ID NO: 7846498 - DNA, 22 bp, Homo sapiens
ctgggcaggagggctctatgga

SEQ ID NO: 7846499 - DNA, 22 bp, Homo sapiens
ctgggcaggagggctctatgga

SEQ ID NO: 7846500 - DNA, 22 bp, Homo sapiens
ctgggcagttttacatcattgc

SEQ ID NO: 7846501 - DNA, 22 bp, Homo sapiens
ctgggcatatacgtgcaagtca

SEQ ID NO: 7846502 - DNA, 22 bp, Homo sapiens
ctgggcagtttattcagttctg

SEQ ID NO: 7846503 - DNA, 22 bp, Homo sapiens
ctgggcagtttattcagttctg

SEQ ID NO: 7846504 - DNA, 22 bp, Homo sapiens
ctggctttctgacatgttactg

SEQ ID NO: 7846505 - DNA, 22 bp, Homo sapiens
ctggctttctgcaaatctccat

SEQ ID NO: 7846506 - DNA, 22 bp, Homo sapiens
ctggctttctgttataaagaca

SEQ ID NO: 7846507 - DNA, 22 bp, Homo sapiens
ctggctttctgttataaagaca

SEQ ID NO: 7846508 - DNA, 22 bp, Homo sapiens
ctggctttctgcacagaattgg

SEQ ID NO: 7846509 - DNA, 22 bp, Homo sapiens
ctggctttctgcacagaattgg

SEQ ID NO: 7846510 - DNA, 22 bp, Homo sapiens
ctggctttctgcaaatctccat

SEQ ID NO: 7846511 - DNA, 22 bp, Homo sapiens
ctggctttctgcacagaattgg

SEQ ID NO: 7846512 - DNA, 22 bp, Homo sapiens
ctggctttctctgtggtgttca

SEQ ID NO: 7846513 - DNA, 22 bp, Homo sapiens
ctggctttctgaacatcagtga

SEQ ID NO: 7846514 - DNA, 22 bp, Homo sapiens
ctggctttctccagaaattttt

SEQ ID NO: 7846515 - DNA, 22 bp, Homo sapiens
ctggctttctatttggtgctat

SEQ ID NO: 7846516 - DNA, 22 bp, Homo sapiens
ctggctttgaggatcccctctt

SEQ ID NO: 7846517 - DNA, 22 bp, Homo sapiens
ctggctttgaaggtctttccta

SEQ ID NO: 7846518 - DNA, 22 bp, Homo sapiens
ctggctttgaaggtctttccta

SEQ ID NO: 7846519 - DNA, 22 bp, Homo sapiens
ctggctttgaaggtctttccta

SEQ ID NO: 7846520 - DNA, 22 bp, Homo sapiens
ctggctttgaaatgcatttcag

SEQ ID NO: 7846521 - DNA, 18 bp, Homo sapiens
ctggctttcttatccatc

SEQ ID NO: 7846522 - DNA, 18 bp, Homo sapiens
ctggctttcttatccatc

SEQ ID NO: 7846523 - DNA, 22 bp, Homo sapiens
ctggctttgaaatgcatttcag

SEQ ID NO: 7846524 - DNA, 22 bp, Homo sapiens
ctggctttgaaatgcatttcag

SEQ ID NO: 7846525 - DNA, 22 bp, Homo sapiens
ctggctttgaaatgcatttcag

SEQ ID NO: 7846526 - DNA, 22 bp, Homo sapiens
ctggctttgcgtctttgccaca

SEQ ID NO: 7846527 - DNA, 22 bp, Homo sapiens
ctggctttgcgtctttgccaca

SEQ ID NO: 7846528 - DNA, 22 bp, Homo sapiens
ctggctttgatcagagtgacct

SEQ ID NO: 7846529 - DNA, 22 bp, Homo sapiens
ctggctttgctggactgggagt

SEQ ID NO: 7846530 - DNA, 22 bp, Homo sapiens
ctggctttgctggactgggagt

SEQ ID NO: 7846531 - DNA, 22 bp, Homo sapiens
ctggctttgcgtctttgccaca

SEQ ID NO: 7846532 - DNA, 22 bp, Homo sapiens
ctggctttggaaacaatttatc

SEQ ID NO: 7846533 - DNA, 22 bp, Homo sapiens
ctggctttgctggactgggagt

SEQ ID NO: 7846534 - DNA, 22 bp, Homo sapiens
ctggctttccttgtctgcatcc

SEQ ID NO: 7846535 - DNA, 22 bp, Homo sapiens
ctggctttccttgtctgcatcc

SEQ ID NO: 7846536 - DNA, 22 bp, Homo sapiens
ctggctttccctggacaacagc

SEQ ID NO: 7846537 - DNA, 22 bp, Homo sapiens
ctggctttccctggacaacagc

SEQ ID NO: 7846538 - DNA, 22 bp, Homo sapiens
ctggctttcatttcaagcacgt

SEQ ID NO: 7846539 - DNA, 22 bp, Homo sapiens
ctggctttcatttcaagcacgt

SEQ ID NO: 7846540 - DNA, 22 bp, Homo sapiens
ctggctttcatttcaagcacgt

SEQ ID NO: 7846541 - DNA, 22 bp, Homo sapiens
ctggctttcatttcaagcacgt

SEQ ID NO: 7846542 - DNA, 22 bp, Homo sapiens
ctggctttcattcattcaggcc

SEQ ID NO: 7846543 - DNA, 22 bp, Homo sapiens
ctggctttaggttggagagctg

SEQ ID NO: 7846544 - DNA, 22 bp, Homo sapiens
ctggctttaggttggagagctg

SEQ ID NO: 7846545 - DNA, 22 bp, Homo sapiens
ctggctttaggttggagagctg

SEQ ID NO: 7846546 - DNA, 22 bp, Homo sapiens
ctggctttaggttggagagctg

SEQ ID NO: 7846547 - DNA, 22 bp, Homo sapiens
ctggctttacctcactggggct

SEQ ID NO: 7846548 - DNA, 22 bp, Homo sapiens
ctggctttcattcattcaggcc

SEQ ID NO: 7846549 - DNA, 22 bp, Homo sapiens
ctggctttcatggcgcagttga

SEQ ID NO: 7846550 - DNA, 22 bp, Homo sapiens
ctggctttaggttggagagctg

SEQ ID NO: 7846551 - DNA, 22 bp, Homo sapiens
ctggctttaggttggagagctg

SEQ ID NO: 7846552 - DNA, 22 bp, Homo sapiens
ctggctttaggttggagagctg

SEQ ID NO: 7846553 - DNA, 22 bp, Homo sapiens
ctggctgtgctgcaggctttgg

SEQ ID NO: 7846554 - DNA, 22 bp, Homo sapiens
ctggctgtgctgcaggctttgg

SEQ ID NO: 7846555 - DNA, 22 bp, Homo sapiens
ctggcttggcttattcatggaa

SEQ ID NO: 7846556 - DNA, 22 bp, Homo sapiens
ctggcttgggtctacctgcctt

SEQ ID NO: 7846557 - DNA, 22 bp, Homo sapiens
ctggctgtgctggagttgagga

SEQ ID NO: 7846558 - DNA, 22 bp, Homo sapiens
ctggctttaatgtcatctttct

SEQ ID NO: 7846559 - DNA, 22 bp, Homo sapiens
ctggctttaatgtcatctttct

SEQ ID NO: 7846560 - DNA, 22 bp, Homo sapiens
ctggctttaaccctacaaacct

SEQ ID NO: 7846561 - DNA, 22 bp, Homo sapiens
ctggctttacctcactggggct

SEQ ID NO: 7846562 - DNA, 22 bp, Homo sapiens
ctggctttaaaatgctcctgga

SEQ ID NO: 7846563 - DNA, 22 bp, Homo sapiens
ctggctttaaaatgctcctgga

SEQ ID NO: 7846564 - DNA, 22 bp, Homo sapiens
ctggctttaaccctacaaacct

SEQ ID NO: 7846565 - DNA, 22 bp, Homo sapiens
ctggctttaaaatgctcctgga

SEQ ID NO: 7846566 - DNA, 22 bp, Homo sapiens
ctgggaggattcattgaggtga

SEQ ID NO: 7846567 - DNA, 22 bp, Homo sapiens
ctgggaggcaccgcgtcgtgct

SEQ ID NO: 7846568 - DNA, 22 bp, Homo sapiens
ctgggaggcaccgcgtcgtgct

SEQ ID NO: 7846569 - DNA, 22 bp, Homo sapiens
ctgggaggcaccgcgtcgtgct

SEQ ID NO: 7846570 - DNA, 22 bp, Homo sapiens
ctgggaggcaccgcgtcgtgct

SEQ ID NO: 7846571 - DNA, 22 bp, Homo sapiens
ctgggagctgaggctgacgctg

SEQ ID NO: 7846572 - DNA, 22 bp, Homo sapiens
ctgggagctgaggctgacgctg

SEQ ID NO: 7846573 - DNA, 22 bp, Homo sapiens
ctgggagctgaggctgacgctg

SEQ ID NO: 7846574 - DNA, 22 bp, Homo sapiens
ctgggaggattcattgaggtga

SEQ ID NO: 7846575 - DNA, 22 bp, Homo sapiens
ctgggaggattcattgaggtga

SEQ ID NO: 7846576 - DNA, 22 bp, Homo sapiens
ctgggaggattcattgaggtga

SEQ ID NO: 7846577 - DNA, 22 bp, Homo sapiens
ctgggaggattcattgaggtga

SEQ ID NO: 7846578 - DNA, 22 bp, Homo sapiens
ctgggagctcagccctggggtg

SEQ ID NO: 7846579 - DNA, 22 bp, Homo sapiens
ctgggagctcagccctggggtg

SEQ ID NO: 7846580 - DNA, 22 bp, Homo sapiens
ctgggagctcagccctggggtg

SEQ ID NO: 7846581 - DNA, 22 bp, Homo sapiens
ctgggagctcagccctggggtg

SEQ ID NO: 7846582 - DNA, 22 bp, Homo sapiens
ctgggagctgaggctgacgctg

SEQ ID NO: 7846583 - DNA, 22 bp, Homo sapiens
ctgggagctcagccctggggtg

SEQ ID NO: 7846584 - DNA, 22 bp, Homo sapiens
ctgggagctcagccctggggtg

SEQ ID NO: 7846585 - DNA, 22 bp, Homo sapiens
ctgggagctagctctgagctga

SEQ ID NO: 7846586 - DNA, 22 bp, Homo sapiens
ctgggagctagctctgagctga

SEQ ID NO: 7846587 - DNA, 22 bp, Homo sapiens
ctgggagctagctctgagctga

SEQ ID NO: 7846588 - DNA, 22 bp, Homo sapiens
ctgggaagaaattgtgggaggc

SEQ ID NO: 7846589 - DNA, 22 bp, Homo sapiens
ctgggaagaaattgtgggaggc

SEQ ID NO: 7846590 - DNA, 22 bp, Homo sapiens
ctgggaagaaattgtgggaggc

SEQ ID NO: 7846591 - DNA, 22 bp, Homo sapiens
ctggcttttggaaacaggctca

SEQ ID NO: 7846592 - DNA, 22 bp, Homo sapiens
ctggcttttggaggagggtcag

SEQ ID NO: 7846593 - DNA, 22 bp, Homo sapiens
ctggcttttggaaacaggctca

SEQ ID NO: 7846594 - DNA, 22 bp, Homo sapiens
ctggcttttggaggagggtcag

SEQ ID NO: 7846595 - DNA, 22 bp, Homo sapiens
ctgggaaatataataaagtggt

SEQ ID NO: 7846596 - DNA, 22 bp, Homo sapiens
ctgggaaattgacactgataaa

SEQ ID NO: 7846597 - DNA, 22 bp, Homo sapiens
ctgggaaatataataaagtggt

SEQ ID NO: 7846598 - DNA, 22 bp, Homo sapiens
ctgggaaattgacactgataaa

SEQ ID NO: 7846599 - DNA, 22 bp, Homo sapiens
ctgggaacatctgaatgctgag

SEQ ID NO: 7846600 - DNA, 22 bp, Homo sapiens
ctgggaacatctgaatgctgag

SEQ ID NO: 7846601 - DNA, 22 bp, Homo sapiens
ctggctttggaacaaatcatag

SEQ ID NO: 7846602 - DNA, 22 bp, Homo sapiens
ctggctttggaacaaatcatag

SEQ ID NO: 7846603 - DNA, 22 bp, Homo sapiens
ctggctttggaaacaatttatc

SEQ ID NO: 7846604 - DNA, 22 bp, Homo sapiens
ctggctttggtcatgtgatcat

SEQ ID NO: 7846605 - DNA, 22 bp, Homo sapiens
ctggctttggtcccctgtgcct

SEQ ID NO: 7846606 - DNA, 22 bp, Homo sapiens
ctggctttgttctgattgcttc

SEQ ID NO: 7846607 - DNA, 22 bp, Homo sapiens
ctggctttgttctgattgcttc

SEQ ID NO: 7846608 - DNA, 22 bp, Homo sapiens
ctggctttgtatagttccctga

SEQ ID NO: 7846609 - DNA, 22 bp, Homo sapiens
ctggctttgtatagttccctga

SEQ ID NO: 7846610 - DNA, 22 bp, Homo sapiens
ctggcttttagtgtgaagactt

SEQ ID NO: 7846611 - DNA, 22 bp, Homo sapiens
ctggcttttagtgtgaagactt

SEQ ID NO: 7846612 - DNA, 22 bp, Homo sapiens
ctggcttttagtgtgaagactt

SEQ ID NO: 7846613 - DNA, 22 bp, Homo sapiens
ctggcttttcaaactgttcagt

SEQ ID NO: 7846614 - DNA, 22 bp, Homo sapiens
ctggcttttcaaactgttcagt

SEQ ID NO: 7846615 - DNA, 22 bp, Homo sapiens
ctggcttttcaaactgttcagt

SEQ ID NO: 7846616 - DNA, 22 bp, Homo sapiens
ctggcttttcaaactgttcagt

SEQ ID NO: 7846617 - DNA, 22 bp, Homo sapiens
ctggcttttcctaaactgggaa

SEQ ID NO: 7846618 - DNA, 22 bp, Homo sapiens
ctggcttttcctaaactgggaa

SEQ ID NO: 7846619 - DNA, 22 bp, Homo sapiens
ctggcttttcctaaactgggaa

SEQ ID NO: 7846620 - DNA, 22 bp, Homo sapiens
ctggggcattgggagaggcctg

SEQ ID NO: 7846621 - DNA, 22 bp, Homo sapiens
ctggggcatgggcccctagagg

SEQ ID NO: 7846622 - DNA, 22 bp, Homo sapiens
ctggggcattgggagaggcctg

SEQ ID NO: 7846623 - DNA, 22 bp, Homo sapiens
ctggggcattgggagaggcctg

SEQ ID NO: 7846624 - DNA, 22 bp, Homo sapiens
ctggggccacaacggcgcacgc

SEQ ID NO: 7846625 - DNA, 22 bp, Homo sapiens
ctggggccacaacggcgcacgc

SEQ ID NO: 7846626 - DNA, 22 bp, Homo sapiens
ctggggcattgggagaggcctg

SEQ ID NO: 7846627 - DNA, 22 bp, Homo sapiens
ctggggccagtgaggaggcttt

SEQ ID NO: 7846628 - DNA, 22 bp, Homo sapiens
ctggggcattgggagaggcctg

SEQ ID NO: 7846629 - DNA, 22 bp, Homo sapiens
ctggggccagtgaggaggcttt

SEQ ID NO: 7846630 - DNA, 22 bp, Homo sapiens
ctggggccagtgaggaggcttt

SEQ ID NO: 7846631 - DNA, 22 bp, Homo sapiens
ctggggccagtgaggaggcttt

SEQ ID NO: 7846632 - DNA, 22 bp, Homo sapiens
ctggggcccatcgagggctgag

SEQ ID NO: 7846633 - DNA, 22 bp, Homo sapiens
ctggggcccatcgagggctgag

SEQ ID NO: 7846634 - DNA, 22 bp, Homo sapiens
ctggggcccatcgagggctgag

SEQ ID NO: 7846635 - DNA, 22 bp, Homo sapiens
ctggggcccatcgagggctgag

SEQ ID NO: 7846636 - DNA, 22 bp, Homo sapiens
ctggggcccatcgagggctgag

SEQ ID NO: 7846637 - DNA, 22 bp, Homo sapiens
ctggggcccatcgagggctgag

SEQ ID NO: 7846638 - DNA, 22 bp, Homo sapiens
ctggggcccatcgagggctgag

SEQ ID NO: 7846639 - DNA, 22 bp, Homo sapiens
ctggggcccatcgagggctgag

SEQ ID NO: 7846640 - DNA, 22 bp, Homo sapiens
ctggggctcactccagccctgg

SEQ ID NO: 7846641 - DNA, 22 bp, Homo sapiens
ctggggctcactccagccctgg

SEQ ID NO: 7846642 - DNA, 22 bp, Homo sapiens
ctggggctcactccagccctgg

SEQ ID NO: 7846643 - DNA, 22 bp, Homo sapiens
ctggggctcactccagccctgg

SEQ ID NO: 7846644 - DNA, 22 bp, Homo sapiens
ctggggctcactttggtcaggc

SEQ ID NO: 7846645 - DNA, 22 bp, Homo sapiens
ctggggctcactttggtcaggc

SEQ ID NO: 7846646 - DNA, 22 bp, Homo sapiens
ctggggcccgagccttgggcca

SEQ ID NO: 7846647 - DNA, 22 bp, Homo sapiens
ctggggcccgagccttgggcca

SEQ ID NO: 7846648 - DNA, 22 bp, Homo sapiens
ctggggcccgagccttgggcca

SEQ ID NO: 7846649 - DNA, 22 bp, Homo sapiens
ctggggccctgggtctgccctc

SEQ ID NO: 7846650 - DNA, 22 bp, Homo sapiens
ctggggccctgggtctgccctc

SEQ ID NO: 7846651 - DNA, 22 bp, Homo sapiens
ctggggccctgggtctgccctc

SEQ ID NO: 7846652 - DNA, 22 bp, Homo sapiens
ctggggctgcagcgatcttcat

SEQ ID NO: 7846653 - DNA, 22 bp, Homo sapiens
ctggggctctctggaatgcttg

SEQ ID NO: 7846654 - DNA, 23 bp, Homo sapiens
ctggggctcattgcagtagccat

SEQ ID NO: 7846655 - DNA, 23 bp, Homo sapiens
ctggggctcattgcagtagccat

SEQ ID NO: 7846656 - DNA, 22 bp, Homo sapiens
ctggggctcactttggtcaggc

SEQ ID NO: 7846657 - DNA, 22 bp, Homo sapiens
ctggggctcactttggtcaggc

SEQ ID NO: 7846658 - DNA, 22 bp, Homo sapiens
ctggggctcactttggtcaggc

SEQ ID NO: 7846659 - DNA, 22 bp, Homo sapiens
ctggggctcactttggtcaggc

SEQ ID NO: 7846660 - DNA, 22 bp, Homo sapiens
ctgggtctggccacaggaagta

SEQ ID NO: 7846661 - DNA, 22 bp, Homo sapiens
ctgggtctggccacaggaagta

SEQ ID NO: 7846662 - DNA, 22 bp, Homo sapiens
ctgggtctggccacaggaagta

SEQ ID NO: 7846663 - DNA, 22 bp, Homo sapiens
ctgggtctggctactgcttcct

SEQ ID NO: 7846664 - DNA, 22 bp, Homo sapiens
ctgggtctggccacaggaagta

SEQ ID NO: 7846665 - DNA, 22 bp, Homo sapiens
ctgggtctggctactgcttcct

SEQ ID NO: 7846666 - DNA, 22 bp, Homo sapiens
ctgggtctggtgtcaggcgacg

SEQ ID NO: 7846667 - DNA, 22 bp, Homo sapiens
ctgggtctggtgtcaggcgacg

SEQ ID NO: 7846668 - DNA, 22 bp, Homo sapiens
ctgggtctgggcctcctggagt

SEQ ID NO: 7846669 - DNA, 22 bp, Homo sapiens
ctgggtctgggcctcctggagt

SEQ ID NO: 7846670 - DNA, 22 bp, Homo sapiens
ctgggtctggtgtcaggcgacg

SEQ ID NO: 7846671 - DNA, 22 bp, Homo sapiens
ctgggtctcttaccatgtgact

SEQ ID NO: 7846672 - DNA, 22 bp, Homo sapiens
ctgggtctcttaccatgtgact

SEQ ID NO: 7846673 - DNA, 22 bp, Homo sapiens
ctgggtctccggcagcctcggg

SEQ ID NO: 7846674 - DNA, 22 bp, Homo sapiens
ctgggtctccggcagcctcggg

SEQ ID NO: 7846675 - DNA, 22 bp, Homo sapiens
ctgggtctctttagggtgccgt

SEQ ID NO: 7846676 - DNA, 22 bp, Homo sapiens
ctgggtctctttagggtgccgt

SEQ ID NO: 7846677 - DNA, 22 bp, Homo sapiens
ctgggtctcttaccatgtgact

SEQ ID NO: 7846678 - DNA, 20 bp, Homo sapiens
ctgggtctccttctgcttaa

SEQ ID NO: 7846679 - DNA, 22 bp, Homo sapiens
ctgggtctcttaccatgtgact

SEQ ID NO: 7846680 - DNA, 22 bp, Homo sapiens
ctgggtctggaggccaagggtg

SEQ ID NO: 7846681 - DNA, 22 bp, Homo sapiens
ctgggtctggaggccaagggtg

SEQ ID NO: 7846682 - DNA, 22 bp, Homo sapiens
ctgggtctggaggccaagggtg

SEQ ID NO: 7846683 - DNA, 22 bp, Homo sapiens
ctgggtctggccacaggaagta

SEQ ID NO: 7846684 - DNA, 22 bp, Homo sapiens
ctggggctgcggacgggagccc

SEQ ID NO: 7846685 - DNA, 22 bp, Homo sapiens
ctggggctgcggtggaggagcc

SEQ ID NO: 7846686 - DNA, 22 bp, Homo sapiens
ctggggctgcggtggaggagcc

SEQ ID NO: 7846687 - DNA, 22 bp, Homo sapiens
ctggggctgcagcgatcttcat

SEQ ID NO: 7846688 - DNA, 22 bp, Homo sapiens
ctggggctgcagcgatcttcat

SEQ ID NO: 7846689 - DNA, 22 bp, Homo sapiens
ctggggctgcagcgatcttcat

SEQ ID NO: 7846690 - DNA, 22 bp, Homo sapiens
ctggggctgcagcgatcttcat

SEQ ID NO: 7846691 - DNA, 22 bp, Homo sapiens
ctggggctgcggtggaggagcc

SEQ ID NO: 7846692 - DNA, 22 bp, Homo sapiens
ctggggctgcggtggaggagcc

SEQ ID NO: 7846693 - DNA, 22 bp, Homo sapiens
ctggggctgcggtggaggagcc

SEQ ID NO: 7846694 - DNA, 22 bp, Homo sapiens
ctggggctgcggtggaggagcc

SEQ ID NO: 7846695 - DNA, 22 bp, Homo sapiens
ctggggctgcggtggaggagcc

SEQ ID NO: 7846696 - DNA, 22 bp, Homo sapiens
ctggggtgtgctcagagcaggg

SEQ ID NO: 7846697 - DNA, 22 bp, Homo sapiens
ctggggtgtgctcagagcaggg

SEQ ID NO: 7846698 - DNA, 22 bp, Homo sapiens
ctggggtgtgctcagagcaggg

SEQ ID NO: 7846699 - DNA, 22 bp, Homo sapiens
ctggggtgtgctcagagcaggg

SEQ ID NO: 7846700 - DNA, 22 bp, Homo sapiens
ctggggtgtgctcagagcaggg

SEQ ID NO: 7846701 - DNA, 22 bp, Homo sapiens
ctgggctgcagcgggagcgacg

SEQ ID NO: 7846702 - DNA, 22 bp, Homo sapiens
ctgggctctgcagttgatgttt

SEQ ID NO: 7846703 - DNA, 22 bp, Homo sapiens
ctgggctgcagcgggagcgacg

SEQ ID NO: 7846704 - DNA, 22 bp, Homo sapiens
ctgggctgcagcgggagcgacg

SEQ ID NO: 7846705 - DNA, 22 bp, Homo sapiens
ctgggctgcagcgggagcgacg

SEQ ID NO: 7846706 - DNA, 22 bp, Homo sapiens
ctgggctgcagcgggagcgacg

SEQ ID NO: 7846707 - DNA, 22 bp, Homo sapiens
ctgggctgcagcgggagcgacg

SEQ ID NO: 7846708 - DNA, 22 bp, Homo sapiens
ctgggctgcagcgggagcgacg

SEQ ID NO: 7846709 - DNA, 22 bp, Homo sapiens
ctgggctgcaggagtggggcaa

SEQ ID NO: 7846710 - DNA, 22 bp, Homo sapiens
ctgggctgcaggagtggggcaa

SEQ ID NO: 7846711 - DNA, 22 bp, Homo sapiens
ctgggctgcaggagtggggcaa

SEQ ID NO: 7846712 - DNA, 22 bp, Homo sapiens
ctgggctgcaggagtggggcaa

SEQ ID NO: 7846713 - DNA, 22 bp, Homo sapiens
ctgggctgcaggagtggggcaa

SEQ ID NO: 7846714 - DNA, 22 bp, Homo sapiens
ctgggctgcaggagtggggcaa

SEQ ID NO: 7846715 - DNA, 22 bp, Homo sapiens
ctgggctgcaggagtggggcaa

SEQ ID NO: 7846716 - DNA, 22 bp, Homo sapiens
ctgggctgcaggagtggggcaa

SEQ ID NO: 7846717 - DNA, 22 bp, Homo sapiens
ctgggctgcaggagtggggcaa

SEQ ID NO: 7846718 - DNA, 22 bp, Homo sapiens
ctgggctgcaggcactaattgg

SEQ ID NO: 7846719 - DNA, 22 bp, Homo sapiens
ctgggctgcagttcctggtcct

SEQ ID NO: 7846720 - DNA, 22 bp, Homo sapiens
ctgggctgcaggagtggggcaa

SEQ ID NO: 7846721 - DNA, 22 bp, Homo sapiens
ctgggctgcagttcctggtcct

SEQ ID NO: 7846722 - DNA, 22 bp, Homo sapiens
ctgggctgcagttcctggtcct

SEQ ID NO: 7846723 - DNA, 22 bp, Homo sapiens
ctgggctgcagttcctggtcct

SEQ ID NO: 7846724 - DNA, 22 bp, Homo sapiens
ctgggctgcagttcctggtcct

SEQ ID NO: 7846725 - DNA, 22 bp, Homo sapiens
ctgggctgcagttcctggtcct

SEQ ID NO: 7846726 - DNA, 22 bp, Homo sapiens
ctgggctgcatcaaagaggcat

SEQ ID NO: 7846727 - DNA, 22 bp, Homo sapiens
ctgggctgcatcaaagaggcat

SEQ ID NO: 7846728 - DNA, 22 bp, Homo sapiens
ctgggctgcagttcctggtcct

SEQ ID NO: 7846729 - DNA, 22 bp, Homo sapiens
ctgggctgcagttcctggtcct

SEQ ID NO: 7846730 - DNA, 22 bp, Homo sapiens
ctgggctgcatcaaagaggcat

SEQ ID NO: 7846731 - DNA, 22 bp, Homo sapiens
ctgggctgcatcaaagaggcat

SEQ ID NO: 7846732 - DNA, 22 bp, Homo sapiens
ctgggccagatccagcctcaca

SEQ ID NO: 7846733 - DNA, 22 bp, Homo sapiens
ctgggccagatccagcctcaca

SEQ ID NO: 7846734 - DNA, 22 bp, Homo sapiens
ctgggccagatccagcctcaca

SEQ ID NO: 7846735 - DNA, 22 bp, Homo sapiens
ctgggccagatccagcctcaca

SEQ ID NO: 7846736 - DNA, 22 bp, Homo sapiens
ctgggctctaggaaccattcct

SEQ ID NO: 7846737 - DNA, 22 bp, Homo sapiens
ctgggccagatccagcctcaca

SEQ ID NO: 7846738 - DNA, 22 bp, Homo sapiens
ctgggctctgcagttgatgttt

SEQ ID NO: 7846739 - DNA, 22 bp, Homo sapiens
ctgggctctgcggtgtcgctct

SEQ ID NO: 7846740 - DNA, 22 bp, Homo sapiens
ctgggctctgcagttgatgttt

SEQ ID NO: 7846741 - DNA, 22 bp, Homo sapiens
ctgggctctaggaaccattcct

SEQ ID NO: 7846742 - DNA, 22 bp, Homo sapiens
ctgggctctagaaaggaaagaa

SEQ ID NO: 7846743 - DNA, 22 bp, Homo sapiens
ctgggctctgcagttgatgttt

SEQ ID NO: 7846744 - DNA, 22 bp, Homo sapiens
ctgggctctaggaaccattcct

SEQ ID NO: 7846745 - DNA, 22 bp, Homo sapiens
ctgggctctaggaaccattcct

SEQ ID NO: 7846746 - DNA, 18 bp, Homo sapiens
ctgggccagagtttctgc

SEQ ID NO: 7846747 - DNA, 19 bp, Homo sapiens
ctgggccagagctgtcctc

SEQ ID NO: 7846748 - DNA, 19 bp, Homo sapiens
ctgggccagagctgtcctc

SEQ ID NO: 7846749 - DNA, 19 bp, Homo sapiens
ctgggccagagctgtcctc

SEQ ID NO: 7846750 - DNA, 19 bp, Homo sapiens
ctgggccagagctgtcctc

SEQ ID NO: 7846751 - DNA, 19 bp, Homo sapiens
ctgggccagagctgtcctc

SEQ ID NO: 7846752 - DNA, 19 bp, Homo sapiens
ctgggccagagctgtcctc

SEQ ID NO: 7846753 - DNA, 19 bp, Homo sapiens
ctgggccagagctgtcctc

SEQ ID NO: 7846754 - DNA, 22 bp, Homo sapiens
ctgggccagaccttgtggtctt

SEQ ID NO: 7846755 - DNA, 22 bp, Homo sapiens
ctgggccagaccttgtggtctt

SEQ ID NO: 7846756 - DNA, 22 bp, Homo sapiens
ctgggccagaccttgtggtctt

SEQ ID NO: 7846757 - DNA, 19 bp, Homo sapiens
ctgggccagaatcagctca

SEQ ID NO: 7846758 - DNA, 22 bp, Homo sapiens
ctgggctgccaggtaggcacac

SEQ ID NO: 7846759 - DNA, 22 bp, Homo sapiens
ctgggctgccaggtaggcacac

SEQ ID NO: 7846760 - DNA, 20 bp, Homo sapiens
ctgggctgcccagctatggg

SEQ ID NO: 7846761 - DNA, 22 bp, Homo sapiens
ctgggctgccaggtaggcacac

SEQ ID NO: 7846762 - DNA, 22 bp, Homo sapiens
ctgggctgccaggtaggcacac

SEQ ID NO: 7846763 - DNA, 20 bp, Homo sapiens
ctgggctgcccagctatggg

SEQ ID NO: 7846764 - DNA, 20 bp, Homo sapiens
ctgggctgcccagctatggg

SEQ ID NO: 7846765 - DNA, 20 bp, Homo sapiens
ctgggctgcccagctatggg

SEQ ID NO: 7846766 - DNA, 20 bp, Homo sapiens
ctgggctgcccagctatggg

SEQ ID NO: 7846767 - DNA, 20 bp, Homo sapiens
ctgggctgcccagctatggg

SEQ ID NO: 7846768 - DNA, 20 bp, Homo sapiens
ctgggctgcccagctatggg

SEQ ID NO: 7846769 - DNA, 20 bp, Homo sapiens
ctgggctgcccagctatggg

SEQ ID NO: 7846770 - DNA, 20 bp, Homo sapiens
ctgggctgcccagctatggg

SEQ ID NO: 7846771 - DNA, 22 bp, Homo sapiens
ctgggctgcgggcgcccctcca

SEQ ID NO: 7846772 - DNA, 22 bp, Homo sapiens
ctgggctgcgggcgcccctcca

SEQ ID NO: 7846773 - DNA, 22 bp, Homo sapiens
ctgggctgcgggcgcccctcca

SEQ ID NO: 7846774 - DNA, 22 bp, Homo sapiens
ctgggctgcggtggtaggttgt

SEQ ID NO: 7846775 - DNA, 22 bp, Homo sapiens
ctgggctgcgggcgcccctcca

SEQ ID NO: 7846776 - DNA, 22 bp, Homo sapiens
ctgggctgcggtggtaggttgt

SEQ ID NO: 7846777 - DNA, 22 bp, Homo sapiens
ctgggctgcggtggtaggttgt

SEQ ID NO: 7846778 - DNA, 22 bp, Homo sapiens
ctgggctgcggttctctgaagc

SEQ ID NO: 7846779 - DNA, 22 bp, Homo sapiens
ctgggctgcggttctctgaagc

SEQ ID NO: 7846780 - DNA, 22 bp, Homo sapiens
ctgggctgcggtggtaggttgt

SEQ ID NO: 7846781 - DNA, 22 bp, Homo sapiens
ctgggctgcggttctctgaagc

SEQ ID NO: 7846782 - DNA, 22 bp, Homo sapiens
ctgggctgctcagccccctcgc

SEQ ID NO: 7846783 - DNA, 22 bp, Homo sapiens
ctgggctgctcagccccctcgc

SEQ ID NO: 7846784 - DNA, 22 bp, Homo sapiens
ctgggctgctgtccactagggt

SEQ ID NO: 7846785 - DNA, 22 bp, Homo sapiens
ctgggctgcttgctgaaggggt

SEQ ID NO: 7846786 - DNA, 22 bp, Homo sapiens
ctgggctggagtgcaatggcgc

SEQ ID NO: 7846787 - DNA, 22 bp, Homo sapiens
ctgggctggagtgcaatggcgc

SEQ ID NO: 7846788 - DNA, 22 bp, Homo sapiens
ctgggctggacacacttaacct

SEQ ID NO: 7846789 - DNA, 22 bp, Homo sapiens
ctgggctggacacacttaacct

SEQ ID NO: 7846790 - DNA, 20 bp, Homo sapiens
ctggggagctgctcccacga

SEQ ID NO: 7846791 - DNA, 20 bp, Homo sapiens
ctggggaggaggatgtgttc

SEQ ID NO: 7846792 - DNA, 20 bp, Homo sapiens
ctggggaggaggatgtgttc

SEQ ID NO: 7846793 - DNA, 20 bp, Homo sapiens
ctggggaggaggatgtgttc

SEQ ID NO: 7846794 - DNA, 20 bp, Homo sapiens
ctggggaggaggatgtgttc

SEQ ID NO: 7846795 - DNA, 20 bp, Homo sapiens
ctggggaggaggatgtgttc

SEQ ID NO: 7846796 - DNA, 20 bp, Homo sapiens
ctggggaggaggatgtgttc

SEQ ID NO: 7846797 - DNA, 20 bp, Homo sapiens
ctggggaggaggatgtgttc

SEQ ID NO: 7846798 - DNA, 20 bp, Homo sapiens
ctggggaggaggatgtgttc

SEQ ID NO: 7846799 - DNA, 22 bp, Homo sapiens
ctgggctgctgtccactagggt

SEQ ID NO: 7846800 - DNA, 22 bp, Homo sapiens
ctgggctgctgtccactagggt

SEQ ID NO: 7846801 - DNA, 22 bp, Homo sapiens
ctgggctgctgtccactagggt

SEQ ID NO: 7846802 - DNA, 22 bp, Homo sapiens
ctgggctgctgtccactagggt

SEQ ID NO: 7846803 - DNA, 22 bp, Homo sapiens
ctgggctgctcagccccctcgc

SEQ ID NO: 7846804 - DNA, 22 bp, Homo sapiens
ctgggctgctgtccactagggt

SEQ ID NO: 7846805 - DNA, 23 bp, Homo sapiens
ctgggctgcttgagtccctggct

SEQ ID NO: 7846806 - DNA, 23 bp, Homo sapiens
ctgggctgcttgagtccctggct

SEQ ID NO: 7846807 - DNA, 23 bp, Homo sapiens
ctgggctgcttgagtccctggct

SEQ ID NO: 7846808 - DNA, 23 bp, Homo sapiens
ctgggctgcttgagtccctggct

SEQ ID NO: 7846809 - DNA, 23 bp, Homo sapiens
ctgggctgcttgagtccctggct

SEQ ID NO: 7846810 - DNA, 23 bp, Homo sapiens
ctgggctgcttgagtccctggct

SEQ ID NO: 7846811 - DNA, 23 bp, Homo sapiens
ctgggctgcttgagtccctggct

SEQ ID NO: 7846812 - DNA, 22 bp, Homo sapiens
ctgggctgcttgctgaaggggt

SEQ ID NO: 7846813 - DNA, 22 bp, Homo sapiens
ctgggctgcttgctgaaggggt

SEQ ID NO: 7846814 - DNA, 22 bp, Homo sapiens
ctgggctgcttgctgaaggggt

SEQ ID NO: 7846815 - DNA, 22 bp, Homo sapiens
ctgggctgcttgctgaaggggt

SEQ ID NO: 7846816 - DNA, 22 bp, Homo sapiens
ctgggctgcttgctgaaggggt

SEQ ID NO: 7846817 - DNA, 22 bp, Homo sapiens
ctgggctgcttgctgaaggggt

SEQ ID NO: 7846818 - DNA, 22 bp, Homo sapiens
ctgggctgcttgctgaaggggt

SEQ ID NO: 7846819 - DNA, 22 bp, Homo sapiens
ctgggtgctgtgggctcagagg

SEQ ID NO: 7846820 - DNA, 22 bp, Homo sapiens
ctgtccctgagcaactcctgtt

SEQ ID NO: 7846821 - DNA, 22 bp, Homo sapiens
ctgtccctgagcaactcctgtt

SEQ ID NO: 7846822 - DNA, 22 bp, Homo sapiens
ctgtccctgagcaactcctgtt

SEQ ID NO: 7846823 - DNA, 22 bp, Homo sapiens
ctgtccctgagcaactcctgtt

SEQ ID NO: 7846824 - DNA, 22 bp, Homo sapiens
ctgggtgctgtgggctcagagg

SEQ ID NO: 7846825 - DNA, 22 bp, Homo sapiens
ctgggtgccaattcatgtttat

SEQ ID NO: 7846826 - DNA, 22 bp, Homo sapiens
ctgggtgcgtgagcgcatgcgt

SEQ ID NO: 7846827 - DNA, 22 bp, Homo sapiens
ctgggtgccagcatggctgagt

SEQ ID NO: 7846828 - DNA, 22 bp, Homo sapiens
ctgggtgccacgggcaccctgg

SEQ ID NO: 7846829 - DNA, 22 bp, Homo sapiens
ctgggtgccagcatggctgagt

SEQ ID NO: 7846830 - DNA, 22 bp, Homo sapiens
ctgggtgccacgggcaccctgg

SEQ ID NO: 7846831 - DNA, 22 bp, Homo sapiens
ctgggtgccacgggcaccctgg

SEQ ID NO: 7846832 - DNA, 22 bp, Homo sapiens
ctgtcctctgtcctcagcagga

SEQ ID NO: 7846833 - DNA, 22 bp, Homo sapiens
ctgtcccttcattattcactac

SEQ ID NO: 7846834 - DNA, 22 bp, Homo sapiens
ctgtcccttcattattcactac

SEQ ID NO: 7846835 - DNA, 22 bp, Homo sapiens
ctgtcccttcattattcactac

SEQ ID NO: 7846836 - DNA, 22 bp, Homo sapiens
ctgtccctgagcaactcctgtt

SEQ ID NO: 7846837 - DNA, 22 bp, Homo sapiens
ctgtccctgagcaactcctgtt

SEQ ID NO: 7846838 - DNA, 22 bp, Homo sapiens
ctgtccctgagcaactcctgtt

SEQ ID NO: 7846839 - DNA, 22 bp, Homo sapiens
ctgtcccttcattattcactac

SEQ ID NO: 7846840 - DNA, 22 bp, Homo sapiens
ctgtcctgaagttttcatgaga

SEQ ID NO: 7846841 - DNA, 22 bp, Homo sapiens
ctgtcctgaagttttcatgaga

SEQ ID NO: 7846842 - DNA, 22 bp, Homo sapiens
ctgtcctgaagttttcatgaga

SEQ ID NO: 7846843 - DNA, 22 bp, Homo sapiens
ctgtcctgaagttttcatgaga

SEQ ID NO: 7846844 - DNA, 22 bp, Homo sapiens
ctgtcctctgtcctcagcagga

SEQ ID NO: 7846845 - DNA, 22 bp, Homo sapiens
ctgtcctgaaagggagattggg

SEQ ID NO: 7846846 - DNA, 22 bp, Homo sapiens
ctgggtgacagagtgagatggt

SEQ ID NO: 7846847 - DNA, 22 bp, Homo sapiens
ctgggtgacagagtgagatggt

SEQ ID NO: 7846848 - DNA, 22 bp, Homo sapiens
ctgggtgacagagtgagatggt

SEQ ID NO: 7846849 - DNA, 22 bp, Homo sapiens
ctgggtgagctggccagagggt

SEQ ID NO: 7846850 - DNA, 22 bp, Homo sapiens
ctgggtgagctggccagagggt

SEQ ID NO: 7846851 - DNA, 22 bp, Homo sapiens
ctgggtgagtataggaaaggga

SEQ ID NO: 7846852 - DNA, 22 bp, Homo sapiens
ctgggtgagttgatgaaggaga

SEQ ID NO: 7846853 - DNA, 22 bp, Homo sapiens
ctgggtgagtataggaaaggga

SEQ ID NO: 7846854 - DNA, 22 bp, Homo sapiens
ctgggtgagttgatgaaggaga

SEQ ID NO: 7846855 - DNA, 22 bp, Homo sapiens
ctgggtgagttgatgaaggaga

SEQ ID NO: 7846856 - DNA, 22 bp, Homo sapiens
ctgggtgattcctgtccaggca

SEQ ID NO: 7846857 - DNA, 22 bp, Homo sapiens
ctgggtgattcctgtccaggca

SEQ ID NO: 7846858 - DNA, 22 bp, Homo sapiens
ctgggtgattcctgtccaggca

SEQ ID NO: 7846859 - DNA, 19 bp, Homo sapiens
ctgggtcttattctgtgaa

SEQ ID NO: 7846860 - DNA, 22 bp, Homo sapiens
ctgggtcttcagcagcaggcgg

SEQ ID NO: 7846861 - DNA, 22 bp, Homo sapiens
ctgggtctgtcactagataaat

SEQ ID NO: 7846862 - DNA, 22 bp, Homo sapiens
ctgggtctgtgcccagggacct

SEQ ID NO: 7846863 - DNA, 22 bp, Homo sapiens
ctgggtctgtgcccagggacct

SEQ ID NO: 7846864 - DNA, 22 bp, Homo sapiens
ctgggtctgtgcccagggacct

SEQ ID NO: 7846865 - DNA, 22 bp, Homo sapiens
ctgggtctttttcttccattga

SEQ ID NO: 7846866 - DNA, 22 bp, Homo sapiens
ctgggtcttcagcagcaggcgg

SEQ ID NO: 7846867 - DNA, 22 bp, Homo sapiens
ctgggtcttcagcagcaggcgg

SEQ ID NO: 7846868 - DNA, 22 bp, Homo sapiens
ctgggtgacagagtgagatggt

SEQ ID NO: 7846869 - DNA, 22 bp, Homo sapiens
ctgggtgaatttgaaggaaagg

SEQ ID NO: 7846870 - DNA, 22 bp, Homo sapiens
ctgggtgaatttgaaggaaagg

SEQ ID NO: 7846871 - DNA, 22 bp, Homo sapiens
ctgggtgaatttgaaggaaagg

SEQ ID NO: 7846872 - DNA, 22 bp, Homo sapiens
ctgtcctggagggcataggacg

SEQ ID NO: 7846873 - DNA, 22 bp, Homo sapiens
ctgtcctggagggcataggacg

SEQ ID NO: 7846874 - DNA, 22 bp, Homo sapiens
ctgtcctggagggcataggacg

SEQ ID NO: 7846875 - DNA, 22 bp, Homo sapiens
ctgtcctggggaaagccagccc

SEQ ID NO: 7846876 - DNA, 22 bp, Homo sapiens
ctgtcctggccgcccttgtgag

SEQ ID NO: 7846877 - DNA, 22 bp, Homo sapiens
ctgtcctggccgcccttgtgag

SEQ ID NO: 7846878 - DNA, 22 bp, Homo sapiens
ctgtcctggccgcccttgtgag

SEQ ID NO: 7846879 - DNA, 22 bp, Homo sapiens
ctgtcctgggggtggtccttgc

SEQ ID NO: 7846880 - DNA, 22 bp, Homo sapiens
ctgtcctgggggtggtccttgc

SEQ ID NO: 7846881 - DNA, 22 bp, Homo sapiens
ctgtcctggggaaagccagccc

SEQ ID NO: 7846882 - DNA, 21 bp, Homo sapiens
ctgtcctggtctagaggcaca

SEQ ID NO: 7846883 - DNA, 21 bp, Homo sapiens
ctgtcctggtctagaggcaca

SEQ ID NO: 7846884 - DNA, 21 bp, Homo sapiens
ctgtcctggtctagaggcaca

SEQ ID NO: 7846885 - DNA, 19 bp, Homo sapiens
ctgtcctggtttggtccct

SEQ ID NO: 7846886 - DNA, 22 bp, Homo sapiens
ctgtcctggtgctggggatccc

SEQ ID NO: 7846887 - DNA, 22 bp, Homo sapiens
ctgtcctgtagctccatcagtc

SEQ ID NO: 7846888 - DNA, 22 bp, Homo sapiens
ctgtcctgtagctccatcagtc

SEQ ID NO: 7846889 - DNA, 22 bp, Homo sapiens
ctgtcctgtactttgaggccct

SEQ ID NO: 7846890 - DNA, 19 bp, Homo sapiens
ctgtcctggtttggtccct

SEQ ID NO: 7846891 - DNA, 22 bp, Homo sapiens
ctgtcctgtactttgaggccct

SEQ ID NO: 7846892 - DNA, 22 bp, Homo sapiens
ctgtcctgtactttgaggccct

SEQ ID NO: 7846893 - DNA, 22 bp, Homo sapiens
ctgtcctgtagctccatcagtc

SEQ ID NO: 7846894 - DNA, 22 bp, Homo sapiens
ctgtcctgtagctccatcagtc

SEQ ID NO: 7846895 - DNA, 22 bp, Homo sapiens
ctgtcctgatggtgccactggt

SEQ ID NO: 7846896 - DNA, 22 bp, Homo sapiens
ctgtcctgatggtgccactggt

SEQ ID NO: 7846897 - DNA, 22 bp, Homo sapiens
ctgtcctgatggtgccactggt

SEQ ID NO: 7846898 - DNA, 22 bp, Homo sapiens
ctgtcctgatggtgccactggt

SEQ ID NO: 7846899 - DNA, 22 bp, Homo sapiens
ctgtcctgatggtgccactggt

SEQ ID NO: 7846900 - DNA, 22 bp, Homo sapiens
ctgtcctgaggcaggtggcctg

SEQ ID NO: 7846901 - DNA, 22 bp, Homo sapiens
ctgtcctgagataaagatgagg

SEQ ID NO: 7846902 - DNA, 20 bp, Homo sapiens
ctgtcctgatcttttcagaa

SEQ ID NO: 7846903 - DNA, 22 bp, Homo sapiens
ctgtcctgagttcttggaggtc

SEQ ID NO: 7846904 - DNA, 22 bp, Homo sapiens
ctgtcctgcccaccctgcaggg

SEQ ID NO: 7846905 - DNA, 22 bp, Homo sapiens
ctgtcctgcccaccctgcaggg

SEQ ID NO: 7846906 - DNA, 22 bp, Homo sapiens
ctgtcctgcccaccctgcaggg

SEQ ID NO: 7846907 - DNA, 22 bp, Homo sapiens
ctgtcctgcccaccctgcaggg

SEQ ID NO: 7846908 - DNA, 22 bp, Homo sapiens
ctgtcctgcccaccctgcaggg

SEQ ID NO: 7846909 - DNA, 22 bp, Homo sapiens
ctgtcctgcccaccctgcaggg

SEQ ID NO: 7846910 - DNA, 22 bp, Homo sapiens
ctgtcctgccagtcctggactc

SEQ ID NO: 7846911 - DNA, 22 bp, Homo sapiens
ctgtcctgccagtcctggactc

SEQ ID NO: 7846912 - DNA, 22 bp, Homo sapiens
ctgtcctgccagtcctggactc

SEQ ID NO: 7846913 - DNA, 22 bp, Homo sapiens
ctgtcctgccagtcctggactc

SEQ ID NO: 7846914 - DNA, 22 bp, Homo sapiens
ctgtcctgcagttgggggcagg

SEQ ID NO: 7846915 - DNA, 22 bp, Homo sapiens
ctgtgccagcctgtcccaggag

SEQ ID NO: 7846916 - DNA, 22 bp, Homo sapiens
ctgtgccaggcccagctgactt

SEQ ID NO: 7846917 - DNA, 22 bp, Homo sapiens
ctgtgccaggcccagctgactt

SEQ ID NO: 7846918 - DNA, 22 bp, Homo sapiens
ctgtgccaggcccgggtgggtg

SEQ ID NO: 7846919 - DNA, 22 bp, Homo sapiens
ctgtgccaggcccagctgactt

SEQ ID NO: 7846920 - DNA, 22 bp, Homo sapiens
ctgtgccatcctagggctgctg

SEQ ID NO: 7846921 - DNA, 22 bp, Homo sapiens
ctgtgccatcctagggctgctg

SEQ ID NO: 7846922 - DNA, 22 bp, Homo sapiens
ctgtgccattctttgtagcatg

SEQ ID NO: 7846923 - DNA, 22 bp, Homo sapiens
ctgtgccattctttgtagcatg

SEQ ID NO: 7846924 - DNA, 22 bp, Homo sapiens
ctgtgcccacctggctctgagg

SEQ ID NO: 7846925 - DNA, 22 bp, Homo sapiens
ctgtgcccacctggctctgagg

SEQ ID NO: 7846926 - DNA, 22 bp, Homo sapiens
ctgtgcccacctggctctgagg

SEQ ID NO: 7846927 - DNA, 22 bp, Homo sapiens
ctgtgcccacctggctctgagg

SEQ ID NO: 7846928 - DNA, 22 bp, Homo sapiens
ctgtgcccacctggctctgagg

SEQ ID NO: 7846929 - DNA, 22 bp, Homo sapiens
ctgtgcccagctccctgactgc

SEQ ID NO: 7846930 - DNA, 22 bp, Homo sapiens
ctgtgcccagctccctgactgc

SEQ ID NO: 7846931 - DNA, 22 bp, Homo sapiens
ctgtgcccaggctggagtgcag

SEQ ID NO: 7846932 - DNA, 22 bp, Homo sapiens
ctgtgcccaggctggagtgcag

SEQ ID NO: 7846933 - DNA, 22 bp, Homo sapiens
ctgtgcccaggcccctggggat

SEQ ID NO: 7846934 - DNA, 22 bp, Homo sapiens
ctgtgcccaggctggagtgcag

SEQ ID NO: 7846935 - DNA, 17 bp, Homo sapiens
ctgtggccacctggatg

SEQ ID NO: 7846936 - DNA, 22 bp, Homo sapiens
ctgtggccagatggtgccagtt

SEQ ID NO: 7846937 - DNA, 22 bp, Homo sapiens
ctgtggctcatatctgtaatct

SEQ ID NO: 7846938 - DNA, 22 bp, Homo sapiens
ctgtggctcatatctgtaatct

SEQ ID NO: 7846939 - DNA, 22 bp, Homo sapiens
ctgtggctcatatctgtaatct

SEQ ID NO: 7846940 - DNA, 22 bp, Homo sapiens
ctgtggccccaccctcttggcc

SEQ ID NO: 7846941 - DNA, 22 bp, Homo sapiens
ctgtggccagtcccacacctcc

SEQ ID NO: 7846942 - DNA, 23 bp, Homo sapiens
ctgtgcccggggctccacctgat

SEQ ID NO: 7846943 - DNA, 23 bp, Homo sapiens
ctgtgcccggggctccacctgat

SEQ ID NO: 7846944 - DNA, 19 bp, Homo sapiens
ctgtgccctatgacttgta

SEQ ID NO: 7846945 - DNA, 22 bp, Homo sapiens
ctgtgccctctttgctggcctt

SEQ ID NO: 7846946 - DNA, 22 bp, Homo sapiens
ctgtgccctctttgctggcctt

SEQ ID NO: 7846947 - DNA, 22 bp, Homo sapiens
ctgtgccctctttgctggcctt

SEQ ID NO: 7846948 - DNA, 19 bp, Homo sapiens
ctgtgccctatgacttgta

SEQ ID NO: 7846949 - DNA, 22 bp, Homo sapiens
ctgtgcccataatctggtattt

SEQ ID NO: 7846950 - DNA, 22 bp, Homo sapiens
ctgtgccccacagagctccaca

SEQ ID NO: 7846951 - DNA, 22 bp, Homo sapiens
ctgtgcccggcccagggccctg

SEQ ID NO: 7846952 - DNA, 22 bp, Homo sapiens
ctgtgcccggcccagggccctg

SEQ ID NO: 7846953 - DNA, 22 bp, Homo sapiens
ctgtgcccggcccagggccctg

SEQ ID NO: 7846954 - DNA, 22 bp, Homo sapiens
ctgtgcagtgtggggtaggcct

SEQ ID NO: 7846955 - DNA, 22 bp, Homo sapiens
ctgtgcagtgtggggtaggcct

SEQ ID NO: 7846956 - DNA, 22 bp, Homo sapiens
ctgtgcagtgtggggtaggcct

SEQ ID NO: 7846957 - DNA, 22 bp, Homo sapiens
ctgtgcattgtcttgtctgtag

SEQ ID NO: 7846958 - DNA, 22 bp, Homo sapiens
ctgtgcattgttgagtgtttag

SEQ ID NO: 7846959 - DNA, 22 bp, Homo sapiens
ctgtgccactgccccaggcctc

SEQ ID NO: 7846960 - DNA, 22 bp, Homo sapiens
ctgtgccactgccctgccacgc

SEQ ID NO: 7846961 - DNA, 22 bp, Homo sapiens
ctgtgccactgccctgccacgc

SEQ ID NO: 7846962 - DNA, 22 bp, Homo sapiens
ctgtgccactgccccaggcctc

SEQ ID NO: 7846963 - DNA, 22 bp, Homo sapiens
ctgtgccacctgagggactcta

SEQ ID NO: 7846964 - DNA, 22 bp, Homo sapiens
ctgtgccactgccccaggcctc

SEQ ID NO: 7846965 - DNA, 22 bp, Homo sapiens
ctgtgccactgccccaggcctc

SEQ ID NO: 7846966 - DNA, 22 bp, Homo sapiens
ctgtgccactgggggccggcaa

SEQ ID NO: 7846967 - DNA, 22 bp, Homo sapiens
ctgtgccagcctgtcccaggag

SEQ ID NO: 7846968 - DNA, 22 bp, Homo sapiens
ctgtgccaggcccagctgactt

SEQ ID NO: 7846969 - DNA, 22 bp, Homo sapiens
ctgtgcagtggcagcgtgtggg

SEQ ID NO: 7846970 - DNA, 22 bp, Homo sapiens
ctgtgcagtggcagcgtgtggg

SEQ ID NO: 7846971 - DNA, 22 bp, Homo sapiens
ctgtgcagtggcagcgtgtggg

SEQ ID NO: 7846972 - DNA, 22 bp, Homo sapiens
ctgtgcagtggcagcgtgtggg

SEQ ID NO: 7846973 - DNA, 22 bp, Homo sapiens
ctgtgagtgaccctggtcagca

SEQ ID NO: 7846974 - DNA, 19 bp, Homo sapiens
ctgtgagtcttgtggcctc

SEQ ID NO: 7846975 - DNA, 22 bp, Homo sapiens
ctgtgagtcttcagcaagtgtt

SEQ ID NO: 7846976 - DNA, 22 bp, Homo sapiens
ctgtgagggtcacagccatgcc

SEQ ID NO: 7846977 - DNA, 22 bp, Homo sapiens
ctgtcctgtggacctgaggacg

SEQ ID NO: 7846978 - DNA, 22 bp, Homo sapiens
ctgtcctgtgctttttactgtc

SEQ ID NO: 7846979 - DNA, 22 bp, Homo sapiens
ctgtcctgtgcattgtcagatg

SEQ ID NO: 7846980 - DNA, 22 bp, Homo sapiens
ctgtcctgtgcattgtcagatg

SEQ ID NO: 7846981 - DNA, 22 bp, Homo sapiens
ctgtcctgtgctttttactgtc

SEQ ID NO: 7846982 - DNA, 22 bp, Homo sapiens
ctgtcctgtggacctgaggacg

SEQ ID NO: 7846983 - DNA, 22 bp, Homo sapiens
ctgtcctgtggacctgaggacg

SEQ ID NO: 7846984 - DNA, 23 bp, Homo sapiens
ctgtcctgtagttcacgttggcc

SEQ ID NO: 7846985 - DNA, 23 bp, Homo sapiens
ctgtcctgtagttcacgttggcc

SEQ ID NO: 7846986 - DNA, 22 bp, Homo sapiens
ctgtcctgtctgcttttaattt

SEQ ID NO: 7846987 - DNA, 22 bp, Homo sapiens
ctgtgtctaatcttatacatca

SEQ ID NO: 7846988 - DNA, 23 bp, Homo sapiens
ctgtgtctatgcagccatatcca

SEQ ID NO: 7846989 - DNA, 22 bp, Homo sapiens
ctgtgtctaatcaggtcagtca

SEQ ID NO: 7846990 - DNA, 23 bp, Homo sapiens
ctgtgtctatgcagccatatcca

SEQ ID NO: 7846991 - DNA, 23 bp, Homo sapiens
ctgtgtctatgcagccatatcca

SEQ ID NO: 7846992 - DNA, 22 bp, Homo sapiens
ctgtgtctaatcttatacatca

SEQ ID NO: 7846993 - DNA, 23 bp, Homo sapiens
ctgtgtctatgcagccatatcca

SEQ ID NO: 7846994 - DNA, 22 bp, Homo sapiens
ctgtgtctcatccgcctctggc

SEQ ID NO: 7846995 - DNA, 22 bp, Homo sapiens
ctgtgtcctttaaaaaagacac

SEQ ID NO: 7846996 - DNA, 22 bp, Homo sapiens
ctgtgtctaatcaggtcagtca

SEQ ID NO: 7846997 - DNA, 22 bp, Homo sapiens
ctgtgtccttttagttgctgtg

SEQ ID NO: 7846998 - DNA, 22 bp, Homo sapiens
ctgtgtctaatcttatacatca

SEQ ID NO: 7846999 - DNA, 22 bp, Homo sapiens
ctgtgtcctccccatcacttct

SEQ ID NO: 7847000 - DNA, 20 bp, Homo sapiens
ctgtgtagtgctcaggtaag

SEQ ID NO: 7847001 - DNA, 22 bp, Homo sapiens
ctgtgtagtcaggtggtcccac

SEQ ID NO: 7847002 - DNA, 22 bp, Homo sapiens
ctgtgtagtatttgtacacata

SEQ ID NO: 7847003 - DNA, 22 bp, Homo sapiens
ctgtgtagtcaggtggtcccac

SEQ ID NO: 7847004 - DNA, 22 bp, Homo sapiens
ctgtgtagctctgggtgcaagt

SEQ ID NO: 7847005 - DNA, 22 bp, Homo sapiens
ctgtgtagctctgggtgcaagt

SEQ ID NO: 7847006 - DNA, 22 bp, Homo sapiens
ctgtgtcctcccgctgcaccca

SEQ ID NO: 7847007 - DNA, 22 bp, Homo sapiens
ctgtgtcctcccgctgcaccca

SEQ ID NO: 7847008 - DNA, 22 bp, Homo sapiens
ctgtgtcctccccatcacttct

SEQ ID NO: 7847009 - DNA, 22 bp, Homo sapiens
ctgtgtcctgtctcctaaggtg

SEQ ID NO: 7847010 - DNA, 22 bp, Homo sapiens
ctgtgtcctgtctcctaaggtg

SEQ ID NO: 7847011 - DNA, 22 bp, Homo sapiens
ctgtgtcctcccgctgcaccca

SEQ ID NO: 7847012 - DNA, 22 bp, Homo sapiens
ctgtgtcctgcgtcaagccaat

SEQ ID NO: 7847013 - DNA, 22 bp, Homo sapiens
ctgtggctgtatttggccagag

SEQ ID NO: 7847014 - DNA, 22 bp, Homo sapiens
ctgtggctgtatttggccagag

SEQ ID NO: 7847015 - DNA, 22 bp, Homo sapiens
ctgtggctgtatttggccagag

SEQ ID NO: 7847016 - DNA, 22 bp, Homo sapiens
ctgtggctgtatttggccagag

SEQ ID NO: 7847017 - DNA, 22 bp, Homo sapiens
ctgtggctgtatttggccagag

SEQ ID NO: 7847018 - DNA, 22 bp, Homo sapiens
ctgtggctggctcatcataggt

SEQ ID NO: 7847019 - DNA, 22 bp, Homo sapiens
ctgtggctggctcatcataggt

SEQ ID NO: 7847020 - DNA, 22 bp, Homo sapiens
ctgtggctgcgtaggtctggca

SEQ ID NO: 7847021 - DNA, 22 bp, Homo sapiens
ctgtggctggcctgtctgacat

SEQ ID NO: 7847022 - DNA, 22 bp, Homo sapiens
ctgtggctgtatttggccagag

SEQ ID NO: 7847023 - DNA, 22 bp, Homo sapiens
ctgtggctgtctctttcccatg

SEQ ID NO: 7847024 - DNA, 22 bp, Homo sapiens
ctgtggctgtgaaacttctcag

SEQ ID NO: 7847025 - DNA, 22 bp, Homo sapiens
ctgtggctgtgaaacttctcag

SEQ ID NO: 7847026 - DNA, 22 bp, Homo sapiens
ctgtggctgtgaaacttctcag

SEQ ID NO: 7847027 - DNA, 22 bp, Homo sapiens
ctgtggctgtgaaacttctcag

SEQ ID NO: 7847028 - DNA, 22 bp, Homo sapiens
ctgtggctgtgaaacttctcag

SEQ ID NO: 7847029 - DNA, 22 bp, Homo sapiens
ctgtggtggcacagcgggctgg

SEQ ID NO: 7847030 - DNA, 22 bp, Homo sapiens
ctgtggctgtgaaacttctcag

SEQ ID NO: 7847031 - DNA, 22 bp, Homo sapiens
ctgtggtgggccctgggcttca

SEQ ID NO: 7847032 - DNA, 22 bp, Homo sapiens
ctgtggtgggccctgggcttca

SEQ ID NO: 7847033 - DNA, 22 bp, Homo sapiens
ctgtggtggcctccctgccatg

SEQ ID NO: 7847034 - DNA, 22 bp, Homo sapiens
ctgtgtagagcggctgcgagcg

SEQ ID NO: 7847035 - DNA, 22 bp, Homo sapiens
ctgtgtagcctcatgtgggctt

SEQ ID NO: 7847036 - DNA, 22 bp, Homo sapiens
ctgtggctgaactctgaagagg

SEQ ID NO: 7847037 - DNA, 22 bp, Homo sapiens
ctgtggctgaactctgaagagg

SEQ ID NO: 7847038 - DNA, 22 bp, Homo sapiens
ctgtggctctttagttgagcac

SEQ ID NO: 7847039 - DNA, 22 bp, Homo sapiens
ctgtggctctgcagtcccaaca

SEQ ID NO: 7847040 - DNA, 19 bp, Homo sapiens
ctgtggctgacctctggcc

SEQ ID NO: 7847041 - DNA, 19 bp, Homo sapiens
ctgtggctgacctctggcc

SEQ ID NO: 7847042 - DNA, 19 bp, Homo sapiens
ctgtggctgacctctggcc

SEQ ID NO: 7847043 - DNA, 23 bp, Homo sapiens
ctgtggctgagtcctgttggagt

SEQ ID NO: 7847044 - DNA, 22 bp, Homo sapiens
ctgtggctgcagccttggtcct

SEQ ID NO: 7847045 - DNA, 22 bp, Homo sapiens
ctgtggctgcagccttggtcct

SEQ ID NO: 7847046 - DNA, 22 bp, Homo sapiens
ctgtggctgcagccttggtcct

SEQ ID NO: 7847047 - DNA, 22 bp, Homo sapiens
ctgtggctgcctcacctacagg

SEQ ID NO: 7847048 - DNA, 22 bp, Homo sapiens
ctgtggctgcctcacctacagg

SEQ ID NO: 7847049 - DNA, 22 bp, Homo sapiens
ctgtggctgcgccctgggggag

SEQ ID NO: 7847050 - DNA, 22 bp, Homo sapiens
ctgtggctgcgtaggtctggca

SEQ ID NO: 7847051 - DNA, 22 bp, Homo sapiens
ctgtggctgcgtaggtctggca

SEQ ID NO: 7847052 - DNA, 22 bp, Homo sapiens
ctgtggctgcgccatcgaaaac

SEQ ID NO: 7847053 - DNA, 22 bp, Homo sapiens
ctgtggctgcgccatcgaaaac

SEQ ID NO: 7847054 - DNA, 22 bp, Homo sapiens
ctgtggctccagtgaaccaatg

SEQ ID NO: 7847055 - DNA, 22 bp, Homo sapiens
ctgtggctccagtgaaccaatg

SEQ ID NO: 7847056 - DNA, 22 bp, Homo sapiens
ctgtggctccatagaagttgca

SEQ ID NO: 7847057 - DNA, 22 bp, Homo sapiens
ctgtggctccatagaagttgca

SEQ ID NO: 7847058 - DNA, 20 bp, Homo sapiens
ctgtggctcatgcatctgcc

SEQ ID NO: 7847059 - DNA, 20 bp, Homo sapiens
ctgtggctcatgcatctgcc

SEQ ID NO: 7847060 - DNA, 20 bp, Homo sapiens
ctgtggctcatgcatctgcc

SEQ ID NO: 7847061 - DNA, 20 bp, Homo sapiens
ctgtggctcatgcatctgcc

SEQ ID NO: 7847062 - DNA, 20 bp, Homo sapiens
ctgtggctcatgcatctgcc

SEQ ID NO: 7847063 - DNA, 20 bp, Homo sapiens
ctgtggctcatgcatctgcc

SEQ ID NO: 7847064 - DNA, 20 bp, Homo sapiens
ctgtggctcatgcatctgcc

SEQ ID NO: 7847065 - DNA, 22 bp, Homo sapiens
ctgtggctctcagaggctgctg

SEQ ID NO: 7847066 - DNA, 22 bp, Homo sapiens
ctgtggctctcagaggctgctg

SEQ ID NO: 7847067 - DNA, 22 bp, Homo sapiens
ctgtggctctcagaggctgctg

SEQ ID NO: 7847068 - DNA, 22 bp, Homo sapiens
ctgtggctctcagaggctgctg

SEQ ID NO: 7847069 - DNA, 22 bp, Homo sapiens
ctgtggctctctgcagggtccc

SEQ ID NO: 7847070 - DNA, 22 bp, Homo sapiens
ctgtggctctctgcagggtccc

SEQ ID NO: 7847071 - DNA, 22 bp, Homo sapiens
ctgtggctctctgcagggtccc

SEQ ID NO: 7847072 - DNA, 22 bp, Homo sapiens
ctgtggctctccaatggaggga

SEQ ID NO: 7847073 - DNA, 22 bp, Homo sapiens
ctgtggctctccaatggaggga

SEQ ID NO: 7847074 - DNA, 22 bp, Homo sapiens
ctgtgtcttcctctgcccaggc

SEQ ID NO: 7847075 - DNA, 22 bp, Homo sapiens
ctgtgtcttcctctgcccaggc

SEQ ID NO: 7847076 - DNA, 22 bp, Homo sapiens
ctgtgtcttcacatttgtgtgc

SEQ ID NO: 7847077 - DNA, 22 bp, Homo sapiens
ctgtgtcttctgcttacagtct

SEQ ID NO: 7847078 - DNA, 22 bp, Homo sapiens
ctgtgtcttcacatttgtgtgc

SEQ ID NO: 7847079 - DNA, 22 bp, Homo sapiens
ctgtgtcttcacatttgtgtgc

SEQ ID NO: 7847080 - DNA, 22 bp, Homo sapiens
ctgtgtcttcctctgcccaggc

SEQ ID NO: 7847081 - DNA, 22 bp, Homo sapiens
ctgtgtcttcacatttgtgtgc

SEQ ID NO: 7847082 - DNA, 22 bp, Homo sapiens
ctgtgtcttcaatgtactggga

SEQ ID NO: 7847083 - DNA, 22 bp, Homo sapiens
ctgtgtctgcctgggatccatt

SEQ ID NO: 7847084 - DNA, 22 bp, Homo sapiens
ctgtgtctgtggaatagcgaat

SEQ ID NO: 7847085 - DNA, 22 bp, Homo sapiens
ctgtgtctgtggaatagcgaat

SEQ ID NO: 7847086 - DNA, 22 bp, Homo sapiens
ctgtgtcttcaatgtactggga

SEQ ID NO: 7847087 - DNA, 22 bp, Homo sapiens
ctgtgtcttcaatgtactggga

SEQ ID NO: 7847088 - DNA, 22 bp, Homo sapiens
ctgtgtcttcaatgtactggga

SEQ ID NO: 7847089 - DNA, 22 bp, Homo sapiens
ctgtgtcttcaatgtactggga

SEQ ID NO: 7847090 - DNA, 22 bp, Homo sapiens
ctgtgtcttcaatgtactggga

SEQ ID NO: 7847091 - DNA, 23 bp, Homo sapiens
ctgttaaattccttaagagcagg

SEQ ID NO: 7847092 - DNA, 22 bp, Homo sapiens
ctgttaagcaacatgagtaagt

SEQ ID NO: 7847093 - DNA, 22 bp, Homo sapiens
ctgttaagtgtagataatgtgg

SEQ ID NO: 7847094 - DNA, 23 bp, Homo sapiens
ctgttaaattccttaagagcagg

SEQ ID NO: 7847095 - DNA, 22 bp, Homo sapiens
ctgtgtcttctgcttacagtct

SEQ ID NO: 7847096 - DNA, 17 bp, Homo sapiens
ctgttaattcatttccc

SEQ ID NO: 7847097 - DNA, 17 bp, Homo sapiens
ctgttaattcatttccc

SEQ ID NO: 7847098 - DNA, 22 bp, Homo sapiens
ctgttaattctagatggtgagt

SEQ ID NO: 7847099 - DNA, 22 bp, Homo sapiens
ctgttacacggaccttcaaatc

SEQ ID NO: 7847100 - DNA, 22 bp, Homo sapiens
ctgttacacggaccttcaaatc

SEQ ID NO: 7847101 - DNA, 22 bp, Homo sapiens
ctgttacaagagagagacatga

SEQ ID NO: 7847102 - DNA, 22 bp, Homo sapiens
ctgttacaagagagagacatga

SEQ ID NO: 7847103 - DNA, 22 bp, Homo sapiens
ctgttacatagcttttcttaac

SEQ ID NO: 7847104 - DNA, 22 bp, Homo sapiens
ctgtgtctcgttaaagcattgg

SEQ ID NO: 7847105 - DNA, 22 bp, Homo sapiens
ctgtgtctcgttaaagcattgg

SEQ ID NO: 7847106 - DNA, 22 bp, Homo sapiens
ctgtgtctctacctccccatcc

SEQ ID NO: 7847107 - DNA, 22 bp, Homo sapiens
ctgtgtctctacctccccatcc

SEQ ID NO: 7847108 - DNA, 22 bp, Homo sapiens
ctgtgtctcgttaaagcattgg

SEQ ID NO: 7847109 - DNA, 22 bp, Homo sapiens
ctgtgtctccttggtgggatat

SEQ ID NO: 7847110 - DNA, 22 bp, Homo sapiens
ctgtgtctccttggtgggatat

SEQ ID NO: 7847111 - DNA, 22 bp, Homo sapiens
ctgtgtctccttggtgggatat

SEQ ID NO: 7847112 - DNA, 22 bp, Homo sapiens
ctgtgtctcatccgcctctggc

SEQ ID NO: 7847113 - DNA, 22 bp, Homo sapiens
ctgtgtctcatccgcctctggc

SEQ ID NO: 7847114 - DNA, 22 bp, Homo sapiens
ctgtgtctcccaaggagggtca

SEQ ID NO: 7847115 - DNA, 22 bp, Homo sapiens
ctgtgtctcatccgcctctggc

SEQ ID NO: 7847116 - DNA, 22 bp, Homo sapiens
ctgtgtctcatccgcctctggc

SEQ ID NO: 7847117 - DNA, 22 bp, Homo sapiens
ctgtgtctcatccgcctctggc

SEQ ID NO: 7847118 - DNA, 23 bp, Homo sapiens
ctgtgtctatgcagccatatcca

SEQ ID NO: 7847119 - DNA, 22 bp, Homo sapiens
ctgtgtctctccttacaagact

SEQ ID NO: 7847120 - DNA, 22 bp, Homo sapiens
ctgtgtctgaataactctgtgt

SEQ ID NO: 7847121 - DNA, 22 bp, Homo sapiens
ctgtgtctctccttacaagact

SEQ ID NO: 7847122 - DNA, 22 bp, Homo sapiens
ctgtgtctctacctccccatcc

SEQ ID NO: 7847123 - DNA, 22 bp, Homo sapiens
ctgtgtctctccttacaagact

SEQ ID NO: 7847124 - DNA, 22 bp, Homo sapiens
ctgtgtctctacctccccatcc

SEQ ID NO: 7847125 - DNA, 22 bp, Homo sapiens
ctgtgtctgcctgggatccatt

SEQ ID NO: 7847126 - DNA, 22 bp, Homo sapiens
ctgtgtctgcctgggatccatt

SEQ ID NO: 7847127 - DNA, 22 bp, Homo sapiens
ctgtgtctgcctgggatccatt

SEQ ID NO: 7847128 - DNA, 22 bp, Homo sapiens
ctgtgtctgcctgggatccatt

SEQ ID NO: 7847129 - DNA, 22 bp, Homo sapiens
ctgtgtctgcctgggatccatt

SEQ ID NO: 7847130 - DNA, 22 bp, Homo sapiens
ctgtgtctgaataactctgtgt

SEQ ID NO: 7847131 - DNA, 22 bp, Homo sapiens
ctgtgtctgaataactctgtgt

SEQ ID NO: 7847132 - DNA, 22 bp, Homo sapiens
ctgtgtctgaataactctgtgt

SEQ ID NO: 7847133 - DNA, 22 bp, Homo sapiens
ctgttctttagttccactgcaa

SEQ ID NO: 7847134 - DNA, 22 bp, Homo sapiens
ctgttctttagttccactgcaa

SEQ ID NO: 7847135 - DNA, 18 bp, Homo sapiens
ctgttgagatgtggctga

SEQ ID NO: 7847136 - DNA, 22 bp, Homo sapiens
ctgttcttctgggaatggccct

SEQ ID NO: 7847137 - DNA, 22 bp, Homo sapiens
ctgttcttctagtccactgaca

SEQ ID NO: 7847138 - DNA, 22 bp, Homo sapiens
ctgttcttctagtccactgaca

SEQ ID NO: 7847139 - DNA, 22 bp, Homo sapiens
ctgttcttctagtccactgaca

SEQ ID NO: 7847140 - DNA, 22 bp, Homo sapiens
ctgttctggagacactgatgaa

SEQ ID NO: 7847141 - DNA, 22 bp, Homo sapiens
ctgttctgctgcataaaaactt

SEQ ID NO: 7847142 - DNA, 22 bp, Homo sapiens
ctgttctggagacactgatgaa

SEQ ID NO: 7847143 - DNA, 22 bp, Homo sapiens
ctgttctgctgcataaaaactt

SEQ ID NO: 7847144 - DNA, 22 bp, Homo sapiens
ctgttctgaccagtgcagggat

SEQ ID NO: 7847145 - DNA, 22 bp, Homo sapiens
ctgttctgtctcatgttgcaca

SEQ ID NO: 7847146 - DNA, 22 bp, Homo sapiens
ctgttctgtaagctgctgttgt

SEQ ID NO: 7847147 - DNA, 22 bp, Homo sapiens
ctgttctgtaagctgctgttgt

SEQ ID NO: 7847148 - DNA, 18 bp, Homo sapiens
ctgttgagatgtggctga

SEQ ID NO: 7847149 - DNA, 22 bp, Homo sapiens
ctgttgagtaatttatatcagg

SEQ ID NO: 7847150 - DNA, 22 bp, Homo sapiens
ctgttgcagaggggcggagagg

SEQ ID NO: 7847151 - DNA, 22 bp, Homo sapiens
ctgttgcatcatggctcttaat

SEQ ID NO: 7847152 - DNA, 22 bp, Homo sapiens
ctgttgctaagtagtgcaggta

SEQ ID NO: 7847153 - DNA, 19 bp, Homo sapiens
ctgttgctggggctctctt

SEQ ID NO: 7847154 - DNA, 19 bp, Homo sapiens
ctgttgctggggctctctt

SEQ ID NO: 7847155 - DNA, 22 bp, Homo sapiens
ctgttgcttcaggaaacagtaa

SEQ ID NO: 7847156 - DNA, 22 bp, Homo sapiens
ctgttgctctgaacaggtcttg

SEQ ID NO: 7847157 - DNA, 22 bp, Homo sapiens
ctgttgctgggaacgcatgtca

SEQ ID NO: 7847158 - DNA, 22 bp, Homo sapiens
ctgttgctctgaacaggtcttg

SEQ ID NO: 7847159 - DNA, 22 bp, Homo sapiens
ctgttgctctgaacaggtcttg

SEQ ID NO: 7847160 - DNA, 22 bp, Homo sapiens
ctgttgctccagggaacacaga

SEQ ID NO: 7847161 - DNA, 22 bp, Homo sapiens
ctgttgctcccagggagagggt

SEQ ID NO: 7847162 - DNA, 22 bp, Homo sapiens
ctgttctatcattaaaagctat

SEQ ID NO: 7847163 - DNA, 22 bp, Homo sapiens
ctgttctccggccagtccagag

SEQ ID NO: 7847164 - DNA, 22 bp, Homo sapiens
ctgttctccggccagtccagag

SEQ ID NO: 7847165 - DNA, 20 bp, Homo sapiens
ctgttcctgtcccatgaagc

SEQ ID NO: 7847166 - DNA, 22 bp, Homo sapiens
ctgttcccggtggccgggccag

SEQ ID NO: 7847167 - DNA, 22 bp, Homo sapiens
ctgttctgaactgcctgcatgc

SEQ ID NO: 7847168 - DNA, 22 bp, Homo sapiens
ctgttctctggcggtggctgtt

SEQ ID NO: 7847169 - DNA, 22 bp, Homo sapiens
ctgttctctggcggtggctgtt

SEQ ID NO: 7847170 - DNA, 22 bp, Homo sapiens
ctgttctctggcggtggctgtt

SEQ ID NO: 7847171 - DNA, 22 bp, Homo sapiens
ctgttctgaccagtgcagggat

SEQ ID NO: 7847172 - DNA, 22 bp, Homo sapiens
ctgttctgaccagtgcagggat

SEQ ID NO: 7847173 - DNA, 22 bp, Homo sapiens
ctgttctgaccagtgcagggat

SEQ ID NO: 7847174 - DNA, 22 bp, Homo sapiens
ctgttctgaactgcctgcatgc

SEQ ID NO: 7847175 - DNA, 22 bp, Homo sapiens
ctgttcagtaacctataaaaca

SEQ ID NO: 7847176 - DNA, 18 bp, Homo sapiens
ctgttcagctgaactaca

SEQ ID NO: 7847177 - DNA, 18 bp, Homo sapiens
ctgttcagctgaactaca

SEQ ID NO: 7847178 - DNA, 22 bp, Homo sapiens
ctgttcagatggcacattcagt

SEQ ID NO: 7847179 - DNA, 22 bp, Homo sapiens
ctgttcatgttgaggcataggg

SEQ ID NO: 7847180 - DNA, 22 bp, Homo sapiens
ctgttccagatcaggacaccgt

SEQ ID NO: 7847181 - DNA, 22 bp, Homo sapiens
ctgttccagatcaggacaccgt

SEQ ID NO: 7847182 - DNA, 22 bp, Homo sapiens
ctgttcagtaacctataaaaca

SEQ ID NO: 7847183 - DNA, 22 bp, Homo sapiens
ctgttcatggaaaaatagttgg

SEQ ID NO: 7847184 - DNA, 22 bp, Homo sapiens
ctgttcatggaaaaatagttgg

SEQ ID NO: 7847185 - DNA, 22 bp, Homo sapiens
ctgttcagaaaaaatcttcatg

SEQ ID NO: 7847186 - DNA, 22 bp, Homo sapiens
ctgttcagaaaaaatcttcatg

SEQ ID NO: 7847187 - DNA, 22 bp, Homo sapiens
ctgttcagatggcacattcagt

SEQ ID NO: 7847188 - DNA, 21 bp, Homo sapiens
ctgttcactgtgctgtgcaaa

SEQ ID NO: 7847189 - DNA, 22 bp, Homo sapiens
ctgttcagaaaaaatcttcatg

SEQ ID NO: 7847190 - DNA, 21 bp, Homo sapiens
ctgttcactgtgctgtgcaaa

SEQ ID NO: 7847191 - DNA, 22 bp, Homo sapiens
ctgttcacacacttgtactctc

SEQ ID NO: 7847192 - DNA, 22 bp, Homo sapiens
ctgttcaatttgtttcagttat

SEQ ID NO: 7847193 - DNA, 22 bp, Homo sapiens
ctgttattttcctctgaactct

SEQ ID NO: 7847194 - DNA, 22 bp, Homo sapiens
cttgacactgtcactcaggcca

SEQ ID NO: 7847195 - DNA, 22 bp, Homo sapiens
cttgacactgtcactcaggcca

SEQ ID NO: 7847196 - DNA, 22 bp, Homo sapiens
cttcctgggtcagcctggaggt

SEQ ID NO: 7847197 - DNA, 22 bp, Homo sapiens
cttcctgggtcagcctggaggt

SEQ ID NO: 7847198 - DNA, 22 bp, Homo sapiens
cttgactcaggctatattctag

SEQ ID NO: 7847199 - DNA, 22 bp, Homo sapiens
cttgactcttgcttcccatgga

SEQ ID NO: 7847200 - DNA, 22 bp, Homo sapiens
cttgacagtcccaggaaaatag

SEQ ID NO: 7847201 - DNA, 22 bp, Homo sapiens
cttgaccctaccccccagaagg

SEQ ID NO: 7847202 - DNA, 22 bp, Homo sapiens
cttgacactgtcactcaggcca

SEQ ID NO: 7847203 - DNA, 22 bp, Homo sapiens
cttgacactgtcactcaggcca

SEQ ID NO: 7847204 - DNA, 22 bp, Homo sapiens
cttcctgggccctgcttaagca

SEQ ID NO: 7847205 - DNA, 22 bp, Homo sapiens
cttcctgggacacctaactcta

SEQ ID NO: 7847206 - DNA, 22 bp, Homo sapiens
cttcctggccattgccatggca

SEQ ID NO: 7847207 - DNA, 22 bp, Homo sapiens
cttcctggccattgccatggca

SEQ ID NO: 7847208 - DNA, 22 bp, Homo sapiens
cttcctggcatgggtctcatga

SEQ ID NO: 7847209 - DNA, 22 bp, Homo sapiens
cttcctggcatgggtctcatga

SEQ ID NO: 7847210 - DNA, 22 bp, Homo sapiens
cttcctggatgaagcccagcat

SEQ ID NO: 7847211 - DNA, 22 bp, Homo sapiens
cttcctggcaaagcaatcagag

SEQ ID NO: 7847212 - DNA, 22 bp, Homo sapiens
cttcctggatgagcaggctgat

SEQ ID NO: 7847213 - DNA, 19 bp, Homo sapiens
cttcctggaggagagcctc

SEQ ID NO: 7847214 - DNA, 19 bp, Homo sapiens
cttcctggaggagagcctc

SEQ ID NO: 7847215 - DNA, 22 bp, Homo sapiens
cttcctgctcccctgccaattc

SEQ ID NO: 7847216 - DNA, 22 bp, Homo sapiens
cttcctgctcccctgccaattc

SEQ ID NO: 7847217 - DNA, 22 bp, Homo sapiens
cttcctgaacaatgccatcaat

SEQ ID NO: 7847218 - DNA, 22 bp, Homo sapiens
cttcctgcccacttcctgctgg

SEQ ID NO: 7847219 - DNA, 22 bp, Homo sapiens
cttcctgcccacttcctgctgg

SEQ ID NO: 7847220 - DNA, 22 bp, Homo sapiens
cttcctgcattgtgccagagtt

SEQ ID NO: 7847221 - DNA, 22 bp, Homo sapiens
cttcctgcccacttcctgctgg

SEQ ID NO: 7847222 - DNA, 22 bp, Homo sapiens
cttcctgcaacacctgtgttgc

SEQ ID NO: 7847223 - DNA, 22 bp, Homo sapiens
cttcctgcaggacagccatctg

SEQ ID NO: 7847224 - DNA, 22 bp, Homo sapiens
cttcctgcaggacagccatctg

SEQ ID NO: 7847225 - DNA, 22 bp, Homo sapiens
cttcctgcaggacagccatctg

SEQ ID NO: 7847226 - DNA, 22 bp, Homo sapiens
cttgatggtggcagaagagtga

SEQ ID NO: 7847227 - DNA, 22 bp, Homo sapiens
cttgatgtataagttgatatgt

SEQ ID NO: 7847228 - DNA, 22 bp, Homo sapiens
cttgatttattacccactatat

SEQ ID NO: 7847229 - DNA, 22 bp, Homo sapiens
cttgattgcttctacgtgactg

SEQ ID NO: 7847230 - DNA, 22 bp, Homo sapiens
cttgatgtataagttgatatgt

SEQ ID NO: 7847231 - DNA, 22 bp, Homo sapiens
cttgcacaaagtcacctagtca

SEQ ID NO: 7847232 - DNA, 22 bp, Homo sapiens
cttgcaaacactcaaagccatc

SEQ ID NO: 7847233 - DNA, 22 bp, Homo sapiens
cttgcaaagtagctgagaggtt

SEQ ID NO: 7847234 - DNA, 22 bp, Homo sapiens
cttgcacacgtgtatgtacatg

SEQ ID NO: 7847235 - DNA, 22 bp, Homo sapiens
cttgcacagtgactaacacgta

SEQ ID NO: 7847236 - DNA, 22 bp, Homo sapiens
cttgcacagaactcttagaggt

SEQ ID NO: 7847237 - DNA, 20 bp, Homo sapiens
cttgatgagataaacagcag

SEQ ID NO: 7847238 - DNA, 20 bp, Homo sapiens
cttgatgagataaacagcag

SEQ ID NO: 7847239 - DNA, 22 bp, Homo sapiens
cttgatgagcctagtgcttaga

SEQ ID NO: 7847240 - DNA, 22 bp, Homo sapiens
cttgatgaggtatgaacctctc

SEQ ID NO: 7847241 - DNA, 22 bp, Homo sapiens
cttgatgatagaatgtgaggag

SEQ ID NO: 7847242 - DNA, 22 bp, Homo sapiens
cttgatgagtcagaactgaagg

SEQ ID NO: 7847243 - DNA, 22 bp, Homo sapiens
cttgatgatttgcagagggagt

SEQ ID NO: 7847244 - DNA, 22 bp, Homo sapiens
cttgatgatgacgtcggtgatg

SEQ ID NO: 7847245 - DNA, 22 bp, Homo sapiens
cttgatgatagcaggcagggaa

SEQ ID NO: 7847246 - DNA, 22 bp, Homo sapiens
cttgatggggtgatccagcacc

SEQ ID NO: 7847247 - DNA, 22 bp, Homo sapiens
cttgatggaggggccaggcttt

SEQ ID NO: 7847248 - DNA, 22 bp, Homo sapiens
cttgactttgccttttaaatgt

SEQ ID NO: 7847249 - DNA, 22 bp, Homo sapiens
cttgatctacatagtgaaaccc

SEQ ID NO: 7847250 - DNA, 22 bp, Homo sapiens
cttgatctacatagtgaaaccc

SEQ ID NO: 7847251 - DNA, 19 bp, Homo sapiens
cttgatcttggacttccag

SEQ ID NO: 7847252 - DNA, 22 bp, Homo sapiens
cttgatgactcaggaggaggag

SEQ ID NO: 7847253 - DNA, 22 bp, Homo sapiens
cttgatgaatgacctgggtggt

SEQ ID NO: 7847254 - DNA, 22 bp, Homo sapiens
cttgatgaaatttttcaattgt

SEQ ID NO: 7847255 - DNA, 22 bp, Homo sapiens
cttgatctacatagtgaaaccc

SEQ ID NO: 7847256 - DNA, 22 bp, Homo sapiens
cttgcaggattttgctgctgta

SEQ ID NO: 7847257 - DNA, 22 bp, Homo sapiens
cttgcaggattttgctgctgta

SEQ ID NO: 7847258 - DNA, 20 bp, Homo sapiens
cttgcaggagtgggtagagt

SEQ ID NO: 7847259 - DNA, 22 bp, Homo sapiens
cttgcagccttaccaaggcatt

SEQ ID NO: 7847260 - DNA, 23 bp, Homo sapiens
cttgcaggaagcagatggcacac

SEQ ID NO: 7847261 - DNA, 23 bp, Homo sapiens
cttgcaggaagcagatggcacac

SEQ ID NO: 7847262 - DNA, 23 bp, Homo sapiens
cttgcaggaagcagatggcacac

SEQ ID NO: 7847263 - DNA, 22 bp, Homo sapiens
cttgcagaggctgttccagatg

SEQ ID NO: 7847264 - DNA, 22 bp, Homo sapiens
cttgcacgtcagatcttcctca

SEQ ID NO: 7847265 - DNA, 22 bp, Homo sapiens
cttgcagatgtgactaaattaa

SEQ ID NO: 7847266 - DNA, 22 bp, Homo sapiens
cttgcagatgtgactaaattaa

SEQ ID NO: 7847267 - DNA, 22 bp, Homo sapiens
cttgcacagtgactaacacgta

SEQ ID NO: 7847268 - DNA, 22 bp, Homo sapiens
cttgcacatggctgctttctcg

SEQ ID NO: 7847269 - DNA, 22 bp, Homo sapiens
cttgcacatttcacacaatagg

SEQ ID NO: 7847270 - DNA, 22 bp, Homo sapiens
cttgcaggattttgctgctgta

SEQ ID NO: 7847271 - DNA, 22 bp, Homo sapiens
cttgcaggcagggacactgtct

SEQ ID NO: 7847272 - DNA, 22 bp, Homo sapiens
cttgcaggcagggacactgtct

SEQ ID NO: 7847273 - DNA, 22 bp, Homo sapiens
cttgcaggcagggcctcctgga

SEQ ID NO: 7847274 - DNA, 22 bp, Homo sapiens
cttgcaggcagggcctcctgga

SEQ ID NO: 7847275 - DNA, 22 bp, Homo sapiens
cttgcaggcagggcctcctgga

SEQ ID NO: 7847276 - DNA, 22 bp, Homo sapiens
cttgcaggcagggcctcctgga

SEQ ID NO: 7847277 - DNA, 22 bp, Homo sapiens
cttgcaggcccagccttacaag

SEQ ID NO: 7847278 - DNA, 22 bp, Homo sapiens
cttgcaggctacatggaacctg

SEQ ID NO: 7847279 - DNA, 22 bp, Homo sapiens
cttgcagggctgatgggaagtg

SEQ ID NO: 7847280 - DNA, 22 bp, Homo sapiens
cttgcaggcctttctagctcta

SEQ ID NO: 7847281 - DNA, 22 bp, Homo sapiens
cttgcaggcctttctagctcta

SEQ ID NO: 7847282 - DNA, 23 bp, Homo sapiens
cttgcagggctggaggcttagaa

SEQ ID NO: 7847283 - DNA, 23 bp, Homo sapiens
cttgcagggctggaggcttagaa

SEQ ID NO: 7847284 - DNA, 22 bp, Homo sapiens
cttgcagtgtggccttgaagag

SEQ ID NO: 7847285 - DNA, 22 bp, Homo sapiens
cttgcagggctgatgggaagtg

SEQ ID NO: 7847286 - DNA, 22 bp, Homo sapiens
cttgtcctttacttgagactca

SEQ ID NO: 7847287 - DNA, 22 bp, Homo sapiens
cttgtcctttacttgagactca

SEQ ID NO: 7847288 - DNA, 23 bp, Homo sapiens
cttgtctaattcatggtgaaggc

SEQ ID NO: 7847289 - DNA, 22 bp, Homo sapiens
cttgtctgataatggggccaac

SEQ ID NO: 7847290 - DNA, 22 bp, Homo sapiens
cttgtctgggcagcttgggagt

SEQ ID NO: 7847291 - DNA, 22 bp, Homo sapiens
cttgtctgggcagcttgggagt

SEQ ID NO: 7847292 - DNA, 22 bp, Homo sapiens
cttgtctgctataaaaatccag

SEQ ID NO: 7847293 - DNA, 22 bp, Homo sapiens
cttgtctgataatggggccaac

SEQ ID NO: 7847294 - DNA, 21 bp, Homo sapiens
cttgtctgcagtgtttatagc

SEQ ID NO: 7847295 - DNA, 22 bp, Homo sapiens
cttgtcctttacttgagactca

SEQ ID NO: 7847296 - DNA, 22 bp, Homo sapiens
cttgtccccagcaggttggttt

SEQ ID NO: 7847297 - DNA, 22 bp, Homo sapiens
cttgtcagtgtactttcttttg

SEQ ID NO: 7847298 - DNA, 22 bp, Homo sapiens
cttgtcagccaattgtggattt

SEQ ID NO: 7847299 - DNA, 22 bp, Homo sapiens
cttgtcagccaattgtggattt

SEQ ID NO: 7847300 - DNA, 22 bp, Homo sapiens
cttgtcagtcaaggtgtgcagg

SEQ ID NO: 7847301 - DNA, 22 bp, Homo sapiens
ctttatggtaagtatagatgac

SEQ ID NO: 7847302 - DNA, 22 bp, Homo sapiens
ctttatggtaagtatagatgac

SEQ ID NO: 7847303 - DNA, 22 bp, Homo sapiens
ctttatgtactgtgtatttgaa

SEQ ID NO: 7847304 - DNA, 22 bp, Homo sapiens
ctttatggaatcaaagactgga

SEQ ID NO: 7847305 - DNA, 22 bp, Homo sapiens
cttgtctttatttcatattcca

SEQ ID NO: 7847306 - DNA, 22 bp, Homo sapiens
ctttatggaatcaaagactgga

SEQ ID NO: 7847307 - DNA, 22 bp, Homo sapiens
ctttatgtccttgaagagttgt

SEQ ID NO: 7847308 - DNA, 22 bp, Homo sapiens
ctttatgtccttgaagagttgt

SEQ ID NO: 7847309 - DNA, 22 bp, Homo sapiens
ctttatgtccaccagactgcaa

SEQ ID NO: 7847310 - DNA, 22 bp, Homo sapiens
ctttatgtccaccagactgcaa

SEQ ID NO: 7847311 - DNA, 22 bp, Homo sapiens
ctttatgtccaccagactgcaa

SEQ ID NO: 7847312 - DNA, 22 bp, Homo sapiens
cttgtcttgcacacggttgcca

SEQ ID NO: 7847313 - DNA, 21 bp, Homo sapiens
cttgtcttgcttagaatagac

SEQ ID NO: 7847314 - DNA, 22 bp, Homo sapiens
cttgtctttatttcatattcca

SEQ ID NO: 7847315 - DNA, 22 bp, Homo sapiens
cttgtctttatttcatattcca

SEQ ID NO: 7847316 - DNA, 22 bp, Homo sapiens
cttgtcttgcacacggttgcca

SEQ ID NO: 7847317 - DNA, 22 bp, Homo sapiens
cttgtcttgcacacggttgcca

SEQ ID NO: 7847318 - DNA, 16 bp, Homo sapiens
cttgtctgttgctcat

SEQ ID NO: 7847319 - DNA, 22 bp, Homo sapiens
cttgtctgtgtcggataaaact

SEQ ID NO: 7847320 - DNA, 22 bp, Homo sapiens
cttgtattcttgtacctttcaa

SEQ ID NO: 7847321 - DNA, 22 bp, Homo sapiens
cttgtattctgcctaaccttca

SEQ ID NO: 7847322 - DNA, 22 bp, Homo sapiens
cttgtattctgcctaaccttca

SEQ ID NO: 7847323 - DNA, 22 bp, Homo sapiens
cttgtcactctggctccagagc

SEQ ID NO: 7847324 - DNA, 22 bp, Homo sapiens
cttgtcagccaattgtggattt

SEQ ID NO: 7847325 - DNA, 22 bp, Homo sapiens
cttgtcagcactttgccgaaaa

SEQ ID NO: 7847326 - DNA, 22 bp, Homo sapiens
cttgtcactctggctccagagc

SEQ ID NO: 7847327 - DNA, 22 bp, Homo sapiens
cttgtcaagtcactttaacctc

SEQ ID NO: 7847328 - DNA, 22 bp, Homo sapiens
cttgtcagccaattgtggattt

SEQ ID NO: 7847329 - DNA, 22 bp, Homo sapiens
cttgtcagccaattgtggattt

SEQ ID NO: 7847330 - DNA, 22 bp, Homo sapiens
cttgtcagccaattgtggattt

SEQ ID NO: 7847331 - DNA, 22 bp, Homo sapiens
cttgtcagccaattgtggattt

SEQ ID NO: 7847332 - DNA, 22 bp, Homo sapiens
cttgtcagccaattgtggattt

SEQ ID NO: 7847333 - DNA, 22 bp, Homo sapiens
cttgtcagccaattgtggattt

SEQ ID NO: 7847334 - DNA, 23 bp, Homo sapiens
cttgtattcactcatttgggaac

SEQ ID NO: 7847335 - DNA, 22 bp, Homo sapiens
cttgtatagggaaagataaatc

SEQ ID NO: 7847336 - DNA, 22 bp, Homo sapiens
cttgtattaggaagaatgcttt

SEQ ID NO: 7847337 - DNA, 22 bp, Homo sapiens
cttgtattaggaagaatgcttt

SEQ ID NO: 7847338 - DNA, 22 bp, Homo sapiens
cttgccagcacttggccagctg

SEQ ID NO: 7847339 - DNA, 22 bp, Homo sapiens
cttgccagcacttggccagctg

SEQ ID NO: 7847340 - DNA, 22 bp, Homo sapiens
cttgccaatggtacaaacgatt

SEQ ID NO: 7847341 - DNA, 22 bp, Homo sapiens
cttgccaaattaacatacagaa

SEQ ID NO: 7847342 - DNA, 22 bp, Homo sapiens
cttgcagtttaggtcctctgtg

SEQ ID NO: 7847343 - DNA, 22 bp, Homo sapiens
cttgcagtttaggtcctctgtg

SEQ ID NO: 7847344 - DNA, 20 bp, Homo sapiens
cttgcagtttcaccttcact

SEQ ID NO: 7847345 - DNA, 21 bp, Homo sapiens
cttgccaggccaggtgtcctc

SEQ ID NO: 7847346 - DNA, 22 bp, Homo sapiens
cttgccaggatcagagtcacag

SEQ ID NO: 7847347 - DNA, 22 bp, Homo sapiens
cttgccaggatcagagtcacag

SEQ ID NO: 7847348 - DNA, 22 bp, Homo sapiens
cttgccagcatttatagggatt

SEQ ID NO: 7847349 - DNA, 22 bp, Homo sapiens
cttgccagcacttggccagctg

SEQ ID NO: 7847350 - DNA, 22 bp, Homo sapiens
cttgccagggactcagtcaggg

SEQ ID NO: 7847351 - DNA, 22 bp, Homo sapiens
cttgccagggactcagtcaggg

SEQ ID NO: 7847352 - DNA, 22 bp, Homo sapiens
cttgccagtgttgcagaagctc

SEQ ID NO: 7847353 - DNA, 22 bp, Homo sapiens
cttgccagtgttgcagaagctc

SEQ ID NO: 7847354 - DNA, 22 bp, Homo sapiens
cttgccagtgttgcagaagctc

SEQ ID NO: 7847355 - DNA, 22 bp, Homo sapiens
cttgccagtgttgcagaagctc

SEQ ID NO: 7847356 - DNA, 20 bp, Homo sapiens
cttgccagttccctggcaga

SEQ ID NO: 7847357 - DNA, 22 bp, Homo sapiens
cttgccatctaaccagactgcc

SEQ ID NO: 7847358 - DNA, 20 bp, Homo sapiens
cttgccagttccctggcaga

SEQ ID NO: 7847359 - DNA, 20 bp, Homo sapiens
cttgcccagggtctcctgcc

SEQ ID NO: 7847360 - DNA, 20 bp, Homo sapiens
cttgcccagggtctcctgcc

SEQ ID NO: 7847361 - DNA, 20 bp, Homo sapiens
cttgcccagggtctcctgcc

SEQ ID NO: 7847362 - DNA, 22 bp, Homo sapiens
cttgcccaccagtcagtggctt

SEQ ID NO: 7847363 - DNA, 20 bp, Homo sapiens
cttgcccagggtctcctgcc

SEQ ID NO: 7847364 - DNA, 22 bp, Homo sapiens
cttgggtgctcagggaaagctt

SEQ ID NO: 7847365 - DNA, 22 bp, Homo sapiens
cttgggtgctggaggctgccgc

SEQ ID NO: 7847366 - DNA, 22 bp, Homo sapiens
cttgggtataaaacttggctat

SEQ ID NO: 7847367 - DNA, 22 bp, Homo sapiens
cttgggggccattaaggggcct

SEQ ID NO: 7847368 - DNA, 22 bp, Homo sapiens
cttgcctacttgtcaaccagca

SEQ ID NO: 7847369 - DNA, 22 bp, Homo sapiens
cttgggtgctggaggctgccgc

SEQ ID NO: 7847370 - DNA, 22 bp, Homo sapiens
cttgggtgctggaggctgccgc

SEQ ID NO: 7847371 - DNA, 22 bp, Homo sapiens
cttgggtgtgaccttggcattg

SEQ ID NO: 7847372 - DNA, 22 bp, Homo sapiens
cttgtacactcagtacttctag

SEQ ID NO: 7847373 - DNA, 22 bp, Homo sapiens
cttgtacaggatattataggct

SEQ ID NO: 7847374 - DNA, 22 bp, Homo sapiens
cttgtacaggatattataggct

SEQ ID NO: 7847375 - DNA, 22 bp, Homo sapiens
cttgtacaggaatccatggtat

SEQ ID NO: 7847376 - DNA, 22 bp, Homo sapiens
cttgtacaggaatccatggtat

SEQ ID NO: 7847377 - DNA, 22 bp, Homo sapiens
cttgtacagatcttgcaaggac

SEQ ID NO: 7847378 - DNA, 20 bp, Homo sapiens
cttgtacatgataaagattt

SEQ ID NO: 7847379 - DNA, 20 bp, Homo sapiens
cttgtacatgataaagattt

SEQ ID NO: 7847380 - DNA, 20 bp, Homo sapiens
cttgtacatgataaagattt

SEQ ID NO: 7847381 - DNA, 20 bp, Homo sapiens
cttgtacatgataaagattt

SEQ ID NO: 7847382 - DNA, 22 bp, Homo sapiens
cttgtacatcactggcagatgg

SEQ ID NO: 7847383 - DNA, 22 bp, Homo sapiens
cttgtacatcactggcagatgg

SEQ ID NO: 7847384 - DNA, 20 bp, Homo sapiens
cttgtacatgataaagattt

SEQ ID NO: 7847385 - DNA, 20 bp, Homo sapiens
cttgtacatgataaagattt

SEQ ID NO: 7847386 - DNA, 22 bp, Homo sapiens
cttgtacatagagaagaagcct

SEQ ID NO: 7847387 - DNA, 22 bp, Homo sapiens
cttgtacatagagaagaagcct

SEQ ID NO: 7847388 - DNA, 22 bp, Homo sapiens
cttgtacaggtctgttgtgggc

SEQ ID NO: 7847389 - DNA, 22 bp, Homo sapiens
cttgtacaggatattataggct

SEQ ID NO: 7847390 - DNA, 22 bp, Homo sapiens
cttgtacagggaggcctgtggt

SEQ ID NO: 7847391 - DNA, 22 bp, Homo sapiens
cttgtagacccctggactcacg

SEQ ID NO: 7847392 - DNA, 22 bp, Homo sapiens
cttgtagacccctggactcacg

SEQ ID NO: 7847393 - DNA, 22 bp, Homo sapiens
cttgtagctgcttcttctgaag

SEQ ID NO: 7847394 - DNA, 22 bp, Homo sapiens
cttgtagaattgaaatggtctc

SEQ ID NO: 7847395 - DNA, 22 bp, Homo sapiens
cttgtagaattgaaatggtctc

SEQ ID NO: 7847396 - DNA, 22 bp, Homo sapiens
cttgtagacccctggactcacg

SEQ ID NO: 7847397 - DNA, 22 bp, Homo sapiens
cttgtagacccctggactcacg

SEQ ID NO: 7847398 - DNA, 22 bp, Homo sapiens
cttgtacatgataatctcactc

SEQ ID NO: 7847399 - DNA, 22 bp, Homo sapiens
cttgtacatgataatctcactc

SEQ ID NO: 7847400 - DNA, 22 bp, Homo sapiens
cttgtacattgatttctgcatt

SEQ ID NO: 7847401 - DNA, 22 bp, Homo sapiens
cttgtacattgatttctgcatt

SEQ ID NO: 7847402 - DNA, 22 bp, Homo sapiens
cttgtagaattgaaatggtctc

SEQ ID NO: 7847403 - DNA, 22 bp, Homo sapiens
cttgtagaattgaaatggtctc

SEQ ID NO: 7847404 - DNA, 22 bp, Homo sapiens
cttatttgcccatgtttcttta

SEQ ID NO: 7847405 - DNA, 22 bp, Homo sapiens
cttatttgcccatgtttcttta

SEQ ID NO: 7847406 - DNA, 22 bp, Homo sapiens
cttattttaagtcagtttgggt

SEQ ID NO: 7847407 - DNA, 22 bp, Homo sapiens
cttattttaagtcagtttgggt

SEQ ID NO: 7847408 - DNA, 22 bp, Homo sapiens
cttattttaagtcagtttgggt

SEQ ID NO: 7847409 - DNA, 22 bp, Homo sapiens
cttattttaagtcagtttgggt

SEQ ID NO: 7847410 - DNA, 22 bp, Homo sapiens
cttatttgtactaataaatctg

SEQ ID NO: 7847411 - DNA, 22 bp, Homo sapiens
cttatttgtactaataaatctg

SEQ ID NO: 7847412 - DNA, 22 bp, Homo sapiens
cttattttaagtcagtttgggt

SEQ ID NO: 7847413 - DNA, 22 bp, Homo sapiens
cttattttaagtcagtttgggt

SEQ ID NO: 7847414 - DNA, 22 bp, Homo sapiens
cttattttgctgatgacccagg

SEQ ID NO: 7847415 - DNA, 22 bp, Homo sapiens
cttattttgctgatgacccagg

SEQ ID NO: 7847416 - DNA, 22 bp, Homo sapiens
cttattttaagtcagtttgggt

SEQ ID NO: 7847417 - DNA, 22 bp, Homo sapiens
cttatttatgtctgtctctaat

SEQ ID NO: 7847418 - DNA, 22 bp, Homo sapiens
cttatttcagccctgggcaccc

SEQ ID NO: 7847419 - DNA, 22 bp, Homo sapiens
cttatttctccatccagagtca

SEQ ID NO: 7847420 - DNA, 22 bp, Homo sapiens
cttatttgaatgtatgagtttt

SEQ ID NO: 7847421 - DNA, 22 bp, Homo sapiens
cttatttgagagaaaagaaact

SEQ ID NO: 7847422 - DNA, 22 bp, Homo sapiens
cttattttgctgatgacccagg

SEQ ID NO: 7847423 - DNA, 22 bp, Homo sapiens
cttattttgctgatgacccagg

SEQ ID NO: 7847424 - DNA, 22 bp, Homo sapiens
cttattttgctgatgacccagg

SEQ ID NO: 7847425 - DNA, 22 bp, Homo sapiens
cttattttgctgatgacccagg

SEQ ID NO: 7847426 - DNA, 22 bp, Homo sapiens
cttattttgctgatgacccagg

SEQ ID NO: 7847427 - DNA, 22 bp, Homo sapiens
cttcaaaagccagaagcctgcg

SEQ ID NO: 7847428 - DNA, 22 bp, Homo sapiens
cttcaaaagccagaagcctgcg

SEQ ID NO: 7847429 - DNA, 22 bp, Homo sapiens
cttcaaacactagaaacacagg

SEQ ID NO: 7847430 - DNA, 22 bp, Homo sapiens
cttcaaacccagattaaatgca

SEQ ID NO: 7847431 - DNA, 22 bp, Homo sapiens
cttcaaagattattgaaaacaa

SEQ ID NO: 7847432 - DNA, 22 bp, Homo sapiens
cttcagaactataaaaagtact

SEQ ID NO: 7847433 - DNA, 22 bp, Homo sapiens
cttcagaaccagccagaagagg

SEQ ID NO: 7847434 - DNA, 22 bp, Homo sapiens
cttcagaaccagccagaagagg

SEQ ID NO: 7847435 - DNA, 22 bp, Homo sapiens
cttcagaaccagccagaagagg

SEQ ID NO: 7847436 - DNA, 22 bp, Homo sapiens
cttcagaagaaaagcagtgtgt

SEQ ID NO: 7847437 - DNA, 22 bp, Homo sapiens
cttcagaagaaaagcagtgtgt

SEQ ID NO: 7847438 - DNA, 22 bp, Homo sapiens
cttcagaactataaaaagtact

SEQ ID NO: 7847439 - DNA, 22 bp, Homo sapiens
cttcagcccagcctccgcctcc

SEQ ID NO: 7847440 - DNA, 22 bp, Homo sapiens
cttcagccctgagtgccagcag

SEQ ID NO: 7847441 - DNA, 22 bp, Homo sapiens
cttcagccagctggggatgcgg

SEQ ID NO: 7847442 - DNA, 22 bp, Homo sapiens
cttcagccagctggggatgcgg

SEQ ID NO: 7847443 - DNA, 22 bp, Homo sapiens
cttcagaagaaaagcagtgtgt

SEQ ID NO: 7847444 - DNA, 22 bp, Homo sapiens
cttcagaagagttaagtgtgag

SEQ ID NO: 7847445 - DNA, 22 bp, Homo sapiens
cttcagaagcctgcagcctttg

SEQ ID NO: 7847446 - DNA, 22 bp, Homo sapiens
cttcagaagagttaagtgtgag

SEQ ID NO: 7847447 - DNA, 22 bp, Homo sapiens
cttatatttgtcaactttacaa

SEQ ID NO: 7847448 - DNA, 22 bp, Homo sapiens
ctgtttaaccagatctcatatc

SEQ ID NO: 7847449 - DNA, 22 bp, Homo sapiens
cttatattttaggaacagacaa

SEQ ID NO: 7847450 - DNA, 22 bp, Homo sapiens
cttatattttaggaacagacaa

SEQ ID NO: 7847451 - DNA, 22 bp, Homo sapiens
cttatattttaggaacagacaa

SEQ ID NO: 7847452 - DNA, 22 bp, Homo sapiens
cttatattttaggaacagacaa

SEQ ID NO: 7847453 - DNA, 22 bp, Homo sapiens
cttatattttaggaacagacaa

SEQ ID NO: 7847454 - DNA, 22 bp, Homo sapiens
cttatatttgtcaactttacaa

SEQ ID NO: 7847455 - DNA, 22 bp, Homo sapiens
cttatattttaggaacagacaa

SEQ ID NO: 7847456 - DNA, 22 bp, Homo sapiens
cttatattttaggaacagacaa

SEQ ID NO: 7847457 - DNA, 22 bp, Homo sapiens
cttatattttaggaacagacaa

SEQ ID NO: 7847458 - DNA, 22 bp, Homo sapiens
cttatcagattatctgggctgt

SEQ ID NO: 7847459 - DNA, 22 bp, Homo sapiens
cttatcagattatctgggctgt

SEQ ID NO: 7847460 - DNA, 22 bp, Homo sapiens
cttatcagattatctgggctgt

SEQ ID NO: 7847461 - DNA, 22 bp, Homo sapiens
cttatcagattatctgggctgt

SEQ ID NO: 7847462 - DNA, 22 bp, Homo sapiens
cttatcatatcatacatggcta

SEQ ID NO: 7847463 - DNA, 22 bp, Homo sapiens
cttatctcatttaatcatcaca

SEQ ID NO: 7847464 - DNA, 23 bp, Homo sapiens
cttattcattcatgtagcccatt

SEQ ID NO: 7847465 - DNA, 22 bp, Homo sapiens
ctgttgtctatataagtttttc

SEQ ID NO: 7847466 - DNA, 22 bp, Homo sapiens
ctgttgtctcctctcagattat

SEQ ID NO: 7847467 - DNA, 22 bp, Homo sapiens
ctgttgttcatcatctgtcatt

SEQ ID NO: 7847468 - DNA, 22 bp, Homo sapiens
ctgttgtatcatttgttcacat

SEQ ID NO: 7847469 - DNA, 22 bp, Homo sapiens
ctgttgtatttccaactatgta

SEQ ID NO: 7847470 - DNA, 22 bp, Homo sapiens
ctgttgtccctgggagctcagc

SEQ ID NO: 7847471 - DNA, 22 bp, Homo sapiens
ctgttgcttcaggaaacagtaa

SEQ ID NO: 7847472 - DNA, 22 bp, Homo sapiens
ctgttgcttcaggaaacagtaa

SEQ ID NO: 7847473 - DNA, 22 bp, Homo sapiens
ctgttggcctggtgatgaagct

SEQ ID NO: 7847474 - DNA, 22 bp, Homo sapiens
ctgttggcttcagtgcagagaa

SEQ ID NO: 7847475 - DNA, 23 bp, Homo sapiens
ctgttggctgtcagggctggact

SEQ ID NO: 7847476 - DNA, 22 bp, Homo sapiens
ctgttggcttcagtgcagagaa

SEQ ID NO: 7847477 - DNA, 22 bp, Homo sapiens
ctgttgtaaagctattcatttg

SEQ ID NO: 7847478 - DNA, 22 bp, Homo sapiens
ctgttgtaaagctattcatttg

SEQ ID NO: 7847479 - DNA, 22 bp, Homo sapiens
cttattgggatgagaggatgca

SEQ ID NO: 7847480 - DNA, 22 bp, Homo sapiens
cttattggtcccaggaggagaa

SEQ ID NO: 7847481 - DNA, 22 bp, Homo sapiens
cttattggtgctttttctcata

SEQ ID NO: 7847482 - DNA, 22 bp, Homo sapiens
cttattggtcccaggaggagaa

SEQ ID NO: 7847483 - DNA, 22 bp, Homo sapiens
cttattggtggagtcaggccct

SEQ ID NO: 7847484 - DNA, 22 bp, Homo sapiens
cttattggtggagtcaggccct

SEQ ID NO: 7847485 - DNA, 22 bp, Homo sapiens
cttattgtcctgactcatggcc

SEQ ID NO: 7847486 - DNA, 22 bp, Homo sapiens
cttattgtcctgactcatggcc

SEQ ID NO: 7847487 - DNA, 22 bp, Homo sapiens
cttattggtgctttttctcata

SEQ ID NO: 7847488 - DNA, 22 bp, Homo sapiens
cttattggagagttgggccctt

SEQ ID NO: 7847489 - DNA, 22 bp, Homo sapiens
cttattgggatgagaggatgca

SEQ ID NO: 7847490 - DNA, 22 bp, Homo sapiens
cttattggagagttgggccctt

SEQ ID NO: 7847491 - DNA, 22 bp, Homo sapiens
cttattgaaagcccctgtgcct

SEQ ID NO: 7847492 - DNA, 22 bp, Homo sapiens
cttattctactccacaagctct

SEQ ID NO: 7847493 - DNA, 22 bp, Homo sapiens
cttattcttgtcttattgtgct

SEQ ID NO: 7847494 - DNA, 22 bp, Homo sapiens
cttatttaatgagggttagaat

SEQ ID NO: 7847495 - DNA, 22 bp, Homo sapiens
cttatttaatgagggttagaat

SEQ ID NO: 7847496 - DNA, 22 bp, Homo sapiens
cttatttactgatccacagatg

SEQ ID NO: 7847497 - DNA, 22 bp, Homo sapiens
cttatttaatgagggttagaat

SEQ ID NO: 7847498 - DNA, 22 bp, Homo sapiens
cttattgttcagatagagatga

SEQ ID NO: 7847499 - DNA, 22 bp, Homo sapiens
cttattgttcagatagagatga

SEQ ID NO: 7847500 - DNA, 22 bp, Homo sapiens
cttattgttcagatagagatga

SEQ ID NO: 7847501 - DNA, 22 bp, Homo sapiens
cttattgtgtgtattttctagt

SEQ ID NO: 7847502 - DNA, 22 bp, Homo sapiens
cttattgtgtgtattttctagt

SEQ ID NO: 7847503 - DNA, 22 bp, Homo sapiens
cttattgttcagatagagatga

SEQ ID NO: 7847504 - DNA, 22 bp, Homo sapiens
cttattgttcctggaccctgag

SEQ ID NO: 7847505 - DNA, 22 bp, Homo sapiens
cttattgttcctggaccctgag

SEQ ID NO: 7847506 - DNA, 22 bp, Homo sapiens
cttattgttcctggaccctgag

SEQ ID NO: 7847507 - DNA, 18 bp, Homo sapiens
cttattgtttaaatggcc

SEQ ID NO: 7847508 - DNA, 18 bp, Homo sapiens
cttattgtttaaatggcc

SEQ ID NO: 7847509 - DNA, 18 bp, Homo sapiens
cttattgtttaaatggcc

SEQ ID NO: 7847510 - DNA, 22 bp, Homo sapiens
cttattgtgtctttgaataagt

SEQ ID NO: 7847511 - DNA, 22 bp, Homo sapiens
cttattgtgtctttgaataagt

SEQ ID NO: 7847512 - DNA, 22 bp, Homo sapiens
cttattgtgtctttgaataagt

SEQ ID NO: 7847513 - DNA, 22 bp, Homo sapiens
cttattgtgtgtattttctagt

SEQ ID NO: 7847514 - DNA, 22 bp, Homo sapiens
cttattgtgataccatgcagta

SEQ ID NO: 7847515 - DNA, 22 bp, Homo sapiens
cttattgtgaggtattgagatt

SEQ ID NO: 7847516 - DNA, 22 bp, Homo sapiens
cttattgtgaggtattgagatt

SEQ ID NO: 7847517 - DNA, 22 bp, Homo sapiens
cttattgtgataccatgcagta

SEQ ID NO: 7847518 - DNA, 22 bp, Homo sapiens
cttattgtgataccatgcagta

SEQ ID NO: 7847519 - DNA, 22 bp, Homo sapiens
cttattgtgattcctgcctctt

SEQ ID NO: 7847520 - DNA, 22 bp, Homo sapiens
cttattgtgtctttgaataagt

SEQ ID NO: 7847521 - DNA, 22 bp, Homo sapiens
cttattgtgattcctgcctctt

SEQ ID NO: 7847522 - DNA, 22 bp, Homo sapiens
cttattgtgattcctgcctctt

SEQ ID NO: 7847523 - DNA, 22 bp, Homo sapiens
cttattgtgagatgcgataatt

SEQ ID NO: 7847524 - DNA, 22 bp, Homo sapiens
cttattgtgagatgcgataatt

SEQ ID NO: 7847525 - DNA, 22 bp, Homo sapiens
cttattgtgagatgcgataatt

SEQ ID NO: 7847526 - DNA, 22 bp, Homo sapiens
cttattgtgaggtattgagatt

SEQ ID NO: 7847527 - DNA, 22 bp, Homo sapiens
cttattgtcttacagtaataga

SEQ ID NO: 7847528 - DNA, 22 bp, Homo sapiens
cttattgtcttacagtaataga

SEQ ID NO: 7847529 - DNA, 22 bp, Homo sapiens
cttattgtcttacagtaataga

SEQ ID NO: 7847530 - DNA, 22 bp, Homo sapiens
cttattgtcctgactcatggcc

SEQ ID NO: 7847531 - DNA, 22 bp, Homo sapiens
cttattgtcttacagtaataga

SEQ ID NO: 7847532 - DNA, 22 bp, Homo sapiens
cttattgtcttacagtaataga

SEQ ID NO: 7847533 - DNA, 22 bp, Homo sapiens
cttcagccctgagtgccagcag

SEQ ID NO: 7847534 - DNA, 22 bp, Homo sapiens
cttcagccctgagtgccagcag

SEQ ID NO: 7847535 - DNA, 22 bp, Homo sapiens
cttcagccctgagtgccagcag

SEQ ID NO: 7847536 - DNA, 22 bp, Homo sapiens
cttcagcctcatctcagcccgt

SEQ ID NO: 7847537 - DNA, 22 bp, Homo sapiens
cttcagcctcgttactcctgcg

SEQ ID NO: 7847538 - DNA, 22 bp, Homo sapiens
cttcagcctcatctcagcccgt

SEQ ID NO: 7847539 - DNA, 22 bp, Homo sapiens
cttcagcctcaactactatggt

SEQ ID NO: 7847540 - DNA, 22 bp, Homo sapiens
cttcagctcttggtaaatgttt

SEQ ID NO: 7847541 - DNA, 22 bp, Homo sapiens
cttcagctgacgtcaaaacacc

SEQ ID NO: 7847542 - DNA, 22 bp, Homo sapiens
cttcagctgcagttatgtttag

SEQ ID NO: 7847543 - DNA, 22 bp, Homo sapiens
cttcagctgcagttatgtttag

SEQ ID NO: 7847544 - DNA, 22 bp, Homo sapiens
cttcagctacctctgatgcaag

SEQ ID NO: 7847545 - DNA, 22 bp, Homo sapiens
cttcagcctcgttactcctgcg

SEQ ID NO: 7847546 - DNA, 22 bp, Homo sapiens
cttcagctaggatccctgcagc

SEQ ID NO: 7847547 - DNA, 22 bp, Homo sapiens
cttcagctacctctgatgcaag

SEQ ID NO: 7847548 - DNA, 22 bp, Homo sapiens
cttcagctaggatccctgcagc

SEQ ID NO: 7847549 - DNA, 22 bp, Homo sapiens
cttcaggagtagttacctagca

SEQ ID NO: 7847550 - DNA, 22 bp, Homo sapiens
cttcagctgttagacgtggaaa

SEQ ID NO: 7847551 - DNA, 20 bp, Homo sapiens
cttcaggacccatcctcccc

SEQ ID NO: 7847552 - DNA, 22 bp, Homo sapiens
cttcaggagtagttacctagca

SEQ ID NO: 7847553 - DNA, 22 bp, Homo sapiens
cttcaggattaatttggggcct

SEQ ID NO: 7847554 - DNA, 22 bp, Homo sapiens
cttcaggattaatttggggcct

SEQ ID NO: 7847555 - DNA, 22 bp, Homo sapiens
cttcaggatttaggaagatgaa

SEQ ID NO: 7847556 - DNA, 22 bp, Homo sapiens
cttcaggatttaggaagatgaa

SEQ ID NO: 7847557 - DNA, 22 bp, Homo sapiens
cttcaggattaatttggggcct

SEQ ID NO: 7847558 - DNA, 22 bp, Homo sapiens
cttcaggagtagttacctagca

SEQ ID NO: 7847559 - DNA, 22 bp, Homo sapiens
cttcaggaaaatctctaaggat

SEQ ID NO: 7847560 - DNA, 22 bp, Homo sapiens
cttcaggaaaatctctaaggat

SEQ ID NO: 7847561 - DNA, 22 bp, Homo sapiens
cttcagctttcagcttccctga

SEQ ID NO: 7847562 - DNA, 22 bp, Homo sapiens
cttcagctgtggtctccaaggc

SEQ ID NO: 7847563 - DNA, 22 bp, Homo sapiens
cttcagctgtggtctccaaggc

SEQ ID NO: 7847564 - DNA, 22 bp, Homo sapiens
cttcagctgtggtctccaaggc

SEQ ID NO: 7847565 - DNA, 22 bp, Homo sapiens
cttcagctgcagttatgtttag

SEQ ID NO: 7847566 - DNA, 18 bp, Homo sapiens
cttcagtcttcccacctc

SEQ ID NO: 7847567 - DNA, 22 bp, Homo sapiens
cttcagtgaatgttgagtaagg

SEQ ID NO: 7847568 - DNA, 22 bp, Homo sapiens
cttcagtgaatgttgagtaagg

SEQ ID NO: 7847569 - DNA, 18 bp, Homo sapiens
cttcagtgacagtctggc

SEQ ID NO: 7847570 - DNA, 22 bp, Homo sapiens
cttcagtgacagccacccaggc

SEQ ID NO: 7847571 - DNA, 22 bp, Homo sapiens
cttcagtgacattccttccctc

SEQ ID NO: 7847572 - DNA, 18 bp, Homo sapiens
cttcagtgacagtctggc

SEQ ID NO: 7847573 - DNA, 22 bp, Homo sapiens
cttcagtgcatgtttataatca

SEQ ID NO: 7847574 - DNA, 22 bp, Homo sapiens
cttcagtgcatgtttataatca

SEQ ID NO: 7847575 - DNA, 22 bp, Homo sapiens
cttcagtgattgcagaaagcct

SEQ ID NO: 7847576 - DNA, 22 bp, Homo sapiens
cttcagtgattgcagaaagcct

SEQ ID NO: 7847577 - DNA, 22 bp, Homo sapiens
cttcagtgattgcagaaagcct

SEQ ID NO: 7847578 - DNA, 22 bp, Homo sapiens
cttcagtgatataggcttctcc

SEQ ID NO: 7847579 - DNA, 22 bp, Homo sapiens
cttcagtgattgcagaaagcct

SEQ ID NO: 7847580 - DNA, 22 bp, Homo sapiens
cttcagtgatataggcttctcc

SEQ ID NO: 7847581 - DNA, 22 bp, Homo sapiens
cttcagtgatataggcttctcc

SEQ ID NO: 7847582 - DNA, 22 bp, Homo sapiens
cttcagtgaatgttgagtaagg

SEQ ID NO: 7847583 - DNA, 18 bp, Homo sapiens
cttcagtcttcccacctc

SEQ ID NO: 7847584 - DNA, 18 bp, Homo sapiens
cttcagtcttcccacctc

SEQ ID NO: 7847585 - DNA, 22 bp, Homo sapiens
cttcagtatcctccacatgtta

SEQ ID NO: 7847586 - DNA, 22 bp, Homo sapiens
cttcagtatcctccacatgtta

SEQ ID NO: 7847587 - DNA, 22 bp, Homo sapiens
cttcagtatcctccacatgtta

SEQ ID NO: 7847588 - DNA, 22 bp, Homo sapiens
cttcagtccttaagccaagcaa

SEQ ID NO: 7847589 - DNA, 22 bp, Homo sapiens
cttcagtatcctccacatgtta

SEQ ID NO: 7847590 - DNA, 22 bp, Homo sapiens
cttcaggatttaggaagatgaa

SEQ ID NO: 7847591 - DNA, 22 bp, Homo sapiens
cttcagggaggagcatgggttc

SEQ ID NO: 7847592 - DNA, 19 bp, Homo sapiens
cttcagggaggggccaggc

SEQ ID NO: 7847593 - DNA, 22 bp, Homo sapiens
cttcagggtgacgcaggctgca

SEQ ID NO: 7847594 - DNA, 22 bp, Homo sapiens
cttcagggtgacgcaggctgca

SEQ ID NO: 7847595 - DNA, 22 bp, Homo sapiens
cttcagggcatattattggctc

SEQ ID NO: 7847596 - DNA, 22 bp, Homo sapiens
cttcaggggtgttagttttgtg

SEQ ID NO: 7847597 - DNA, 22 bp, Homo sapiens
cttcctctgtggccagagtgta

SEQ ID NO: 7847598 - DNA, 22 bp, Homo sapiens
cttcctctgtgtcctgggcttc

SEQ ID NO: 7847599 - DNA, 22 bp, Homo sapiens
cttcctctgtgtcctgggcttc

SEQ ID NO: 7847600 - DNA, 22 bp, Homo sapiens
cttcctctgtgtcctgggcttc

SEQ ID NO: 7847601 - DNA, 22 bp, Homo sapiens
cttcctctgtgtcctgggcttg

SEQ ID NO: 7847602 - DNA, 22 bp, Homo sapiens
cttcctctgtgtcctgggcttg

SEQ ID NO: 7847603 - DNA, 22 bp, Homo sapiens
cttcctctgtgtcctgggcttg

SEQ ID NO: 7847604 - DNA, 18 bp, Homo sapiens
cttcctcttctggagaaa

SEQ ID NO: 7847605 - DNA, 22 bp, Homo sapiens
cttcctgaaatgtctcaccagt

SEQ ID NO: 7847606 - DNA, 22 bp, Homo sapiens
cttcctgaaagtagtaggttga

SEQ ID NO: 7847607 - DNA, 22 bp, Homo sapiens
cttcctgaagaggttggtcagg

SEQ ID NO: 7847608 - DNA, 22 bp, Homo sapiens
cttcctgaagaggttggtcagg

SEQ ID NO: 7847609 - DNA, 22 bp, Homo sapiens
cttcctgaacaatgccatcaat

SEQ ID NO: 7847610 - DNA, 22 bp, Homo sapiens
cttcctgagcaaggaactatag

SEQ ID NO: 7847611 - DNA, 22 bp, Homo sapiens
cttcctgagcaaggaactatag

SEQ ID NO: 7847612 - DNA, 22 bp, Homo sapiens
cttcctgagcaaggaactatag

SEQ ID NO: 7847613 - DNA, 22 bp, Homo sapiens
cttcctgaggtgctgagcacag

SEQ ID NO: 7847614 - DNA, 22 bp, Homo sapiens
cttcctgaaggatggcagcctc

SEQ ID NO: 7847615 - DNA, 22 bp, Homo sapiens
cttcctgaaggatggcagcctc

SEQ ID NO: 7847616 - DNA, 22 bp, Homo sapiens
cttcctgaaggatggcagcctc

SEQ ID NO: 7847617 - DNA, 22 bp, Homo sapiens
cttcctgaagaggttggtcagg

SEQ ID NO: 7847618 - DNA, 18 bp, Homo sapiens
cttcctgactagctctgg

SEQ ID NO: 7847619 - DNA, 18 bp, Homo sapiens
cttcctgactagctctgg

SEQ ID NO: 7847620 - DNA, 22 bp, Homo sapiens
cttcctgaatcttccatgtata

SEQ ID NO: 7847621 - DNA, 22 bp, Homo sapiens
cttcctgaatcttccatgtata

SEQ ID NO: 7847622 - DNA, 22 bp, Homo sapiens
cttcctctcttgcccataagag

SEQ ID NO: 7847623 - DNA, 22 bp, Homo sapiens
cttcctctcttgcccataagag

SEQ ID NO: 7847624 - DNA, 22 bp, Homo sapiens
cttcctaaaagcttcaagagaa

SEQ ID NO: 7847625 - DNA, 22 bp, Homo sapiens
cttccctttttatgtcttcagc

SEQ ID NO: 7847626 - DNA, 22 bp, Homo sapiens
cttccctttttatgtcttcagc

SEQ ID NO: 7847627 - DNA, 22 bp, Homo sapiens
cttccgtgtcagttccaggtgg

SEQ ID NO: 7847628 - DNA, 22 bp, Homo sapiens
cttcctctgcggcgccgggcgc

SEQ ID NO: 7847629 - DNA, 22 bp, Homo sapiens
cttcctctgcctcccgtgctca

SEQ ID NO: 7847630 - DNA, 22 bp, Homo sapiens
cttcctctgaggcttctgagtc

SEQ ID NO: 7847631 - DNA, 22 bp, Homo sapiens
cttcctctgaggcttctgagtc

SEQ ID NO: 7847632 - DNA, 22 bp, Homo sapiens
cttccctttttatgtcttcagc

SEQ ID NO: 7847633 - DNA, 22 bp, Homo sapiens
cttccctttctggtgacttctc

SEQ ID NO: 7847634 - DNA, 22 bp, Homo sapiens
cttcagtgttcccatctgtaaa

SEQ ID NO: 7847635 - DNA, 19 bp, Homo sapiens
cttcagtgttcacctggcc

SEQ ID NO: 7847636 - DNA, 22 bp, Homo sapiens
cttcagtgttcccatctgtaaa

SEQ ID NO: 7847637 - DNA, 19 bp, Homo sapiens
cttcagtgttcacctggcc

SEQ ID NO: 7847638 - DNA, 22 bp, Homo sapiens
cttcagtgtcctctctagtaga

SEQ ID NO: 7847639 - DNA, 22 bp, Homo sapiens
cttcagtggtcatttgtgataa

SEQ ID NO: 7847640 - DNA, 18 bp, Homo sapiens
cttcagtggctgctctgc

SEQ ID NO: 7847641 - DNA, 18 bp, Homo sapiens
cttcagtggctgctctgc

SEQ ID NO: 7847642 - DNA, 23 bp, Homo sapiens
cttcagtgtgggactgcagcgtg

SEQ ID NO: 7847643 - DNA, 23 bp, Homo sapiens
cttcagtgtgggactgcagcgtg

SEQ ID NO: 7847644 - DNA, 23 bp, Homo sapiens
cttcagtgtgggactgcagcgtg

SEQ ID NO: 7847645 - DNA, 22 bp, Homo sapiens
cttcagtgtcctctctagtaga

SEQ ID NO: 7847646 - DNA, 22 bp, Homo sapiens
cttcagtgtcctctctagtaga

SEQ ID NO: 7847647 - DNA, 22 bp, Homo sapiens
gagcttaaatggctaaatataa

SEQ ID NO: 7847648 - DNA, 22 bp, Homo sapiens
gagcttaaaacatagccagact

SEQ ID NO: 7847649 - DNA, 21 bp, Homo sapiens
gagctgttactctctctggag

SEQ ID NO: 7847650 - DNA, 22 bp, Homo sapiens
gagctgtgttgtctagtaccga

SEQ ID NO: 7847651 - DNA, 22 bp, Homo sapiens
gagcttaggccagggacaggga

SEQ ID NO: 7847652 - DNA, 23 bp, Homo sapiens
gagcttagtctactcagacatcc

SEQ ID NO: 7847653 - DNA, 22 bp, Homo sapiens
gagcttcagaatttaacagact

SEQ ID NO: 7847654 - DNA, 22 bp, Homo sapiens
gagcttcagctgccatgactgt

SEQ ID NO: 7847655 - DNA, 22 bp, Homo sapiens
gagcttcatatgttgcagagaa

SEQ ID NO: 7847656 - DNA, 22 bp, Homo sapiens
gagcttcatatgttgcagagaa

SEQ ID NO: 7847657 - DNA, 22 bp, Homo sapiens
gagcttccagagacatcagagt

SEQ ID NO: 7847658 - DNA, 22 bp, Homo sapiens
gagcttccagagacatcagagt

SEQ ID NO: 7847659 - DNA, 22 bp, Homo sapiens
gagcttccatccttactgtgtg

SEQ ID NO: 7847660 - DNA, 22 bp, Homo sapiens
gagcttccatccttactgtgtg

SEQ ID NO: 7847661 - DNA, 22 bp, Homo sapiens
gagcttggcagtgtcactaggg

SEQ ID NO: 7847662 - DNA, 22 bp, Homo sapiens
gagcttggatgtcttttgttca

SEQ ID NO: 7847663 - DNA, 22 bp, Homo sapiens
gagcttggacaagctctgaagg

SEQ ID NO: 7847664 - DNA, 22 bp, Homo sapiens
gagcttggacaccttggcaggt

SEQ ID NO: 7847665 - DNA, 22 bp, Homo sapiens
gagcttggacaagctctgaagg

SEQ ID NO: 7847666 - DNA, 22 bp, Homo sapiens
gagcttggacaagctctgaagg

SEQ ID NO: 7847667 - DNA, 22 bp, Homo sapiens
gagcttggctggacctcacgga

SEQ ID NO: 7847668 - DNA, 22 bp, Homo sapiens
gagcttggctggacctcacgga

SEQ ID NO: 7847669 - DNA, 22 bp, Homo sapiens
gagcttttcccgtctttctcgt

SEQ ID NO: 7847670 - DNA, 22 bp, Homo sapiens
gagcttggctggacctcacgga

SEQ ID NO: 7847671 - DNA, 22 bp, Homo sapiens
gagcttggcctcttgaacgtgg

SEQ ID NO: 7847672 - DNA, 22 bp, Homo sapiens
gagcttttgtgggggccaaggt

SEQ ID NO: 7847673 - DNA, 22 bp, Homo sapiens
gaggaaaagagacaggttattg

SEQ ID NO: 7847674 - DNA, 22 bp, Homo sapiens
gagcttcttgtttcttcatctg

SEQ ID NO: 7847675 - DNA, 22 bp, Homo sapiens
gagcttctcaacagttatctct

SEQ ID NO: 7847676 - DNA, 22 bp, Homo sapiens
gagcttctcaacagttatctct

SEQ ID NO: 7847677 - DNA, 22 bp, Homo sapiens
gagcttctgccatagagggact

SEQ ID NO: 7847678 - DNA, 22 bp, Homo sapiens
gagcttctgccatagagggact

SEQ ID NO: 7847679 - DNA, 22 bp, Homo sapiens
gagcttcctttttctgcatgac

SEQ ID NO: 7847680 - DNA, 22 bp, Homo sapiens
gagcttcctcagcctttctcac

SEQ ID NO: 7847681 - DNA, 22 bp, Homo sapiens
gagcttcctgatgccgaccagt

SEQ ID NO: 7847682 - DNA, 22 bp, Homo sapiens
gagcttccatggacgccatctg

SEQ ID NO: 7847683 - DNA, 22 bp, Homo sapiens
gagctgaaggagaaagcagggg

SEQ ID NO: 7847684 - DNA, 22 bp, Homo sapiens
gagctgaatcagagatattatt

SEQ ID NO: 7847685 - DNA, 22 bp, Homo sapiens
gagctgaattacggtgagtcat

SEQ ID NO: 7847686 - DNA, 22 bp, Homo sapiens
gagctgaatcagagatattatt

SEQ ID NO: 7847687 - DNA, 18 bp, Homo sapiens
gagctgagaagaggatgc

SEQ ID NO: 7847688 - DNA, 18 bp, Homo sapiens
gagctgagaagaggatgc

SEQ ID NO: 7847689 - DNA, 22 bp, Homo sapiens
gagctgaattgaagcaaggagc

SEQ ID NO: 7847690 - DNA, 22 bp, Homo sapiens
gagctgaattgctgccatttgc

SEQ ID NO: 7847691 - DNA, 22 bp, Homo sapiens
gagctgacatccagcagtgacc

SEQ ID NO: 7847692 - DNA, 22 bp, Homo sapiens
gagctgaattgctgccatttgc

SEQ ID NO: 7847693 - DNA, 18 bp, Homo sapiens
gagctgagaagaggatgc

SEQ ID NO: 7847694 - DNA, 18 bp, Homo sapiens
gagctgagaagaggatgc

SEQ ID NO: 7847695 - DNA, 19 bp, Homo sapiens
gagctgagagtagcactgg

SEQ ID NO: 7847696 - DNA, 19 bp, Homo sapiens
gagctgagagtagcactgg

SEQ ID NO: 7847697 - DNA, 19 bp, Homo sapiens
gagctgagagtagcactgg

SEQ ID NO: 7847698 - DNA, 22 bp, Homo sapiens
gagctgagacacactttggcaa

SEQ ID NO: 7847699 - DNA, 22 bp, Homo sapiens
gagctgagatcatgtacactag

SEQ ID NO: 7847700 - DNA, 19 bp, Homo sapiens
gagctgagagtagcactgg

SEQ ID NO: 7847701 - DNA, 22 bp, Homo sapiens
gagctgtgttgtctagtaccga

SEQ ID NO: 7847702 - DNA, 22 bp, Homo sapiens
gagctgtgttcatgaggagaaa

SEQ ID NO: 7847703 - DNA, 22 bp, Homo sapiens
gagctgtgttcatgaggagaaa

SEQ ID NO: 7847704 - DNA, 22 bp, Homo sapiens
gagctgtgttcatgaggagaaa

SEQ ID NO: 7847705 - DNA, 22 bp, Homo sapiens
gagctgagacacactttggcaa

SEQ ID NO: 7847706 - DNA, 19 bp, Homo sapiens
gagctgagagtagcactgg

SEQ ID NO: 7847707 - DNA, 22 bp, Homo sapiens
gagctgagaagcagcgcttgat

SEQ ID NO: 7847708 - DNA, 22 bp, Homo sapiens
gagctgagaagcagcgcttgat

SEQ ID NO: 7847709 - DNA, 22 bp, Homo sapiens
gagctgagaagcagcgcttgat

SEQ ID NO: 7847710 - DNA, 22 bp, Homo sapiens
gagctgaagcgctacagcatcc

SEQ ID NO: 7847711 - DNA, 22 bp, Homo sapiens
gagctgaagcgctacagcatcc

SEQ ID NO: 7847712 - DNA, 22 bp, Homo sapiens
gagctgaacatcatggaaaggc

SEQ ID NO: 7847713 - DNA, 22 bp, Homo sapiens
gagctgaacatcatggaaaggc

SEQ ID NO: 7847714 - DNA, 22 bp, Homo sapiens
gagctgaaatatgaagccaatt

SEQ ID NO: 7847715 - DNA, 22 bp, Homo sapiens
gagctctttcatggttctgtga

SEQ ID NO: 7847716 - DNA, 22 bp, Homo sapiens
gagctctttcggttgttttcga

SEQ ID NO: 7847717 - DNA, 22 bp, Homo sapiens
gagctcttccccatcttacatc

SEQ ID NO: 7847718 - DNA, 22 bp, Homo sapiens
gagctcttatagttctagcagt

SEQ ID NO: 7847719 - DNA, 22 bp, Homo sapiens
gagctcttccccatcttacatc

SEQ ID NO: 7847720 - DNA, 22 bp, Homo sapiens
gagctcttctggttagatgttg

SEQ ID NO: 7847721 - DNA, 22 bp, Homo sapiens
gagctcttgcttctagtccagg

SEQ ID NO: 7847722 - DNA, 22 bp, Homo sapiens
gagcctgaatttgacctgctta

SEQ ID NO: 7847723 - DNA, 22 bp, Homo sapiens
gagcctgcccagccctgtccac

SEQ ID NO: 7847724 - DNA, 22 bp, Homo sapiens
gagcctgcaggcctcggcctca

SEQ ID NO: 7847725 - DNA, 22 bp, Homo sapiens
gagcctgcagctttcacagcat

SEQ ID NO: 7847726 - DNA, 22 bp, Homo sapiens
gagcctcgtggcggccactgcg

SEQ ID NO: 7847727 - DNA, 22 bp, Homo sapiens
gagcctcgtggcggccactgcg

SEQ ID NO: 7847728 - DNA, 22 bp, Homo sapiens
gagcctgaatttgacctgctta

SEQ ID NO: 7847729 - DNA, 22 bp, Homo sapiens
gagcctcgtggcggccactgcg

SEQ ID NO: 7847730 - DNA, 22 bp, Homo sapiens
gagcctcgtggcggccactgcg

SEQ ID NO: 7847731 - DNA, 22 bp, Homo sapiens
gagcctcgtggcggccactgcg

SEQ ID NO: 7847732 - DNA, 22 bp, Homo sapiens
gagcctcctcctggtgtgccga

SEQ ID NO: 7847733 - DNA, 22 bp, Homo sapiens
gagccgtgccagccctgtctcg

SEQ ID NO: 7847734 - DNA, 22 bp, Homo sapiens
gagcctcagggttttgttgaca

SEQ ID NO: 7847735 - DNA, 22 bp, Homo sapiens
gagcccttttcctagatactgt

SEQ ID NO: 7847736 - DNA, 22 bp, Homo sapiens
gagcccttttcctagatactgt

SEQ ID NO: 7847737 - DNA, 22 bp, Homo sapiens
gagccgtgccagccctgtctcg

SEQ ID NO: 7847738 - DNA, 22 bp, Homo sapiens
gagccgaggcgcacagctcggg

SEQ ID NO: 7847739 - DNA, 22 bp, Homo sapiens
gagccctttccactgccctctg

SEQ ID NO: 7847740 - DNA, 22 bp, Homo sapiens
gagccaggtttgaatctcagtc

SEQ ID NO: 7847741 - DNA, 22 bp, Homo sapiens
gagccaggtttgaatctcagtc

SEQ ID NO: 7847742 - DNA, 22 bp, Homo sapiens
gagccaggtttgaatctcagtc

SEQ ID NO: 7847743 - DNA, 22 bp, Homo sapiens
gagccctgttcaggcctcctca

SEQ ID NO: 7847744 - DNA, 22 bp, Homo sapiens
gagccaggtttgaatctcagtc

SEQ ID NO: 7847745 - DNA, 22 bp, Homo sapiens
gagccaggtttgaatctcagtc

SEQ ID NO: 7847746 - DNA, 22 bp, Homo sapiens
gagccctgttcaggcctcctca

SEQ ID NO: 7847747 - DNA, 22 bp, Homo sapiens
gagcctggagctggaacgaagc

SEQ ID NO: 7847748 - DNA, 22 bp, Homo sapiens
gagcctggagctggaacgaagc

SEQ ID NO: 7847749 - DNA, 22 bp, Homo sapiens
gagcctggagctggaacgaagc

SEQ ID NO: 7847750 - DNA, 22 bp, Homo sapiens
gagcctggacatctcaggccca

SEQ ID NO: 7847751 - DNA, 22 bp, Homo sapiens
gagcctggacatctcaggccca

SEQ ID NO: 7847752 - DNA, 22 bp, Homo sapiens
gagcctggacatctcaggccca

SEQ ID NO: 7847753 - DNA, 22 bp, Homo sapiens
gagcctggacatctcaggccca

SEQ ID NO: 7847754 - DNA, 22 bp, Homo sapiens
gagcctgcccctccaccaggat

SEQ ID NO: 7847755 - DNA, 22 bp, Homo sapiens
gagcctggacatctcaggccca

SEQ ID NO: 7847756 - DNA, 22 bp, Homo sapiens
gagcctggacatctcaggccca

SEQ ID NO: 7847757 - DNA, 22 bp, Homo sapiens
gagcctggacatctcaggccca

SEQ ID NO: 7847758 - DNA, 22 bp, Homo sapiens
gagcctggacatctcaggccca

SEQ ID NO: 7847759 - DNA, 22 bp, Homo sapiens
gagcctggacatctcaggccca

SEQ ID NO: 7847760 - DNA, 22 bp, Homo sapiens
gagcctggacatctcaggccca

SEQ ID NO: 7847761 - DNA, 22 bp, Homo sapiens
gagcctggacatctcaggccca

SEQ ID NO: 7847762 - DNA, 22 bp, Homo sapiens
gagcctggattgaagtgggtgg

SEQ ID NO: 7847763 - DNA, 22 bp, Homo sapiens
gagcctggattgaagtgggtgg

SEQ ID NO: 7847764 - DNA, 22 bp, Homo sapiens
gagcctggattgaagtgggtgg

SEQ ID NO: 7847765 - DNA, 22 bp, Homo sapiens
gagcctggattgaagtgggtgg

SEQ ID NO: 7847766 - DNA, 22 bp, Homo sapiens
gagcctggattgtcaccgactt

SEQ ID NO: 7847767 - DNA, 22 bp, Homo sapiens
gagcctggattgaagtgggtgg

SEQ ID NO: 7847768 - DNA, 22 bp, Homo sapiens
gagcggcaggagccacctgcct

SEQ ID NO: 7847769 - DNA, 22 bp, Homo sapiens
gagcggaggcttggaggccagc

SEQ ID NO: 7847770 - DNA, 22 bp, Homo sapiens
gagcctggatagccttgttcca

SEQ ID NO: 7847771 - DNA, 22 bp, Homo sapiens
gagcctggagctggaacgaagc

SEQ ID NO: 7847772 - DNA, 22 bp, Homo sapiens
gagcctggagctggaacgaagc

SEQ ID NO: 7847773 - DNA, 22 bp, Homo sapiens
gagcctggattgaagtgggtgg

SEQ ID NO: 7847774 - DNA, 22 bp, Homo sapiens
gagctctgactgctgggtgaca

SEQ ID NO: 7847775 - DNA, 22 bp, Homo sapiens
gagctctgatgtttagtggaga

SEQ ID NO: 7847776 - DNA, 22 bp, Homo sapiens
gagctctgatgtttagtggaga

SEQ ID NO: 7847777 - DNA, 22 bp, Homo sapiens
gagctctgactgctgggtgaca

SEQ ID NO: 7847778 - DNA, 22 bp, Homo sapiens
gagctctgactgctgggtgaca

SEQ ID NO: 7847779 - DNA, 22 bp, Homo sapiens
gagctctgactgctgggtgaca

SEQ ID NO: 7847780 - DNA, 22 bp, Homo sapiens
gagctatagatgtttacatact

SEQ ID NO: 7847781 - DNA, 22 bp, Homo sapiens
gagctctatgtggctggcatgt

SEQ ID NO: 7847782 - DNA, 22 bp, Homo sapiens
gagctcagactcgggcctgggg

SEQ ID NO: 7847783 - DNA, 22 bp, Homo sapiens
gagctctgaaaaagcttgcctt

SEQ ID NO: 7847784 - DNA, 22 bp, Homo sapiens
gagctctgaaaaagcttgcctt

SEQ ID NO: 7847785 - DNA, 22 bp, Homo sapiens
gagctctgaaaaagcttgcctt

SEQ ID NO: 7847786 - DNA, 22 bp, Homo sapiens
gagctctgaaaaagcttgcctt

SEQ ID NO: 7847787 - DNA, 22 bp, Homo sapiens
gagctctgaaaaagcttgcctt

SEQ ID NO: 7847788 - DNA, 22 bp, Homo sapiens
gagctctctggggagatgggat

SEQ ID NO: 7847789 - DNA, 22 bp, Homo sapiens
gagctctctggggagatgggat

SEQ ID NO: 7847790 - DNA, 21 bp, Homo sapiens
gagctctctacttgcacattt

SEQ ID NO: 7847791 - DNA, 21 bp, Homo sapiens
gagctctcaggcaagaagcag

SEQ ID NO: 7847792 - DNA, 22 bp, Homo sapiens
gagctcttatagttctagcagt

SEQ ID NO: 7847793 - DNA, 22 bp, Homo sapiens
gagctcttatagttctagcagt

SEQ ID NO: 7847794 - DNA, 22 bp, Homo sapiens
gagctctgttctcgtcctgctg

SEQ ID NO: 7847795 - DNA, 22 bp, Homo sapiens
gagctctgttctcgtcctgctg

SEQ ID NO: 7847796 - DNA, 22 bp, Homo sapiens
gagctctgttctcgtcctgctg

SEQ ID NO: 7847797 - DNA, 22 bp, Homo sapiens
gagctctgtgtagcctgagggt

SEQ ID NO: 7847798 - DNA, 22 bp, Homo sapiens
gagctctgtgtagcctgagggt

SEQ ID NO: 7847799 - DNA, 22 bp, Homo sapiens
gagctctgtgtagcctgagggt

SEQ ID NO: 7847800 - DNA, 22 bp, Homo sapiens
gagctctgtgtagcctgagggt

SEQ ID NO: 7847801 - DNA, 22 bp, Homo sapiens
gagctacaagggagactttttt

SEQ ID NO: 7847802 - DNA, 22 bp, Homo sapiens
gagctaaggtcacaagaagcag

SEQ ID NO: 7847803 - DNA, 22 bp, Homo sapiens
gagctactgaaatattgatttt

SEQ ID NO: 7847804 - DNA, 22 bp, Homo sapiens
gagctacaggcagctgagccct

SEQ ID NO: 7847805 - DNA, 22 bp, Homo sapiens
gagctacactgattcatttgtt

SEQ ID NO: 7847806 - DNA, 22 bp, Homo sapiens
gagctaagagtctagaaaggct

SEQ ID NO: 7847807 - DNA, 22 bp, Homo sapiens
gagctaagacctgagggcaagt

SEQ ID NO: 7847808 - DNA, 22 bp, Homo sapiens
gagcgggaggaacggctcgggc

SEQ ID NO: 7847809 - DNA, 22 bp, Homo sapiens
gagcgggaggaacggctcgggc

SEQ ID NO: 7847810 - DNA, 22 bp, Homo sapiens
gagcgggaggaacggctcgggc

SEQ ID NO: 7847811 - DNA, 22 bp, Homo sapiens
gagcgggggctgccgggatttg

SEQ ID NO: 7847812 - DNA, 22 bp, Homo sapiens
gagcgggggctgccgggatttg

SEQ ID NO: 7847813 - DNA, 22 bp, Homo sapiens
gagctagtagaacaagtgagga

SEQ ID NO: 7847814 - DNA, 22 bp, Homo sapiens
gagctaggttgagactcactta

SEQ ID NO: 7847815 - DNA, 22 bp, Homo sapiens
gagctaggggtagtcaggagac

SEQ ID NO: 7847816 - DNA, 22 bp, Homo sapiens
gagctaggggtagtcaggagac

SEQ ID NO: 7847817 - DNA, 22 bp, Homo sapiens
gagctaggggtagtcaggagac

SEQ ID NO: 7847818 - DNA, 22 bp, Homo sapiens
gagctagggaggaggcttgctc

SEQ ID NO: 7847819 - DNA, 22 bp, Homo sapiens
gagctagggaggaggcttgctc

SEQ ID NO: 7847820 - DNA, 22 bp, Homo sapiens
gagctaggctagggggagtcgc

SEQ ID NO: 7847821 - DNA, 22 bp, Homo sapiens
gagctaggatatcatgagggta

SEQ ID NO: 7847822 - DNA, 22 bp, Homo sapiens
gagctagagggagaagggcact

SEQ ID NO: 7847823 - DNA, 22 bp, Homo sapiens
gagctagagtttgtagggtaga

SEQ ID NO: 7847824 - DNA, 22 bp, Homo sapiens
gagctagactgggctctgatgt

SEQ ID NO: 7847825 - DNA, 22 bp, Homo sapiens
gagctactgaaatattgatttt

SEQ ID NO: 7847826 - DNA, 22 bp, Homo sapiens
gagctagaattaggccaatttc

SEQ ID NO: 7847827 - DNA, 22 bp, Homo sapiens
gagctagacagcaagggcctgc

SEQ ID NO: 7847828 - DNA, 22 bp, Homo sapiens
gaggcaatgggctatagcattg

SEQ ID NO: 7847829 - DNA, 22 bp, Homo sapiens
gaggcacatcacttggtgcatt

SEQ ID NO: 7847830 - DNA, 22 bp, Homo sapiens
gaggcacatcacttggtgcatt

SEQ ID NO: 7847831 - DNA, 22 bp, Homo sapiens
gaggcacatcacttggtgcatt

SEQ ID NO: 7847832 - DNA, 22 bp, Homo sapiens
gaggcacatcacttggtgcatt

SEQ ID NO: 7847833 - DNA, 22 bp, Homo sapiens
gaggcacatcacttggtgcatt

SEQ ID NO: 7847834 - DNA, 22 bp, Homo sapiens
gaggcacatcacttggtgcatt

SEQ ID NO: 7847835 - DNA, 22 bp, Homo sapiens
gaggcaccagacatggcctcat

SEQ ID NO: 7847836 - DNA, 22 bp, Homo sapiens
gaggcacatgactcaccaatgg

SEQ ID NO: 7847837 - DNA, 22 bp, Homo sapiens
gaggcaccagccccgctagcct

SEQ ID NO: 7847838 - DNA, 22 bp, Homo sapiens
gaggcaccagacatggcctcat

SEQ ID NO: 7847839 - DNA, 22 bp, Homo sapiens
gaggcaccagacatggcctcat

SEQ ID NO: 7847840 - DNA, 22 bp, Homo sapiens
gaggcaccagacatggcctcat

SEQ ID NO: 7847841 - DNA, 23 bp, Homo sapiens
gaggcactcaggaaatgtgagtg

SEQ ID NO: 7847842 - DNA, 22 bp, Homo sapiens
gaggcactgaatacttgagggt

SEQ ID NO: 7847843 - DNA, 23 bp, Homo sapiens
gaggcactcaggaaatgtgagtg

SEQ ID NO: 7847844 - DNA, 22 bp, Homo sapiens
gaggcactctcgacaagggtgg

SEQ ID NO: 7847845 - DNA, 22 bp, Homo sapiens
gaggcacctcgcgggaggaggc

SEQ ID NO: 7847846 - DNA, 22 bp, Homo sapiens
gaggcacctcgcgggaggaggc

SEQ ID NO: 7847847 - DNA, 22 bp, Homo sapiens
gaggcacctcgcgggaggaggc

SEQ ID NO: 7847848 - DNA, 22 bp, Homo sapiens
gaggcacctcgcgggaggaggc

SEQ ID NO: 7847849 - DNA, 22 bp, Homo sapiens
gaggcacctcgcgggaggaggc

SEQ ID NO: 7847850 - DNA, 22 bp, Homo sapiens
gaggcactgaatacttgagggt

SEQ ID NO: 7847851 - DNA, 22 bp, Homo sapiens
gaggcactgaatacttgagggt

SEQ ID NO: 7847852 - DNA, 22 bp, Homo sapiens
gaggcactgaatacttgagggt

SEQ ID NO: 7847853 - DNA, 22 bp, Homo sapiens
gaggcactgagagtgggggatg

SEQ ID NO: 7847854 - DNA, 22 bp, Homo sapiens
gaggcactgaatacttgagggt

SEQ ID NO: 7847855 - DNA, 22 bp, Homo sapiens
gaggcactgaccattttcatat

SEQ ID NO: 7847856 - DNA, 22 bp, Homo sapiens
gaggcactgagagtgggggatg

SEQ ID NO: 7847857 - DNA, 22 bp, Homo sapiens
gaggcactgagagtgggggatg

SEQ ID NO: 7847858 - DNA, 22 bp, Homo sapiens
gaggcactgagagtgggggatg

SEQ ID NO: 7847859 - DNA, 22 bp, Homo sapiens
gaggcactgcagtacagtgact

SEQ ID NO: 7847860 - DNA, 22 bp, Homo sapiens
gaggcactgctgggcccctgta

SEQ ID NO: 7847861 - DNA, 22 bp, Homo sapiens
gaggcactgctgggcccctgta

SEQ ID NO: 7847862 - DNA, 22 bp, Homo sapiens
gaggcactgctgggcccctgta

SEQ ID NO: 7847863 - DNA, 22 bp, Homo sapiens
gaggcactggaggaaaggagaa

SEQ ID NO: 7847864 - DNA, 22 bp, Homo sapiens
gaggcagaagttgcagtgagca

SEQ ID NO: 7847865 - DNA, 22 bp, Homo sapiens
gaggcagaagttgcagtgagca

SEQ ID NO: 7847866 - DNA, 23 bp, Homo sapiens
gaggcactcaggaaatgtgagtg

SEQ ID NO: 7847867 - DNA, 22 bp, Homo sapiens
gaggcagaagttgcagtgagca

SEQ ID NO: 7847868 - DNA, 22 bp, Homo sapiens
gaggcagaagttgcagtgagca

SEQ ID NO: 7847869 - DNA, 22 bp, Homo sapiens
gaggcactggaggaaaggagaa

SEQ ID NO: 7847870 - DNA, 22 bp, Homo sapiens
gaggcagaagttgcagtgagca

SEQ ID NO: 7847871 - DNA, 22 bp, Homo sapiens
gaggcagaagttgcagtgagca

SEQ ID NO: 7847872 - DNA, 22 bp, Homo sapiens
gaggcagaagttgcagtgagca

SEQ ID NO: 7847873 - DNA, 22 bp, Homo sapiens
gaggcagaagttgcagtgagca

SEQ ID NO: 7847874 - DNA, 22 bp, Homo sapiens
gaggcagagactccaccttcag

SEQ ID NO: 7847875 - DNA, 22 bp, Homo sapiens
gaggcagagactccaccttcag

SEQ ID NO: 7847876 - DNA, 22 bp, Homo sapiens
gaggcagaggaaggtggtctct

SEQ ID NO: 7847877 - DNA, 22 bp, Homo sapiens
gaggcagagaccttcaggacct

SEQ ID NO: 7847878 - DNA, 22 bp, Homo sapiens
gaggcagagactccaccttcag

SEQ ID NO: 7847879 - DNA, 22 bp, Homo sapiens
gaggcagagaccttcaggacct

SEQ ID NO: 7847880 - DNA, 22 bp, Homo sapiens
gaggcagaagttgcagtgagca

SEQ ID NO: 7847881 - DNA, 22 bp, Homo sapiens
gaggcagaagttgcagtgagca

SEQ ID NO: 7847882 - DNA, 22 bp, Homo sapiens
gaggcagaagttgcagtgagca

SEQ ID NO: 7847883 - DNA, 22 bp, Homo sapiens
gaggcagagaccttcaggacct

SEQ ID NO: 7847884 - DNA, 22 bp, Homo sapiens
gaggcagagaccttcaggacct

SEQ ID NO: 7847885 - DNA, 22 bp, Homo sapiens
gaggcagagaccttcaggacct

SEQ ID NO: 7847886 - DNA, 22 bp, Homo sapiens
gaggcagagaccttcaggacct

SEQ ID NO: 7847887 - DNA, 22 bp, Homo sapiens
gaggcagagaccttcaggacct

SEQ ID NO: 7847888 - DNA, 22 bp, Homo sapiens
gaggcagagaccttcaggacct

SEQ ID NO: 7847889 - DNA, 22 bp, Homo sapiens
gaggccaggacatgaaagctga

SEQ ID NO: 7847890 - DNA, 22 bp, Homo sapiens
gaggccaggacatgaaagctga

SEQ ID NO: 7847891 - DNA, 22 bp, Homo sapiens
gaggccaggacatgaaagctga

SEQ ID NO: 7847892 - DNA, 22 bp, Homo sapiens
gaggccaggaggatctctctaa

SEQ ID NO: 7847893 - DNA, 22 bp, Homo sapiens
gaggccaggacatgaaagctga

SEQ ID NO: 7847894 - DNA, 22 bp, Homo sapiens
gaggccaggacatgaaagctga

SEQ ID NO: 7847895 - DNA, 22 bp, Homo sapiens
gaggccaggaagcccaagatca

SEQ ID NO: 7847896 - DNA, 22 bp, Homo sapiens
gaggccaggaagcccaagatca

SEQ ID NO: 7847897 - DNA, 22 bp, Homo sapiens
gaggccaggaagcccaagatca

SEQ ID NO: 7847898 - DNA, 22 bp, Homo sapiens
gaggccaggaagcccaagatca

SEQ ID NO: 7847899 - DNA, 22 bp, Homo sapiens
gaggccaggaagcccaagatca

SEQ ID NO: 7847900 - DNA, 22 bp, Homo sapiens
gaggccaggacatgaaagctga

SEQ ID NO: 7847901 - DNA, 22 bp, Homo sapiens
gaggccagctacccaagggtca

SEQ ID NO: 7847902 - DNA, 22 bp, Homo sapiens
gaggccagctacccaagggtca

SEQ ID NO: 7847903 - DNA, 22 bp, Homo sapiens
gaggccagctacccaagggtca

SEQ ID NO: 7847904 - DNA, 22 bp, Homo sapiens
gaggccagcgcgcagcactttt

SEQ ID NO: 7847905 - DNA, 22 bp, Homo sapiens
gaggccagctacccaagggtca

SEQ ID NO: 7847906 - DNA, 22 bp, Homo sapiens
gaggccagctagtccaggaagt

SEQ ID NO: 7847907 - DNA, 22 bp, Homo sapiens
gaggccagctagtccaggaagt

SEQ ID NO: 7847908 - DNA, 22 bp, Homo sapiens
gaggccagctagtccaggaagt

SEQ ID NO: 7847909 - DNA, 22 bp, Homo sapiens
gaggccagcgcgcagcactttt

SEQ ID NO: 7847910 - DNA, 22 bp, Homo sapiens
gaggccagcccctcttgaaggc

SEQ ID NO: 7847911 - DNA, 22 bp, Homo sapiens
gaggccagcgcgcagcactttt

SEQ ID NO: 7847912 - DNA, 22 bp, Homo sapiens
gaggccagcgcgcagcactttt

SEQ ID NO: 7847913 - DNA, 22 bp, Homo sapiens
gaggccagcgcgcagcactttt

SEQ ID NO: 7847914 - DNA, 22 bp, Homo sapiens
gaggccagcgcgcagcactttt

SEQ ID NO: 7847915 - DNA, 22 bp, Homo sapiens
gaggccagcccctcttgaaggc

SEQ ID NO: 7847916 - DNA, 22 bp, Homo sapiens
gaggccagcccctcttgaaggc

SEQ ID NO: 7847917 - DNA, 22 bp, Homo sapiens
gaggccagcccctcttgaaggc

SEQ ID NO: 7847918 - DNA, 22 bp, Homo sapiens
gaggccagcccctcttgaaggc

SEQ ID NO: 7847919 - DNA, 22 bp, Homo sapiens
gaggccagatgtcatgtcttat

SEQ ID NO: 7847920 - DNA, 22 bp, Homo sapiens
gaggcagaggaaggtggtctct

SEQ ID NO: 7847921 - DNA, 22 bp, Homo sapiens
gaggcagagactccaccttcag

SEQ ID NO: 7847922 - DNA, 22 bp, Homo sapiens
gaggcagaggaaggtggtctct

SEQ ID NO: 7847923 - DNA, 22 bp, Homo sapiens
gaggcagaggaaggtggtctct

SEQ ID NO: 7847924 - DNA, 22 bp, Homo sapiens
gaggcagaggaaggtggtctct

SEQ ID NO: 7847925 - DNA, 22 bp, Homo sapiens
gaggcagaggttgcagtgagct

SEQ ID NO: 7847926 - DNA, 22 bp, Homo sapiens
gaggccagatgtcatgtcttat

SEQ ID NO: 7847927 - DNA, 22 bp, Homo sapiens
gaggccagatgtcatgtcttat

SEQ ID NO: 7847928 - DNA, 22 bp, Homo sapiens
gaggcagaggaaggtggtctct

SEQ ID NO: 7847929 - DNA, 22 bp, Homo sapiens
gaggcagaggttgcagtgagct

SEQ ID NO: 7847930 - DNA, 22 bp, Homo sapiens
gaggcagaggttgcagtgagct

SEQ ID NO: 7847931 - DNA, 22 bp, Homo sapiens
gaggaggaggaagtggaaccca

SEQ ID NO: 7847932 - DNA, 22 bp, Homo sapiens
gaggaggaggaagtggaaccca

SEQ ID NO: 7847933 - DNA, 22 bp, Homo sapiens
gaggaggaggaagtggaaccca

SEQ ID NO: 7847934 - DNA, 22 bp, Homo sapiens
gaggaggaggaagtggaaccca

SEQ ID NO: 7847935 - DNA, 22 bp, Homo sapiens
gaggaggcactagttagtgaca

SEQ ID NO: 7847936 - DNA, 22 bp, Homo sapiens
gaggaggcactagttagtgaca

SEQ ID NO: 7847937 - DNA, 22 bp, Homo sapiens
gaggaggcacttgagcagatgt

SEQ ID NO: 7847938 - DNA, 19 bp, Homo sapiens
gaggaggaaaactagtgta

SEQ ID NO: 7847939 - DNA, 22 bp, Homo sapiens
gaggaggaaaccctgttcctct

SEQ ID NO: 7847940 - DNA, 19 bp, Homo sapiens
gaggaggaaaactagtgta

SEQ ID NO: 7847941 - DNA, 19 bp, Homo sapiens
gaggaggaaaactagtgta

SEQ ID NO: 7847942 - DNA, 19 bp, Homo sapiens
gaggaggaaaactagtgta

SEQ ID NO: 7847943 - DNA, 22 bp, Homo sapiens
gaggaggaagttctctgtaggc

SEQ ID NO: 7847944 - DNA, 22 bp, Homo sapiens
gaggaggaagttctctgtaggc

SEQ ID NO: 7847945 - DNA, 22 bp, Homo sapiens
gaggaggaagttctctgtaggc

SEQ ID NO: 7847946 - DNA, 22 bp, Homo sapiens
gaggaggaaaggagttgaaatg

SEQ ID NO: 7847947 - DNA, 22 bp, Homo sapiens
gaggaggaaaggagttgaaatg

SEQ ID NO: 7847948 - DNA, 22 bp, Homo sapiens
gaggaggaaaccctgttcctct

SEQ ID NO: 7847949 - DNA, 22 bp, Homo sapiens
gaggaggaaaggagttgaaatg

SEQ ID NO: 7847950 - DNA, 22 bp, Homo sapiens
gaggaggaagttctctgtaggc

SEQ ID NO: 7847951 - DNA, 22 bp, Homo sapiens
gaggaggctaagtgggctctgg

SEQ ID NO: 7847952 - DNA, 22 bp, Homo sapiens
gaggaggccagtggaaggaagc

SEQ ID NO: 7847953 - DNA, 22 bp, Homo sapiens
gaggaggctaagtgggctctgg

SEQ ID NO: 7847954 - DNA, 22 bp, Homo sapiens
gaggaggctaagtgggctctgg

SEQ ID NO: 7847955 - DNA, 22 bp, Homo sapiens
gaggaggccagtggaaggaagc

SEQ ID NO: 7847956 - DNA, 22 bp, Homo sapiens
gaggaggccagtggaaggaagc

SEQ ID NO: 7847957 - DNA, 22 bp, Homo sapiens
gaggaggctaagtgggctctgg

SEQ ID NO: 7847958 - DNA, 22 bp, Homo sapiens
gaggaggccagtggaaggaagc

SEQ ID NO: 7847959 - DNA, 22 bp, Homo sapiens
gaggaggcacttgagcagatgt

SEQ ID NO: 7847960 - DNA, 22 bp, Homo sapiens
gaggaggctaagtgggctctgg

SEQ ID NO: 7847961 - DNA, 22 bp, Homo sapiens
gaggaggctaagtgggctctgg

SEQ ID NO: 7847962 - DNA, 22 bp, Homo sapiens
gaggaggctatcagcaatcagg

SEQ ID NO: 7847963 - DNA, 19 bp, Homo sapiens
gaggcaaggagtttaagcc

SEQ ID NO: 7847964 - DNA, 22 bp, Homo sapiens
gaggcaaggccgcacgtctcag

SEQ ID NO: 7847965 - DNA, 22 bp, Homo sapiens
gaggcaaggccgcacgtctcag

SEQ ID NO: 7847966 - DNA, 22 bp, Homo sapiens
gaggcaagagaagccagctttc

SEQ ID NO: 7847967 - DNA, 22 bp, Homo sapiens
gaggcaagagaagccagctttc

SEQ ID NO: 7847968 - DNA, 22 bp, Homo sapiens
gaggaggctaagtgggctctgg

SEQ ID NO: 7847969 - DNA, 22 bp, Homo sapiens
gaggaaaataacaactaagggc

SEQ ID NO: 7847970 - DNA, 22 bp, Homo sapiens
gaggaaaataacaactaagggc

SEQ ID NO: 7847971 - DNA, 20 bp, Homo sapiens
gaggaaaagctgccaggcct

SEQ ID NO: 7847972 - DNA, 22 bp, Homo sapiens
gaggaaaataacaactaagggc

SEQ ID NO: 7847973 - DNA, 20 bp, Homo sapiens
gaggaaaagctgccaggcct

SEQ ID NO: 7847974 - DNA, 20 bp, Homo sapiens
gaggaaaagctgccaggcct

SEQ ID NO: 7847975 - DNA, 20 bp, Homo sapiens
gaggaaaagctgccaggcct

SEQ ID NO: 7847976 - DNA, 22 bp, Homo sapiens
gaggaaaagagacaggttattg

SEQ ID NO: 7847977 - DNA, 22 bp, Homo sapiens
gaggaaaagagacaggttattg

SEQ ID NO: 7847978 - DNA, 22 bp, Homo sapiens
gaggaaaatattcagggaggtt

SEQ ID NO: 7847979 - DNA, 22 bp, Homo sapiens
gaggaaaatattcagggaggtt

SEQ ID NO: 7847980 - DNA, 22 bp, Homo sapiens
gaggaaaatattcagggaggtt

SEQ ID NO: 7847981 - DNA, 22 bp, Homo sapiens
gaggaaaatattcagggaggtt

SEQ ID NO: 7847982 - DNA, 22 bp, Homo sapiens
gaggaaaataacaactaagggc

SEQ ID NO: 7847983 - DNA, 22 bp, Homo sapiens
gaggaaaataacaactaagggc

SEQ ID NO: 7847984 - DNA, 22 bp, Homo sapiens
gaggaaaatgcaacaggaatgc

SEQ ID NO: 7847985 - DNA, 22 bp, Homo sapiens
gaggaaaatgcaacaggaatgc

SEQ ID NO: 7847986 - DNA, 22 bp, Homo sapiens
gaggagccctgttccccaggcc

SEQ ID NO: 7847987 - DNA, 22 bp, Homo sapiens
gaggagctgttccctcacctct

SEQ ID NO: 7847988 - DNA, 19 bp, Homo sapiens
gaggagctatcggagacag

SEQ ID NO: 7847989 - DNA, 19 bp, Homo sapiens
gaggagctatcggagacag

SEQ ID NO: 7847990 - DNA, 22 bp, Homo sapiens
gaggagcttgcatttaagtgcc

SEQ ID NO: 7847991 - DNA, 22 bp, Homo sapiens
gaggagcttgaggctaggagcc

SEQ ID NO: 7847992 - DNA, 22 bp, Homo sapiens
gaggagcttgaggctaggagcc

SEQ ID NO: 7847993 - DNA, 22 bp, Homo sapiens
gaggagcttgcatttaagtgcc

SEQ ID NO: 7847994 - DNA, 22 bp, Homo sapiens
gaggagcttgaggctaggagcc

SEQ ID NO: 7847995 - DNA, 22 bp, Homo sapiens
gaggagcttgtgagaagatgtc

SEQ ID NO: 7847996 - DNA, 22 bp, Homo sapiens
gaggagcttgtgagaagatgtc

SEQ ID NO: 7847997 - DNA, 22 bp, Homo sapiens
gaggagcttgtgagaagatgtc

SEQ ID NO: 7847998 - DNA, 22 bp, Homo sapiens
gaggagctgttccctcacctct

SEQ ID NO: 7847999 - DNA, 22 bp, Homo sapiens
gaggagcttcagaggaatctta

SEQ ID NO: 7848000 - DNA, 22 bp, Homo sapiens
gaggagcttcagaggaatctta

SEQ ID NO: 7848001 - DNA, 22 bp, Homo sapiens
gaggagcttgaggctaggagcc

SEQ ID NO: 7848002 - DNA, 22 bp, Homo sapiens
gaggagcttgaggctaggagcc

SEQ ID NO: 7848003 - DNA, 22 bp, Homo sapiens
gaggagcttgaggctaggagcc

SEQ ID NO: 7848004 - DNA, 22 bp, Homo sapiens
gagatcggtaaagagcatgcac

SEQ ID NO: 7848005 - DNA, 22 bp, Homo sapiens
gagatcggtaaagagcatgcac

SEQ ID NO: 7848006 - DNA, 18 bp, Homo sapiens
gagagggatccctcagga

SEQ ID NO: 7848007 - DNA, 22 bp, Homo sapiens
gagatcggtaaagagcatgcac

SEQ ID NO: 7848008 - DNA, 22 bp, Homo sapiens
gagatcttcaaggttttagata

SEQ ID NO: 7848009 - DNA, 22 bp, Homo sapiens
gagatgaatcattccatggtca

SEQ ID NO: 7848010 - DNA, 22 bp, Homo sapiens
gagatcttcaaggttttagata

SEQ ID NO: 7848011 - DNA, 22 bp, Homo sapiens
gagatgaatgtaaacaaaggca

SEQ ID NO: 7848012 - DNA, 22 bp, Homo sapiens
gagatgaatgtaaacaaaggca

SEQ ID NO: 7848013 - DNA, 22 bp, Homo sapiens
gagatgaatgtaaacaaaggca

SEQ ID NO: 7848014 - DNA, 22 bp, Homo sapiens
gagatgagtgggggatctctca

SEQ ID NO: 7848015 - DNA, 22 bp, Homo sapiens
gagatgagtgggggatctctca

SEQ ID NO: 7848016 - DNA, 22 bp, Homo sapiens
gagatgcagaaccctcaggagc

SEQ ID NO: 7848017 - DNA, 20 bp, Homo sapiens
gagatgcaagtgtatctgac

SEQ ID NO: 7848018 - DNA, 20 bp, Homo sapiens
gagatgcaagtgtatctgac

SEQ ID NO: 7848019 - DNA, 22 bp, Homo sapiens
gagatgcagaaccctcaggagc

SEQ ID NO: 7848020 - DNA, 22 bp, Homo sapiens
gagatgcagaaccctcaggagc

SEQ ID NO: 7848021 - DNA, 17 bp, Homo sapiens
gagatgctaatctgatc

SEQ ID NO: 7848022 - DNA, 22 bp, Homo sapiens
gagatgctgtcaggctatctgt

SEQ ID NO: 7848023 - DNA, 22 bp, Homo sapiens
gagagggagccagccaggaacc

SEQ ID NO: 7848024 - DNA, 22 bp, Homo sapiens
gagagggagccagccaggaacc

SEQ ID NO: 7848025 - DNA, 22 bp, Homo sapiens
gagaggcttgtgtgaagaacaa

SEQ ID NO: 7848026 - DNA, 22 bp, Homo sapiens
gagaggcttaagggctgtgaag

SEQ ID NO: 7848027 - DNA, 22 bp, Homo sapiens
gagaggcttaagggctgtgaag

SEQ ID NO: 7848028 - DNA, 22 bp, Homo sapiens
gagaggcttaagggctgtgaag

SEQ ID NO: 7848029 - DNA, 22 bp, Homo sapiens
gagatcctgtaggcagctaaga

SEQ ID NO: 7848030 - DNA, 22 bp, Homo sapiens
gagagggatactgagttttggt

SEQ ID NO: 7848031 - DNA, 22 bp, Homo sapiens
gagaggctgggttggagatcga

SEQ ID NO: 7848032 - DNA, 22 bp, Homo sapiens
gagaggctgggttggagatcga

SEQ ID NO: 7848033 - DNA, 22 bp, Homo sapiens
gagaggctgggttggagatcga

SEQ ID NO: 7848034 - DNA, 22 bp, Homo sapiens
gagaggcttaagggctgtgaag

SEQ ID NO: 7848035 - DNA, 22 bp, Homo sapiens
gagaggctgtgtgccattgttg

SEQ ID NO: 7848036 - DNA, 22 bp, Homo sapiens
gagaggctgtgtgccattgttg

SEQ ID NO: 7848037 - DNA, 22 bp, Homo sapiens
gagaggctggtaaagtctgaac

SEQ ID NO: 7848038 - DNA, 22 bp, Homo sapiens
gagaggctggtaaagtctgaac

SEQ ID NO: 7848039 - DNA, 22 bp, Homo sapiens
gagaggctggtaaagtctgaac

SEQ ID NO: 7848040 - DNA, 22 bp, Homo sapiens
gagaggccctgtggtcccagct

SEQ ID NO: 7848041 - DNA, 22 bp, Homo sapiens
gagaggccctgtggtcccagct

SEQ ID NO: 7848042 - DNA, 22 bp, Homo sapiens
gagaggccctgtggtcccagct

SEQ ID NO: 7848043 - DNA, 22 bp, Homo sapiens
gagaggccctgtggtcccagct

SEQ ID NO: 7848044 - DNA, 22 bp, Homo sapiens
gagaggccctgtggtcccagct

SEQ ID NO: 7848045 - DNA, 22 bp, Homo sapiens
gagaggccggcgtcgctgcggc

SEQ ID NO: 7848046 - DNA, 22 bp, Homo sapiens
gagaggcctgagaggctgcgga

SEQ ID NO: 7848047 - DNA, 22 bp, Homo sapiens
gagaggcctgagaggctgcgga

SEQ ID NO: 7848048 - DNA, 22 bp, Homo sapiens
gagaggcctgagaggctgcgga

SEQ ID NO: 7848049 - DNA, 22 bp, Homo sapiens
gagaggccctgaagcccacaga

SEQ ID NO: 7848050 - DNA, 22 bp, Homo sapiens
gagaggccctgaagcccacaga

SEQ ID NO: 7848051 - DNA, 22 bp, Homo sapiens
gagaggccctgaagcccacaga

SEQ ID NO: 7848052 - DNA, 22 bp, Homo sapiens
gagaggccctgaagcccacaga

SEQ ID NO: 7848053 - DNA, 18 bp, Homo sapiens
gagaggcccggctgtgcc

SEQ ID NO: 7848054 - DNA, 18 bp, Homo sapiens
gagaggcccggctgtgcc

SEQ ID NO: 7848055 - DNA, 18 bp, Homo sapiens
gagaggcccggctgtgcc

SEQ ID NO: 7848056 - DNA, 18 bp, Homo sapiens
gagaggcccggctgtgcc

SEQ ID NO: 7848057 - DNA, 18 bp, Homo sapiens
gagaggcccggctgtgcc

SEQ ID NO: 7848058 - DNA, 22 bp, Homo sapiens
gagaggccatggggtgggatgc

SEQ ID NO: 7848059 - DNA, 22 bp, Homo sapiens
gagaggccatggggtgggatgc

SEQ ID NO: 7848060 - DNA, 19 bp, Homo sapiens
gagaggcctgtgcttgaag

SEQ ID NO: 7848061 - DNA, 19 bp, Homo sapiens
gagaggcctgtgcttgaag

SEQ ID NO: 7848062 - DNA, 22 bp, Homo sapiens
gagaggctatgaggttctgtgt

SEQ ID NO: 7848063 - DNA, 22 bp, Homo sapiens
gagaggctatgaggttctgtgt

SEQ ID NO: 7848064 - DNA, 22 bp, Homo sapiens
gagaggctcagggacttgctga

SEQ ID NO: 7848065 - DNA, 22 bp, Homo sapiens
gagaggcctgagaggctgcgga

SEQ ID NO: 7848066 - DNA, 21 bp, Homo sapiens
gagaggcctgggcccgtgagc

SEQ ID NO: 7848067 - DNA, 21 bp, Homo sapiens
gagaggcctgggcccgtgagc

SEQ ID NO: 7848068 - DNA, 21 bp, Homo sapiens
gagaggcctgggcccgtgagc

SEQ ID NO: 7848069 - DNA, 22 bp, Homo sapiens
gagaggcctgggcccgtgagct

SEQ ID NO: 7848070 - DNA, 22 bp, Homo sapiens
gagaggcctgggcccgtgagct

SEQ ID NO: 7848071 - DNA, 22 bp, Homo sapiens
gagaggcctgggcccgtgagct

SEQ ID NO: 7848072 - DNA, 22 bp, Homo sapiens
gagaggcctgggcccgtgagct

SEQ ID NO: 7848073 - DNA, 19 bp, Homo sapiens
gagaggcctgtgcttgaag

SEQ ID NO: 7848074 - DNA, 22 bp, Homo sapiens
gagacacaaacacatttagagg

SEQ ID NO: 7848075 - DNA, 22 bp, Homo sapiens
gagacacaaacacatttagagg

SEQ ID NO: 7848076 - DNA, 22 bp, Homo sapiens
gagacacaaacacatttagagg

SEQ ID NO: 7848077 - DNA, 22 bp, Homo sapiens
gagacaatttctaagatgcttc

SEQ ID NO: 7848078 - DNA, 22 bp, Homo sapiens
gagacaatttctaagatgcttc

SEQ ID NO: 7848079 - DNA, 22 bp, Homo sapiens
gagacaaaagttggagtgcaag

SEQ ID NO: 7848080 - DNA, 22 bp, Homo sapiens
gagacaaagcttcctgtgggta

SEQ ID NO: 7848081 - DNA, 22 bp, Homo sapiens
gagaggcaggcgctgcaatggt

SEQ ID NO: 7848082 - DNA, 22 bp, Homo sapiens
gagaggcatggaacagattctt

SEQ ID NO: 7848083 - DNA, 22 bp, Homo sapiens
gagaggcatggaacagattctt

SEQ ID NO: 7848084 - DNA, 22 bp, Homo sapiens
gagaggcatggaacagattctt

SEQ ID NO: 7848085 - DNA, 22 bp, Homo sapiens
gagaggcatggaacagattctt

SEQ ID NO: 7848086 - DNA, 22 bp, Homo sapiens
gagaggccaaaatccctgcccc

SEQ ID NO: 7848087 - DNA, 22 bp, Homo sapiens
gagaggccaagggatccgtgag

SEQ ID NO: 7848088 - DNA, 22 bp, Homo sapiens
gagaggccacctgacgagcagt

SEQ ID NO: 7848089 - DNA, 22 bp, Homo sapiens
gagaggccacctgacgagcagt

SEQ ID NO: 7848090 - DNA, 22 bp, Homo sapiens
gagaggccacctgacgagcagt

SEQ ID NO: 7848091 - DNA, 22 bp, Homo sapiens
gagaggccatggctgtgcagtg

SEQ ID NO: 7848092 - DNA, 22 bp, Homo sapiens
gagaggccacctgacgagcagt

SEQ ID NO: 7848093 - DNA, 22 bp, Homo sapiens
gagaggccatggggtgggatgc

SEQ ID NO: 7848094 - DNA, 22 bp, Homo sapiens
gagaggccatggggtgggatgc

SEQ ID NO: 7848095 - DNA, 22 bp, Homo sapiens
gagaggccatggctgtgcagtg

SEQ ID NO: 7848096 - DNA, 22 bp, Homo sapiens
gagaggccatggggtgggatgc

SEQ ID NO: 7848097 - DNA, 22 bp, Homo sapiens
gagaggccatggctgtgcagtg

SEQ ID NO: 7848098 - DNA, 22 bp, Homo sapiens
gagaggccatggggtgggatgc

SEQ ID NO: 7848099 - DNA, 22 bp, Homo sapiens
gagaggccatggctgtgcagtg

SEQ ID NO: 7848100 - DNA, 22 bp, Homo sapiens
gagaggccatggctgtgcagtg

SEQ ID NO: 7848101 - DNA, 22 bp, Homo sapiens
gagaggccatggctgtgcagtg

SEQ ID NO: 7848102 - DNA, 22 bp, Homo sapiens
gagaggccatggctgtgcagtg

SEQ ID NO: 7848103 - DNA, 22 bp, Homo sapiens
gagaaggggtgatgtgggtaat

SEQ ID NO: 7848104 - DNA, 22 bp, Homo sapiens
gagaatctctttgacaagcaga

SEQ ID NO: 7848105 - DNA, 22 bp, Homo sapiens
gagaatctccagatgaagtcct

SEQ ID NO: 7848106 - DNA, 22 bp, Homo sapiens
gagaatctgggttttggctatc

SEQ ID NO: 7848107 - DNA, 22 bp, Homo sapiens
gagaatctgggttttggctatc

SEQ ID NO: 7848108 - DNA, 19 bp, Homo sapiens
gagaatctctttgatgttt

SEQ ID NO: 7848109 - DNA, 22 bp, Homo sapiens
gagaatctctttgacaagcaga

SEQ ID NO: 7848110 - DNA, 22 bp, Homo sapiens
gagaagggggctcgagtgtcct

SEQ ID NO: 7848111 - DNA, 22 bp, Homo sapiens
gagaagggggctcgagtgtcct

SEQ ID NO: 7848112 - DNA, 22 bp, Homo sapiens
gagaagggggctcgagtgtcct

SEQ ID NO: 7848113 - DNA, 22 bp, Homo sapiens
gagaagggggctcgagtgtcct

SEQ ID NO: 7848114 - DNA, 22 bp, Homo sapiens
gagaatgtggagcctgtggttg

SEQ ID NO: 7848115 - DNA, 22 bp, Homo sapiens
gagaatgtggagcctgtggttg

SEQ ID NO: 7848116 - DNA, 22 bp, Homo sapiens
gagaatgggaatgaaagtagca

SEQ ID NO: 7848117 - DNA, 22 bp, Homo sapiens
gagaatgggaatgaaagtagca

SEQ ID NO: 7848118 - DNA, 22 bp, Homo sapiens
gagaatctttccccacagaagg

SEQ ID NO: 7848119 - DNA, 22 bp, Homo sapiens
gagaatctttccccacagaagg

SEQ ID NO: 7848120 - DNA, 22 bp, Homo sapiens
gagaatctgggttttggctatc

SEQ ID NO: 7848121 - DNA, 21 bp, Homo sapiens
gagaatctgttttcttgtctt

SEQ ID NO: 7848122 - DNA, 22 bp, Homo sapiens
gagaatgccttggaagaagtcc

SEQ ID NO: 7848123 - DNA, 22 bp, Homo sapiens
gagaatgctggagatttatttt

SEQ ID NO: 7848124 - DNA, 22 bp, Homo sapiens
gagaatttcccagtctgtgctg

SEQ ID NO: 7848125 - DNA, 22 bp, Homo sapiens
gagaattcttcaacaaagtatt

SEQ ID NO: 7848126 - DNA, 22 bp, Homo sapiens
gagaatgttaatgttgaagtat

SEQ ID NO: 7848127 - DNA, 22 bp, Homo sapiens
gagaatgttaatgttgaagtat

SEQ ID NO: 7848128 - DNA, 22 bp, Homo sapiens
gagaattactgtttttataaca

SEQ ID NO: 7848129 - DNA, 22 bp, Homo sapiens
gagaattagggcgtaattcaga

SEQ ID NO: 7848130 - DNA, 22 bp, Homo sapiens
gagaattagggcgtaattcaga

SEQ ID NO: 7848131 - DNA, 22 bp, Homo sapiens
gagaattagggcgtaattcaga

SEQ ID NO: 7848132 - DNA, 22 bp, Homo sapiens
gagaattttctagtagtttcat

SEQ ID NO: 7848133 - DNA, 22 bp, Homo sapiens
gagacaaaagttggagtgcaag

SEQ ID NO: 7848134 - DNA, 22 bp, Homo sapiens
gagacaaaagttggagtgcaag

SEQ ID NO: 7848135 - DNA, 22 bp, Homo sapiens
gagacaaaagttggagtgcaag

SEQ ID NO: 7848136 - DNA, 22 bp, Homo sapiens
gagaagggcttgggagtcaaca

SEQ ID NO: 7848137 - DNA, 22 bp, Homo sapiens
gagaagggcttgggagtcaaca

SEQ ID NO: 7848138 - DNA, 22 bp, Homo sapiens
gagaagggggctcgagtgtcct

SEQ ID NO: 7848139 - DNA, 22 bp, Homo sapiens
gagaagggatatgccactctcg

SEQ ID NO: 7848140 - DNA, 22 bp, Homo sapiens
gagaagggatatgccactctcg

SEQ ID NO: 7848141 - DNA, 22 bp, Homo sapiens
gagaagggatatgccactctcg

SEQ ID NO: 7848142 - DNA, 22 bp, Homo sapiens
gagaagggatatgccactctcg

SEQ ID NO: 7848143 - DNA, 22 bp, Homo sapiens
gagaagggatatgccactctcg

SEQ ID NO: 7848144 - DNA, 22 bp, Homo sapiens
gagaagggatatggcttcttga

SEQ ID NO: 7848145 - DNA, 22 bp, Homo sapiens
gagaagggatatggcttcttga

SEQ ID NO: 7848146 - DNA, 22 bp, Homo sapiens
gagaagggatatggcttcttga

SEQ ID NO: 7848147 - DNA, 22 bp, Homo sapiens
gagaagggcttgggagtcaaca

SEQ ID NO: 7848148 - DNA, 22 bp, Homo sapiens
gagaaggcttccaaattctgtg

SEQ ID NO: 7848149 - DNA, 22 bp, Homo sapiens
gagaaggcttcttttcctctga

SEQ ID NO: 7848150 - DNA, 22 bp, Homo sapiens
gagaaggcttcttttcctctga

SEQ ID NO: 7848151 - DNA, 22 bp, Homo sapiens
gagaaggctggtcttaagtcga

SEQ ID NO: 7848152 - DNA, 22 bp, Homo sapiens
gagaaggctggtcttaagtcga

SEQ ID NO: 7848153 - DNA, 22 bp, Homo sapiens
gagaaggctgatccttggagtt

SEQ ID NO: 7848154 - DNA, 22 bp, Homo sapiens
gagaaggccaggaacccagtgt

SEQ ID NO: 7848155 - DNA, 22 bp, Homo sapiens
gagaaggccaggaacccagtgt

SEQ ID NO: 7848156 - DNA, 22 bp, Homo sapiens
gagaaggctgatccttggagtt

SEQ ID NO: 7848157 - DNA, 22 bp, Homo sapiens
gagaaggctgatccttggagtt

SEQ ID NO: 7848158 - DNA, 22 bp, Homo sapiens
gagaaggctgatccttggagtt

SEQ ID NO: 7848159 - DNA, 22 bp, Homo sapiens
gagaaggctgatccttggagtt

SEQ ID NO: 7848160 - DNA, 18 bp, Homo sapiens
gagaaggccacttgtttt

SEQ ID NO: 7848161 - DNA, 22 bp, Homo sapiens
gagaaggatgtggctcatagct

SEQ ID NO: 7848162 - DNA, 22 bp, Homo sapiens
gacctcagtgaatggtcatgta

SEQ ID NO: 7848163 - DNA, 16 bp, Homo sapiens
gacctcagtgctggct

SEQ ID NO: 7848164 - DNA, 16 bp, Homo sapiens
gacctcagtgctggct

SEQ ID NO: 7848165 - DNA, 22 bp, Homo sapiens
gacctcatctgaacatatgcaa

SEQ ID NO: 7848166 - DNA, 22 bp, Homo sapiens
gacctcagtgaatggtcatgta

SEQ ID NO: 7848167 - DNA, 22 bp, Homo sapiens
gacctcagtgaatggtcatgta

SEQ ID NO: 7848168 - DNA, 22 bp, Homo sapiens
gacctcagtgaatggtcatgta

SEQ ID NO: 7848169 - DNA, 22 bp, Homo sapiens
gacctcatgatccacctgcctt

SEQ ID NO: 7848170 - DNA, 22 bp, Homo sapiens
gacctcatgatccacctgcctt

SEQ ID NO: 7848171 - DNA, 22 bp, Homo sapiens
gacctcatgatccacctgcctt

SEQ ID NO: 7848172 - DNA, 22 bp, Homo sapiens
gacctcatgatccacctgcctt

SEQ ID NO: 7848173 - DNA, 22 bp, Homo sapiens
gacctcagattttcccaggcca

SEQ ID NO: 7848174 - DNA, 22 bp, Homo sapiens
gacctcagctgtggggatgctg

SEQ ID NO: 7848175 - DNA, 22 bp, Homo sapiens
gacctcaggcttctgtaattaa

SEQ ID NO: 7848176 - DNA, 22 bp, Homo sapiens
gacctcagctgtggggatgctg

SEQ ID NO: 7848177 - DNA, 22 bp, Homo sapiens
gacctcagtattgttcaggatg

SEQ ID NO: 7848178 - DNA, 22 bp, Homo sapiens
gacctcagtattgttcaggatg

SEQ ID NO: 7848179 - DNA, 22 bp, Homo sapiens
gacctcagtattgttcaggatg

SEQ ID NO: 7848180 - DNA, 17 bp, Homo sapiens
gacctcaggtgatctgc

SEQ ID NO: 7848181 - DNA, 22 bp, Homo sapiens
gacctcaggtttgtaatggaca

SEQ ID NO: 7848182 - DNA, 22 bp, Homo sapiens
gacctccgtgtacacctcccag

SEQ ID NO: 7848183 - DNA, 22 bp, Homo sapiens
gacctccgtgtacacctcccag

SEQ ID NO: 7848184 - DNA, 22 bp, Homo sapiens
gacctccgtgtacacctcccag

SEQ ID NO: 7848185 - DNA, 22 bp, Homo sapiens
gacctctcaggaatctcacatg

SEQ ID NO: 7848186 - DNA, 22 bp, Homo sapiens
gacctcgtgatctgccagcctt

SEQ ID NO: 7848187 - DNA, 22 bp, Homo sapiens
gacctcgtgatctgccggcctt

SEQ ID NO: 7848188 - DNA, 22 bp, Homo sapiens
gacctcgtgatccgccctcctt

SEQ ID NO: 7848189 - DNA, 22 bp, Homo sapiens
gacctcgtgatccgccctcctt

SEQ ID NO: 7848190 - DNA, 22 bp, Homo sapiens
gacctcgtgatccgcccgcttt

SEQ ID NO: 7848191 - DNA, 22 bp, Homo sapiens
gacctccagcggccctgcagag

SEQ ID NO: 7848192 - DNA, 22 bp, Homo sapiens
gacctccagcggccctgcagag

SEQ ID NO: 7848193 - DNA, 22 bp, Homo sapiens
gacctccattctgtcatgactg

SEQ ID NO: 7848194 - DNA, 22 bp, Homo sapiens
gacctccagcggccctgcagag

SEQ ID NO: 7848195 - DNA, 22 bp, Homo sapiens
gacctccagcggccctgcagag

SEQ ID NO: 7848196 - DNA, 22 bp, Homo sapiens
gacctcatgatccacctgcctt

SEQ ID NO: 7848197 - DNA, 22 bp, Homo sapiens
gacctcatgatccacctgcctt

SEQ ID NO: 7848198 - DNA, 22 bp, Homo sapiens
gacctcttgcaccctggctctt

SEQ ID NO: 7848199 - DNA, 22 bp, Homo sapiens
gagaaggactacggaaaacaga

SEQ ID NO: 7848200 - DNA, 22 bp, Homo sapiens
gagaaggactacggaaaacaga

SEQ ID NO: 7848201 - DNA, 22 bp, Homo sapiens
gagaaggactacacatctggcc

SEQ ID NO: 7848202 - DNA, 22 bp, Homo sapiens
gagaaggactacacatctggcc

SEQ ID NO: 7848203 - DNA, 22 bp, Homo sapiens
gagaaggatgaggaaatggtat

SEQ ID NO: 7848204 - DNA, 22 bp, Homo sapiens
gagaaggatgtggctcatagct

SEQ ID NO: 7848205 - DNA, 22 bp, Homo sapiens
gagaaggatgtggctcatagct

SEQ ID NO: 7848206 - DNA, 22 bp, Homo sapiens
gagaaggatgtggctcatagct

SEQ ID NO: 7848207 - DNA, 22 bp, Homo sapiens
gagaaggatgaggaaatggtat

SEQ ID NO: 7848208 - DNA, 22 bp, Homo sapiens
gagaaggaggcgaagcgtgtgc

SEQ ID NO: 7848209 - DNA, 22 bp, Homo sapiens
gagaaggaggcgaagcgtgtgc

SEQ ID NO: 7848210 - DNA, 22 bp, Homo sapiens
gagaaggagctcaaatatggct

SEQ ID NO: 7848211 - DNA, 22 bp, Homo sapiens
gagaaggagctcaaatatggct

SEQ ID NO: 7848212 - DNA, 22 bp, Homo sapiens
gagcagcaggtggggctggctt

SEQ ID NO: 7848213 - DNA, 22 bp, Homo sapiens
gagcagcaggtggggctggctt

SEQ ID NO: 7848214 - DNA, 22 bp, Homo sapiens
gagcagcagttgttacaatgat

SEQ ID NO: 7848215 - DNA, 22 bp, Homo sapiens
gagcagcatctccggcttaaag

SEQ ID NO: 7848216 - DNA, 22 bp, Homo sapiens
gagcagcagttgttacaatgat

SEQ ID NO: 7848217 - DNA, 22 bp, Homo sapiens
gagcagcaggtggggctggctt

SEQ ID NO: 7848218 - DNA, 22 bp, Homo sapiens
gagcagcaggtggctgtgatgg

SEQ ID NO: 7848219 - DNA, 22 bp, Homo sapiens
gagcagcaggtggctgtgatgg

SEQ ID NO: 7848220 - DNA, 22 bp, Homo sapiens
gagcagcaggtggctgtgatgg

SEQ ID NO: 7848221 - DNA, 22 bp, Homo sapiens
gagcagcaggtggggctggctt

SEQ ID NO: 7848222 - DNA, 22 bp, Homo sapiens
gagcagcaggtggggctggctt

SEQ ID NO: 7848223 - DNA, 22 bp, Homo sapiens
gagcagcaggtggctgtgatgg

SEQ ID NO: 7848224 - DNA, 22 bp, Homo sapiens
gagcagcaggtggggctggctt

SEQ ID NO: 7848225 - DNA, 22 bp, Homo sapiens
gagcagcaggtggggctggctt

SEQ ID NO: 7848226 - DNA, 22 bp, Homo sapiens
gagcagcagctgggccaggttc

SEQ ID NO: 7848227 - DNA, 18 bp, Homo sapiens
gagcagcaggatcaagaa

SEQ ID NO: 7848228 - DNA, 18 bp, Homo sapiens
gagcagcaggatcaagaa

SEQ ID NO: 7848229 - DNA, 22 bp, Homo sapiens
gagcagcagctgggccaggttc

SEQ ID NO: 7848230 - DNA, 22 bp, Homo sapiens
gagcagcagctgggccaggttc

SEQ ID NO: 7848231 - DNA, 22 bp, Homo sapiens
gagcagcagctgggccaggttc

SEQ ID NO: 7848232 - DNA, 22 bp, Homo sapiens
gagcagcaggccaggttgcagg

SEQ ID NO: 7848233 - DNA, 22 bp, Homo sapiens
gagcagcaggccaggttgcagg

SEQ ID NO: 7848234 - DNA, 22 bp, Homo sapiens
gagcagcaggccaggttgcagg

SEQ ID NO: 7848235 - DNA, 22 bp, Homo sapiens
gagcagcaggtggctgtgatgg

SEQ ID NO: 7848236 - DNA, 18 bp, Homo sapiens
gagcagcaggatcaagaa

SEQ ID NO: 7848237 - DNA, 22 bp, Homo sapiens
gagcagcagctgggccaggttc

SEQ ID NO: 7848238 - DNA, 22 bp, Homo sapiens
gagcagcaggccaggttgcagg

SEQ ID NO: 7848239 - DNA, 23 bp, Homo sapiens
gagatttagcagacaaagctctt

SEQ ID NO: 7848240 - DNA, 23 bp, Homo sapiens
gagatttagcagacaaagctctt

SEQ ID NO: 7848241 - DNA, 22 bp, Homo sapiens
gagatttagagagacttaaaca

SEQ ID NO: 7848242 - DNA, 23 bp, Homo sapiens
gagatttagcagacaaagctctt

SEQ ID NO: 7848243 - DNA, 22 bp, Homo sapiens
gagcagagtctatttccacact

SEQ ID NO: 7848244 - DNA, 22 bp, Homo sapiens
gagcagagtctatttccacact

SEQ ID NO: 7848245 - DNA, 22 bp, Homo sapiens
gagcagagtctatttccacact

SEQ ID NO: 7848246 - DNA, 22 bp, Homo sapiens
gagcagagtctatttccacact

SEQ ID NO: 7848247 - DNA, 22 bp, Homo sapiens
gagcagcaaagggagggtaaat

SEQ ID NO: 7848248 - DNA, 22 bp, Homo sapiens
gagcagatgtgtgccaggatgc

SEQ ID NO: 7848249 - DNA, 22 bp, Homo sapiens
gagcagatctcaggccttctgt

SEQ ID NO: 7848250 - DNA, 22 bp, Homo sapiens
gagcagcactgagttagcagct

SEQ ID NO: 7848251 - DNA, 22 bp, Homo sapiens
gagcagcactgagttagcagct

SEQ ID NO: 7848252 - DNA, 22 bp, Homo sapiens
gagcagcactgagttagcagct

SEQ ID NO: 7848253 - DNA, 22 bp, Homo sapiens
gagcagcactgagttagcagct

SEQ ID NO: 7848254 - DNA, 22 bp, Homo sapiens
gagcagcaagcactcaaaggct

SEQ ID NO: 7848255 - DNA, 22 bp, Homo sapiens
gagcagcaagcactcaaaggct

SEQ ID NO: 7848256 - DNA, 22 bp, Homo sapiens
gagcagcaaagggagggtaaat

SEQ ID NO: 7848257 - DNA, 22 bp, Homo sapiens
gagcagcagctgggccaggttc

SEQ ID NO: 7848258 - DNA, 22 bp, Homo sapiens
gagcagcagattgtctccatgg

SEQ ID NO: 7848259 - DNA, 22 bp, Homo sapiens
gagcagcacttgaggcatgtca

SEQ ID NO: 7848260 - DNA, 22 bp, Homo sapiens
gagcagcacttgaggcatgtca

SEQ ID NO: 7848261 - DNA, 22 bp, Homo sapiens
gagcagcagattgtctccatgg

SEQ ID NO: 7848262 - DNA, 22 bp, Homo sapiens
gagcagcacttgaggcatgtca

SEQ ID NO: 7848263 - DNA, 22 bp, Homo sapiens
gagatggagtctttttctgtca

SEQ ID NO: 7848264 - DNA, 22 bp, Homo sapiens
gagatggagtctttttctgtca

SEQ ID NO: 7848265 - DNA, 22 bp, Homo sapiens
gagatggagtctttttctgtca

SEQ ID NO: 7848266 - DNA, 22 bp, Homo sapiens
gagatggagtctttttctgtca

SEQ ID NO: 7848267 - DNA, 22 bp, Homo sapiens
gagatggagtctttttctgtca

SEQ ID NO: 7848268 - DNA, 22 bp, Homo sapiens
gagatggagtctttttctgtca

SEQ ID NO: 7848269 - DNA, 22 bp, Homo sapiens
gagatggtgttccactgccagt

SEQ ID NO: 7848270 - DNA, 22 bp, Homo sapiens
gagatggttgcaatagtttaaa

SEQ ID NO: 7848271 - DNA, 22 bp, Homo sapiens
gagatggttgggttaacaacta

SEQ ID NO: 7848272 - DNA, 22 bp, Homo sapiens
gagatggagtctttttctgtca

SEQ ID NO: 7848273 - DNA, 22 bp, Homo sapiens
gagatggagtctttttctgtca

SEQ ID NO: 7848274 - DNA, 22 bp, Homo sapiens
gagatggagtctttttctgtca

SEQ ID NO: 7848275 - DNA, 22 bp, Homo sapiens
gagatggagtctttttctgtca

SEQ ID NO: 7848276 - DNA, 22 bp, Homo sapiens
gagatggagtctttttctgtca

SEQ ID NO: 7848277 - DNA, 22 bp, Homo sapiens
gagatggagtctttttctgtca

SEQ ID NO: 7848278 - DNA, 22 bp, Homo sapiens
gagatggagtctttttctgtca

SEQ ID NO: 7848279 - DNA, 22 bp, Homo sapiens
gagatggagaaggaagctgttt

SEQ ID NO: 7848280 - DNA, 22 bp, Homo sapiens
gagatggagtctttttctgtca

SEQ ID NO: 7848281 - DNA, 22 bp, Homo sapiens
gagatggagaaggaagctgttt

SEQ ID NO: 7848282 - DNA, 22 bp, Homo sapiens
gagatggagaaggaagctgttt

SEQ ID NO: 7848283 - DNA, 20 bp, Homo sapiens
gagatggacagatgaagggg

SEQ ID NO: 7848284 - DNA, 22 bp, Homo sapiens
gagatggaatctgtgtggaggg

SEQ ID NO: 7848285 - DNA, 22 bp, Homo sapiens
gagatggaatctgtgtggaggg

SEQ ID NO: 7848286 - DNA, 22 bp, Homo sapiens
gagatggaaaactgctggtagt

SEQ ID NO: 7848287 - DNA, 22 bp, Homo sapiens
gagatgcttttggtccaagagt

SEQ ID NO: 7848288 - DNA, 22 bp, Homo sapiens
gagatggaaaactgctggtagt

SEQ ID NO: 7848289 - DNA, 20 bp, Homo sapiens
gagatggacagatgaagggg

SEQ ID NO: 7848290 - DNA, 20 bp, Homo sapiens
gagatggacagatgaagggg

SEQ ID NO: 7848291 - DNA, 20 bp, Homo sapiens
gagatggacagatgaagggg

SEQ ID NO: 7848292 - DNA, 20 bp, Homo sapiens
gagatggacagatgaagggg

SEQ ID NO: 7848293 - DNA, 20 bp, Homo sapiens
gagatggacagatgaagggg

SEQ ID NO: 7848294 - DNA, 20 bp, Homo sapiens
gagatggacagatgaagggg

SEQ ID NO: 7848295 - DNA, 22 bp, Homo sapiens
gagattgggtcttgctctgtca

SEQ ID NO: 7848296 - DNA, 22 bp, Homo sapiens
gagattggcctggcttgccaac

SEQ ID NO: 7848297 - DNA, 22 bp, Homo sapiens
gagattgtttagctaccatggc

SEQ ID NO: 7848298 - DNA, 21 bp, Homo sapiens
gagatttagaaggatcaattt

SEQ ID NO: 7848299 - DNA, 21 bp, Homo sapiens
gagatttagaaggatcaattt

SEQ ID NO: 7848300 - DNA, 22 bp, Homo sapiens
gagattctgtagtcaggcatct

SEQ ID NO: 7848301 - DNA, 22 bp, Homo sapiens
gagattctgtgaaacggacatt

SEQ ID NO: 7848302 - DNA, 22 bp, Homo sapiens
gagattctgtagtcaggcatct

SEQ ID NO: 7848303 - DNA, 22 bp, Homo sapiens
gagattctgagaagttaagtcc

SEQ ID NO: 7848304 - DNA, 22 bp, Homo sapiens
gagattctggttaggtgtattt

SEQ ID NO: 7848305 - DNA, 22 bp, Homo sapiens
gagattctcgagggcttccagc

SEQ ID NO: 7848306 - DNA, 23 bp, Homo sapiens
gagattctcctgttgtcaagtct

SEQ ID NO: 7848307 - DNA, 22 bp, Homo sapiens
gagatgtttagggtggggagag

SEQ ID NO: 7848308 - DNA, 22 bp, Homo sapiens
gagatgtttagatgtttgtcca

SEQ ID NO: 7848309 - DNA, 20 bp, Homo sapiens
gagattaactgagaatctag

SEQ ID NO: 7848310 - DNA, 22 bp, Homo sapiens
gagattagagttgtttcattgt

SEQ ID NO: 7848311 - DNA, 22 bp, Homo sapiens
gagatgttttgctgagaatggg

SEQ ID NO: 7848312 - DNA, 22 bp, Homo sapiens
gagattctaatataaggatggg

SEQ ID NO: 7848313 - DNA, 22 bp, Homo sapiens
gagattctaatataaggatggg

SEQ ID NO: 7848314 - DNA, 22 bp, Homo sapiens
gagattcagtaaccaatatggt

SEQ ID NO: 7848315 - DNA, 22 bp, Homo sapiens
gagattatggagaggacattct

SEQ ID NO: 7848316 - DNA, 22 bp, Homo sapiens
gagatgttattcttcagtgtgt

SEQ ID NO: 7848317 - DNA, 22 bp, Homo sapiens
gagatgttctgattaggtttcc

SEQ ID NO: 7848318 - DNA, 22 bp, Homo sapiens
gagatgttattcttcagtgtgt

SEQ ID NO: 7848319 - DNA, 22 bp, Homo sapiens
gagatgttgttcaaagatttta

SEQ ID NO: 7848320 - DNA, 22 bp, Homo sapiens
gagatgttgtgggtagttttgg

SEQ ID NO: 7848321 - DNA, 22 bp, Homo sapiens
gagatgttaactacatagctac

SEQ ID NO: 7848322 - DNA, 22 bp, Homo sapiens
gagatgttaactacatagctac

SEQ ID NO: 7848323 - DNA, 21 bp, Homo sapiens
gagatgtgagctctgatagtc

SEQ ID NO: 7848324 - DNA, 22 bp, Homo sapiens
gagccagggtttgaaactagac

SEQ ID NO: 7848325 - DNA, 22 bp, Homo sapiens
gagccagggtttgaaactagac

SEQ ID NO: 7848326 - DNA, 22 bp, Homo sapiens
gagccaggggtcagctccgagg

SEQ ID NO: 7848327 - DNA, 22 bp, Homo sapiens
gagccaggggtcagctccgagg

SEQ ID NO: 7848328 - DNA, 22 bp, Homo sapiens
gagccaggggtcagctccgagg

SEQ ID NO: 7848329 - DNA, 22 bp, Homo sapiens
gagccagggctgtgagctgagc

SEQ ID NO: 7848330 - DNA, 22 bp, Homo sapiens
gagccagggctgtgagctgagc

SEQ ID NO: 7848331 - DNA, 22 bp, Homo sapiens
gagccaggggtcagctccgagg

SEQ ID NO: 7848332 - DNA, 22 bp, Homo sapiens
gagccaggggtcagctccgagg

SEQ ID NO: 7848333 - DNA, 22 bp, Homo sapiens
gagccaggggtcagctccgagg

SEQ ID NO: 7848334 - DNA, 22 bp, Homo sapiens
gagccaggtcgggccgcggcga

SEQ ID NO: 7848335 - DNA, 22 bp, Homo sapiens
gagccaggtcgggccgcggcga

SEQ ID NO: 7848336 - DNA, 22 bp, Homo sapiens
gagccaggtcgggccgcggcga

SEQ ID NO: 7848337 - DNA, 16 bp, Homo sapiens
gagccaggtgccttga

SEQ ID NO: 7848338 - DNA, 22 bp, Homo sapiens
gagccaggttggaggctgcagt

SEQ ID NO: 7848339 - DNA, 22 bp, Homo sapiens
gagccaggttggaggctgcagt

SEQ ID NO: 7848340 - DNA, 22 bp, Homo sapiens
gagccaggttggaggctgcagt

SEQ ID NO: 7848341 - DNA, 22 bp, Homo sapiens
gagccaggttggaggctgcagt

SEQ ID NO: 7848342 - DNA, 22 bp, Homo sapiens
gagccaggttggaggctgcagt

SEQ ID NO: 7848343 - DNA, 22 bp, Homo sapiens
gagccaggttggaggctgcagt

SEQ ID NO: 7848344 - DNA, 22 bp, Homo sapiens
gagccaccttcaactcaggaat

SEQ ID NO: 7848345 - DNA, 22 bp, Homo sapiens
gagccactgttgggcactttcc

SEQ ID NO: 7848346 - DNA, 22 bp, Homo sapiens
gagccagaaaagctgcctgact

SEQ ID NO: 7848347 - DNA, 22 bp, Homo sapiens
gagccagaaaagctgcctgact

SEQ ID NO: 7848348 - DNA, 22 bp, Homo sapiens
gagccagactgcctgaagctca

SEQ ID NO: 7848349 - DNA, 22 bp, Homo sapiens
gagccagacaggctagagcggg

SEQ ID NO: 7848350 - DNA, 22 bp, Homo sapiens
gagccagagatccaggatggct

SEQ ID NO: 7848351 - DNA, 22 bp, Homo sapiens
gagccagactgcctgaagctca

SEQ ID NO: 7848352 - DNA, 22 bp, Homo sapiens
gagccagagatccaggatggct

SEQ ID NO: 7848353 - DNA, 22 bp, Homo sapiens
gagccagcagccggcaccacca

SEQ ID NO: 7848354 - DNA, 22 bp, Homo sapiens
gagccagattttatgcaagaca

SEQ ID NO: 7848355 - DNA, 22 bp, Homo sapiens
gagccagcagccggcaccacca

SEQ ID NO: 7848356 - DNA, 22 bp, Homo sapiens
gagccagagctacaagtgtctg

SEQ ID NO: 7848357 - DNA, 22 bp, Homo sapiens
gagccagccgcaagagctgtga

SEQ ID NO: 7848358 - DNA, 22 bp, Homo sapiens
gagccagcaggacttaagccag

SEQ ID NO: 7848359 - DNA, 22 bp, Homo sapiens
gagccagccgcaagagctgtga

SEQ ID NO: 7848360 - DNA, 22 bp, Homo sapiens
gagccagggctgtgagctgagc

SEQ ID NO: 7848361 - DNA, 22 bp, Homo sapiens
gagccaatctttgggctcttgg

SEQ ID NO: 7848362 - DNA, 22 bp, Homo sapiens
gagccacagcaacctcaaagga

SEQ ID NO: 7848363 - DNA, 22 bp, Homo sapiens
gagccacagcaacctcaaagga

SEQ ID NO: 7848364 - DNA, 22 bp, Homo sapiens
gagccacagactgtatttggga

SEQ ID NO: 7848365 - DNA, 22 bp, Homo sapiens
gagccacagcaacctcaaagga

SEQ ID NO: 7848366 - DNA, 22 bp, Homo sapiens
gagccacagaaggaaattgggg

SEQ ID NO: 7848367 - DNA, 22 bp, Homo sapiens
gagccaccttcaactcaggaat

SEQ ID NO: 7848368 - DNA, 22 bp, Homo sapiens
gagccacagtggtggcccacgt

SEQ ID NO: 7848369 - DNA, 22 bp, Homo sapiens
gagccacagtggtggcccacgt

SEQ ID NO: 7848370 - DNA, 22 bp, Homo sapiens
gagccacagtggattgattcca

SEQ ID NO: 7848371 - DNA, 20 bp, Homo sapiens
gagcagctgtttgcattgca

SEQ ID NO: 7848372 - DNA, 20 bp, Homo sapiens
gagcagctgtttgcattgca

SEQ ID NO: 7848373 - DNA, 22 bp, Homo sapiens
gagcagcttatgtcaagccaga

SEQ ID NO: 7848374 - DNA, 22 bp, Homo sapiens
gagcagcttatgtcaagccaga

SEQ ID NO: 7848375 - DNA, 22 bp, Homo sapiens
gagcagcttatgtcaagccaga

SEQ ID NO: 7848376 - DNA, 22 bp, Homo sapiens
gagccaagatcgcaccactgca

SEQ ID NO: 7848377 - DNA, 22 bp, Homo sapiens
gagccaagatcgcaccactgca

SEQ ID NO: 7848378 - DNA, 22 bp, Homo sapiens
gagcagcttatgtcaagccaga

SEQ ID NO: 7848379 - DNA, 22 bp, Homo sapiens
gagccaaatgtgcagacattgt

SEQ ID NO: 7848380 - DNA, 22 bp, Homo sapiens
gagcatttttgtctgcatttta

SEQ ID NO: 7848381 - DNA, 22 bp, Homo sapiens
gagccaagcaatatacccaacc

SEQ ID NO: 7848382 - DNA, 22 bp, Homo sapiens
gagccaagcaccacattaagtt

SEQ ID NO: 7848383 - DNA, 22 bp, Homo sapiens
gagccaagctcttctccatgag

SEQ ID NO: 7848384 - DNA, 22 bp, Homo sapiens
gagccaagggcgtgctggagag

SEQ ID NO: 7848385 - DNA, 22 bp, Homo sapiens
gagccaagctcttctccatgag

SEQ ID NO: 7848386 - DNA, 22 bp, Homo sapiens
gagcagctgttctgacttgtct

SEQ ID NO: 7848387 - DNA, 20 bp, Homo sapiens
gagcagctgtttgcattgca

SEQ ID NO: 7848388 - DNA, 22 bp, Homo sapiens
gagcagctgttctgacttgtct

SEQ ID NO: 7848389 - DNA, 22 bp, Homo sapiens
gagcagctgttctgacttgtct

SEQ ID NO: 7848390 - DNA, 22 bp, Homo sapiens
gagcagctgtggggttgaccat

SEQ ID NO: 7848391 - DNA, 22 bp, Homo sapiens
gagcagctgttctgacttgtct

SEQ ID NO: 7848392 - DNA, 22 bp, Homo sapiens
gagcagctgtggggttgaccat

SEQ ID NO: 7848393 - DNA, 22 bp, Homo sapiens
gagcagctggtaggtgaaccca

SEQ ID NO: 7848394 - DNA, 22 bp, Homo sapiens
gagcagctggtaggtgaaccca

SEQ ID NO: 7848395 - DNA, 22 bp, Homo sapiens
gagcagctggctgtattggttt

SEQ ID NO: 7848396 - DNA, 22 bp, Homo sapiens
gagcagctgtccccaaagcttc

SEQ ID NO: 7848397 - DNA, 22 bp, Homo sapiens
gagcagctggtaggtgaaccca

SEQ ID NO: 7848398 - DNA, 22 bp, Homo sapiens
gagcagctgtccccaaagcttc

SEQ ID NO: 7848399 - DNA, 22 bp, Homo sapiens
gagcagctgtccccaaagcttc

SEQ ID NO: 7848400 - DNA, 22 bp, Homo sapiens
gagcagctgtccccaaagcttc

SEQ ID NO: 7848401 - DNA, 22 bp, Homo sapiens
gagcagctgcagtgcagaccct

SEQ ID NO: 7848402 - DNA, 22 bp, Homo sapiens
gagcagctgcagtgcagaccct

SEQ ID NO: 7848403 - DNA, 22 bp, Homo sapiens
gagcagctgcagtgcagaccct

SEQ ID NO: 7848404 - DNA, 22 bp, Homo sapiens
gagcagcctgaggagcgtgggc

SEQ ID NO: 7848405 - DNA, 22 bp, Homo sapiens
gagcagccctagggcataagca

SEQ ID NO: 7848406 - DNA, 22 bp, Homo sapiens
gagcagccctagggcataagca

SEQ ID NO: 7848407 - DNA, 22 bp, Homo sapiens
gagcagctggacaggcctccct

SEQ ID NO: 7848408 - DNA, 22 bp, Homo sapiens
gagcagctggacaggcctccct

SEQ ID NO: 7848409 - DNA, 22 bp, Homo sapiens
gagcagctggacaggcctccct

SEQ ID NO: 7848410 - DNA, 22 bp, Homo sapiens
gagcagctggacaggcctccct

SEQ ID NO: 7848411 - DNA, 22 bp, Homo sapiens
gagcagctggctgtattggttt

SEQ ID NO: 7848412 - DNA, 22 bp, Homo sapiens
gagcagctggaggccttgttgg

SEQ ID NO: 7848413 - DNA, 22 bp, Homo sapiens
gagcagctggctgtattggttt

SEQ ID NO: 7848414 - DNA, 22 bp, Homo sapiens
gagcagctggaggccttgttgg

SEQ ID NO: 7848415 - DNA, 21 bp, Homo sapiens
gacaggggaagaagcaaggag

SEQ ID NO: 7848416 - DNA, 21 bp, Homo sapiens
gacaggggaagaagcaaggag

SEQ ID NO: 7848417 - DNA, 22 bp, Homo sapiens
gacagggctgtgggaggagcag

SEQ ID NO: 7848418 - DNA, 22 bp, Homo sapiens
gacagggctgtgggaggagcag

SEQ ID NO: 7848419 - DNA, 22 bp, Homo sapiens
gacagggctgtgggaggagcag

SEQ ID NO: 7848420 - DNA, 22 bp, Homo sapiens
gacagggctgtgggaggagcag

SEQ ID NO: 7848421 - DNA, 22 bp, Homo sapiens
gacagggctgtgggaggagcag

SEQ ID NO: 7848422 - DNA, 22 bp, Homo sapiens
gacagggacacagccagtgagg

SEQ ID NO: 7848423 - DNA, 22 bp, Homo sapiens
gacagggacacagccagtgagg

SEQ ID NO: 7848424 - DNA, 22 bp, Homo sapiens
gacagggacacagccagtgagg

SEQ ID NO: 7848425 - DNA, 22 bp, Homo sapiens
gacagggacgaggcttcaggca

SEQ ID NO: 7848426 - DNA, 21 bp, Homo sapiens
gacaggggaagaagcaaggag

SEQ ID NO: 7848427 - DNA, 21 bp, Homo sapiens
gacaggggaagaagcaaggag

SEQ ID NO: 7848428 - DNA, 21 bp, Homo sapiens
gacaggggaagaagcaaggag

SEQ ID NO: 7848429 - DNA, 21 bp, Homo sapiens
gacaggggccatgggtttcta

SEQ ID NO: 7848430 - DNA, 21 bp, Homo sapiens
gacaggggccatgggtttcta

SEQ ID NO: 7848431 - DNA, 21 bp, Homo sapiens
gacaggggccatgggtttcta

SEQ ID NO: 7848432 - DNA, 22 bp, Homo sapiens
gacaggggctttgcatgcttta

SEQ ID NO: 7848433 - DNA, 22 bp, Homo sapiens
gacaggggtccctctgggctgt

SEQ ID NO: 7848434 - DNA, 22 bp, Homo sapiens
gacaggggtccctctgggctgt

SEQ ID NO: 7848435 - DNA, 22 bp, Homo sapiens
gacaggggtccctctgggctgt

SEQ ID NO: 7848436 - DNA, 22 bp, Homo sapiens
gacaggggtccctctgggctgt

SEQ ID NO: 7848437 - DNA, 22 bp, Homo sapiens
gacagggaaacattgaagtgtc

SEQ ID NO: 7848438 - DNA, 22 bp, Homo sapiens
gacagggaacttcattagctgt

SEQ ID NO: 7848439 - DNA, 22 bp, Homo sapiens
gacagggaaacattgaagtgtc

SEQ ID NO: 7848440 - DNA, 22 bp, Homo sapiens
gacaggcttcctaagtgccaga

SEQ ID NO: 7848441 - DNA, 22 bp, Homo sapiens
gacaggcttcctaagtgccaga

SEQ ID NO: 7848442 - DNA, 22 bp, Homo sapiens
gacaggcttcatgatggcagga

SEQ ID NO: 7848443 - DNA, 22 bp, Homo sapiens
gacaggcttccactatgttgcc

SEQ ID NO: 7848444 - DNA, 22 bp, Homo sapiens
gacaggcttcctaagtgccaga

SEQ ID NO: 7848445 - DNA, 22 bp, Homo sapiens
gacaggcttcctaagtgccaga

SEQ ID NO: 7848446 - DNA, 22 bp, Homo sapiens
gacaggctattttcttacgggt

SEQ ID NO: 7848447 - DNA, 17 bp, Homo sapiens
gacaggctcagtgacga

SEQ ID NO: 7848448 - DNA, 22 bp, Homo sapiens
gacaggcttagggagggtgctc

SEQ ID NO: 7848449 - DNA, 22 bp, Homo sapiens
gacaggctgtgatggccgggag

SEQ ID NO: 7848450 - DNA, 22 bp, Homo sapiens
gacaggcttcatcctcagagtt

SEQ ID NO: 7848451 - DNA, 22 bp, Homo sapiens
gacaggcttcatgatggcagga

SEQ ID NO: 7848452 - DNA, 22 bp, Homo sapiens
gacaggcttagggagggtgctc

SEQ ID NO: 7848453 - DNA, 22 bp, Homo sapiens
gacaggcttcatcctcagagtt

SEQ ID NO: 7848454 - DNA, 22 bp, Homo sapiens
gacaaggcagaaagcttaaagg

SEQ ID NO: 7848455 - DNA, 22 bp, Homo sapiens
gacaagggttctgcagagcctg

SEQ ID NO: 7848456 - DNA, 22 bp, Homo sapiens
gacaagctcttgtttcatggtt

SEQ ID NO: 7848457 - DNA, 22 bp, Homo sapiens
gacaaggagccaccagtcacgt

SEQ ID NO: 7848458 - DNA, 22 bp, Homo sapiens
gacaaggcaaccagggaggctt

SEQ ID NO: 7848459 - DNA, 22 bp, Homo sapiens
gacaaggcaaccagggaggctt

SEQ ID NO: 7848460 - DNA, 22 bp, Homo sapiens
gacaaggttagggagtgcttag

SEQ ID NO: 7848461 - DNA, 22 bp, Homo sapiens
gacaaggtgataatagcttctg

SEQ ID NO: 7848462 - DNA, 22 bp, Homo sapiens
gacaagggttctgcagagcctg

SEQ ID NO: 7848463 - DNA, 22 bp, Homo sapiens
gacaagtgatgattataattca

SEQ ID NO: 7848464 - DNA, 22 bp, Homo sapiens
gacaagtcatctggggcctgtg

SEQ ID NO: 7848465 - DNA, 22 bp, Homo sapiens
gacaagtgcccattattcttta

SEQ ID NO: 7848466 - DNA, 22 bp, Homo sapiens
gacaagtgcatgatttctatct

SEQ ID NO: 7848467 - DNA, 16 bp, Homo sapiens
gacaagtggaggggcc

SEQ ID NO: 7848468 - DNA, 22 bp, Homo sapiens
gacaagtgctgatttatctccc

SEQ ID NO: 7848469 - DNA, 22 bp, Homo sapiens
gacaagtgggctgcagcttttg

SEQ ID NO: 7848470 - DNA, 22 bp, Homo sapiens
gacaagtgggctgcagcttttg

SEQ ID NO: 7848471 - DNA, 22 bp, Homo sapiens
gacaataaaatgatcttacagt

SEQ ID NO: 7848472 - DNA, 22 bp, Homo sapiens
gacacagaaggtcacatgttca

SEQ ID NO: 7848473 - DNA, 22 bp, Homo sapiens
gacacagaaggtcacatgttca

SEQ ID NO: 7848474 - DNA, 22 bp, Homo sapiens
gacacagaaggtcacatgttca

SEQ ID NO: 7848475 - DNA, 22 bp, Homo sapiens
gacacagaaggtcacatgttca

SEQ ID NO: 7848476 - DNA, 22 bp, Homo sapiens
gacacagaaggtcacatgttca

SEQ ID NO: 7848477 - DNA, 22 bp, Homo sapiens
gacacagaaggtcacatgttca

SEQ ID NO: 7848478 - DNA, 22 bp, Homo sapiens
gacacagaattcccctccaagt

SEQ ID NO: 7848479 - DNA, 22 bp, Homo sapiens
gacacagaatgggtgctcagta

SEQ ID NO: 7848480 - DNA, 22 bp, Homo sapiens
gacaggccccctcaggactgat

SEQ ID NO: 7848481 - DNA, 22 bp, Homo sapiens
gacaggccccctcaggactgat

SEQ ID NO: 7848482 - DNA, 22 bp, Homo sapiens
gacaggccccctcaggactgat

SEQ ID NO: 7848483 - DNA, 22 bp, Homo sapiens
gacaggccaggggctgaggtgg

SEQ ID NO: 7848484 - DNA, 22 bp, Homo sapiens
gacaggccaggggctgaggtgg

SEQ ID NO: 7848485 - DNA, 22 bp, Homo sapiens
gacacagagataggcctgtgtt

SEQ ID NO: 7848486 - DNA, 22 bp, Homo sapiens
gacaggcctagattcactgctg

SEQ ID NO: 7848487 - DNA, 22 bp, Homo sapiens
gacaggcctagattcactgctg

SEQ ID NO: 7848488 - DNA, 22 bp, Homo sapiens
gacaggcccgagtagctgatga

SEQ ID NO: 7848489 - DNA, 17 bp, Homo sapiens
gacaggctcagtgacga

SEQ ID NO: 7848490 - DNA, 22 bp, Homo sapiens
gacacagaatttactcccgata

SEQ ID NO: 7848491 - DNA, 22 bp, Homo sapiens
gacacagaatttactcccgata

SEQ ID NO: 7848492 - DNA, 22 bp, Homo sapiens
gacacagacagttagaggtaat

SEQ ID NO: 7848493 - DNA, 22 bp, Homo sapiens
gacacagaattcccctccaagt

SEQ ID NO: 7848494 - DNA, 22 bp, Homo sapiens
gacacagacagttagaggtaat

SEQ ID NO: 7848495 - DNA, 22 bp, Homo sapiens
gacacagacagttagaggtaat

SEQ ID NO: 7848496 - DNA, 22 bp, Homo sapiens
gacacagacagttagaggtaat

SEQ ID NO: 7848497 - DNA, 22 bp, Homo sapiens
gacacagacagttagaggtaat

SEQ ID NO: 7848498 - DNA, 22 bp, Homo sapiens
gacacagaccaccaggccctgg

SEQ ID NO: 7848499 - DNA, 22 bp, Homo sapiens
gacacagagacttgcagttgta

SEQ ID NO: 7848500 - DNA, 22 bp, Homo sapiens
gacacagagacttgcagttgta

SEQ ID NO: 7848501 - DNA, 22 bp, Homo sapiens
gacacagagacttgcagttgta

SEQ ID NO: 7848502 - DNA, 21 bp, Homo sapiens
gacaggtgattcagagcaggg

SEQ ID NO: 7848503 - DNA, 21 bp, Homo sapiens
gacaggtgattcagagcaggg

SEQ ID NO: 7848504 - DNA, 21 bp, Homo sapiens
gacaggtgattcagagcaggg

SEQ ID NO: 7848505 - DNA, 22 bp, Homo sapiens
gacaggtgagatgaggaacacc

SEQ ID NO: 7848506 - DNA, 22 bp, Homo sapiens
gacaggtgaaacagcaaggtaa

SEQ ID NO: 7848507 - DNA, 22 bp, Homo sapiens
gacaggtatttgagagctggga

SEQ ID NO: 7848508 - DNA, 22 bp, Homo sapiens
gacaggtgaaacagcaaggtaa

SEQ ID NO: 7848509 - DNA, 22 bp, Homo sapiens
gacaggtgaaacagcaaggtaa

SEQ ID NO: 7848510 - DNA, 22 bp, Homo sapiens
gacaggtgaaacagcaaggtaa

SEQ ID NO: 7848511 - DNA, 22 bp, Homo sapiens
gacagggtacgggctaggcaca

SEQ ID NO: 7848512 - DNA, 22 bp, Homo sapiens
gacagggtacgggctaggcaca

SEQ ID NO: 7848513 - DNA, 22 bp, Homo sapiens
gacagggtccaaaggcagggga

SEQ ID NO: 7848514 - DNA, 22 bp, Homo sapiens
gacagggtccaaaggcagggga

SEQ ID NO: 7848515 - DNA, 22 bp, Homo sapiens
gacagggtccaaaggcagggga

SEQ ID NO: 7848516 - DNA, 22 bp, Homo sapiens
gacagggtggctgatagggctc

SEQ ID NO: 7848517 - DNA, 22 bp, Homo sapiens
gacagggtccaaaggcagggga

SEQ ID NO: 7848518 - DNA, 22 bp, Homo sapiens
gacagggtccaaaggcagggga

SEQ ID NO: 7848519 - DNA, 22 bp, Homo sapiens
gacagggtccaaaggcagggga

SEQ ID NO: 7848520 - DNA, 22 bp, Homo sapiens
gacaggtaaagatggtggcagg

SEQ ID NO: 7848521 - DNA, 23 bp, Homo sapiens
gacaggtaagggttgggagaatc

SEQ ID NO: 7848522 - DNA, 22 bp, Homo sapiens
gacaggtaaagatggtggcagg

SEQ ID NO: 7848523 - DNA, 22 bp, Homo sapiens
gacagggtttgcaaggacttcg

SEQ ID NO: 7848524 - DNA, 22 bp, Homo sapiens
gacagggtggctgatagggctc

SEQ ID NO: 7848525 - DNA, 22 bp, Homo sapiens
gacaggttgaagtatcaaaggt

SEQ ID NO: 7848526 - DNA, 22 bp, Homo sapiens
gacaggttgaagtatcaaaggt

SEQ ID NO: 7848527 - DNA, 22 bp, Homo sapiens
gacaggtgtgtgtatattaggg

SEQ ID NO: 7848528 - DNA, 22 bp, Homo sapiens
gacagtaactacagttctgtgg

SEQ ID NO: 7848529 - DNA, 22 bp, Homo sapiens
gacagtaaatgcagtctagcac

SEQ ID NO: 7848530 - DNA, 18 bp, Homo sapiens
gacagtaaacttccccat

SEQ ID NO: 7848531 - DNA, 22 bp, Homo sapiens
gacaggtgggttctcgtatctg

SEQ ID NO: 7848532 - DNA, 22 bp, Homo sapiens
gacaggtgggtacctttatgga

SEQ ID NO: 7848533 - DNA, 22 bp, Homo sapiens
gacaggtgggttctcgtatctg

SEQ ID NO: 7848534 - DNA, 22 bp, Homo sapiens
gacaggtgtgatgatttaggct

SEQ ID NO: 7848535 - DNA, 22 bp, Homo sapiens
gacaggtggggaaactaaggta

SEQ ID NO: 7848536 - DNA, 22 bp, Homo sapiens
gacaggtgctaagggacctggc

SEQ ID NO: 7848537 - DNA, 22 bp, Homo sapiens
gacaggtgctaagggacctggc

SEQ ID NO: 7848538 - DNA, 22 bp, Homo sapiens
gacaggtgctaagggacctggc

SEQ ID NO: 7848539 - DNA, 22 bp, Homo sapiens
gacaggtgctaagggacctggc

SEQ ID NO: 7848540 - DNA, 20 bp, Homo sapiens
gacaggtgctaaagaggggc

SEQ ID NO: 7848541 - DNA, 20 bp, Homo sapiens
gacaggtgctaaagaggggc

SEQ ID NO: 7848542 - DNA, 20 bp, Homo sapiens
gacaggtgctaaagaggggc

SEQ ID NO: 7848543 - DNA, 22 bp, Homo sapiens
gacaggtggggaaactaaggta

SEQ ID NO: 7848544 - DNA, 18 bp, Homo sapiens
gacaggtgggtgagacca

SEQ ID NO: 7848545 - DNA, 22 bp, Homo sapiens
gacaggtgggtacctttatgga

SEQ ID NO: 7848546 - DNA, 22 bp, Homo sapiens
gacctcagattttcccaggcca

SEQ ID NO: 7848547 - DNA, 22 bp, Homo sapiens
gacctcagctgtggggatgctg

SEQ ID NO: 7848548 - DNA, 22 bp, Homo sapiens
gacctcagattttcccaggcca

SEQ ID NO: 7848549 - DNA, 22 bp, Homo sapiens
gacctagattaacattctgtga

SEQ ID NO: 7848550 - DNA, 22 bp, Homo sapiens
gacctagattaacattctgtga

SEQ ID NO: 7848551 - DNA, 22 bp, Homo sapiens
gaccggttctgccgtggactgg

SEQ ID NO: 7848552 - DNA, 22 bp, Homo sapiens
gacccttagaatgtgatcttat

SEQ ID NO: 7848553 - DNA, 22 bp, Homo sapiens
gacccttagaatgtgatcttat

SEQ ID NO: 7848554 - DNA, 22 bp, Homo sapiens
gacccttagaatgtgatcttat

SEQ ID NO: 7848555 - DNA, 22 bp, Homo sapiens
gaccctgtttctacaaataatt

SEQ ID NO: 7848556 - DNA, 22 bp, Homo sapiens
gaccctgtttctacaaataatt

SEQ ID NO: 7848557 - DNA, 22 bp, Homo sapiens
gaccctgtttctacaaataatt

SEQ ID NO: 7848558 - DNA, 22 bp, Homo sapiens
gaccctggtgtccaggtcctgc

SEQ ID NO: 7848559 - DNA, 22 bp, Homo sapiens
gaccctggtgtccaggtcctgc

SEQ ID NO: 7848560 - DNA, 22 bp, Homo sapiens
gaccctggtgggcactggcacc

SEQ ID NO: 7848561 - DNA, 22 bp, Homo sapiens
gaccctggtgtccaggtcctgc

SEQ ID NO: 7848562 - DNA, 22 bp, Homo sapiens
gaccctgtttctacaaataatt

SEQ ID NO: 7848563 - DNA, 22 bp, Homo sapiens
gaccctgtttctacaaataatt

SEQ ID NO: 7848564 - DNA, 22 bp, Homo sapiens
gaccctggtgggcactggcacc

SEQ ID NO: 7848565 - DNA, 22 bp, Homo sapiens
gaccctggtgggcactggcacc

SEQ ID NO: 7848566 - DNA, 22 bp, Homo sapiens
gaccctggtgggcactggcacc

SEQ ID NO: 7848567 - DNA, 22 bp, Homo sapiens
gaccctggtgggcactggcacc

SEQ ID NO: 7848568 - DNA, 22 bp, Homo sapiens
gaccctggtgggcactggcacc

SEQ ID NO: 7848569 - DNA, 22 bp, Homo sapiens
gaccctggtgggcactggcacc

SEQ ID NO: 7848570 - DNA, 22 bp, Homo sapiens
gaccctggctggagctggcctg

SEQ ID NO: 7848571 - DNA, 22 bp, Homo sapiens
gaccctggctggagctggcctg

SEQ ID NO: 7848572 - DNA, 22 bp, Homo sapiens
gaccctggctggagctggcctg

SEQ ID NO: 7848573 - DNA, 22 bp, Homo sapiens
gaccctgggatgcttgttttac

SEQ ID NO: 7848574 - DNA, 22 bp, Homo sapiens
gaccctggggaccatctagccc

SEQ ID NO: 7848575 - DNA, 22 bp, Homo sapiens
gaccctggctggagctggcctg

SEQ ID NO: 7848576 - DNA, 22 bp, Homo sapiens
gacccagtgactcgtctctgtg

SEQ ID NO: 7848577 - DNA, 22 bp, Homo sapiens
gacccagggtttctgcacaggg

SEQ ID NO: 7848578 - DNA, 22 bp, Homo sapiens
gacagtcccccagcagcaaacc

SEQ ID NO: 7848579 - DNA, 22 bp, Homo sapiens
gacagtcccccagcagcaaacc

SEQ ID NO: 7848580 - DNA, 22 bp, Homo sapiens
gacccatataggaccctccaaa

SEQ ID NO: 7848581 - DNA, 22 bp, Homo sapiens
gacccataggaatctgttgtcc

SEQ ID NO: 7848582 - DNA, 22 bp, Homo sapiens
gaccctggcaggtagcctcaca

SEQ ID NO: 7848583 - DNA, 22 bp, Homo sapiens
gacccatataggaccctccaaa

SEQ ID NO: 7848584 - DNA, 22 bp, Homo sapiens
gacccatatatacgtaatttgt

SEQ ID NO: 7848585 - DNA, 22 bp, Homo sapiens
gaccctggctagggcttaacct

SEQ ID NO: 7848586 - DNA, 22 bp, Homo sapiens
gaccctggctgccgcggtctgg

SEQ ID NO: 7848587 - DNA, 22 bp, Homo sapiens
gaccctggctgccgcggtctgg

SEQ ID NO: 7848588 - DNA, 22 bp, Homo sapiens
gaccctggctggagctggcctg

SEQ ID NO: 7848589 - DNA, 22 bp, Homo sapiens
gaccctggcaggtagcctcaca

SEQ ID NO: 7848590 - DNA, 22 bp, Homo sapiens
gacagtaagagtgtctgggttc

SEQ ID NO: 7848591 - DNA, 22 bp, Homo sapiens
gacagtaagaccttaccagcct

SEQ ID NO: 7848592 - DNA, 22 bp, Homo sapiens
gacagtaagaccttaccagcct

SEQ ID NO: 7848593 - DNA, 22 bp, Homo sapiens
gacagtaagaccttaccagcct

SEQ ID NO: 7848594 - DNA, 22 bp, Homo sapiens
gacagtaactgagagatgtaat

SEQ ID NO: 7848595 - DNA, 22 bp, Homo sapiens
gacagtaactgagagatgtaat

SEQ ID NO: 7848596 - DNA, 22 bp, Homo sapiens
gacagtaactgagagatgtaat

SEQ ID NO: 7848597 - DNA, 22 bp, Homo sapiens
gacagtaactgagagatgtaat

SEQ ID NO: 7848598 - DNA, 22 bp, Homo sapiens
gacagtaactgagagatgtaat

SEQ ID NO: 7848599 - DNA, 22 bp, Homo sapiens
gacagtaactgagagatgtaat

SEQ ID NO: 7848600 - DNA, 22 bp, Homo sapiens
gacagtaactgagagatgtaat

SEQ ID NO: 7848601 - DNA, 22 bp, Homo sapiens
gacagtaagtcagagacttggt

SEQ ID NO: 7848602 - DNA, 22 bp, Homo sapiens
gacagtaaggtggcttcttctt

SEQ ID NO: 7848603 - DNA, 22 bp, Homo sapiens
gacagtaagtcagagacttggt

SEQ ID NO: 7848604 - DNA, 22 bp, Homo sapiens
gacagtaagtcagagacttggt

SEQ ID NO: 7848605 - DNA, 22 bp, Homo sapiens
gacagtacaggtagaagtcact

SEQ ID NO: 7848606 - DNA, 22 bp, Homo sapiens
gacagtatccaggtggtgaaga

SEQ ID NO: 7848607 - DNA, 22 bp, Homo sapiens
gacaagcaggctcctgaagaaa

SEQ ID NO: 7848608 - DNA, 22 bp, Homo sapiens
gacaagcaagagtttgctgggc

SEQ ID NO: 7848609 - DNA, 22 bp, Homo sapiens
gacaagatttagagtctgctaa

SEQ ID NO: 7848610 - DNA, 22 bp, Homo sapiens
gacaagatttagagtctgctaa

SEQ ID NO: 7848611 - DNA, 22 bp, Homo sapiens
gacaagctcttgtttcatggtt

SEQ ID NO: 7848612 - DNA, 22 bp, Homo sapiens
gacaagattaaccatagttaag

SEQ ID NO: 7848613 - DNA, 22 bp, Homo sapiens
gacaagatgagcagctcagtgt

SEQ ID NO: 7848614 - DNA, 22 bp, Homo sapiens
gacaagattaaccatagttaag

SEQ ID NO: 7848615 - DNA, 22 bp, Homo sapiens
gacaagatgagcagctcagtgt

SEQ ID NO: 7848616 - DNA, 22 bp, Homo sapiens
gacaagatgacatcatggcttc

SEQ ID NO: 7848617 - DNA, 22 bp, Homo sapiens
gacaagataatgaagtgcaatt

SEQ ID NO: 7848618 - DNA, 22 bp, Homo sapiens
gacaagataatgaagtgcaatt

SEQ ID NO: 7848619 - DNA, 22 bp, Homo sapiens
gacaagacatgtgatgacatca

SEQ ID NO: 7848620 - DNA, 22 bp, Homo sapiens
gacaagacattggtaaagatat

SEQ ID NO: 7848621 - DNA, 22 bp, Homo sapiens
gacaagacacctctctccatcc

SEQ ID NO: 7848622 - DNA, 22 bp, Homo sapiens
gacaactgtcagtatattgtta

SEQ ID NO: 7848623 - DNA, 18 bp, Homo sapiens
gaatatctagcacatagt

SEQ ID NO: 7848624 - DNA, 22 bp, Homo sapiens
gaatatctgggagtgggaagct

SEQ ID NO: 7848625 - DNA, 22 bp, Homo sapiens
gaatatcccgctatgcaaagta

SEQ ID NO: 7848626 - DNA, 18 bp, Homo sapiens
gaatatctagcacatagt

SEQ ID NO: 7848627 - DNA, 22 bp, Homo sapiens
gaatatcccgctatgcaaagta

SEQ ID NO: 7848628 - DNA, 22 bp, Homo sapiens
gaatatcccgctatgcaaagta

SEQ ID NO: 7848629 - DNA, 22 bp, Homo sapiens
gaatatcccgctatgcaaagta

SEQ ID NO: 7848630 - DNA, 22 bp, Homo sapiens
gaatatcccgctatgcaaagta

SEQ ID NO: 7848631 - DNA, 22 bp, Homo sapiens
gaatatcccgctatgcaaagta

SEQ ID NO: 7848632 - DNA, 22 bp, Homo sapiens
gaatatcccgctatgcaaagta

SEQ ID NO: 7848633 - DNA, 22 bp, Homo sapiens
gaatatcccgctatgcaaagta

SEQ ID NO: 7848634 - DNA, 22 bp, Homo sapiens
gaatatatttctcttaccttta

SEQ ID NO: 7848635 - DNA, 22 bp, Homo sapiens
gaatatatttctcttaccttta

SEQ ID NO: 7848636 - DNA, 22 bp, Homo sapiens
gaatatatttctcttaccttta

SEQ ID NO: 7848637 - DNA, 22 bp, Homo sapiens
gaatatatttctcttaccttta

SEQ ID NO: 7848638 - DNA, 22 bp, Homo sapiens
gaatatatttctcttaccttta

SEQ ID NO: 7848639 - DNA, 22 bp, Homo sapiens
gaatatatttctcttaccttta

SEQ ID NO: 7848640 - DNA, 20 bp, Homo sapiens
gacaacatgcagaaagtata

SEQ ID NO: 7848641 - DNA, 22 bp, Homo sapiens
gacaactgatgtgcttgtggga

SEQ ID NO: 7848642 - DNA, 22 bp, Homo sapiens
gacaactgccccattttaaatg

SEQ ID NO: 7848643 - DNA, 22 bp, Homo sapiens
gaatatgtttgacatttagttg

SEQ ID NO: 7848644 - DNA, 22 bp, Homo sapiens
gaatattagtatcagttatacc

SEQ ID NO: 7848645 - DNA, 22 bp, Homo sapiens
gaatatgtttgacatttagttg

SEQ ID NO: 7848646 - DNA, 22 bp, Homo sapiens
gaatatgttctggaagttcttg

SEQ ID NO: 7848647 - DNA, 22 bp, Homo sapiens
gaatatgtgttcctggacaaga

SEQ ID NO: 7848648 - DNA, 22 bp, Homo sapiens
gaatatgtgcatttatgagtgt

SEQ ID NO: 7848649 - DNA, 22 bp, Homo sapiens
gaatatcttgtacatctaagta

SEQ ID NO: 7848650 - DNA, 22 bp, Homo sapiens
gaatacatggcagggagtcatc

SEQ ID NO: 7848651 - DNA, 22 bp, Homo sapiens
gaatacatgatacatgaactgc

SEQ ID NO: 7848652 - DNA, 22 bp, Homo sapiens
gaatacatgtgtgtatagaggt

SEQ ID NO: 7848653 - DNA, 22 bp, Homo sapiens
gaatacatgattaaagtttgat

SEQ ID NO: 7848654 - DNA, 22 bp, Homo sapiens
gaatacatgatacatgaactgc

SEQ ID NO: 7848655 - DNA, 22 bp, Homo sapiens
gaatacattggaaatcagaata

SEQ ID NO: 7848656 - DNA, 22 bp, Homo sapiens
gaatacatgtgtgtatagaggt

SEQ ID NO: 7848657 - DNA, 22 bp, Homo sapiens
gaatacatgtgtgtatagaggt

SEQ ID NO: 7848658 - DNA, 22 bp, Homo sapiens
gaatacttttgttaggaaaacg

SEQ ID NO: 7848659 - DNA, 22 bp, Homo sapiens
gaatacttgggtctggagtcaa

SEQ ID NO: 7848660 - DNA, 22 bp, Homo sapiens
gaatacttgggtctggagtcaa

SEQ ID NO: 7848661 - DNA, 22 bp, Homo sapiens
gaatactggaaaactcatttta

SEQ ID NO: 7848662 - DNA, 22 bp, Homo sapiens
gaatactgatgctcagccccct

SEQ ID NO: 7848663 - DNA, 18 bp, Homo sapiens
gaatactgagagcacaaa

SEQ ID NO: 7848664 - DNA, 22 bp, Homo sapiens
gaatactgacactcaggtggga

SEQ ID NO: 7848665 - DNA, 22 bp, Homo sapiens
gaatacctggtcccacatctca

SEQ ID NO: 7848666 - DNA, 22 bp, Homo sapiens
gaatacattggaaatcagaata

SEQ ID NO: 7848667 - DNA, 22 bp, Homo sapiens
gaatacattggaaatcagaata

SEQ ID NO: 7848668 - DNA, 22 bp, Homo sapiens
gaatacattggaaatcagaata

SEQ ID NO: 7848669 - DNA, 22 bp, Homo sapiens
gaatacattggaaatcagaata

SEQ ID NO: 7848670 - DNA, 23 bp, Homo sapiens
gaatagttttagaaattggagaa

SEQ ID NO: 7848671 - DNA, 22 bp, Homo sapiens
gaatatattattcagcttttca

SEQ ID NO: 7848672 - DNA, 22 bp, Homo sapiens
gaatatattattcagcttttca

SEQ ID NO: 7848673 - DNA, 21 bp, Homo sapiens
gaatagttctgtggcagcagt

SEQ ID NO: 7848674 - DNA, 23 bp, Homo sapiens
gaatagttttagaaattggagaa

SEQ ID NO: 7848675 - DNA, 22 bp, Homo sapiens
gaatatattattcagcttttca

SEQ ID NO: 7848676 - DNA, 22 bp, Homo sapiens
gaatatattattcagcttttca

SEQ ID NO: 7848677 - DNA, 22 bp, Homo sapiens
gaatatattggtgaaaatagtt

SEQ ID NO: 7848678 - DNA, 22 bp, Homo sapiens
gaatatattggtgaaaatagtt

SEQ ID NO: 7848679 - DNA, 22 bp, Homo sapiens
gaatatattggtgaaaatagtt

SEQ ID NO: 7848680 - DNA, 22 bp, Homo sapiens
gaatatattggtgaaaatagtt

SEQ ID NO: 7848681 - DNA, 22 bp, Homo sapiens
gaatatattggtgaaaatagtt

SEQ ID NO: 7848682 - DNA, 22 bp, Homo sapiens
gaatatattggtgaaaatagtt

SEQ ID NO: 7848683 - DNA, 22 bp, Homo sapiens
gaatatattggtgaaaatagtt

SEQ ID NO: 7848684 - DNA, 22 bp, Homo sapiens
gaatagataagtgactatttgg

SEQ ID NO: 7848685 - DNA, 22 bp, Homo sapiens
gaatagatagcttggatggttg

SEQ ID NO: 7848686 - DNA, 22 bp, Homo sapiens
gaatagatatccttgagggtct

SEQ ID NO: 7848687 - DNA, 22 bp, Homo sapiens
gaatagatcctcatttattgat

SEQ ID NO: 7848688 - DNA, 22 bp, Homo sapiens
gaatagatgaaagtgtctctta

SEQ ID NO: 7848689 - DNA, 22 bp, Homo sapiens
gaatagattatacttgaagcat

SEQ ID NO: 7848690 - DNA, 22 bp, Homo sapiens
gaatagattagaaagagtatgt

SEQ ID NO: 7848691 - DNA, 22 bp, Homo sapiens
gaatagcttccttttttccaaa

SEQ ID NO: 7848692 - DNA, 22 bp, Homo sapiens
gaatagttctatggctgcaggg

SEQ ID NO: 7848693 - DNA, 22 bp, Homo sapiens
gaagcctcaacatctctgcgtc

SEQ ID NO: 7848694 - DNA, 22 bp, Homo sapiens
gaagcctcaacatctctgcgtc

SEQ ID NO: 7848695 - DNA, 22 bp, Homo sapiens
gaagctgtgttgatggcatgga

SEQ ID NO: 7848696 - DNA, 22 bp, Homo sapiens
gaagctgtgttgatggcatgga

SEQ ID NO: 7848697 - DNA, 22 bp, Homo sapiens
gaagcttcgaaagagtgatttc

SEQ ID NO: 7848698 - DNA, 22 bp, Homo sapiens
gaagcttcgtggctcttcaaat

SEQ ID NO: 7848699 - DNA, 22 bp, Homo sapiens
gaagcttcgaaagagtgatttc

SEQ ID NO: 7848700 - DNA, 22 bp, Homo sapiens
gaagcttctggcatttctcaaa

SEQ ID NO: 7848701 - DNA, 22 bp, Homo sapiens
gaagctttattgcaagtgaggc

SEQ ID NO: 7848702 - DNA, 22 bp, Homo sapiens
gaagcttggtgttgtcttaagt

SEQ ID NO: 7848703 - DNA, 22 bp, Homo sapiens
gaagctttgagagcagaagccc

SEQ ID NO: 7848704 - DNA, 22 bp, Homo sapiens
gaagctttgagagcagaagccc

SEQ ID NO: 7848705 - DNA, 22 bp, Homo sapiens
gaagctttgtcttgtctcctgg

SEQ ID NO: 7848706 - DNA, 22 bp, Homo sapiens
gaagctttgagagcagaagccc

SEQ ID NO: 7848707 - DNA, 22 bp, Homo sapiens
gaagctttgtcttgtctcctgg

SEQ ID NO: 7848708 - DNA, 22 bp, Homo sapiens
gaaggaaaaatactctgtaagg

SEQ ID NO: 7848709 - DNA, 22 bp, Homo sapiens
gaaggaaaaatactctgtaagg

SEQ ID NO: 7848710 - DNA, 22 bp, Homo sapiens
gaaggaaaaatactctgtaagg

SEQ ID NO: 7848711 - DNA, 22 bp, Homo sapiens
gaaggaaaaatactctgtaagg

SEQ ID NO: 7848712 - DNA, 22 bp, Homo sapiens
gaaggaaaacagatctgcctga

SEQ ID NO: 7848713 - DNA, 22 bp, Homo sapiens
gaaggaaaacagatctgcctga

SEQ ID NO: 7848714 - DNA, 22 bp, Homo sapiens
gaaggaaaacagatctgcctga

SEQ ID NO: 7848715 - DNA, 22 bp, Homo sapiens
gaaggaaaacagatctgcctga

SEQ ID NO: 7848716 - DNA, 22 bp, Homo sapiens
gaaggaaaacagatctgcctga

SEQ ID NO: 7848717 - DNA, 22 bp, Homo sapiens
gaaggaaaggtctcatgccttt

SEQ ID NO: 7848718 - DNA, 22 bp, Homo sapiens
gaaggaaaggtctcatgccttt

SEQ ID NO: 7848719 - DNA, 22 bp, Homo sapiens
gaaggaaatctgtgatttatgc

SEQ ID NO: 7848720 - DNA, 22 bp, Homo sapiens
gaaggaaatctgtgatttatgc

SEQ ID NO: 7848721 - DNA, 22 bp, Homo sapiens
gaaggaaatctgtgatttatgc

SEQ ID NO: 7848722 - DNA, 22 bp, Homo sapiens
gaaggaaatctgtgatttatgc

SEQ ID NO: 7848723 - DNA, 22 bp, Homo sapiens
gaaggaagactggtttaaatgt

SEQ ID NO: 7848724 - DNA, 22 bp, Homo sapiens
gaaggaagattctgttggaatc

SEQ ID NO: 7848725 - DNA, 22 bp, Homo sapiens
gaagttctcagctaggtgatgt

SEQ ID NO: 7848726 - DNA, 22 bp, Homo sapiens
gaagttcttagtctcatttgca

SEQ ID NO: 7848727 - DNA, 22 bp, Homo sapiens
gaagttcttagtctcatttgca

SEQ ID NO: 7848728 - DNA, 22 bp, Homo sapiens
gaagttctggtgtatgtgataa

SEQ ID NO: 7848729 - DNA, 23 bp, Homo sapiens
gaagttctgttcagccagacaag

SEQ ID NO: 7848730 - DNA, 22 bp, Homo sapiens
gaagttctttatagcagtgtga

SEQ ID NO: 7848731 - DNA, 22 bp, Homo sapiens
gaagttctttatagcagtgtga

SEQ ID NO: 7848732 - DNA, 23 bp, Homo sapiens
gaagttctttcttctcatgctgt

SEQ ID NO: 7848733 - DNA, 22 bp, Homo sapiens
gaagttctttgctccccagtac

SEQ ID NO: 7848734 - DNA, 22 bp, Homo sapiens
gaagtttagagtgttgtaattt

SEQ ID NO: 7848735 - DNA, 22 bp, Homo sapiens
gaagtttagaagtgacaggttt

SEQ ID NO: 7848736 - DNA, 22 bp, Homo sapiens
gaagttgatagagtacatgatt

SEQ ID NO: 7848737 - DNA, 22 bp, Homo sapiens
gaagttgatatctactctcatg

SEQ ID NO: 7848738 - DNA, 22 bp, Homo sapiens
gaataaactcctcagcttcctt

SEQ ID NO: 7848739 - DNA, 22 bp, Homo sapiens
gaagttttagtcaaaatgtaga

SEQ ID NO: 7848740 - DNA, 22 bp, Homo sapiens
gaataacattttttcctttaca

SEQ ID NO: 7848741 - DNA, 22 bp, Homo sapiens
gaataacattggaaccctgaag

SEQ ID NO: 7848742 - DNA, 22 bp, Homo sapiens
gaataacagcaagtttgcaggc

SEQ ID NO: 7848743 - DNA, 22 bp, Homo sapiens
gaataaactcctcagcttcctt

SEQ ID NO: 7848744 - DNA, 22 bp, Homo sapiens
gaataacagcaagtttgcaggc

SEQ ID NO: 7848745 - DNA, 22 bp, Homo sapiens
gaataaactcctcagcttcctt

SEQ ID NO: 7848746 - DNA, 22 bp, Homo sapiens
gaagtttaggttcttatgttta

SEQ ID NO: 7848747 - DNA, 22 bp, Homo sapiens
gaagtttaggttcttatgttta

SEQ ID NO: 7848748 - DNA, 22 bp, Homo sapiens
gaagtttagagtgttgtaattt

SEQ ID NO: 7848749 - DNA, 22 bp, Homo sapiens
gaagtttagagtgttgtaattt

SEQ ID NO: 7848750 - DNA, 22 bp, Homo sapiens
gaagtttagagtgttgtaattt

SEQ ID NO: 7848751 - DNA, 22 bp, Homo sapiens
gaagtttattttacacatccat

SEQ ID NO: 7848752 - DNA, 22 bp, Homo sapiens
gaagtttattttacacatccat

SEQ ID NO: 7848753 - DNA, 22 bp, Homo sapiens
gaagtttattttacacatccat

SEQ ID NO: 7848754 - DNA, 22 bp, Homo sapiens
gaagtttatggtgcttgtaagg

SEQ ID NO: 7848755 - DNA, 22 bp, Homo sapiens
gaagtttatttcaatctattca

SEQ ID NO: 7848756 - DNA, 22 bp, Homo sapiens
gaagtttatttcaatctattca

SEQ ID NO: 7848757 - DNA, 22 bp, Homo sapiens
gaatacacgaatagagcatggt

SEQ ID NO: 7848758 - DNA, 22 bp, Homo sapiens
gaatacaggcaggtggctgtgc

SEQ ID NO: 7848759 - DNA, 19 bp, Homo sapiens
gaatacagataataagcag

SEQ ID NO: 7848760 - DNA, 22 bp, Homo sapiens
gaatacaggcaggtggctgtgc

SEQ ID NO: 7848761 - DNA, 22 bp, Homo sapiens
gaatacatgatacatgaactgc

SEQ ID NO: 7848762 - DNA, 23 bp, Homo sapiens
gaatacagagataaatagaacac

SEQ ID NO: 7848763 - DNA, 22 bp, Homo sapiens
gaatacacgaatagagcatggt

SEQ ID NO: 7848764 - DNA, 19 bp, Homo sapiens
gaatacagataataagcag

SEQ ID NO: 7848765 - DNA, 23 bp, Homo sapiens
gaatacagagataaatagaacac

SEQ ID NO: 7848766 - DNA, 23 bp, Homo sapiens
gaatacagagataaatagaacac

SEQ ID NO: 7848767 - DNA, 22 bp, Homo sapiens
gaatacaccaaggaatcagaat

SEQ ID NO: 7848768 - DNA, 22 bp, Homo sapiens
gaatacaagcctgccacctgga

SEQ ID NO: 7848769 - DNA, 22 bp, Homo sapiens
gaatacacgaatagagcatggt

SEQ ID NO: 7848770 - DNA, 22 bp, Homo sapiens
gaatacacgaaggcaagagtcc

SEQ ID NO: 7848771 - DNA, 22 bp, Homo sapiens
gaatacaagccaggcacaaggc

SEQ ID NO: 7848772 - DNA, 22 bp, Homo sapiens
gaatacaagccaggcacaaggc

SEQ ID NO: 7848773 - DNA, 22 bp, Homo sapiens
gaatacaagccaggcacaaggc

SEQ ID NO: 7848774 - DNA, 22 bp, Homo sapiens
gaatacaagccaggcacaaggc

SEQ ID NO: 7848775 - DNA, 22 bp, Homo sapiens
gaatacaagccaggcacaaggc

SEQ ID NO: 7848776 - DNA, 22 bp, Homo sapiens
gaatacaagccaggcacaaggc

SEQ ID NO: 7848777 - DNA, 22 bp, Homo sapiens
gaatacaagcctgccacctgga

SEQ ID NO: 7848778 - DNA, 22 bp, Homo sapiens
gaatacaagcctgccacctgga

SEQ ID NO: 7848779 - DNA, 22 bp, Homo sapiens
gaatacaagccaggcacaaggc

SEQ ID NO: 7848780 - DNA, 22 bp, Homo sapiens
gaatacaagcctgccacctgga

SEQ ID NO: 7848781 - DNA, 22 bp, Homo sapiens
gaatacaagcctgccacctgga

SEQ ID NO: 7848782 - DNA, 22 bp, Homo sapiens
gaatacaagcctgccacctgga

SEQ ID NO: 7848783 - DNA, 22 bp, Homo sapiens
gaatacaagcctgccacctgga

SEQ ID NO: 7848784 - DNA, 22 bp, Homo sapiens
gaatacaagcctgccacctgga

SEQ ID NO: 7848785 - DNA, 22 bp, Homo sapiens
ctttcacaagatttgagatgct

SEQ ID NO: 7848786 - DNA, 22 bp, Homo sapiens
ctttcacaagatttgagatgct

SEQ ID NO: 7848787 - DNA, 22 bp, Homo sapiens
ctttcacacacatacatttgga

SEQ ID NO: 7848788 - DNA, 18 bp, Homo sapiens
ctttatgtgcagagcttt

SEQ ID NO: 7848789 - DNA, 18 bp, Homo sapiens
ctttatgtgcagagcttt

SEQ ID NO: 7848790 - DNA, 22 bp, Homo sapiens
ctttcagaagaggacctttcca

SEQ ID NO: 7848791 - DNA, 22 bp, Homo sapiens
ctttcacagtcatatgatgaat

SEQ ID NO: 7848792 - DNA, 22 bp, Homo sapiens
ctttcacagcttgaaaagtatt

SEQ ID NO: 7848793 - DNA, 22 bp, Homo sapiens
ctttcacagtcatatgatgaat

SEQ ID NO: 7848794 - DNA, 22 bp, Homo sapiens
ctttcagtctttacaaggttgc

SEQ ID NO: 7848795 - DNA, 22 bp, Homo sapiens
ctttcagtcagttaactcagaa

SEQ ID NO: 7848796 - DNA, 22 bp, Homo sapiens
ctttcagtctttacaaggttgc

SEQ ID NO: 7848797 - DNA, 22 bp, Homo sapiens
ctttcagttaatgactccatag

SEQ ID NO: 7848798 - DNA, 22 bp, Homo sapiens
ctttcagtcagttaactcagaa

SEQ ID NO: 7848799 - DNA, 18 bp, Homo sapiens
ctttcagtaatttcagcc

SEQ ID NO: 7848800 - DNA, 22 bp, Homo sapiens
ctttcataaaggaaatgatgag

SEQ ID NO: 7848801 - DNA, 22 bp, Homo sapiens
ctttcataaggggttttataat

SEQ ID NO: 7848802 - DNA, 22 bp, Homo sapiens
ctttcagttacagttacacaca

SEQ ID NO: 7848803 - DNA, 22 bp, Homo sapiens
ctttcataaaggaaatgatgag

SEQ ID NO: 7848804 - DNA, 22 bp, Homo sapiens
ctttcataaaggaaatgatgag

SEQ ID NO: 7848805 - DNA, 22 bp, Homo sapiens
ctttcagttagtacctagtggc

SEQ ID NO: 7848806 - DNA, 22 bp, Homo sapiens
ctttcagttagtacctagtggc

SEQ ID NO: 7848807 - DNA, 22 bp, Homo sapiens
ctttcaggttctataggaagcc

SEQ ID NO: 7848808 - DNA, 18 bp, Homo sapiens
ctttcagatggatatgct

SEQ ID NO: 7848809 - DNA, 22 bp, Homo sapiens
ctttcagcatccctgggattac

SEQ ID NO: 7848810 - DNA, 22 bp, Homo sapiens
ctttcagaagtatattctggaa

SEQ ID NO: 7848811 - DNA, 22 bp, Homo sapiens
ctttcagaagccggaagggcag

SEQ ID NO: 7848812 - DNA, 22 bp, Homo sapiens
ctttcagaggttactcaggaaa

SEQ ID NO: 7848813 - DNA, 22 bp, Homo sapiens
ctttcagatagtctgagatata

SEQ ID NO: 7848814 - DNA, 22 bp, Homo sapiens
ctttcagatagtctgagatata

SEQ ID NO: 7848815 - DNA, 22 bp, Homo sapiens
ctttcattcttagatattagtg

SEQ ID NO: 7848816 - DNA, 22 bp, Homo sapiens
ctttcattcttagatattagtg

SEQ ID NO: 7848817 - DNA, 22 bp, Homo sapiens
ctttcattcttagatattagtg

SEQ ID NO: 7848818 - DNA, 19 bp, Homo sapiens
ctttcatgtggttcttctt

SEQ ID NO: 7848819 - DNA, 22 bp, Homo sapiens
ctttcatgcagttgacaaggtg

SEQ ID NO: 7848820 - DNA, 22 bp, Homo sapiens
ctttcatgcacttctttagatc

SEQ ID NO: 7848821 - DNA, 22 bp, Homo sapiens
ctttcatccgcagatgagcctc

SEQ ID NO: 7848822 - DNA, 22 bp, Homo sapiens
ctttcatccgcagatgagcctc

SEQ ID NO: 7848823 - DNA, 22 bp, Homo sapiens
ctttcatgaacagacaaggaac

SEQ ID NO: 7848824 - DNA, 22 bp, Homo sapiens
ctttcatgaacagacaaggaac

SEQ ID NO: 7848825 - DNA, 22 bp, Homo sapiens
ctttcatccgcagatgagcctc

SEQ ID NO: 7848826 - DNA, 22 bp, Homo sapiens
ctttcatagttaaaatagtttg

SEQ ID NO: 7848827 - DNA, 22 bp, Homo sapiens
ctttcatttgataagaatgcca

SEQ ID NO: 7848828 - DNA, 22 bp, Homo sapiens
ctttcatttgataagaatgcca

SEQ ID NO: 7848829 - DNA, 22 bp, Homo sapiens
ctttccaactctagtgaaattt

SEQ ID NO: 7848830 - DNA, 22 bp, Homo sapiens
ctttccaactctagtgaaattt

SEQ ID NO: 7848831 - DNA, 22 bp, Homo sapiens
ctttccaactctagtgaaattt

SEQ ID NO: 7848832 - DNA, 23 bp, Homo sapiens
ctttcattgtggtttcacagagc

SEQ ID NO: 7848833 - DNA, 23 bp, Homo sapiens
ctttcattgtggtttcacagagc

SEQ ID NO: 7848834 - DNA, 22 bp, Homo sapiens
gaaatatttctcttgagcccct

SEQ ID NO: 7848835 - DNA, 22 bp, Homo sapiens
gaaatatttctcttgagcccct

SEQ ID NO: 7848836 - DNA, 22 bp, Homo sapiens
ctttccaactgggtgggcagct

SEQ ID NO: 7848837 - DNA, 22 bp, Homo sapiens
ctttccaactgggtgggcagct

SEQ ID NO: 7848838 - DNA, 22 bp, Homo sapiens
gaaatatttctcttgagcccct

SEQ ID NO: 7848839 - DNA, 22 bp, Homo sapiens
gaaatatttctcttgagcccct

SEQ ID NO: 7848840 - DNA, 22 bp, Homo sapiens
gaaatatttctcttgagcccct

SEQ ID NO: 7848841 - DNA, 22 bp, Homo sapiens
gaaatatttctcttgagcccct

SEQ ID NO: 7848842 - DNA, 22 bp, Homo sapiens
gaaatatttctcttgagcccct

SEQ ID NO: 7848843 - DNA, 22 bp, Homo sapiens
gaaatatttctcttgagcccct

SEQ ID NO: 7848844 - DNA, 22 bp, Homo sapiens
gaaatatttctcttgagcccct

SEQ ID NO: 7848845 - DNA, 22 bp, Homo sapiens
gaaatatttctcttgagcccct

SEQ ID NO: 7848846 - DNA, 22 bp, Homo sapiens
gaaatcaaacccttttctgata

SEQ ID NO: 7848847 - DNA, 22 bp, Homo sapiens
gaaatcaaacccttttctgata

SEQ ID NO: 7848848 - DNA, 22 bp, Homo sapiens
gaaatcaaacccttttctgata

SEQ ID NO: 7848849 - DNA, 22 bp, Homo sapiens
gaaatcaggatgatgttccaga

SEQ ID NO: 7848850 - DNA, 20 bp, Homo sapiens
gaaatcagttaatgatggtt

SEQ ID NO: 7848851 - DNA, 22 bp, Homo sapiens
gaaatcagttctgaaatttaca

SEQ ID NO: 7848852 - DNA, 22 bp, Homo sapiens
gaaatcacttttttcatagttg

SEQ ID NO: 7848853 - DNA, 22 bp, Homo sapiens
gaaatcaaggctacattcaggt

SEQ ID NO: 7848854 - DNA, 22 bp, Homo sapiens
gaaatcaaggctacattcaggt

SEQ ID NO: 7848855 - DNA, 22 bp, Homo sapiens
gaaatcaatttcttggttgata

SEQ ID NO: 7848856 - DNA, 22 bp, Homo sapiens
gaaatcaatttcttggttgata

SEQ ID NO: 7848857 - DNA, 22 bp, Homo sapiens
gaaatcaatttcttggttgata

SEQ ID NO: 7848858 - DNA, 22 bp, Homo sapiens
gaaatcaaggctacattcaggt

SEQ ID NO: 7848859 - DNA, 22 bp, Homo sapiens
gaaatgtactttaaagccatcc

SEQ ID NO: 7848860 - DNA, 22 bp, Homo sapiens
gaacagcagcttcctgggaatt

SEQ ID NO: 7848861 - DNA, 22 bp, Homo sapiens
gaaatgtactttaaagccatcc

SEQ ID NO: 7848862 - DNA, 22 bp, Homo sapiens
gaaatgtactttaaagccatcc

SEQ ID NO: 7848863 - DNA, 20 bp, Homo sapiens
gaaatgtacacattaccaca

SEQ ID NO: 7848864 - DNA, 20 bp, Homo sapiens
gaaatgtacacattaccaca

SEQ ID NO: 7848865 - DNA, 22 bp, Homo sapiens
gaaatgcataatcttagtagat

SEQ ID NO: 7848866 - DNA, 22 bp, Homo sapiens
gaaatgcataatcttagtagat

SEQ ID NO: 7848867 - DNA, 22 bp, Homo sapiens
gaaatgcaggcttggattcagc

SEQ ID NO: 7848868 - DNA, 22 bp, Homo sapiens
gaaatgcatggatcttggcaga

SEQ ID NO: 7848869 - DNA, 22 bp, Homo sapiens
gaaatgcatggatcttggcaga

SEQ ID NO: 7848870 - DNA, 22 bp, Homo sapiens
gaaatgcatggatcttggcaga

SEQ ID NO: 7848871 - DNA, 22 bp, Homo sapiens
gaaatggtaaacattttaatgg

SEQ ID NO: 7848872 - DNA, 22 bp, Homo sapiens
gaaatgctacacttgttaatga

SEQ ID NO: 7848873 - DNA, 22 bp, Homo sapiens
gaaatggtagagtaggaagatt

SEQ ID NO: 7848874 - DNA, 22 bp, Homo sapiens
gaaatgtaattctcttgaagat

SEQ ID NO: 7848875 - DNA, 22 bp, Homo sapiens
gaaatgtaattctcttgaagat

SEQ ID NO: 7848876 - DNA, 22 bp, Homo sapiens
gaaatgcaaattctctctcgct

SEQ ID NO: 7848877 - DNA, 22 bp, Homo sapiens
gaaatctacgattagtgaaaat

SEQ ID NO: 7848878 - DNA, 22 bp, Homo sapiens
gaaatctacgattagtgaaaat

SEQ ID NO: 7848879 - DNA, 22 bp, Homo sapiens
gaaatcatctgagtaataatct

SEQ ID NO: 7848880 - DNA, 22 bp, Homo sapiens
gaaatccagttccctactctta

SEQ ID NO: 7848881 - DNA, 22 bp, Homo sapiens
gaaatgcagattctgattctgt

SEQ ID NO: 7848882 - DNA, 22 bp, Homo sapiens
gaaatgcaggcttggattcagc

SEQ ID NO: 7848883 - DNA, 22 bp, Homo sapiens
gaaatgcagaacctgagaccat

SEQ ID NO: 7848884 - DNA, 22 bp, Homo sapiens
gaaatcattagcaaagatatgt

SEQ ID NO: 7848885 - DNA, 22 bp, Homo sapiens
gaaatcattagcaaagatatgt

SEQ ID NO: 7848886 - DNA, 22 bp, Homo sapiens
gaaatcatctgagtaataatct

SEQ ID NO: 7848887 - DNA, 22 bp, Homo sapiens
gaaatcatctgagtaataatct

SEQ ID NO: 7848888 - DNA, 22 bp, Homo sapiens
gaacatttggatttgtaaattt

SEQ ID NO: 7848889 - DNA, 22 bp, Homo sapiens
gaacatttggatttgtaaattt

SEQ ID NO: 7848890 - DNA, 22 bp, Homo sapiens
gaacatttggatttgtaaattt

SEQ ID NO: 7848891 - DNA, 22 bp, Homo sapiens
gaacagtttccctgtagaaaat

SEQ ID NO: 7848892 - DNA, 22 bp, Homo sapiens
gaacatttggatttgtaaattt

SEQ ID NO: 7848893 - DNA, 22 bp, Homo sapiens
gaacatttggatttgtaaattt

SEQ ID NO: 7848894 - DNA, 22 bp, Homo sapiens
gaacatttggcatgagaatttg

SEQ ID NO: 7848895 - DNA, 22 bp, Homo sapiens
gaacatttggcatgagaatttg

SEQ ID NO: 7848896 - DNA, 22 bp, Homo sapiens
gaacatttggatttgtaaattt

SEQ ID NO: 7848897 - DNA, 22 bp, Homo sapiens
gaacatttggcatgagaatttg

SEQ ID NO: 7848898 - DNA, 22 bp, Homo sapiens
gaacagtagatgagatgctaga

SEQ ID NO: 7848899 - DNA, 22 bp, Homo sapiens
gaacagtatcagtagtgccagt

SEQ ID NO: 7848900 - DNA, 22 bp, Homo sapiens
gaacagtactaagagctttaca

SEQ ID NO: 7848901 - DNA, 22 bp, Homo sapiens
gaacagtactaagagctttaca

SEQ ID NO: 7848902 - DNA, 22 bp, Homo sapiens
gaacagtaactgtctgctgtgt

SEQ ID NO: 7848903 - DNA, 22 bp, Homo sapiens
gaacagtaaatttatgcagcac

SEQ ID NO: 7848904 - DNA, 22 bp, Homo sapiens
gaacagtatttccaggaatccc

SEQ ID NO: 7848905 - DNA, 22 bp, Homo sapiens
gaacagtatcagtagtgccagt

SEQ ID NO: 7848906 - DNA, 20 bp, Homo sapiens
gaacagtcttctgagccaca

SEQ ID NO: 7848907 - DNA, 20 bp, Homo sapiens
gaacagtcttctgagccaca

SEQ ID NO: 7848908 - DNA, 22 bp, Homo sapiens
gaacagtcttgagggtggccag

SEQ ID NO: 7848909 - DNA, 22 bp, Homo sapiens
gaacagctgctagagatctgtg

SEQ ID NO: 7848910 - DNA, 22 bp, Homo sapiens
gaacagctataatcatctgtcc

SEQ ID NO: 7848911 - DNA, 22 bp, Homo sapiens
gaacagctgctagagatctgtg

SEQ ID NO: 7848912 - DNA, 22 bp, Homo sapiens
gaacagctataatcatctgtcc

SEQ ID NO: 7848913 - DNA, 22 bp, Homo sapiens
gaacagctctgaagcagtaaat

SEQ ID NO: 7848914 - DNA, 22 bp, Homo sapiens
gaacagcagtcactcatgttat

SEQ ID NO: 7848915 - DNA, 22 bp, Homo sapiens
gaacagcatgcatgcaagacta

SEQ ID NO: 7848916 - DNA, 22 bp, Homo sapiens
gaacagcatgcatgcaagacta

SEQ ID NO: 7848917 - DNA, 22 bp, Homo sapiens
gaacagcatgtaagaagctact

SEQ ID NO: 7848918 - DNA, 22 bp, Homo sapiens
gaacagcatgtaagaagctact

SEQ ID NO: 7848919 - DNA, 22 bp, Homo sapiens
gaacagcctcaataacatcctt

SEQ ID NO: 7848920 - DNA, 22 bp, Homo sapiens
gaacagccctgttaagtctgtt

SEQ ID NO: 7848921 - DNA, 22 bp, Homo sapiens
gaacagcatgtaagaagctact

SEQ ID NO: 7848922 - DNA, 22 bp, Homo sapiens
gaacagggttgggtgagagagg

SEQ ID NO: 7848923 - DNA, 22 bp, Homo sapiens
gaacagggttgggtgagagagg

SEQ ID NO: 7848924 - DNA, 22 bp, Homo sapiens
gaacagggtttgagaggcttag

SEQ ID NO: 7848925 - DNA, 22 bp, Homo sapiens
gaacagcttcttgggagctggg

SEQ ID NO: 7848926 - DNA, 21 bp, Homo sapiens
gaacaggaaaagctggcttca

SEQ ID NO: 7848927 - DNA, 22 bp, Homo sapiens
gaacaggctggagtagcacaga

SEQ ID NO: 7848928 - DNA, 22 bp, Homo sapiens
gaacaggctggagtagcacaga

SEQ ID NO: 7848929 - DNA, 22 bp, Homo sapiens
gaacaggaacatattggctctc

SEQ ID NO: 7848930 - DNA, 22 bp, Homo sapiens
gaagagctatgtccagggagca

SEQ ID NO: 7848931 - DNA, 22 bp, Homo sapiens
gaagagctaaaggcacaggctt

SEQ ID NO: 7848932 - DNA, 22 bp, Homo sapiens
gaagagctatgtccagggagca

SEQ ID NO: 7848933 - DNA, 22 bp, Homo sapiens
gaagagctatgtccagggagca

SEQ ID NO: 7848934 - DNA, 22 bp, Homo sapiens
gaagagctgacagtgtcatcct

SEQ ID NO: 7848935 - DNA, 22 bp, Homo sapiens
gaagagctccaaaaacagtgag

SEQ ID NO: 7848936 - DNA, 22 bp, Homo sapiens
gaagagctccaaaaacagtgag

SEQ ID NO: 7848937 - DNA, 22 bp, Homo sapiens
gaagagctccaaaaacagtgag

SEQ ID NO: 7848938 - DNA, 22 bp, Homo sapiens
gaagagctccaaaaacagtgag

SEQ ID NO: 7848939 - DNA, 22 bp, Homo sapiens
gaagagctgacagtgtcatcct

SEQ ID NO: 7848940 - DNA, 22 bp, Homo sapiens
gaagagctgacagtgtcatcct

SEQ ID NO: 7848941 - DNA, 22 bp, Homo sapiens
gaagagctgcacactggggact

SEQ ID NO: 7848942 - DNA, 22 bp, Homo sapiens
gaagagctgcacactggggact

SEQ ID NO: 7848943 - DNA, 22 bp, Homo sapiens
gaagagctgctcagaacatgat

SEQ ID NO: 7848944 - DNA, 22 bp, Homo sapiens
gaagagctgcagtttcctgggc

SEQ ID NO: 7848945 - DNA, 22 bp, Homo sapiens
gaagagctgcacactggggact

SEQ ID NO: 7848946 - DNA, 22 bp, Homo sapiens
gaagagctgcagtttcctgggc

SEQ ID NO: 7848947 - DNA, 22 bp, Homo sapiens
gaagagaaaggcaaggagtttt

SEQ ID NO: 7848948 - DNA, 22 bp, Homo sapiens
gaagagaagcatcaataggtaa

SEQ ID NO: 7848949 - DNA, 22 bp, Homo sapiens
gaagagaaaggcaaggagtttt

SEQ ID NO: 7848950 - DNA, 22 bp, Homo sapiens
gaagagaaaggcaaggagtttt

SEQ ID NO: 7848951 - DNA, 22 bp, Homo sapiens
gaagagaaaggcaaggagtttt

SEQ ID NO: 7848952 - DNA, 22 bp, Homo sapiens
gaagactctaagagaaatatga

SEQ ID NO: 7848953 - DNA, 22 bp, Homo sapiens
gaagactttaagccgagattag

SEQ ID NO: 7848954 - DNA, 22 bp, Homo sapiens
gaagagaagcatcaataggtaa

SEQ ID NO: 7848955 - DNA, 22 bp, Homo sapiens
gaagagaagcatcaataggtaa

SEQ ID NO: 7848956 - DNA, 22 bp, Homo sapiens
gaagagaagcatcaataggtaa

SEQ ID NO: 7848957 - DNA, 22 bp, Homo sapiens
gaagagaagcatcaataggtaa

SEQ ID NO: 7848958 - DNA, 22 bp, Homo sapiens
gaagagaaggtgtaggccatcc

SEQ ID NO: 7848959 - DNA, 22 bp, Homo sapiens
gaagagctaaaggcacaggctt

SEQ ID NO: 7848960 - DNA, 22 bp, Homo sapiens
gaagagctaaaggcacaggctt

SEQ ID NO: 7848961 - DNA, 22 bp, Homo sapiens
gaagagaaggtgtaggccatcc

SEQ ID NO: 7848962 - DNA, 22 bp, Homo sapiens
gaagagaagcatcaataggtaa

SEQ ID NO: 7848963 - DNA, 22 bp, Homo sapiens
gaagagaaggtgtaggccatcc

SEQ ID NO: 7848964 - DNA, 22 bp, Homo sapiens
gaagagaaggtgtaggccatcc

SEQ ID NO: 7848965 - DNA, 22 bp, Homo sapiens
gaagagaaggtgtaggccatcc

SEQ ID NO: 7848966 - DNA, 22 bp, Homo sapiens
gaagagctgtgattcaggctta

SEQ ID NO: 7848967 - DNA, 22 bp, Homo sapiens
gaagagctgtcagaaaagctaa

SEQ ID NO: 7848968 - DNA, 22 bp, Homo sapiens
gaagagctgtcagaaaagctaa

SEQ ID NO: 7848969 - DNA, 22 bp, Homo sapiens
gaagagctgtcagaaaagctaa

SEQ ID NO: 7848970 - DNA, 22 bp, Homo sapiens
gaagagctgtcagaaaagctaa

SEQ ID NO: 7848971 - DNA, 22 bp, Homo sapiens
gaagagctgtagcctgctcttt

SEQ ID NO: 7848972 - DNA, 22 bp, Homo sapiens
gaagagctggaatccagtctgg

SEQ ID NO: 7848973 - DNA, 22 bp, Homo sapiens
gaagagctgctcagaacatgat

SEQ ID NO: 7848974 - DNA, 22 bp, Homo sapiens
gaagagctggaatccagtctgg

SEQ ID NO: 7848975 - DNA, 22 bp, Homo sapiens
gaagagcttagacagaatcaaa

SEQ ID NO: 7848976 - DNA, 22 bp, Homo sapiens
gaagagcttagacagaatcaaa

SEQ ID NO: 7848977 - DNA, 22 bp, Homo sapiens
gaagagctgtgattcaggctta

SEQ ID NO: 7848978 - DNA, 22 bp, Homo sapiens
gaagagctgtgattcaggctta

SEQ ID NO: 7848979 - DNA, 22 bp, Homo sapiens
gaagagctgtgattcaggctta

SEQ ID NO: 7848980 - DNA, 22 bp, Homo sapiens
gaagagcttagttgtcctagaa

SEQ ID NO: 7848981 - DNA, 22 bp, Homo sapiens
gaagagcttagttgtcctagaa

SEQ ID NO: 7848982 - DNA, 22 bp, Homo sapiens
gaagaggatgacaggagccggt

SEQ ID NO: 7848983 - DNA, 22 bp, Homo sapiens
gaagaggatgacaggagccggt

SEQ ID NO: 7848984 - DNA, 22 bp, Homo sapiens
gaagaggatgacaggagccggt

SEQ ID NO: 7848985 - DNA, 22 bp, Homo sapiens
gaagaggatgacaggagccggt

SEQ ID NO: 7848986 - DNA, 22 bp, Homo sapiens
gaagaggatgacaggagccggt

SEQ ID NO: 7848987 - DNA, 22 bp, Homo sapiens
gaagaggactgtggcatcctag

SEQ ID NO: 7848988 - DNA, 22 bp, Homo sapiens
gaagaggctttcctagggcaag

SEQ ID NO: 7848989 - DNA, 22 bp, Homo sapiens
gaagaggctttcctagggcaag

SEQ ID NO: 7848990 - DNA, 22 bp, Homo sapiens
gaagaggcaattgaataagcta

SEQ ID NO: 7848991 - DNA, 22 bp, Homo sapiens
gaaccatttctgaatagtttgt

SEQ ID NO: 7848992 - DNA, 22 bp, Homo sapiens
gaaccagcagttgcctgaaaaa

SEQ ID NO: 7848993 - DNA, 22 bp, Homo sapiens
gaaccagcagactttgacaggt

SEQ ID NO: 7848994 - DNA, 22 bp, Homo sapiens
gaaccagcagccctgcagaagt

SEQ ID NO: 7848995 - DNA, 22 bp, Homo sapiens
gaaccattgttgaaaagaatag

SEQ ID NO: 7848996 - DNA, 22 bp, Homo sapiens
gaacccagaggatatgggaaag

SEQ ID NO: 7848997 - DNA, 21 bp, Homo sapiens
gaacccagcagcagtgctctg

SEQ ID NO: 7848998 - DNA, 22 bp, Homo sapiens
gaagacaattctgggtggagga

SEQ ID NO: 7848999 - DNA, 22 bp, Homo sapiens
gaagacaattctgggtggagga

SEQ ID NO: 7849000 - DNA, 21 bp, Homo sapiens
gaacccagcagcagtgctctg

SEQ ID NO: 7849001 - DNA, 21 bp, Homo sapiens
gaacatttgggttgtttctac

SEQ ID NO: 7849002 - DNA, 21 bp, Homo sapiens
gaacatttgggttgtttctac

SEQ ID NO: 7849003 - DNA, 21 bp, Homo sapiens
gaacatttgggttgtttctac

SEQ ID NO: 7849004 - DNA, 21 bp, Homo sapiens
gaacatttgggttgtttctac

SEQ ID NO: 7849005 - DNA, 21 bp, Homo sapiens
gaacatttgggttgtttctac

SEQ ID NO: 7849006 - DNA, 22 bp, Homo sapiens
gaacatttggcatgagaatttg

SEQ ID NO: 7849007 - DNA, 20 bp, Homo sapiens
gaacatttggccatactgag

SEQ ID NO: 7849008 - DNA, 22 bp, Homo sapiens
gaagacagaaacctgtttggct

SEQ ID NO: 7849009 - DNA, 22 bp, Homo sapiens
gaagacagaaacctgtttggct

SEQ ID NO: 7849010 - DNA, 22 bp, Homo sapiens
gaagacatgtggattctagttt

SEQ ID NO: 7849011 - DNA, 22 bp, Homo sapiens
gaagacatcatggagaggatag

SEQ ID NO: 7849012 - DNA, 22 bp, Homo sapiens
gaagacactctgcagagttatc

SEQ ID NO: 7849013 - DNA, 22 bp, Homo sapiens
gaagacatgtggattctagttt

SEQ ID NO: 7849014 - DNA, 22 bp, Homo sapiens
gaagacatgtttttaatatgta

SEQ ID NO: 7849015 - DNA, 22 bp, Homo sapiens
gaagaccactgtgaaatgccat

SEQ ID NO: 7849016 - DNA, 22 bp, Homo sapiens
gaagaccaccccctacagcaca

SEQ ID NO: 7849017 - DNA, 22 bp, Homo sapiens
gaagacattttatgcatactct

SEQ ID NO: 7849018 - DNA, 22 bp, Homo sapiens
gaagaccaatttgggccatggc

SEQ ID NO: 7849019 - DNA, 22 bp, Homo sapiens
gaagacctcataattcacatgc

SEQ ID NO: 7849020 - DNA, 22 bp, Homo sapiens
gaagaccatattcagcaggcat

SEQ ID NO: 7849021 - DNA, 22 bp, Homo sapiens
gaagactactgttgcactcata

SEQ ID NO: 7849022 - DNA, 22 bp, Homo sapiens
gaagacctgtttatgctgcatt

SEQ ID NO: 7849023 - DNA, 22 bp, Homo sapiens
gaagacgagataaaatggtgtc

SEQ ID NO: 7849024 - DNA, 22 bp, Homo sapiens
gaagatttttcttaatgctccg

SEQ ID NO: 7849025 - DNA, 22 bp, Homo sapiens
gaagattttctcctttaaatga

SEQ ID NO: 7849026 - DNA, 22 bp, Homo sapiens
gaagcaaaatgtctgcacatat

SEQ ID NO: 7849027 - DNA, 22 bp, Homo sapiens
gaagcaaaatgtctgcacatat

SEQ ID NO: 7849028 - DNA, 22 bp, Homo sapiens
gaagattttctcctttaaatga

SEQ ID NO: 7849029 - DNA, 22 bp, Homo sapiens
gaagattttctcctttaaatga

SEQ ID NO: 7849030 - DNA, 22 bp, Homo sapiens
gaagatttggattccatgtcac

SEQ ID NO: 7849031 - DNA, 22 bp, Homo sapiens
gaagccaggggcctgacaggca

SEQ ID NO: 7849032 - DNA, 22 bp, Homo sapiens
gaagccaggggcctgacaggca

SEQ ID NO: 7849033 - DNA, 22 bp, Homo sapiens
gaagccagcagtggagaaagga

SEQ ID NO: 7849034 - DNA, 22 bp, Homo sapiens
gaagccaggggcctgacaggca

SEQ ID NO: 7849035 - DNA, 22 bp, Homo sapiens
gaagccaggggcctgacaggca

SEQ ID NO: 7849036 - DNA, 22 bp, Homo sapiens
gaagccagcatccctctcccat

SEQ ID NO: 7849037 - DNA, 22 bp, Homo sapiens
gaagccagccttgtctgcctct

SEQ ID NO: 7849038 - DNA, 22 bp, Homo sapiens
gaagccagcatccctctcccat

SEQ ID NO: 7849039 - DNA, 22 bp, Homo sapiens
gaagccagattatcacaagcca

SEQ ID NO: 7849040 - DNA, 22 bp, Homo sapiens
gaagccagatttggggcatatc

SEQ ID NO: 7849041 - DNA, 22 bp, Homo sapiens
gaagccagatttggggcatatc

SEQ ID NO: 7849042 - DNA, 22 bp, Homo sapiens
gaagccagattatcacaagcca

SEQ ID NO: 7849043 - DNA, 22 bp, Homo sapiens
gaagccagcagtggagaaagga

SEQ ID NO: 7849044 - DNA, 22 bp, Homo sapiens
gaagccagatttggggcatatc

SEQ ID NO: 7849045 - DNA, 22 bp, Homo sapiens
gaagccagcagtggagaaagga

SEQ ID NO: 7849046 - DNA, 22 bp, Homo sapiens
gaagccagatttggggcatatc

SEQ ID NO: 7849047 - DNA, 22 bp, Homo sapiens
gaagccagcagtggagaaagga

SEQ ID NO: 7849048 - DNA, 22 bp, Homo sapiens
gaagccaggggcctgacaggca

SEQ ID NO: 7849049 - DNA, 22 bp, Homo sapiens
gaagccaggggcctgacaggca

SEQ ID NO: 7849050 - DNA, 22 bp, Homo sapiens
gaagccagtactgtgctctgca

SEQ ID NO: 7849051 - DNA, 22 bp, Homo sapiens
gaagccagtactgtgctctgca

SEQ ID NO: 7849052 - DNA, 22 bp, Homo sapiens
gaagccagtgtttgaagaattt

SEQ ID NO: 7849053 - DNA, 22 bp, Homo sapiens
gaagccagtgtttgaagaattt

SEQ ID NO: 7849054 - DNA, 22 bp, Homo sapiens
gaagccagtgtttgaagaattt

SEQ ID NO: 7849055 - DNA, 22 bp, Homo sapiens
gaagcccacgtttggtgatgta

SEQ ID NO: 7849056 - DNA, 22 bp, Homo sapiens
gaagcccacgtttggtgatgta

SEQ ID NO: 7849057 - DNA, 22 bp, Homo sapiens
gaagcccagcaaactgtgatca

SEQ ID NO: 7849058 - DNA, 22 bp, Homo sapiens
gaagcccaggcttccttggctt

SEQ ID NO: 7849059 - DNA, 22 bp, Homo sapiens
gaagcccaggcttccttggctt

SEQ ID NO: 7849060 - DNA, 22 bp, Homo sapiens
gaagcccaggcttccttggctt

SEQ ID NO: 7849061 - DNA, 22 bp, Homo sapiens
gaagcccagcaaactgtgatca

SEQ ID NO: 7849062 - DNA, 22 bp, Homo sapiens
gaagcccagcaaactgtgatca

SEQ ID NO: 7849063 - DNA, 22 bp, Homo sapiens
gaagcccagggcgtggccgggc

SEQ ID NO: 7849064 - DNA, 22 bp, Homo sapiens
gaagcccagggcgtggccgggc

SEQ ID NO: 7849065 - DNA, 22 bp, Homo sapiens
gaagatgttatggagagctcag

SEQ ID NO: 7849066 - DNA, 22 bp, Homo sapiens
gaagatgtgggcccactccaga

SEQ ID NO: 7849067 - DNA, 22 bp, Homo sapiens
gaagatgttatggagagctcag

SEQ ID NO: 7849068 - DNA, 20 bp, Homo sapiens
gaagatgggtagaggcacag

SEQ ID NO: 7849069 - DNA, 20 bp, Homo sapiens
gaagatgggtagaggcacag

SEQ ID NO: 7849070 - DNA, 22 bp, Homo sapiens
gaagattgaaggctgggaatta

SEQ ID NO: 7849071 - DNA, 22 bp, Homo sapiens
gaagattgaaggctgggaatta

SEQ ID NO: 7849072 - DNA, 22 bp, Homo sapiens
gaagattgaaggctgggaatta

SEQ ID NO: 7849073 - DNA, 22 bp, Homo sapiens
gaagatttataaggaccttatt

SEQ ID NO: 7849074 - DNA, 22 bp, Homo sapiens
gaagattaaacatatttagtgt

SEQ ID NO: 7849075 - DNA, 22 bp, Homo sapiens
gaagatttaagcacaatagtct

SEQ ID NO: 7849076 - DNA, 22 bp, Homo sapiens
gaagattggggcctctgcaccc

SEQ ID NO: 7849077 - DNA, 22 bp, Homo sapiens
gaagatttcagttaagtatcta

SEQ ID NO: 7849078 - DNA, 22 bp, Homo sapiens
gaagatttctgatgagttactt

SEQ ID NO: 7849079 - DNA, 22 bp, Homo sapiens
gaagatttctttatgaaagatg

SEQ ID NO: 7849080 - DNA, 22 bp, Homo sapiens
gaagatttctttatgaaagatg

SEQ ID NO: 7849081 - DNA, 22 bp, Homo sapiens
gaagataattcctacttataac

SEQ ID NO: 7849082 - DNA, 22 bp, Homo sapiens
gaagataattcctacttataac

SEQ ID NO: 7849083 - DNA, 22 bp, Homo sapiens
gaagatattctctaaatacttt

SEQ ID NO: 7849084 - DNA, 22 bp, Homo sapiens
gaagatattctctaaatacttt

SEQ ID NO: 7849085 - DNA, 22 bp, Homo sapiens
gaagatattctctaaatacttt

SEQ ID NO: 7849086 - DNA, 22 bp, Homo sapiens
gaagatgggaatgatgagtggg

SEQ ID NO: 7849087 - DNA, 22 bp, Homo sapiens
gaagatgggaatgatgagtggg

SEQ ID NO: 7849088 - DNA, 20 bp, Homo sapiens
gaagatgggtagaggcacag

SEQ ID NO: 7849089 - DNA, 20 bp, Homo sapiens
gaagatgggtagaggcacag

SEQ ID NO: 7849090 - DNA, 22 bp, Homo sapiens
gaagatgggaatgatgagtggg

SEQ ID NO: 7849091 - DNA, 22 bp, Homo sapiens
gaagatgggaatgatgagtggg

SEQ ID NO: 7849092 - DNA, 22 bp, Homo sapiens
gaagatgggaatgatgagtggg

SEQ ID NO: 7849093 - DNA, 22 bp, Homo sapiens
gaagaggctttcctagggcaag

SEQ ID NO: 7849094 - DNA, 22 bp, Homo sapiens
gaagaggctttcctagggcaag

SEQ ID NO: 7849095 - DNA, 22 bp, Homo sapiens
gaagaggctttcctagggcaag

SEQ ID NO: 7849096 - DNA, 22 bp, Homo sapiens
gaagaggctttcctagggcaag

SEQ ID NO: 7849097 - DNA, 22 bp, Homo sapiens
gaagaggctttcctagggcaag

SEQ ID NO: 7849098 - DNA, 22 bp, Homo sapiens
gaagaggctttcctagggcaag

SEQ ID NO: 7849099 - DNA, 22 bp, Homo sapiens
gaagaggtagcattggcaggtg

SEQ ID NO: 7849100 - DNA, 22 bp, Homo sapiens
gaagataactttaaaaagtggc

SEQ ID NO: 7849101 - DNA, 22 bp, Homo sapiens
gaagagtatatttagtgaaatc

SEQ ID NO: 7849102 - DNA, 22 bp, Homo sapiens
gaagagtggttatccctgctgt

SEQ ID NO: 7849103 - DNA, 23 bp, Homo sapiens
gaagagttgcaaagacgggacag

SEQ ID NO: 7849104 - DNA, 22 bp, Homo sapiens
ctagccagatttaaagagagac

SEQ ID NO: 7849105 - DNA, 22 bp, Homo sapiens
ctagccagatttaaagagagac

SEQ ID NO: 7849106 - DNA, 22 bp, Homo sapiens
ctagccagatttaaagagagac

SEQ ID NO: 7849107 - DNA, 22 bp, Homo sapiens
ctatatatatcatcttccagtt

SEQ ID NO: 7849108 - DNA, 22 bp, Homo sapiens
ctatatacttttcacagatgtt

SEQ ID NO: 7849109 - DNA, 22 bp, Homo sapiens
ctatatacttttcacagatgtt

SEQ ID NO: 7849110 - DNA, 22 bp, Homo sapiens
ctatatacttttcacagatgtt

SEQ ID NO: 7849111 - DNA, 22 bp, Homo sapiens
ctagcatctcactgatttactg

SEQ ID NO: 7849112 - DNA, 22 bp, Homo sapiens
ctagccagatgattcccaaata

SEQ ID NO: 7849113 - DNA, 22 bp, Homo sapiens
ctagccagatgattcccaaata

SEQ ID NO: 7849114 - DNA, 22 bp, Homo sapiens
ctagccagactcaagggccacc

SEQ ID NO: 7849115 - DNA, 22 bp, Homo sapiens
ctagccagactcaagggccacc

SEQ ID NO: 7849116 - DNA, 22 bp, Homo sapiens
ctagcatctcactgatttactg

SEQ ID NO: 7849117 - DNA, 22 bp, Homo sapiens
ctagcatcagatgagaagctgt

SEQ ID NO: 7849118 - DNA, 22 bp, Homo sapiens
ctagcagtgtactcaacaaggg

SEQ ID NO: 7849119 - DNA, 22 bp, Homo sapiens
ctagcatcagatgagaagctgt

SEQ ID NO: 7849120 - DNA, 22 bp, Homo sapiens
ctagcaggtcaaaccagctgat

SEQ ID NO: 7849121 - DNA, 22 bp, Homo sapiens
ctagcagggattgggcactggg

SEQ ID NO: 7849122 - DNA, 22 bp, Homo sapiens
ctagcagggattgggcactggg

SEQ ID NO: 7849123 - DNA, 22 bp, Homo sapiens
ctagcagctctgatatttacaa

SEQ ID NO: 7849124 - DNA, 22 bp, Homo sapiens
ctagcaggctaatgtaagcttg

SEQ ID NO: 7849125 - DNA, 22 bp, Homo sapiens
ctagcagggtcgacgtctggcg

SEQ ID NO: 7849126 - DNA, 22 bp, Homo sapiens
ctagcaggtcaaaccagctgat

SEQ ID NO: 7849127 - DNA, 22 bp, Homo sapiens
ctagcagcatcacaggaagact

SEQ ID NO: 7849128 - DNA, 22 bp, Homo sapiens
ctagcagcatcacaggaagact

SEQ ID NO: 7849129 - DNA, 22 bp, Homo sapiens
ctagcagcatcacaggaagact

SEQ ID NO: 7849130 - DNA, 22 bp, Homo sapiens
ctagcagcatcacaggaagact

SEQ ID NO: 7849131 - DNA, 22 bp, Homo sapiens
ctagcagaagctccttgagggt

SEQ ID NO: 7849132 - DNA, 22 bp, Homo sapiens
ctagcagctctgatatttacaa

SEQ ID NO: 7849133 - DNA, 22 bp, Homo sapiens
ctagcagcattcttctagttag

SEQ ID NO: 7849134 - DNA, 22 bp, Homo sapiens
ctagcagcattcttctagttag

SEQ ID NO: 7849135 - DNA, 22 bp, Homo sapiens
ctagcagcattcttctagttag

SEQ ID NO: 7849136 - DNA, 22 bp, Homo sapiens
ttctctggccatagctggctag

SEQ ID NO: 7849137 - DNA, 22 bp, Homo sapiens
ttctctggatgtttctcagtca

SEQ ID NO: 7849138 - DNA, 22 bp, Homo sapiens
ttctctggatgtttctcagtca

SEQ ID NO: 7849139 - DNA, 22 bp, Homo sapiens
ttctctggccatagctggctag

SEQ ID NO: 7849140 - DNA, 22 bp, Homo sapiens
ttctctggcctgaggcgaggcc

SEQ ID NO: 7849141 - DNA, 22 bp, Homo sapiens
ttctctggccatagctggctag

SEQ ID NO: 7849142 - DNA, 22 bp, Homo sapiens
ttctctggcggtgtgttttcct

SEQ ID NO: 7849143 - DNA, 22 bp, Homo sapiens
ttctctggcgcgctgtgctatg

SEQ ID NO: 7849144 - DNA, 22 bp, Homo sapiens
ttctctggcctgaggcgaggcc

SEQ ID NO: 7849145 - DNA, 22 bp, Homo sapiens
ttctctggcctgaggcgaggcc

SEQ ID NO: 7849146 - DNA, 22 bp, Homo sapiens
ttctctggcgcgctgtgctatg

SEQ ID NO: 7849147 - DNA, 22 bp, Homo sapiens
ctagcacagtatggtatcagat

SEQ ID NO: 7849148 - DNA, 22 bp, Homo sapiens
ctagcactgagaatagtgcata

SEQ ID NO: 7849149 - DNA, 22 bp, Homo sapiens
ctagcaccagcctgagagtttt

SEQ ID NO: 7849150 - DNA, 22 bp, Homo sapiens
ctagatttgcatgcctacacca

SEQ ID NO: 7849151 - DNA, 22 bp, Homo sapiens
ctagatttgcatgcctacacca

SEQ ID NO: 7849152 - DNA, 22 bp, Homo sapiens
ctagatttctagttcattatcc

SEQ ID NO: 7849153 - DNA, 22 bp, Homo sapiens
ctagatttctagttcattatcc

SEQ ID NO: 7849154 - DNA, 22 bp, Homo sapiens
ctagattctttctactattatc

SEQ ID NO: 7849155 - DNA, 22 bp, Homo sapiens
ttctctgggaacataaatgaag

SEQ ID NO: 7849156 - DNA, 22 bp, Homo sapiens
ttctctgggaacataaatgaag

SEQ ID NO: 7849157 - DNA, 23 bp, Homo sapiens
ctagatgcaagctccatgaggga

SEQ ID NO: 7849158 - DNA, 22 bp, Homo sapiens
ctagattcatatatttttggag

SEQ ID NO: 7849159 - DNA, 22 bp, Homo sapiens
ctagattcaatatttttctgcc

SEQ ID NO: 7849160 - DNA, 21 bp, Homo sapiens
ttctctggcttctgtagctgg

SEQ ID NO: 7849161 - DNA, 22 bp, Homo sapiens
ttctctggcggtgtgttttcct

SEQ ID NO: 7849162 - DNA, 21 bp, Homo sapiens
ttctctggcttctgtagctgg

SEQ ID NO: 7849163 - DNA, 19 bp, Homo sapiens
ctatgtttatatatccagt

SEQ ID NO: 7849164 - DNA, 22 bp, Homo sapiens
ctatgtttatctgtatttctgt

SEQ ID NO: 7849165 - DNA, 22 bp, Homo sapiens
ctatgtttatctgtatttctgt

SEQ ID NO: 7849166 - DNA, 22 bp, Homo sapiens
ctatgtttatctgtatttctgt

SEQ ID NO: 7849167 - DNA, 22 bp, Homo sapiens
ctattaaacactactgtgcact

SEQ ID NO: 7849168 - DNA, 22 bp, Homo sapiens
ctattaaacactactgtgcact

SEQ ID NO: 7849169 - DNA, 22 bp, Homo sapiens
ctattaaatactcttcaaattg

SEQ ID NO: 7849170 - DNA, 22 bp, Homo sapiens
ctattaaatactcttcaaattg

SEQ ID NO: 7849171 - DNA, 22 bp, Homo sapiens
ctattaaatactcttcaaattg

SEQ ID NO: 7849172 - DNA, 22 bp, Homo sapiens
ctattaaacactactgtgcact

SEQ ID NO: 7849173 - DNA, 22 bp, Homo sapiens
ctattaaatactcttcaaattg

SEQ ID NO: 7849174 - DNA, 22 bp, Homo sapiens
ctattaaatactcttcaaattg

SEQ ID NO: 7849175 - DNA, 22 bp, Homo sapiens
ctattaaatactcttcaaattg

SEQ ID NO: 7849176 - DNA, 22 bp, Homo sapiens
ctattaaatactcttcaaattg

SEQ ID NO: 7849177 - DNA, 22 bp, Homo sapiens
ctattaaatactcttcaaattg

SEQ ID NO: 7849178 - DNA, 18 bp, Homo sapiens
ctattacaatgcagtggt

SEQ ID NO: 7849179 - DNA, 18 bp, Homo sapiens
ctattacaatgcagtggt

SEQ ID NO: 7849180 - DNA, 18 bp, Homo sapiens
ctattacaatgcagtggt

SEQ ID NO: 7849181 - DNA, 22 bp, Homo sapiens
ctattacaattctgcaaggagt

SEQ ID NO: 7849182 - DNA, 22 bp, Homo sapiens
ctattacaatctgctactatga

SEQ ID NO: 7849183 - DNA, 22 bp, Homo sapiens
ctattacaatctgctactatga

SEQ ID NO: 7849184 - DNA, 22 bp, Homo sapiens
ctattacatttctggacattca

SEQ ID NO: 7849185 - DNA, 22 bp, Homo sapiens
ctattacagggaagccttggga

SEQ ID NO: 7849186 - DNA, 22 bp, Homo sapiens
ctatgtatgcgattagaatttt

SEQ ID NO: 7849187 - DNA, 22 bp, Homo sapiens
ctatgtctcactccctagtcag

SEQ ID NO: 7849188 - DNA, 22 bp, Homo sapiens
ctatgtactggattagctccca

SEQ ID NO: 7849189 - DNA, 22 bp, Homo sapiens
ctatgtaccatgcctgatgtta

SEQ ID NO: 7849190 - DNA, 23 bp, Homo sapiens
ctatggttttaaaggtggatatc

SEQ ID NO: 7849191 - DNA, 22 bp, Homo sapiens
ctatggtctggaccgaggtcct

SEQ ID NO: 7849192 - DNA, 22 bp, Homo sapiens
ctatggtgatagaaatcagaat

SEQ ID NO: 7849193 - DNA, 22 bp, Homo sapiens
ctatggctcaattctagtggtt

SEQ ID NO: 7849194 - DNA, 22 bp, Homo sapiens
ctatggctcaattctagtggtt

SEQ ID NO: 7849195 - DNA, 22 bp, Homo sapiens
ctatggctctggttatggctgt

SEQ ID NO: 7849196 - DNA, 22 bp, Homo sapiens
ctatggctgccactcaagccaa

SEQ ID NO: 7849197 - DNA, 22 bp, Homo sapiens
ctatggctgtgttcatgctaca

SEQ ID NO: 7849198 - DNA, 22 bp, Homo sapiens
ctatggcttaagattgacatga

SEQ ID NO: 7849199 - DNA, 22 bp, Homo sapiens
ctatggtctggaccgaggtcct

SEQ ID NO: 7849200 - DNA, 22 bp, Homo sapiens
ctatgagaagaaaacaagatta

SEQ ID NO: 7849201 - DNA, 22 bp, Homo sapiens
ctatgcagaatttagtgactta

SEQ ID NO: 7849202 - DNA, 22 bp, Homo sapiens
ctatgagaagaaaacaagatta

SEQ ID NO: 7849203 - DNA, 18 bp, Homo sapiens
ctatgcatgcattgtatc

SEQ ID NO: 7849204 - DNA, 22 bp, Homo sapiens
ctatgcaggccaggtccgcccg

SEQ ID NO: 7849205 - DNA, 23 bp, Homo sapiens
ctatggaataccaatgattctca

SEQ ID NO: 7849206 - DNA, 23 bp, Homo sapiens
ctatggaataccaatgattctca

SEQ ID NO: 7849207 - DNA, 22 bp, Homo sapiens
ctatggaaacctaatcaggaga

SEQ ID NO: 7849208 - DNA, 22 bp, Homo sapiens
ctatggaaactcaacatttgtt

SEQ ID NO: 7849209 - DNA, 22 bp, Homo sapiens
ctcacagcatggaattttctgg

SEQ ID NO: 7849210 - DNA, 22 bp, Homo sapiens
ctcacagctgcttcaggatcca

SEQ ID NO: 7849211 - DNA, 22 bp, Homo sapiens
ctcacaggagaaagtcatggtc

SEQ ID NO: 7849212 - DNA, 22 bp, Homo sapiens
ctcacaggagaaagtcatggtc

SEQ ID NO: 7849213 - DNA, 22 bp, Homo sapiens
ctcacaggagaaagtcatggtc

SEQ ID NO: 7849214 - DNA, 22 bp, Homo sapiens
ctcacaggagaaagtcatggtc

SEQ ID NO: 7849215 - DNA, 22 bp, Homo sapiens
ctcacaggagaaagtcatggtc

SEQ ID NO: 7849216 - DNA, 22 bp, Homo sapiens
ctcacagcagccagtctgcctt

SEQ ID NO: 7849217 - DNA, 22 bp, Homo sapiens
ctcacagcagctctgcgagata

SEQ ID NO: 7849218 - DNA, 22 bp, Homo sapiens
ctcacagcagctctgcgagata

SEQ ID NO: 7849219 - DNA, 22 bp, Homo sapiens
ctcacagcagccagtctgcctt

SEQ ID NO: 7849220 - DNA, 22 bp, Homo sapiens
ctcacagcagccagtctgcctt

SEQ ID NO: 7849221 - DNA, 22 bp, Homo sapiens
ctcacagggttctatcgaagag

SEQ ID NO: 7849222 - DNA, 22 bp, Homo sapiens
ctcacaggtaccagcaccctcc

SEQ ID NO: 7849223 - DNA, 22 bp, Homo sapiens
ctcacaggtaccagcaccctcc

SEQ ID NO: 7849224 - DNA, 22 bp, Homo sapiens
ctcacaggtcatgtggtggctt

SEQ ID NO: 7849225 - DNA, 22 bp, Homo sapiens
ctcacaggttagttgtgtggat

SEQ ID NO: 7849226 - DNA, 22 bp, Homo sapiens
ctcacagggttctatcgaagag

SEQ ID NO: 7849227 - DNA, 22 bp, Homo sapiens
ctcacaggcggtaattcaggga

SEQ ID NO: 7849228 - DNA, 22 bp, Homo sapiens
ctcacaggcatctcatcaggct

SEQ ID NO: 7849229 - DNA, 22 bp, Homo sapiens
ctcacaggcatctcatcaggct

SEQ ID NO: 7849230 - DNA, 22 bp, Homo sapiens
ctcacagatctgtgcctgaacc

SEQ ID NO: 7849231 - DNA, 22 bp, Homo sapiens
ctcacagatctgtgcctgaacc

SEQ ID NO: 7849232 - DNA, 22 bp, Homo sapiens
ctcacagatgatgtctatgtgg

SEQ ID NO: 7849233 - DNA, 22 bp, Homo sapiens
ctcacagatgatgtctatgtgg

SEQ ID NO: 7849234 - DNA, 22 bp, Homo sapiens
ctcacagatatttgcttcaggt

SEQ ID NO: 7849235 - DNA, 22 bp, Homo sapiens
ctcacagatatttgcttcaggt

SEQ ID NO: 7849236 - DNA, 22 bp, Homo sapiens
ctcacagatctgtgcctgaacc

SEQ ID NO: 7849237 - DNA, 22 bp, Homo sapiens
ctcacagatgctgtgggtcagg

SEQ ID NO: 7849238 - DNA, 22 bp, Homo sapiens
ctcacagatgctgtgggtcagg

SEQ ID NO: 7849239 - DNA, 22 bp, Homo sapiens
ctcacagatgctgtgggtcagg

SEQ ID NO: 7849240 - DNA, 22 bp, Homo sapiens
ctcacagatgctgtgggtcagg

SEQ ID NO: 7849241 - DNA, 22 bp, Homo sapiens
ctcacagatgctgtgggtcagg

SEQ ID NO: 7849242 - DNA, 22 bp, Homo sapiens
ctcacagatgtcctggcacttc

SEQ ID NO: 7849243 - DNA, 22 bp, Homo sapiens
ctcacagatgttctcctttagg

SEQ ID NO: 7849244 - DNA, 22 bp, Homo sapiens
ctcacagcaaggaggtaaggta

SEQ ID NO: 7849245 - DNA, 22 bp, Homo sapiens
ctcacagatgtcctggcacttc

SEQ ID NO: 7849246 - DNA, 22 bp, Homo sapiens
ctcacagatgtcctggcacttc

SEQ ID NO: 7849247 - DNA, 22 bp, Homo sapiens
ctcacagagctcatactgggag

SEQ ID NO: 7849248 - DNA, 22 bp, Homo sapiens
ctcacagagctcatactgggag

SEQ ID NO: 7849249 - DNA, 22 bp, Homo sapiens
ctcacagatacggctattcctg

SEQ ID NO: 7849250 - DNA, 22 bp, Homo sapiens
ctcacagagcctctgtgtcttc

SEQ ID NO: 7849251 - DNA, 22 bp, Homo sapiens
ctcacagagcctctgtgtcttc

SEQ ID NO: 7849252 - DNA, 22 bp, Homo sapiens
ctcacagagcctctgtgtcttc

SEQ ID NO: 7849253 - DNA, 22 bp, Homo sapiens
ctcacagagcctctgtgtcttc

SEQ ID NO: 7849254 - DNA, 22 bp, Homo sapiens
ctcaatgagggaaggacagagg

SEQ ID NO: 7849255 - DNA, 22 bp, Homo sapiens
ctcaatgagaggctttggaaag

SEQ ID NO: 7849256 - DNA, 22 bp, Homo sapiens
ctcacacacgaagcccttggcc

SEQ ID NO: 7849257 - DNA, 22 bp, Homo sapiens
ctcacaaccttatgaagcatga

SEQ ID NO: 7849258 - DNA, 22 bp, Homo sapiens
ctcacaatttttcagtgactat

SEQ ID NO: 7849259 - DNA, 22 bp, Homo sapiens
ctcacaatttttcagtgactat

SEQ ID NO: 7849260 - DNA, 20 bp, Homo sapiens
ctcacactggaaaagtctga

SEQ ID NO: 7849261 - DNA, 20 bp, Homo sapiens
ctcacactggaaaagtctga

SEQ ID NO: 7849262 - DNA, 22 bp, Homo sapiens
ctcacactgacttccaggaaca

SEQ ID NO: 7849263 - DNA, 22 bp, Homo sapiens
ctcaaaatccataaaatcaggt

SEQ ID NO: 7849264 - DNA, 22 bp, Homo sapiens
ctcaaaatccataaaatcaggt

SEQ ID NO: 7849265 - DNA, 22 bp, Homo sapiens
ctcaaaatccataaaatcaggt

SEQ ID NO: 7849266 - DNA, 22 bp, Homo sapiens
ctattatttcctcatctataaa

SEQ ID NO: 7849267 - DNA, 22 bp, Homo sapiens
ctatttttctgtaccctaattt

SEQ ID NO: 7849268 - DNA, 22 bp, Homo sapiens
ctattattatgttaactggact

SEQ ID NO: 7849269 - DNA, 22 bp, Homo sapiens
ctattatttcctcatctataaa

SEQ ID NO: 7849270 - DNA, 22 bp, Homo sapiens
ctattattatgttaactggact

SEQ ID NO: 7849271 - DNA, 22 bp, Homo sapiens
ctattattatgttaactggact

SEQ ID NO: 7849272 - DNA, 22 bp, Homo sapiens
ctattattatgttaactggact

SEQ ID NO: 7849273 - DNA, 22 bp, Homo sapiens
ctattattatgttaactggact

SEQ ID NO: 7849274 - DNA, 22 bp, Homo sapiens
ctattattatcctaatttctgt

SEQ ID NO: 7849275 - DNA, 22 bp, Homo sapiens
ctattattaatgtggggctttg

SEQ ID NO: 7849276 - DNA, 22 bp, Homo sapiens
ctattattaatgtggggctttg

SEQ ID NO: 7849277 - DNA, 22 bp, Homo sapiens
ctattattagcaaaaggtggat

SEQ ID NO: 7849278 - DNA, 22 bp, Homo sapiens
ctattattagcaaaaggtggat

SEQ ID NO: 7849279 - DNA, 22 bp, Homo sapiens
ctattattagataatctacttg

SEQ ID NO: 7849280 - DNA, 22 bp, Homo sapiens
ctattattaatgtggggctttg

SEQ ID NO: 7849281 - DNA, 22 bp, Homo sapiens
ctattagaaagcatcttctata

SEQ ID NO: 7849282 - DNA, 22 bp, Homo sapiens
ctattacatttctggacattca

SEQ ID NO: 7849283 - DNA, 22 bp, Homo sapiens
ctattagacacaattagtgatt

SEQ ID NO: 7849284 - DNA, 22 bp, Homo sapiens
ctattagaaagcatcttctata

SEQ ID NO: 7849285 - DNA, 22 bp, Homo sapiens
ctattactgacttctgtattta

SEQ ID NO: 7849286 - DNA, 22 bp, Homo sapiens
ctcaagaggatatgtccagaaa

SEQ ID NO: 7849287 - DNA, 22 bp, Homo sapiens
ctcaagataatgacaaaaagag

SEQ ID NO: 7849288 - DNA, 22 bp, Homo sapiens
ctcaagagatataaaaatgtgg

SEQ ID NO: 7849289 - DNA, 22 bp, Homo sapiens
ctcaaaatggttaattttaata

SEQ ID NO: 7849290 - DNA, 22 bp, Homo sapiens
ctcaagatcatcaatataccaa

SEQ ID NO: 7849291 - DNA, 22 bp, Homo sapiens
ctcaagatgtcagggcacctgc

SEQ ID NO: 7849292 - DNA, 22 bp, Homo sapiens
ctcaagatattccagctctcaa

SEQ ID NO: 7849293 - DNA, 22 bp, Homo sapiens
ctcaagatcacacagctgagaa

SEQ ID NO: 7849294 - DNA, 22 bp, Homo sapiens
ctcaaggaaagtctggagaaga

SEQ ID NO: 7849295 - DNA, 22 bp, Homo sapiens
ctcaaggaaagtctggagaaga

SEQ ID NO: 7849296 - DNA, 22 bp, Homo sapiens
ctcaagttggcatgaacaaatt

SEQ ID NO: 7849297 - DNA, 22 bp, Homo sapiens
ctcaagttggcatgaacaaatt

SEQ ID NO: 7849298 - DNA, 22 bp, Homo sapiens
ctcaagttggcatgaacaaatt

SEQ ID NO: 7849299 - DNA, 22 bp, Homo sapiens
ctcaagtttcatatttgtctag

SEQ ID NO: 7849300 - DNA, 22 bp, Homo sapiens
ctcaatatgccagaggggaaag

SEQ ID NO: 7849301 - DNA, 22 bp, Homo sapiens
ctcaagtttcatatttgtctag

SEQ ID NO: 7849302 - DNA, 22 bp, Homo sapiens
ctcaagtttcatatttgtctag

SEQ ID NO: 7849303 - DNA, 22 bp, Homo sapiens
ctcaaggccagttcttctgact

SEQ ID NO: 7849304 - DNA, 22 bp, Homo sapiens
ctaaatctagtctttactgatt

SEQ ID NO: 7849305 - DNA, 22 bp, Homo sapiens
ctaaatcatcatttatgtttgt

SEQ ID NO: 7849306 - DNA, 22 bp, Homo sapiens
ctaaatgacttccagtggttat

SEQ ID NO: 7849307 - DNA, 22 bp, Homo sapiens
ctaaatgacaggtaccatagtg

SEQ ID NO: 7849308 - DNA, 22 bp, Homo sapiens
ctaaatgacaggtaccatagtg

SEQ ID NO: 7849309 - DNA, 22 bp, Homo sapiens
ttccaggaccaggaagagggga

SEQ ID NO: 7849310 - DNA, 22 bp, Homo sapiens
ttccaggactcgttctggctca

SEQ ID NO: 7849311 - DNA, 22 bp, Homo sapiens
ttccaggaccaggaagagggga

SEQ ID NO: 7849312 - DNA, 22 bp, Homo sapiens
ttccaggacaagatgtttcagg

SEQ ID NO: 7849313 - DNA, 22 bp, Homo sapiens
ttccaggaattcagctctcagt

SEQ ID NO: 7849314 - DNA, 22 bp, Homo sapiens
ctaaatgatattttggtttcct

SEQ ID NO: 7849315 - DNA, 22 bp, Homo sapiens
ctaaatgatattttggtttcct

SEQ ID NO: 7849316 - DNA, 22 bp, Homo sapiens
ttccaggactcgttctggctca

SEQ ID NO: 7849317 - DNA, 22 bp, Homo sapiens
ttccaggactcgttctggctca

SEQ ID NO: 7849318 - DNA, 22 bp, Homo sapiens
ttccaggactcgttctggctca

SEQ ID NO: 7849319 - DNA, 22 bp, Homo sapiens
ttccaggactgggtgtttgaag

SEQ ID NO: 7849320 - DNA, 22 bp, Homo sapiens
ttccaggactgggtgtttgaag

SEQ ID NO: 7849321 - DNA, 22 bp, Homo sapiens
ttccaggacttcatggctctga

SEQ ID NO: 7849322 - DNA, 22 bp, Homo sapiens
ttccaggacttcatggctctga

SEQ ID NO: 7849323 - DNA, 22 bp, Homo sapiens
ttccaggagacttccagaaata

SEQ ID NO: 7849324 - DNA, 22 bp, Homo sapiens
ttccaggagaggaaacctgatt

SEQ ID NO: 7849325 - DNA, 22 bp, Homo sapiens
ttccaggagacttccagaaata

SEQ ID NO: 7849326 - DNA, 22 bp, Homo sapiens
ttccaggaggaaagtttgggtg

SEQ ID NO: 7849327 - DNA, 22 bp, Homo sapiens
ttccaggaggaaagtttgggtg

SEQ ID NO: 7849328 - DNA, 22 bp, Homo sapiens
ttccaggagccacacaggggcg

SEQ ID NO: 7849329 - DNA, 22 bp, Homo sapiens
ttccaggaggaggtactagagg

SEQ ID NO: 7849330 - DNA, 22 bp, Homo sapiens
ttccaggaggaggtactagagg

SEQ ID NO: 7849331 - DNA, 22 bp, Homo sapiens
ttccaggaggcactgacagagg

SEQ ID NO: 7849332 - DNA, 22 bp, Homo sapiens
ttccaggaggcattcttagttt

SEQ ID NO: 7849333 - DNA, 22 bp, Homo sapiens
ttccaggaggcattcttagttt

SEQ ID NO: 7849334 - DNA, 22 bp, Homo sapiens
ttccaggaggcttggcgggagg

SEQ ID NO: 7849335 - DNA, 22 bp, Homo sapiens
ttccaggatagctttcaggaat

SEQ ID NO: 7849336 - DNA, 22 bp, Homo sapiens
ttccaggatagctttcaggaat

SEQ ID NO: 7849337 - DNA, 22 bp, Homo sapiens
ttccaggatgctgctgcttttt

SEQ ID NO: 7849338 - DNA, 22 bp, Homo sapiens
ttccaggaggtcaaaggcctgt

SEQ ID NO: 7849339 - DNA, 22 bp, Homo sapiens
ttccaggatgctgctgcttttt

SEQ ID NO: 7849340 - DNA, 22 bp, Homo sapiens
ttccaggatgctgctgcttttt

SEQ ID NO: 7849341 - DNA, 22 bp, Homo sapiens
ttccaggatggcaataatgaat

SEQ ID NO: 7849342 - DNA, 22 bp, Homo sapiens
ttccaggatggagacactagta

SEQ ID NO: 7849343 - DNA, 22 bp, Homo sapiens
ctacagagaactcagctgccct

SEQ ID NO: 7849344 - DNA, 22 bp, Homo sapiens
ctacagagaactcagctgccct

SEQ ID NO: 7849345 - DNA, 22 bp, Homo sapiens
ctacagagaattgtgtgatttt

SEQ ID NO: 7849346 - DNA, 21 bp, Homo sapiens
ctacagaggagagggaaaggc

SEQ ID NO: 7849347 - DNA, 22 bp, Homo sapiens
ctacagaggacacaaagatctt

SEQ ID NO: 7849348 - DNA, 22 bp, Homo sapiens
ctacaacaccaggcacggagtg

SEQ ID NO: 7849349 - DNA, 22 bp, Homo sapiens
ctacaacatagtcttctacaga

SEQ ID NO: 7849350 - DNA, 22 bp, Homo sapiens
ttccaggatgggctgtcctact

SEQ ID NO: 7849351 - DNA, 22 bp, Homo sapiens
ctacaacatagtcttctacaga

SEQ ID NO: 7849352 - DNA, 22 bp, Homo sapiens
ctacagagaactcagctgccct

SEQ ID NO: 7849353 - DNA, 22 bp, Homo sapiens
ctacaacattatgctttctgtc

SEQ ID NO: 7849354 - DNA, 22 bp, Homo sapiens
ttcctggctgaactgaactcct

SEQ ID NO: 7849355 - DNA, 22 bp, Homo sapiens
ttcctggctgaactgaactcct

SEQ ID NO: 7849356 - DNA, 22 bp, Homo sapiens
ttcctggctctctgttgcacag

SEQ ID NO: 7849357 - DNA, 22 bp, Homo sapiens
ttcctggcttttgggctaattc

SEQ ID NO: 7849358 - DNA, 22 bp, Homo sapiens
ttcctggcttttgggctaattc

SEQ ID NO: 7849359 - DNA, 22 bp, Homo sapiens
ttcctgggactggagcagccca

SEQ ID NO: 7849360 - DNA, 22 bp, Homo sapiens
ttcctgggactggagcagccca

SEQ ID NO: 7849361 - DNA, 22 bp, Homo sapiens
ttcctgggagctagccacatct

SEQ ID NO: 7849362 - DNA, 22 bp, Homo sapiens
ttcctgggccttaaatcttttg

SEQ ID NO: 7849363 - DNA, 22 bp, Homo sapiens
ttcctgggcaggacgagagtct

SEQ ID NO: 7849364 - DNA, 22 bp, Homo sapiens
ttcctgggcaggacgagagtct

SEQ ID NO: 7849365 - DNA, 22 bp, Homo sapiens
ttcctgggctgcagagagcacc

SEQ ID NO: 7849366 - DNA, 22 bp, Homo sapiens
ttcctgggaggctgtgtacttg

SEQ ID NO: 7849367 - DNA, 22 bp, Homo sapiens
ttcctgggattattgtcaagca

SEQ ID NO: 7849368 - DNA, 22 bp, Homo sapiens
ctacagcagagaccagccacat

SEQ ID NO: 7849369 - DNA, 22 bp, Homo sapiens
ctacagcagagaccagccacat

SEQ ID NO: 7849370 - DNA, 22 bp, Homo sapiens
ctacagagttcacaggatttta

SEQ ID NO: 7849371 - DNA, 22 bp, Homo sapiens
ctacagagttcacaggatttta

SEQ ID NO: 7849372 - DNA, 22 bp, Homo sapiens
ctacagagtgaatgcagaaaat

SEQ ID NO: 7849373 - DNA, 22 bp, Homo sapiens
ctacagctgtgtgtttatgtgc

SEQ ID NO: 7849374 - DNA, 22 bp, Homo sapiens
ctacaggaaggatcttgctcaa

SEQ ID NO: 7849375 - DNA, 22 bp, Homo sapiens
ctacagctgtaaaaggaatgtc

SEQ ID NO: 7849376 - DNA, 22 bp, Homo sapiens
ctacagcagagctacactaact

SEQ ID NO: 7849377 - DNA, 22 bp, Homo sapiens
ctacagccagatgcagaaagtt

SEQ ID NO: 7849378 - DNA, 22 bp, Homo sapiens
ctacagcagagctacactaact

SEQ ID NO: 7849379 - DNA, 22 bp, Homo sapiens
ctacaggtatgtgcatgacatc

SEQ ID NO: 7849380 - DNA, 22 bp, Homo sapiens
ctacaggaaggatcttgctcaa

SEQ ID NO: 7849381 - DNA, 22 bp, Homo sapiens
ctacagctgtgtgtttatgtgc

SEQ ID NO: 7849382 - DNA, 22 bp, Homo sapiens
ctacaggagggtgtgttgggcg

SEQ ID NO: 7849383 - DNA, 22 bp, Homo sapiens
ctacaggctcagggagccctct

SEQ ID NO: 7849384 - DNA, 22 bp, Homo sapiens
ctacaggctcagggagccctct

SEQ ID NO: 7849385 - DNA, 22 bp, Homo sapiens
ctacaggtatgtgcatgacatc

SEQ ID NO: 7849386 - DNA, 22 bp, Homo sapiens
ctacaggctcagggagccctct

SEQ ID NO: 7849387 - DNA, 22 bp, Homo sapiens
ttcctgggctgcagagagcacc

SEQ ID NO: 7849388 - DNA, 22 bp, Homo sapiens
ttcctgggctttcccctctggt

SEQ ID NO: 7849389 - DNA, 22 bp, Homo sapiens
ttcctgggctgcagagagcacc

SEQ ID NO: 7849390 - DNA, 22 bp, Homo sapiens
ttcctgggctgcagagagcacc

SEQ ID NO: 7849391 - DNA, 22 bp, Homo sapiens
ctacatttcatccagggagagc

SEQ ID NO: 7849392 - DNA, 22 bp, Homo sapiens
ctacatttcatccagggagagc

SEQ ID NO: 7849393 - DNA, 22 bp, Homo sapiens
ctacatttacacagttaggctt

SEQ ID NO: 7849394 - DNA, 22 bp, Homo sapiens
ctacatttcatccagggagagc

SEQ ID NO: 7849395 - DNA, 22 bp, Homo sapiens
ctacccttaagtttctgtgggg

SEQ ID NO: 7849396 - DNA, 22 bp, Homo sapiens
ctacccttaagtttctgtgggg

SEQ ID NO: 7849397 - DNA, 22 bp, Homo sapiens
ctacctgaaaaggttgtggtga

SEQ ID NO: 7849398 - DNA, 22 bp, Homo sapiens
ctacctgaaaaggttgtggtga

SEQ ID NO: 7849399 - DNA, 22 bp, Homo sapiens
ctaccttcaagttcctccctct

SEQ ID NO: 7849400 - DNA, 22 bp, Homo sapiens
ctacccaggcttagagggctgg

SEQ ID NO: 7849401 - DNA, 21 bp, Homo sapiens
ctaccctcactcccattcctc

SEQ ID NO: 7849402 - DNA, 21 bp, Homo sapiens
ctaccctcactcccattcctc

SEQ ID NO: 7849403 - DNA, 21 bp, Homo sapiens
ctaccctctcctgctcatatc

SEQ ID NO: 7849404 - DNA, 22 bp, Homo sapiens
ctacccaggctggagtgcagta

SEQ ID NO: 7849405 - DNA, 22 bp, Homo sapiens
ctacccaggcttagagggctgg

SEQ ID NO: 7849406 - DNA, 22 bp, Homo sapiens
ctactgaattagactgcatttt

SEQ ID NO: 7849407 - DNA, 22 bp, Homo sapiens
ctactgaattagactgcatttt

SEQ ID NO: 7849408 - DNA, 22 bp, Homo sapiens
ctactgaagataactggctctt

SEQ ID NO: 7849409 - DNA, 22 bp, Homo sapiens
ctactgaaactcagaaattcaa

SEQ ID NO: 7849410 - DNA, 22 bp, Homo sapiens
ctactgaagataactggctctt

SEQ ID NO: 7849411 - DNA, 22 bp, Homo sapiens
ctactcttttgagtcttcagat

SEQ ID NO: 7849412 - DNA, 22 bp, Homo sapiens
ctactgaaactcagaaattcaa

SEQ ID NO: 7849413 - DNA, 22 bp, Homo sapiens
ctactagctactcattcaaatt

SEQ ID NO: 7849414 - DNA, 22 bp, Homo sapiens
ctactctcccatgattctctgt

SEQ ID NO: 7849415 - DNA, 22 bp, Homo sapiens
ctactagatcagtatgcctcaa

SEQ ID NO: 7849416 - DNA, 22 bp, Homo sapiens
ctacctttctgactcttgggat

SEQ ID NO: 7849417 - DNA, 22 bp, Homo sapiens
ctactgtaatagatgaatttga

SEQ ID NO: 7849418 - DNA, 22 bp, Homo sapiens
ctactgccattgtctctgccat

SEQ ID NO: 7849419 - DNA, 22 bp, Homo sapiens
ctactggccatctgatctacaa

SEQ ID NO: 7849420 - DNA, 22 bp, Homo sapiens
ctactgccattgtctctgccat

SEQ ID NO: 7849421 - DNA, 22 bp, Homo sapiens
ctactgccattgtctctgccat

SEQ ID NO: 7849422 - DNA, 22 bp, Homo sapiens
ctactgtagtggcctatttacc

SEQ ID NO: 7849423 - DNA, 22 bp, Homo sapiens
ctactgtatgtgttctctagtc

SEQ ID NO: 7849424 - DNA, 22 bp, Homo sapiens
ctactgttgtgttttaaaggta

SEQ ID NO: 7849425 - DNA, 22 bp, Homo sapiens
ctactgttgggagccctggaag

SEQ ID NO: 7849426 - DNA, 22 bp, Homo sapiens
ctactgttattattaatagtaa

SEQ ID NO: 7849427 - DNA, 21 bp, Homo sapiens
ctactgtgagacacaaagtgc

SEQ ID NO: 7849428 - DNA, 22 bp, Homo sapiens
ctactgttattattaatagtaa

SEQ ID NO: 7849429 - DNA, 22 bp, Homo sapiens
ctactgtcttccttggtaacaa

SEQ ID NO: 7849430 - DNA, 22 bp, Homo sapiens
ctacttctgtgatgaaactaca

SEQ ID NO: 7849431 - DNA, 22 bp, Homo sapiens
ctacttccaggggtggggctca

SEQ ID NO: 7849432 - DNA, 22 bp, Homo sapiens
ctacttatgggtggtaccagca

SEQ ID NO: 7849433 - DNA, 21 bp, Homo sapiens
ctacttaagtaggggattagg

SEQ ID NO: 7849434 - DNA, 21 bp, Homo sapiens
ctacttaagtaggggattagg

SEQ ID NO: 7849435 - DNA, 21 bp, Homo sapiens
ctacttaagtaggggattagg

SEQ ID NO: 7849436 - DNA, 22 bp, Homo sapiens
ctacttatgggtggtaccagca

SEQ ID NO: 7849437 - DNA, 22 bp, Homo sapiens
ctacttagagacatgctaacat

SEQ ID NO: 7849438 - DNA, 20 bp, Homo sapiens
ctactttaggcactgagaat

SEQ ID NO: 7849439 - DNA, 22 bp, Homo sapiens
ctacttgttcactgtaggtcgc

SEQ ID NO: 7849440 - DNA, 22 bp, Homo sapiens
ctacttgttcactgtaggtcgc

SEQ ID NO: 7849441 - DNA, 22 bp, Homo sapiens
ctagaaaaatactttattgtga

SEQ ID NO: 7849442 - DNA, 22 bp, Homo sapiens
ctagaaaaatactttattgtga

SEQ ID NO: 7849443 - DNA, 22 bp, Homo sapiens
ctagaaaaatactttattgtga

SEQ ID NO: 7849444 - DNA, 22 bp, Homo sapiens
ctagaaaaatactttattgtga

SEQ ID NO: 7849445 - DNA, 22 bp, Homo sapiens
ctagaaaaatactttattgtga

SEQ ID NO: 7849446 - DNA, 19 bp, Homo sapiens
ctactttataatatgcctc

SEQ ID NO: 7849447 - DNA, 22 bp, Homo sapiens
ctagaaacattacatgtgttaa

SEQ ID NO: 7849448 - DNA, 22 bp, Homo sapiens
ctagaaacgcctttagcacaac

SEQ ID NO: 7849449 - DNA, 22 bp, Homo sapiens
ctagaaacgcctttagcacaac

SEQ ID NO: 7849450 - DNA, 22 bp, Homo sapiens
ttctccttttccagttcccagt

SEQ ID NO: 7849451 - DNA, 22 bp, Homo sapiens
ttctccttttccagttcccagt

SEQ ID NO: 7849452 - DNA, 22 bp, Homo sapiens
ttctcctttgtaattctcatcc

SEQ ID NO: 7849453 - DNA, 22 bp, Homo sapiens
ttctcctttgtaattctcatcc

SEQ ID NO: 7849454 - DNA, 22 bp, Homo sapiens
ttctctggactatttgcactcc

SEQ ID NO: 7849455 - DNA, 19 bp, Homo sapiens
ttctctggactagatgctg

SEQ ID NO: 7849456 - DNA, 22 bp, Homo sapiens
ttctctaaagagttaggccaag

SEQ ID NO: 7849457 - DNA, 22 bp, Homo sapiens
ttctctggagggctgcccggcc

SEQ ID NO: 7849458 - DNA, 22 bp, Homo sapiens
ttctctggagagtatcttctta

SEQ ID NO: 7849459 - DNA, 22 bp, Homo sapiens
ttctctggagagtatcttctta

SEQ ID NO: 7849460 - DNA, 22 bp, Homo sapiens
ttctctggactatttgcactcc

SEQ ID NO: 7849461 - DNA, 20 bp, Homo sapiens
ttctctggatagccagatgt

SEQ ID NO: 7849462 - DNA, 20 bp, Homo sapiens
ttctctggatagccagatgt

SEQ ID NO: 7849463 - DNA, 21 bp, Homo sapiens
ttctctggataggccagtcct

SEQ ID NO: 7849464 - DNA, 20 bp, Homo sapiens
ttctctggatagccagatgt

SEQ ID NO: 7849465 - DNA, 21 bp, Homo sapiens
ttctctggataggccagtcct

SEQ ID NO: 7849466 - DNA, 22 bp, Homo sapiens
ttctctggatgtttctcagtca

SEQ ID NO: 7849467 - DNA, 22 bp, Homo sapiens
cggtcctgtacttgatgagata

SEQ ID NO: 7849468 - DNA, 22 bp, Homo sapiens
cggtcctgtacttgatgagata

SEQ ID NO: 7849469 - DNA, 22 bp, Homo sapiens
cggtcctggcacttgcggctcc

SEQ ID NO: 7849470 - DNA, 19 bp, Homo sapiens
cggtccatccgattttaca

SEQ ID NO: 7849471 - DNA, 22 bp, Homo sapiens
cggtcagttgccaggccctgcc

SEQ ID NO: 7849472 - DNA, 22 bp, Homo sapiens
cggtcaggtgcagcgttggcac

SEQ ID NO: 7849473 - DNA, 22 bp, Homo sapiens
cggtcaggtgcagcgttggcac

SEQ ID NO: 7849474 - DNA, 22 bp, Homo sapiens
cggtctcccgtgtgtgtgcgct

SEQ ID NO: 7849475 - DNA, 22 bp, Homo sapiens
cggtctcccgtgtgtgtgcgct

SEQ ID NO: 7849476 - DNA, 22 bp, Homo sapiens
cggtctcccgtgtgtgtgcgct

SEQ ID NO: 7849477 - DNA, 22 bp, Homo sapiens
cggtctcccgtgtgtgtgcgct

SEQ ID NO: 7849478 - DNA, 22 bp, Homo sapiens
cggtctcccgtgtgtgtgcgct

SEQ ID NO: 7849479 - DNA, 22 bp, Homo sapiens
cggtggagtgctcagctgaacc

SEQ ID NO: 7849480 - DNA, 22 bp, Homo sapiens
cggtggccaacaagaggccggg

SEQ ID NO: 7849481 - DNA, 22 bp, Homo sapiens
cggtggccaacaagaggccggg

SEQ ID NO: 7849482 - DNA, 22 bp, Homo sapiens
cggtgcccggtgccaggcgcgg

SEQ ID NO: 7849483 - DNA, 19 bp, Homo sapiens
cggtggcttgcagggaggt

SEQ ID NO: 7849484 - DNA, 22 bp, Homo sapiens
cggttctcgcctctgctgctcc

SEQ ID NO: 7849485 - DNA, 19 bp, Homo sapiens
cggtggcttgcagggaggt

SEQ ID NO: 7849486 - DNA, 19 bp, Homo sapiens
cggtggcttgcagggaggt

SEQ ID NO: 7849487 - DNA, 21 bp, Homo sapiens
cggtggctcccgggatggctc

SEQ ID NO: 7849488 - DNA, 22 bp, Homo sapiens
cggtggctcaggcccccagcag

SEQ ID NO: 7849489 - DNA, 22 bp, Homo sapiens
cggtggctcaggcccccagcag

SEQ ID NO: 7849490 - DNA, 21 bp, Homo sapiens
cggtggctcccgggatggctc

SEQ ID NO: 7849491 - DNA, 22 bp, Homo sapiens
cgtaggtggctcagcacctggg

SEQ ID NO: 7849492 - DNA, 22 bp, Homo sapiens
cgtaggtggctcagcacctggg

SEQ ID NO: 7849493 - DNA, 22 bp, Homo sapiens
cgtaggtggctcagcacctggg

SEQ ID NO: 7849494 - DNA, 22 bp, Homo sapiens
cgtaggtggctcagcacctggg

SEQ ID NO: 7849495 - DNA, 22 bp, Homo sapiens
cgtaggtggctcagcacctggg

SEQ ID NO: 7849496 - DNA, 22 bp, Homo sapiens
cgtagctgggaacttcactctc

SEQ ID NO: 7849497 - DNA, 22 bp, Homo sapiens
cgtaccagcataaactgaaggt

SEQ ID NO: 7849498 - DNA, 22 bp, Homo sapiens
cgtagacaactgaaatgcacag

SEQ ID NO: 7849499 - DNA, 19 bp, Homo sapiens
cgtacctgacacagaacag

SEQ ID NO: 7849500 - DNA, 22 bp, Homo sapiens
cgtaattctctctagtacccct

SEQ ID NO: 7849501 - DNA, 22 bp, Homo sapiens
cgtcacttcttagtctattttc

SEQ ID NO: 7849502 - DNA, 22 bp, Homo sapiens
cgtcacttcttagtctattttc

SEQ ID NO: 7849503 - DNA, 22 bp, Homo sapiens
cgtcacttcttagtctattttc

SEQ ID NO: 7849504 - DNA, 22 bp, Homo sapiens
cgtatttagaaggctgctgaaa

SEQ ID NO: 7849505 - DNA, 22 bp, Homo sapiens
cgtatacatgaagacattgctg

SEQ ID NO: 7849506 - DNA, 22 bp, Homo sapiens
cgtagtatgatttctgagctcc

SEQ ID NO: 7849507 - DNA, 22 bp, Homo sapiens
cgtcacttcttagtctattttc

SEQ ID NO: 7849508 - DNA, 22 bp, Homo sapiens
cgtcacttcttagtctattttc

SEQ ID NO: 7849509 - DNA, 22 bp, Homo sapiens
ttcatccatatgcagagagctt

SEQ ID NO: 7849510 - DNA, 22 bp, Homo sapiens
ttcatccatgtggttgtgtata

SEQ ID NO: 7849511 - DNA, 22 bp, Homo sapiens
ttcatctgcttcttcctattcc

SEQ ID NO: 7849512 - DNA, 22 bp, Homo sapiens
ttcatgaaagacagcaactgtg

SEQ ID NO: 7849513 - DNA, 22 bp, Homo sapiens
ttcatgaaagacagcaactgtg

SEQ ID NO: 7849514 - DNA, 22 bp, Homo sapiens
ttcatgaaacttaactgttggg

SEQ ID NO: 7849515 - DNA, 22 bp, Homo sapiens
ttcatgaaacttaactgttggg

SEQ ID NO: 7849516 - DNA, 22 bp, Homo sapiens
ttcatgaaaaggtctatttctt

SEQ ID NO: 7849517 - DNA, 22 bp, Homo sapiens
ttcatgaaacttaactgttggg

SEQ ID NO: 7849518 - DNA, 22 bp, Homo sapiens
ttcatctgtagtttttccaagg

SEQ ID NO: 7849519 - DNA, 22 bp, Homo sapiens
ttcatctgtagtttttccaagg

SEQ ID NO: 7849520 - DNA, 22 bp, Homo sapiens
ttcatctggaagttcccaaggc

SEQ ID NO: 7849521 - DNA, 21 bp, Homo sapiens
ttcatctggccgtattccagg

SEQ ID NO: 7849522 - DNA, 22 bp, Homo sapiens
ttcatctgtagtttttccaagg

SEQ ID NO: 7849523 - DNA, 22 bp, Homo sapiens
ttcatctgtagcatcttccaat

SEQ ID NO: 7849524 - DNA, 22 bp, Homo sapiens
ttcatctgtagcatcttccaat

SEQ ID NO: 7849525 - DNA, 22 bp, Homo sapiens
ttcatctgtagcatcttccaat

SEQ ID NO: 7849526 - DNA, 21 bp, Homo sapiens
ttcatctggccgtattccagg

SEQ ID NO: 7849527 - DNA, 22 bp, Homo sapiens
ttcatgaatgttccatgtgagt

SEQ ID NO: 7849528 - DNA, 22 bp, Homo sapiens
ctaaaaatccacactaggtgaa

SEQ ID NO: 7849529 - DNA, 22 bp, Homo sapiens
ctaaaattacctaccagtttag

SEQ ID NO: 7849530 - DNA, 22 bp, Homo sapiens
ctaaagaagctagcaatctata

SEQ ID NO: 7849531 - DNA, 22 bp, Homo sapiens
ttcatgaagggtgaatatagtc

SEQ ID NO: 7849532 - DNA, 22 bp, Homo sapiens
ttcatgaagggtgaatatagtc

SEQ ID NO: 7849533 - DNA, 22 bp, Homo sapiens
ttcatgaatatattgaattagc

SEQ ID NO: 7849534 - DNA, 22 bp, Homo sapiens
ttcatgaacgaacatatgtata

SEQ ID NO: 7849535 - DNA, 22 bp, Homo sapiens
ttcatgaacgaacatatgtata

SEQ ID NO: 7849536 - DNA, 22 bp, Homo sapiens
ctaaataatccctctggtctta

SEQ ID NO: 7849537 - DNA, 22 bp, Homo sapiens
ctaaataatccctctggtctta

SEQ ID NO: 7849538 - DNA, 22 bp, Homo sapiens
ctaaataatccctctggtctta

SEQ ID NO: 7849539 - DNA, 22 bp, Homo sapiens
ctaaagtgccaggaatacaggt

SEQ ID NO: 7849540 - DNA, 22 bp, Homo sapiens
ctaaagtgccaggaatacaggt

SEQ ID NO: 7849541 - DNA, 22 bp, Homo sapiens
ctaaataatccctctggtctta

SEQ ID NO: 7849542 - DNA, 22 bp, Homo sapiens
ctaaataatccctctggtctta

SEQ ID NO: 7849543 - DNA, 17 bp, Homo sapiens
ctaaatacttgcgtttc

SEQ ID NO: 7849544 - DNA, 22 bp, Homo sapiens
ctaaatcaggccttacagcttc

SEQ ID NO: 7849545 - DNA, 22 bp, Homo sapiens
ctaaatcaggccttacagcttc

SEQ ID NO: 7849546 - DNA, 22 bp, Homo sapiens
ctaaataatccctctggtctta

SEQ ID NO: 7849547 - DNA, 22 bp, Homo sapiens
ctaaatactagccttcagattt

SEQ ID NO: 7849548 - DNA, 22 bp, Homo sapiens
ctaaagaattttgcttgaccag

SEQ ID NO: 7849549 - DNA, 22 bp, Homo sapiens
ctaaagaagctagcaatctata

SEQ ID NO: 7849550 - DNA, 22 bp, Homo sapiens
ctaaagaagctagcaatctata

SEQ ID NO: 7849551 - DNA, 22 bp, Homo sapiens
ctaaagataaggaaagtatcct

SEQ ID NO: 7849552 - DNA, 22 bp, Homo sapiens
ctaaagagaagatgtttgctga

SEQ ID NO: 7849553 - DNA, 22 bp, Homo sapiens
ctaaaggatattagaggagaaa

SEQ ID NO: 7849554 - DNA, 22 bp, Homo sapiens
ctaaagatgtacatttttctcc

SEQ ID NO: 7849555 - DNA, 22 bp, Homo sapiens
ctaaagcaactgagacacatag

SEQ ID NO: 7849556 - DNA, 22 bp, Homo sapiens
ctaaagtccttatcaagtgtaa

SEQ ID NO: 7849557 - DNA, 22 bp, Homo sapiens
ctaaaggattcttagttcctgg

SEQ ID NO: 7849558 - DNA, 22 bp, Homo sapiens
ctaaaggattcttagttcctgg

SEQ ID NO: 7849559 - DNA, 20 bp, Homo sapiens
ttcagagtcagcaaatgcag

SEQ ID NO: 7849560 - DNA, 22 bp, Homo sapiens
ttcagagtaggatactagctta

SEQ ID NO: 7849561 - DNA, 22 bp, Homo sapiens
ttcagagtacacagagatcttc

SEQ ID NO: 7849562 - DNA, 20 bp, Homo sapiens
ttcagagtcagcaaatgcag

SEQ ID NO: 7849563 - DNA, 22 bp, Homo sapiens
ttcagagtaggatactagctta

SEQ ID NO: 7849564 - DNA, 22 bp, Homo sapiens
ttcagagtggtatgaagtgatg

SEQ ID NO: 7849565 - DNA, 22 bp, Homo sapiens
ttcagagtggtatgaagtgatg

SEQ ID NO: 7849566 - DNA, 18 bp, Homo sapiens
ttcagagtctggtgagga

SEQ ID NO: 7849567 - DNA, 18 bp, Homo sapiens
ttcagagtctggtgagga

SEQ ID NO: 7849568 - DNA, 18 bp, Homo sapiens
ttcagagtctggtgagga

SEQ ID NO: 7849569 - DNA, 22 bp, Homo sapiens
ttcagagtcagggatctcagag

SEQ ID NO: 7849570 - DNA, 22 bp, Homo sapiens
ttcagagtcagggatctcagag

SEQ ID NO: 7849571 - DNA, 22 bp, Homo sapiens
ttcagataaactacaaataatt

SEQ ID NO: 7849572 - DNA, 22 bp, Homo sapiens
ttcagagttagacgaaaagcaa

SEQ ID NO: 7849573 - DNA, 22 bp, Homo sapiens
ttcagagttagacgaaaagcaa

SEQ ID NO: 7849574 - DNA, 22 bp, Homo sapiens
ttcagagtggtatgaagtgatg

SEQ ID NO: 7849575 - DNA, 22 bp, Homo sapiens
ttcagagtggtatgaagtgatg

SEQ ID NO: 7849576 - DNA, 22 bp, Homo sapiens
ttcagataatgacaggtcagga

SEQ ID NO: 7849577 - DNA, 22 bp, Homo sapiens
ttcagataagtcaagttagtat

SEQ ID NO: 7849578 - DNA, 22 bp, Homo sapiens
ttcagataagtcaagttagtat

SEQ ID NO: 7849579 - DNA, 22 bp, Homo sapiens
ttcagataaattgttttgtgat

SEQ ID NO: 7849580 - DNA, 22 bp, Homo sapiens
ttcagataaactacaaataatt

SEQ ID NO: 7849581 - DNA, 22 bp, Homo sapiens
ttcagagtacacagagatcttc

SEQ ID NO: 7849582 - DNA, 22 bp, Homo sapiens
ttcagagtacacagagatcttc

SEQ ID NO: 7849583 - DNA, 20 bp, Homo sapiens
ttcagaggtgaagttgtggt

SEQ ID NO: 7849584 - DNA, 22 bp, Homo sapiens
ttcagaggtagagaggatcttg

SEQ ID NO: 7849585 - DNA, 22 bp, Homo sapiens
ttcagaggtagagaggatcttg

SEQ ID NO: 7849586 - DNA, 20 bp, Homo sapiens
ttcagaggtgaagttgtggt

SEQ ID NO: 7849587 - DNA, 22 bp, Homo sapiens
ttcagaggggctaagtacttgc

SEQ ID NO: 7849588 - DNA, 22 bp, Homo sapiens
ttcagagggttcagagggttcg

SEQ ID NO: 7849589 - DNA, 22 bp, Homo sapiens
ttcagagggttttagggtcaga

SEQ ID NO: 7849590 - DNA, 22 bp, Homo sapiens
ttcagagggttttagggtcaga

SEQ ID NO: 7849591 - DNA, 22 bp, Homo sapiens
ttcacactgtttttcatagtgg

SEQ ID NO: 7849592 - DNA, 22 bp, Homo sapiens
ttcacactataaagggcgtgaa

SEQ ID NO: 7849593 - DNA, 22 bp, Homo sapiens
ttcacaccaaagacaaacaggg

SEQ ID NO: 7849594 - DNA, 22 bp, Homo sapiens
ttcacacagcaactgtatgaat

SEQ ID NO: 7849595 - DNA, 22 bp, Homo sapiens
ttcacacagcaactgtatgaat

SEQ ID NO: 7849596 - DNA, 22 bp, Homo sapiens
ttcacaccaagcttcccaaaga

SEQ ID NO: 7849597 - DNA, 22 bp, Homo sapiens
ttcacactttggaattccacct

SEQ ID NO: 7849598 - DNA, 22 bp, Homo sapiens
ttcacactttggaattccacct

SEQ ID NO: 7849599 - DNA, 22 bp, Homo sapiens
ttcacagaagaggtcacatttc

SEQ ID NO: 7849600 - DNA, 22 bp, Homo sapiens
ttcacactttggaattccacct

SEQ ID NO: 7849601 - DNA, 22 bp, Homo sapiens
ttcacagaagaggtcacatttc

SEQ ID NO: 7849602 - DNA, 22 bp, Homo sapiens
ttcacagaagaggtcacatttc

SEQ ID NO: 7849603 - DNA, 22 bp, Homo sapiens
ttcacagaatggcaagttatgg

SEQ ID NO: 7849604 - DNA, 22 bp, Homo sapiens
ttcacagaatggcaagttatgg

SEQ ID NO: 7849605 - DNA, 22 bp, Homo sapiens
ttcacagaagaggtcacatttc

SEQ ID NO: 7849606 - DNA, 22 bp, Homo sapiens
ttcacagaagaggtcacatttc

SEQ ID NO: 7849607 - DNA, 22 bp, Homo sapiens
ttcagaaagtgaatcttgttat

SEQ ID NO: 7849608 - DNA, 22 bp, Homo sapiens
ttcagagggcttgctatgtaca

SEQ ID NO: 7849609 - DNA, 22 bp, Homo sapiens
ttcagagggacattcaagggaa

SEQ ID NO: 7849610 - DNA, 21 bp, Homo sapiens
ttcagaggatgccaaggtcca

SEQ ID NO: 7849611 - DNA, 22 bp, Homo sapiens
ttcagaaagtgaatcttgttat

SEQ ID NO: 7849612 - DNA, 22 bp, Homo sapiens
ttcagaaagtgaatcttgttat

SEQ ID NO: 7849613 - DNA, 22 bp, Homo sapiens
ttcagaaagtgaatcttgttat

SEQ ID NO: 7849614 - DNA, 22 bp, Homo sapiens
ttcagaaagtgaatcttgttat

SEQ ID NO: 7849615 - DNA, 22 bp, Homo sapiens
ttcacagaattgtcttgactgg

SEQ ID NO: 7849616 - DNA, 22 bp, Homo sapiens
ttcaggcccaacgcacagcttc

SEQ ID NO: 7849617 - DNA, 22 bp, Homo sapiens
ttcaggcccagcacagcgcgtg

SEQ ID NO: 7849618 - DNA, 22 bp, Homo sapiens
ttcaggcctaatttctagcccc

SEQ ID NO: 7849619 - DNA, 22 bp, Homo sapiens
ttcaggcctctaaagggaaagc

SEQ ID NO: 7849620 - DNA, 22 bp, Homo sapiens
ttcaggcctctaaagggaaagc

SEQ ID NO: 7849621 - DNA, 22 bp, Homo sapiens
ttcaggcctaatttctagcccc

SEQ ID NO: 7849622 - DNA, 22 bp, Homo sapiens
ttcaggcctaatttctagcccc

SEQ ID NO: 7849623 - DNA, 22 bp, Homo sapiens
ttcagggactttgatgtatcag

SEQ ID NO: 7849624 - DNA, 22 bp, Homo sapiens
ttcagggacttagtgtcagttt

SEQ ID NO: 7849625 - DNA, 22 bp, Homo sapiens
ttcagggacttagtgtcagttt

SEQ ID NO: 7849626 - DNA, 22 bp, Homo sapiens
ttcagggagagcgggacgggtg

SEQ ID NO: 7849627 - DNA, 22 bp, Homo sapiens
ttcaggcttcagtctttcttaa

SEQ ID NO: 7849628 - DNA, 22 bp, Homo sapiens
ttcagggagagcgggacgggtg

SEQ ID NO: 7849629 - DNA, 22 bp, Homo sapiens
ttcagggcatgagggacacatc

SEQ ID NO: 7849630 - DNA, 22 bp, Homo sapiens
ttcagggcagagagttcaggga

SEQ ID NO: 7849631 - DNA, 22 bp, Homo sapiens
ttcagggcagagagttcaggga

SEQ ID NO: 7849632 - DNA, 22 bp, Homo sapiens
ttcagggcagagagttcaggga

SEQ ID NO: 7849633 - DNA, 22 bp, Homo sapiens
ttcagggcagacagaagagatg

SEQ ID NO: 7849634 - DNA, 22 bp, Homo sapiens
cgggggagttgaggcacatggg

SEQ ID NO: 7849635 - DNA, 22 bp, Homo sapiens
cgggggagttgaggcacatggg

SEQ ID NO: 7849636 - DNA, 22 bp, Homo sapiens
cgggggagttgaggcacatggg

SEQ ID NO: 7849637 - DNA, 22 bp, Homo sapiens
cgggggagttgaggcacatggg

SEQ ID NO: 7849638 - DNA, 22 bp, Homo sapiens
cgggggagttgaggcacatggg

SEQ ID NO: 7849639 - DNA, 22 bp, Homo sapiens
cggtcaggtgcagcgttggcac

SEQ ID NO: 7849640 - DNA, 22 bp, Homo sapiens
cggtcaggtgcagcgttggcac

SEQ ID NO: 7849641 - DNA, 22 bp, Homo sapiens
cggggctgtagcacagctgagc

SEQ ID NO: 7849642 - DNA, 22 bp, Homo sapiens
cggggctgtagcacagctgagc

SEQ ID NO: 7849643 - DNA, 22 bp, Homo sapiens
cggggctgtagcacagctgagc

SEQ ID NO: 7849644 - DNA, 22 bp, Homo sapiens
ttcagcaaacacgatgcttgtt

SEQ ID NO: 7849645 - DNA, 22 bp, Homo sapiens
ttcagcaaacacgatgcttgtt

SEQ ID NO: 7849646 - DNA, 22 bp, Homo sapiens
ttcagcaaacacgatgcttgtt

SEQ ID NO: 7849647 - DNA, 22 bp, Homo sapiens
ttcagataatgacaggtcagga

SEQ ID NO: 7849648 - DNA, 22 bp, Homo sapiens
ttcagatgattagaatagtatt

SEQ ID NO: 7849649 - DNA, 22 bp, Homo sapiens
ttcagattttttaataggtaat

SEQ ID NO: 7849650 - DNA, 22 bp, Homo sapiens
ttcaggcatggaaactggatta

SEQ ID NO: 7849651 - DNA, 22 bp, Homo sapiens
ttcaggcatccctacagttagg

SEQ ID NO: 7849652 - DNA, 22 bp, Homo sapiens
ttcaggcagctgaggagaaagt

SEQ ID NO: 7849653 - DNA, 22 bp, Homo sapiens
cgccctccacacagcccctggc

SEQ ID NO: 7849654 - DNA, 22 bp, Homo sapiens
cgccgcctgctgcagcagctgt

SEQ ID NO: 7849655 - DNA, 22 bp, Homo sapiens
cgccgcctgctgcagcagctgt

SEQ ID NO: 7849656 - DNA, 22 bp, Homo sapiens
cgccccagtctgtaggtgcccc

SEQ ID NO: 7849657 - DNA, 22 bp, Homo sapiens
cgcccctcagcgacccaccagc

SEQ ID NO: 7849658 - DNA, 22 bp, Homo sapiens
cgccccggacgtctgaccaaac

SEQ ID NO: 7849659 - DNA, 22 bp, Homo sapiens
ttcaaattaccacatttgctta

SEQ ID NO: 7849660 - DNA, 22 bp, Homo sapiens
cgccggcttgaggcaggcggca

SEQ ID NO: 7849661 - DNA, 22 bp, Homo sapiens
cgccggcttgaggcaggcggca

SEQ ID NO: 7849662 - DNA, 22 bp, Homo sapiens
ttcaaatttggtatgcaagcca

SEQ ID NO: 7849663 - DNA, 22 bp, Homo sapiens
ttcaaatttggtatgcaagcca

SEQ ID NO: 7849664 - DNA, 22 bp, Homo sapiens
ttcaagtctggagatctggaac

SEQ ID NO: 7849665 - DNA, 22 bp, Homo sapiens
ttcaagtctgtttcattgcatg

SEQ ID NO: 7849666 - DNA, 22 bp, Homo sapiens
ttcaagtctggagatctggaac

SEQ ID NO: 7849667 - DNA, 22 bp, Homo sapiens
ttcaagtctgtttcattgcatg

SEQ ID NO: 7849668 - DNA, 22 bp, Homo sapiens
ttcaagtgaggctgtctttaga

SEQ ID NO: 7849669 - DNA, 22 bp, Homo sapiens
ttcaagttaactctccttgtac

SEQ ID NO: 7849670 - DNA, 22 bp, Homo sapiens
ttcaagttaactctccttgtac

SEQ ID NO: 7849671 - DNA, 22 bp, Homo sapiens
ttcaagtcttccatggtattct

SEQ ID NO: 7849672 - DNA, 22 bp, Homo sapiens
cgcccaggctggagagcagtgg

SEQ ID NO: 7849673 - DNA, 20 bp, Homo sapiens
cgcccaggagggcccatgtg

SEQ ID NO: 7849674 - DNA, 22 bp, Homo sapiens
cgcccagctgaaatctccaggc

SEQ ID NO: 7849675 - DNA, 20 bp, Homo sapiens
cgcccaggagggcccatgtg

SEQ ID NO: 7849676 - DNA, 22 bp, Homo sapiens
cgcccaggctggagtgcagtga

SEQ ID NO: 7849677 - DNA, 22 bp, Homo sapiens
cgcccaggctggagtgcagtga

SEQ ID NO: 7849678 - DNA, 22 bp, Homo sapiens
cgcccaggctggagagcagtgg

SEQ ID NO: 7849679 - DNA, 22 bp, Homo sapiens
cgcccaggctggagtgcagtgg

SEQ ID NO: 7849680 - DNA, 22 bp, Homo sapiens
cgcccaggctggagtgcagtgg

SEQ ID NO: 7849681 - DNA, 22 bp, Homo sapiens
cgccccagtctgtaggtgcccc

SEQ ID NO: 7849682 - DNA, 22 bp, Homo sapiens
cgccccagtctgtaggtgcccc

SEQ ID NO: 7849683 - DNA, 22 bp, Homo sapiens
cgccccagccagttgagcggcg

SEQ ID NO: 7849684 - DNA, 22 bp, Homo sapiens
cgcccagggcaggaggccgctc

SEQ ID NO: 7849685 - DNA, 20 bp, Homo sapiens
cgcccagtgcggttctgacc

SEQ ID NO: 7849686 - DNA, 20 bp, Homo sapiens
cgcccagtgcggttctgacc

SEQ ID NO: 7849687 - DNA, 20 bp, Homo sapiens
cgcccagtgcggttctgacc

SEQ ID NO: 7849688 - DNA, 22 bp, Homo sapiens
cgccccagatgcaagacaaaga

SEQ ID NO: 7849689 - DNA, 22 bp, Homo sapiens
ttcacacagcaactgtatgaat

SEQ ID NO: 7849690 - DNA, 22 bp, Homo sapiens
ttcacacagcaactgtatgaat

SEQ ID NO: 7849691 - DNA, 22 bp, Homo sapiens
ttcacacagaatctgaggagct

SEQ ID NO: 7849692 - DNA, 22 bp, Homo sapiens
ttcacacagaatctgaggagct

SEQ ID NO: 7849693 - DNA, 22 bp, Homo sapiens
ttcacacagaatctgaggagct

SEQ ID NO: 7849694 - DNA, 22 bp, Homo sapiens
ttcacacagaatctgaggagct

SEQ ID NO: 7849695 - DNA, 22 bp, Homo sapiens
ttcacacacagcttcctattgt

SEQ ID NO: 7849696 - DNA, 22 bp, Homo sapiens
ttcacacacagcttcctattgt

SEQ ID NO: 7849697 - DNA, 22 bp, Homo sapiens
ttcacacacagcttcctattgt

SEQ ID NO: 7849698 - DNA, 22 bp, Homo sapiens
ttcacaatttcccttcatcagg

SEQ ID NO: 7849699 - DNA, 22 bp, Homo sapiens
ttcacaatttcccttcatcagg

SEQ ID NO: 7849700 - DNA, 22 bp, Homo sapiens
ttcaatatcattgtttagtctc

SEQ ID NO: 7849701 - DNA, 22 bp, Homo sapiens
ttcaatatcattgtttagtctc

SEQ ID NO: 7849702 - DNA, 22 bp, Homo sapiens
ttcaataggatgcatgatataa

SEQ ID NO: 7849703 - DNA, 19 bp, Homo sapiens
ttcacaattatgaaattag

SEQ ID NO: 7849704 - DNA, 19 bp, Homo sapiens
ttcacaattatgaaattag

SEQ ID NO: 7849705 - DNA, 22 bp, Homo sapiens
ttcacaatttcccttcatcagg

SEQ ID NO: 7849706 - DNA, 22 bp, Homo sapiens
ttcaatagcatacttttgctct

SEQ ID NO: 7849707 - DNA, 22 bp, Homo sapiens
ttcaatagaaatgacattcttt

SEQ ID NO: 7849708 - DNA, 22 bp, Homo sapiens
ttcaatagaaatgacattcttt

SEQ ID NO: 7849709 - DNA, 22 bp, Homo sapiens
ttcaatagaaatgacattcttt

SEQ ID NO: 7849710 - DNA, 22 bp, Homo sapiens
ttcaatagaaagtccctagtta

SEQ ID NO: 7849711 - DNA, 22 bp, Homo sapiens
ttcaagttgtgttttccgggct

SEQ ID NO: 7849712 - DNA, 22 bp, Homo sapiens
ttcaagtttactttgaagttta

SEQ ID NO: 7849713 - DNA, 22 bp, Homo sapiens
ttcaagtttgcatgcccaagca

SEQ ID NO: 7849714 - DNA, 22 bp, Homo sapiens
ttcaagtttgtatttctgtatt

SEQ ID NO: 7849715 - DNA, 22 bp, Homo sapiens
ttcaagttttatatccatggct

SEQ ID NO: 7849716 - DNA, 22 bp, Homo sapiens
ttcaagttttcagaatagccac

SEQ ID NO: 7849717 - DNA, 22 bp, Homo sapiens
ttcaagttttatattgaagcaa

SEQ ID NO: 7849718 - DNA, 22 bp, Homo sapiens
ttcaagttttgacttagtcctt

SEQ ID NO: 7849719 - DNA, 22 bp, Homo sapiens
ttcaagttttgacttagtcctt

SEQ ID NO: 7849720 - DNA, 22 bp, Homo sapiens
ttcaagttaatgattctggttt

SEQ ID NO: 7849721 - DNA, 22 bp, Homo sapiens
ttcaagttcatgtgtagtcagt

SEQ ID NO: 7849722 - DNA, 22 bp, Homo sapiens
ttcaagttctagtgttcacttc

SEQ ID NO: 7849723 - DNA, 20 bp, Homo sapiens
ttcaagttgggtctctggct

SEQ ID NO: 7849724 - DNA, 20 bp, Homo sapiens
ttcaagttgggtctctggct

SEQ ID NO: 7849725 - DNA, 20 bp, Homo sapiens
ttcaagttgggtctctggct

SEQ ID NO: 7849726 - DNA, 22 bp, Homo sapiens
cctttctacagatgcctcttgc

SEQ ID NO: 7849727 - DNA, 22 bp, Homo sapiens
cctttcctgtgtccttttaagg

SEQ ID NO: 7849728 - DNA, 22 bp, Homo sapiens
cctttctctatcgacccatcgc

SEQ ID NO: 7849729 - DNA, 22 bp, Homo sapiens
cctttctctatcgacccatcgc

SEQ ID NO: 7849730 - DNA, 22 bp, Homo sapiens
cctttctctatcgacccatcgc

SEQ ID NO: 7849731 - DNA, 16 bp, Homo sapiens
cctttctctgccttcc

SEQ ID NO: 7849732 - DNA, 22 bp, Homo sapiens
cctttcctgcctcaggaagtag

SEQ ID NO: 7849733 - DNA, 22 bp, Homo sapiens
cctttcctgcctcaggaagtag

SEQ ID NO: 7849734 - DNA, 18 bp, Homo sapiens
cctttcctcccctcagct

SEQ ID NO: 7849735 - DNA, 18 bp, Homo sapiens
cctttcctcccctcagct

SEQ ID NO: 7849736 - DNA, 22 bp, Homo sapiens
cctttcaaaacagaacactagc

SEQ ID NO: 7849737 - DNA, 22 bp, Homo sapiens
cctttcaaaacagaacactagc

SEQ ID NO: 7849738 - DNA, 22 bp, Homo sapiens
cctttcaaagttttgccatgct

SEQ ID NO: 7849739 - DNA, 22 bp, Homo sapiens
cctttcaaattacatgactgct

SEQ ID NO: 7849740 - DNA, 22 bp, Homo sapiens
cctttcaaattacatgactgct

SEQ ID NO: 7849741 - DNA, 22 bp, Homo sapiens
cctttcaaaacagaacactagc

SEQ ID NO: 7849742 - DNA, 19 bp, Homo sapiens
cctttcagaacagaagcca

SEQ ID NO: 7849743 - DNA, 22 bp, Homo sapiens
cctttcagatgggcatggaccg

SEQ ID NO: 7849744 - DNA, 22 bp, Homo sapiens
cctttcaacaagatttctggcc

SEQ ID NO: 7849745 - DNA, 17 bp, Homo sapiens
cctttctctttcatctc

SEQ ID NO: 7849746 - DNA, 22 bp, Homo sapiens
cctttctctatcgacccatcgc

SEQ ID NO: 7849747 - DNA, 22 bp, Homo sapiens
cctttctgacagtgatgggggg

SEQ ID NO: 7849748 - DNA, 22 bp, Homo sapiens
cctttctctttgctgatcatgt

SEQ ID NO: 7849749 - DNA, 17 bp, Homo sapiens
cctttctctttcatctc

SEQ ID NO: 7849750 - DNA, 22 bp, Homo sapiens
ttaggaatattttctgagtagt

SEQ ID NO: 7849751 - DNA, 22 bp, Homo sapiens
ttaggaatattttctgagtagt

SEQ ID NO: 7849752 - DNA, 22 bp, Homo sapiens
ttaggaatatgtattttaaagt

SEQ ID NO: 7849753 - DNA, 22 bp, Homo sapiens
ttaggaatatagactaagtaga

SEQ ID NO: 7849754 - DNA, 22 bp, Homo sapiens
ttaggaatgagatttctagtga

SEQ ID NO: 7849755 - DNA, 22 bp, Homo sapiens
ttaggaatgagatttctagtga

SEQ ID NO: 7849756 - DNA, 22 bp, Homo sapiens
ttaggaatcacctgcagatctt

SEQ ID NO: 7849757 - DNA, 22 bp, Homo sapiens
ttaggaatcacctgcagatctt

SEQ ID NO: 7849758 - DNA, 22 bp, Homo sapiens
ttaggaatttatcacagactgg

SEQ ID NO: 7849759 - DNA, 22 bp, Homo sapiens
ttaggaatgagatttctagtga

SEQ ID NO: 7849760 - DNA, 22 bp, Homo sapiens
ttaggacaagataaaacacaag

SEQ ID NO: 7849761 - DNA, 22 bp, Homo sapiens
ttaggacaagataaaacacaag

SEQ ID NO: 7849762 - DNA, 22 bp, Homo sapiens
ttaggaatttattccattgttg

SEQ ID NO: 7849763 - DNA, 22 bp, Homo sapiens
ttaggaatttatcacagactgg

SEQ ID NO: 7849764 - DNA, 22 bp, Homo sapiens
ttaggagatggtcctctaggga

SEQ ID NO: 7849765 - DNA, 22 bp, Homo sapiens
ttaggagtccagatgtcttggg

SEQ ID NO: 7849766 - DNA, 22 bp, Homo sapiens
ttaggattaaaagttaatgcaa

SEQ ID NO: 7849767 - DNA, 22 bp, Homo sapiens
ttaggatttgaaaaggggcaga

SEQ ID NO: 7849768 - DNA, 21 bp, Homo sapiens
ttaggcactgcaattttatgc

SEQ ID NO: 7849769 - DNA, 22 bp, Homo sapiens
ttaggcacttgctttgtgttca

SEQ ID NO: 7849770 - DNA, 22 bp, Homo sapiens
ttaggcatagttttgataaata

SEQ ID NO: 7849771 - DNA, 22 bp, Homo sapiens
ttaggcaatgctctcaaatttg

SEQ ID NO: 7849772 - DNA, 22 bp, Homo sapiens
ttaggcaatgaattattccaag

SEQ ID NO: 7849773 - DNA, 22 bp, Homo sapiens
ttaggcattagagaaatgcaat

SEQ ID NO: 7849774 - DNA, 22 bp, Homo sapiens
ttaggccaatcaggaaaactca

SEQ ID NO: 7849775 - DNA, 22 bp, Homo sapiens
ttaggctcacatgctagatttg

SEQ ID NO: 7849776 - DNA, 22 bp, Homo sapiens
ttaggctctctgcaactaagta

SEQ ID NO: 7849777 - DNA, 22 bp, Homo sapiens
ttaggctgggctacaacaactg

SEQ ID NO: 7849778 - DNA, 22 bp, Homo sapiens
ttaggcctttgattggggtgct

SEQ ID NO: 7849779 - DNA, 22 bp, Homo sapiens
ttaggctgttcttgtgttgtta

SEQ ID NO: 7849780 - DNA, 22 bp, Homo sapiens
ttaggctgttcttgtgttgtta

SEQ ID NO: 7849781 - DNA, 22 bp, Homo sapiens
ttaggcttccggcaggcggcgc

SEQ ID NO: 7849782 - DNA, 22 bp, Homo sapiens
ttaggcttcatgtgcagaggat

SEQ ID NO: 7849783 - DNA, 22 bp, Homo sapiens
cgcagctgcacggggctgagcc

SEQ ID NO: 7849784 - DNA, 22 bp, Homo sapiens
cgcagctgccttgtcagccgtt

SEQ ID NO: 7849785 - DNA, 22 bp, Homo sapiens
cgcagctgccttgtcagccgtt

SEQ ID NO: 7849786 - DNA, 22 bp, Homo sapiens
cgcagctgctgctctgaaacag

SEQ ID NO: 7849787 - DNA, 22 bp, Homo sapiens
cgccagtggcagctggaacagg

SEQ ID NO: 7849788 - DNA, 22 bp, Homo sapiens
cgccaggcttggtagctcatgc

SEQ ID NO: 7849789 - DNA, 23 bp, Homo sapiens
cgcccagcctcagtgacctgggc

SEQ ID NO: 7849790 - DNA, 22 bp, Homo sapiens
cgccagtggcagctggaacagg

SEQ ID NO: 7849791 - DNA, 23 bp, Homo sapiens
cgcccagcctcagtgacctgggc

SEQ ID NO: 7849792 - DNA, 23 bp, Homo sapiens
cgcccagcctcagtgacctgggc

SEQ ID NO: 7849793 - DNA, 22 bp, Homo sapiens
cgccaggcttggtagctcatgc

SEQ ID NO: 7849794 - DNA, 18 bp, Homo sapiens
cgcatgtacacgtcatgc

SEQ ID NO: 7849795 - DNA, 22 bp, Homo sapiens
cgcatcgggtagaggagctgga

SEQ ID NO: 7849796 - DNA, 22 bp, Homo sapiens
cgcatccagggcgcaggatctg

SEQ ID NO: 7849797 - DNA, 22 bp, Homo sapiens
cgcatgagacctgccggccatc

SEQ ID NO: 7849798 - DNA, 22 bp, Homo sapiens
cgcagctgtccatgtgtggggg

SEQ ID NO: 7849799 - DNA, 22 bp, Homo sapiens
cgcagctggatatcatgtgcct

SEQ ID NO: 7849800 - DNA, 22 bp, Homo sapiens
cgcagctgctgctctgaaacag

SEQ ID NO: 7849801 - DNA, 22 bp, Homo sapiens
cgcagctggatatcatgtgcct

SEQ ID NO: 7849802 - DNA, 22 bp, Homo sapiens
cgcagctggatatcatgtgcct

SEQ ID NO: 7849803 - DNA, 22 bp, Homo sapiens
cgcagctggatatcatgtgcct

SEQ ID NO: 7849804 - DNA, 19 bp, Homo sapiens
cgcaggtggaaggagccgc

SEQ ID NO: 7849805 - DNA, 22 bp, Homo sapiens
cgcatacatagaaacacacaga

SEQ ID NO: 7849806 - DNA, 22 bp, Homo sapiens
cgcatacatagaaacacacaga

SEQ ID NO: 7849807 - DNA, 22 bp, Homo sapiens
cgcagtgagtctgtaaaaggct

SEQ ID NO: 7849808 - DNA, 22 bp, Homo sapiens
cgcaggtgtgttttcaggacta

SEQ ID NO: 7849809 - DNA, 22 bp, Homo sapiens
cgcaggtgggcccttcattgat

SEQ ID NO: 7849810 - DNA, 21 bp, Homo sapiens
ttactaaacaaaacatgcagg

SEQ ID NO: 7849811 - DNA, 21 bp, Homo sapiens
ttactaaacaaaacatgcagg

SEQ ID NO: 7849812 - DNA, 22 bp, Homo sapiens
ttactaaggactctaagttcta

SEQ ID NO: 7849813 - DNA, 22 bp, Homo sapiens
ttacttttctattcgatatgtg

SEQ ID NO: 7849814 - DNA, 22 bp, Homo sapiens
ttactacaagattctgttttat

SEQ ID NO: 7849815 - DNA, 22 bp, Homo sapiens
ttacttttgcaccaaactaata

SEQ ID NO: 7849816 - DNA, 21 bp, Homo sapiens
ttacttttgcaccaacctaat

SEQ ID NO: 7849817 - DNA, 21 bp, Homo sapiens
ttacttttgcaccaacctaat

SEQ ID NO: 7849818 - DNA, 21 bp, Homo sapiens
ttacttttgcaccaacctaat

SEQ ID NO: 7849819 - DNA, 22 bp, Homo sapiens
ttacttttgcaccaaactaata

SEQ ID NO: 7849820 - DNA, 22 bp, Homo sapiens
ttacttttgcaccaaactaata

SEQ ID NO: 7849821 - DNA, 22 bp, Homo sapiens
ttacttttgcaccaaactaata

SEQ ID NO: 7849822 - DNA, 22 bp, Homo sapiens
ttacttttgcaccaaactaata

SEQ ID NO: 7849823 - DNA, 23 bp, Homo sapiens
ttacttttgcaccaacctaatat

SEQ ID NO: 7849824 - DNA, 21 bp, Homo sapiens
ttacttttgcagcaacctaat

SEQ ID NO: 7849825 - DNA, 21 bp, Homo sapiens
ttacttttgcagcaacctaat

SEQ ID NO: 7849826 - DNA, 21 bp, Homo sapiens
ttacttttgcagcaacctaat

SEQ ID NO: 7849827 - DNA, 23 bp, Homo sapiens
ttacttttgcaccaacctaatat

SEQ ID NO: 7849828 - DNA, 21 bp, Homo sapiens
ttacttttgcaccaacctaat

SEQ ID NO: 7849829 - DNA, 23 bp, Homo sapiens
ttacttttgcaccaacctaatat

SEQ ID NO: 7849830 - DNA, 23 bp, Homo sapiens
ttacttttgcaccaacctaatat

SEQ ID NO: 7849831 - DNA, 22 bp, Homo sapiens
ttagaaaaaacgtcttctagtg

SEQ ID NO: 7849832 - DNA, 22 bp, Homo sapiens
ttagaaaaaacgtcttctagtg

SEQ ID NO: 7849833 - DNA, 22 bp, Homo sapiens
ttagaaaaaacgtcttctagtg

SEQ ID NO: 7849834 - DNA, 22 bp, Homo sapiens
ttagaaaaaacgtcttctagtg

SEQ ID NO: 7849835 - DNA, 21 bp, Homo sapiens
ttacttttgcagcaacctaat

SEQ ID NO: 7849836 - DNA, 22 bp, Homo sapiens
ttagaaaaaacgtcttctagtg

SEQ ID NO: 7849837 - DNA, 22 bp, Homo sapiens
ttagaaaaaacgtcttctagtg

SEQ ID NO: 7849838 - DNA, 22 bp, Homo sapiens
ttagaaaaaggctgtggtctta

SEQ ID NO: 7849839 - DNA, 22 bp, Homo sapiens
ccttccttgagaagcaattcct

SEQ ID NO: 7849840 - DNA, 22 bp, Homo sapiens
ccttccttgagaagcaattcct

SEQ ID NO: 7849841 - DNA, 22 bp, Homo sapiens
ccttccttcaagcacacatcta

SEQ ID NO: 7849842 - DNA, 22 bp, Homo sapiens
ccttccttgtctacaaaagctc

SEQ ID NO: 7849843 - DNA, 22 bp, Homo sapiens
ccttccttgtctacaaaagctc

SEQ ID NO: 7849844 - DNA, 22 bp, Homo sapiens
ccttccttgtctacaaaagctc

SEQ ID NO: 7849845 - DNA, 22 bp, Homo sapiens
ccttcctttcagggctatgcct

SEQ ID NO: 7849846 - DNA, 22 bp, Homo sapiens
ccttcctttcagggctatgcct

SEQ ID NO: 7849847 - DNA, 22 bp, Homo sapiens
ccttcctttgcaggtcaggtca

SEQ ID NO: 7849848 - DNA, 22 bp, Homo sapiens
ccttcctttgcaggtcaggtca

SEQ ID NO: 7849849 - DNA, 22 bp, Homo sapiens
ccttcctttgcaggtcaggtca

SEQ ID NO: 7849850 - DNA, 22 bp, Homo sapiens
ccttcctttgcatcatttctag

SEQ ID NO: 7849851 - DNA, 22 bp, Homo sapiens
ccttccttttactgtctccgga

SEQ ID NO: 7849852 - DNA, 22 bp, Homo sapiens
ccttcctttgcatcatttctag

SEQ ID NO: 7849853 - DNA, 22 bp, Homo sapiens
ccttccttttactgtctccgga

SEQ ID NO: 7849854 - DNA, 22 bp, Homo sapiens
ccttctagcaaatcaacataaa

SEQ ID NO: 7849855 - DNA, 22 bp, Homo sapiens
ccttctagcaaatcaacataaa

SEQ ID NO: 7849856 - DNA, 22 bp, Homo sapiens
ccttcgagatttaaacactgat

SEQ ID NO: 7849857 - DNA, 22 bp, Homo sapiens
ccttctagcaaatcaacataaa

SEQ ID NO: 7849858 - DNA, 21 bp, Homo sapiens
ccttctccacagggtctccgg

SEQ ID NO: 7849859 - DNA, 21 bp, Homo sapiens
ccttctccacagggtctccgg

SEQ ID NO: 7849860 - DNA, 21 bp, Homo sapiens
ccttctccacagggtctccgg

SEQ ID NO: 7849861 - DNA, 22 bp, Homo sapiens
ccttctagcaaatcaacataaa

SEQ ID NO: 7849862 - DNA, 22 bp, Homo sapiens
ccttctagcctgcgccagggca

SEQ ID NO: 7849863 - DNA, 22 bp, Homo sapiens
ttagaagtgggcctatagtcct

SEQ ID NO: 7849864 - DNA, 22 bp, Homo sapiens
ttagaagttcaggtctgtaatc

SEQ ID NO: 7849865 - DNA, 22 bp, Homo sapiens
ttagaagtggtaagtagaaaga

SEQ ID NO: 7849866 - DNA, 22 bp, Homo sapiens
ttagaagttcaggtctgtaatc

SEQ ID NO: 7849867 - DNA, 22 bp, Homo sapiens
ttagaatcagaagagaggtatt

SEQ ID NO: 7849868 - DNA, 22 bp, Homo sapiens
ttagaatcagaagagaggtatt

SEQ ID NO: 7849869 - DNA, 22 bp, Homo sapiens
ttagaatcaggtgttataatca

SEQ ID NO: 7849870 - DNA, 22 bp, Homo sapiens
ttagaatctaacattcttatct

SEQ ID NO: 7849871 - DNA, 22 bp, Homo sapiens
ttagaatccatggttgcagtgg

SEQ ID NO: 7849872 - DNA, 22 bp, Homo sapiens
ttagaatccatggttgcagtgg

SEQ ID NO: 7849873 - DNA, 22 bp, Homo sapiens
ttagaatcaggtgttataatca

SEQ ID NO: 7849874 - DNA, 22 bp, Homo sapiens
ttagaatcaggtgttataatca

SEQ ID NO: 7849875 - DNA, 22 bp, Homo sapiens
ttagaatcttgtatcagaagtt

SEQ ID NO: 7849876 - DNA, 22 bp, Homo sapiens
ttagaatcttgtatcagaagtt

SEQ ID NO: 7849877 - DNA, 22 bp, Homo sapiens
ttagaatctttagagtctcact

SEQ ID NO: 7849878 - DNA, 22 bp, Homo sapiens
ttagaatctaacattcttatct

SEQ ID NO: 7849879 - DNA, 22 bp, Homo sapiens
ttagaatcttgtatcagaagtt

SEQ ID NO: 7849880 - DNA, 22 bp, Homo sapiens
ttagaatctaacattcttatct

SEQ ID NO: 7849881 - DNA, 22 bp, Homo sapiens
ttagaatttctgctcactttga

SEQ ID NO: 7849882 - DNA, 22 bp, Homo sapiens
ttagacaagggctccttaaaag

SEQ ID NO: 7849883 - DNA, 22 bp, Homo sapiens
ttagacaagggctccttaaaag

SEQ ID NO: 7849884 - DNA, 22 bp, Homo sapiens
ttagaatttctgctcactttga

SEQ ID NO: 7849885 - DNA, 22 bp, Homo sapiens
ttagacaagggctccttaaaag

SEQ ID NO: 7849886 - DNA, 22 bp, Homo sapiens
ttagaatgatagagaatttgtt

SEQ ID NO: 7849887 - DNA, 22 bp, Homo sapiens
ttagaatgatagagaatttgtt

SEQ ID NO: 7849888 - DNA, 22 bp, Homo sapiens
ttagaattattgtttccttcta

SEQ ID NO: 7849889 - DNA, 23 bp, Homo sapiens
ttagacaatcctcaaaaggtaat

SEQ ID NO: 7849890 - DNA, 22 bp, Homo sapiens
ttagacaatctgttggtaaggt

SEQ ID NO: 7849891 - DNA, 20 bp, Homo sapiens
cctttagaaactcatatgta

SEQ ID NO: 7849892 - DNA, 22 bp, Homo sapiens
cctttagaaagtcagtagttgc

SEQ ID NO: 7849893 - DNA, 22 bp, Homo sapiens
ttagaagtgaaatagctgtaca

SEQ ID NO: 7849894 - DNA, 22 bp, Homo sapiens
ttagaagtcatctagtctaaaa

SEQ ID NO: 7849895 - DNA, 22 bp, Homo sapiens
ttagaagtcatctagtctaaaa

SEQ ID NO: 7849896 - DNA, 22 bp, Homo sapiens
ttagaaaatttgcttctttgga

SEQ ID NO: 7849897 - DNA, 22 bp, Homo sapiens
ttagaaaatggaggtgggaggg

SEQ ID NO: 7849898 - DNA, 22 bp, Homo sapiens
ttagaagtacatttagaacata

SEQ ID NO: 7849899 - DNA, 22 bp, Homo sapiens
ttagaaaaaggctgtggtctta

SEQ ID NO: 7849900 - DNA, 22 bp, Homo sapiens
ttagaaaaatgttcagtagttt

SEQ ID NO: 7849901 - DNA, 22 bp, Homo sapiens
ttagaaaaatgttcagtagttt

SEQ ID NO: 7849902 - DNA, 22 bp, Homo sapiens
ttagaaaaatgttcagtagttt

SEQ ID NO: 7849903 - DNA, 22 bp, Homo sapiens
ttagaaaaatgttcagtagttt

SEQ ID NO: 7849904 - DNA, 22 bp, Homo sapiens
ttagaaaaatgttcagtagttt

SEQ ID NO: 7849905 - DNA, 22 bp, Homo sapiens
ttagaaaacataagtggtaaag

SEQ ID NO: 7849906 - DNA, 22 bp, Homo sapiens
ttagaaaatggaggtgggaggg

SEQ ID NO: 7849907 - DNA, 22 bp, Homo sapiens
ttagaaaacataagtggtaaag

SEQ ID NO: 7849908 - DNA, 22 bp, Homo sapiens
ccttcctggagcccatgcagat

SEQ ID NO: 7849909 - DNA, 22 bp, Homo sapiens
ccttcctggagcccatgcagat

SEQ ID NO: 7849910 - DNA, 22 bp, Homo sapiens
ccttcctggagcccatgcagat

SEQ ID NO: 7849911 - DNA, 22 bp, Homo sapiens
ccttcctggctgtccgcctgat

SEQ ID NO: 7849912 - DNA, 22 bp, Homo sapiens
ccttcctggagcccatgcagat

SEQ ID NO: 7849913 - DNA, 22 bp, Homo sapiens
ccttcctggctgtccgcctgat

SEQ ID NO: 7849914 - DNA, 22 bp, Homo sapiens
ccttcctggctgtccgcctgat

SEQ ID NO: 7849915 - DNA, 22 bp, Homo sapiens
ccttccttcaagcacacatcta

SEQ ID NO: 7849916 - DNA, 22 bp, Homo sapiens
ccttccttcaagcacacatcta

SEQ ID NO: 7849917 - DNA, 19 bp, Homo sapiens
ccttcctccccagggccat

SEQ ID NO: 7849918 - DNA, 17 bp, Homo sapiens
ccttcctcatctccttc

SEQ ID NO: 7849919 - DNA, 17 bp, Homo sapiens
ccttcctcatctccttc

SEQ ID NO: 7849920 - DNA, 17 bp, Homo sapiens
ccttcctcatctccttc

SEQ ID NO: 7849921 - DNA, 17 bp, Homo sapiens
ccttcctcatctccttc

SEQ ID NO: 7849922 - DNA, 17 bp, Homo sapiens
ccttcctcatctccttc

SEQ ID NO: 7849923 - DNA, 22 bp, Homo sapiens
ccttcctcatccatttctcttg

SEQ ID NO: 7849924 - DNA, 22 bp, Homo sapiens
ccttcctcatccatttctcttg

SEQ ID NO: 7849925 - DNA, 22 bp, Homo sapiens
ccttccctaaagcgtcgcttag

SEQ ID NO: 7849926 - DNA, 22 bp, Homo sapiens
ccttccctaaagcgtcgcttag

SEQ ID NO: 7849927 - DNA, 19 bp, Homo sapiens
ccttccccttcagcctctg

SEQ ID NO: 7849928 - DNA, 19 bp, Homo sapiens
ccttccccttcagcctctg

SEQ ID NO: 7849929 - DNA, 22 bp, Homo sapiens
ccttcccacattccttacatgc

SEQ ID NO: 7849930 - DNA, 22 bp, Homo sapiens
ccttccagttcttggttgtaat

SEQ ID NO: 7849931 - DNA, 22 bp, Homo sapiens
ccttcccaggctagaccaacat

SEQ ID NO: 7849932 - DNA, 22 bp, Homo sapiens
ccttccagttcttggttgtaat

SEQ ID NO: 7849933 - DNA, 22 bp, Homo sapiens
ccttcccaggctagaccaacat

SEQ ID NO: 7849934 - DNA, 22 bp, Homo sapiens
ccttcccatgcagcctgtctga

SEQ ID NO: 7849935 - DNA, 22 bp, Homo sapiens
ccttcccatgcagcctgtctga

SEQ ID NO: 7849936 - DNA, 22 bp, Homo sapiens
ccttcccatgcagcctgtctga

SEQ ID NO: 7849937 - DNA, 22 bp, Homo sapiens
ccttcccatgcagcctgtctga

SEQ ID NO: 7849938 - DNA, 22 bp, Homo sapiens
ccttcagtcccatgtttctctt

SEQ ID NO: 7849939 - DNA, 22 bp, Homo sapiens
ccttcagtcccatgtttctctt

SEQ ID NO: 7849940 - DNA, 22 bp, Homo sapiens
ccttcattattcctgaactgtt

SEQ ID NO: 7849941 - DNA, 22 bp, Homo sapiens
ccttcatgtcattggacacctt

SEQ ID NO: 7849942 - DNA, 22 bp, Homo sapiens
ccttccagtgatatgcgtgaat

SEQ ID NO: 7849943 - DNA, 22 bp, Homo sapiens
ccttccagtgactaaggaggaa

SEQ ID NO: 7849944 - DNA, 22 bp, Homo sapiens
ccttccagtgatatgcgtgaat

SEQ ID NO: 7849945 - DNA, 22 bp, Homo sapiens
ccttccagtgatatgcgtgaat

SEQ ID NO: 7849946 - DNA, 22 bp, Homo sapiens
ccttcattattcctgaactgtt

SEQ ID NO: 7849947 - DNA, 22 bp, Homo sapiens
ccttccccaggtgctcactgtc

SEQ ID NO: 7849948 - DNA, 22 bp, Homo sapiens
ccttccccaggtgctcactgtc

SEQ ID NO: 7849949 - DNA, 20 bp, Homo sapiens
ccttccccacccgctgaggt

SEQ ID NO: 7849950 - DNA, 22 bp, Homo sapiens
ccttcccatgcagcctgtctga

SEQ ID NO: 7849951 - DNA, 20 bp, Homo sapiens
ccttccccacccgctgaggt

SEQ ID NO: 7849952 - DNA, 22 bp, Homo sapiens
ccttccccagtgattctctcag

SEQ ID NO: 7849953 - DNA, 22 bp, Homo sapiens
ccttccccagtgattctctcag

SEQ ID NO: 7849954 - DNA, 22 bp, Homo sapiens
ccttccccaggtgctcactgtc

SEQ ID NO: 7849955 - DNA, 22 bp, Homo sapiens
ccttccccaggtgctcactgtc

SEQ ID NO: 7849956 - DNA, 19 bp, Homo sapiens
ccttccccttcagcctctg

SEQ ID NO: 7849957 - DNA, 19 bp, Homo sapiens
ccttccccttcagcctctg

SEQ ID NO: 7849958 - DNA, 19 bp, Homo sapiens
ccttccccttcagcctctg

SEQ ID NO: 7849959 - DNA, 22 bp, Homo sapiens
cctgtgtcttccccactggtgt

SEQ ID NO: 7849960 - DNA, 22 bp, Homo sapiens
cctgtgtcttccccactggtgt

SEQ ID NO: 7849961 - DNA, 22 bp, Homo sapiens
cctgtgtctttgcctcagggtc

SEQ ID NO: 7849962 - DNA, 22 bp, Homo sapiens
cctgtgtctttgcctcagggtc

SEQ ID NO: 7849963 - DNA, 22 bp, Homo sapiens
cctgtgtcttccccactggtgt

SEQ ID NO: 7849964 - DNA, 23 bp, Homo sapiens
cctgtgtctgttgctgaataatg

SEQ ID NO: 7849965 - DNA, 22 bp, Homo sapiens
cctgtgtcttccccactggtgt

SEQ ID NO: 7849966 - DNA, 22 bp, Homo sapiens
cctgtgtcttccccactggtgt

SEQ ID NO: 7849967 - DNA, 22 bp, Homo sapiens
cctgtgtctgaccatgcacatg

SEQ ID NO: 7849968 - DNA, 22 bp, Homo sapiens
cctgtgtctgaccatgcacatg

SEQ ID NO: 7849969 - DNA, 23 bp, Homo sapiens
cctgtgtctgttgctgaataatg

SEQ ID NO: 7849970 - DNA, 22 bp, Homo sapiens
cctgtgtcttccccactggtgt

SEQ ID NO: 7849971 - DNA, 22 bp, Homo sapiens
cctgtgtcctcccactcagtcc

SEQ ID NO: 7849972 - DNA, 22 bp, Homo sapiens
cctgtgtcctcccactcagtcc

SEQ ID NO: 7849973 - DNA, 22 bp, Homo sapiens
cctgtgtccttggcagatatcc

SEQ ID NO: 7849974 - DNA, 22 bp, Homo sapiens
cctgtgtcctcccactcagtcc

SEQ ID NO: 7849975 - DNA, 22 bp, Homo sapiens
cctgtgtcctaatccatcaggc

SEQ ID NO: 7849976 - DNA, 22 bp, Homo sapiens
cctgtgtcctaatccatcaggc

SEQ ID NO: 7849977 - DNA, 22 bp, Homo sapiens
cctgtgtcctaatccatcaggc

SEQ ID NO: 7849978 - DNA, 22 bp, Homo sapiens
cctgtgtctgaccatgcacatg

SEQ ID NO: 7849979 - DNA, 16 bp, Homo sapiens
cctgtgtctatcaggt

SEQ ID NO: 7849980 - DNA, 22 bp, Homo sapiens
cctgtgtccttggcagatatcc

SEQ ID NO: 7849981 - DNA, 22 bp, Homo sapiens
cctgtgtccttggcagatatcc

SEQ ID NO: 7849982 - DNA, 22 bp, Homo sapiens
cctgtgtccttggcagatatcc

SEQ ID NO: 7849983 - DNA, 22 bp, Homo sapiens
cctgtgtgctgatgacgacaga

SEQ ID NO: 7849984 - DNA, 23 bp, Homo sapiens
cctgtgtgcccttaattcacagc

SEQ ID NO: 7849985 - DNA, 22 bp, Homo sapiens
cctgtgtgcctggccgcgggag

SEQ ID NO: 7849986 - DNA, 22 bp, Homo sapiens
cctgtgtgctgatgacgacaga

SEQ ID NO: 7849987 - DNA, 22 bp, Homo sapiens
cctgtgtgctgatgacgacaga

SEQ ID NO: 7849988 - DNA, 22 bp, Homo sapiens
cctgtgtgcacacgaggccatg

SEQ ID NO: 7849989 - DNA, 22 bp, Homo sapiens
cctgtgtgcacacgaggccatg

SEQ ID NO: 7849990 - DNA, 22 bp, Homo sapiens
cctgtgtctttgcctcagggtc

SEQ ID NO: 7849991 - DNA, 22 bp, Homo sapiens
cctgtgtgattggaagctgaga

SEQ ID NO: 7849992 - DNA, 22 bp, Homo sapiens
ccttcaggtcatatatgtcaga

SEQ ID NO: 7849993 - DNA, 22 bp, Homo sapiens
cctgtgtgtctgtcactgcaca

SEQ ID NO: 7849994 - DNA, 22 bp, Homo sapiens
cctgtgtgtctgtcactgcaca

SEQ ID NO: 7849995 - DNA, 22 bp, Homo sapiens
cctgtgtgtaggccaggggagt

SEQ ID NO: 7849996 - DNA, 21 bp, Homo sapiens
cctgtgtgtctgactgggcta

SEQ ID NO: 7849997 - DNA, 22 bp, Homo sapiens
cctgtgtgtaggccaggggagt

SEQ ID NO: 7849998 - DNA, 22 bp, Homo sapiens
cctgtgtgtaggccaggggagt

SEQ ID NO: 7849999 - DNA, 20 bp, Homo sapiens
cctgtgtggtttgcactaca

SEQ ID NO: 7850000 - DNA, 20 bp, Homo sapiens
cctgtgtggtttgcactaca

SEQ ID NO: 7850001 - DNA, 20 bp, Homo sapiens
cctgtgtggtttgcactaca

SEQ ID NO: 7850002 - DNA, 22 bp, Homo sapiens
cctgtgtggtagccagcggtgc

SEQ ID NO: 7850003 - DNA, 22 bp, Homo sapiens
cctgtgtggccaggctggagtc

SEQ ID NO: 7850004 - DNA, 22 bp, Homo sapiens
cctgtgtggccgcactgctccc

SEQ ID NO: 7850005 - DNA, 22 bp, Homo sapiens
cctgtgtggccaggctggagtc

SEQ ID NO: 7850006 - DNA, 19 bp, Homo sapiens
cctgtgtggggtagagatc

SEQ ID NO: 7850007 - DNA, 20 bp, Homo sapiens
cctgtgtggccagctgaggc

SEQ ID NO: 7850008 - DNA, 20 bp, Homo sapiens
cctgtgtggccagctgaggc

SEQ ID NO: 7850009 - DNA, 20 bp, Homo sapiens
cctgtgtggccagctgaggc

SEQ ID NO: 7850010 - DNA, 22 bp, Homo sapiens
cctgtgtggccaggctggagtc

SEQ ID NO: 7850011 - DNA, 22 bp, Homo sapiens
ttaaatagctcttgtagaagaa

SEQ ID NO: 7850012 - DNA, 22 bp, Homo sapiens
cctgtggctggtcaggccagca

SEQ ID NO: 7850013 - DNA, 22 bp, Homo sapiens
cctgtggcttccacgacctaat

SEQ ID NO: 7850014 - DNA, 22 bp, Homo sapiens
cctgtggcttccacgacctaat

SEQ ID NO: 7850015 - DNA, 22 bp, Homo sapiens
cctgtgggaaaggtctgctctc

SEQ ID NO: 7850016 - DNA, 22 bp, Homo sapiens
ttaaatagctcttgtagaagaa

SEQ ID NO: 7850017 - DNA, 19 bp, Homo sapiens
ttaaagtgcgagaagtctt

SEQ ID NO: 7850018 - DNA, 22 bp, Homo sapiens
ttaaagttcattaaatgagcca

SEQ ID NO: 7850019 - DNA, 22 bp, Homo sapiens
ttaaagttcattaaatgagcca

SEQ ID NO: 7850020 - DNA, 22 bp, Homo sapiens
ttaaatagctcttgtagaagaa

SEQ ID NO: 7850021 - DNA, 22 bp, Homo sapiens
ttaaagtttcagaaacttggtc

SEQ ID NO: 7850022 - DNA, 22 bp, Homo sapiens
ttaaaggcatggttagacatgg

SEQ ID NO: 7850023 - DNA, 22 bp, Homo sapiens
ttaaaggctgatcttaatatta

SEQ ID NO: 7850024 - DNA, 22 bp, Homo sapiens
ttaaaggctgatcttaatatta

SEQ ID NO: 7850025 - DNA, 22 bp, Homo sapiens
ttaaagtaatctgtgtgaattt

SEQ ID NO: 7850026 - DNA, 22 bp, Homo sapiens
ttaaagtaatctgtgtgaattt

SEQ ID NO: 7850027 - DNA, 22 bp, Homo sapiens
ttaaagtaatctgtgtgaattt

SEQ ID NO: 7850028 - DNA, 22 bp, Homo sapiens
ttaaagtatagaggacaaaaac

SEQ ID NO: 7850029 - DNA, 19 bp, Homo sapiens
ttaaagtgcgagaagtctt

SEQ ID NO: 7850030 - DNA, 22 bp, Homo sapiens
ttaaagtatggtttaagggctt

SEQ ID NO: 7850031 - DNA, 22 bp, Homo sapiens
ttaaagtatggtttaagggctt

SEQ ID NO: 7850032 - DNA, 22 bp, Homo sapiens
ttaaagtatagaggacaaaaac

SEQ ID NO: 7850033 - DNA, 22 bp, Homo sapiens
ttaaagtatagaggacaaaaac

SEQ ID NO: 7850034 - DNA, 22 bp, Homo sapiens
cctgtgtcctaatccatcaggc

SEQ ID NO: 7850035 - DNA, 22 bp, Homo sapiens
cctgtgtcctaatccatcaggc

SEQ ID NO: 7850036 - DNA, 22 bp, Homo sapiens
cctgtgtccagttccaggttgt

SEQ ID NO: 7850037 - DNA, 22 bp, Homo sapiens
cctgtgtccagttccaggttgt

SEQ ID NO: 7850038 - DNA, 19 bp, Homo sapiens
cctgtgtcccacgtagatg

SEQ ID NO: 7850039 - DNA, 22 bp, Homo sapiens
cctgtgtcatcagctgtggcta

SEQ ID NO: 7850040 - DNA, 22 bp, Homo sapiens
cctgtgtcatcagctgtggcta

SEQ ID NO: 7850041 - DNA, 22 bp, Homo sapiens
cctgtgtcagcccctgcctcca

SEQ ID NO: 7850042 - DNA, 22 bp, Homo sapiens
cctgtgtcagcccctgcctcca

SEQ ID NO: 7850043 - DNA, 22 bp, Homo sapiens
cctgtgtcatcagctgtggcta

SEQ ID NO: 7850044 - DNA, 22 bp, Homo sapiens
cctgtgtcagcccctgcctcca

SEQ ID NO: 7850045 - DNA, 22 bp, Homo sapiens
cctgtgtcaccggaacggagga

SEQ ID NO: 7850046 - DNA, 22 bp, Homo sapiens
cctgtgtcagcccctgcctcca

SEQ ID NO: 7850047 - DNA, 22 bp, Homo sapiens
cctgtgtcaccggaacggagga

SEQ ID NO: 7850048 - DNA, 22 bp, Homo sapiens
cctgtgtcagcccctgcctcca

SEQ ID NO: 7850049 - DNA, 22 bp, Homo sapiens
cctgtgtagcaaaattgccccc

SEQ ID NO: 7850050 - DNA, 22 bp, Homo sapiens
cctgtgggtcacatgggtgact

SEQ ID NO: 7850051 - DNA, 22 bp, Homo sapiens
cctgtgggagcccaggcagata

SEQ ID NO: 7850052 - DNA, 22 bp, Homo sapiens
cctgtgggtcacatgggtgact

SEQ ID NO: 7850053 - DNA, 22 bp, Homo sapiens
cctgtgggtcacatgggtgact

SEQ ID NO: 7850054 - DNA, 22 bp, Homo sapiens
cctgtgggttttcaagatgcta

SEQ ID NO: 7850055 - DNA, 22 bp, Homo sapiens
cctgtgggttttctgtagaaat

SEQ ID NO: 7850056 - DNA, 22 bp, Homo sapiens
cctgtggttacgcctgtttcca

SEQ ID NO: 7850057 - DNA, 21 bp, Homo sapiens
cctgtggtctggagggagcac

SEQ ID NO: 7850058 - DNA, 21 bp, Homo sapiens
cctgtggtctggagggagcac

SEQ ID NO: 7850059 - DNA, 21 bp, Homo sapiens
cctgtggtctggagggagcac

SEQ ID NO: 7850060 - DNA, 21 bp, Homo sapiens
cctgtggtctggagggagcac

SEQ ID NO: 7850061 - DNA, 22 bp, Homo sapiens
cctgtggtttactctgtggcta

SEQ ID NO: 7850062 - DNA, 22 bp, Homo sapiens
cctgtggtttactctgtggcta

SEQ ID NO: 7850063 - DNA, 21 bp, Homo sapiens
cctgtgtatatggcttgcatg

SEQ ID NO: 7850064 - DNA, 22 bp, Homo sapiens
cctgtggtttacgtacagctcc

SEQ ID NO: 7850065 - DNA, 22 bp, Homo sapiens
ttaaagctggcgttacagtttg

SEQ ID NO: 7850066 - DNA, 22 bp, Homo sapiens
ttaaagctgagccctcagaagc

SEQ ID NO: 7850067 - DNA, 22 bp, Homo sapiens
ttaaagctgagccctcagaagc

SEQ ID NO: 7850068 - DNA, 22 bp, Homo sapiens
ttaaagctggcgttacagtttg

SEQ ID NO: 7850069 - DNA, 22 bp, Homo sapiens
ttaaaggatctttgtcattaat

SEQ ID NO: 7850070 - DNA, 22 bp, Homo sapiens
ttaaaggaattgagtttcttgt

SEQ ID NO: 7850071 - DNA, 23 bp, Homo sapiens
ttaaaggcagatgttgagtatta

SEQ ID NO: 7850072 - DNA, 23 bp, Homo sapiens
ttaaaggcagatgttgagtatta

SEQ ID NO: 7850073 - DNA, 22 bp, Homo sapiens
ttaaaggcatggttagacatgg

SEQ ID NO: 7850074 - DNA, 17 bp, Homo sapiens
ttaaaggatgctctctc

SEQ ID NO: 7850075 - DNA, 21 bp, Homo sapiens
ttaaagctatggtagtgggct

SEQ ID NO: 7850076 - DNA, 22 bp, Homo sapiens
cctgtgcttcagctggaggagg

SEQ ID NO: 7850077 - DNA, 20 bp, Homo sapiens
cctgtgcttatcacttgctg

SEQ ID NO: 7850078 - DNA, 22 bp, Homo sapiens
cctgtgcttcactcaacaagcc

SEQ ID NO: 7850079 - DNA, 22 bp, Homo sapiens
cctgtgcttcactcaacaagcc

SEQ ID NO: 7850080 - DNA, 22 bp, Homo sapiens
cctgtgctggacagggctgggc

SEQ ID NO: 7850081 - DNA, 22 bp, Homo sapiens
cctgtgctgggtgtgagggaca

SEQ ID NO: 7850082 - DNA, 22 bp, Homo sapiens
cctgtgctggacagggctgggc

SEQ ID NO: 7850083 - DNA, 22 bp, Homo sapiens
cctgtgctggacagggctgggc

SEQ ID NO: 7850084 - DNA, 20 bp, Homo sapiens
cctgtgctgccctcggggcc

SEQ ID NO: 7850085 - DNA, 22 bp, Homo sapiens
cctgtgccctgccaggctggtg

SEQ ID NO: 7850086 - DNA, 22 bp, Homo sapiens
cctgtgccctgccaggctggtg

SEQ ID NO: 7850087 - DNA, 22 bp, Homo sapiens
cctgtgccctggaaggagagag

SEQ ID NO: 7850088 - DNA, 22 bp, Homo sapiens
cctgtgccctggaaggagagag

SEQ ID NO: 7850089 - DNA, 22 bp, Homo sapiens
cctgtgccctggaaggagagag

SEQ ID NO: 7850090 - DNA, 22 bp, Homo sapiens
cctgtgcctgcctgtgagttct

SEQ ID NO: 7850091 - DNA, 22 bp, Homo sapiens
cctgtgccttaaccctttaggc

SEQ ID NO: 7850092 - DNA, 22 bp, Homo sapiens
cctgtgccttaaccctttaggc

SEQ ID NO: 7850093 - DNA, 22 bp, Homo sapiens
cctgtgccttccttaggcacct

SEQ ID NO: 7850094 - DNA, 22 bp, Homo sapiens
cctgtgccttccttaggcacct

SEQ ID NO: 7850095 - DNA, 22 bp, Homo sapiens
cctgtgccctctgcatagcagc

SEQ ID NO: 7850096 - DNA, 22 bp, Homo sapiens
cctgtgccctctgcatagcagc

SEQ ID NO: 7850097 - DNA, 22 bp, Homo sapiens
cctgtgccctcagcctggctct

SEQ ID NO: 7850098 - DNA, 22 bp, Homo sapiens
cctgtgccctcagcctggctct

SEQ ID NO: 7850099 - DNA, 22 bp, Homo sapiens
cctgtgccctacacctttccag

SEQ ID NO: 7850100 - DNA, 22 bp, Homo sapiens
cctgtgccctacacctttccag

SEQ ID NO: 7850101 - DNA, 22 bp, Homo sapiens
cctgtgccatcctgagcatccc

SEQ ID NO: 7850102 - DNA, 18 bp, Homo sapiens
cctgtgctccagcatctg

SEQ ID NO: 7850103 - DNA, 22 bp, Homo sapiens
cctgtgctcccatagcttctgt

SEQ ID NO: 7850104 - DNA, 22 bp, Homo sapiens
cctgtgctccctatgtatctgg

SEQ ID NO: 7850105 - DNA, 22 bp, Homo sapiens
cctgtgctccctatgtatctgg

SEQ ID NO: 7850106 - DNA, 19 bp, Homo sapiens
cctgtgctaggagctgacc

SEQ ID NO: 7850107 - DNA, 21 bp, Homo sapiens
cctgtgctccacacagggtcc

SEQ ID NO: 7850108 - DNA, 19 bp, Homo sapiens
cctgtgctaggagctgacc

SEQ ID NO: 7850109 - DNA, 19 bp, Homo sapiens
cctgtgctaggagctgacc

SEQ ID NO: 7850110 - DNA, 22 bp, Homo sapiens
cctgtgccttccttaggcacct

SEQ ID NO: 7850111 - DNA, 22 bp, Homo sapiens
cctgtgccttccttaggcacct

SEQ ID NO: 7850112 - DNA, 22 bp, Homo sapiens
cctgtgccttccttaggcacct

SEQ ID NO: 7850113 - DNA, 22 bp, Homo sapiens
tgtttagaggaacaacagactt

SEQ ID NO: 7850114 - DNA, 22 bp, Homo sapiens
tgtttagagtctctgtcaacat

SEQ ID NO: 7850115 - DNA, 22 bp, Homo sapiens
tgtttagaggaactggaatcag

SEQ ID NO: 7850116 - DNA, 22 bp, Homo sapiens
tgtttacttgaggtggaaacaa

SEQ ID NO: 7850117 - DNA, 22 bp, Homo sapiens
tgtttactttccttctcacagg

SEQ ID NO: 7850118 - DNA, 22 bp, Homo sapiens
tgtttactttccttctcacagg

SEQ ID NO: 7850119 - DNA, 22 bp, Homo sapiens
tgtttactttccttctcacagg

SEQ ID NO: 7850120 - DNA, 22 bp, Homo sapiens
tgtttacttttaattacctgtc

SEQ ID NO: 7850121 - DNA, 22 bp, Homo sapiens
tgtttacttttaattacctgtc

SEQ ID NO: 7850122 - DNA, 22 bp, Homo sapiens
tgtttataaattttcttgccat

SEQ ID NO: 7850123 - DNA, 22 bp, Homo sapiens
tgtttagtaggagtttaatact

SEQ ID NO: 7850124 - DNA, 22 bp, Homo sapiens
tgtttataatatgcagtgagca

SEQ ID NO: 7850125 - DNA, 22 bp, Homo sapiens
cctgtcactgttgcagccagct

SEQ ID NO: 7850126 - DNA, 22 bp, Homo sapiens
cctgtcactctgagccgctccg

SEQ ID NO: 7850127 - DNA, 22 bp, Homo sapiens
cctgtctctgcagggccctgcc

SEQ ID NO: 7850128 - DNA, 22 bp, Homo sapiens
cctgtcagctgatggctatgta

SEQ ID NO: 7850129 - DNA, 22 bp, Homo sapiens
cctgtctctgcagggccctgcc

SEQ ID NO: 7850130 - DNA, 22 bp, Homo sapiens
cctgtctctttcaatctgagag

SEQ ID NO: 7850131 - DNA, 22 bp, Homo sapiens
cctgtctctgcagggccctgcc

SEQ ID NO: 7850132 - DNA, 22 bp, Homo sapiens
cctgtctgaaggcagggggatg

SEQ ID NO: 7850133 - DNA, 22 bp, Homo sapiens
cctgtctctttcaatctgagag

SEQ ID NO: 7850134 - DNA, 22 bp, Homo sapiens
cctgtctgaatcatgatttcct

SEQ ID NO: 7850135 - DNA, 22 bp, Homo sapiens
cctgtctgaatcatgatttcct

SEQ ID NO: 7850136 - DNA, 22 bp, Homo sapiens
cctgtctgaatcatgatttcct

SEQ ID NO: 7850137 - DNA, 22 bp, Homo sapiens
cctgtctgcagatatctcaggt

SEQ ID NO: 7850138 - DNA, 22 bp, Homo sapiens
cctgtctgcagatatctcaggt

SEQ ID NO: 7850139 - DNA, 20 bp, Homo sapiens
cctgtctgcaatggaggtca

SEQ ID NO: 7850140 - DNA, 22 bp, Homo sapiens
cctgtctgaggaggtgctcttt

SEQ ID NO: 7850141 - DNA, 22 bp, Homo sapiens
cctgtctgaggaggtgctcttt

SEQ ID NO: 7850142 - DNA, 22 bp, Homo sapiens
cctgtctgaggaggtgctcttt

SEQ ID NO: 7850143 - DNA, 22 bp, Homo sapiens
cctgtctgcatgagtgagcata

SEQ ID NO: 7850144 - DNA, 22 bp, Homo sapiens
cctgtctgcaggaaattaccag

SEQ ID NO: 7850145 - DNA, 22 bp, Homo sapiens
cctgtctgcagatatctcaggt

SEQ ID NO: 7850146 - DNA, 22 bp, Homo sapiens
cctgtctgcagatatctcaggt

SEQ ID NO: 7850147 - DNA, 22 bp, Homo sapiens
cctgtctgcatgagtgagcata

SEQ ID NO: 7850148 - DNA, 22 bp, Homo sapiens
cctgtctgcatgagtgagcata

SEQ ID NO: 7850149 - DNA, 22 bp, Homo sapiens
cctgtctgcatgatccctgcca

SEQ ID NO: 7850150 - DNA, 22 bp, Homo sapiens
cctgtctgcatgagtgagcata

SEQ ID NO: 7850151 - DNA, 22 bp, Homo sapiens
cctgtctgcatgatccctgcca

SEQ ID NO: 7850152 - DNA, 22 bp, Homo sapiens
cctgtctggaacatggcctgtt

SEQ ID NO: 7850153 - DNA, 22 bp, Homo sapiens
cctgtctgcatgatccctgcca

SEQ ID NO: 7850154 - DNA, 22 bp, Homo sapiens
cctgtctgcatgatccctgcca

SEQ ID NO: 7850155 - DNA, 22 bp, Homo sapiens
cctgtctgcatgatccctgcca

SEQ ID NO: 7850156 - DNA, 22 bp, Homo sapiens
cctgtctgcatgatccctgcca

SEQ ID NO: 7850157 - DNA, 23 bp, Homo sapiens
cctgtctgtgctgggtggacaca

SEQ ID NO: 7850158 - DNA, 23 bp, Homo sapiens
cctgtctgtgctgggtggacaca

SEQ ID NO: 7850159 - DNA, 22 bp, Homo sapiens
cctgtctgtttgcccattcttg

SEQ ID NO: 7850160 - DNA, 22 bp, Homo sapiens
cctgtctgtttcattccttgtt

SEQ ID NO: 7850161 - DNA, 22 bp, Homo sapiens
cctgtctgttctgactggtcag

SEQ ID NO: 7850162 - DNA, 22 bp, Homo sapiens
cctgtctgtcctttgcattctt

SEQ ID NO: 7850163 - DNA, 22 bp, Homo sapiens
cctgtctgtcctttgcattctt

SEQ ID NO: 7850164 - DNA, 22 bp, Homo sapiens
cctgtctgtcctttgcattctt

SEQ ID NO: 7850165 - DNA, 23 bp, Homo sapiens
cctgtctgtgctgggtggacaca

SEQ ID NO: 7850166 - DNA, 23 bp, Homo sapiens
cctgtctgtgctgggtggacaca

SEQ ID NO: 7850167 - DNA, 23 bp, Homo sapiens
cctgtctgtgctgggtggacaca

SEQ ID NO: 7850168 - DNA, 23 bp, Homo sapiens
cctgtctgtgctgggtggacaca

SEQ ID NO: 7850169 - DNA, 23 bp, Homo sapiens
cctgtctgtgctgggtggacaca

SEQ ID NO: 7850170 - DNA, 19 bp, Homo sapiens
cctgtctgtcttcagctag

SEQ ID NO: 7850171 - DNA, 19 bp, Homo sapiens
cctgtctgtcttcagctag

SEQ ID NO: 7850172 - DNA, 22 bp, Homo sapiens
cctgtgccatcctgagcatccc

SEQ ID NO: 7850173 - DNA, 22 bp, Homo sapiens
cctgtgccatcctgagcatccc

SEQ ID NO: 7850174 - DNA, 22 bp, Homo sapiens
cctgtgccatcctgagcatccc

SEQ ID NO: 7850175 - DNA, 22 bp, Homo sapiens
cctgtgccatcctgagcatccc

SEQ ID NO: 7850176 - DNA, 18 bp, Homo sapiens
cctgtgacagaggcatca

SEQ ID NO: 7850177 - DNA, 22 bp, Homo sapiens
cctgtgacaaacccgcctattc

SEQ ID NO: 7850178 - DNA, 23 bp, Homo sapiens
cctgtgacactgtttgtggtaag

SEQ ID NO: 7850179 - DNA, 21 bp, Homo sapiens
cctgtcttggactgaggcacc

SEQ ID NO: 7850180 - DNA, 17 bp, Homo sapiens
cctgtcttgtttctgcc

SEQ ID NO: 7850181 - DNA, 17 bp, Homo sapiens
cctgtcttgtttctgcc

SEQ ID NO: 7850182 - DNA, 17 bp, Homo sapiens
cctgtcttgtttctgcc

SEQ ID NO: 7850183 - DNA, 17 bp, Homo sapiens
cctgtcttgtttctgcc

SEQ ID NO: 7850184 - DNA, 22 bp, Homo sapiens
cctgtctgtttgcccattcttg

SEQ ID NO: 7850185 - DNA, 22 bp, Homo sapiens
cctgtctgtttgcccattcttg

SEQ ID NO: 7850186 - DNA, 22 bp, Homo sapiens
cctgtcttagggaaagactgga

SEQ ID NO: 7850187 - DNA, 22 bp, Homo sapiens
cctgtcttagggaaagactgga

SEQ ID NO: 7850188 - DNA, 21 bp, Homo sapiens
cctgtcttggactgaggcacc

SEQ ID NO: 7850189 - DNA, 22 bp, Homo sapiens
cctgtctggccttccacggggg

SEQ ID NO: 7850190 - DNA, 22 bp, Homo sapiens
cctgtctggccaccagggcgat

SEQ ID NO: 7850191 - DNA, 22 bp, Homo sapiens
cctgtctggccaccagggcgat

SEQ ID NO: 7850192 - DNA, 22 bp, Homo sapiens
cctgtctggccttccacggggg

SEQ ID NO: 7850193 - DNA, 22 bp, Homo sapiens
cctgtctggccttccacggggg

SEQ ID NO: 7850194 - DNA, 22 bp, Homo sapiens
cctgtctgggcttgagtattta

SEQ ID NO: 7850195 - DNA, 22 bp, Homo sapiens
cctgtctggggactccctgggt

SEQ ID NO: 7850196 - DNA, 22 bp, Homo sapiens
cctgtctggccaccagggcgat

SEQ ID NO: 7850197 - DNA, 20 bp, Homo sapiens
cctgtctggagacaaagaga

SEQ ID NO: 7850198 - DNA, 22 bp, Homo sapiens
cctgtctggaacatggcctgtt

SEQ ID NO: 7850199 - DNA, 22 bp, Homo sapiens
cctgtctggaacatggcctgtt

SEQ ID NO: 7850200 - DNA, 22 bp, Homo sapiens
cctgtctggaacatggcctgtt

SEQ ID NO: 7850201 - DNA, 22 bp, Homo sapiens
cctgtctggaacatggcctgtt

SEQ ID NO: 7850202 - DNA, 22 bp, Homo sapiens
cctgtctggaacatggcctgtt

SEQ ID NO: 7850203 - DNA, 22 bp, Homo sapiens
cctgtctgtcctttgcattctt

SEQ ID NO: 7850204 - DNA, 22 bp, Homo sapiens
cctgtctgtcctctcatgagcc

SEQ ID NO: 7850205 - DNA, 22 bp, Homo sapiens
cctgtctgtcctctcatgagcc

SEQ ID NO: 7850206 - DNA, 22 bp, Homo sapiens
cctgtctgtattggtttgctat

SEQ ID NO: 7850207 - DNA, 22 bp, Homo sapiens
cctgtctgtcctctcatgagcc

SEQ ID NO: 7850208 - DNA, 22 bp, Homo sapiens
cctgtctgtcctctcatgagcc

SEQ ID NO: 7850209 - DNA, 22 bp, Homo sapiens
cctgtctgtattggtttgctat

SEQ ID NO: 7850210 - DNA, 22 bp, Homo sapiens
cctgtctgtattggtttgctat

SEQ ID NO: 7850211 - DNA, 22 bp, Homo sapiens
cctgtctgtatcggttcagagt

SEQ ID NO: 7850212 - DNA, 22 bp, Homo sapiens
cctgtctgtattattcaccact

SEQ ID NO: 7850213 - DNA, 22 bp, Homo sapiens
cctgtctgtatcggttcagagt

SEQ ID NO: 7850214 - DNA, 18 bp, Homo sapiens
cctgtctggggtccccac

SEQ ID NO: 7850215 - DNA, 18 bp, Homo sapiens
cctgtctggggtccccac

SEQ ID NO: 7850216 - DNA, 22 bp, Homo sapiens
cctgtctggggactccctgggt

SEQ ID NO: 7850217 - DNA, 22 bp, Homo sapiens
cctgtctggggactccctgggt

SEQ ID NO: 7850218 - DNA, 22 bp, Homo sapiens
cctggtgggcaggagtgagacc

SEQ ID NO: 7850219 - DNA, 22 bp, Homo sapiens
cctggtgggcaggagtgagacc

SEQ ID NO: 7850220 - DNA, 22 bp, Homo sapiens
cctggtgggcaggagtgagacc

SEQ ID NO: 7850221 - DNA, 22 bp, Homo sapiens
cctggtgggcaggagtgagacc

SEQ ID NO: 7850222 - DNA, 22 bp, Homo sapiens
cctggtgggcaggagtgagacc

SEQ ID NO: 7850223 - DNA, 20 bp, Homo sapiens
cctggtgtatttcctggggt

SEQ ID NO: 7850224 - DNA, 22 bp, Homo sapiens
cctggtgtcatggatgtcacat

SEQ ID NO: 7850225 - DNA, 22 bp, Homo sapiens
cctggtggcttctgggtggacg

SEQ ID NO: 7850226 - DNA, 22 bp, Homo sapiens
cctggtggcttctgggtggacg

SEQ ID NO: 7850227 - DNA, 22 bp, Homo sapiens
cctggtggcttctgggtggacg

SEQ ID NO: 7850228 - DNA, 22 bp, Homo sapiens
cctggtggcttctgggtggacg

SEQ ID NO: 7850229 - DNA, 22 bp, Homo sapiens
cctggtggccttcagcccacaa

SEQ ID NO: 7850230 - DNA, 22 bp, Homo sapiens
cctggtggagaggggcggagcg

SEQ ID NO: 7850231 - DNA, 22 bp, Homo sapiens
cctggtggagaggggcggagcg

SEQ ID NO: 7850232 - DNA, 22 bp, Homo sapiens
cctggtggcttctgggtggacg

SEQ ID NO: 7850233 - DNA, 22 bp, Homo sapiens
cctggtggcgaatggtggtagg

SEQ ID NO: 7850234 - DNA, 22 bp, Homo sapiens
cctggtggcgaatggtggtagg

SEQ ID NO: 7850235 - DNA, 22 bp, Homo sapiens
cctggtggcgaatggtggtagg

SEQ ID NO: 7850236 - DNA, 22 bp, Homo sapiens
cctggtggcgaatggtggtagg

SEQ ID NO: 7850237 - DNA, 22 bp, Homo sapiens
cctggtggccttcagcccacaa

SEQ ID NO: 7850238 - DNA, 22 bp, Homo sapiens
cctggtggacagcagccagcag

SEQ ID NO: 7850239 - DNA, 22 bp, Homo sapiens
cctggtggacagcagccagcag

SEQ ID NO: 7850240 - DNA, 22 bp, Homo sapiens
cctggtggagaggggcggagcg

SEQ ID NO: 7850241 - DNA, 22 bp, Homo sapiens
cctggtggagaggggcggagcg

SEQ ID NO: 7850242 - DNA, 22 bp, Homo sapiens
cctggtggagaggggcggagcg

SEQ ID NO: 7850243 - DNA, 22 bp, Homo sapiens
cctggtggacagcagccagcag

SEQ ID NO: 7850244 - DNA, 22 bp, Homo sapiens
cctggtggaaggtgagtgaggc

SEQ ID NO: 7850245 - DNA, 22 bp, Homo sapiens
cctggtggaaggtgagtgaggc

SEQ ID NO: 7850246 - DNA, 22 bp, Homo sapiens
cctggtggaaggtgagtgaggc

SEQ ID NO: 7850247 - DNA, 22 bp, Homo sapiens
cctggtggaaggtgagtgaggc

SEQ ID NO: 7850248 - DNA, 22 bp, Homo sapiens
cctgggtgtcatgggcagctgg

SEQ ID NO: 7850249 - DNA, 22 bp, Homo sapiens
cctggtgcttaccagagctttt

SEQ ID NO: 7850250 - DNA, 22 bp, Homo sapiens
cctgggtgtcatgggcagctgg

SEQ ID NO: 7850251 - DNA, 22 bp, Homo sapiens
cctgggtgtcatgggcagctgg

SEQ ID NO: 7850252 - DNA, 22 bp, Homo sapiens
cctgggtgtcatgggcagctgg

SEQ ID NO: 7850253 - DNA, 22 bp, Homo sapiens
cctgggtgtcatgggcagctgg

SEQ ID NO: 7850254 - DNA, 22 bp, Homo sapiens
cctgggtgtcatgggcagctgg

SEQ ID NO: 7850255 - DNA, 22 bp, Homo sapiens
tgtttacttaaatgttttcata

SEQ ID NO: 7850256 - DNA, 22 bp, Homo sapiens
tgtttacttaaatgttttcata

SEQ ID NO: 7850257 - DNA, 22 bp, Homo sapiens
tgtttactggctcctgtggttc

SEQ ID NO: 7850258 - DNA, 22 bp, Homo sapiens
tgtttactggctcctgtggttc

SEQ ID NO: 7850259 - DNA, 22 bp, Homo sapiens
cctggtttgggtgccagtgagt

SEQ ID NO: 7850260 - DNA, 22 bp, Homo sapiens
tgtttactggaccagggagggg

SEQ ID NO: 7850261 - DNA, 22 bp, Homo sapiens
cctggtttctccatgtctcatt

SEQ ID NO: 7850262 - DNA, 22 bp, Homo sapiens
cctggtttcaggaacataatct

SEQ ID NO: 7850263 - DNA, 22 bp, Homo sapiens
cctggtttcaggaacataatct

SEQ ID NO: 7850264 - DNA, 22 bp, Homo sapiens
tgtttacttcatcgagtacttc

SEQ ID NO: 7850265 - DNA, 22 bp, Homo sapiens
tgtttacttcatcgagtacttc

SEQ ID NO: 7850266 - DNA, 22 bp, Homo sapiens
tgtttacttatgtgggtcacat

SEQ ID NO: 7850267 - DNA, 22 bp, Homo sapiens
tgtttacttaaatgttttcata

SEQ ID NO: 7850268 - DNA, 22 bp, Homo sapiens
tgtttacttatgtgggtcacat

SEQ ID NO: 7850269 - DNA, 22 bp, Homo sapiens
tgtttacttctttccatggctt

SEQ ID NO: 7850270 - DNA, 22 bp, Homo sapiens
tgtttacttctttccatggctt

SEQ ID NO: 7850271 - DNA, 22 bp, Homo sapiens
tgtttacttgaggtggaaacaa

SEQ ID NO: 7850272 - DNA, 22 bp, Homo sapiens
tgtttacttgaggtggaaacaa

SEQ ID NO: 7850273 - DNA, 22 bp, Homo sapiens
cctggtgtctgtttacagcagc

SEQ ID NO: 7850274 - DNA, 22 bp, Homo sapiens
cctggtgtggccctgtgacatg

SEQ ID NO: 7850275 - DNA, 22 bp, Homo sapiens
cctggtgtcatggatgtcacat

SEQ ID NO: 7850276 - DNA, 22 bp, Homo sapiens
cctggtgtggctgtcacagagg

SEQ ID NO: 7850277 - DNA, 22 bp, Homo sapiens
cctggtgtggctgtcacagagg

SEQ ID NO: 7850278 - DNA, 22 bp, Homo sapiens
cctggttcagtctttctatgct

SEQ ID NO: 7850279 - DNA, 22 bp, Homo sapiens
cctggttcagtctttctatgct

SEQ ID NO: 7850280 - DNA, 22 bp, Homo sapiens
cctggtgttgccaatctgtgcc

SEQ ID NO: 7850281 - DNA, 22 bp, Homo sapiens
cctggtgttatcataggtcatg

SEQ ID NO: 7850282 - DNA, 22 bp, Homo sapiens
cctggtgttgtgaagtagccgt

SEQ ID NO: 7850283 - DNA, 22 bp, Homo sapiens
cctggttgtgagttgagttgag

SEQ ID NO: 7850284 - DNA, 22 bp, Homo sapiens
cctggttgagggaggtgtggac

SEQ ID NO: 7850285 - DNA, 22 bp, Homo sapiens
cctggttgagggaggtgtggac

SEQ ID NO: 7850286 - DNA, 22 bp, Homo sapiens
cctggtttcaggaacataatct

SEQ ID NO: 7850287 - DNA, 22 bp, Homo sapiens
cctggtttatgccagatcctgt

SEQ ID NO: 7850288 - DNA, 22 bp, Homo sapiens
cctggtttaatgctcactgttg

SEQ ID NO: 7850289 - DNA, 22 bp, Homo sapiens
cctggtttaatgctcactgttg

SEQ ID NO: 7850290 - DNA, 22 bp, Homo sapiens
cctggtttatgccagatcctgt

SEQ ID NO: 7850291 - DNA, 22 bp, Homo sapiens
tgttcattcgctattgtctatg

SEQ ID NO: 7850292 - DNA, 22 bp, Homo sapiens
tgttcattccggggagggctaa

SEQ ID NO: 7850293 - DNA, 22 bp, Homo sapiens
tgttcattcaacatgtcatcta

SEQ ID NO: 7850294 - DNA, 22 bp, Homo sapiens
tgttcattattcttcatctgcc

SEQ ID NO: 7850295 - DNA, 22 bp, Homo sapiens
tgttcattctgtgacctggttc

SEQ ID NO: 7850296 - DNA, 22 bp, Homo sapiens
tgttcattttgaagtacttcaa

SEQ ID NO: 7850297 - DNA, 22 bp, Homo sapiens
tgttcattttgaagtacttcaa

SEQ ID NO: 7850298 - DNA, 23 bp, Homo sapiens
tgttccagatacgccttttcctc

SEQ ID NO: 7850299 - DNA, 23 bp, Homo sapiens
tgttccagatacgccttttcctc

SEQ ID NO: 7850300 - DNA, 22 bp, Homo sapiens
tgttccagatttagccaaccga

SEQ ID NO: 7850301 - DNA, 20 bp, Homo sapiens
tgttccaggaggccagggct

SEQ ID NO: 7850302 - DNA, 22 bp, Homo sapiens
tgttccagggcgcgaaggtggt

SEQ ID NO: 7850303 - DNA, 20 bp, Homo sapiens
tgttccaggaggccagggct

SEQ ID NO: 7850304 - DNA, 23 bp, Homo sapiens
tgttccagatacgccttttcctc

SEQ ID NO: 7850305 - DNA, 23 bp, Homo sapiens
tgttccagatacgccttttcctc

SEQ ID NO: 7850306 - DNA, 23 bp, Homo sapiens
tgttccagatacgccttttcctc

SEQ ID NO: 7850307 - DNA, 23 bp, Homo sapiens
tgttccagatacgccttttcctc

SEQ ID NO: 7850308 - DNA, 23 bp, Homo sapiens
tgttccagatacgccttttcctc

SEQ ID NO: 7850309 - DNA, 18 bp, Homo sapiens
tgttccaaggaaggaatc

SEQ ID NO: 7850310 - DNA, 22 bp, Homo sapiens
tgttccagaggcagagatagga

SEQ ID NO: 7850311 - DNA, 22 bp, Homo sapiens
tgttccaataaggagttgaaat

SEQ ID NO: 7850312 - DNA, 22 bp, Homo sapiens
tgttccaataaggagttgaaat

SEQ ID NO: 7850313 - DNA, 22 bp, Homo sapiens
tgttacagtactacaattctgc

SEQ ID NO: 7850314 - DNA, 22 bp, Homo sapiens
tgttacaatattatcaactgag

SEQ ID NO: 7850315 - DNA, 22 bp, Homo sapiens
tgttacaatattatcaactgag

SEQ ID NO: 7850316 - DNA, 22 bp, Homo sapiens
tgttacacagcagaatagcaag

SEQ ID NO: 7850317 - DNA, 22 bp, Homo sapiens
tgttacagaaagtttatgaatg

SEQ ID NO: 7850318 - DNA, 19 bp, Homo sapiens
tgttcagatatgtcagctt

SEQ ID NO: 7850319 - DNA, 19 bp, Homo sapiens
tgttcagatatgtcagctt

SEQ ID NO: 7850320 - DNA, 22 bp, Homo sapiens
tgttcagttaacacagacacca

SEQ ID NO: 7850321 - DNA, 21 bp, Homo sapiens
tgttacagtccaaatgtttgt

SEQ ID NO: 7850322 - DNA, 22 bp, Homo sapiens
tgttcagagacagaaattctaa

SEQ ID NO: 7850323 - DNA, 22 bp, Homo sapiens
tgttcatagctatcattgtgtc

SEQ ID NO: 7850324 - DNA, 22 bp, Homo sapiens
tgttcatagctatcattgtgtc

SEQ ID NO: 7850325 - DNA, 22 bp, Homo sapiens
tgttcatatcattttgaaagct

SEQ ID NO: 7850326 - DNA, 22 bp, Homo sapiens
tgttcatatcattttgaaagct

SEQ ID NO: 7850327 - DNA, 22 bp, Homo sapiens
tgttcatatcattttgaaagct

SEQ ID NO: 7850328 - DNA, 22 bp, Homo sapiens
tgttcatctggcaggcatagcc

SEQ ID NO: 7850329 - DNA, 22 bp, Homo sapiens
tgttcattaaactactgtgtgg

SEQ ID NO: 7850330 - DNA, 22 bp, Homo sapiens
tgttcattactgctgtttgcca

SEQ ID NO: 7850331 - DNA, 22 bp, Homo sapiens
tgttacaagtcttgaggtactt

SEQ ID NO: 7850332 - DNA, 22 bp, Homo sapiens
tgttacaagtcttgaggtactt

SEQ ID NO: 7850333 - DNA, 22 bp, Homo sapiens
tgttacaaggaagaatgtaggt

SEQ ID NO: 7850334 - DNA, 22 bp, Homo sapiens
tgttacaactatagatcccaag

SEQ ID NO: 7850335 - DNA, 22 bp, Homo sapiens
tgttacaactatagatcccaag

SEQ ID NO: 7850336 - DNA, 22 bp, Homo sapiens
tgttacaaactgttgtttctat

SEQ ID NO: 7850337 - DNA, 22 bp, Homo sapiens
tgttaatgtgctttgaaagact

SEQ ID NO: 7850338 - DNA, 22 bp, Homo sapiens
tgttaatctttgagtcttcatc

SEQ ID NO: 7850339 - DNA, 22 bp, Homo sapiens
tgttaatatactaaaatccact

SEQ ID NO: 7850340 - DNA, 22 bp, Homo sapiens
tgttaatatactaaaatccact

SEQ ID NO: 7850341 - DNA, 23 bp, Homo sapiens
tgttaatacatctgccactcatt

SEQ ID NO: 7850342 - DNA, 23 bp, Homo sapiens
tgttaatacatctgccactcatt

SEQ ID NO: 7850343 - DNA, 22 bp, Homo sapiens
tgttaagttgccagtgtatgac

SEQ ID NO: 7850344 - DNA, 22 bp, Homo sapiens
tgtgttctcctacagataagga

SEQ ID NO: 7850345 - DNA, 22 bp, Homo sapiens
tgtgttctcctacagataagga

SEQ ID NO: 7850346 - DNA, 22 bp, Homo sapiens
tgtgttctgaaggagaagagtg

SEQ ID NO: 7850347 - DNA, 18 bp, Homo sapiens
tgttaaggatccagtagt

SEQ ID NO: 7850348 - DNA, 22 bp, Homo sapiens
tgtgttctgaaggagaagagtg

SEQ ID NO: 7850349 - DNA, 22 bp, Homo sapiens
tgtgttctgaaggagaagagtg

SEQ ID NO: 7850350 - DNA, 22 bp, Homo sapiens
tgttaaggggatatagcagggc

SEQ ID NO: 7850351 - DNA, 22 bp, Homo sapiens
tgttaaggtcctgacttctgca

SEQ ID NO: 7850352 - DNA, 22 bp, Homo sapiens
tgttaaggcagattgcctggcc

SEQ ID NO: 7850353 - DNA, 22 bp, Homo sapiens
tgttaaggtcctgacttctgca

SEQ ID NO: 7850354 - DNA, 22 bp, Homo sapiens
tgttaagggtaaacagcagtaa

SEQ ID NO: 7850355 - DNA, 22 bp, Homo sapiens
cctgggctgggcgtctcatggg

SEQ ID NO: 7850356 - DNA, 22 bp, Homo sapiens
cctgggctgggcgtctcatggg

SEQ ID NO: 7850357 - DNA, 22 bp, Homo sapiens
cctgggctgggcgtctcatggg

SEQ ID NO: 7850358 - DNA, 22 bp, Homo sapiens
cctgggctgggcgtctcatggg

SEQ ID NO: 7850359 - DNA, 22 bp, Homo sapiens
cctgggctgggcgtctcatggg

SEQ ID NO: 7850360 - DNA, 22 bp, Homo sapiens
cctgggctgggcgtctcatggg

SEQ ID NO: 7850361 - DNA, 22 bp, Homo sapiens
cctgggctgtacctgtgcgcgg

SEQ ID NO: 7850362 - DNA, 22 bp, Homo sapiens
cctgggctgtacctgtgcgcgg

SEQ ID NO: 7850363 - DNA, 22 bp, Homo sapiens
cctgggctgtacctgtgcgcgg

SEQ ID NO: 7850364 - DNA, 22 bp, Homo sapiens
cctgggctgtacctgtgcgcgg

SEQ ID NO: 7850365 - DNA, 22 bp, Homo sapiens
cctgggctgtacctgtgcgcgg

SEQ ID NO: 7850366 - DNA, 21 bp, Homo sapiens
cctgggctgtggtttggagac

SEQ ID NO: 7850367 - DNA, 21 bp, Homo sapiens
cctgggctgtggtttggagac

SEQ ID NO: 7850368 - DNA, 21 bp, Homo sapiens
cctgggctgtggtttggagac

SEQ ID NO: 7850369 - DNA, 22 bp, Homo sapiens
cctgggcttccacgagcagagg

SEQ ID NO: 7850370 - DNA, 22 bp, Homo sapiens
tgtgttctcctacagataagga

SEQ ID NO: 7850371 - DNA, 22 bp, Homo sapiens
cctgggcttccacgagcagagg

SEQ ID NO: 7850372 - DNA, 22 bp, Homo sapiens
cctgggcttccacgagcagagg

SEQ ID NO: 7850373 - DNA, 22 bp, Homo sapiens
cctgggcttccacgagcagagg

SEQ ID NO: 7850374 - DNA, 22 bp, Homo sapiens
cctgggcttacgacctctgact

SEQ ID NO: 7850375 - DNA, 22 bp, Homo sapiens
cctgggcttacgacctctgact

SEQ ID NO: 7850376 - DNA, 22 bp, Homo sapiens
cctgggcttacgacctctgact

SEQ ID NO: 7850377 - DNA, 22 bp, Homo sapiens
cctgggctgttgcatcatcctt

SEQ ID NO: 7850378 - DNA, 22 bp, Homo sapiens
cctgggctgttgcatcatcctt

SEQ ID NO: 7850379 - DNA, 22 bp, Homo sapiens
cctgggctgttgcatcatcctt

SEQ ID NO: 7850380 - DNA, 22 bp, Homo sapiens
cctgggcttacgacctctgact

SEQ ID NO: 7850381 - DNA, 22 bp, Homo sapiens
cctgggcttacgacctctgact

SEQ ID NO: 7850382 - DNA, 22 bp, Homo sapiens
cctgggcttacgacctctgact

SEQ ID NO: 7850383 - DNA, 22 bp, Homo sapiens
cctgggcttacgacctctgact

SEQ ID NO: 7850384 - DNA, 22 bp, Homo sapiens
cctgggctctatcctgacccag

SEQ ID NO: 7850385 - DNA, 22 bp, Homo sapiens
cctgggctctatcctgacccag

SEQ ID NO: 7850386 - DNA, 22 bp, Homo sapiens
cctgggctctatcctgacccag

SEQ ID NO: 7850387 - DNA, 22 bp, Homo sapiens
cctgggctctatcctgacccag

SEQ ID NO: 7850388 - DNA, 22 bp, Homo sapiens
cctgggctctgaggagggagtc

SEQ ID NO: 7850389 - DNA, 22 bp, Homo sapiens
cctgggctctgaggagggagtc

SEQ ID NO: 7850390 - DNA, 22 bp, Homo sapiens
cctgggctctgaggagggagtc

SEQ ID NO: 7850391 - DNA, 22 bp, Homo sapiens
cctgggctctgaggagggagtc

SEQ ID NO: 7850392 - DNA, 22 bp, Homo sapiens
cctgggctctgaggagggagtc

SEQ ID NO: 7850393 - DNA, 22 bp, Homo sapiens
cctgggctctgaggagggagtc

SEQ ID NO: 7850394 - DNA, 22 bp, Homo sapiens
cctgggctctgaggagggagtc

SEQ ID NO: 7850395 - DNA, 22 bp, Homo sapiens
cctgggctctgaggagggagtc

SEQ ID NO: 7850396 - DNA, 22 bp, Homo sapiens
cctgggctctgaggagggagtc

SEQ ID NO: 7850397 - DNA, 22 bp, Homo sapiens
cctgggctctgaggagggagtc

SEQ ID NO: 7850398 - DNA, 22 bp, Homo sapiens
cctgggctctgtcagaattggg

SEQ ID NO: 7850399 - DNA, 22 bp, Homo sapiens
cctgggctcaagtgatcctcct

SEQ ID NO: 7850400 - DNA, 22 bp, Homo sapiens
cctgggctcaagtgatcctcct

SEQ ID NO: 7850401 - DNA, 22 bp, Homo sapiens
cctgggctcaagtgatcctcct

SEQ ID NO: 7850402 - DNA, 22 bp, Homo sapiens
cctgggctcaagtgatcctcct

SEQ ID NO: 7850403 - DNA, 22 bp, Homo sapiens
cctgggctcaagtgatcctcct

SEQ ID NO: 7850404 - DNA, 22 bp, Homo sapiens
cctgggctctatcctgacccag

SEQ ID NO: 7850405 - DNA, 22 bp, Homo sapiens
tgtgtctgcccttagtacatct

SEQ ID NO: 7850406 - DNA, 22 bp, Homo sapiens
tgtgtctgcccttagtacatct

SEQ ID NO: 7850407 - DNA, 22 bp, Homo sapiens
tgtgtctgcccttagtacatct

SEQ ID NO: 7850408 - DNA, 22 bp, Homo sapiens
tgtgtctgcccttagtacatct

SEQ ID NO: 7850409 - DNA, 22 bp, Homo sapiens
tgtgtctggaccggggaggagc

SEQ ID NO: 7850410 - DNA, 22 bp, Homo sapiens
tgtgtctggataggtaatggat

SEQ ID NO: 7850411 - DNA, 22 bp, Homo sapiens
tgtgtctggaccggggaggagc

SEQ ID NO: 7850412 - DNA, 22 bp, Homo sapiens
tgtgtctggaccggggaggagc

SEQ ID NO: 7850413 - DNA, 22 bp, Homo sapiens
tgtgtctggataggtaatggat

SEQ ID NO: 7850414 - DNA, 22 bp, Homo sapiens
tgtgtctggataggtaatggat

SEQ ID NO: 7850415 - DNA, 22 bp, Homo sapiens
tgtgtctggataggtaatggat

SEQ ID NO: 7850416 - DNA, 22 bp, Homo sapiens
cctgggctggagtacagcagtg

SEQ ID NO: 7850417 - DNA, 22 bp, Homo sapiens
cctgggctggagtacagcagtg

SEQ ID NO: 7850418 - DNA, 22 bp, Homo sapiens
cctgggctggagtacagcagtg

SEQ ID NO: 7850419 - DNA, 22 bp, Homo sapiens
cctgggctggagtacagcagtg

SEQ ID NO: 7850420 - DNA, 22 bp, Homo sapiens
cctgggctggagtacagcagtg

SEQ ID NO: 7850421 - DNA, 22 bp, Homo sapiens
cctgggctgctcatggggatga

SEQ ID NO: 7850422 - DNA, 22 bp, Homo sapiens
cctgggctgctcatggggatga

SEQ ID NO: 7850423 - DNA, 22 bp, Homo sapiens
cctgggctgctcatggggatga

SEQ ID NO: 7850424 - DNA, 22 bp, Homo sapiens
cctgggctgctcatggggatga

SEQ ID NO: 7850425 - DNA, 22 bp, Homo sapiens
cctgggctggagtacagcagtg

SEQ ID NO: 7850426 - DNA, 22 bp, Homo sapiens
cctgggctgcatgatggcattt

SEQ ID NO: 7850427 - DNA, 22 bp, Homo sapiens
cctgggctgcatgatggcattt

SEQ ID NO: 7850428 - DNA, 22 bp, Homo sapiens
cctgggctgcatgatggcattt

SEQ ID NO: 7850429 - DNA, 22 bp, Homo sapiens
cctgggctgcatgatggcattt

SEQ ID NO: 7850430 - DNA, 22 bp, Homo sapiens
cctgggctgaagtcaagtgtgg

SEQ ID NO: 7850431 - DNA, 22 bp, Homo sapiens
cctgggctgcatgatggcattt

SEQ ID NO: 7850432 - DNA, 22 bp, Homo sapiens
cctgggctctgtcagaattggg

SEQ ID NO: 7850433 - DNA, 22 bp, Homo sapiens
cctgggctctgtcagaattggg

SEQ ID NO: 7850434 - DNA, 22 bp, Homo sapiens
cctgggctctgtcagaattggg

SEQ ID NO: 7850435 - DNA, 22 bp, Homo sapiens
cctgggctctgtcagaattggg

SEQ ID NO: 7850436 - DNA, 16 bp, Homo sapiens
cctgggctctgttgga

SEQ ID NO: 7850437 - DNA, 16 bp, Homo sapiens
cctgggctctgttgga

SEQ ID NO: 7850438 - DNA, 22 bp, Homo sapiens
cctgggctgaagtcaagtgtgg

SEQ ID NO: 7850439 - DNA, 16 bp, Homo sapiens
cctgggctctgttgga

SEQ ID NO: 7850440 - DNA, 22 bp, Homo sapiens
tggggcagggatgggaaactat

SEQ ID NO: 7850441 - DNA, 22 bp, Homo sapiens
tggggcagggatgggaaactat

SEQ ID NO: 7850442 - DNA, 22 bp, Homo sapiens
tggggcagggatgggaaactat

SEQ ID NO: 7850443 - DNA, 22 bp, Homo sapiens
tggggcagggatgggaaactat

SEQ ID NO: 7850444 - DNA, 22 bp, Homo sapiens
tggggcagggatgggaaactat

SEQ ID NO: 7850445 - DNA, 22 bp, Homo sapiens
tggggcagtggcttttcaccct

SEQ ID NO: 7850446 - DNA, 22 bp, Homo sapiens
tggggcagtggcttttcaccct

SEQ ID NO: 7850447 - DNA, 22 bp, Homo sapiens
tggggcagtggcttttcaccct

SEQ ID NO: 7850448 - DNA, 22 bp, Homo sapiens
tggggcagtggcttttcaccct

SEQ ID NO: 7850449 - DNA, 22 bp, Homo sapiens
tggggcagttaataaacattct

SEQ ID NO: 7850450 - DNA, 22 bp, Homo sapiens
tggggcagttaataaacattct

SEQ ID NO: 7850451 - DNA, 22 bp, Homo sapiens
tggggcagccacatagacaaca

SEQ ID NO: 7850452 - DNA, 22 bp, Homo sapiens
tggggcagccacatagacaaca

SEQ ID NO: 7850453 - DNA, 22 bp, Homo sapiens
tggggcagccacatagacaaca

SEQ ID NO: 7850454 - DNA, 22 bp, Homo sapiens
tggggcagccacatagacaaca

SEQ ID NO: 7850455 - DNA, 22 bp, Homo sapiens
tggggcagccacatagacaaca

SEQ ID NO: 7850456 - DNA, 22 bp, Homo sapiens
tggggcagctccatctattcca

SEQ ID NO: 7850457 - DNA, 22 bp, Homo sapiens
tggggcagctccatctattcca

SEQ ID NO: 7850458 - DNA, 22 bp, Homo sapiens
tggggcagccacatagacaaca

SEQ ID NO: 7850459 - DNA, 23 bp, Homo sapiens
tggggccaagtgaggaagggtct

SEQ ID NO: 7850460 - DNA, 23 bp, Homo sapiens
tggggccaagtgaggaagggtct

SEQ ID NO: 7850461 - DNA, 23 bp, Homo sapiens
tggggccaagtgaggaagggtct

SEQ ID NO: 7850462 - DNA, 22 bp, Homo sapiens
tggggcatggatgataagctgg

SEQ ID NO: 7850463 - DNA, 22 bp, Homo sapiens
tggggccaagaaggtctcatgt

SEQ ID NO: 7850464 - DNA, 22 bp, Homo sapiens
tggggccacacatctctttcta

SEQ ID NO: 7850465 - DNA, 22 bp, Homo sapiens
tggggccacactgatctcccag

SEQ ID NO: 7850466 - DNA, 23 bp, Homo sapiens
tggggccaagtgaggaagggtct

SEQ ID NO: 7850467 - DNA, 22 bp, Homo sapiens
tggggctgtgagactacaggat

SEQ ID NO: 7850468 - DNA, 22 bp, Homo sapiens
tggggcttctcctgtaggctca

SEQ ID NO: 7850469 - DNA, 19 bp, Homo sapiens
tggggctgtgttttgaccc

SEQ ID NO: 7850470 - DNA, 19 bp, Homo sapiens
tggggctgtgttttgaccc

SEQ ID NO: 7850471 - DNA, 19 bp, Homo sapiens
tggggctgtgttttgaccc

SEQ ID NO: 7850472 - DNA, 22 bp, Homo sapiens
tggggctgtggattctcacgaa

SEQ ID NO: 7850473 - DNA, 22 bp, Homo sapiens
tggggctgtggattctcacgaa

SEQ ID NO: 7850474 - DNA, 22 bp, Homo sapiens
tggggctgtgagactacaggat

SEQ ID NO: 7850475 - DNA, 22 bp, Homo sapiens
tggggctgtgagactacaggat

SEQ ID NO: 7850476 - DNA, 22 bp, Homo sapiens
tggggctgtgagactacaggat

SEQ ID NO: 7850477 - DNA, 22 bp, Homo sapiens
tggggctgtgagactacaggat

SEQ ID NO: 7850478 - DNA, 22 bp, Homo sapiens
tggggctgtggattctcacgaa

SEQ ID NO: 7850479 - DNA, 22 bp, Homo sapiens
tggggctgtgagactacaggat

SEQ ID NO: 7850480 - DNA, 22 bp, Homo sapiens
tgggggacaccagtctctctct

SEQ ID NO: 7850481 - DNA, 22 bp, Homo sapiens
tgggggaagagcttgttaaagt

SEQ ID NO: 7850482 - DNA, 22 bp, Homo sapiens
tgggggaaattcagccagatat

SEQ ID NO: 7850483 - DNA, 22 bp, Homo sapiens
tgggggaaattcagccagatat

SEQ ID NO: 7850484 - DNA, 22 bp, Homo sapiens
tggggcttctcctgtaggctca

SEQ ID NO: 7850485 - DNA, 22 bp, Homo sapiens
tgggggaactgttgcgcgcggg

SEQ ID NO: 7850486 - DNA, 21 bp, Homo sapiens
tgggggagaattggttgcttt

SEQ ID NO: 7850487 - DNA, 21 bp, Homo sapiens
tgggggagaattggttgcttt

SEQ ID NO: 7850488 - DNA, 21 bp, Homo sapiens
tgggggagaattggttgcttt

SEQ ID NO: 7850489 - DNA, 21 bp, Homo sapiens
tgggggagaattggttgcttt

SEQ ID NO: 7850490 - DNA, 21 bp, Homo sapiens
tgggggagaattggttgcttt

SEQ ID NO: 7850491 - DNA, 22 bp, Homo sapiens
tgggggactgcactggcgtcag

SEQ ID NO: 7850492 - DNA, 22 bp, Homo sapiens
tgggggactgcactggcgtcag

SEQ ID NO: 7850493 - DNA, 21 bp, Homo sapiens
tgggggagaattggttgcttt

SEQ ID NO: 7850494 - DNA, 21 bp, Homo sapiens
tgggggagaattggttgcttt

SEQ ID NO: 7850495 - DNA, 21 bp, Homo sapiens
tgggggagaattggttgcttt

SEQ ID NO: 7850496 - DNA, 22 bp, Homo sapiens
cctgggaggctgaggctgcagt

SEQ ID NO: 7850497 - DNA, 22 bp, Homo sapiens
cctgggaggctgaggctgcagt

SEQ ID NO: 7850498 - DNA, 21 bp, Homo sapiens
tgggggagaattggttgcttt

SEQ ID NO: 7850499 - DNA, 22 bp, Homo sapiens
cctgggaggctgaggctgcagt

SEQ ID NO: 7850500 - DNA, 22 bp, Homo sapiens
cctgggaggctgaggctgcagt

SEQ ID NO: 7850501 - DNA, 19 bp, Homo sapiens
cctgggagtcagctgaagg

SEQ ID NO: 7850502 - DNA, 19 bp, Homo sapiens
cctgggagtcagctgaagg

SEQ ID NO: 7850503 - DNA, 19 bp, Homo sapiens
cctgggagtcagctgaagg

SEQ ID NO: 7850504 - DNA, 19 bp, Homo sapiens
cctgggagtcagctgaagg

SEQ ID NO: 7850505 - DNA, 22 bp, Homo sapiens
cctgggaggctgaggctgcagt

SEQ ID NO: 7850506 - DNA, 22 bp, Homo sapiens
cctgggaggctgaggctgcagt

SEQ ID NO: 7850507 - DNA, 22 bp, Homo sapiens
cctgggaggtggatgttgcggt

SEQ ID NO: 7850508 - DNA, 22 bp, Homo sapiens
cctgggagtgtgccatctctgt

SEQ ID NO: 7850509 - DNA, 22 bp, Homo sapiens
cctgggagtgtgccatctctgt

SEQ ID NO: 7850510 - DNA, 22 bp, Homo sapiens
cctgggagtgtcagacttgctt

SEQ ID NO: 7850511 - DNA, 22 bp, Homo sapiens
cctgggagtgtgccatctctgt

SEQ ID NO: 7850512 - DNA, 22 bp, Homo sapiens
cctgggagtgtcagacttgctt

SEQ ID NO: 7850513 - DNA, 22 bp, Homo sapiens
cctgggagtgtcagacttgctt

SEQ ID NO: 7850514 - DNA, 22 bp, Homo sapiens
cctgggatgaaagcagcccact

SEQ ID NO: 7850515 - DNA, 22 bp, Homo sapiens
cctgggatgaaagcagcccact

SEQ ID NO: 7850516 - DNA, 22 bp, Homo sapiens
cctgggagtgtgccatctctgt

SEQ ID NO: 7850517 - DNA, 22 bp, Homo sapiens
cctgggagtgtgccatctctgt

SEQ ID NO: 7850518 - DNA, 22 bp, Homo sapiens
cctgggagtgcacaggtttcgt

SEQ ID NO: 7850519 - DNA, 19 bp, Homo sapiens
cctgggagtcagctgaagg

SEQ ID NO: 7850520 - DNA, 22 bp, Homo sapiens
cctgggagtggcactcacagca

SEQ ID NO: 7850521 - DNA, 22 bp, Homo sapiens
cctgggagtgcacaggtttcgt

SEQ ID NO: 7850522 - DNA, 19 bp, Homo sapiens
cctgggagtcagctgaagg

SEQ ID NO: 7850523 - DNA, 22 bp, Homo sapiens
cctgggagtggcactcacagca

SEQ ID NO: 7850524 - DNA, 22 bp, Homo sapiens
cctgggagtggcactcacagca

SEQ ID NO: 7850525 - DNA, 22 bp, Homo sapiens
tgtgtatacaacttataggagc

SEQ ID NO: 7850526 - DNA, 22 bp, Homo sapiens
tgtgtatacgagtatgaatatg

SEQ ID NO: 7850527 - DNA, 22 bp, Homo sapiens
cctgggcaatatagtgaggccc

SEQ ID NO: 7850528 - DNA, 22 bp, Homo sapiens
tgtgtagtgattttcttccaac

SEQ ID NO: 7850529 - DNA, 22 bp, Homo sapiens
tgtgggtcctcctgtgtgcccg

SEQ ID NO: 7850530 - DNA, 22 bp, Homo sapiens
tgtgggtgatgaatttgttctt

SEQ ID NO: 7850531 - DNA, 22 bp, Homo sapiens
tgtgggtcttccaaagaagggc

SEQ ID NO: 7850532 - DNA, 22 bp, Homo sapiens
cctgggcaatatagtgaggccc

SEQ ID NO: 7850533 - DNA, 22 bp, Homo sapiens
cctgggcaacatagtgagacct

SEQ ID NO: 7850534 - DNA, 22 bp, Homo sapiens
cctgggcaatatagtgaggccc

SEQ ID NO: 7850535 - DNA, 22 bp, Homo sapiens
cctgggcaatatagtgaggccc

SEQ ID NO: 7850536 - DNA, 22 bp, Homo sapiens
cctgggcaacatagtgagacct

SEQ ID NO: 7850537 - DNA, 22 bp, Homo sapiens
cctgggcaacatagtgagacct

SEQ ID NO: 7850538 - DNA, 22 bp, Homo sapiens
cctgggcaacatagtgagacct

SEQ ID NO: 7850539 - DNA, 22 bp, Homo sapiens
cctgggcaacatagtgagaccc

SEQ ID NO: 7850540 - DNA, 22 bp, Homo sapiens
cctgggcaacatagtgagacct

SEQ ID NO: 7850541 - DNA, 22 bp, Homo sapiens
cctgggcaacatagtgagacct

SEQ ID NO: 7850542 - DNA, 22 bp, Homo sapiens
cctgggcaacatagggagaccc

SEQ ID NO: 7850543 - DNA, 22 bp, Homo sapiens
cctgggcaacatagggagaccc

SEQ ID NO: 7850544 - DNA, 22 bp, Homo sapiens
cctgggcaacatagggagaccc

SEQ ID NO: 7850545 - DNA, 22 bp, Homo sapiens
cctgggcaacatagtgagaccc

SEQ ID NO: 7850546 - DNA, 22 bp, Homo sapiens
cctgggcaacatagtgagaccc

SEQ ID NO: 7850547 - DNA, 22 bp, Homo sapiens
cctgggcaacatagtgagaccc

SEQ ID NO: 7850548 - DNA, 22 bp, Homo sapiens
cctgggcaacatagtgagaccc

SEQ ID NO: 7850549 - DNA, 22 bp, Homo sapiens
cctgggcaacatagtgagaccc

SEQ ID NO: 7850550 - DNA, 22 bp, Homo sapiens
cctgggcaaatgccagagacaa

SEQ ID NO: 7850551 - DNA, 22 bp, Homo sapiens
cctgggcaaatgccagagacaa

SEQ ID NO: 7850552 - DNA, 22 bp, Homo sapiens
cctgggcaaatgccagagacaa

SEQ ID NO: 7850553 - DNA, 22 bp, Homo sapiens
cctgggatttgcgccagacctt

SEQ ID NO: 7850554 - DNA, 22 bp, Homo sapiens
cctgggcaaatgccagagacaa

SEQ ID NO: 7850555 - DNA, 22 bp, Homo sapiens
cctgggcaaatgccagagacaa

SEQ ID NO: 7850556 - DNA, 22 bp, Homo sapiens
cctgggatttgcgccagacctt

SEQ ID NO: 7850557 - DNA, 22 bp, Homo sapiens
cctgggatttgcgccagacctt

SEQ ID NO: 7850558 - DNA, 22 bp, Homo sapiens
cctgggatttcctgagcactct

SEQ ID NO: 7850559 - DNA, 22 bp, Homo sapiens
cctgggatttcctgagcactct

SEQ ID NO: 7850560 - DNA, 22 bp, Homo sapiens
cctgggatttcctgagcactct

SEQ ID NO: 7850561 - DNA, 22 bp, Homo sapiens
cctgggcaacatagggagaccc

SEQ ID NO: 7850562 - DNA, 22 bp, Homo sapiens
cctgggcaacatagggagaccc

SEQ ID NO: 7850563 - DNA, 22 bp, Homo sapiens
cctgggcaacatagggagaccc

SEQ ID NO: 7850564 - DNA, 22 bp, Homo sapiens
cctgggcaacatagggagaccc

SEQ ID NO: 7850565 - DNA, 22 bp, Homo sapiens
cctgggcaaattatgttactca

SEQ ID NO: 7850566 - DNA, 22 bp, Homo sapiens
cctgggcaaatgccagagacaa

SEQ ID NO: 7850567 - DNA, 22 bp, Homo sapiens
tgtgtatatatgtttaagtcat

SEQ ID NO: 7850568 - DNA, 22 bp, Homo sapiens
tgtgtatatgtaaatatagttg

SEQ ID NO: 7850569 - DNA, 22 bp, Homo sapiens
tgtgtatatgtaaatatagttg

SEQ ID NO: 7850570 - DNA, 22 bp, Homo sapiens
tgtgtatgcatacacacataga

SEQ ID NO: 7850571 - DNA, 22 bp, Homo sapiens
tgtgtatgcatacacacataga

SEQ ID NO: 7850572 - DNA, 23 bp, Homo sapiens
tgtgtatgtatctatgcataggt

SEQ ID NO: 7850573 - DNA, 22 bp, Homo sapiens
tgtgtatgtaagcatgtgcata

SEQ ID NO: 7850574 - DNA, 22 bp, Homo sapiens
tgtgtatgtaagcatgtgcata

SEQ ID NO: 7850575 - DNA, 23 bp, Homo sapiens
tgtgtatgtatctatgcataggt

SEQ ID NO: 7850576 - DNA, 22 bp, Homo sapiens
tgtgtatgtctgtatgcacaca

SEQ ID NO: 7850577 - DNA, 20 bp, Homo sapiens
tgtgtatgtgcacatgcgaa

SEQ ID NO: 7850578 - DNA, 20 bp, Homo sapiens
tgtgtatgtgcacatgcgaa

SEQ ID NO: 7850579 - DNA, 22 bp, Homo sapiens
tgtgtatgtgtatacactatat

SEQ ID NO: 7850580 - DNA, 22 bp, Homo sapiens
tgtgtatgtgtatacactatat

SEQ ID NO: 7850581 - DNA, 22 bp, Homo sapiens
tgtgtattaatgtttgtatatg

SEQ ID NO: 7850582 - DNA, 22 bp, Homo sapiens
tgtgtattaatgtttgtatatg

SEQ ID NO: 7850583 - DNA, 22 bp, Homo sapiens
tgtgtattaatgtttgtatatg

SEQ ID NO: 7850584 - DNA, 22 bp, Homo sapiens
tgtgtattaatgtttgtatatg

SEQ ID NO: 7850585 - DNA, 22 bp, Homo sapiens
tgtgtattaatgtttgtatatg

SEQ ID NO: 7850586 - DNA, 22 bp, Homo sapiens
tgtgtattaatgtttgtatatg

SEQ ID NO: 7850587 - DNA, 22 bp, Homo sapiens
tgtgtattaccattttacagct

SEQ ID NO: 7850588 - DNA, 22 bp, Homo sapiens
tgtgtctcaagtcagagcatca

SEQ ID NO: 7850589 - DNA, 22 bp, Homo sapiens
tgtgtctgcactgagtcctcac

SEQ ID NO: 7850590 - DNA, 22 bp, Homo sapiens
tgtgtctgcactgagtcctcac

SEQ ID NO: 7850591 - DNA, 23 bp, Homo sapiens
tgtgtctgaggatatatgtgcat

SEQ ID NO: 7850592 - DNA, 22 bp, Homo sapiens
tgtgtctgcactgagtcctcac

SEQ ID NO: 7850593 - DNA, 22 bp, Homo sapiens
tgtgtctgcactgagtcctcac

SEQ ID NO: 7850594 - DNA, 22 bp, Homo sapiens
tgtgtctgcactgagtcctcac

SEQ ID NO: 7850595 - DNA, 22 bp, Homo sapiens
tgtgtctgcccttagtacatct

SEQ ID NO: 7850596 - DNA, 22 bp, Homo sapiens
tgtgtctgaactagttgctctc

SEQ ID NO: 7850597 - DNA, 22 bp, Homo sapiens
tgtgtctgaactagttgctctc

SEQ ID NO: 7850598 - DNA, 22 bp, Homo sapiens
tgtgtctgaactagttgctctc

SEQ ID NO: 7850599 - DNA, 23 bp, Homo sapiens
tgtgtctgaggatatatgtgcat

SEQ ID NO: 7850600 - DNA, 23 bp, Homo sapiens
tgtgtctgaggatatatgtgcat

SEQ ID NO: 7850601 - DNA, 23 bp, Homo sapiens
tgtgtctgaggatatatgtgcat

SEQ ID NO: 7850602 - DNA, 23 bp, Homo sapiens
tgtgtctgaggatatatgtgcat

SEQ ID NO: 7850603 - DNA, 22 bp, Homo sapiens
tgtgtctcctttccctgtctaa

SEQ ID NO: 7850604 - DNA, 22 bp, Homo sapiens
tgtgtctcctttccctgtctaa

SEQ ID NO: 7850605 - DNA, 22 bp, Homo sapiens
tgtgtctccatagccagctagc

SEQ ID NO: 7850606 - DNA, 22 bp, Homo sapiens
tgtgtctcatttcctcctgctg

SEQ ID NO: 7850607 - DNA, 22 bp, Homo sapiens
tgtgtctccatagccagctagc

SEQ ID NO: 7850608 - DNA, 19 bp, Homo sapiens
tgtgtctctgtgtagcctg

SEQ ID NO: 7850609 - DNA, 19 bp, Homo sapiens
tgtgtctctgtgtagcctg

SEQ ID NO: 7850610 - DNA, 22 bp, Homo sapiens
tgtgtctcctttccctgtctaa

SEQ ID NO: 7850611 - DNA, 22 bp, Homo sapiens
tgtgtctctcctggaagcacgt

SEQ ID NO: 7850612 - DNA, 22 bp, Homo sapiens
tgtgtctctttgtcctagagct

SEQ ID NO: 7850613 - DNA, 22 bp, Homo sapiens
tgtgtctctttgtcctagagct

SEQ ID NO: 7850614 - DNA, 22 bp, Homo sapiens
tgtgtctgaacatgctttgtaa

SEQ ID NO: 7850615 - DNA, 22 bp, Homo sapiens
tgtgtctctttgtcctagagct

SEQ ID NO: 7850616 - DNA, 22 bp, Homo sapiens
tgtgtctctttgtcctagagct

SEQ ID NO: 7850617 - DNA, 22 bp, Homo sapiens
tgtgtctgaactagttgctctc

SEQ ID NO: 7850618 - DNA, 22 bp, Homo sapiens
tgtgtctgaacatgctttgtaa

SEQ ID NO: 7850619 - DNA, 22 bp, Homo sapiens
tgtgtctgaacatgctttgtaa

SEQ ID NO: 7850620 - DNA, 22 bp, Homo sapiens
ctctctgatgtcaggtcgctga

SEQ ID NO: 7850621 - DNA, 22 bp, Homo sapiens
ctctctgagtggctgtactttc

SEQ ID NO: 7850622 - DNA, 22 bp, Homo sapiens
ctctctgatgtcaggtcgctga

SEQ ID NO: 7850623 - DNA, 22 bp, Homo sapiens
ctctctgagtgagggacaagct

SEQ ID NO: 7850624 - DNA, 22 bp, Homo sapiens
ctctctggaagggggagctgat

SEQ ID NO: 7850625 - DNA, 22 bp, Homo sapiens
ctctctggaagggggagctgat

SEQ ID NO: 7850626 - DNA, 22 bp, Homo sapiens
ctctctggaagggggagctgat

SEQ ID NO: 7850627 - DNA, 18 bp, Homo sapiens
tttccttgtatgaacata

SEQ ID NO: 7850628 - DNA, 22 bp, Homo sapiens
tttccttgggtctcttagtggc

SEQ ID NO: 7850629 - DNA, 22 bp, Homo sapiens
tttccttgggtctcttagtggc

SEQ ID NO: 7850630 - DNA, 22 bp, Homo sapiens
tttccttgcctcctgtccttct

SEQ ID NO: 7850631 - DNA, 22 bp, Homo sapiens
tttccttgggtctcttagtggc

SEQ ID NO: 7850632 - DNA, 22 bp, Homo sapiens
tttccttgcctcctgtccttct

SEQ ID NO: 7850633 - DNA, 22 bp, Homo sapiens
tttccttgcctcctgtccttct

SEQ ID NO: 7850634 - DNA, 22 bp, Homo sapiens
ctctctggaagggggagctgat

SEQ ID NO: 7850635 - DNA, 22 bp, Homo sapiens
ctctctggaagggggagctgat

SEQ ID NO: 7850636 - DNA, 22 bp, Homo sapiens
ctctctggaagggggagctgat

SEQ ID NO: 7850637 - DNA, 22 bp, Homo sapiens
tttccttgcctcctgtccttct

SEQ ID NO: 7850638 - DNA, 20 bp, Homo sapiens
ctctctctccattcccaggg

SEQ ID NO: 7850639 - DNA, 20 bp, Homo sapiens
ctctctctccattcccaggg

SEQ ID NO: 7850640 - DNA, 20 bp, Homo sapiens
ctctctctccattcccaggg

SEQ ID NO: 7850641 - DNA, 20 bp, Homo sapiens
ctctctctccattcccaggg

SEQ ID NO: 7850642 - DNA, 20 bp, Homo sapiens
ctctctctccattcccaggg

SEQ ID NO: 7850643 - DNA, 20 bp, Homo sapiens
ctctctctccattcccaggg

SEQ ID NO: 7850644 - DNA, 20 bp, Homo sapiens
ctctctctccattcccaggg

SEQ ID NO: 7850645 - DNA, 22 bp, Homo sapiens
ctctctctatgcgttgttccta

SEQ ID NO: 7850646 - DNA, 22 bp, Homo sapiens
ctctctctatgcgttgttccta

SEQ ID NO: 7850647 - DNA, 22 bp, Homo sapiens
ctctctctatgcgttgttccta

SEQ ID NO: 7850648 - DNA, 23 bp, Homo sapiens
ctctctctaccatgtgaggacac

SEQ ID NO: 7850649 - DNA, 23 bp, Homo sapiens
ctctctctaccatgtgaggacac

SEQ ID NO: 7850650 - DNA, 22 bp, Homo sapiens
ctctctctatgcgttgttccta

SEQ ID NO: 7850651 - DNA, 17 bp, Homo sapiens
ctctccttcctctgagg

SEQ ID NO: 7850652 - DNA, 22 bp, Homo sapiens
ctctctcttgtgttgctgcaga

SEQ ID NO: 7850653 - DNA, 22 bp, Homo sapiens
ctctctcttgtgttgctgcaga

SEQ ID NO: 7850654 - DNA, 22 bp, Homo sapiens
ctctctcttgtgttgctgcaga

SEQ ID NO: 7850655 - DNA, 22 bp, Homo sapiens
ctctctctttagaagcgtctgg

SEQ ID NO: 7850656 - DNA, 22 bp, Homo sapiens
ctctctcttgtgttgctgcaga

SEQ ID NO: 7850657 - DNA, 22 bp, Homo sapiens
ctctctcttgtgttgctgcaga

SEQ ID NO: 7850658 - DNA, 22 bp, Homo sapiens
ctctctctttagaagcgtctgg

SEQ ID NO: 7850659 - DNA, 22 bp, Homo sapiens
ctctctgaaactggagagtctc

SEQ ID NO: 7850660 - DNA, 22 bp, Homo sapiens
ctctctctttagaagcgtctgg

SEQ ID NO: 7850661 - DNA, 22 bp, Homo sapiens
ctctctgaggaaggagcatctg

SEQ ID NO: 7850662 - DNA, 16 bp, Homo sapiens
ctctctgaatgcaatt

SEQ ID NO: 7850663 - DNA, 22 bp, Homo sapiens
ctctctctttagaagcgtctgg

SEQ ID NO: 7850664 - DNA, 22 bp, Homo sapiens
tttcctcactcatgtcatcagt

SEQ ID NO: 7850665 - DNA, 22 bp, Homo sapiens
ctctccaggagctcagagtcta

SEQ ID NO: 7850666 - DNA, 22 bp, Homo sapiens
ctctccaggagctcagagtcta

SEQ ID NO: 7850667 - DNA, 22 bp, Homo sapiens
tttcctcacacagaagatcttg

SEQ ID NO: 7850668 - DNA, 22 bp, Homo sapiens
tttcctatgatattctatgtgt

SEQ ID NO: 7850669 - DNA, 22 bp, Homo sapiens
tttcctcaactgtcaaatgggg

SEQ ID NO: 7850670 - DNA, 22 bp, Homo sapiens
tttcctcaactgtcaaatgggg

SEQ ID NO: 7850671 - DNA, 22 bp, Homo sapiens
tttcctatgatattctatgtgt

SEQ ID NO: 7850672 - DNA, 22 bp, Homo sapiens
ctctccaggcgaggtcctactg

SEQ ID NO: 7850673 - DNA, 22 bp, Homo sapiens
ctctccaggagctcagagtcta

SEQ ID NO: 7850674 - DNA, 22 bp, Homo sapiens
ctctccaggcgaggtcctactg

SEQ ID NO: 7850675 - DNA, 22 bp, Homo sapiens
ctctccaggcgaggtcctactg

SEQ ID NO: 7850676 - DNA, 22 bp, Homo sapiens
ctctccaggcgaggtcctactg

SEQ ID NO: 7850677 - DNA, 22 bp, Homo sapiens
ctctccaggagctcagagtcta

SEQ ID NO: 7850678 - DNA, 22 bp, Homo sapiens
ctctccaggagctcagagtcta

SEQ ID NO: 7850679 - DNA, 22 bp, Homo sapiens
ctctccaggagctcagagtcta

SEQ ID NO: 7850680 - DNA, 22 bp, Homo sapiens
ctctccaggctgggacaggacc

SEQ ID NO: 7850681 - DNA, 22 bp, Homo sapiens
ctctccaggctgggacaggacc

SEQ ID NO: 7850682 - DNA, 22 bp, Homo sapiens
ctctccaggcgaggtcctactg

SEQ ID NO: 7850683 - DNA, 22 bp, Homo sapiens
ctctccaggctgggacaggacc

SEQ ID NO: 7850684 - DNA, 22 bp, Homo sapiens
ctctccaggctgggacaggacc

SEQ ID NO: 7850685 - DNA, 22 bp, Homo sapiens
ctctccaggggtagatgccttc

SEQ ID NO: 7850686 - DNA, 21 bp, Homo sapiens
ctctccaggtaggataaatgt

SEQ ID NO: 7850687 - DNA, 21 bp, Homo sapiens
ctctccaggtaggataaatgt

SEQ ID NO: 7850688 - DNA, 22 bp, Homo sapiens
ctctccaggggtagatgccttc

SEQ ID NO: 7850689 - DNA, 22 bp, Homo sapiens
ctctccaggggtagatgccttc

SEQ ID NO: 7850690 - DNA, 22 bp, Homo sapiens
ctctccaggggtagatgccttc

SEQ ID NO: 7850691 - DNA, 22 bp, Homo sapiens
ctctccaggggaacattgttcc

SEQ ID NO: 7850692 - DNA, 22 bp, Homo sapiens
ctctccaggggaacattgttcc

SEQ ID NO: 7850693 - DNA, 22 bp, Homo sapiens
ctctccagggcatgagttccac

SEQ ID NO: 7850694 - DNA, 22 bp, Homo sapiens
ctctccaggggtagatgccttc

SEQ ID NO: 7850695 - DNA, 22 bp, Homo sapiens
ctctccagggaagcagtgtact

SEQ ID NO: 7850696 - DNA, 22 bp, Homo sapiens
ctctccagggcatgagttccac

SEQ ID NO: 7850697 - DNA, 22 bp, Homo sapiens
ctctccagggcatgagttccac

SEQ ID NO: 7850698 - DNA, 22 bp, Homo sapiens
ctctccagggaagcagtgtact

SEQ ID NO: 7850699 - DNA, 22 bp, Homo sapiens
ctctccagggaagcagtgtact

SEQ ID NO: 7850700 - DNA, 22 bp, Homo sapiens
ctctccagggcatgagttccac

SEQ ID NO: 7850701 - DNA, 22 bp, Homo sapiens
ctctccagtcatattctcagtc

SEQ ID NO: 7850702 - DNA, 22 bp, Homo sapiens
ctctccagtcatattctcagtc

SEQ ID NO: 7850703 - DNA, 22 bp, Homo sapiens
ctctccagtcaggaactctgac

SEQ ID NO: 7850704 - DNA, 22 bp, Homo sapiens
ctctccagtcaggaactctgac

SEQ ID NO: 7850705 - DNA, 22 bp, Homo sapiens
ctctccagtcaggaactctgac

SEQ ID NO: 7850706 - DNA, 22 bp, Homo sapiens
ctctccagtcaggaactctgac

SEQ ID NO: 7850707 - DNA, 22 bp, Homo sapiens
ctctccaggttagagcacttat

SEQ ID NO: 7850708 - DNA, 22 bp, Homo sapiens
ctctccaggttagagcacttat

SEQ ID NO: 7850709 - DNA, 22 bp, Homo sapiens
ctctccaggttagagcacttat

SEQ ID NO: 7850710 - DNA, 22 bp, Homo sapiens
ctctccagtcatattctcagtc

SEQ ID NO: 7850711 - DNA, 22 bp, Homo sapiens
ctctccagtcatattctcagtc

SEQ ID NO: 7850712 - DNA, 22 bp, Homo sapiens
tttcacataaatggagtaaaga

SEQ ID NO: 7850713 - DNA, 22 bp, Homo sapiens
tttcacataaatggagtaaaga

SEQ ID NO: 7850714 - DNA, 22 bp, Homo sapiens
tttcacataaatggagtaaaga

SEQ ID NO: 7850715 - DNA, 22 bp, Homo sapiens
tttcacataaatggagtaaaga

SEQ ID NO: 7850716 - DNA, 22 bp, Homo sapiens
tttcacatacagtgtatagtag

SEQ ID NO: 7850717 - DNA, 22 bp, Homo sapiens
tttcacataaatattatgccta

SEQ ID NO: 7850718 - DNA, 22 bp, Homo sapiens
tttcacataaatattatgccta

SEQ ID NO: 7850719 - DNA, 22 bp, Homo sapiens
tttcacataaatggagtaaaga

SEQ ID NO: 7850720 - DNA, 22 bp, Homo sapiens
tttcacatagaaagtgatttac

SEQ ID NO: 7850721 - DNA, 22 bp, Homo sapiens
tttcacatagaaagtgatttac

SEQ ID NO: 7850722 - DNA, 22 bp, Homo sapiens
tttcacatagaaagtgatttac

SEQ ID NO: 7850723 - DNA, 22 bp, Homo sapiens
tttcacatagaaagtgatttac

SEQ ID NO: 7850724 - DNA, 22 bp, Homo sapiens
tttcacatagaaagtgatttac

SEQ ID NO: 7850725 - DNA, 22 bp, Homo sapiens
tttcacatacagtgtatagtag

SEQ ID NO: 7850726 - DNA, 22 bp, Homo sapiens
tttcacatacagtgtatagtag

SEQ ID NO: 7850727 - DNA, 22 bp, Homo sapiens
tttcacatacagtgtatagtag

SEQ ID NO: 7850728 - DNA, 22 bp, Homo sapiens
tttcacagtagaaatcattatg

SEQ ID NO: 7850729 - DNA, 22 bp, Homo sapiens
tttcacagtagaaatcattatg

SEQ ID NO: 7850730 - DNA, 20 bp, Homo sapiens
tttcacagtccctgtttcct

SEQ ID NO: 7850731 - DNA, 22 bp, Homo sapiens
tttcacagttagcatgaggact

SEQ ID NO: 7850732 - DNA, 22 bp, Homo sapiens
tttcctagagtctctagaagaa

SEQ ID NO: 7850733 - DNA, 22 bp, Homo sapiens
tttcctagagtctctagaagaa

SEQ ID NO: 7850734 - DNA, 22 bp, Homo sapiens
tttcctaggagattgatcacat

SEQ ID NO: 7850735 - DNA, 22 bp, Homo sapiens
tttcctactgccctatacacac

SEQ ID NO: 7850736 - DNA, 22 bp, Homo sapiens
tttcctaatcccaatgacattt

SEQ ID NO: 7850737 - DNA, 22 bp, Homo sapiens
tttcctaagggatgcggctcaa

SEQ ID NO: 7850738 - DNA, 22 bp, Homo sapiens
tttcctaaggtagtgataattt

SEQ ID NO: 7850739 - DNA, 22 bp, Homo sapiens
tttcctaatcccaatgacattt

SEQ ID NO: 7850740 - DNA, 20 bp, Homo sapiens
tttcctaagtggtttgctga

SEQ ID NO: 7850741 - DNA, 22 bp, Homo sapiens
tttcctaacacaatgcatgaga

SEQ ID NO: 7850742 - DNA, 22 bp, Homo sapiens
tttccagagcatgtctgctcag

SEQ ID NO: 7850743 - DNA, 22 bp, Homo sapiens
tttccagagcatgtctgctcag

SEQ ID NO: 7850744 - DNA, 22 bp, Homo sapiens
tttccagaaataccatttggtg

SEQ ID NO: 7850745 - DNA, 20 bp, Homo sapiens
tttccactgtaatgtatgat

SEQ ID NO: 7850746 - DNA, 20 bp, Homo sapiens
tttccactgtaatgtatgat

SEQ ID NO: 7850747 - DNA, 22 bp, Homo sapiens
tttcctaagatagatacttcag

SEQ ID NO: 7850748 - DNA, 22 bp, Homo sapiens
tttcctaacacaatgcatgaga

SEQ ID NO: 7850749 - DNA, 22 bp, Homo sapiens
tttcctaagatagatacttcag

SEQ ID NO: 7850750 - DNA, 22 bp, Homo sapiens
tttcctaaggctcattttaaaa

SEQ ID NO: 7850751 - DNA, 22 bp, Homo sapiens
tttcctaactcatcggatgtac

SEQ ID NO: 7850752 - DNA, 22 bp, Homo sapiens
tttcacaaagcatagcacttta

SEQ ID NO: 7850753 - DNA, 22 bp, Homo sapiens
tttcacaaagcatagcacttta

SEQ ID NO: 7850754 - DNA, 22 bp, Homo sapiens
tttcacaaactgaggagacaat

SEQ ID NO: 7850755 - DNA, 21 bp, Homo sapiens
tttcacaaaagtatgtgacaa

SEQ ID NO: 7850756 - DNA, 22 bp, Homo sapiens
tttcacaggtacaaacactcct

SEQ ID NO: 7850757 - DNA, 22 bp, Homo sapiens
tttcacaggtacaaacactcct

SEQ ID NO: 7850758 - DNA, 22 bp, Homo sapiens
tttcacaggtacaaacactcct

SEQ ID NO: 7850759 - DNA, 22 bp, Homo sapiens
ctcctggccctgagctcccagg

SEQ ID NO: 7850760 - DNA, 22 bp, Homo sapiens
ctcctggccctgagctcccagg

SEQ ID NO: 7850761 - DNA, 22 bp, Homo sapiens
tttcaaatggagtcgtgaaatg

SEQ ID NO: 7850762 - DNA, 22 bp, Homo sapiens
tttcaaatggagtcgtgaaatg

SEQ ID NO: 7850763 - DNA, 23 bp, Homo sapiens
tttcaaattactctgcagatgac

SEQ ID NO: 7850764 - DNA, 21 bp, Homo sapiens
tttcaatgtgttctttgtagt

SEQ ID NO: 7850765 - DNA, 22 bp, Homo sapiens
tttcaatgtatgtctttctgag

SEQ ID NO: 7850766 - DNA, 21 bp, Homo sapiens
tttcaatttgccttgagtcat

SEQ ID NO: 7850767 - DNA, 22 bp, Homo sapiens
tttcaatttccaggctagaatt

SEQ ID NO: 7850768 - DNA, 22 bp, Homo sapiens
tttcaatttccaggctagaatt

SEQ ID NO: 7850769 - DNA, 22 bp, Homo sapiens
tttcaattgactttggaagaaa

SEQ ID NO: 7850770 - DNA, 22 bp, Homo sapiens
tttcaattccaccaaagcgccc

SEQ ID NO: 7850771 - DNA, 22 bp, Homo sapiens
tttcaattaggatgtttccatg

SEQ ID NO: 7850772 - DNA, 17 bp, Homo sapiens
ctcctggcagcctcagg

SEQ ID NO: 7850773 - DNA, 17 bp, Homo sapiens
ctcctggcagcctcagg

SEQ ID NO: 7850774 - DNA, 22 bp, Homo sapiens
ctcctggcaggctgagtgaaat

SEQ ID NO: 7850775 - DNA, 22 bp, Homo sapiens
ctcctggcaggctgagtgaaat

SEQ ID NO: 7850776 - DNA, 17 bp, Homo sapiens
ctcctggcagcctcagg

SEQ ID NO: 7850777 - DNA, 22 bp, Homo sapiens
ctcctggcagcaacatttatat

SEQ ID NO: 7850778 - DNA, 17 bp, Homo sapiens
ctcctggcagcctcagg

SEQ ID NO: 7850779 - DNA, 17 bp, Homo sapiens
ctcctggcagcctcagg

SEQ ID NO: 7850780 - DNA, 17 bp, Homo sapiens
ctcctggcagcctcagg

SEQ ID NO: 7850781 - DNA, 22 bp, Homo sapiens
ctcctggcactgtcttgaccca

SEQ ID NO: 7850782 - DNA, 22 bp, Homo sapiens
ctcctggcactgtcttgaccca

SEQ ID NO: 7850783 - DNA, 22 bp, Homo sapiens
ctcctggccctgagctcccagg

SEQ ID NO: 7850784 - DNA, 22 bp, Homo sapiens
ctcctggccccagatcccaatc

SEQ ID NO: 7850785 - DNA, 22 bp, Homo sapiens
ctcctggccccagatcccaatc

SEQ ID NO: 7850786 - DNA, 22 bp, Homo sapiens
ctcctggccacgttcttgctgg

SEQ ID NO: 7850787 - DNA, 22 bp, Homo sapiens
ctcctggccacgttcttgctgg

SEQ ID NO: 7850788 - DNA, 22 bp, Homo sapiens
ctcctggccacgttcttgctgg

SEQ ID NO: 7850789 - DNA, 17 bp, Homo sapiens
ctcctggccacccctct

SEQ ID NO: 7850790 - DNA, 22 bp, Homo sapiens
ctcctggccacgttcttgctgg

SEQ ID NO: 7850791 - DNA, 17 bp, Homo sapiens
ctcctggccacccctct

SEQ ID NO: 7850792 - DNA, 22 bp, Homo sapiens
ctcctggcagttccccttgtca

SEQ ID NO: 7850793 - DNA, 22 bp, Homo sapiens
ctcctggcagttccccttgtca

SEQ ID NO: 7850794 - DNA, 22 bp, Homo sapiens
ctcctggcagttccccttgtca

SEQ ID NO: 7850795 - DNA, 22 bp, Homo sapiens
ctcctggatgcaggctgtctgc

SEQ ID NO: 7850796 - DNA, 22 bp, Homo sapiens
ctcctggatgcaggctgtctgc

SEQ ID NO: 7850797 - DNA, 22 bp, Homo sapiens
ctcctggcactcagtgtggaag

SEQ ID NO: 7850798 - DNA, 22 bp, Homo sapiens
ctcctggcactcagtgtggaag

SEQ ID NO: 7850799 - DNA, 22 bp, Homo sapiens
ctcctggcactcagtgtggaag

SEQ ID NO: 7850800 - DNA, 16 bp, Homo sapiens
tttatttactagtgtt

SEQ ID NO: 7850801 - DNA, 22 bp, Homo sapiens
tttatttaccttatgtcctcca

SEQ ID NO: 7850802 - DNA, 16 bp, Homo sapiens
tttatttactagtgtt

SEQ ID NO: 7850803 - DNA, 22 bp, Homo sapiens
tttatttaccttatgtcctcca

SEQ ID NO: 7850804 - DNA, 22 bp, Homo sapiens
tttatttaccttatgtcctcca

SEQ ID NO: 7850805 - DNA, 22 bp, Homo sapiens
tttatttaccttatgtcctcca

SEQ ID NO: 7850806 - DNA, 22 bp, Homo sapiens
tttatttaaagtcgtgtgttaa

SEQ ID NO: 7850807 - DNA, 22 bp, Homo sapiens
tttatttaaagtcgtgtgttaa

SEQ ID NO: 7850808 - DNA, 22 bp, Homo sapiens
tttatttaccttatgtcctcca

SEQ ID NO: 7850809 - DNA, 22 bp, Homo sapiens
tttatttaccttatgtcctcca

SEQ ID NO: 7850810 - DNA, 22 bp, Homo sapiens
tttatttaaagtcgtgtgttaa

SEQ ID NO: 7850811 - DNA, 22 bp, Homo sapiens
tttatttaaagtcgtgtgttaa

SEQ ID NO: 7850812 - DNA, 22 bp, Homo sapiens
tttatttaaagtcgtgtgttaa

SEQ ID NO: 7850813 - DNA, 18 bp, Homo sapiens
ctcctccacagcccctgc

SEQ ID NO: 7850814 - DNA, 22 bp, Homo sapiens
ctcctccacccgctggggccca

SEQ ID NO: 7850815 - DNA, 22 bp, Homo sapiens
ctcctccagacttactgaatcc

SEQ ID NO: 7850816 - DNA, 22 bp, Homo sapiens
ctcctccactaggcaaaatgtg

SEQ ID NO: 7850817 - DNA, 22 bp, Homo sapiens
ctcctccagctctccctggggg

SEQ ID NO: 7850818 - DNA, 22 bp, Homo sapiens
ctcctccagctctccctggggg

SEQ ID NO: 7850819 - DNA, 22 bp, Homo sapiens
ctcctccagcttccagtggctc

SEQ ID NO: 7850820 - DNA, 22 bp, Homo sapiens
ctcctccagcttccagtggctc

SEQ ID NO: 7850821 - DNA, 22 bp, Homo sapiens
ctcctccagcttccagtggctc

SEQ ID NO: 7850822 - DNA, 22 bp, Homo sapiens
ctcctccagcttccagtggctc

SEQ ID NO: 7850823 - DNA, 22 bp, Homo sapiens
ctcctcccaattgccaagtgct

SEQ ID NO: 7850824 - DNA, 22 bp, Homo sapiens
ctcctcccaattgccaagtgct

SEQ ID NO: 7850825 - DNA, 22 bp, Homo sapiens
ctcctcccaattgccaagtgct

SEQ ID NO: 7850826 - DNA, 22 bp, Homo sapiens
ctcctcccaattgccaagtgct

SEQ ID NO: 7850827 - DNA, 22 bp, Homo sapiens
ctcctccagtgggtccctcagg

SEQ ID NO: 7850828 - DNA, 22 bp, Homo sapiens
ctcctccagtgggtccctcagg

SEQ ID NO: 7850829 - DNA, 22 bp, Homo sapiens
ctcctccagcttccagtggctc

SEQ ID NO: 7850830 - DNA, 22 bp, Homo sapiens
ctcctccagcttccagtggctc

SEQ ID NO: 7850831 - DNA, 22 bp, Homo sapiens
ctcctccagtgggtccctcagg

SEQ ID NO: 7850832 - DNA, 22 bp, Homo sapiens
ctcctccagtgggtccctcagg

SEQ ID NO: 7850833 - DNA, 22 bp, Homo sapiens
ctcctccagtgggtccctcagg

SEQ ID NO: 7850834 - DNA, 22 bp, Homo sapiens
ctcctccagtgggtccctcagg

SEQ ID NO: 7850835 - DNA, 22 bp, Homo sapiens
tttattgttgttagtcataagt

SEQ ID NO: 7850836 - DNA, 22 bp, Homo sapiens
tttattgttgttagtcataagt

SEQ ID NO: 7850837 - DNA, 22 bp, Homo sapiens
tttattgttgggtcttaagctg

SEQ ID NO: 7850838 - DNA, 22 bp, Homo sapiens
tttattgttgttagtcataagt

SEQ ID NO: 7850839 - DNA, 22 bp, Homo sapiens
tttattgttgttagtcataagt

SEQ ID NO: 7850840 - DNA, 22 bp, Homo sapiens
tttattgttgttagtcataagt

SEQ ID NO: 7850841 - DNA, 22 bp, Homo sapiens
tttattgttgttagtcataagt

SEQ ID NO: 7850842 - DNA, 22 bp, Homo sapiens
tttattgttgttagtcataagt

SEQ ID NO: 7850843 - DNA, 22 bp, Homo sapiens
tttattgttgttagtcataagt

SEQ ID NO: 7850844 - DNA, 22 bp, Homo sapiens
tttatttaaagtcgtgtgttaa

SEQ ID NO: 7850845 - DNA, 22 bp, Homo sapiens
tttattgtttagaagggggctg

SEQ ID NO: 7850846 - DNA, 22 bp, Homo sapiens
tttattgtttagaagggggctg

SEQ ID NO: 7850847 - DNA, 22 bp, Homo sapiens
tttattgtttagaagggggctg

SEQ ID NO: 7850848 - DNA, 22 bp, Homo sapiens
tttattgtttagaagggggctg

SEQ ID NO: 7850849 - DNA, 22 bp, Homo sapiens
tttattccagtgtttctcaaat

SEQ ID NO: 7850850 - DNA, 22 bp, Homo sapiens
tttattccatgtgtctatgacc

SEQ ID NO: 7850851 - DNA, 22 bp, Homo sapiens
tttattctaacttgctgctcta

SEQ ID NO: 7850852 - DNA, 22 bp, Homo sapiens
tttattgttatcatgggtgagt

SEQ ID NO: 7850853 - DNA, 22 bp, Homo sapiens
tttattgttatcatgggtgagt

SEQ ID NO: 7850854 - DNA, 22 bp, Homo sapiens
tttattgttatcatgggtgagt

SEQ ID NO: 7850855 - DNA, 22 bp, Homo sapiens
tttattgtgttgaaactgaatt

SEQ ID NO: 7850856 - DNA, 22 bp, Homo sapiens
tttattgttgggtcttaagctg

SEQ ID NO: 7850857 - DNA, 22 bp, Homo sapiens
tttattgttgggtcttaagctg

SEQ ID NO: 7850858 - DNA, 22 bp, Homo sapiens
tttattgttatcatgggtgagt

SEQ ID NO: 7850859 - DNA, 22 bp, Homo sapiens
tttattgttgggtcttaagctg

SEQ ID NO: 7850860 - DNA, 22 bp, Homo sapiens
tttagtatataaaaagagaagt

SEQ ID NO: 7850861 - DNA, 22 bp, Homo sapiens
tttagtaggcactaggagggga

SEQ ID NO: 7850862 - DNA, 22 bp, Homo sapiens
tttagtagaatgatacagggca

SEQ ID NO: 7850863 - DNA, 22 bp, Homo sapiens
tttagtaccatcatttgcctct

SEQ ID NO: 7850864 - DNA, 22 bp, Homo sapiens
tttaggcttggtgatattctta

SEQ ID NO: 7850865 - DNA, 22 bp, Homo sapiens
tttaggctgcagcagggatgga

SEQ ID NO: 7850866 - DNA, 22 bp, Homo sapiens
tttaggctcaaaagagttggtg

SEQ ID NO: 7850867 - DNA, 22 bp, Homo sapiens
tttaggcattgggtgctcaagt

SEQ ID NO: 7850868 - DNA, 22 bp, Homo sapiens
tttaggcattgggtgctcaagt

SEQ ID NO: 7850869 - DNA, 22 bp, Homo sapiens
tttaggcattgaattagaatag

SEQ ID NO: 7850870 - DNA, 22 bp, Homo sapiens
tttaggcatgcagttctattta

SEQ ID NO: 7850871 - DNA, 22 bp, Homo sapiens
tttaggcattgaattagaatag

SEQ ID NO: 7850872 - DNA, 22 bp, Homo sapiens
tttaggttaatcaacaaacatt

SEQ ID NO: 7850873 - DNA, 22 bp, Homo sapiens
tttaggttcttggaatcagtct

SEQ ID NO: 7850874 - DNA, 22 bp, Homo sapiens
tttaggttttttcacgtggcta

SEQ ID NO: 7850875 - DNA, 22 bp, Homo sapiens
tttaggttttttcacgtggcta

SEQ ID NO: 7850876 - DNA, 22 bp, Homo sapiens
tttagggatgtcagaacaggga

SEQ ID NO: 7850877 - DNA, 22 bp, Homo sapiens
tttaggtaagctgaatatgaag

SEQ ID NO: 7850878 - DNA, 22 bp, Homo sapiens
tttaggttaatcaacaaacatt

SEQ ID NO: 7850879 - DNA, 23 bp, Homo sapiens
tttagtcagttgacagccatata

SEQ ID NO: 7850880 - DNA, 23 bp, Homo sapiens
tttagtcagttgacagccatata

SEQ ID NO: 7850881 - DNA, 22 bp, Homo sapiens
tttagtcatttggatttgatct

SEQ ID NO: 7850882 - DNA, 22 bp, Homo sapiens
tttagtctaataaaagtggagt

SEQ ID NO: 7850883 - DNA, 22 bp, Homo sapiens
tttagtgagtgtgaatcaaatg

SEQ ID NO: 7850884 - DNA, 22 bp, Homo sapiens
tttagtctaataaaagtggagt

SEQ ID NO: 7850885 - DNA, 22 bp, Homo sapiens
tttagtgattcatttagaaaaa

SEQ ID NO: 7850886 - DNA, 22 bp, Homo sapiens
tttagtgataagaattatgaaa

SEQ ID NO: 7850887 - DNA, 22 bp, Homo sapiens
tttagtgataagaattatgaaa

SEQ ID NO: 7850888 - DNA, 22 bp, Homo sapiens
ctcctcagttgtcccatggaga

SEQ ID NO: 7850889 - DNA, 22 bp, Homo sapiens
ctcctccacagacctactgaat

SEQ ID NO: 7850890 - DNA, 22 bp, Homo sapiens
ctcctcagttgtcccatggaga

SEQ ID NO: 7850891 - DNA, 22 bp, Homo sapiens
tttagtgcctgggccagttcca

SEQ ID NO: 7850892 - DNA, 22 bp, Homo sapiens
ctcctccacagagtccttgcca

SEQ ID NO: 7850893 - DNA, 22 bp, Homo sapiens
ctcctcagttgtcccatggaga

SEQ ID NO: 7850894 - DNA, 22 bp, Homo sapiens
ctcctccacagagtccttgcca

SEQ ID NO: 7850895 - DNA, 22 bp, Homo sapiens
ctcctccacagagtccttgcca

SEQ ID NO: 7850896 - DNA, 18 bp, Homo sapiens
ctcctccacagcccctgc

SEQ ID NO: 7850897 - DNA, 23 bp, Homo sapiens
ctccccagtgtcctcatgcatct

SEQ ID NO: 7850898 - DNA, 23 bp, Homo sapiens
ctccccagtgtcctcatgcatct

SEQ ID NO: 7850899 - DNA, 23 bp, Homo sapiens
ctccccagtgtcctcatgcatct

SEQ ID NO: 7850900 - DNA, 22 bp, Homo sapiens
tttaatctattccctaaacacc

SEQ ID NO: 7850901 - DNA, 23 bp, Homo sapiens
ctccccagtgtcctcatgcatct

SEQ ID NO: 7850902 - DNA, 23 bp, Homo sapiens
ctccccagtgtcctcatgcatct

SEQ ID NO: 7850903 - DNA, 23 bp, Homo sapiens
ctccccagtgtcctcatgcatct

SEQ ID NO: 7850904 - DNA, 22 bp, Homo sapiens
tttaatcataagaaggaaaata

SEQ ID NO: 7850905 - DNA, 22 bp, Homo sapiens
tttaatcataagaaggaaaata

SEQ ID NO: 7850906 - DNA, 22 bp, Homo sapiens
tttaatcataagaaggaaaata

SEQ ID NO: 7850907 - DNA, 22 bp, Homo sapiens
tttaatcaggcaaagcataata

SEQ ID NO: 7850908 - DNA, 22 bp, Homo sapiens
tttaatcaggcaaagcataata

SEQ ID NO: 7850909 - DNA, 22 bp, Homo sapiens
tttaatcaggcaaagcataata

SEQ ID NO: 7850910 - DNA, 22 bp, Homo sapiens
ctcccctccttaggtcttctag

SEQ ID NO: 7850911 - DNA, 22 bp, Homo sapiens
ctcccctccttaggtcttctag

SEQ ID NO: 7850912 - DNA, 22 bp, Homo sapiens
ctcccctccttaggtcttctag

SEQ ID NO: 7850913 - DNA, 22 bp, Homo sapiens
ctcccctccttaggtcttctag

SEQ ID NO: 7850914 - DNA, 22 bp, Homo sapiens
ctcccctagcccgttgggaggt

SEQ ID NO: 7850915 - DNA, 22 bp, Homo sapiens
ctcccccttagctcttgtcttt

SEQ ID NO: 7850916 - DNA, 17 bp, Homo sapiens
ctcccccccacgtgtcc

SEQ ID NO: 7850917 - DNA, 17 bp, Homo sapiens
ctcccccccacgtgtcc

SEQ ID NO: 7850918 - DNA, 22 bp, Homo sapiens
ctccccccacagtgttcttgcc

SEQ ID NO: 7850919 - DNA, 22 bp, Homo sapiens
ctccccattgtgacctcatcca

SEQ ID NO: 7850920 - DNA, 22 bp, Homo sapiens
ctccccatccaggcagcaggtg

SEQ ID NO: 7850921 - DNA, 22 bp, Homo sapiens
ctccccattatgcagtcattat

SEQ ID NO: 7850922 - DNA, 22 bp, Homo sapiens
ctccccatccaggcagcaggtg

SEQ ID NO: 7850923 - DNA, 22 bp, Homo sapiens
ctccccattgtgacctcatcca

SEQ ID NO: 7850924 - DNA, 22 bp, Homo sapiens
tttaggcagtcattgaacaagt

SEQ ID NO: 7850925 - DNA, 22 bp, Homo sapiens
tttaggcagtcattgaacaagt

SEQ ID NO: 7850926 - DNA, 22 bp, Homo sapiens
tttaggcagtcattgaacaagt

SEQ ID NO: 7850927 - DNA, 22 bp, Homo sapiens
tttaggcagtcattgaacaagt

SEQ ID NO: 7850928 - DNA, 21 bp, Homo sapiens
tttagagaagacaatgggcat

SEQ ID NO: 7850929 - DNA, 21 bp, Homo sapiens
tttagagaagacaatgggcat

SEQ ID NO: 7850930 - DNA, 22 bp, Homo sapiens
tttagaccctgggagattgact

SEQ ID NO: 7850931 - DNA, 22 bp, Homo sapiens
tttagacatttgtggtttgcaa

SEQ ID NO: 7850932 - DNA, 22 bp, Homo sapiens
ctccctcacaaagcattctctt

SEQ ID NO: 7850933 - DNA, 22 bp, Homo sapiens
ctcccgtggatgttcttcagtc

SEQ ID NO: 7850934 - DNA, 22 bp, Homo sapiens
tttagacatggcttgctcactt

SEQ ID NO: 7850935 - DNA, 19 bp, Homo sapiens
tttagacattgtctggtat

SEQ ID NO: 7850936 - DNA, 22 bp, Homo sapiens
tttagacatggcttgctcactt

SEQ ID NO: 7850937 - DNA, 22 bp, Homo sapiens
ctcccgtgatcctggaggagag

SEQ ID NO: 7850938 - DNA, 22 bp, Homo sapiens
ctcccgcaggagcagctcgcag

SEQ ID NO: 7850939 - DNA, 22 bp, Homo sapiens
ctcccgagttcaagctattttc

SEQ ID NO: 7850940 - DNA, 22 bp, Homo sapiens
ctccccttcttgccagatcctt

SEQ ID NO: 7850941 - DNA, 20 bp, Homo sapiens
ctcccctctacagagggctg

SEQ ID NO: 7850942 - DNA, 22 bp, Homo sapiens
ctcccctccttaggtcttctag

SEQ ID NO: 7850943 - DNA, 18 bp, Homo sapiens
ctcccctgttttccctgc

SEQ ID NO: 7850944 - DNA, 20 bp, Homo sapiens
ctcccctctacagagggctg

SEQ ID NO: 7850945 - DNA, 23 bp, Homo sapiens
ttgtatttttagtagagacaggg

SEQ ID NO: 7850946 - DNA, 22 bp, Homo sapiens
ttgtattttgttatgctactgc

SEQ ID NO: 7850947 - DNA, 22 bp, Homo sapiens
ttgtattttgttatgctactgc

SEQ ID NO: 7850948 - DNA, 22 bp, Homo sapiens
ttgtattttgttatgctactgc

SEQ ID NO: 7850949 - DNA, 22 bp, Homo sapiens
ttgtattttgttatgctactgc

SEQ ID NO: 7850950 - DNA, 22 bp, Homo sapiens
ttgtctgtccaggcaccccaag

SEQ ID NO: 7850951 - DNA, 22 bp, Homo sapiens
ttgtctgtcccagcttgtgcat

SEQ ID NO: 7850952 - DNA, 22 bp, Homo sapiens
ttgtctgtccaggcaccccaag

SEQ ID NO: 7850953 - DNA, 22 bp, Homo sapiens
ctccagcctcatctcctggctg

SEQ ID NO: 7850954 - DNA, 22 bp, Homo sapiens
ctccagcctcatctcctggctg

SEQ ID NO: 7850955 - DNA, 22 bp, Homo sapiens
ctccagcctcatctcctggctg

SEQ ID NO: 7850956 - DNA, 22 bp, Homo sapiens
ctccagcctcagatgacggtac

SEQ ID NO: 7850957 - DNA, 22 bp, Homo sapiens
ctccagcctcagatgacggtac

SEQ ID NO: 7850958 - DNA, 20 bp, Homo sapiens
ctccagcccctgccctggtc

SEQ ID NO: 7850959 - DNA, 22 bp, Homo sapiens
ctccagccagagtgcctctgtt

SEQ ID NO: 7850960 - DNA, 22 bp, Homo sapiens
ctccagccagagtgcctctgtt

SEQ ID NO: 7850961 - DNA, 22 bp, Homo sapiens
ctccagccagagtgcctctgtt

SEQ ID NO: 7850962 - DNA, 22 bp, Homo sapiens
ctccagccagagtgcctctgtt

SEQ ID NO: 7850963 - DNA, 22 bp, Homo sapiens
ctccagccagagtgcctctgtt

SEQ ID NO: 7850964 - DNA, 22 bp, Homo sapiens
ctccagcaggtgcgtctcagag

SEQ ID NO: 7850965 - DNA, 22 bp, Homo sapiens
ctccagccagagtgcctctgtt

SEQ ID NO: 7850966 - DNA, 20 bp, Homo sapiens
ctccagcccctgccctggtc

SEQ ID NO: 7850967 - DNA, 22 bp, Homo sapiens
ctccagccagagtgcctctgtt

SEQ ID NO: 7850968 - DNA, 20 bp, Homo sapiens
ctccagcccctgccctggtc

SEQ ID NO: 7850969 - DNA, 20 bp, Homo sapiens
ctccagcccctgccctggtc

SEQ ID NO: 7850970 - DNA, 20 bp, Homo sapiens
ctccagcccctgccctggtc

SEQ ID NO: 7850971 - DNA, 22 bp, Homo sapiens
ttgtcttagagtgaaaacttta

SEQ ID NO: 7850972 - DNA, 22 bp, Homo sapiens
ttgtcttagagtgaaaacttta

SEQ ID NO: 7850973 - DNA, 22 bp, Homo sapiens
ttgtcttagagtgaaaacttta

SEQ ID NO: 7850974 - DNA, 22 bp, Homo sapiens
ttgtcttaaatggatggacaat

SEQ ID NO: 7850975 - DNA, 22 bp, Homo sapiens
ttgtcttaaatggatggacaat

SEQ ID NO: 7850976 - DNA, 22 bp, Homo sapiens
ttgtcttattttatcataagca

SEQ ID NO: 7850977 - DNA, 22 bp, Homo sapiens
ttgtcttattttatcataagca

SEQ ID NO: 7850978 - DNA, 22 bp, Homo sapiens
ttgtctttcccagcttctagag

SEQ ID NO: 7850979 - DNA, 19 bp, Homo sapiens
ttgtcttagctgcataaga

SEQ ID NO: 7850980 - DNA, 19 bp, Homo sapiens
ttgtcttagctgcataaga

SEQ ID NO: 7850981 - DNA, 22 bp, Homo sapiens
ttgtctgtgaaatggaaatagt

SEQ ID NO: 7850982 - DNA, 23 bp, Homo sapiens
ttgtctgtgcttttccagttgct

SEQ ID NO: 7850983 - DNA, 22 bp, Homo sapiens
ttgtcttaaatggatggacaat

SEQ ID NO: 7850984 - DNA, 23 bp, Homo sapiens
ttgtctgtgcttttccagttgct

SEQ ID NO: 7850985 - DNA, 22 bp, Homo sapiens
ttgtctgtgaaatggaaatagt

SEQ ID NO: 7850986 - DNA, 22 bp, Homo sapiens
ttgtctgtgaaatggaaatagt

SEQ ID NO: 7850987 - DNA, 22 bp, Homo sapiens
ttgtctgtcccagcttgtgcat

SEQ ID NO: 7850988 - DNA, 22 bp, Homo sapiens
ttgtctttcccagcttctagag

SEQ ID NO: 7850989 - DNA, 22 bp, Homo sapiens
ttgtctttcccagcttctagag

SEQ ID NO: 7850990 - DNA, 22 bp, Homo sapiens
ttgtctttcccagcttctagag

SEQ ID NO: 7850991 - DNA, 22 bp, Homo sapiens
ttgtctttcccagcttctagag

SEQ ID NO: 7850992 - DNA, 22 bp, Homo sapiens
ttgtctttcccagcttctagag

SEQ ID NO: 7850993 - DNA, 22 bp, Homo sapiens
ttgtctttggaaatttaatgtt

SEQ ID NO: 7850994 - DNA, 22 bp, Homo sapiens
ttgtctttggaaatttaatgtt

SEQ ID NO: 7850995 - DNA, 22 bp, Homo sapiens
ttgtctttggaaatttaatgtt

SEQ ID NO: 7850996 - DNA, 22 bp, Homo sapiens
ttgtcttttgtgggaaatatgg

SEQ ID NO: 7850997 - DNA, 22 bp, Homo sapiens
ttgtcttttgtgggaaatatgg

SEQ ID NO: 7850998 - DNA, 22 bp, Homo sapiens
ttgtcttttgtgggaaatatgg

SEQ ID NO: 7850999 - DNA, 22 bp, Homo sapiens
ttgtcttttgtgggaaatatgg

SEQ ID NO: 7851000 - DNA, 22 bp, Homo sapiens
ctccagtgctcatgccgttgac

SEQ ID NO: 7851001 - DNA, 22 bp, Homo sapiens
ctccagtgcgtcttagtaaacc

SEQ ID NO: 7851002 - DNA, 22 bp, Homo sapiens
ctccagtgcgcaggacagcccc

SEQ ID NO: 7851003 - DNA, 22 bp, Homo sapiens
ttgtgtaattagcaaacaaatc

SEQ ID NO: 7851004 - DNA, 22 bp, Homo sapiens
ttgtgtaatgaagttatcatgt

SEQ ID NO: 7851005 - DNA, 22 bp, Homo sapiens
ttgtgtaagatgcaatatggta

SEQ ID NO: 7851006 - DNA, 22 bp, Homo sapiens
ctccatggggaaatgaaggtgg

SEQ ID NO: 7851007 - DNA, 22 bp, Homo sapiens
ctccatggaaccggggctgctt

SEQ ID NO: 7851008 - DNA, 22 bp, Homo sapiens
ctccatggaaccggggctgctt

SEQ ID NO: 7851009 - DNA, 22 bp, Homo sapiens
ctccagtgcgcaggacagcccc

SEQ ID NO: 7851010 - DNA, 22 bp, Homo sapiens
ctccagtgctgtcatcccttcc

SEQ ID NO: 7851011 - DNA, 22 bp, Homo sapiens
ttgtggttaaccgcacattttt

SEQ ID NO: 7851012 - DNA, 22 bp, Homo sapiens
ttgtgtaaatatctaaatgttt

SEQ ID NO: 7851013 - DNA, 22 bp, Homo sapiens
ttgtgtaaatatctaaatgttt

SEQ ID NO: 7851014 - DNA, 22 bp, Homo sapiens
ttgtggggtgatttgccacggg

SEQ ID NO: 7851015 - DNA, 22 bp, Homo sapiens
ttgtggggtgatttgccacggg

SEQ ID NO: 7851016 - DNA, 22 bp, Homo sapiens
ttgtgggggctgccctgtacgg

SEQ ID NO: 7851017 - DNA, 22 bp, Homo sapiens
ttgtggttaaccgcacattttt

SEQ ID NO: 7851018 - DNA, 22 bp, Homo sapiens
ttgtggggttggcagttcttta

SEQ ID NO: 7851019 - DNA, 22 bp, Homo sapiens
ttgtggggccccaatgttgctg

SEQ ID NO: 7851020 - DNA, 20 bp, Homo sapiens
ttgtgggggcaatggtatgc

SEQ ID NO: 7851021 - DNA, 20 bp, Homo sapiens
ttgtgggggcaatggtatgc

SEQ ID NO: 7851022 - DNA, 22 bp, Homo sapiens
ttgtggggcaacagcaggtgaa

SEQ ID NO: 7851023 - DNA, 22 bp, Homo sapiens
ttgtggggcaacagcaggtgaa

SEQ ID NO: 7851024 - DNA, 22 bp, Homo sapiens
ttgtggggcaacagcaggtgaa

SEQ ID NO: 7851025 - DNA, 22 bp, Homo sapiens
ttgtggggcaacagcaggtgaa

SEQ ID NO: 7851026 - DNA, 22 bp, Homo sapiens
ttgtggggaggatttgatgaga

SEQ ID NO: 7851027 - DNA, 22 bp, Homo sapiens
ttgtggggaggatttgatgaga

SEQ ID NO: 7851028 - DNA, 22 bp, Homo sapiens
ttgtggggaacccctgtcccac

SEQ ID NO: 7851029 - DNA, 22 bp, Homo sapiens
ttgtggggaaacactgtttctt

SEQ ID NO: 7851030 - DNA, 22 bp, Homo sapiens
ttgtggggaaacactgtttctt

SEQ ID NO: 7851031 - DNA, 22 bp, Homo sapiens
ttgtgggcttgcctggctcttg

SEQ ID NO: 7851032 - DNA, 22 bp, Homo sapiens
ttgtgggccattcagctgctct

SEQ ID NO: 7851033 - DNA, 22 bp, Homo sapiens
ttgtgaaaagccgcaagtatag

SEQ ID NO: 7851034 - DNA, 22 bp, Homo sapiens
ttgtgaaaagccgcaagtatag

SEQ ID NO: 7851035 - DNA, 22 bp, Homo sapiens
ttgtcttttgtgggaaatatgg

SEQ ID NO: 7851036 - DNA, 22 bp, Homo sapiens
ttgtgaaaagccgcaagtatag

SEQ ID NO: 7851037 - DNA, 22 bp, Homo sapiens
ttgtgaaacattcatggatttg

SEQ ID NO: 7851038 - DNA, 22 bp, Homo sapiens
ttgtgaaacattcatggatttg

SEQ ID NO: 7851039 - DNA, 22 bp, Homo sapiens
ttgtgaaacattcatggatttg

SEQ ID NO: 7851040 - DNA, 22 bp, Homo sapiens
ttgtgaaacattcatggatttg

SEQ ID NO: 7851041 - DNA, 21 bp, Homo sapiens
ttgtgaaagtccaggaacaac

SEQ ID NO: 7851042 - DNA, 18 bp, Homo sapiens
ttgtgaaatattggagtc

SEQ ID NO: 7851043 - DNA, 22 bp, Homo sapiens
ttgtgggatggctcttcccaaa

SEQ ID NO: 7851044 - DNA, 23 bp, Homo sapiens
ttgtgggcagattccatggggag

SEQ ID NO: 7851045 - DNA, 22 bp, Homo sapiens
ctcccagagaccaagctgagaa

SEQ ID NO: 7851046 - DNA, 22 bp, Homo sapiens
ctcccagagaccaagctgagaa

SEQ ID NO: 7851047 - DNA, 22 bp, Homo sapiens
ctcccagagagcaggtgggccg

SEQ ID NO: 7851048 - DNA, 22 bp, Homo sapiens
ctcccagagaccaagctgagaa

SEQ ID NO: 7851049 - DNA, 22 bp, Homo sapiens
ctcccagagaccaagctgagaa

SEQ ID NO: 7851050 - DNA, 22 bp, Homo sapiens
ctcccagattcctgctgtggga

SEQ ID NO: 7851051 - DNA, 22 bp, Homo sapiens
ctcccagattcctgctgtggga

SEQ ID NO: 7851052 - DNA, 22 bp, Homo sapiens
ctcccagattcctgctgtggga

SEQ ID NO: 7851053 - DNA, 22 bp, Homo sapiens
ctcccagattcctgctgtggga

SEQ ID NO: 7851054 - DNA, 22 bp, Homo sapiens
ctcccagagagcaggtgggccg

SEQ ID NO: 7851055 - DNA, 22 bp, Homo sapiens
ctcccagagagcaggtgggccg

SEQ ID NO: 7851056 - DNA, 22 bp, Homo sapiens
ctcccagagagcaggtgggccg

SEQ ID NO: 7851057 - DNA, 22 bp, Homo sapiens
ctcccagagagcaggtgggccg

SEQ ID NO: 7851058 - DNA, 22 bp, Homo sapiens
ctcccagaggtgtcattcgagc

SEQ ID NO: 7851059 - DNA, 22 bp, Homo sapiens
ctcccagaggtgtcattcgagc

SEQ ID NO: 7851060 - DNA, 22 bp, Homo sapiens
ctcccagccttcgccagtctga

SEQ ID NO: 7851061 - DNA, 22 bp, Homo sapiens
ctcccagccttcgccagtctga

SEQ ID NO: 7851062 - DNA, 22 bp, Homo sapiens
ctcccagccttcgccagtctga

SEQ ID NO: 7851063 - DNA, 22 bp, Homo sapiens
ctcccagccttcgccagtctga

SEQ ID NO: 7851064 - DNA, 22 bp, Homo sapiens
ctcccagccttcgccagtctga

SEQ ID NO: 7851065 - DNA, 22 bp, Homo sapiens
ctcccagccttcgccagtctga

SEQ ID NO: 7851066 - DNA, 22 bp, Homo sapiens
ctcccagccttcgccagtctga

SEQ ID NO: 7851067 - DNA, 22 bp, Homo sapiens
ctcccaggactcagaggagaag

SEQ ID NO: 7851068 - DNA, 22 bp, Homo sapiens
ctcccaggactcagaggagaag

SEQ ID NO: 7851069 - DNA, 22 bp, Homo sapiens
ctcccagccttcgccagtctga

SEQ ID NO: 7851070 - DNA, 22 bp, Homo sapiens
ctcccaggactcagaggagaag

SEQ ID NO: 7851071 - DNA, 22 bp, Homo sapiens
ctcccaggactcagaggagaag

SEQ ID NO: 7851072 - DNA, 22 bp, Homo sapiens
ctccattgttcgcgcagctgca

SEQ ID NO: 7851073 - DNA, 22 bp, Homo sapiens
ctccatgtccaaagtttccttg

SEQ ID NO: 7851074 - DNA, 22 bp, Homo sapiens
ctccatggctttcgcatctgca

SEQ ID NO: 7851075 - DNA, 22 bp, Homo sapiens
ctccatgggggctggcctgtgt

SEQ ID NO: 7851076 - DNA, 22 bp, Homo sapiens
ctccatgggggctggcctgtgt

SEQ ID NO: 7851077 - DNA, 22 bp, Homo sapiens
ctcccaagctgtgctgaactgt

SEQ ID NO: 7851078 - DNA, 22 bp, Homo sapiens
ctcccacatggaatagcaggga

SEQ ID NO: 7851079 - DNA, 22 bp, Homo sapiens
ctcccacatggaatagcaggga

SEQ ID NO: 7851080 - DNA, 22 bp, Homo sapiens
ctcccaaggggtaagggagctg

SEQ ID NO: 7851081 - DNA, 22 bp, Homo sapiens
ctcccactcctggctcaccaca

SEQ ID NO: 7851082 - DNA, 22 bp, Homo sapiens
ctcccacatggaatagcaggga

SEQ ID NO: 7851083 - DNA, 22 bp, Homo sapiens
ctcccactcctggctcaccaca

SEQ ID NO: 7851084 - DNA, 22 bp, Homo sapiens
ctcccactcctggctcaccaca

SEQ ID NO: 7851085 - DNA, 22 bp, Homo sapiens
ctcccactcctggctcaccaca

SEQ ID NO: 7851086 - DNA, 22 bp, Homo sapiens
ctcccagaaaattctcagacaa

SEQ ID NO: 7851087 - DNA, 22 bp, Homo sapiens
ctcccagaaaattctcagacaa

SEQ ID NO: 7851088 - DNA, 22 bp, Homo sapiens
ctcccagacatgtgcctccttg

SEQ ID NO: 7851089 - DNA, 22 bp, Homo sapiens
ctcccagacatgtgcctccttg

SEQ ID NO: 7851090 - DNA, 22 bp, Homo sapiens
ctcccagacatgtgcctccttg

SEQ ID NO: 7851091 - DNA, 22 bp, Homo sapiens
tttaacagatgtgaaattttca

SEQ ID NO: 7851092 - DNA, 22 bp, Homo sapiens
tttaatacagaacttgtcaggg

SEQ ID NO: 7851093 - DNA, 22 bp, Homo sapiens
tttaatacagaacttgtcaggg

SEQ ID NO: 7851094 - DNA, 22 bp, Homo sapiens
tttaatacagaacttgtcaggg

SEQ ID NO: 7851095 - DNA, 22 bp, Homo sapiens
tttaagttccttttcaacaact

SEQ ID NO: 7851096 - DNA, 22 bp, Homo sapiens
tttaagttccttttcaacaact

SEQ ID NO: 7851097 - DNA, 22 bp, Homo sapiens
ctcccaggccatgctctagcca

SEQ ID NO: 7851098 - DNA, 22 bp, Homo sapiens
ctcccaggccatgctctagcca

SEQ ID NO: 7851099 - DNA, 22 bp, Homo sapiens
tttaacagatgctatgtctacc

SEQ ID NO: 7851100 - DNA, 22 bp, Homo sapiens
ctcccaggcagggctgcccact

SEQ ID NO: 7851101 - DNA, 22 bp, Homo sapiens
ctcccaggccatgctctagcca

SEQ ID NO: 7851102 - DNA, 22 bp, Homo sapiens
ctcccaggccatgctctagcca

SEQ ID NO: 7851103 - DNA, 22 bp, Homo sapiens
ctcccaggcagggctgcccact

SEQ ID NO: 7851104 - DNA, 22 bp, Homo sapiens
ctcccaggcagggctgcccact

SEQ ID NO: 7851105 - DNA, 22 bp, Homo sapiens
ctcccaggcagggctgcccact

SEQ ID NO: 7851106 - DNA, 22 bp, Homo sapiens
ctcccaggcacagggaggagcc

SEQ ID NO: 7851107 - DNA, 22 bp, Homo sapiens
ctcccaggcacagggaggagcc

SEQ ID NO: 7851108 - DNA, 22 bp, Homo sapiens
ctcccaggcacagggaggagcc

SEQ ID NO: 7851109 - DNA, 22 bp, Homo sapiens
ctcccaggcacagggaggagcc

SEQ ID NO: 7851110 - DNA, 22 bp, Homo sapiens
ctcccaggactggctctaactg

SEQ ID NO: 7851111 - DNA, 22 bp, Homo sapiens
tttaatatttctttcctgaagc

SEQ ID NO: 7851112 - DNA, 22 bp, Homo sapiens
tttaatatttctttcctgaagc

SEQ ID NO: 7851113 - DNA, 22 bp, Homo sapiens
tttaatatttctttcctgaagc

SEQ ID NO: 7851114 - DNA, 22 bp, Homo sapiens
tttaatcaggcaaagcataata

SEQ ID NO: 7851115 - DNA, 22 bp, Homo sapiens
tttaatcaggcaaagcataata

SEQ ID NO: 7851116 - DNA, 22 bp, Homo sapiens
tttaatatctcacacttccatg

SEQ ID NO: 7851117 - DNA, 22 bp, Homo sapiens
tttaatatctcacacttccatg

SEQ ID NO: 7851118 - DNA, 22 bp, Homo sapiens
tttaatattctgcattctcctt

SEQ ID NO: 7851119 - DNA, 22 bp, Homo sapiens
tttaatatctcacacttccatg

SEQ ID NO: 7851120 - DNA, 22 bp, Homo sapiens
tttaatatccagtggatacaaa

SEQ ID NO: 7851121 - DNA, 22 bp, Homo sapiens
tttaatatccagtggatacaaa

SEQ ID NO: 7851122 - DNA, 22 bp, Homo sapiens
tttaatatccagtggatacaaa

SEQ ID NO: 7851123 - DNA, 22 bp, Homo sapiens
tttaatatccagtggatacaaa

SEQ ID NO: 7851124 - DNA, 22 bp, Homo sapiens
tttaatagggcccaatgagact

SEQ ID NO: 7851125 - DNA, 22 bp, Homo sapiens
tttaatagggcccaatgagact

SEQ ID NO: 7851126 - DNA, 22 bp, Homo sapiens
tttaatactatggggatgaaca

SEQ ID NO: 7851127 - DNA, 22 bp, Homo sapiens
tttaatatccagtggatacaaa

SEQ ID NO: 7851128 - DNA, 22 bp, Homo sapiens
ttgtacaacgttttaaatttga

SEQ ID NO: 7851129 - DNA, 22 bp, Homo sapiens
ttgtacaacgttttaaatttga

SEQ ID NO: 7851130 - DNA, 22 bp, Homo sapiens
ttgtacaacgttttaaatttga

SEQ ID NO: 7851131 - DNA, 22 bp, Homo sapiens
ttgtacaacgttttaaatttga

SEQ ID NO: 7851132 - DNA, 22 bp, Homo sapiens
ttgtacaacgttttaaatttga

SEQ ID NO: 7851133 - DNA, 22 bp, Homo sapiens
ttgtacaacacatattctacag

SEQ ID NO: 7851134 - DNA, 22 bp, Homo sapiens
ttgtacaacacatattctacag

SEQ ID NO: 7851135 - DNA, 22 bp, Homo sapiens
ttgtacaacgttttaaatttga

SEQ ID NO: 7851136 - DNA, 22 bp, Homo sapiens
ttgtacaacacatattctacag

SEQ ID NO: 7851137 - DNA, 22 bp, Homo sapiens
ttgtacaacacatattctacag

SEQ ID NO: 7851138 - DNA, 22 bp, Homo sapiens
ttgtacaacacatattctacag

SEQ ID NO: 7851139 - DNA, 22 bp, Homo sapiens
ttgtacaacacatattctacag

SEQ ID NO: 7851140 - DNA, 22 bp, Homo sapiens
ttgtacaacacatattctacag

SEQ ID NO: 7851141 - DNA, 22 bp, Homo sapiens
ttgtacaaatgcatattcctgg

SEQ ID NO: 7851142 - DNA, 22 bp, Homo sapiens
ttgtacaaataggaacctctga

SEQ ID NO: 7851143 - DNA, 22 bp, Homo sapiens
ttgtacaaatgcatattcctgg

SEQ ID NO: 7851144 - DNA, 22 bp, Homo sapiens
ttgtacaaatgcatattcctgg

SEQ ID NO: 7851145 - DNA, 22 bp, Homo sapiens
ttgtacaaatgcatattcctgg

SEQ ID NO: 7851146 - DNA, 22 bp, Homo sapiens
ttgtacaagtattatgtgaaca

SEQ ID NO: 7851147 - DNA, 22 bp, Homo sapiens
ttgtacaagtattatgtgaaca

SEQ ID NO: 7851148 - DNA, 22 bp, Homo sapiens
ttgtacaagtattatgtgaaca

SEQ ID NO: 7851149 - DNA, 22 bp, Homo sapiens
ctccagattccgtttattcagg

SEQ ID NO: 7851150 - DNA, 22 bp, Homo sapiens
ctccagattccgtttattcagg

SEQ ID NO: 7851151 - DNA, 22 bp, Homo sapiens
ctccagatccagctgagctgca

SEQ ID NO: 7851152 - DNA, 22 bp, Homo sapiens
ctccagattccgtttattcagg

SEQ ID NO: 7851153 - DNA, 22 bp, Homo sapiens
ctccagattccgtttattcagg

SEQ ID NO: 7851154 - DNA, 22 bp, Homo sapiens
ctccagattctggatgactggg

SEQ ID NO: 7851155 - DNA, 22 bp, Homo sapiens
ctccagcagaaagggcgagtgg

SEQ ID NO: 7851156 - DNA, 22 bp, Homo sapiens
ctccagcagaaagggcgagtgg

SEQ ID NO: 7851157 - DNA, 22 bp, Homo sapiens
ctccagcagaaagggcgagtgg

SEQ ID NO: 7851158 - DNA, 22 bp, Homo sapiens
ctccagattccgtttattcagg

SEQ ID NO: 7851159 - DNA, 22 bp, Homo sapiens
ttgtacaaagatttcacagctc

SEQ ID NO: 7851160 - DNA, 22 bp, Homo sapiens
ttgtacaaagatttcacagctc

SEQ ID NO: 7851161 - DNA, 22 bp, Homo sapiens
ttgtaatttgttcccaagcaga

SEQ ID NO: 7851162 - DNA, 22 bp, Homo sapiens
ttgtacaaagatttcacagctc

SEQ ID NO: 7851163 - DNA, 22 bp, Homo sapiens
ttgtaatttgttcccaagcaga

SEQ ID NO: 7851164 - DNA, 22 bp, Homo sapiens
ttgtaatttgcaaatgtattgt

SEQ ID NO: 7851165 - DNA, 22 bp, Homo sapiens
ttgtaatttttcatggtatcac

SEQ ID NO: 7851166 - DNA, 22 bp, Homo sapiens
ttgtaattgaacccttaggctt

SEQ ID NO: 7851167 - DNA, 22 bp, Homo sapiens
ttgtaattggacagccatcagg

SEQ ID NO: 7851168 - DNA, 22 bp, Homo sapiens
ttgtaattgggtggtttgggac

SEQ ID NO: 7851169 - DNA, 22 bp, Homo sapiens
ttgtaatttgcaaatgtattgt

SEQ ID NO: 7851170 - DNA, 22 bp, Homo sapiens
ttgtaatttgcaaatgtattgt

SEQ ID NO: 7851171 - DNA, 22 bp, Homo sapiens
ttgtacaaataggaacctctga

SEQ ID NO: 7851172 - DNA, 22 bp, Homo sapiens
ttgtacaaataggaacctctga

SEQ ID NO: 7851173 - DNA, 22 bp, Homo sapiens
ttgtacaaataggaacctctga

SEQ ID NO: 7851174 - DNA, 22 bp, Homo sapiens
ttgtacaaaggatttggaagag

SEQ ID NO: 7851175 - DNA, 22 bp, Homo sapiens
ttgtacaaaggatttggaagag

SEQ ID NO: 7851176 - DNA, 22 bp, Homo sapiens
ttgtacaaaggatttggaagag

SEQ ID NO: 7851177 - DNA, 22 bp, Homo sapiens
ttgtacaaaggatttggaagag

SEQ ID NO: 7851178 - DNA, 22 bp, Homo sapiens
ttgtacaaagatttcacagctc

SEQ ID NO: 7851179 - DNA, 22 bp, Homo sapiens
ttgtacaaagatttcacagctc

SEQ ID NO: 7851180 - DNA, 22 bp, Homo sapiens
ttggtcagctaataaggacagg

SEQ ID NO: 7851181 - DNA, 22 bp, Homo sapiens
ttggtcagctaataaggacagg

SEQ ID NO: 7851182 - DNA, 22 bp, Homo sapiens
ttggtcagctaataaggacagg

SEQ ID NO: 7851183 - DNA, 22 bp, Homo sapiens
ttgtaattagtttttgatctgg

SEQ ID NO: 7851184 - DNA, 22 bp, Homo sapiens
ttgtaattaatggcagcaatta

SEQ ID NO: 7851185 - DNA, 22 bp, Homo sapiens
ttgtaattactccaggggtaaa

SEQ ID NO: 7851186 - DNA, 22 bp, Homo sapiens
ttgtaattaatggcagcaatta

SEQ ID NO: 7851187 - DNA, 22 bp, Homo sapiens
ctccaccccgtgccggtgctgg

SEQ ID NO: 7851188 - DNA, 22 bp, Homo sapiens
ctccacggcccattgggcagga

SEQ ID NO: 7851189 - DNA, 22 bp, Homo sapiens
ctccactcaacaagcccagtgt

SEQ ID NO: 7851190 - DNA, 22 bp, Homo sapiens
ttggtcagatgtgtctcctcct

SEQ ID NO: 7851191 - DNA, 22 bp, Homo sapiens
ttggtcagattgggcttccatt

SEQ ID NO: 7851192 - DNA, 22 bp, Homo sapiens
ctccaccacacatctgtccacc

SEQ ID NO: 7851193 - DNA, 22 bp, Homo sapiens
ctccaccccgtgccggtgctgg

SEQ ID NO: 7851194 - DNA, 22 bp, Homo sapiens
ctccaccacacatctgtccacc

SEQ ID NO: 7851195 - DNA, 22 bp, Homo sapiens
ctccaccacacatctgtccacc

SEQ ID NO: 7851196 - DNA, 22 bp, Homo sapiens
ctccacagttgctgcttttaat

SEQ ID NO: 7851197 - DNA, 22 bp, Homo sapiens
ctccacagcccctccagtggca

SEQ ID NO: 7851198 - DNA, 22 bp, Homo sapiens
ctccacagcccctccagtggca

SEQ ID NO: 7851199 - DNA, 22 bp, Homo sapiens
ctccacagcccctccagtggca

SEQ ID NO: 7851200 - DNA, 22 bp, Homo sapiens
ctccacagctcaggctcagagt

SEQ ID NO: 7851201 - DNA, 22 bp, Homo sapiens
ctccacagctcaggctcagagt

SEQ ID NO: 7851202 - DNA, 22 bp, Homo sapiens
ctccacagctcaggctcagagt

SEQ ID NO: 7851203 - DNA, 22 bp, Homo sapiens
ctccacagctcaggctcagagt

SEQ ID NO: 7851204 - DNA, 22 bp, Homo sapiens
ctccacaggtgtactgtacctt

SEQ ID NO: 7851205 - DNA, 22 bp, Homo sapiens
ctccacaggtgtactgtacctt

SEQ ID NO: 7851206 - DNA, 22 bp, Homo sapiens
ctccacaggtgtactgtacctt

SEQ ID NO: 7851207 - DNA, 22 bp, Homo sapiens
ctccacaggtgtactgtacctt

SEQ ID NO: 7851208 - DNA, 22 bp, Homo sapiens
ctccacaggtggtgtttgcttc

SEQ ID NO: 7851209 - DNA, 22 bp, Homo sapiens
ctccacaggtggtgtttgcttc

SEQ ID NO: 7851210 - DNA, 19 bp, Homo sapiens
ctccacagggattgtgatt

SEQ ID NO: 7851211 - DNA, 22 bp, Homo sapiens
ctccacagctgtaaatataggg

SEQ ID NO: 7851212 - DNA, 19 bp, Homo sapiens
ctccacagggattgtgatt

SEQ ID NO: 7851213 - DNA, 22 bp, Homo sapiens
ctccaagtccgagggctctcaa

SEQ ID NO: 7851214 - DNA, 22 bp, Homo sapiens
ctccaagtatgttaaaatctaa

SEQ ID NO: 7851215 - DNA, 22 bp, Homo sapiens
ctccaaggttttccctgtcctt

SEQ ID NO: 7851216 - DNA, 22 bp, Homo sapiens
ctccaaggttttccctgtcctt

SEQ ID NO: 7851217 - DNA, 22 bp, Homo sapiens
ctccaaggttttccctgtcctt

SEQ ID NO: 7851218 - DNA, 22 bp, Homo sapiens
ctccaaggtttcagaacaaatg

SEQ ID NO: 7851219 - DNA, 22 bp, Homo sapiens
ctccaaggtttcagaacaaatg

SEQ ID NO: 7851220 - DNA, 22 bp, Homo sapiens
ctccacagagcatgcttatagg

SEQ ID NO: 7851221 - DNA, 22 bp, Homo sapiens
ctccacagagatgctgattgta

SEQ ID NO: 7851222 - DNA, 22 bp, Homo sapiens
ctccacagcccctccagtggca

SEQ ID NO: 7851223 - DNA, 22 bp, Homo sapiens
ctccacagcccctccagtggca

SEQ ID NO: 7851224 - DNA, 22 bp, Homo sapiens
ctccacagcccctccagtggca

SEQ ID NO: 7851225 - DNA, 22 bp, Homo sapiens
ctccacagcccctccagtggca

SEQ ID NO: 7851226 - DNA, 20 bp, Homo sapiens
ctccacacctgttcgcaggc

SEQ ID NO: 7851227 - DNA, 22 bp, Homo sapiens
ctccacagagatgctgattgta

SEQ ID NO: 7851228 - DNA, 22 bp, Homo sapiens
ctccacagagatgctgattgta

SEQ ID NO: 7851229 - DNA, 22 bp, Homo sapiens
ctccaaggaagccccaagggat

SEQ ID NO: 7851230 - DNA, 22 bp, Homo sapiens
ctccaactgatctcacagcaga

SEQ ID NO: 7851231 - DNA, 22 bp, Homo sapiens
ctccaaggaagccccaagggat

SEQ ID NO: 7851232 - DNA, 20 bp, Homo sapiens
ctccaaattcctgaggataa

SEQ ID NO: 7851233 - DNA, 22 bp, Homo sapiens
ctccaaattcagtcacagtctg

SEQ ID NO: 7851234 - DNA, 22 bp, Homo sapiens
ctccaacgaggctggggtacaa

SEQ ID NO: 7851235 - DNA, 22 bp, Homo sapiens
ctccaacgaggctggggtacaa

SEQ ID NO: 7851236 - DNA, 22 bp, Homo sapiens
ctccaacgaggctggggtacaa

SEQ ID NO: 7851237 - DNA, 22 bp, Homo sapiens
ctccaaggagaaatgggcaaca

SEQ ID NO: 7851238 - DNA, 22 bp, Homo sapiens
ctccaaggagaaatgggcaaca

SEQ ID NO: 7851239 - DNA, 22 bp, Homo sapiens
ctccaaggagaaatgggcaaca

SEQ ID NO: 7851240 - DNA, 22 bp, Homo sapiens
ctccaaggagaaatgggcaaca

SEQ ID NO: 7851241 - DNA, 22 bp, Homo sapiens
ctccaaggattctggacccttg

SEQ ID NO: 7851242 - DNA, 22 bp, Homo sapiens
ctccaaggattctggacccttg

SEQ ID NO: 7851243 - DNA, 23 bp, Homo sapiens
ctccaaggcccaactgtctaggc

SEQ ID NO: 7851244 - DNA, 22 bp, Homo sapiens
ctccaaggctaggagcatgttc

SEQ ID NO: 7851245 - DNA, 22 bp, Homo sapiens
ctccaaggctaggagcatgttc

SEQ ID NO: 7851246 - DNA, 22 bp, Homo sapiens
ctccaaggctaggagcatgttc

SEQ ID NO: 7851247 - DNA, 23 bp, Homo sapiens
ctccaaggcccaactgtctaggc

SEQ ID NO: 7851248 - DNA, 23 bp, Homo sapiens
ctccaaggcccaactgtctaggc

SEQ ID NO: 7851249 - DNA, 22 bp, Homo sapiens
ctccaaggctaggagcatgttc

SEQ ID NO: 7851250 - DNA, 22 bp, Homo sapiens
ctccaagggtcttccaccagga

SEQ ID NO: 7851251 - DNA, 22 bp, Homo sapiens
ctccaagggtcttccaccagga

SEQ ID NO: 7851252 - DNA, 22 bp, Homo sapiens
ctccaagggtcttccaccagga

SEQ ID NO: 7851253 - DNA, 22 bp, Homo sapiens
ctccaagggttgtgggtggtca

SEQ ID NO: 7851254 - DNA, 18 bp, Homo sapiens
ctccaaggtctctggctt

SEQ ID NO: 7851255 - DNA, 18 bp, Homo sapiens
ctccaaggtctctggctt

SEQ ID NO: 7851256 - DNA, 18 bp, Homo sapiens
ctccaaggtctctggctt

SEQ ID NO: 7851257 - DNA, 18 bp, Homo sapiens
ctccaaggtctctggctt

SEQ ID NO: 7851258 - DNA, 18 bp, Homo sapiens
ctccaaggtctctggctt

SEQ ID NO: 7851259 - DNA, 22 bp, Homo sapiens
ctccaaggtggttatttgagat

SEQ ID NO: 7851260 - DNA, 22 bp, Homo sapiens
ctccaaggtttcagaacaaatg

SEQ ID NO: 7851261 - DNA, 22 bp, Homo sapiens
ctccaaggtggttatttgagat

SEQ ID NO: 7851262 - DNA, 20 bp, Homo sapiens
ctccaaggcttgcaggaggc

SEQ ID NO: 7851263 - DNA, 20 bp, Homo sapiens
ctccaaggcttgcaggaggc

SEQ ID NO: 7851264 - DNA, 20 bp, Homo sapiens
ctccaaggcttgcaggaggc

SEQ ID NO: 7851265 - DNA, 22 bp, Homo sapiens
ctccaaggctctggtgctgagg

SEQ ID NO: 7851266 - DNA, 23 bp, Homo sapiens
ctccaagggagggcaaacaacag

SEQ ID NO: 7851267 - DNA, 23 bp, Homo sapiens
ctccaagggagggcaaacaacag

SEQ ID NO: 7851268 - DNA, 20 bp, Homo sapiens
ctccaaggcttgcaggaggc

SEQ ID NO: 7851269 - DNA, 22 bp, Homo sapiens
ctccaagggctcccagacgtct

SEQ ID NO: 7851270 - DNA, 22 bp, Homo sapiens
ctccaagggctcccagacgtct

SEQ ID NO: 7851271 - DNA, 22 bp, Homo sapiens
ctcatttatttctcccaaaaca

SEQ ID NO: 7851272 - DNA, 22 bp, Homo sapiens
ctcatttatgtaatgattaagg

SEQ ID NO: 7851273 - DNA, 22 bp, Homo sapiens
ctcatttgttacaattcatact

SEQ ID NO: 7851274 - DNA, 22 bp, Homo sapiens
ctcatttgtaattagttctcag

SEQ ID NO: 7851275 - DNA, 22 bp, Homo sapiens
ctcatttgtaattagttctcag

SEQ ID NO: 7851276 - DNA, 22 bp, Homo sapiens
ctcatttgttctgcagaagatc

SEQ ID NO: 7851277 - DNA, 22 bp, Homo sapiens
ctcatttgtaattagttctcag

SEQ ID NO: 7851278 - DNA, 19 bp, Homo sapiens
ctccaaatacttttccctt

SEQ ID NO: 7851279 - DNA, 22 bp, Homo sapiens
ctccaaatacagtcatcttggg

SEQ ID NO: 7851280 - DNA, 23 bp, Homo sapiens
ctccaaatactcccaattgtttt

SEQ ID NO: 7851281 - DNA, 22 bp, Homo sapiens
ctccaaattcagtcacagtctg

SEQ ID NO: 7851282 - DNA, 22 bp, Homo sapiens
ctccaaattcagtcacagtctg

SEQ ID NO: 7851283 - DNA, 22 bp, Homo sapiens
ctccaaatataatcacattgga

SEQ ID NO: 7851284 - DNA, 22 bp, Homo sapiens
ctccaaatataatcacattgga

SEQ ID NO: 7851285 - DNA, 22 bp, Homo sapiens
ctccaaatacaatattgttgtt

SEQ ID NO: 7851286 - DNA, 22 bp, Homo sapiens
ctccaaatacaatattgttgtt

SEQ ID NO: 7851287 - DNA, 22 bp, Homo sapiens
ctcatttgttggcctagagtgg

SEQ ID NO: 7851288 - DNA, 22 bp, Homo sapiens
ctcatttgttacaattcatact

SEQ ID NO: 7851289 - DNA, 22 bp, Homo sapiens
ctcatttaacagattaaaaagt

SEQ ID NO: 7851290 - DNA, 22 bp, Homo sapiens
ctcatttacctttgcaatcaag

SEQ ID NO: 7851291 - DNA, 22 bp, Homo sapiens
ctcatttactcatctgcaaaac

SEQ ID NO: 7851292 - DNA, 22 bp, Homo sapiens
ctcatttactcatctgcaaaac

SEQ ID NO: 7851293 - DNA, 22 bp, Homo sapiens
ttgaaatactgcattgttcagt

SEQ ID NO: 7851294 - DNA, 22 bp, Homo sapiens
ttgaaatactgcattgttcagt

SEQ ID NO: 7851295 - DNA, 22 bp, Homo sapiens
ttgaaatactgcattgttcagt

SEQ ID NO: 7851296 - DNA, 22 bp, Homo sapiens
ttgaaatatcaagttattagtg

SEQ ID NO: 7851297 - DNA, 22 bp, Homo sapiens
ttgaaatagatgcgtcagagat

SEQ ID NO: 7851298 - DNA, 22 bp, Homo sapiens
ctcatctgtatatagtgaatga

SEQ ID NO: 7851299 - DNA, 22 bp, Homo sapiens
ctcatctgtatatagtgaatga

SEQ ID NO: 7851300 - DNA, 22 bp, Homo sapiens
ctcatctgtatatagtgaatga

SEQ ID NO: 7851301 - DNA, 22 bp, Homo sapiens
ctcatttaacagattaaaaagt

SEQ ID NO: 7851302 - DNA, 22 bp, Homo sapiens
ttgaaataaggaagctcgaaat

SEQ ID NO: 7851303 - DNA, 22 bp, Homo sapiens
ttgaaatactgcattgttcagt

SEQ ID NO: 7851304 - DNA, 22 bp, Homo sapiens
ttgaaagtagcagctgcatatg

SEQ ID NO: 7851305 - DNA, 22 bp, Homo sapiens
ttgaaagtctaggcttacagta

SEQ ID NO: 7851306 - DNA, 22 bp, Homo sapiens
ttgaaagtctctgcatgtagga

SEQ ID NO: 7851307 - DNA, 22 bp, Homo sapiens
ttcttttcggcctgtgagaagg

SEQ ID NO: 7851308 - DNA, 22 bp, Homo sapiens
ttcttttcggcctgtgagaagg

SEQ ID NO: 7851309 - DNA, 22 bp, Homo sapiens
ttcttttcggcctgtgagaagg

SEQ ID NO: 7851310 - DNA, 22 bp, Homo sapiens
ttcttttcctgtggctcatcca

SEQ ID NO: 7851311 - DNA, 22 bp, Homo sapiens
ttcttttcctgtggctcatcca

SEQ ID NO: 7851312 - DNA, 23 bp, Homo sapiens
ttgaaaggtagctggcagctaga

SEQ ID NO: 7851313 - DNA, 22 bp, Homo sapiens
ttcttttcggcctgtgagaagg

SEQ ID NO: 7851314 - DNA, 21 bp, Homo sapiens
ttgaaagtaaattcagcagct

SEQ ID NO: 7851315 - DNA, 22 bp, Homo sapiens
ttgaaaggtgaacatgatgcac

SEQ ID NO: 7851316 - DNA, 22 bp, Homo sapiens
ttcttttcccaatattttgctg

SEQ ID NO: 7851317 - DNA, 22 bp, Homo sapiens
ttcttttcccaatattttgctg

SEQ ID NO: 7851318 - DNA, 22 bp, Homo sapiens
ttcttttcccaatattttgctg

SEQ ID NO: 7851319 - DNA, 22 bp, Homo sapiens
ttcttttcccaatattttgctg

SEQ ID NO: 7851320 - DNA, 18 bp, Homo sapiens
ttcttttcatgtgatctc

SEQ ID NO: 7851321 - DNA, 22 bp, Homo sapiens
ttcttttcccaatattttgctg

SEQ ID NO: 7851322 - DNA, 22 bp, Homo sapiens
ttcttttcccaatattttgctg

SEQ ID NO: 7851323 - DNA, 22 bp, Homo sapiens
ttcttttcaagaggggcaagga

SEQ ID NO: 7851324 - DNA, 18 bp, Homo sapiens
ttcttttcatgtgatctc

SEQ ID NO: 7851325 - DNA, 18 bp, Homo sapiens
ttcttttcatgtgatctc

SEQ ID NO: 7851326 - DNA, 18 bp, Homo sapiens
ttcttttcatgtgatctc

SEQ ID NO: 7851327 - DNA, 22 bp, Homo sapiens
ttcttttcccaatattttgctg

SEQ ID NO: 7851328 - DNA, 22 bp, Homo sapiens
ttcttttcctacacagcgattt

SEQ ID NO: 7851329 - DNA, 22 bp, Homo sapiens
ttcttttcctacacagcgattt

SEQ ID NO: 7851330 - DNA, 22 bp, Homo sapiens
ttcttttcctacacagcgattt

SEQ ID NO: 7851331 - DNA, 22 bp, Homo sapiens
ttcttttcctacacagcgattt

SEQ ID NO: 7851332 - DNA, 22 bp, Homo sapiens
ttcttttcctacacagcgattt

SEQ ID NO: 7851333 - DNA, 22 bp, Homo sapiens
ttcttttcctacacagcgattt

SEQ ID NO: 7851334 - DNA, 22 bp, Homo sapiens
ttcttttcctgtggctcatcca

SEQ ID NO: 7851335 - DNA, 22 bp, Homo sapiens
ttctttcttagcaatctatggt

SEQ ID NO: 7851336 - DNA, 22 bp, Homo sapiens
ttctttcttagcaatctatggt

SEQ ID NO: 7851337 - DNA, 22 bp, Homo sapiens
ttctttcttagcaatctatggt

SEQ ID NO: 7851338 - DNA, 22 bp, Homo sapiens
ctcacaggttagttgtgtggat

SEQ ID NO: 7851339 - DNA, 22 bp, Homo sapiens
ttctttctgtccataatgagac

SEQ ID NO: 7851340 - DNA, 22 bp, Homo sapiens
ctcacaggttagttgtgtggat

SEQ ID NO: 7851341 - DNA, 22 bp, Homo sapiens
ctcacaggttagttgtgtggat

SEQ ID NO: 7851342 - DNA, 22 bp, Homo sapiens
ttcttttacattaagatttcag

SEQ ID NO: 7851343 - DNA, 22 bp, Homo sapiens
ttcttttacattaagatttcag

SEQ ID NO: 7851344 - DNA, 22 bp, Homo sapiens
ttcttttacattaagatttcag

SEQ ID NO: 7851345 - DNA, 22 bp, Homo sapiens
ttcttttacattaagatttcag

SEQ ID NO: 7851346 - DNA, 22 bp, Homo sapiens
ttcttttagaatttcctaaggt

SEQ ID NO: 7851347 - DNA, 22 bp, Homo sapiens
ttcttttacattaagatttcag

SEQ ID NO: 7851348 - DNA, 22 bp, Homo sapiens
ttcttttagaatttcctaaggt

SEQ ID NO: 7851349 - DNA, 22 bp, Homo sapiens
ttcttttcaagaggggcaagga

SEQ ID NO: 7851350 - DNA, 22 bp, Homo sapiens
ctctgcccagtgcccacaggag

SEQ ID NO: 7851351 - DNA, 22 bp, Homo sapiens
ctctgcccagtgcccacaggag

SEQ ID NO: 7851352 - DNA, 22 bp, Homo sapiens
ctctgcccagtgcccacaggag

SEQ ID NO: 7851353 - DNA, 22 bp, Homo sapiens
ctctgcccagtgcccacaggag

SEQ ID NO: 7851354 - DNA, 22 bp, Homo sapiens
ctctgcccagtgcccacaggag

SEQ ID NO: 7851355 - DNA, 22 bp, Homo sapiens
ctctgcccccagctggtgcttg

SEQ ID NO: 7851356 - DNA, 22 bp, Homo sapiens
ctctgcccccagctggtgcttg

SEQ ID NO: 7851357 - DNA, 22 bp, Homo sapiens
ctctgcccgcggatgccacgtc

SEQ ID NO: 7851358 - DNA, 22 bp, Homo sapiens
ctctgcccgtgcctttcccagt

SEQ ID NO: 7851359 - DNA, 22 bp, Homo sapiens
ctctgcccgtgcctttcccagt

SEQ ID NO: 7851360 - DNA, 22 bp, Homo sapiens
ctctgccctcgcacatctgcca

SEQ ID NO: 7851361 - DNA, 22 bp, Homo sapiens
ctctgccctcacttggggcctg

SEQ ID NO: 7851362 - DNA, 22 bp, Homo sapiens
ctctgccctcacttggggcctg

SEQ ID NO: 7851363 - DNA, 22 bp, Homo sapiens
ctctgcccgcggatgccacgtc

SEQ ID NO: 7851364 - DNA, 22 bp, Homo sapiens
ctctgcccgcggatgccacgtc

SEQ ID NO: 7851365 - DNA, 22 bp, Homo sapiens
ctctgcccgcggatgccacgtc

SEQ ID NO: 7851366 - DNA, 22 bp, Homo sapiens
ctctgcccgcggatgccacgtc

SEQ ID NO: 7851367 - DNA, 22 bp, Homo sapiens
tttgcaaagttatttagactca

SEQ ID NO: 7851368 - DNA, 22 bp, Homo sapiens
tttgcaaagttatttagactca

SEQ ID NO: 7851369 - DNA, 22 bp, Homo sapiens
tttgcaaagttatttagactca

SEQ ID NO: 7851370 - DNA, 19 bp, Homo sapiens
ctctgcctccctcctgggt

SEQ ID NO: 7851371 - DNA, 22 bp, Homo sapiens
tttgcaaagtgcttgcagagta

SEQ ID NO: 7851372 - DNA, 22 bp, Homo sapiens
tttgcattttgataagatcact

SEQ ID NO: 7851373 - DNA, 22 bp, Homo sapiens
tttgcattttgataagatcact

SEQ ID NO: 7851374 - DNA, 22 bp, Homo sapiens
tttgcattttgataagatcact

SEQ ID NO: 7851375 - DNA, 22 bp, Homo sapiens
tttgccaggcttgcatgaattt

SEQ ID NO: 7851376 - DNA, 22 bp, Homo sapiens
tttgcaaataaataagtgctcg

SEQ ID NO: 7851377 - DNA, 22 bp, Homo sapiens
tttgcaaataaataagtgctcg

SEQ ID NO: 7851378 - DNA, 22 bp, Homo sapiens
tttgcattttagatttaggcct

SEQ ID NO: 7851379 - DNA, 22 bp, Homo sapiens
tttgcattttagatttaggcct

SEQ ID NO: 7851380 - DNA, 19 bp, Homo sapiens
ctctgcctccctcctgggt

SEQ ID NO: 7851381 - DNA, 19 bp, Homo sapiens
ctctgcctccctcctgggt

SEQ ID NO: 7851382 - DNA, 22 bp, Homo sapiens
ctctgcctcccaggttcaagcg

SEQ ID NO: 7851383 - DNA, 19 bp, Homo sapiens
ctctgcctccctcctgggt

SEQ ID NO: 7851384 - DNA, 19 bp, Homo sapiens
ctctgcctccctcctgggt

SEQ ID NO: 7851385 - DNA, 19 bp, Homo sapiens
ctctgcctccctcctgggt

SEQ ID NO: 7851386 - DNA, 22 bp, Homo sapiens
ctctgccctcgcacatctgcca

SEQ ID NO: 7851387 - DNA, 19 bp, Homo sapiens
ctctgcctccctcctgggt

SEQ ID NO: 7851388 - DNA, 22 bp, Homo sapiens
ctctgccactcgaagtcaagga

SEQ ID NO: 7851389 - DNA, 22 bp, Homo sapiens
ctctgccagccaaaatttatga

SEQ ID NO: 7851390 - DNA, 22 bp, Homo sapiens
ctctgccagccaaagtcatcac

SEQ ID NO: 7851391 - DNA, 22 bp, Homo sapiens
ctctgccagccaaagtcatcac

SEQ ID NO: 7851392 - DNA, 22 bp, Homo sapiens
ctctgccagtttctggcctcag

SEQ ID NO: 7851393 - DNA, 22 bp, Homo sapiens
ctctgccagtttctggcctcag

SEQ ID NO: 7851394 - DNA, 22 bp, Homo sapiens
ctctgccagtttctggcctcag

SEQ ID NO: 7851395 - DNA, 22 bp, Homo sapiens
ctctgccatcagtttttctttg

SEQ ID NO: 7851396 - DNA, 22 bp, Homo sapiens
ctctgccatctcactgggtcct

SEQ ID NO: 7851397 - DNA, 22 bp, Homo sapiens
ctctgccatcttggagctcaag

SEQ ID NO: 7851398 - DNA, 22 bp, Homo sapiens
ctctgccatcttggagctcaag

SEQ ID NO: 7851399 - DNA, 22 bp, Homo sapiens
ctctgccatcttggagctcaag

SEQ ID NO: 7851400 - DNA, 22 bp, Homo sapiens
ctctgccatcttggagctcaag

SEQ ID NO: 7851401 - DNA, 22 bp, Homo sapiens
ctctgccatttatcagaactgt

SEQ ID NO: 7851402 - DNA, 22 bp, Homo sapiens
ctctgccatttatcagaactgt

SEQ ID NO: 7851403 - DNA, 22 bp, Homo sapiens
ctctgcccacgtcttgcccaga

SEQ ID NO: 7851404 - DNA, 22 bp, Homo sapiens
ctctgcccacgtcttgcccaga

SEQ ID NO: 7851405 - DNA, 22 bp, Homo sapiens
ctctgcccacgtcttgcccaga

SEQ ID NO: 7851406 - DNA, 21 bp, Homo sapiens
ctctgcccagggcctcctgcc

SEQ ID NO: 7851407 - DNA, 21 bp, Homo sapiens
ctctgcccagggcctcctgcc

SEQ ID NO: 7851408 - DNA, 21 bp, Homo sapiens
ctctgcccagggcctcctgcc

SEQ ID NO: 7851409 - DNA, 20 bp, Homo sapiens
ctctgcagcaaggcctgggt

SEQ ID NO: 7851410 - DNA, 22 bp, Homo sapiens
tttcctttccaaaattctgcct

SEQ ID NO: 7851411 - DNA, 22 bp, Homo sapiens
tttcctttccaaaattctgcct

SEQ ID NO: 7851412 - DNA, 22 bp, Homo sapiens
ctctgccaagatgacaggtaag

SEQ ID NO: 7851413 - DNA, 22 bp, Homo sapiens
ctctgccaagatgacaggtaag

SEQ ID NO: 7851414 - DNA, 20 bp, Homo sapiens
ctctgcagcaaggcctgggt

SEQ ID NO: 7851415 - DNA, 22 bp, Homo sapiens
ctctgccaagatgacaggtaag

SEQ ID NO: 7851416 - DNA, 22 bp, Homo sapiens
ctctgccaccatgcttcctgac

SEQ ID NO: 7851417 - DNA, 22 bp, Homo sapiens
ctctgccaccatgcttcctgac

SEQ ID NO: 7851418 - DNA, 22 bp, Homo sapiens
ctctgccactcgaagtcaagga

SEQ ID NO: 7851419 - DNA, 22 bp, Homo sapiens
ctctgccactcgaagtcaagga

SEQ ID NO: 7851420 - DNA, 20 bp, Homo sapiens
tttcctttcattttagtacc

SEQ ID NO: 7851421 - DNA, 20 bp, Homo sapiens
tttcctttcattttagtacc

SEQ ID NO: 7851422 - DNA, 20 bp, Homo sapiens
tttcctttcattttagtacc

SEQ ID NO: 7851423 - DNA, 22 bp, Homo sapiens
tttcctttatgacatcaccact

SEQ ID NO: 7851424 - DNA, 20 bp, Homo sapiens
tttcctttcattttagtacc

SEQ ID NO: 7851425 - DNA, 22 bp, Homo sapiens
tttcctttatgacatcaccact

SEQ ID NO: 7851426 - DNA, 22 bp, Homo sapiens
tttccttgttattatttgtcct

SEQ ID NO: 7851427 - DNA, 22 bp, Homo sapiens
tttccttgttattatttgtcct

SEQ ID NO: 7851428 - DNA, 22 bp, Homo sapiens
tttccttgttattatttgtcct

SEQ ID NO: 7851429 - DNA, 22 bp, Homo sapiens
tttcctttatgacatcaccact

SEQ ID NO: 7851430 - DNA, 22 bp, Homo sapiens
tttcctttatgacatcaccact

SEQ ID NO: 7851431 - DNA, 22 bp, Homo sapiens
tttccttgttcatttgccctat

SEQ ID NO: 7851432 - DNA, 22 bp, Homo sapiens
tttccttgttcatttgccctat

SEQ ID NO: 7851433 - DNA, 22 bp, Homo sapiens
tttgctctgacagtgccagaga

SEQ ID NO: 7851434 - DNA, 22 bp, Homo sapiens
tttgctctgacagtgccagaga

SEQ ID NO: 7851435 - DNA, 22 bp, Homo sapiens
tttgctatttttctgtgcagct

SEQ ID NO: 7851436 - DNA, 22 bp, Homo sapiens
tttgctctgacagtgccagaga

SEQ ID NO: 7851437 - DNA, 22 bp, Homo sapiens
tttgctatttttctgtgcagct

SEQ ID NO: 7851438 - DNA, 22 bp, Homo sapiens
tttgctctgctgttgccaggtg

SEQ ID NO: 7851439 - DNA, 22 bp, Homo sapiens
tttgctcttatgaacaaggtgg

SEQ ID NO: 7851440 - DNA, 22 bp, Homo sapiens
tttgctcttgctggaaaagttg

SEQ ID NO: 7851441 - DNA, 20 bp, Homo sapiens
ctctgctttaggagagtcag

SEQ ID NO: 7851442 - DNA, 20 bp, Homo sapiens
ctctgctttccacctttcag

SEQ ID NO: 7851443 - DNA, 20 bp, Homo sapiens
ctctgctttccacctttcag

SEQ ID NO: 7851444 - DNA, 20 bp, Homo sapiens
ctctgctttccacctttcag

SEQ ID NO: 7851445 - DNA, 22 bp, Homo sapiens
ctctgctttcctcttacacact

SEQ ID NO: 7851446 - DNA, 22 bp, Homo sapiens
ctctgctttcctcttacacact

SEQ ID NO: 7851447 - DNA, 22 bp, Homo sapiens
ctctgctttgtaagttgtgagg

SEQ ID NO: 7851448 - DNA, 22 bp, Homo sapiens
ctctgctttgtaagttgtgagg

SEQ ID NO: 7851449 - DNA, 22 bp, Homo sapiens
ctctggaaaaccactagcagga

SEQ ID NO: 7851450 - DNA, 22 bp, Homo sapiens
ctctggaaaaccactagcagga

SEQ ID NO: 7851451 - DNA, 22 bp, Homo sapiens
ctctggaaaaccactagcagga

SEQ ID NO: 7851452 - DNA, 22 bp, Homo sapiens
ctctgctttttaaaaggagtcc

SEQ ID NO: 7851453 - DNA, 22 bp, Homo sapiens
ctctggaaatggccatagtcat

SEQ ID NO: 7851454 - DNA, 22 bp, Homo sapiens
ctctggaaatggccatagtcat

SEQ ID NO: 7851455 - DNA, 22 bp, Homo sapiens
ctctggaaaattgtgtgggggt

SEQ ID NO: 7851456 - DNA, 22 bp, Homo sapiens
ctctggaaaaccactagcagga

SEQ ID NO: 7851457 - DNA, 22 bp, Homo sapiens
ctctggaaaaccactagcagga

SEQ ID NO: 7851458 - DNA, 22 bp, Homo sapiens
tttgccaggtaagtactatgct

SEQ ID NO: 7851459 - DNA, 19 bp, Homo sapiens
tttgccacttctacctacc

SEQ ID NO: 7851460 - DNA, 22 bp, Homo sapiens
tttgccagtattttattgatga

SEQ ID NO: 7851461 - DNA, 22 bp, Homo sapiens
tttgccaggtaagtactatgct

SEQ ID NO: 7851462 - DNA, 22 bp, Homo sapiens
tttgccctttctgagcctcatc

SEQ ID NO: 7851463 - DNA, 22 bp, Homo sapiens
tttgccctggagtcaggataca

SEQ ID NO: 7851464 - DNA, 20 bp, Homo sapiens
tttgcccttcctctgccttt

SEQ ID NO: 7851465 - DNA, 22 bp, Homo sapiens
tttgcctgggaattctagtgta

SEQ ID NO: 7851466 - DNA, 22 bp, Homo sapiens
tttgcctgggaattctagtgta

SEQ ID NO: 7851467 - DNA, 21 bp, Homo sapiens
tttgccttcacgaagcatcct

SEQ ID NO: 7851468 - DNA, 22 bp, Homo sapiens
tttgcctgggaattctagtgta

SEQ ID NO: 7851469 - DNA, 22 bp, Homo sapiens
tttgcctgggaattctagtgta

SEQ ID NO: 7851470 - DNA, 19 bp, Homo sapiens
tttgcctgtataccctgtg

SEQ ID NO: 7851471 - DNA, 21 bp, Homo sapiens
tttgccttcacgaagcatcct

SEQ ID NO: 7851472 - DNA, 21 bp, Homo sapiens
tttgccttcacgaagcatcct

SEQ ID NO: 7851473 - DNA, 22 bp, Homo sapiens
tttgccttctctgaacctattt

SEQ ID NO: 7851474 - DNA, 22 bp, Homo sapiens
tttgccttctctgaacctattt

SEQ ID NO: 7851475 - DNA, 19 bp, Homo sapiens
tttgccttgcagctgtgtg

SEQ ID NO: 7851476 - DNA, 22 bp, Homo sapiens
tttgctattgtgaatagtgcca

SEQ ID NO: 7851477 - DNA, 22 bp, Homo sapiens
tttgctattgtgaatagtgcca

SEQ ID NO: 7851478 - DNA, 22 bp, Homo sapiens
tttgctatttttctgtgcagct

SEQ ID NO: 7851479 - DNA, 22 bp, Homo sapiens
tttgctataaaagggtcacacg

SEQ ID NO: 7851480 - DNA, 22 bp, Homo sapiens
tttgccttctctgaacctattt

SEQ ID NO: 7851481 - DNA, 20 bp, Homo sapiens
tttgcgaggccaaggcgggc

SEQ ID NO: 7851482 - DNA, 20 bp, Homo sapiens
tttgcgaggccaaggcgggc

SEQ ID NO: 7851483 - DNA, 20 bp, Homo sapiens
tttgcgaggccaaggcgggc

SEQ ID NO: 7851484 - DNA, 19 bp, Homo sapiens
tttgccttgcagctgtgtg

SEQ ID NO: 7851485 - DNA, 22 bp, Homo sapiens
tttgctagtacacagctgtttc

SEQ ID NO: 7851486 - DNA, 22 bp, Homo sapiens
tttgctaaataagtgattaagt

SEQ ID NO: 7851487 - DNA, 22 bp, Homo sapiens
tttgggaatctttgtgcatgac

SEQ ID NO: 7851488 - DNA, 22 bp, Homo sapiens
tttgggaattgtagctgtcttg

SEQ ID NO: 7851489 - DNA, 18 bp, Homo sapiens
tttgggatcctcttttct

SEQ ID NO: 7851490 - DNA, 22 bp, Homo sapiens
tttgggaagtttaaaataagta

SEQ ID NO: 7851491 - DNA, 22 bp, Homo sapiens
tttgggaataattgcacagatt

SEQ ID NO: 7851492 - DNA, 22 bp, Homo sapiens
tttgggcaattcagtgggacct

SEQ ID NO: 7851493 - DNA, 22 bp, Homo sapiens
tttgggcaagctcactgattca

SEQ ID NO: 7851494 - DNA, 22 bp, Homo sapiens
tttgggcaagctcactgattca

SEQ ID NO: 7851495 - DNA, 22 bp, Homo sapiens
tttgggcaaggtccagattcct

SEQ ID NO: 7851496 - DNA, 22 bp, Homo sapiens
tttgggcaaggtccagattcct

SEQ ID NO: 7851497 - DNA, 22 bp, Homo sapiens
tttgggcaaaggtagaaggaga

SEQ ID NO: 7851498 - DNA, 21 bp, Homo sapiens
tttgggcaaaattaaatgaga

SEQ ID NO: 7851499 - DNA, 22 bp, Homo sapiens
tttgggcaaaggtagaaggaga

SEQ ID NO: 7851500 - DNA, 21 bp, Homo sapiens
tttgggcaaaattaaatgaga

SEQ ID NO: 7851501 - DNA, 22 bp, Homo sapiens
tttgggatgctagacacctcag

SEQ ID NO: 7851502 - DNA, 22 bp, Homo sapiens
tttgggattttacattgtatgg

SEQ ID NO: 7851503 - DNA, 22 bp, Homo sapiens
tttgggaagtgggagcaaggtg

SEQ ID NO: 7851504 - DNA, 22 bp, Homo sapiens
tttgggaaggcagacatcccac

SEQ ID NO: 7851505 - DNA, 22 bp, Homo sapiens
tttgggaagaggaatctctgga

SEQ ID NO: 7851506 - DNA, 22 bp, Homo sapiens
tttgggaagaggaatctctgga

SEQ ID NO: 7851507 - DNA, 19 bp, Homo sapiens
tttgggaagcccagagtgt

SEQ ID NO: 7851508 - DNA, 22 bp, Homo sapiens
tttgggaactggacttcctgct

SEQ ID NO: 7851509 - DNA, 22 bp, Homo sapiens
tttgggaagaagttgcaaattt

SEQ ID NO: 7851510 - DNA, 22 bp, Homo sapiens
tttgggaagaagttgcaaattt

SEQ ID NO: 7851511 - DNA, 22 bp, Homo sapiens
tttgggaactggacttcctgct

SEQ ID NO: 7851512 - DNA, 22 bp, Homo sapiens
ctctggaagatgacctgggtaa

SEQ ID NO: 7851513 - DNA, 22 bp, Homo sapiens
ctctggaagtgatggcaggtca

SEQ ID NO: 7851514 - DNA, 22 bp, Homo sapiens
ctctggaagtgatggcaggtca

SEQ ID NO: 7851515 - DNA, 20 bp, Homo sapiens
ctctggaagagtttaaatgg

SEQ ID NO: 7851516 - DNA, 20 bp, Homo sapiens
ctctggaagagtttaaatgg

SEQ ID NO: 7851517 - DNA, 22 bp, Homo sapiens
ctctggaagaatacacttagaa

SEQ ID NO: 7851518 - DNA, 22 bp, Homo sapiens
ctctggaagaatacacttagaa

SEQ ID NO: 7851519 - DNA, 22 bp, Homo sapiens
ctctggaagaatacacttagaa

SEQ ID NO: 7851520 - DNA, 22 bp, Homo sapiens
ctctggaatgtttacatgccct

SEQ ID NO: 7851521 - DNA, 22 bp, Homo sapiens
ctctggaatgggtgtttctaac

SEQ ID NO: 7851522 - DNA, 22 bp, Homo sapiens
ctctggaatgggtgtttctaac

SEQ ID NO: 7851523 - DNA, 22 bp, Homo sapiens
ctctggaatgtttacatgccct

SEQ ID NO: 7851524 - DNA, 22 bp, Homo sapiens
ctctggaattaaggaagcctgt

SEQ ID NO: 7851525 - DNA, 22 bp, Homo sapiens
tttgggaaatagtagaaaatgt

SEQ ID NO: 7851526 - DNA, 22 bp, Homo sapiens
tttgggaaatattgtgttcaag

SEQ ID NO: 7851527 - DNA, 22 bp, Homo sapiens
tttggaattggtggaggaaggg

SEQ ID NO: 7851528 - DNA, 22 bp, Homo sapiens
ctctggaattaaggaagcctgt

SEQ ID NO: 7851529 - DNA, 22 bp, Homo sapiens
ctctggaattaaggaagcctgt

SEQ ID NO: 7851530 - DNA, 22 bp, Homo sapiens
tttggaattggcattctattct

SEQ ID NO: 7851531 - DNA, 22 bp, Homo sapiens
tttggaattggcattctattct

SEQ ID NO: 7851532 - DNA, 22 bp, Homo sapiens
ctcttcatgtgtttaattttta

SEQ ID NO: 7851533 - DNA, 22 bp, Homo sapiens
ctcttcattagttcctgtccca

SEQ ID NO: 7851534 - DNA, 22 bp, Homo sapiens
ctcttcattagttcctgtccca

SEQ ID NO: 7851535 - DNA, 22 bp, Homo sapiens
ctcttcatagcaaacatatggg

SEQ ID NO: 7851536 - DNA, 22 bp, Homo sapiens
ctcttccacctccttcaggaga

SEQ ID NO: 7851537 - DNA, 22 bp, Homo sapiens
ctcttccacctccttcaggaga

SEQ ID NO: 7851538 - DNA, 22 bp, Homo sapiens
ctcttccatttctacttcacag

SEQ ID NO: 7851539 - DNA, 22 bp, Homo sapiens
ctcttccacctccttcaggaga

SEQ ID NO: 7851540 - DNA, 22 bp, Homo sapiens
ctcttcattagttcctgtccca

SEQ ID NO: 7851541 - DNA, 22 bp, Homo sapiens
ctcttccacctccttcaggaga

SEQ ID NO: 7851542 - DNA, 22 bp, Homo sapiens
ctcttccatattactcagggta

SEQ ID NO: 7851543 - DNA, 22 bp, Homo sapiens
ctcttccatattactcagggta

SEQ ID NO: 7851544 - DNA, 21 bp, Homo sapiens
ctcttcagtggtgagctcttc

SEQ ID NO: 7851545 - DNA, 21 bp, Homo sapiens
ctcttcagtggtgagctcttc

SEQ ID NO: 7851546 - DNA, 22 bp, Homo sapiens
ctcttcagtaaatgacactgtt

SEQ ID NO: 7851547 - DNA, 21 bp, Homo sapiens
ctcttcagtggtgagctcttc

SEQ ID NO: 7851548 - DNA, 22 bp, Homo sapiens
ctcttcatagcaaacatatggg

SEQ ID NO: 7851549 - DNA, 22 bp, Homo sapiens
ctcttcaggatggcttgtgatg

SEQ ID NO: 7851550 - DNA, 22 bp, Homo sapiens
ctcttcaggaatatgtcagtca

SEQ ID NO: 7851551 - DNA, 22 bp, Homo sapiens
ctcttcagcaatgctttagtcc

SEQ ID NO: 7851552 - DNA, 22 bp, Homo sapiens
ctcttcaggaatatgtcagtca

SEQ ID NO: 7851553 - DNA, 22 bp, Homo sapiens
ctcttcaggtttctgctctgga

SEQ ID NO: 7851554 - DNA, 22 bp, Homo sapiens
ctcttcagtaaatgacactgtt

SEQ ID NO: 7851555 - DNA, 22 bp, Homo sapiens
ctcttcagtaaatgacactgtt

SEQ ID NO: 7851556 - DNA, 22 bp, Homo sapiens
ctcttcaggtttctgctctgga

SEQ ID NO: 7851557 - DNA, 22 bp, Homo sapiens
ctcttcaggtttctgctctgga

SEQ ID NO: 7851558 - DNA, 22 bp, Homo sapiens
ctcttcagatatacagtactct

SEQ ID NO: 7851559 - DNA, 22 bp, Homo sapiens
ctcttcagcctatttgagtgca

SEQ ID NO: 7851560 - DNA, 22 bp, Homo sapiens
ctcttcagataaaagggatatt

SEQ ID NO: 7851561 - DNA, 22 bp, Homo sapiens
ctcttcactgagataatcctag

SEQ ID NO: 7851562 - DNA, 22 bp, Homo sapiens
ctcttcactgagataatcctag

SEQ ID NO: 7851563 - DNA, 22 bp, Homo sapiens
ctcttcactgagataatcctag

SEQ ID NO: 7851564 - DNA, 22 bp, Homo sapiens
ctcttcaactgccaggcagtct

SEQ ID NO: 7851565 - DNA, 22 bp, Homo sapiens
ctcttcaaaagtctaatcctta

SEQ ID NO: 7851566 - DNA, 22 bp, Homo sapiens
ctcttcaaatgatttccttagg

SEQ ID NO: 7851567 - DNA, 22 bp, Homo sapiens
ctcttattttatggcatttgtg

SEQ ID NO: 7851568 - DNA, 22 bp, Homo sapiens
ctcttattttatggcatttgtg

SEQ ID NO: 7851569 - DNA, 22 bp, Homo sapiens
ctcttcaaaagatgtattagaa

SEQ ID NO: 7851570 - DNA, 20 bp, Homo sapiens
ctcttattgcattagtttct

SEQ ID NO: 7851571 - DNA, 22 bp, Homo sapiens
ctcttattttatggcatttgtg

SEQ ID NO: 7851572 - DNA, 22 bp, Homo sapiens
ctcttatacatatttttaggcg

SEQ ID NO: 7851573 - DNA, 22 bp, Homo sapiens
ctcttattcctacagtaacagg

SEQ ID NO: 7851574 - DNA, 22 bp, Homo sapiens
ctcttatagacactcttctata

SEQ ID NO: 7851575 - DNA, 22 bp, Homo sapiens
ctcttattcctacagtaacagg

SEQ ID NO: 7851576 - DNA, 22 bp, Homo sapiens
ctcttattcctacagtaacagg

SEQ ID NO: 7851577 - DNA, 22 bp, Homo sapiens
ctcttattcctacagtaacagg

SEQ ID NO: 7851578 - DNA, 22 bp, Homo sapiens
ctcttattgatgaaggtgctaa

SEQ ID NO: 7851579 - DNA, 22 bp, Homo sapiens
ctcttattgatgaaggtgctaa

SEQ ID NO: 7851580 - DNA, 22 bp, Homo sapiens
ctcttattgatgaaggtgctaa

SEQ ID NO: 7851581 - DNA, 22 bp, Homo sapiens
ctcttattgatgaaggtgctaa

SEQ ID NO: 7851582 - DNA, 22 bp, Homo sapiens
ctcttattgatgaaggtgctaa

SEQ ID NO: 7851583 - DNA, 23 bp, Homo sapiens
ttttagtgactcctttatctgcc

SEQ ID NO: 7851584 - DNA, 23 bp, Homo sapiens
ttttagtgactcctttatctgcc

SEQ ID NO: 7851585 - DNA, 23 bp, Homo sapiens
ttttagtgactcctttatctgcc

SEQ ID NO: 7851586 - DNA, 22 bp, Homo sapiens
ctctgtttctcagcctatttcc

SEQ ID NO: 7851587 - DNA, 22 bp, Homo sapiens
ctcttagtttgtaaaaataatt

SEQ ID NO: 7851588 - DNA, 22 bp, Homo sapiens
ctctgtttctcagcctatttcc

SEQ ID NO: 7851589 - DNA, 22 bp, Homo sapiens
ctcttagtttatctttgacaaa

SEQ ID NO: 7851590 - DNA, 18 bp, Homo sapiens
ctctgtgttggtgtgaag

SEQ ID NO: 7851591 - DNA, 22 bp, Homo sapiens
ttttcagtgggcaatgatgtga

SEQ ID NO: 7851592 - DNA, 22 bp, Homo sapiens
ttttcagtgggcaatgatgtga

SEQ ID NO: 7851593 - DNA, 22 bp, Homo sapiens
ttttcagtggcttgcatatgtt

SEQ ID NO: 7851594 - DNA, 22 bp, Homo sapiens
ttttcagtaatgtctacataat

SEQ ID NO: 7851595 - DNA, 22 bp, Homo sapiens
ttttcaggccagaagatagacc

SEQ ID NO: 7851596 - DNA, 22 bp, Homo sapiens
ttttcagctaagtcacacgctg

SEQ ID NO: 7851597 - DNA, 22 bp, Homo sapiens
ttttcagaggcctaagaggttt

SEQ ID NO: 7851598 - DNA, 22 bp, Homo sapiens
ttttcagaggcctaagaggttt

SEQ ID NO: 7851599 - DNA, 22 bp, Homo sapiens
ttttcagaattagcataccatt

SEQ ID NO: 7851600 - DNA, 22 bp, Homo sapiens
ttttcacttaaggaatttcatg

SEQ ID NO: 7851601 - DNA, 22 bp, Homo sapiens
ttttcagaaagatgagaaatta

SEQ ID NO: 7851602 - DNA, 22 bp, Homo sapiens
ttttcagaaagatgagaaatta

SEQ ID NO: 7851603 - DNA, 22 bp, Homo sapiens
ttttcagagagcttttatgtcc

SEQ ID NO: 7851604 - DNA, 22 bp, Homo sapiens
ttttcagagagcttttatgtcc

SEQ ID NO: 7851605 - DNA, 22 bp, Homo sapiens
ctcttcccagctccacgagagg

SEQ ID NO: 7851606 - DNA, 22 bp, Homo sapiens
ttttcacttaaggaatttcatg

SEQ ID NO: 7851607 - DNA, 22 bp, Homo sapiens
ttttcacttaaggaatttcatg

SEQ ID NO: 7851608 - DNA, 22 bp, Homo sapiens
ttttcagttatagaatggtaga

SEQ ID NO: 7851609 - DNA, 22 bp, Homo sapiens
ttttcagttactgtttatgtga

SEQ ID NO: 7851610 - DNA, 22 bp, Homo sapiens
ttttcagttactgtttatgtga

SEQ ID NO: 7851611 - DNA, 22 bp, Homo sapiens
ttttcagttactgtttatgtga

SEQ ID NO: 7851612 - DNA, 22 bp, Homo sapiens
ttttcagtggtatctttgtaaa

SEQ ID NO: 7851613 - DNA, 22 bp, Homo sapiens
ttttcagtggtatctttgtaaa

SEQ ID NO: 7851614 - DNA, 22 bp, Homo sapiens
ctcttcttgcctgatgaggcag

SEQ ID NO: 7851615 - DNA, 22 bp, Homo sapiens
ctcttcttggaatgctgactgt

SEQ ID NO: 7851616 - DNA, 22 bp, Homo sapiens
ctcttgtttcctttctgcagtc

SEQ ID NO: 7851617 - DNA, 22 bp, Homo sapiens
ctctttaactcccattctgtcc

SEQ ID NO: 7851618 - DNA, 22 bp, Homo sapiens
ctctttaaagtaaaatttgtct

SEQ ID NO: 7851619 - DNA, 22 bp, Homo sapiens
ctctttaagctcctaacagcca

SEQ ID NO: 7851620 - DNA, 22 bp, Homo sapiens
ctctttactgctactacaaaga

SEQ ID NO: 7851621 - DNA, 22 bp, Homo sapiens
ctctttactgctactacaaaga

SEQ ID NO: 7851622 - DNA, 22 bp, Homo sapiens
ctctttagtcacagggcttcat

SEQ ID NO: 7851623 - DNA, 22 bp, Homo sapiens
ctctttagtctgtgtggagaag

SEQ ID NO: 7851624 - DNA, 22 bp, Homo sapiens
ctctttagtcacagggcttcat

SEQ ID NO: 7851625 - DNA, 22 bp, Homo sapiens
ctctttagtctgtgtggagaag

SEQ ID NO: 7851626 - DNA, 22 bp, Homo sapiens
ctctttagtggtgatgatgcta

SEQ ID NO: 7851627 - DNA, 22 bp, Homo sapiens
ttttagattgggaaatgtaaag

SEQ ID NO: 7851628 - DNA, 22 bp, Homo sapiens
ttttagattgggaaatgtaaag

SEQ ID NO: 7851629 - DNA, 22 bp, Homo sapiens
ttttagattgggaaatgtaaag

SEQ ID NO: 7851630 - DNA, 22 bp, Homo sapiens
ttttagcacactttctttagcg

SEQ ID NO: 7851631 - DNA, 22 bp, Homo sapiens
ttttagcactaagtgatatgct

SEQ ID NO: 7851632 - DNA, 22 bp, Homo sapiens
ttttagcacactttctttagcg

SEQ ID NO: 7851633 - DNA, 22 bp, Homo sapiens
ttttagctgttgattgttcccc

SEQ ID NO: 7851634 - DNA, 20 bp, Homo sapiens
ttttagcagaaagaaagctc

SEQ ID NO: 7851635 - DNA, 20 bp, Homo sapiens
ttttagcacttgttatggtg

SEQ ID NO: 7851636 - DNA, 22 bp, Homo sapiens
ttttagcactaagtgatatgct

SEQ ID NO: 7851637 - DNA, 22 bp, Homo sapiens
ttttagcactaagtgatatgct

SEQ ID NO: 7851638 - DNA, 22 bp, Homo sapiens
ttttagattgggaaatgtaaag

SEQ ID NO: 7851639 - DNA, 22 bp, Homo sapiens
ttttagattataagtctaattc

SEQ ID NO: 7851640 - DNA, 22 bp, Homo sapiens
ttttagattataagtctaattc

SEQ ID NO: 7851641 - DNA, 22 bp, Homo sapiens
ttttagattataagtctaattc

SEQ ID NO: 7851642 - DNA, 22 bp, Homo sapiens
ttttagatagtttaactgcact

SEQ ID NO: 7851643 - DNA, 22 bp, Homo sapiens
ttttaatactgctattgtagga

SEQ ID NO: 7851644 - DNA, 22 bp, Homo sapiens
ttttagaatcaggttgtctggg

SEQ ID NO: 7851645 - DNA, 22 bp, Homo sapiens
ttttagaatcaggttgtctggg

SEQ ID NO: 7851646 - DNA, 22 bp, Homo sapiens
ttttagaatcaggttgtctggg

SEQ ID NO: 7851647 - DNA, 22 bp, Homo sapiens
ttttagaatcaggttgtctggg

SEQ ID NO: 7851648 - DNA, 22 bp, Homo sapiens
ttttagactccatctgattcag

SEQ ID NO: 7851649 - DNA, 22 bp, Homo sapiens
ttttagacttgtatgtaaagcc

SEQ ID NO: 7851650 - DNA, 22 bp, Homo sapiens
ttttagatagtttaactgcact

SEQ ID NO: 7851651 - DNA, 22 bp, Homo sapiens
ttttagatagtttaactgcact

SEQ ID NO: 7851652 - DNA, 22 bp, Homo sapiens
ttttaatactgctattgtagga

SEQ ID NO: 7851653 - DNA, 22 bp, Homo sapiens
ttttaatactgctattgtagga

SEQ ID NO: 7851654 - DNA, 22 bp, Homo sapiens
ttttaagtttattccagtacat

SEQ ID NO: 7851655 - DNA, 22 bp, Homo sapiens
ttttaagttggattgctaagta

SEQ ID NO: 7851656 - DNA, 22 bp, Homo sapiens
ttttaagttggattgctaagta

SEQ ID NO: 7851657 - DNA, 22 bp, Homo sapiens
ttttaatactgctattgtagga

SEQ ID NO: 7851658 - DNA, 22 bp, Homo sapiens
ttttaatactgctattgtagga

SEQ ID NO: 7851659 - DNA, 22 bp, Homo sapiens
ttttaatactgctattgtagga

SEQ ID NO: 7851660 - DNA, 22 bp, Homo sapiens
ttttaatactgctattgtagga

SEQ ID NO: 7851661 - DNA, 22 bp, Homo sapiens
ttttaatactgctattgtagga

SEQ ID NO: 7851662 - DNA, 22 bp, Homo sapiens
ttttaatactgctattgtagga

SEQ ID NO: 7851663 - DNA, 22 bp, Homo sapiens
ttttaatactgctattgtagga

SEQ ID NO: 7851664 - DNA, 22 bp, Homo sapiens
ttttaagttaatataattgagg

SEQ ID NO: 7851665 - DNA, 19 bp, Homo sapiens
ttttaagtgccctttcttc

SEQ ID NO: 7851666 - DNA, 19 bp, Homo sapiens
ttttaagtgccctttcttc

SEQ ID NO: 7851667 - DNA, 22 bp, Homo sapiens
ttttaagtgcaatctgaatgcg

SEQ ID NO: 7851668 - DNA, 19 bp, Homo sapiens
ttttaagtcctctctattc

SEQ ID NO: 7851669 - DNA, 19 bp, Homo sapiens
ttttaagtcctctctattc

SEQ ID NO: 7851670 - DNA, 19 bp, Homo sapiens
ttttaagtcctctctattc

SEQ ID NO: 7851671 - DNA, 22 bp, Homo sapiens
ttttaagcaaaagaatggtgtg

SEQ ID NO: 7851672 - DNA, 22 bp, Homo sapiens
ttttaagctacaagagacatat

SEQ ID NO: 7851673 - DNA, 22 bp, Homo sapiens
tttgtacatataaatcttgtat

SEQ ID NO: 7851674 - DNA, 22 bp, Homo sapiens
tttgtacatataaatcttgtat

SEQ ID NO: 7851675 - DNA, 22 bp, Homo sapiens
tttgtacatataaatcttgtat

SEQ ID NO: 7851676 - DNA, 22 bp, Homo sapiens
tttgtacatataaatcttgtat

SEQ ID NO: 7851677 - DNA, 22 bp, Homo sapiens
tttgtacatataaatcttgtat

SEQ ID NO: 7851678 - DNA, 22 bp, Homo sapiens
tttgtacatatataaaatctgt

SEQ ID NO: 7851679 - DNA, 22 bp, Homo sapiens
tttgtacatatataaaatctgt

SEQ ID NO: 7851680 - DNA, 22 bp, Homo sapiens
tttgtacatatataaaatctgt

SEQ ID NO: 7851681 - DNA, 22 bp, Homo sapiens
tttgtacatcctaattctgagt

SEQ ID NO: 7851682 - DNA, 22 bp, Homo sapiens
tttgtacatatataaaatctgt

SEQ ID NO: 7851683 - DNA, 22 bp, Homo sapiens
tttgtacatcctaattctgagt

SEQ ID NO: 7851684 - DNA, 22 bp, Homo sapiens
tttgtacatatttgtggggcac

SEQ ID NO: 7851685 - DNA, 22 bp, Homo sapiens
tttgttctattttagagatgaa

SEQ ID NO: 7851686 - DNA, 22 bp, Homo sapiens
tttgttctattttagagatgaa

SEQ ID NO: 7851687 - DNA, 22 bp, Homo sapiens
tttgttctgaaaactcaagtcc

SEQ ID NO: 7851688 - DNA, 22 bp, Homo sapiens
tttgttctgaaaactcaagtcc

SEQ ID NO: 7851689 - DNA, 22 bp, Homo sapiens
ttttaagaactgttctgtgctt

SEQ ID NO: 7851690 - DNA, 22 bp, Homo sapiens
ttttaagaaatgtatgactgtc

SEQ ID NO: 7851691 - DNA, 22 bp, Homo sapiens
ttttaagaactgttctgtgctt

SEQ ID NO: 7851692 - DNA, 22 bp, Homo sapiens
ttttaagaactgttctgtgctt

SEQ ID NO: 7851693 - DNA, 22 bp, Homo sapiens
ttttaagatgctagtatttcag

SEQ ID NO: 7851694 - DNA, 22 bp, Homo sapiens
ttttaagatgctagtatttcag

SEQ ID NO: 7851695 - DNA, 22 bp, Homo sapiens
ttttaagatgctagtatttcag

SEQ ID NO: 7851696 - DNA, 22 bp, Homo sapiens
ttttaagaggaggctgtttgaa

SEQ ID NO: 7851697 - DNA, 22 bp, Homo sapiens
ttttaagaggaggctgtttgaa

SEQ ID NO: 7851698 - DNA, 22 bp, Homo sapiens
tttgtacacaggatgttataat

SEQ ID NO: 7851699 - DNA, 22 bp, Homo sapiens
tttgtacacaggatgttataat

SEQ ID NO: 7851700 - DNA, 22 bp, Homo sapiens
tttgtacacaggatgttataat

SEQ ID NO: 7851701 - DNA, 22 bp, Homo sapiens
tttgggcagaagctgaatgtct

SEQ ID NO: 7851702 - DNA, 22 bp, Homo sapiens
tttgggcagaagctgaatgtct

SEQ ID NO: 7851703 - DNA, 22 bp, Homo sapiens
tttgggcagaaacatgcgcccc

SEQ ID NO: 7851704 - DNA, 22 bp, Homo sapiens
tttgggcacacaaatattttat

SEQ ID NO: 7851705 - DNA, 22 bp, Homo sapiens
tttgggcaattcagtgggacct

SEQ ID NO: 7851706 - DNA, 22 bp, Homo sapiens
tttgggcacagatattaagtat

SEQ ID NO: 7851707 - DNA, 22 bp, Homo sapiens
tttgggcacacaaatattttat

SEQ ID NO: 7851708 - DNA, 20 bp, Homo sapiens
tttgggcacggctagatttt

SEQ ID NO: 7851709 - DNA, 22 bp, Homo sapiens
tttgggcacagatattaagtat

SEQ ID NO: 7851710 - DNA, 22 bp, Homo sapiens
tttgggcagaaacatgcgcccc

SEQ ID NO: 7851711 - DNA, 20 bp, Homo sapiens
tttgggcacggctagatttt

SEQ ID NO: 7851712 - DNA, 22 bp, Homo sapiens
tttgtacacaggtcattcaggg

SEQ ID NO: 7851713 - DNA, 22 bp, Homo sapiens
tttgtacacaggtcattcaggg

SEQ ID NO: 7851714 - DNA, 22 bp, Homo sapiens
tttgtacacctacctaatacag

SEQ ID NO: 7851715 - DNA, 22 bp, Homo sapiens
tttgtacacctacctaatacag

SEQ ID NO: 7851716 - DNA, 22 bp, Homo sapiens
tttgtacactgtctactatgaa

SEQ ID NO: 7851717 - DNA, 22 bp, Homo sapiens
tttgtacactgtctactatgaa

SEQ ID NO: 7851718 - DNA, 22 bp, Homo sapiens
tttgtacactgtctactatgaa

SEQ ID NO: 7851719 - DNA, 22 bp, Homo sapiens
tttgtacactgtctactatgaa

SEQ ID NO: 7851720 - DNA, 22 bp, Homo sapiens
tttgtacacaggtcattcaggg

SEQ ID NO: 7851721 - DNA, 22 bp, Homo sapiens
tttgtacactgtctactatgaa

SEQ ID NO: 7851722 - DNA, 22 bp, Homo sapiens
tttgtacactgtctactatgaa

SEQ ID NO: 7851723 - DNA, 22 bp, Homo sapiens
tttgtacactgtctactatgaa

SEQ ID NO: 7851724 - DNA, 22 bp, Homo sapiens
tttgtacaggtgcaggcatttg

SEQ ID NO: 7851725 - DNA, 23 bp, Homo sapiens
tttgtacagaattttgccttcag

SEQ ID NO: 7851726 - DNA, 22 bp, Homo sapiens
tttgtacaggtgcaggcatttg

SEQ ID NO: 7851727 - DNA, 22 bp, Homo sapiens
tttgtacaggtgcaggcatttg

SEQ ID NO: 7851728 - DNA, 22 bp, Homo sapiens
tttgtacaggtgcaggcatttg

SEQ ID NO: 7851729 - DNA, 22 bp, Homo sapiens
tttgtacagtgaaagcgaggtt

SEQ ID NO: 7851730 - DNA, 22 bp, Homo sapiens
tttgtacagtgatgttgtatgc

SEQ ID NO: 7851731 - DNA, 22 bp, Homo sapiens
tttgtacagtgatgttgtatgc

SEQ ID NO: 7851732 - DNA, 22 bp, Homo sapiens
tttgtacagtgaaagcgaggtt

SEQ ID NO: 7851733 - DNA, 22 bp, Homo sapiens
tttgtacagtgaaagcgaggtt

SEQ ID NO: 7851734 - DNA, 22 bp, Homo sapiens
tttgtacagtgatgttgtatgc

SEQ ID NO: 7851735 - DNA, 22 bp, Homo sapiens
ctgacatttactgagcacttac

SEQ ID NO: 7851736 - DNA, 22 bp, Homo sapiens
ctgaccagaccccaggaggctg

SEQ ID NO: 7851737 - DNA, 22 bp, Homo sapiens
ctgaccactgttctcctggggt

SEQ ID NO: 7851738 - DNA, 22 bp, Homo sapiens
ctgaccacaggcctctaacagc

SEQ ID NO: 7851739 - DNA, 22 bp, Homo sapiens
ctgacatgtataagctttaagt

SEQ ID NO: 7851740 - DNA, 19 bp, Homo sapiens
ctgacatcccaggtcagaa

SEQ ID NO: 7851741 - DNA, 22 bp, Homo sapiens
ctgacatttactgagcacttac

SEQ ID NO: 7851742 - DNA, 22 bp, Homo sapiens
ctgacaggttggtagctttgga

SEQ ID NO: 7851743 - DNA, 22 bp, Homo sapiens
ctgacagtctcattgatttgct

SEQ ID NO: 7851744 - DNA, 22 bp, Homo sapiens
ctgacaggttggtagctttgga

SEQ ID NO: 7851745 - DNA, 22 bp, Homo sapiens
ctgacaggttggtagctttgga

SEQ ID NO: 7851746 - DNA, 22 bp, Homo sapiens
ctgacagtgtacactgacagct

SEQ ID NO: 7851747 - DNA, 22 bp, Homo sapiens
ctgacagtttttgctgtattgt

SEQ ID NO: 7851748 - DNA, 22 bp, Homo sapiens
ctgacagtcttgccaagtttct

SEQ ID NO: 7851749 - DNA, 22 bp, Homo sapiens
ctgacagtcttgccaagtttct

SEQ ID NO: 7851750 - DNA, 22 bp, Homo sapiens
ctgaccagggtagaggtgagag

SEQ ID NO: 7851751 - DNA, 22 bp, Homo sapiens
ctgaccagccctgcccagggaa

SEQ ID NO: 7851752 - DNA, 20 bp, Homo sapiens
ctgaccagcagcctgtctcc

SEQ ID NO: 7851753 - DNA, 22 bp, Homo sapiens
ctgaccagggtagaggtgagag

SEQ ID NO: 7851754 - DNA, 22 bp, Homo sapiens
ctgaccagtccttagcacctgg

SEQ ID NO: 7851755 - DNA, 19 bp, Homo sapiens
ctgacccaggacaccacgg

SEQ ID NO: 7851756 - DNA, 22 bp, Homo sapiens
ctgacccagaggaactgcaaag

SEQ ID NO: 7851757 - DNA, 20 bp, Homo sapiens
ctgacccaatctctgtcccc

SEQ ID NO: 7851758 - DNA, 22 bp, Homo sapiens
ctgaccctggaggcatttctct

SEQ ID NO: 7851759 - DNA, 22 bp, Homo sapiens
ctgacagctgaattgcttgcat

SEQ ID NO: 7851760 - DNA, 22 bp, Homo sapiens
ctgacagctcctagtgctcact

SEQ ID NO: 7851761 - DNA, 22 bp, Homo sapiens
ctgacagattagatgtgcatat

SEQ ID NO: 7851762 - DNA, 22 bp, Homo sapiens
ctgacagctgttgcagtgaatg

SEQ ID NO: 7851763 - DNA, 22 bp, Homo sapiens
ctgacaggctgagatccctggt

SEQ ID NO: 7851764 - DNA, 22 bp, Homo sapiens
ctgacagggtagacagagggca

SEQ ID NO: 7851765 - DNA, 22 bp, Homo sapiens
ctgacagggtagacagagggca

SEQ ID NO: 7851766 - DNA, 22 bp, Homo sapiens
ctgacagatgctgctggcagta

SEQ ID NO: 7851767 - DNA, 22 bp, Homo sapiens
ctgacagatgctgctggcagta

SEQ ID NO: 7851768 - DNA, 22 bp, Homo sapiens
ctgacagattagatgtgcatat

SEQ ID NO: 7851769 - DNA, 22 bp, Homo sapiens
ctgacagatctggatctgaact

SEQ ID NO: 7851770 - DNA, 22 bp, Homo sapiens
ctgaatcatggtcattagttta

SEQ ID NO: 7851771 - DNA, 22 bp, Homo sapiens
ctgaatccacacaaggtgatgg

SEQ ID NO: 7851772 - DNA, 22 bp, Homo sapiens
ctgaatatcatttatcattggc

SEQ ID NO: 7851773 - DNA, 22 bp, Homo sapiens
ctgaatattagtcatgtctgat

SEQ ID NO: 7851774 - DNA, 22 bp, Homo sapiens
ctgaatcatgccattttgctta

SEQ ID NO: 7851775 - DNA, 22 bp, Homo sapiens
ctgaatattagtcatgtctgat

SEQ ID NO: 7851776 - DNA, 22 bp, Homo sapiens
ctctttctcgccgcccgcagtc

SEQ ID NO: 7851777 - DNA, 22 bp, Homo sapiens
ctctttctcgccgcccgcagtc

SEQ ID NO: 7851778 - DNA, 22 bp, Homo sapiens
ctctttctcattgtcagcagaa

SEQ ID NO: 7851779 - DNA, 22 bp, Homo sapiens
ctctttctcattgtcagcagaa

SEQ ID NO: 7851780 - DNA, 22 bp, Homo sapiens
ctctttctgattcgctgggacc

SEQ ID NO: 7851781 - DNA, 22 bp, Homo sapiens
ctctttctgattcgctgggacc

SEQ ID NO: 7851782 - DNA, 22 bp, Homo sapiens
ctctttctgattcgctgggacc

SEQ ID NO: 7851783 - DNA, 22 bp, Homo sapiens
ctctttctgattcgctgggacc

SEQ ID NO: 7851784 - DNA, 22 bp, Homo sapiens
ctctttctgattcgctgggacc

SEQ ID NO: 7851785 - DNA, 22 bp, Homo sapiens
ctctttcctcgatgggctcctg

SEQ ID NO: 7851786 - DNA, 22 bp, Homo sapiens
ctctttcctcgatgggctcctg

SEQ ID NO: 7851787 - DNA, 22 bp, Homo sapiens
ctctttcctcgatgggctcctg

SEQ ID NO: 7851788 - DNA, 22 bp, Homo sapiens
ctctttcctcagccacagtcta

SEQ ID NO: 7851789 - DNA, 22 bp, Homo sapiens
ctctttcctcagccacagtcta

SEQ ID NO: 7851790 - DNA, 22 bp, Homo sapiens
ctctttcctcagccacagtcta

SEQ ID NO: 7851791 - DNA, 17 bp, Homo sapiens
ctctttataaagagtta

SEQ ID NO: 7851792 - DNA, 17 bp, Homo sapiens
ctctttataaagagtta

SEQ ID NO: 7851793 - DNA, 22 bp, Homo sapiens
ctctttagtggtgatgatgcta

SEQ ID NO: 7851794 - DNA, 22 bp, Homo sapiens
ctctttagtttgaaatccacat

SEQ ID NO: 7851795 - DNA, 21 bp, Homo sapiens
ctctttatatagtaaagatat

SEQ ID NO: 7851796 - DNA, 21 bp, Homo sapiens
ctctttatatagtaaagatat

SEQ ID NO: 7851797 - DNA, 22 bp, Homo sapiens
ctctttagtttgaaatccacat

SEQ ID NO: 7851798 - DNA, 19 bp, Homo sapiens
ctctttccattgtatttgc

SEQ ID NO: 7851799 - DNA, 22 bp, Homo sapiens
ctctttccagggtaccccaggt

SEQ ID NO: 7851800 - DNA, 22 bp, Homo sapiens
ctctttccagggtaccccaggt

SEQ ID NO: 7851801 - DNA, 22 bp, Homo sapiens
ctctttccagggtaccccaggt

SEQ ID NO: 7851802 - DNA, 22 bp, Homo sapiens
ctctttcagttctgatagtctc

SEQ ID NO: 7851803 - DNA, 22 bp, Homo sapiens
ctctttcagttctgatagtctc

SEQ ID NO: 7851804 - DNA, 22 bp, Homo sapiens
ctctttcagttctgatagtctc

SEQ ID NO: 7851805 - DNA, 22 bp, Homo sapiens
ctctttggccagaaaatgtttt

SEQ ID NO: 7851806 - DNA, 22 bp, Homo sapiens
ctctttggccagaaaatgtttt

SEQ ID NO: 7851807 - DNA, 22 bp, Homo sapiens
ctctttggatgtttatgataag

SEQ ID NO: 7851808 - DNA, 22 bp, Homo sapiens
ctctttggatgtttatgataag

SEQ ID NO: 7851809 - DNA, 22 bp, Homo sapiens
ctctttggatgtttatgataag

SEQ ID NO: 7851810 - DNA, 22 bp, Homo sapiens
ctctttggatagaattacaaag

SEQ ID NO: 7851811 - DNA, 22 bp, Homo sapiens
ctctttggatgtttatgataag

SEQ ID NO: 7851812 - DNA, 19 bp, Homo sapiens
ctctttggagatccttgga

SEQ ID NO: 7851813 - DNA, 22 bp, Homo sapiens
ctctttggagaagcacgtatta

SEQ ID NO: 7851814 - DNA, 19 bp, Homo sapiens
ctctttggagatccttgga

SEQ ID NO: 7851815 - DNA, 22 bp, Homo sapiens
ctctttggatagaattacaaag

SEQ ID NO: 7851816 - DNA, 22 bp, Homo sapiens
ctctttggatagaattacaaag

SEQ ID NO: 7851817 - DNA, 22 bp, Homo sapiens
ctctttggatagaattacaaag

SEQ ID NO: 7851818 - DNA, 22 bp, Homo sapiens
ctctttggatagaattacaaag

SEQ ID NO: 7851819 - DNA, 22 bp, Homo sapiens
ctctttggagaagcacgtatta

SEQ ID NO: 7851820 - DNA, 22 bp, Homo sapiens
ctctttggagaagcacgtatta

SEQ ID NO: 7851821 - DNA, 22 bp, Homo sapiens
ctctttgacgtgcccatgtccc

SEQ ID NO: 7851822 - DNA, 20 bp, Homo sapiens
ctctttgaaatgctcttggg

SEQ ID NO: 7851823 - DNA, 20 bp, Homo sapiens
ctctttgaaatgctcttggg

SEQ ID NO: 7851824 - DNA, 22 bp, Homo sapiens
ctctttgaaatccatcactgct

SEQ ID NO: 7851825 - DNA, 20 bp, Homo sapiens
ctctttgaaatgctcttggg

SEQ ID NO: 7851826 - DNA, 22 bp, Homo sapiens
ctctttgaaatccatcactgct

SEQ ID NO: 7851827 - DNA, 22 bp, Homo sapiens
ctctttgaaatccatcactgct

SEQ ID NO: 7851828 - DNA, 22 bp, Homo sapiens
ctctttgaaatccatcactgct

SEQ ID NO: 7851829 - DNA, 18 bp, Homo sapiens
ctctttctttggcacaaa

SEQ ID NO: 7851830 - DNA, 18 bp, Homo sapiens
ctctttctttggcacaaa

SEQ ID NO: 7851831 - DNA, 22 bp, Homo sapiens
ctctttctgattcgctgggacc

SEQ ID NO: 7851832 - DNA, 22 bp, Homo sapiens
ctctttctgattcgctgggacc

SEQ ID NO: 7851833 - DNA, 22 bp, Homo sapiens
ctgagcctcctgcttctatttc

SEQ ID NO: 7851834 - DNA, 22 bp, Homo sapiens
ctgagcctcctgcttctatttc

SEQ ID NO: 7851835 - DNA, 22 bp, Homo sapiens
ctgagcctcctgcttctatttc

SEQ ID NO: 7851836 - DNA, 22 bp, Homo sapiens
ctgagcctccaggaggggggtg

SEQ ID NO: 7851837 - DNA, 22 bp, Homo sapiens
ctgagcctgtgtttctctggca

SEQ ID NO: 7851838 - DNA, 22 bp, Homo sapiens
ctgaggcagagggcagaccaga

SEQ ID NO: 7851839 - DNA, 22 bp, Homo sapiens
ctgagcctgtgtttctctggca

SEQ ID NO: 7851840 - DNA, 22 bp, Homo sapiens
ctgaggcagagggcagaccaga

SEQ ID NO: 7851841 - DNA, 22 bp, Homo sapiens
ctgaggcagagggcagaccaga

SEQ ID NO: 7851842 - DNA, 22 bp, Homo sapiens
ctgaggcagagggcagaccaga

SEQ ID NO: 7851843 - DNA, 22 bp, Homo sapiens
ctgaggcagagggcagaccaga

SEQ ID NO: 7851844 - DNA, 22 bp, Homo sapiens
ctgaggcagagggcagaccaga

SEQ ID NO: 7851845 - DNA, 21 bp, Homo sapiens
ctgaggcagcacagctagtca

SEQ ID NO: 7851846 - DNA, 21 bp, Homo sapiens
ctgaggcagcacagctagtca

SEQ ID NO: 7851847 - DNA, 22 bp, Homo sapiens
ctgagccctggctcgcctggag

SEQ ID NO: 7851848 - DNA, 20 bp, Homo sapiens
ctgagcccttcctgtgaacc

SEQ ID NO: 7851849 - DNA, 22 bp, Homo sapiens
ctgagcccttgcttatgcttcc

SEQ ID NO: 7851850 - DNA, 22 bp, Homo sapiens
ctgagcctccatttcatcaggt

SEQ ID NO: 7851851 - DNA, 22 bp, Homo sapiens
ctgagccatgggtctaagcact

SEQ ID NO: 7851852 - DNA, 22 bp, Homo sapiens
ctgagccatgggtctaagcact

SEQ ID NO: 7851853 - DNA, 22 bp, Homo sapiens
ctgagcccaggcgggagctgag

SEQ ID NO: 7851854 - DNA, 22 bp, Homo sapiens
ctgagcccaggcgggagctgag

SEQ ID NO: 7851855 - DNA, 22 bp, Homo sapiens
ctgagcccaggcgggagctgag

SEQ ID NO: 7851856 - DNA, 22 bp, Homo sapiens
ctgagcccattgggtgctgtta

SEQ ID NO: 7851857 - DNA, 22 bp, Homo sapiens
ctgagccccatctgaggtgccc

SEQ ID NO: 7851858 - DNA, 22 bp, Homo sapiens
ctgagcccattgggtgctgtta

SEQ ID NO: 7851859 - DNA, 22 bp, Homo sapiens
ctgagccccatctgaggtgccc

SEQ ID NO: 7851860 - DNA, 22 bp, Homo sapiens
ctgagccccatctgaggtgccc

SEQ ID NO: 7851861 - DNA, 22 bp, Homo sapiens
ctgagccccatctgaggtgccc

SEQ ID NO: 7851862 - DNA, 20 bp, Homo sapiens
ctgagcccccagcctgcagg

SEQ ID NO: 7851863 - DNA, 22 bp, Homo sapiens
ctgagccctcctgcttgctgag

SEQ ID NO: 7851864 - DNA, 22 bp, Homo sapiens
ctgagcccctctgacctcagag

SEQ ID NO: 7851865 - DNA, 22 bp, Homo sapiens
ctgagcccctctgacctcagag

SEQ ID NO: 7851866 - DNA, 20 bp, Homo sapiens
ctgagcccccagcctgcagg

SEQ ID NO: 7851867 - DNA, 20 bp, Homo sapiens
ctgagcccccagcctgcagg

SEQ ID NO: 7851868 - DNA, 20 bp, Homo sapiens
ctgagcccccagcctgcagg

SEQ ID NO: 7851869 - DNA, 20 bp, Homo sapiens
ctgagcccccagcctgcagg

SEQ ID NO: 7851870 - DNA, 17 bp, Homo sapiens
ctgagccccgggcagct

SEQ ID NO: 7851871 - DNA, 17 bp, Homo sapiens
ctgagccccgggcagct

SEQ ID NO: 7851872 - DNA, 17 bp, Homo sapiens
ctgagccccgggcagct

SEQ ID NO: 7851873 - DNA, 17 bp, Homo sapiens
ctgagccccgggcagct

SEQ ID NO: 7851874 - DNA, 22 bp, Homo sapiens
ctgagccatgagcctgcgccca

SEQ ID NO: 7851875 - DNA, 22 bp, Homo sapiens
ctgagccatgggtctaagcact

SEQ ID NO: 7851876 - DNA, 22 bp, Homo sapiens
ctgagccatgggtctaagcact

SEQ ID NO: 7851877 - DNA, 22 bp, Homo sapiens
ctgagccatgagcctgcgccca

SEQ ID NO: 7851878 - DNA, 22 bp, Homo sapiens
ctgagccatgagcctgcgccca

SEQ ID NO: 7851879 - DNA, 22 bp, Homo sapiens
ctgagccatgagcctgcgccca

SEQ ID NO: 7851880 - DNA, 22 bp, Homo sapiens
ctgagccataagggaggctggg

SEQ ID NO: 7851881 - DNA, 22 bp, Homo sapiens
ctgagccataagggaggctggg

SEQ ID NO: 7851882 - DNA, 22 bp, Homo sapiens
ctgagccatccataccagctta

SEQ ID NO: 7851883 - DNA, 22 bp, Homo sapiens
ctgagccatccataccagctta

SEQ ID NO: 7851884 - DNA, 22 bp, Homo sapiens
ctgagccatccataccagctta

SEQ ID NO: 7851885 - DNA, 22 bp, Homo sapiens
ctgagccatccataccagctta

SEQ ID NO: 7851886 - DNA, 22 bp, Homo sapiens
ctgagccatccataccagctta

SEQ ID NO: 7851887 - DNA, 20 bp, Homo sapiens
ctgagccaactctcttcttg

SEQ ID NO: 7851888 - DNA, 22 bp, Homo sapiens
ctgagccaaccacagcaggagc

SEQ ID NO: 7851889 - DNA, 20 bp, Homo sapiens
ctgagccaactctcttcttg

SEQ ID NO: 7851890 - DNA, 22 bp, Homo sapiens
ctgagccagtagtcagggacaa

SEQ ID NO: 7851891 - DNA, 22 bp, Homo sapiens
ctgagccaaggggacagtgaca

SEQ ID NO: 7851892 - DNA, 22 bp, Homo sapiens
ctgagccagtagtcagggacaa

SEQ ID NO: 7851893 - DNA, 22 bp, Homo sapiens
ctgagccagtagtcagggacaa

SEQ ID NO: 7851894 - DNA, 22 bp, Homo sapiens
ctgagccataagggaggctggg

SEQ ID NO: 7851895 - DNA, 22 bp, Homo sapiens
ctgagccataagggaggctggg

SEQ ID NO: 7851896 - DNA, 22 bp, Homo sapiens
ctgagccaaccacagcaggagc

SEQ ID NO: 7851897 - DNA, 22 bp, Homo sapiens
ctgagccaaccacagcaggagc

SEQ ID NO: 7851898 - DNA, 22 bp, Homo sapiens
ctgactgtaattctgttcttaa

SEQ ID NO: 7851899 - DNA, 22 bp, Homo sapiens
ctgactctctgagctcaaggtt

SEQ ID NO: 7851900 - DNA, 20 bp, Homo sapiens
ctgactctccttggcttgga

SEQ ID NO: 7851901 - DNA, 22 bp, Homo sapiens
ctgactctctgagctcaaggtt

SEQ ID NO: 7851902 - DNA, 22 bp, Homo sapiens
ctgactctcctgagatggggag

SEQ ID NO: 7851903 - DNA, 22 bp, Homo sapiens
ctgactccctgattctgggttt

SEQ ID NO: 7851904 - DNA, 22 bp, Homo sapiens
ctgactcctatcacagtgttct

SEQ ID NO: 7851905 - DNA, 18 bp, Homo sapiens
ctgacccttttacattcc

SEQ ID NO: 7851906 - DNA, 18 bp, Homo sapiens
ctgacccttttacattcc

SEQ ID NO: 7851907 - DNA, 18 bp, Homo sapiens
ctgacctctgagcccctc

SEQ ID NO: 7851908 - DNA, 22 bp, Homo sapiens
ctgacctgtaactgtaagagac

SEQ ID NO: 7851909 - DNA, 19 bp, Homo sapiens
ctgacctggctcagcaaag

SEQ ID NO: 7851910 - DNA, 22 bp, Homo sapiens
ctgacctgcccttaggcttctc

SEQ ID NO: 7851911 - DNA, 23 bp, Homo sapiens
ctgactcatcccaccacctcctc

SEQ ID NO: 7851912 - DNA, 22 bp, Homo sapiens
ctgactatctttctcaaagtgg

SEQ ID NO: 7851913 - DNA, 23 bp, Homo sapiens
ctgactcatcccaccacctcctc

SEQ ID NO: 7851914 - DNA, 22 bp, Homo sapiens
ctgactcccaaagaggacgcgt

SEQ ID NO: 7851915 - DNA, 22 bp, Homo sapiens
ctgactcactgtggctcttaat

SEQ ID NO: 7851916 - DNA, 22 bp, Homo sapiens
ctgacctgttacactagggctg

SEQ ID NO: 7851917 - DNA, 16 bp, Homo sapiens
ctgacctgtgcactgt

SEQ ID NO: 7851918 - DNA, 22 bp, Homo sapiens
ctgaccttcccaggggctggaa

SEQ ID NO: 7851919 - DNA, 22 bp, Homo sapiens
ctgaccttcgggcgggctgcgg

SEQ ID NO: 7851920 - DNA, 22 bp, Homo sapiens
ctgcagggcagaagggcataga

SEQ ID NO: 7851921 - DNA, 22 bp, Homo sapiens
ctgcagggattgcttctgtata

SEQ ID NO: 7851922 - DNA, 22 bp, Homo sapiens
ctgcagggattgcttctgtata

SEQ ID NO: 7851923 - DNA, 22 bp, Homo sapiens
ctgcagggattgcttctgtata

SEQ ID NO: 7851924 - DNA, 22 bp, Homo sapiens
ctgcagggcagaagggcataga

SEQ ID NO: 7851925 - DNA, 22 bp, Homo sapiens
ctgcagggcagggcctcctggc

SEQ ID NO: 7851926 - DNA, 22 bp, Homo sapiens
ctgcagggcagaagggcataga

SEQ ID NO: 7851927 - DNA, 22 bp, Homo sapiens
ctgcagggcagggcctcctggc

SEQ ID NO: 7851928 - DNA, 22 bp, Homo sapiens
ctgcagggcagggcctcctggc

SEQ ID NO: 7851929 - DNA, 22 bp, Homo sapiens
ctgcagggcattgtaactcttt

SEQ ID NO: 7851930 - DNA, 22 bp, Homo sapiens
ctgcagggcattgtaactcttt

SEQ ID NO: 7851931 - DNA, 22 bp, Homo sapiens
ctgcagggatgtgaggcccgtt

SEQ ID NO: 7851932 - DNA, 19 bp, Homo sapiens
ctgcagggatgtgcagagt

SEQ ID NO: 7851933 - DNA, 19 bp, Homo sapiens
ctgcagggatgtgcagagt

SEQ ID NO: 7851934 - DNA, 22 bp, Homo sapiens
ctgcagggatgtgaggcccgtt

SEQ ID NO: 7851935 - DNA, 22 bp, Homo sapiens
ctgcagggatgtgaggcccgtt

SEQ ID NO: 7851936 - DNA, 19 bp, Homo sapiens
ctgcagggatgtgcagagt

SEQ ID NO: 7851937 - DNA, 19 bp, Homo sapiens
ctgcagggatgtgcagagt

SEQ ID NO: 7851938 - DNA, 19 bp, Homo sapiens
ctgcagggatgtgcagagt

SEQ ID NO: 7851939 - DNA, 19 bp, Homo sapiens
ctgcagggatgtgcagagt

SEQ ID NO: 7851940 - DNA, 19 bp, Homo sapiens
ctgcagggatgtgcagagt

SEQ ID NO: 7851941 - DNA, 22 bp, Homo sapiens
ctgcaggggcctcgagcacagg

SEQ ID NO: 7851942 - DNA, 22 bp, Homo sapiens
ctgcaggggcctcgagcacagg

SEQ ID NO: 7851943 - DNA, 22 bp, Homo sapiens
ctgcaggggcagtccacttcct

SEQ ID NO: 7851944 - DNA, 22 bp, Homo sapiens
ctgcaggggcagtccacttcct

SEQ ID NO: 7851945 - DNA, 22 bp, Homo sapiens
ctgcaggggaccaaagtctgac

SEQ ID NO: 7851946 - DNA, 22 bp, Homo sapiens
ctgcagggcttaccttgctctg

SEQ ID NO: 7851947 - DNA, 22 bp, Homo sapiens
ctgcaggggaccaaagtctgac

SEQ ID NO: 7851948 - DNA, 22 bp, Homo sapiens
ctgcaggggaccaaagtctgac

SEQ ID NO: 7851949 - DNA, 22 bp, Homo sapiens
ctgcaggggaccaaagtctgac

SEQ ID NO: 7851950 - DNA, 22 bp, Homo sapiens
ctgcagggcccgcctgagccct

SEQ ID NO: 7851951 - DNA, 22 bp, Homo sapiens
ctgcagggcccgcctgagccct

SEQ ID NO: 7851952 - DNA, 22 bp, Homo sapiens
ctgcagggcccgcctgagccct

SEQ ID NO: 7851953 - DNA, 22 bp, Homo sapiens
ctgcagggcccgcctgagccct

SEQ ID NO: 7851954 - DNA, 22 bp, Homo sapiens
ctgcagggcccgcctgagccct

SEQ ID NO: 7851955 - DNA, 22 bp, Homo sapiens
ctgcagggccatgggttctata

SEQ ID NO: 7851956 - DNA, 22 bp, Homo sapiens
ctgcagggcccaaggtcaacgg

SEQ ID NO: 7851957 - DNA, 22 bp, Homo sapiens
ctgcagggcccaaggtcaacgg

SEQ ID NO: 7851958 - DNA, 22 bp, Homo sapiens
ctgcactgtgtaacagataact

SEQ ID NO: 7851959 - DNA, 18 bp, Homo sapiens
ctgcactgtgggtagctc

SEQ ID NO: 7851960 - DNA, 22 bp, Homo sapiens
ctgcactgtgtaacagataact

SEQ ID NO: 7851961 - DNA, 22 bp, Homo sapiens
ctgcactgctgatcccaggtct

SEQ ID NO: 7851962 - DNA, 22 bp, Homo sapiens
ctgcactgagctctcccagccc

SEQ ID NO: 7851963 - DNA, 22 bp, Homo sapiens
ctgcactgagctctcccagccc

SEQ ID NO: 7851964 - DNA, 22 bp, Homo sapiens
ctgcactgagctctcccagccc

SEQ ID NO: 7851965 - DNA, 22 bp, Homo sapiens
ctgcactgtgtattccttggct

SEQ ID NO: 7851966 - DNA, 18 bp, Homo sapiens
ctgcacttcagcttgggc

SEQ ID NO: 7851967 - DNA, 22 bp, Homo sapiens
ctgcaggcatttattcatgcaa

SEQ ID NO: 7851968 - DNA, 22 bp, Homo sapiens
ctgcaggcccccttcctggagt

SEQ ID NO: 7851969 - DNA, 22 bp, Homo sapiens
ctgcaggcatctaactgtgggc

SEQ ID NO: 7851970 - DNA, 22 bp, Homo sapiens
ctgcaggctcgaagacacggat

SEQ ID NO: 7851971 - DNA, 22 bp, Homo sapiens
ctgcagggagaggggacagcct

SEQ ID NO: 7851972 - DNA, 22 bp, Homo sapiens
ctgcagggagcagatggcgtgt

SEQ ID NO: 7851973 - DNA, 22 bp, Homo sapiens
ctgcaggctcgaagacacggat

SEQ ID NO: 7851974 - DNA, 22 bp, Homo sapiens
ctgcaggcccccttcctggagt

SEQ ID NO: 7851975 - DNA, 22 bp, Homo sapiens
ctgcaggcccccttcctggagt

SEQ ID NO: 7851976 - DNA, 22 bp, Homo sapiens
ctgcaggccgagctccttctcg

SEQ ID NO: 7851977 - DNA, 22 bp, Homo sapiens
ctgcagggagcagatggcgtgt

SEQ ID NO: 7851978 - DNA, 22 bp, Homo sapiens
ctgcagggagcagatggcgtgt

SEQ ID NO: 7851979 - DNA, 22 bp, Homo sapiens
ctgcagggagcagatggcgtgt

SEQ ID NO: 7851980 - DNA, 22 bp, Homo sapiens
ctgcagggaggttccttgttct

SEQ ID NO: 7851981 - DNA, 22 bp, Homo sapiens
ctgcagggatgtgaggcccgtt

SEQ ID NO: 7851982 - DNA, 19 bp, Homo sapiens
ctgcactgagaaaaggagg

SEQ ID NO: 7851983 - DNA, 22 bp, Homo sapiens
ctgcactgagaccctctttgct

SEQ ID NO: 7851984 - DNA, 22 bp, Homo sapiens
ctgcactgagaccctctttgct

SEQ ID NO: 7851985 - DNA, 22 bp, Homo sapiens
ctgcactgagcatctaacctta

SEQ ID NO: 7851986 - DNA, 22 bp, Homo sapiens
ctgcactgagcatctaacctta

SEQ ID NO: 7851987 - DNA, 22 bp, Homo sapiens
ctgcactgacttccccggctgc

SEQ ID NO: 7851988 - DNA, 19 bp, Homo sapiens
ctgcactgagaaaaggagg

SEQ ID NO: 7851989 - DNA, 22 bp, Homo sapiens
ctgcactgaagaaaggagctct

SEQ ID NO: 7851990 - DNA, 22 bp, Homo sapiens
ctgcactgacttccccggctgc

SEQ ID NO: 7851991 - DNA, 22 bp, Homo sapiens
ctgcaccgtgtctcgggctgcc

SEQ ID NO: 7851992 - DNA, 22 bp, Homo sapiens
ctgcaccgtgtctcgggctgcc

SEQ ID NO: 7851993 - DNA, 22 bp, Homo sapiens
ctgcaccgtgtctcgggctgcc

SEQ ID NO: 7851994 - DNA, 22 bp, Homo sapiens
ctgcacctacagccacatttac

SEQ ID NO: 7851995 - DNA, 18 bp, Homo sapiens
ctgcactcccgcctgggc

SEQ ID NO: 7851996 - DNA, 22 bp, Homo sapiens
ctgcaccctcaaactcctgggc

SEQ ID NO: 7851997 - DNA, 22 bp, Homo sapiens
ctgcaccctcaaactcctgggc

SEQ ID NO: 7851998 - DNA, 22 bp, Homo sapiens
ctgcaccacagcctgaggcagc

SEQ ID NO: 7851999 - DNA, 22 bp, Homo sapiens
ctgcaccatccttcatgctctg

SEQ ID NO: 7852000 - DNA, 22 bp, Homo sapiens
ctgcaccatctggagcacctcc

SEQ ID NO: 7852001 - DNA, 22 bp, Homo sapiens
ctgcaccatctggagcacctcc

SEQ ID NO: 7852002 - DNA, 22 bp, Homo sapiens
ctgcacatagtaagtactcaat

SEQ ID NO: 7852003 - DNA, 22 bp, Homo sapiens
ctgcacatgtccctaagtgtca

SEQ ID NO: 7852004 - DNA, 22 bp, Homo sapiens
ctgcaccacagcctgaggcagc

SEQ ID NO: 7852005 - DNA, 22 bp, Homo sapiens
ctgcaccacagcctgaggcagc

SEQ ID NO: 7852006 - DNA, 22 bp, Homo sapiens
ctgcacagtttgatttcttgct

SEQ ID NO: 7852007 - DNA, 22 bp, Homo sapiens
ctgcacagctgggcaagatata

SEQ ID NO: 7852008 - DNA, 22 bp, Homo sapiens
ctgcacagctgggcaagatata

SEQ ID NO: 7852009 - DNA, 22 bp, Homo sapiens
ctgcacagctgggcaagatata

SEQ ID NO: 7852010 - DNA, 22 bp, Homo sapiens
ctgcacagctggccagggagag

SEQ ID NO: 7852011 - DNA, 22 bp, Homo sapiens
ctgcacagctggccagggagag

SEQ ID NO: 7852012 - DNA, 22 bp, Homo sapiens
ctgcacagcctgtctgggggcc

SEQ ID NO: 7852013 - DNA, 22 bp, Homo sapiens
ctgcacaggggatgagggcagt

SEQ ID NO: 7852014 - DNA, 22 bp, Homo sapiens
ctgcacaggggatgagggcagt

SEQ ID NO: 7852015 - DNA, 22 bp, Homo sapiens
ctgcacagtaagcttcagagat

SEQ ID NO: 7852016 - DNA, 22 bp, Homo sapiens
ctgcacagggatatggggagct

SEQ ID NO: 7852017 - DNA, 22 bp, Homo sapiens
ctgcacaggggatgagggcagt

SEQ ID NO: 7852018 - DNA, 22 bp, Homo sapiens
ctgcacaggggatgagggcagt

SEQ ID NO: 7852019 - DNA, 22 bp, Homo sapiens
ctgcacacatatggcttctctc

SEQ ID NO: 7852020 - DNA, 22 bp, Homo sapiens
ctgcacacatatggcttctctc

SEQ ID NO: 7852021 - DNA, 22 bp, Homo sapiens
ctgcacacatcgcactgcccgt

SEQ ID NO: 7852022 - DNA, 22 bp, Homo sapiens
ctgcacacatcgcactgcccgt

SEQ ID NO: 7852023 - DNA, 22 bp, Homo sapiens
ctgcacacatatggcttctctc

SEQ ID NO: 7852024 - DNA, 22 bp, Homo sapiens
ctgcacacatcgcactgcccgt

SEQ ID NO: 7852025 - DNA, 22 bp, Homo sapiens
ctgcacagagcagggcagacac

SEQ ID NO: 7852026 - DNA, 22 bp, Homo sapiens
ctgcacagagcagggcagacac

SEQ ID NO: 7852027 - DNA, 22 bp, Homo sapiens
ctgcacagagcagggcagacac

SEQ ID NO: 7852028 - DNA, 22 bp, Homo sapiens
ctgcacacatcgcactgcccgt

SEQ ID NO: 7852029 - DNA, 22 bp, Homo sapiens
ctgcacagccctcaagagcctg

SEQ ID NO: 7852030 - DNA, 22 bp, Homo sapiens
ctgcacagagcggcagttctta

SEQ ID NO: 7852031 - DNA, 22 bp, Homo sapiens
ctgcaaaggtgggggaggagct

SEQ ID NO: 7852032 - DNA, 22 bp, Homo sapiens
ctgcaaaggtgggggaggagct

SEQ ID NO: 7852033 - DNA, 22 bp, Homo sapiens
ctgcaaagctgttcacaaattt

SEQ ID NO: 7852034 - DNA, 22 bp, Homo sapiens
ctgcaaagctgttcacaaattt

SEQ ID NO: 7852035 - DNA, 22 bp, Homo sapiens
ctgcaaaattgttctttgctcc

SEQ ID NO: 7852036 - DNA, 22 bp, Homo sapiens
ctgcaaaattgttctttgctcc

SEQ ID NO: 7852037 - DNA, 20 bp, Homo sapiens
ctgcaaaatgacattaggaa

SEQ ID NO: 7852038 - DNA, 20 bp, Homo sapiens
ctgcaaaatgacattaggaa

SEQ ID NO: 7852039 - DNA, 22 bp, Homo sapiens
ctgaggccgtctgggtctgcag

SEQ ID NO: 7852040 - DNA, 22 bp, Homo sapiens
ctgaggccgtctgggtctgcag

SEQ ID NO: 7852041 - DNA, 22 bp, Homo sapiens
ctgaggccgtctgggtctgcag

SEQ ID NO: 7852042 - DNA, 20 bp, Homo sapiens
ctgcaaaatgacattaggaa

SEQ ID NO: 7852043 - DNA, 22 bp, Homo sapiens
ctgaggccgtctgggtctgcag

SEQ ID NO: 7852044 - DNA, 22 bp, Homo sapiens
ctgaggccggagcactgaagag

SEQ ID NO: 7852045 - DNA, 22 bp, Homo sapiens
ctgaggccggagcactgaagag

SEQ ID NO: 7852046 - DNA, 22 bp, Homo sapiens
ctgaggcccctcttgtgagcat

SEQ ID NO: 7852047 - DNA, 22 bp, Homo sapiens
ctgaggcccctcttgtgagcat

SEQ ID NO: 7852048 - DNA, 22 bp, Homo sapiens
ctgaggccggagcactgaagag

SEQ ID NO: 7852049 - DNA, 22 bp, Homo sapiens
ctgaggcccctcttgtgagcat

SEQ ID NO: 7852050 - DNA, 22 bp, Homo sapiens
ctgaggcccctctcttgagctt

SEQ ID NO: 7852051 - DNA, 22 bp, Homo sapiens
ctgaggcccctctcttgagctt

SEQ ID NO: 7852052 - DNA, 22 bp, Homo sapiens
ctgaggcccctctcttgagctt

SEQ ID NO: 7852053 - DNA, 22 bp, Homo sapiens
ctgaggcccctctcttgagctt

SEQ ID NO: 7852054 - DNA, 19 bp, Homo sapiens
ctgaggcccatgtaccatg

SEQ ID NO: 7852055 - DNA, 22 bp, Homo sapiens
ctgaggcccctctcttgagctt

SEQ ID NO: 7852056 - DNA, 19 bp, Homo sapiens
ctgaggcccatgtaccatg

SEQ ID NO: 7852057 - DNA, 22 bp, Homo sapiens
ctgaggccagctgcagagctct

SEQ ID NO: 7852058 - DNA, 22 bp, Homo sapiens
ctgaggccagctgcagagctct

SEQ ID NO: 7852059 - DNA, 22 bp, Homo sapiens
ctgaggccagctgcagagctct

SEQ ID NO: 7852060 - DNA, 18 bp, Homo sapiens
ctgaggcccagagagggc

SEQ ID NO: 7852061 - DNA, 18 bp, Homo sapiens
ctgaggcccagagagggc

SEQ ID NO: 7852062 - DNA, 17 bp, Homo sapiens
ctgaggcccagggccca

SEQ ID NO: 7852063 - DNA, 17 bp, Homo sapiens
ctgaggcccagggccca

SEQ ID NO: 7852064 - DNA, 18 bp, Homo sapiens
ctgaggcccagagagggc

SEQ ID NO: 7852065 - DNA, 22 bp, Homo sapiens
ctgaggccagagtgggcctctt

SEQ ID NO: 7852066 - DNA, 22 bp, Homo sapiens
ctgaggccagagtgggcctctt

SEQ ID NO: 7852067 - DNA, 22 bp, Homo sapiens
ctgaggccagctgcagagctct

SEQ ID NO: 7852068 - DNA, 22 bp, Homo sapiens
ctgaggccagctgcagagctct

SEQ ID NO: 7852069 - DNA, 22 bp, Homo sapiens
ctgaggccagaacccgaccctg

SEQ ID NO: 7852070 - DNA, 22 bp, Homo sapiens
ctgaggccagaacccgaccctg

SEQ ID NO: 7852071 - DNA, 18 bp, Homo sapiens
ctgaggccaactacactg

SEQ ID NO: 7852072 - DNA, 22 bp, Homo sapiens
ctgaggccagagtgggcctctt

SEQ ID NO: 7852073 - DNA, 22 bp, Homo sapiens
ctgaggccagagtgggcctctt

SEQ ID NO: 7852074 - DNA, 22 bp, Homo sapiens
ctgaggccagagtgggcctctt

SEQ ID NO: 7852075 - DNA, 22 bp, Homo sapiens
ctgaggccagaacccgaccctg

SEQ ID NO: 7852076 - DNA, 22 bp, Homo sapiens
ctgaggcatgggaagttgggtg

SEQ ID NO: 7852077 - DNA, 22 bp, Homo sapiens
ctgaggcatgggaagttgggtg

SEQ ID NO: 7852078 - DNA, 22 bp, Homo sapiens
ctgaggcatgttacaggacata

SEQ ID NO: 7852079 - DNA, 22 bp, Homo sapiens
ctgaggcatgttacaggacata

SEQ ID NO: 7852080 - DNA, 22 bp, Homo sapiens
ctgaggcatgggaagttgggtg

SEQ ID NO: 7852081 - DNA, 21 bp, Homo sapiens
ctgaggcatgcaggcctgggc

SEQ ID NO: 7852082 - DNA, 22 bp, Homo sapiens
ctgaggcatgggaagttgggtg

SEQ ID NO: 7852083 - DNA, 22 bp, Homo sapiens
ctgaggcatgggaagttgggtg

SEQ ID NO: 7852084 - DNA, 22 bp, Homo sapiens
ctgaggcatgggaagttgggtg

SEQ ID NO: 7852085 - DNA, 22 bp, Homo sapiens
ctgaggcatgttacaggacata

SEQ ID NO: 7852086 - DNA, 22 bp, Homo sapiens
ctgaggcatgttacaggacata

SEQ ID NO: 7852087 - DNA, 22 bp, Homo sapiens
ctgaggcatgttacaggacata

SEQ ID NO: 7852088 - DNA, 22 bp, Homo sapiens
ctgaggcatgttacaggacata

SEQ ID NO: 7852089 - DNA, 22 bp, Homo sapiens
ctgaggcatgttacaggacata

SEQ ID NO: 7852090 - DNA, 22 bp, Homo sapiens
tcctggctccagcagctcttcc

SEQ ID NO: 7852091 - DNA, 22 bp, Homo sapiens
tcctggctccagcagctcttcc

SEQ ID NO: 7852092 - DNA, 22 bp, Homo sapiens
tcctggctccagcagctcttcc

SEQ ID NO: 7852093 - DNA, 22 bp, Homo sapiens
ccacagaaagttgtctagagta

SEQ ID NO: 7852094 - DNA, 22 bp, Homo sapiens
ccacagaaagttgtctagagta

SEQ ID NO: 7852095 - DNA, 22 bp, Homo sapiens
ccacagaaagttgtctagagta

SEQ ID NO: 7852096 - DNA, 22 bp, Homo sapiens
tcctgggactctttatcagaga

SEQ ID NO: 7852097 - DNA, 22 bp, Homo sapiens
tcctggctcctgatctgtcact

SEQ ID NO: 7852098 - DNA, 22 bp, Homo sapiens
tcctgggactctttatcagaga

SEQ ID NO: 7852099 - DNA, 22 bp, Homo sapiens
tcctggctccagcagctcttcc

SEQ ID NO: 7852100 - DNA, 22 bp, Homo sapiens
tcctggctcctgatctgtcact

SEQ ID NO: 7852101 - DNA, 22 bp, Homo sapiens
tcctggctcctgatctgtcact

SEQ ID NO: 7852102 - DNA, 22 bp, Homo sapiens
tcctggctcctgatctgtcact

SEQ ID NO: 7852103 - DNA, 22 bp, Homo sapiens
tcctggctcctgatctgtcact

SEQ ID NO: 7852104 - DNA, 22 bp, Homo sapiens
tcctgggagagtgggactgtat

SEQ ID NO: 7852105 - DNA, 22 bp, Homo sapiens
tcctgggagagtgggactgtat

SEQ ID NO: 7852106 - DNA, 22 bp, Homo sapiens
tcctgggagagtttgattcatt

SEQ ID NO: 7852107 - DNA, 22 bp, Homo sapiens
tcctgggagacccagctgtgga

SEQ ID NO: 7852108 - DNA, 22 bp, Homo sapiens
tcctgggagacccagctgtgga

SEQ ID NO: 7852109 - DNA, 22 bp, Homo sapiens
tcctgggagacccagctgtgga

SEQ ID NO: 7852110 - DNA, 22 bp, Homo sapiens
tcctgggactttcaaggctagg

SEQ ID NO: 7852111 - DNA, 22 bp, Homo sapiens
tcctgggactctttatcagaga

SEQ ID NO: 7852112 - DNA, 22 bp, Homo sapiens
tcctgggagacccagctgtgga

SEQ ID NO: 7852113 - DNA, 22 bp, Homo sapiens
tcctgggagcccttgctccacc

SEQ ID NO: 7852114 - DNA, 22 bp, Homo sapiens
tcctgggagcccttgctccacc

SEQ ID NO: 7852115 - DNA, 22 bp, Homo sapiens
tcctgggagcccttgctccacc

SEQ ID NO: 7852116 - DNA, 22 bp, Homo sapiens
tcctgggctgtgtgccactctg

SEQ ID NO: 7852117 - DNA, 22 bp, Homo sapiens
tcctgggcttaagtgatcctcc

SEQ ID NO: 7852118 - DNA, 22 bp, Homo sapiens
tcctgggcttaagtgatcctcc

SEQ ID NO: 7852119 - DNA, 22 bp, Homo sapiens
tcctgggcttaagtgatcctcc

SEQ ID NO: 7852120 - DNA, 22 bp, Homo sapiens
tcctgggcttaagtgatcctcc

SEQ ID NO: 7852121 - DNA, 22 bp, Homo sapiens
tcctgggagcccttgctccacc

SEQ ID NO: 7852122 - DNA, 22 bp, Homo sapiens
tcctgggagcatggtgccgtga

SEQ ID NO: 7852123 - DNA, 22 bp, Homo sapiens
tcctgggagcatggtgccgtga

SEQ ID NO: 7852124 - DNA, 22 bp, Homo sapiens
tcctgggagcatgaagagggat

SEQ ID NO: 7852125 - DNA, 22 bp, Homo sapiens
tcctgggagcatggtgccgtga

SEQ ID NO: 7852126 - DNA, 22 bp, Homo sapiens
tcctgggagcacatggtcctgc

SEQ ID NO: 7852127 - DNA, 22 bp, Homo sapiens
tcctgggagagtttgattcatt

SEQ ID NO: 7852128 - DNA, 22 bp, Homo sapiens
tcctgggagcacatggtcctgc

SEQ ID NO: 7852129 - DNA, 22 bp, Homo sapiens
ccacacagggggatgagttatt

SEQ ID NO: 7852130 - DNA, 22 bp, Homo sapiens
ccacacagtcagtttccaagaa

SEQ ID NO: 7852131 - DNA, 22 bp, Homo sapiens
ccacacagtcagtttccaagaa

SEQ ID NO: 7852132 - DNA, 19 bp, Homo sapiens
ccacacagtgtgcaattta

SEQ ID NO: 7852133 - DNA, 19 bp, Homo sapiens
ccacacagtgtgcaattta

SEQ ID NO: 7852134 - DNA, 22 bp, Homo sapiens
ccacaccatcgtttttacctta

SEQ ID NO: 7852135 - DNA, 17 bp, Homo sapiens
ccacaccctttccttcc

SEQ ID NO: 7852136 - DNA, 17 bp, Homo sapiens
ccacaccctttccttcc

SEQ ID NO: 7852137 - DNA, 22 bp, Homo sapiens
ccacactaaactgctcaaacca

SEQ ID NO: 7852138 - DNA, 22 bp, Homo sapiens
ccacactccccgcaggcgtagg

SEQ ID NO: 7852139 - DNA, 22 bp, Homo sapiens
ccacactccccgcaggcgtagg

SEQ ID NO: 7852140 - DNA, 22 bp, Homo sapiens
ccacactgaacctcagtgtctt

SEQ ID NO: 7852141 - DNA, 22 bp, Homo sapiens
ccacagaaaataaagcacgatt

SEQ ID NO: 7852142 - DNA, 22 bp, Homo sapiens
ccacagaaaataaagcacgatt

SEQ ID NO: 7852143 - DNA, 22 bp, Homo sapiens
ccacactgaccagctgtgagac

SEQ ID NO: 7852144 - DNA, 22 bp, Homo sapiens
ccacactgaccagctgtgagac

SEQ ID NO: 7852145 - DNA, 22 bp, Homo sapiens
ccacactgcctgttatctccca

SEQ ID NO: 7852146 - DNA, 22 bp, Homo sapiens
ccacactgaccagctgtgagac

SEQ ID NO: 7852147 - DNA, 22 bp, Homo sapiens
tcctggcagtcaaataaccttg

SEQ ID NO: 7852148 - DNA, 18 bp, Homo sapiens
tcctggcagtcagagagg

SEQ ID NO: 7852149 - DNA, 22 bp, Homo sapiens
tcctggcaggtctgagaggtct

SEQ ID NO: 7852150 - DNA, 22 bp, Homo sapiens
tcctggcaggtctgagaggtct

SEQ ID NO: 7852151 - DNA, 22 bp, Homo sapiens
tcctggcaggtgtattggctgt

SEQ ID NO: 7852152 - DNA, 22 bp, Homo sapiens
tcctggcaggtgtattggctgt

SEQ ID NO: 7852153 - DNA, 22 bp, Homo sapiens
tcctggcaggtcagcaggagca

SEQ ID NO: 7852154 - DNA, 22 bp, Homo sapiens
tcctggcaggtcagcaggagca

SEQ ID NO: 7852155 - DNA, 22 bp, Homo sapiens
tcctggcaggtcagcaggagca

SEQ ID NO: 7852156 - DNA, 22 bp, Homo sapiens
tcctggcagggtggcagcgggt

SEQ ID NO: 7852157 - DNA, 22 bp, Homo sapiens
tcctggcaggtcagcaggagca

SEQ ID NO: 7852158 - DNA, 22 bp, Homo sapiens
tcctggcaggtcagcaggagca

SEQ ID NO: 7852159 - DNA, 22 bp, Homo sapiens
tcctggcagggtctaggtctag

SEQ ID NO: 7852160 - DNA, 22 bp, Homo sapiens
tcctggcagggtctaggtctag

SEQ ID NO: 7852161 - DNA, 22 bp, Homo sapiens
tcctggcagggtctaggtctag

SEQ ID NO: 7852162 - DNA, 22 bp, Homo sapiens
tcctggcagggtctaggtctag

SEQ ID NO: 7852163 - DNA, 22 bp, Homo sapiens
tcctggcagggtggcagcgggt

SEQ ID NO: 7852164 - DNA, 22 bp, Homo sapiens
tcctggcagggtggcagcgggt

SEQ ID NO: 7852165 - DNA, 22 bp, Homo sapiens
tcctggcagggtggcagcgggt

SEQ ID NO: 7852166 - DNA, 21 bp, Homo sapiens
tcctggcaggcccaggaccct

SEQ ID NO: 7852167 - DNA, 21 bp, Homo sapiens
tcctggcaggcccaggaccct

SEQ ID NO: 7852168 - DNA, 21 bp, Homo sapiens
tcctggcaggcccaggaccct

SEQ ID NO: 7852169 - DNA, 22 bp, Homo sapiens
tcctggcagcccgcaggtgctg

SEQ ID NO: 7852170 - DNA, 22 bp, Homo sapiens
ccaaggcaatgtgcagctggtg

SEQ ID NO: 7852171 - DNA, 22 bp, Homo sapiens
ccaaggcaatgtgcagctggtg

SEQ ID NO: 7852172 - DNA, 22 bp, Homo sapiens
ccaaggcaatgtgcagctggtg

SEQ ID NO: 7852173 - DNA, 22 bp, Homo sapiens
ccaaggcaacgttggtgtcagg

SEQ ID NO: 7852174 - DNA, 22 bp, Homo sapiens
ccaaggcaacgttggtgtcagg

SEQ ID NO: 7852175 - DNA, 22 bp, Homo sapiens
ccaaggaggccccaggtcagct

SEQ ID NO: 7852176 - DNA, 22 bp, Homo sapiens
ccaaggaggccccaggtcagct

SEQ ID NO: 7852177 - DNA, 22 bp, Homo sapiens
ccaaggagtagagcaggaagct

SEQ ID NO: 7852178 - DNA, 22 bp, Homo sapiens
ccaaggagtagagcaggaagct

SEQ ID NO: 7852179 - DNA, 22 bp, Homo sapiens
ccaaggcagaagatggctcttg

SEQ ID NO: 7852180 - DNA, 22 bp, Homo sapiens
ccaaggcagaagatggctcttg

SEQ ID NO: 7852181 - DNA, 22 bp, Homo sapiens
ccaaggcagaagatggctcttg

SEQ ID NO: 7852182 - DNA, 22 bp, Homo sapiens
ccaaggcacactctgcaaggtt

SEQ ID NO: 7852183 - DNA, 22 bp, Homo sapiens
ccaaggcacactctgcaaggtt

SEQ ID NO: 7852184 - DNA, 22 bp, Homo sapiens
ccaaggcacactctgcaaggtt

SEQ ID NO: 7852185 - DNA, 22 bp, Homo sapiens
ccaaggcatatggctgaaacca

SEQ ID NO: 7852186 - DNA, 22 bp, Homo sapiens
ccaaggccacaaacagcctggc

SEQ ID NO: 7852187 - DNA, 22 bp, Homo sapiens
ccaaggccatcaggtaggtcct

SEQ ID NO: 7852188 - DNA, 22 bp, Homo sapiens
ccaaggccacaaacagcctggc

SEQ ID NO: 7852189 - DNA, 22 bp, Homo sapiens
tcctagaaagatgtcttttcac

SEQ ID NO: 7852190 - DNA, 22 bp, Homo sapiens
tcctacagatactaaggagatc

SEQ ID NO: 7852191 - DNA, 22 bp, Homo sapiens
tcctagaactccaggacagtcc

SEQ ID NO: 7852192 - DNA, 22 bp, Homo sapiens
tcctagaactccaggacagtcc

SEQ ID NO: 7852193 - DNA, 22 bp, Homo sapiens
tcctagaactccaggacagtcc

SEQ ID NO: 7852194 - DNA, 22 bp, Homo sapiens
tcctagaacagcccacctggaa

SEQ ID NO: 7852195 - DNA, 22 bp, Homo sapiens
tcctagaacagcccacctggaa

SEQ ID NO: 7852196 - DNA, 22 bp, Homo sapiens
tcctacaatgcacagaatagcc

SEQ ID NO: 7852197 - DNA, 22 bp, Homo sapiens
tcctaactccactagccttggg

SEQ ID NO: 7852198 - DNA, 22 bp, Homo sapiens
tcctacagaaccaggctaggtg

SEQ ID NO: 7852199 - DNA, 18 bp, Homo sapiens
tcctaacttagatactcc

SEQ ID NO: 7852200 - DNA, 20 bp, Homo sapiens
tcctaataacctgaagaaat

SEQ ID NO: 7852201 - DNA, 22 bp, Homo sapiens
ccaaggagcaaggctcaacaag

SEQ ID NO: 7852202 - DNA, 22 bp, Homo sapiens
ccaaggagcaagtttacacctg

SEQ ID NO: 7852203 - DNA, 22 bp, Homo sapiens
ccaaggagaatgacaccatgga

SEQ ID NO: 7852204 - DNA, 22 bp, Homo sapiens
ccaagaggttgtgaggcaggca

SEQ ID NO: 7852205 - DNA, 22 bp, Homo sapiens
ccaaggagaatgacaccatgga

SEQ ID NO: 7852206 - DNA, 22 bp, Homo sapiens
ccaagaggttgaggctgcagtg

SEQ ID NO: 7852207 - DNA, 22 bp, Homo sapiens
ccaagaggttgaggctgcagtg

SEQ ID NO: 7852208 - DNA, 22 bp, Homo sapiens
tcctagaactccaggacagtcc

SEQ ID NO: 7852209 - DNA, 22 bp, Homo sapiens
tcctagaagatggatcagagaa

SEQ ID NO: 7852210 - DNA, 22 bp, Homo sapiens
tcctagaagatggatcagagaa

SEQ ID NO: 7852211 - DNA, 22 bp, Homo sapiens
ccaagaggttgaggctgcagtg

SEQ ID NO: 7852212 - DNA, 22 bp, Homo sapiens
tcctggcagagggcggcctcga

SEQ ID NO: 7852213 - DNA, 22 bp, Homo sapiens
tcctggcagagggcggcctcga

SEQ ID NO: 7852214 - DNA, 22 bp, Homo sapiens
tcctggcagcccgcaggtgctg

SEQ ID NO: 7852215 - DNA, 22 bp, Homo sapiens
tcctggcagaaatggggctgtg

SEQ ID NO: 7852216 - DNA, 22 bp, Homo sapiens
tcctggcagaaatggggctgtg

SEQ ID NO: 7852217 - DNA, 22 bp, Homo sapiens
tcctggcagagagcatgaggcc

SEQ ID NO: 7852218 - DNA, 22 bp, Homo sapiens
tcctggcagagagcatgaggcc

SEQ ID NO: 7852219 - DNA, 22 bp, Homo sapiens
tcctggcactttgggggctcgc

SEQ ID NO: 7852220 - DNA, 22 bp, Homo sapiens
tcctggcactttgggggctcgc

SEQ ID NO: 7852221 - DNA, 22 bp, Homo sapiens
tcctggcactttgggggctcgc

SEQ ID NO: 7852222 - DNA, 22 bp, Homo sapiens
tcctggaggagatccaatctga

SEQ ID NO: 7852223 - DNA, 22 bp, Homo sapiens
tcctggaggacagaggcatctc

SEQ ID NO: 7852224 - DNA, 22 bp, Homo sapiens
tcctggaggacagaggcatctc

SEQ ID NO: 7852225 - DNA, 22 bp, Homo sapiens
ccaaggcttcccagagatgctc

SEQ ID NO: 7852226 - DNA, 22 bp, Homo sapiens
ccaaggcttcccagagatgctc

SEQ ID NO: 7852227 - DNA, 22 bp, Homo sapiens
ccaaggcttcccagagatgctc

SEQ ID NO: 7852228 - DNA, 22 bp, Homo sapiens
ccaaggcttcccagagatgctc

SEQ ID NO: 7852229 - DNA, 22 bp, Homo sapiens
tcctggaggacagaggcatctc

SEQ ID NO: 7852230 - DNA, 22 bp, Homo sapiens
ccaaggcttcctgacctacatg

SEQ ID NO: 7852231 - DNA, 22 bp, Homo sapiens
ccaaggcttcctgacctacatg

SEQ ID NO: 7852232 - DNA, 22 bp, Homo sapiens
ccaagggaaaccgagaggctgg

SEQ ID NO: 7852233 - DNA, 22 bp, Homo sapiens
ccaaggcttcctgacctacatg

SEQ ID NO: 7852234 - DNA, 22 bp, Homo sapiens
ccaaggctggagtgcagtggcg

SEQ ID NO: 7852235 - DNA, 22 bp, Homo sapiens
ccaaggctggagtgcagtggcg

SEQ ID NO: 7852236 - DNA, 22 bp, Homo sapiens
ccaaggctgaggtttccagttg

SEQ ID NO: 7852237 - DNA, 22 bp, Homo sapiens
ccaaggctggagggcttatgta

SEQ ID NO: 7852238 - DNA, 22 bp, Homo sapiens
ccaaggctggagggcttatgta

SEQ ID NO: 7852239 - DNA, 22 bp, Homo sapiens
ccaaggctgtcattcagtagct

SEQ ID NO: 7852240 - DNA, 22 bp, Homo sapiens
ccaaggctgtcattcagtagct

SEQ ID NO: 7852241 - DNA, 22 bp, Homo sapiens
ccaaggctggagtgcagtggcg

SEQ ID NO: 7852242 - DNA, 22 bp, Homo sapiens
ccaaggctgtggggctgtgcag

SEQ ID NO: 7852243 - DNA, 22 bp, Homo sapiens
ccaaggctgtggggctgtgcag

SEQ ID NO: 7852244 - DNA, 22 bp, Homo sapiens
ccaaggctgtggggctgtgcag

SEQ ID NO: 7852245 - DNA, 22 bp, Homo sapiens
ccaaggctcctcagctggtctt

SEQ ID NO: 7852246 - DNA, 22 bp, Homo sapiens
ccaaggccttgaaggcgcgggg

SEQ ID NO: 7852247 - DNA, 22 bp, Homo sapiens
ccaaggctcctcagctggtctt

SEQ ID NO: 7852248 - DNA, 22 bp, Homo sapiens
ccaaggctcctcagctggtctt

SEQ ID NO: 7852249 - DNA, 17 bp, Homo sapiens
ccaaggctatttgtagt

SEQ ID NO: 7852250 - DNA, 22 bp, Homo sapiens
ccaaggcccctgtggtctagcc

SEQ ID NO: 7852251 - DNA, 18 bp, Homo sapiens
ccaaggcccctgctgggg

SEQ ID NO: 7852252 - DNA, 22 bp, Homo sapiens
ccaaggcccctgtggtctagcc

SEQ ID NO: 7852253 - DNA, 18 bp, Homo sapiens
ccaaggcccctgctgggg

SEQ ID NO: 7852254 - DNA, 18 bp, Homo sapiens
ccaaggcccctgctgggg

SEQ ID NO: 7852255 - DNA, 22 bp, Homo sapiens
ccaaggccatcaggtaggtcct

SEQ ID NO: 7852256 - DNA, 22 bp, Homo sapiens
ccagagaccagaacatggggat

SEQ ID NO: 7852257 - DNA, 19 bp, Homo sapiens
ccagagacattggcatctt

SEQ ID NO: 7852258 - DNA, 22 bp, Homo sapiens
ccagagaattttagacaaaaat

SEQ ID NO: 7852259 - DNA, 22 bp, Homo sapiens
ccagagaattttagacaaaaat

SEQ ID NO: 7852260 - DNA, 22 bp, Homo sapiens
ccagagacaaggagctggagtc

SEQ ID NO: 7852261 - DNA, 22 bp, Homo sapiens
ccagagacaaggagctggagtc

SEQ ID NO: 7852262 - DNA, 22 bp, Homo sapiens
ccagagaattttagacaaaaat

SEQ ID NO: 7852263 - DNA, 22 bp, Homo sapiens
ccagagaatccggagagtccat

SEQ ID NO: 7852264 - DNA, 22 bp, Homo sapiens
ccagagaatccggagagtccat

SEQ ID NO: 7852265 - DNA, 22 bp, Homo sapiens
ccagagaatccggagagtccat

SEQ ID NO: 7852266 - DNA, 22 bp, Homo sapiens
ccagagaagtcttgcctggatt

SEQ ID NO: 7852267 - DNA, 22 bp, Homo sapiens
ccagagaagtcttgcctggatt

SEQ ID NO: 7852268 - DNA, 22 bp, Homo sapiens
ccagagaagtcttgcctggatt

SEQ ID NO: 7852269 - DNA, 22 bp, Homo sapiens
ccagagaaggtggagcttgtgt

SEQ ID NO: 7852270 - DNA, 22 bp, Homo sapiens
ccagagaaggtggagcttgtgt

SEQ ID NO: 7852271 - DNA, 22 bp, Homo sapiens
ccagagaaggtggagcttgtgt

SEQ ID NO: 7852272 - DNA, 22 bp, Homo sapiens
ccagagaagaaaagcacctttt

SEQ ID NO: 7852273 - DNA, 22 bp, Homo sapiens
ccagagaaggtggagcttgtgt

SEQ ID NO: 7852274 - DNA, 22 bp, Homo sapiens
ccagagaaggtggagcttgtgt

SEQ ID NO: 7852275 - DNA, 22 bp, Homo sapiens
ccagagaagaaaagcacctttt

SEQ ID NO: 7852276 - DNA, 22 bp, Homo sapiens
ccagagaagaaaagcacctttt

SEQ ID NO: 7852277 - DNA, 22 bp, Homo sapiens
ccagagaagaaaagcacctttt

SEQ ID NO: 7852278 - DNA, 22 bp, Homo sapiens
ccagagaaccttgagctgtgag

SEQ ID NO: 7852279 - DNA, 22 bp, Homo sapiens
ccagagaaccttgagctgtgag

SEQ ID NO: 7852280 - DNA, 22 bp, Homo sapiens
ccagagaaccttgagctgtgag

SEQ ID NO: 7852281 - DNA, 22 bp, Homo sapiens
ccagagaaataaggggaaaatg

SEQ ID NO: 7852282 - DNA, 22 bp, Homo sapiens
ccagagaaataaggggaaaatg

SEQ ID NO: 7852283 - DNA, 22 bp, Homo sapiens
ccagacaggggctgttcctgct

SEQ ID NO: 7852284 - DNA, 22 bp, Homo sapiens
ccagacagttccttgaggttca

SEQ ID NO: 7852285 - DNA, 22 bp, Homo sapiens
ccagagaaccatctgcttgagg

SEQ ID NO: 7852286 - DNA, 22 bp, Homo sapiens
ccagagaaccatctgcttgagg

SEQ ID NO: 7852287 - DNA, 22 bp, Homo sapiens
ccagagaaccatctgcttgagg

SEQ ID NO: 7852288 - DNA, 22 bp, Homo sapiens
ccagagaaccatctgcttgagg

SEQ ID NO: 7852289 - DNA, 22 bp, Homo sapiens
ccagagaaccatctgcttgagg

SEQ ID NO: 7852290 - DNA, 22 bp, Homo sapiens
ccagagaaccatctgcttgagg

SEQ ID NO: 7852291 - DNA, 22 bp, Homo sapiens
ccagagaaccatctgcttgagg

SEQ ID NO: 7852292 - DNA, 22 bp, Homo sapiens
tctaaggagcgctccagaaaaa

SEQ ID NO: 7852293 - DNA, 21 bp, Homo sapiens
tctaagccttgcagatgggtt

SEQ ID NO: 7852294 - DNA, 22 bp, Homo sapiens
tctaagcctcagaccacgctgc

SEQ ID NO: 7852295 - DNA, 22 bp, Homo sapiens
tctaagccaggactgagagacg

SEQ ID NO: 7852296 - DNA, 22 bp, Homo sapiens
tctaagcctgtgtcctctgcag

SEQ ID NO: 7852297 - DNA, 21 bp, Homo sapiens
tctaagccttgcagatgggtt

SEQ ID NO: 7852298 - DNA, 22 bp, Homo sapiens
tctaataaataaatgctctagg

SEQ ID NO: 7852299 - DNA, 22 bp, Homo sapiens
tctaataaataaatgctctagg

SEQ ID NO: 7852300 - DNA, 22 bp, Homo sapiens
tctaagttttaattggcaatgt

SEQ ID NO: 7852301 - DNA, 22 bp, Homo sapiens
tctaatcctatggtggggaggg

SEQ ID NO: 7852302 - DNA, 22 bp, Homo sapiens
tctaatccttgctacctgggtg

SEQ ID NO: 7852303 - DNA, 22 bp, Homo sapiens
tctaatcctatggtggggaggg

SEQ ID NO: 7852304 - DNA, 22 bp, Homo sapiens
ccagacaggggctgttcctgct

SEQ ID NO: 7852305 - DNA, 22 bp, Homo sapiens
ccagacaggggctgttcctgct

SEQ ID NO: 7852306 - DNA, 22 bp, Homo sapiens
ccagacaggggctgttcctgct

SEQ ID NO: 7852307 - DNA, 22 bp, Homo sapiens
ccagacaggggctgttcctgct

SEQ ID NO: 7852308 - DNA, 22 bp, Homo sapiens
ccactgtctgtgacatcagaaa

SEQ ID NO: 7852309 - DNA, 22 bp, Homo sapiens
ccactgtctgtgacatcagaaa

SEQ ID NO: 7852310 - DNA, 22 bp, Homo sapiens
ccactgtcttttccaggctgaa

SEQ ID NO: 7852311 - DNA, 22 bp, Homo sapiens
ccactgtctgtgacatcagaaa

SEQ ID NO: 7852312 - DNA, 22 bp, Homo sapiens
ccactgtcttttccaggctgaa

SEQ ID NO: 7852313 - DNA, 22 bp, Homo sapiens
ccactgtcttttccaggctgaa

SEQ ID NO: 7852314 - DNA, 22 bp, Homo sapiens
ccactgtgagcatgaacaggac

SEQ ID NO: 7852315 - DNA, 22 bp, Homo sapiens
ccactgtattttggaagcagat

SEQ ID NO: 7852316 - DNA, 22 bp, Homo sapiens
ccactgtattttggaagcagat

SEQ ID NO: 7852317 - DNA, 22 bp, Homo sapiens
ccactgtatagccactgccggt

SEQ ID NO: 7852318 - DNA, 22 bp, Homo sapiens
ccactgtatcttccttgaattt

SEQ ID NO: 7852319 - DNA, 22 bp, Homo sapiens
ccactgtcagaggggctgtgcc

SEQ ID NO: 7852320 - DNA, 22 bp, Homo sapiens
ccactgggggctgctcccaggt

SEQ ID NO: 7852321 - DNA, 22 bp, Homo sapiens
ccactggttttattgtagctta

SEQ ID NO: 7852322 - DNA, 22 bp, Homo sapiens
ccactgtaagtttgaaaataac

SEQ ID NO: 7852323 - DNA, 22 bp, Homo sapiens
ccactgggggctgctcccaggt

SEQ ID NO: 7852324 - DNA, 22 bp, Homo sapiens
ccactgggggctgctcccaggt

SEQ ID NO: 7852325 - DNA, 22 bp, Homo sapiens
ccactgggggctgctcccaggt

SEQ ID NO: 7852326 - DNA, 22 bp, Homo sapiens
ccactgctagagatgcatcccc

SEQ ID NO: 7852327 - DNA, 22 bp, Homo sapiens
ccactgctaacttgctgcagct

SEQ ID NO: 7852328 - DNA, 22 bp, Homo sapiens
ccactgtataagcaaaatgaaa

SEQ ID NO: 7852329 - DNA, 22 bp, Homo sapiens
ccactgtagttatgatgaagtt

SEQ ID NO: 7852330 - DNA, 22 bp, Homo sapiens
ccactgtataagcaaaatgaaa

SEQ ID NO: 7852331 - DNA, 22 bp, Homo sapiens
ccactgtagttatgatgaagtt

SEQ ID NO: 7852332 - DNA, 22 bp, Homo sapiens
ccactgtaagtttgaaaataac

SEQ ID NO: 7852333 - DNA, 22 bp, Homo sapiens
ccactgtagagatttgaatgcc

SEQ ID NO: 7852334 - DNA, 22 bp, Homo sapiens
ccactgtgtccaccaggaatgc

SEQ ID NO: 7852335 - DNA, 22 bp, Homo sapiens
ccactgtgtccaccaggaatgc

SEQ ID NO: 7852336 - DNA, 22 bp, Homo sapiens
ccactgtgagcatgaacaggac

SEQ ID NO: 7852337 - DNA, 22 bp, Homo sapiens
ccactgtgagcatgaacaggac

SEQ ID NO: 7852338 - DNA, 22 bp, Homo sapiens
ccactgttggcccgaaggggtc

SEQ ID NO: 7852339 - DNA, 22 bp, Homo sapiens
ccactgttaccagtcaatcaca

SEQ ID NO: 7852340 - DNA, 22 bp, Homo sapiens
ccactgtttcctttctgctggc

SEQ ID NO: 7852341 - DNA, 22 bp, Homo sapiens
ccacttcatcccagctcagata

SEQ ID NO: 7852342 - DNA, 22 bp, Homo sapiens
ccacttcatcccagctcagata

SEQ ID NO: 7852343 - DNA, 22 bp, Homo sapiens
tctaagatctactatacatgtg

SEQ ID NO: 7852344 - DNA, 22 bp, Homo sapiens
tctaagaggcatcaagacaagc

SEQ ID NO: 7852345 - DNA, 22 bp, Homo sapiens
tctaagatctactatacatgtg

SEQ ID NO: 7852346 - DNA, 22 bp, Homo sapiens
tctaagccaggactgagagacg

SEQ ID NO: 7852347 - DNA, 22 bp, Homo sapiens
tctaagcccccgcaccgcagga

SEQ ID NO: 7852348 - DNA, 22 bp, Homo sapiens
tctaagccccgtggaaagggaa

SEQ ID NO: 7852349 - DNA, 22 bp, Homo sapiens
tctaagccgcaagcctatctgt

SEQ ID NO: 7852350 - DNA, 22 bp, Homo sapiens
tctaagcctaggaaatgagttt

SEQ ID NO: 7852351 - DNA, 19 bp, Homo sapiens
tctaagcctcaatgttttc

SEQ ID NO: 7852352 - DNA, 22 bp, Homo sapiens
ccacttgaaacttagtggcata

SEQ ID NO: 7852353 - DNA, 22 bp, Homo sapiens
tctaagaaatcagatgatgagg

SEQ ID NO: 7852354 - DNA, 22 bp, Homo sapiens
tctaagaaatcagatgatgagg

SEQ ID NO: 7852355 - DNA, 22 bp, Homo sapiens
tctaagaagggttttaaatatt

SEQ ID NO: 7852356 - DNA, 22 bp, Homo sapiens
tctaagaagggttttaaatatt

SEQ ID NO: 7852357 - DNA, 22 bp, Homo sapiens
tctaagaagggttttaaatatt

SEQ ID NO: 7852358 - DNA, 22 bp, Homo sapiens
tctaagaatactcatatcttct

SEQ ID NO: 7852359 - DNA, 22 bp, Homo sapiens
tccttcccaggtgtcgccgcct

SEQ ID NO: 7852360 - DNA, 22 bp, Homo sapiens
tccttccatggtggggctgctt

SEQ ID NO: 7852361 - DNA, 22 bp, Homo sapiens
tccttccatggtggggctgctt

SEQ ID NO: 7852362 - DNA, 22 bp, Homo sapiens
tccttccatggtggggctgctt

SEQ ID NO: 7852363 - DNA, 19 bp, Homo sapiens
tccttccagttcctggggt

SEQ ID NO: 7852364 - DNA, 19 bp, Homo sapiens
tccttccagttcctggggt

SEQ ID NO: 7852365 - DNA, 22 bp, Homo sapiens
tccttcatgcctgtaatcccag

SEQ ID NO: 7852366 - DNA, 22 bp, Homo sapiens
tccttccaggtccagggatgtg

SEQ ID NO: 7852367 - DNA, 22 bp, Homo sapiens
tccttccaggtccagggatgtg

SEQ ID NO: 7852368 - DNA, 22 bp, Homo sapiens
tccttccaggtccagggatgtg

SEQ ID NO: 7852369 - DNA, 22 bp, Homo sapiens
tccttccaggtccagggatgtg

SEQ ID NO: 7852370 - DNA, 21 bp, Homo sapiens
tccttcagttctgcactttct

SEQ ID NO: 7852371 - DNA, 22 bp, Homo sapiens
tccttcagttcaattagtccgt

SEQ ID NO: 7852372 - DNA, 22 bp, Homo sapiens
tccttcagttatcacagtactg

SEQ ID NO: 7852373 - DNA, 22 bp, Homo sapiens
tccttcagttaaagatctcaca

SEQ ID NO: 7852374 - DNA, 22 bp, Homo sapiens
tccttaaagtgcacctcctcat

SEQ ID NO: 7852375 - DNA, 22 bp, Homo sapiens
tccttaaagttggggtgctgca

SEQ ID NO: 7852376 - DNA, 22 bp, Homo sapiens
tccttaaatatttactgttaac

SEQ ID NO: 7852377 - DNA, 22 bp, Homo sapiens
tccttaaatatttactgttaac

SEQ ID NO: 7852378 - DNA, 22 bp, Homo sapiens
tccttaaatatttactgttaac

SEQ ID NO: 7852379 - DNA, 22 bp, Homo sapiens
tccttaaacaacacactttgta

SEQ ID NO: 7852380 - DNA, 22 bp, Homo sapiens
tccttaaacaacacactttgta

SEQ ID NO: 7852381 - DNA, 22 bp, Homo sapiens
tccttaaaggactagaagtcaa

SEQ ID NO: 7852382 - DNA, 22 bp, Homo sapiens
tccttcagtcttctgagccata

SEQ ID NO: 7852383 - DNA, 21 bp, Homo sapiens
tccttcagtctagatgattgt

SEQ ID NO: 7852384 - DNA, 22 bp, Homo sapiens
tccttcagtcttctgagccata

SEQ ID NO: 7852385 - DNA, 17 bp, Homo sapiens
tccttcagtgcctctgc

SEQ ID NO: 7852386 - DNA, 17 bp, Homo sapiens
tccttcagtgcctctgc

SEQ ID NO: 7852387 - DNA, 17 bp, Homo sapiens
tccttcagtgcctctgc

SEQ ID NO: 7852388 - DNA, 22 bp, Homo sapiens
tccttcagtcttctgagccata

SEQ ID NO: 7852389 - DNA, 22 bp, Homo sapiens
tccttcagttaaagatctcaca

SEQ ID NO: 7852390 - DNA, 22 bp, Homo sapiens
tccttcagtgtcccgctcaggt

SEQ ID NO: 7852391 - DNA, 22 bp, Homo sapiens
tcctgggcttagtggctaggtc

SEQ ID NO: 7852392 - DNA, 22 bp, Homo sapiens
tcctgggcttagtggctaggtc

SEQ ID NO: 7852393 - DNA, 22 bp, Homo sapiens
tcctgggcttagtggctaggtc

SEQ ID NO: 7852394 - DNA, 22 bp, Homo sapiens
tcctgggcttcacagactctgt

SEQ ID NO: 7852395 - DNA, 22 bp, Homo sapiens
tcctgggcttcacagactctgt

SEQ ID NO: 7852396 - DNA, 22 bp, Homo sapiens
tcctgggcttcacagactctgt

SEQ ID NO: 7852397 - DNA, 22 bp, Homo sapiens
tcctgggcttcacagactctgt

SEQ ID NO: 7852398 - DNA, 22 bp, Homo sapiens
tcctgggcttcacagactctgt

SEQ ID NO: 7852399 - DNA, 22 bp, Homo sapiens
tcctgggcttgctcctccagct

SEQ ID NO: 7852400 - DNA, 22 bp, Homo sapiens
tcctgggcttgctcctccagct

SEQ ID NO: 7852401 - DNA, 22 bp, Homo sapiens
tcctgggcttgctcctccagct

SEQ ID NO: 7852402 - DNA, 22 bp, Homo sapiens
tcctgggcttgctcctccagct

SEQ ID NO: 7852403 - DNA, 22 bp, Homo sapiens
tcctgggcttgctcctccagct

SEQ ID NO: 7852404 - DNA, 22 bp, Homo sapiens
tcctgggcttgctcctccagct

SEQ ID NO: 7852405 - DNA, 22 bp, Homo sapiens
tcctgggcttgctcctccagct

SEQ ID NO: 7852406 - DNA, 19 bp, Homo sapiens
tcctggggaggggcatggc

SEQ ID NO: 7852407 - DNA, 19 bp, Homo sapiens
tcctggggaggggcatggc

SEQ ID NO: 7852408 - DNA, 19 bp, Homo sapiens
tcctggggaggggcatggc

SEQ ID NO: 7852409 - DNA, 22 bp, Homo sapiens
tcctgggcttgctcctccagct

SEQ ID NO: 7852410 - DNA, 22 bp, Homo sapiens
tcctgggctttgtttctctcct

SEQ ID NO: 7852411 - DNA, 22 bp, Homo sapiens
tcctgggctttgtttctctcct

SEQ ID NO: 7852412 - DNA, 19 bp, Homo sapiens
tccttaaaaaagcagttct

SEQ ID NO: 7852413 - DNA, 19 bp, Homo sapiens
tccttaaaaaagcagttct

SEQ ID NO: 7852414 - DNA, 19 bp, Homo sapiens
tcctggggaggggcatggc

SEQ ID NO: 7852415 - DNA, 19 bp, Homo sapiens
tcctggggaggggcatggc

SEQ ID NO: 7852416 - DNA, 19 bp, Homo sapiens
tcctggggaggggcatggc

SEQ ID NO: 7852417 - DNA, 22 bp, Homo sapiens
tccttcctgcaggccaagtcct

SEQ ID NO: 7852418 - DNA, 22 bp, Homo sapiens
tccttcctgcaggccaagtcct

SEQ ID NO: 7852419 - DNA, 22 bp, Homo sapiens
tccttcctgcaggccaagtcct

SEQ ID NO: 7852420 - DNA, 22 bp, Homo sapiens
tccttcctgctctaacattcag

SEQ ID NO: 7852421 - DNA, 22 bp, Homo sapiens
tccttcctgctctaacattcag

SEQ ID NO: 7852422 - DNA, 23 bp, Homo sapiens
tccttgggcctgcccagagtggt

SEQ ID NO: 7852423 - DNA, 23 bp, Homo sapiens
tccttgggcctgcccagagtggt

SEQ ID NO: 7852424 - DNA, 22 bp, Homo sapiens
tccttggggacgctgacatcgt

SEQ ID NO: 7852425 - DNA, 22 bp, Homo sapiens
tccttgggtcagtgagtgaggt

SEQ ID NO: 7852426 - DNA, 22 bp, Homo sapiens
tccttgggtcagtgagtgaggt

SEQ ID NO: 7852427 - DNA, 22 bp, Homo sapiens
tccttggggtaactccagcctg

SEQ ID NO: 7852428 - DNA, 22 bp, Homo sapiens
tccttccccctcaagagaactt

SEQ ID NO: 7852429 - DNA, 21 bp, Homo sapiens
tccttcccccttggcctggga

SEQ ID NO: 7852430 - DNA, 21 bp, Homo sapiens
tccttcccccttggcctggga

SEQ ID NO: 7852431 - DNA, 19 bp, Homo sapiens
tccttccccccagcacaga

SEQ ID NO: 7852432 - DNA, 19 bp, Homo sapiens
tccttccccccagcacaga

SEQ ID NO: 7852433 - DNA, 19 bp, Homo sapiens
tccttccccccagcacaga

SEQ ID NO: 7852434 - DNA, 22 bp, Homo sapiens
tccttcctccatggtcttggtt

SEQ ID NO: 7852435 - DNA, 22 bp, Homo sapiens
tccttcctccatggtcttggtt

SEQ ID NO: 7852436 - DNA, 22 bp, Homo sapiens
tccttcctccatggtcttggtt

SEQ ID NO: 7852437 - DNA, 22 bp, Homo sapiens
tccttcctcggggacccagatc

SEQ ID NO: 7852438 - DNA, 22 bp, Homo sapiens
tccttcctcggggacccagatc

SEQ ID NO: 7852439 - DNA, 22 bp, Homo sapiens
tccttcctgcaggccaagtcct

SEQ ID NO: 7852440 - DNA, 22 bp, Homo sapiens
tccttcctgcaggccaagtcct

SEQ ID NO: 7852441 - DNA, 22 bp, Homo sapiens
tcctttaacttgattattttca

SEQ ID NO: 7852442 - DNA, 22 bp, Homo sapiens
tcctttaactagttaccatgtt

SEQ ID NO: 7852443 - DNA, 22 bp, Homo sapiens
tcctttaactagttaccatgtt

SEQ ID NO: 7852444 - DNA, 22 bp, Homo sapiens
tcctttaaactcctttcaagtc

SEQ ID NO: 7852445 - DNA, 22 bp, Homo sapiens
tcctttaaagaactgtgctttt

SEQ ID NO: 7852446 - DNA, 22 bp, Homo sapiens
tcctttaaacaaccagctctca

SEQ ID NO: 7852447 - DNA, 22 bp, Homo sapiens
tcctttaaagaactgtgctttt

SEQ ID NO: 7852448 - DNA, 22 bp, Homo sapiens
tcctttaaactcctttcaagtc

SEQ ID NO: 7852449 - DNA, 22 bp, Homo sapiens
tccttgggtcagtgagtgaggt

SEQ ID NO: 7852450 - DNA, 22 bp, Homo sapiens
tccttgggtcagtgagtgaggt

SEQ ID NO: 7852451 - DNA, 22 bp, Homo sapiens
tccttggtgcaaatgatttaat

SEQ ID NO: 7852452 - DNA, 22 bp, Homo sapiens
tcctttaaacaaccagctctca

SEQ ID NO: 7852453 - DNA, 22 bp, Homo sapiens
tccttgtaacgttgggctgggg

SEQ ID NO: 7852454 - DNA, 22 bp, Homo sapiens
tccttgtaaaggagctctaaca

SEQ ID NO: 7852455 - DNA, 22 bp, Homo sapiens
ccactgctaacttgctgcagct

SEQ ID NO: 7852456 - DNA, 22 bp, Homo sapiens
ccactgctaacttgctgcagct

SEQ ID NO: 7852457 - DNA, 22 bp, Homo sapiens
ccactgctaacttgctgcagct

SEQ ID NO: 7852458 - DNA, 22 bp, Homo sapiens
tcctttcaccaaaaagtgttgt

SEQ ID NO: 7852459 - DNA, 22 bp, Homo sapiens
tcctttatgtgagttgtttccc

SEQ ID NO: 7852460 - DNA, 22 bp, Homo sapiens
tcctttatgtgagttgtttccc

SEQ ID NO: 7852461 - DNA, 23 bp, Homo sapiens
tcctttaagatatcttattcctt

SEQ ID NO: 7852462 - DNA, 23 bp, Homo sapiens
tcctttaatgctggaatggctag

SEQ ID NO: 7852463 - DNA, 23 bp, Homo sapiens
tcctttaatgctggaatggctag

SEQ ID NO: 7852464 - DNA, 23 bp, Homo sapiens
tcctttaatgctggaatggctag

SEQ ID NO: 7852465 - DNA, 22 bp, Homo sapiens
tcctttatcaaggagccttaga

SEQ ID NO: 7852466 - DNA, 22 bp, Homo sapiens
tcctttatcaaggagccttaga

SEQ ID NO: 7852467 - DNA, 22 bp, Homo sapiens
tcctttagctttcttggacaaa

SEQ ID NO: 7852468 - DNA, 22 bp, Homo sapiens
tcctttatctgctcagaaagta

SEQ ID NO: 7852469 - DNA, 22 bp, Homo sapiens
tcctttatcaaggagccttaga

SEQ ID NO: 7852470 - DNA, 22 bp, Homo sapiens
tcctttatctgctcagaaagta

SEQ ID NO: 7852471 - DNA, 22 bp, Homo sapiens
tcctttatctgctcagaaagta

SEQ ID NO: 7852472 - DNA, 22 bp, Homo sapiens
cattgtctggtaggaagtgggc

SEQ ID NO: 7852473 - DNA, 22 bp, Homo sapiens
cattgtctcttgtcatttagta

SEQ ID NO: 7852474 - DNA, 22 bp, Homo sapiens
cattgtcacccaaagctcatag

SEQ ID NO: 7852475 - DNA, 22 bp, Homo sapiens
cattgtcacccaaagctcatag

SEQ ID NO: 7852476 - DNA, 22 bp, Homo sapiens
cattgtcattctatgctattca

SEQ ID NO: 7852477 - DNA, 22 bp, Homo sapiens
cattgtcattctatgctattca

SEQ ID NO: 7852478 - DNA, 22 bp, Homo sapiens
cattgtcacccaaagctcatag

SEQ ID NO: 7852479 - DNA, 22 bp, Homo sapiens
cattgtcacccaaagctcatag

SEQ ID NO: 7852480 - DNA, 22 bp, Homo sapiens
cattgtattgaggatacttaag

SEQ ID NO: 7852481 - DNA, 22 bp, Homo sapiens
cattgtacagttattttaaaat

SEQ ID NO: 7852482 - DNA, 18 bp, Homo sapiens
cattgtacaatgctttat

SEQ ID NO: 7852483 - DNA, 22 bp, Homo sapiens
cattgtattgaggatacttaag

SEQ ID NO: 7852484 - DNA, 22 bp, Homo sapiens
cattgcactccagtctgggcca

SEQ ID NO: 7852485 - DNA, 22 bp, Homo sapiens
tcccactcccaggcaggcctct

SEQ ID NO: 7852486 - DNA, 22 bp, Homo sapiens
tcccactcactgtctctgacac

SEQ ID NO: 7852487 - DNA, 22 bp, Homo sapiens
tcccactcactgtctctgacac

SEQ ID NO: 7852488 - DNA, 22 bp, Homo sapiens
tcccactcagtccttttcagtt

SEQ ID NO: 7852489 - DNA, 22 bp, Homo sapiens
tcccactcactgtctctgacac

SEQ ID NO: 7852490 - DNA, 22 bp, Homo sapiens
tcccactcccaggcaggcctct

SEQ ID NO: 7852491 - DNA, 22 bp, Homo sapiens
tcccactcccaggcaggcctct

SEQ ID NO: 7852492 - DNA, 22 bp, Homo sapiens
catttaaaggttgtgggtaaaa

SEQ ID NO: 7852493 - DNA, 22 bp, Homo sapiens
catttaaaggttgtgggtaaaa

SEQ ID NO: 7852494 - DNA, 22 bp, Homo sapiens
catttaaaggttgtgggtaaaa

SEQ ID NO: 7852495 - DNA, 22 bp, Homo sapiens
cattgttttgagaacaacctga

SEQ ID NO: 7852496 - DNA, 22 bp, Homo sapiens
cattgtttgagcatctgggatc

SEQ ID NO: 7852497 - DNA, 22 bp, Homo sapiens
cattgtttctggagggatctgt

SEQ ID NO: 7852498 - DNA, 22 bp, Homo sapiens
cattgtttctggagggatctgt

SEQ ID NO: 7852499 - DNA, 18 bp, Homo sapiens
cattgtttccagaagacc

SEQ ID NO: 7852500 - DNA, 22 bp, Homo sapiens
cattgtttgtaaaattccagta

SEQ ID NO: 7852501 - DNA, 22 bp, Homo sapiens
cattgtttgagcatctgggatc

SEQ ID NO: 7852502 - DNA, 18 bp, Homo sapiens
cattgtttccagaagacc

SEQ ID NO: 7852503 - DNA, 18 bp, Homo sapiens
cattgtttccagaagacc

SEQ ID NO: 7852504 - DNA, 22 bp, Homo sapiens
cattgttgtgagatcaagcagt

SEQ ID NO: 7852505 - DNA, 22 bp, Homo sapiens
cattgttaccatcttttaccta

SEQ ID NO: 7852506 - DNA, 22 bp, Homo sapiens
cattgttaattggtatcttaca

SEQ ID NO: 7852507 - DNA, 22 bp, Homo sapiens
cattgttaattggtatcttaca

SEQ ID NO: 7852508 - DNA, 22 bp, Homo sapiens
cattgtgtatttctgtagtact

SEQ ID NO: 7852509 - DNA, 22 bp, Homo sapiens
cattgtgtatttctgtagtact

SEQ ID NO: 7852510 - DNA, 22 bp, Homo sapiens
cattgttcaacactgacttgca

SEQ ID NO: 7852511 - DNA, 22 bp, Homo sapiens
cattgttcaacactgacttgca

SEQ ID NO: 7852512 - DNA, 22 bp, Homo sapiens
cattgttgctgcttcaagatat

SEQ ID NO: 7852513 - DNA, 22 bp, Homo sapiens
catttaatagatgctgtttcag

SEQ ID NO: 7852514 - DNA, 22 bp, Homo sapiens
catttaatagatgctgtttcag

SEQ ID NO: 7852515 - DNA, 22 bp, Homo sapiens
catttaatagatgctgtttcag

SEQ ID NO: 7852516 - DNA, 22 bp, Homo sapiens
catttaatagatgctgtttcag

SEQ ID NO: 7852517 - DNA, 22 bp, Homo sapiens
catttaatccatagaggaatgt

SEQ ID NO: 7852518 - DNA, 22 bp, Homo sapiens
catttaatcctcacaagcctat

SEQ ID NO: 7852519 - DNA, 22 bp, Homo sapiens
catttaatagatgctgtttcag

SEQ ID NO: 7852520 - DNA, 22 bp, Homo sapiens
catttaatagatgctgtttcag

SEQ ID NO: 7852521 - DNA, 22 bp, Homo sapiens
catttaatccatagaggaatgt

SEQ ID NO: 7852522 - DNA, 22 bp, Homo sapiens
catttaatgcacggatgtagcc

SEQ ID NO: 7852523 - DNA, 22 bp, Homo sapiens
catttaatgcacggatgtagcc

SEQ ID NO: 7852524 - DNA, 22 bp, Homo sapiens
catttaatcctcacaagcctat

SEQ ID NO: 7852525 - DNA, 22 bp, Homo sapiens
catttaatctggctcatgagca

SEQ ID NO: 7852526 - DNA, 22 bp, Homo sapiens
catttaatctggctcatgagca

SEQ ID NO: 7852527 - DNA, 22 bp, Homo sapiens
catttaatctggctcatgagca

SEQ ID NO: 7852528 - DNA, 22 bp, Homo sapiens
catttacaatgtacaggttgtg

SEQ ID NO: 7852529 - DNA, 22 bp, Homo sapiens
catttacacacagaggtgtgct

SEQ ID NO: 7852530 - DNA, 22 bp, Homo sapiens
catttacacacagaggtgtgct

SEQ ID NO: 7852531 - DNA, 22 bp, Homo sapiens
catttacacacagaggtgtgct

SEQ ID NO: 7852532 - DNA, 22 bp, Homo sapiens
catttacacacagaggtgtgct

SEQ ID NO: 7852533 - DNA, 22 bp, Homo sapiens
catttacaatgtacaggttgtg

SEQ ID NO: 7852534 - DNA, 22 bp, Homo sapiens
catttacaatgtacaggttgtg

SEQ ID NO: 7852535 - DNA, 22 bp, Homo sapiens
catttacaatgtacaggttgtg

SEQ ID NO: 7852536 - DNA, 22 bp, Homo sapiens
catttacaatgtacaggttgtg

SEQ ID NO: 7852537 - DNA, 22 bp, Homo sapiens
catttaatgcctttgccatcca

SEQ ID NO: 7852538 - DNA, 22 bp, Homo sapiens
tccctcctggtgagcaggggct

SEQ ID NO: 7852539 - DNA, 22 bp, Homo sapiens
tccctcctggtgatgatgcaaa

SEQ ID NO: 7852540 - DNA, 22 bp, Homo sapiens
tccctccttaataagaggtctg

SEQ ID NO: 7852541 - DNA, 22 bp, Homo sapiens
tccctccttaataagaggtctg

SEQ ID NO: 7852542 - DNA, 22 bp, Homo sapiens
tccctcctggccgtcaccgctg

SEQ ID NO: 7852543 - DNA, 22 bp, Homo sapiens
tccctccttaataagaggtctg

SEQ ID NO: 7852544 - DNA, 22 bp, Homo sapiens
tccctccttaataagaggtctg

SEQ ID NO: 7852545 - DNA, 18 bp, Homo sapiens
tccctcctgcctgcttcc

SEQ ID NO: 7852546 - DNA, 22 bp, Homo sapiens
tccctcctgcatgaggctcggc

SEQ ID NO: 7852547 - DNA, 18 bp, Homo sapiens
tccctcctgcctgcttcc

SEQ ID NO: 7852548 - DNA, 22 bp, Homo sapiens
tccctcctggccgtcaccgctg

SEQ ID NO: 7852549 - DNA, 22 bp, Homo sapiens
tccctcctggccgtcaccgctg

SEQ ID NO: 7852550 - DNA, 22 bp, Homo sapiens
tccctcctggccgtcaccgctg

SEQ ID NO: 7852551 - DNA, 22 bp, Homo sapiens
tccctcagaaattctctctgaa

SEQ ID NO: 7852552 - DNA, 20 bp, Homo sapiens
tccctcctgcagatagagaa

SEQ ID NO: 7852553 - DNA, 22 bp, Homo sapiens
tccctcctgcatgaggctcggc

SEQ ID NO: 7852554 - DNA, 22 bp, Homo sapiens
catttacacttctaaccacaag

SEQ ID NO: 7852555 - DNA, 22 bp, Homo sapiens
tccctcagaaattctctctgaa

SEQ ID NO: 7852556 - DNA, 22 bp, Homo sapiens
catttacacttctaaccacaag

SEQ ID NO: 7852557 - DNA, 22 bp, Homo sapiens
catttacacttctaaccacaag

SEQ ID NO: 7852558 - DNA, 22 bp, Homo sapiens
catttacacttctaaccacaag

SEQ ID NO: 7852559 - DNA, 22 bp, Homo sapiens
catttacacttctaaccacaag

SEQ ID NO: 7852560 - DNA, 22 bp, Homo sapiens
catttacacttctaaccacaag

SEQ ID NO: 7852561 - DNA, 22 bp, Homo sapiens
catttattctcagatccttgtc

SEQ ID NO: 7852562 - DNA, 22 bp, Homo sapiens
catttattctcagatccttgtc

SEQ ID NO: 7852563 - DNA, 22 bp, Homo sapiens
catttattctcagatccttgtc

SEQ ID NO: 7852564 - DNA, 22 bp, Homo sapiens
catttattctcagatccttgtc

SEQ ID NO: 7852565 - DNA, 22 bp, Homo sapiens
catttattctcagatccttgtc

SEQ ID NO: 7852566 - DNA, 22 bp, Homo sapiens
catttattctcagatccttgtc

SEQ ID NO: 7852567 - DNA, 22 bp, Homo sapiens
catttattctcagatccttgtc

SEQ ID NO: 7852568 - DNA, 22 bp, Homo sapiens
catttattcatttgctagggct

SEQ ID NO: 7852569 - DNA, 22 bp, Homo sapiens
catttattcatttgctagggct

SEQ ID NO: 7852570 - DNA, 22 bp, Homo sapiens
catttattgagtggccacagtg

SEQ ID NO: 7852571 - DNA, 22 bp, Homo sapiens
catttattgagtggccacagtg

SEQ ID NO: 7852572 - DNA, 22 bp, Homo sapiens
catttattgagtggccacagtg

SEQ ID NO: 7852573 - DNA, 22 bp, Homo sapiens
catttattctcagatccttgtc

SEQ ID NO: 7852574 - DNA, 22 bp, Homo sapiens
catttattcatgatctgtagct

SEQ ID NO: 7852575 - DNA, 22 bp, Homo sapiens
catttattcatgatctgtagct

SEQ ID NO: 7852576 - DNA, 22 bp, Homo sapiens
catttattcatgatctgtagct

SEQ ID NO: 7852577 - DNA, 22 bp, Homo sapiens
catttattcatgatctgtagct

SEQ ID NO: 7852578 - DNA, 22 bp, Homo sapiens
catttattcatgatctgtagct

SEQ ID NO: 7852579 - DNA, 22 bp, Homo sapiens
catttattcatgatctgtagct

SEQ ID NO: 7852580 - DNA, 22 bp, Homo sapiens
catttattcatgatctgtagct

SEQ ID NO: 7852581 - DNA, 22 bp, Homo sapiens
catttattcatttgctagggct

SEQ ID NO: 7852582 - DNA, 22 bp, Homo sapiens
catttattcatttgctagggct

SEQ ID NO: 7852583 - DNA, 22 bp, Homo sapiens
catttattcatttgctagggct

SEQ ID NO: 7852584 - DNA, 22 bp, Homo sapiens
catttattcatttgctagggct

SEQ ID NO: 7852585 - DNA, 22 bp, Homo sapiens
catttattcatttgctagggct

SEQ ID NO: 7852586 - DNA, 22 bp, Homo sapiens
catttattcatgatctgtagct

SEQ ID NO: 7852587 - DNA, 22 bp, Homo sapiens
tccctctctagcctgttcagta

SEQ ID NO: 7852588 - DNA, 22 bp, Homo sapiens
tccctctctagcctgttcagta

SEQ ID NO: 7852589 - DNA, 22 bp, Homo sapiens
tccctctccctattgcctggag

SEQ ID NO: 7852590 - DNA, 22 bp, Homo sapiens
tccctctctagcctgttcagta

SEQ ID NO: 7852591 - DNA, 22 bp, Homo sapiens
tccctctccctattgcctggag

SEQ ID NO: 7852592 - DNA, 22 bp, Homo sapiens
tccctctccctattgcctggag

SEQ ID NO: 7852593 - DNA, 22 bp, Homo sapiens
tccctcctttatcaaaaagaga

SEQ ID NO: 7852594 - DNA, 22 bp, Homo sapiens
tccctcctttatcaaaaagaga

SEQ ID NO: 7852595 - DNA, 22 bp, Homo sapiens
tccctctccctattgcctggag

SEQ ID NO: 7852596 - DNA, 22 bp, Homo sapiens
tccctctccctattgcctggag

SEQ ID NO: 7852597 - DNA, 22 bp, Homo sapiens
tccctctccctattgcctggag

SEQ ID NO: 7852598 - DNA, 22 bp, Homo sapiens
tccctctccctattgcctggag

SEQ ID NO: 7852599 - DNA, 22 bp, Homo sapiens
catttattagttagttcgatgt

SEQ ID NO: 7852600 - DNA, 22 bp, Homo sapiens
catttattcagctcagtcggtt

SEQ ID NO: 7852601 - DNA, 22 bp, Homo sapiens
catttattcagctcagtcggtt

SEQ ID NO: 7852602 - DNA, 22 bp, Homo sapiens
catttattcagctcagtcggtt

SEQ ID NO: 7852603 - DNA, 22 bp, Homo sapiens
catttattcagctcagtcggtt

SEQ ID NO: 7852604 - DNA, 22 bp, Homo sapiens
catttattcagctcagtcggtt

SEQ ID NO: 7852605 - DNA, 22 bp, Homo sapiens
catttattcatgatctgtagct

SEQ ID NO: 7852606 - DNA, 22 bp, Homo sapiens
catttattcagctcagtcggtt

SEQ ID NO: 7852607 - DNA, 22 bp, Homo sapiens
tccctctctggctggggtgcgg

SEQ ID NO: 7852608 - DNA, 22 bp, Homo sapiens
tccctctcttgggcgtggctca

SEQ ID NO: 7852609 - DNA, 22 bp, Homo sapiens
tccctctcttgggcgtggctca

SEQ ID NO: 7852610 - DNA, 22 bp, Homo sapiens
tccctctctagcctgttcagta

SEQ ID NO: 7852611 - DNA, 22 bp, Homo sapiens
tccctctctagcctgttcagta

SEQ ID NO: 7852612 - DNA, 22 bp, Homo sapiens
tccctctctggctggggtgcgg

SEQ ID NO: 7852613 - DNA, 22 bp, Homo sapiens
tccctctctggctggggtgcgg

SEQ ID NO: 7852614 - DNA, 22 bp, Homo sapiens
tccctgggttcccgtggaagtg

SEQ ID NO: 7852615 - DNA, 16 bp, Homo sapiens
tcctaacgtgcagcca

SEQ ID NO: 7852616 - DNA, 23 bp, Homo sapiens
tcctaactgattctgcagtctct

SEQ ID NO: 7852617 - DNA, 22 bp, Homo sapiens
tcctaactccactagccttggg

SEQ ID NO: 7852618 - DNA, 23 bp, Homo sapiens
tcctaactgattctgcagtctct

SEQ ID NO: 7852619 - DNA, 23 bp, Homo sapiens
tcctaactcaattcaggggtgtc

SEQ ID NO: 7852620 - DNA, 23 bp, Homo sapiens
tcctaactcaattcaggggtgtc

SEQ ID NO: 7852621 - DNA, 22 bp, Homo sapiens
tccctgggttcccgtggaagtg

SEQ ID NO: 7852622 - DNA, 22 bp, Homo sapiens
tccctgggtcctgcttgctctc

SEQ ID NO: 7852623 - DNA, 22 bp, Homo sapiens
tccctgggtcctgcttgctctc

SEQ ID NO: 7852624 - DNA, 22 bp, Homo sapiens
tccctgggtcattctctggcac

SEQ ID NO: 7852625 - DNA, 22 bp, Homo sapiens
tccctgggtcctgcttgctctc

SEQ ID NO: 7852626 - DNA, 22 bp, Homo sapiens
tccctgggtcctgcttgctctc

SEQ ID NO: 7852627 - DNA, 22 bp, Homo sapiens
tccctgggtcctgcttgctctc

SEQ ID NO: 7852628 - DNA, 18 bp, Homo sapiens
tccctggggctgccaccc

SEQ ID NO: 7852629 - DNA, 18 bp, Homo sapiens
tccctggggctgccaccc

SEQ ID NO: 7852630 - DNA, 20 bp, Homo sapiens
tccctggggccctacttcct

SEQ ID NO: 7852631 - DNA, 22 bp, Homo sapiens
tccctgctttcttgtgagggga

SEQ ID NO: 7852632 - DNA, 22 bp, Homo sapiens
tccctggaacagagagacaacg

SEQ ID NO: 7852633 - DNA, 22 bp, Homo sapiens
tccctggaacagagagacaacg

SEQ ID NO: 7852634 - DNA, 22 bp, Homo sapiens
tccctggaacagagagacaacg

SEQ ID NO: 7852635 - DNA, 22 bp, Homo sapiens
catttattgagtggccacagtg

SEQ ID NO: 7852636 - DNA, 22 bp, Homo sapiens
catttattgagtggccacagtg

SEQ ID NO: 7852637 - DNA, 22 bp, Homo sapiens
tccctggggttcctccagccac

SEQ ID NO: 7852638 - DNA, 22 bp, Homo sapiens
tccctggggttcctccagccac

SEQ ID NO: 7852639 - DNA, 22 bp, Homo sapiens
tccctggggtatcgctgaggca

SEQ ID NO: 7852640 - DNA, 22 bp, Homo sapiens
tccctggggtatcgctgaggca

SEQ ID NO: 7852641 - DNA, 22 bp, Homo sapiens
tccctgggtcattctctggcac

SEQ ID NO: 7852642 - DNA, 22 bp, Homo sapiens
tccctggggttcctccagccac

SEQ ID NO: 7852643 - DNA, 22 bp, Homo sapiens
tccctggggtatcgctgaggca

SEQ ID NO: 7852644 - DNA, 22 bp, Homo sapiens
tccctggggtatcgctgaggca

SEQ ID NO: 7852645 - DNA, 22 bp, Homo sapiens
tccctggggtaacattagaggg

SEQ ID NO: 7852646 - DNA, 22 bp, Homo sapiens
tccctggggtatcgctgaggca

SEQ ID NO: 7852647 - DNA, 22 bp, Homo sapiens
tccctggggtatcgctgaggca

SEQ ID NO: 7852648 - DNA, 22 bp, Homo sapiens
catgggcaccttaaaatgaggc

SEQ ID NO: 7852649 - DNA, 22 bp, Homo sapiens
catgggcagaagtggcatcatt

SEQ ID NO: 7852650 - DNA, 23 bp, Homo sapiens
catgggagtgagaatgccagctc

SEQ ID NO: 7852651 - DNA, 23 bp, Homo sapiens
catgggagtgagaatgccagctc

SEQ ID NO: 7852652 - DNA, 22 bp, Homo sapiens
catgggaggttggcttggcatg

SEQ ID NO: 7852653 - DNA, 22 bp, Homo sapiens
catgggaggttggcttggcatg

SEQ ID NO: 7852654 - DNA, 22 bp, Homo sapiens
catgggaggttggcttggcatg

SEQ ID NO: 7852655 - DNA, 22 bp, Homo sapiens
catgggaggttggcttggcatg

SEQ ID NO: 7852656 - DNA, 22 bp, Homo sapiens
catgggaggtctgcaaggtgct

SEQ ID NO: 7852657 - DNA, 22 bp, Homo sapiens
catgggaggcctgctgctggtg

SEQ ID NO: 7852658 - DNA, 22 bp, Homo sapiens
catgggaggtctgcaaggtgct

SEQ ID NO: 7852659 - DNA, 22 bp, Homo sapiens
catgggaggtctgcaaggtgct

SEQ ID NO: 7852660 - DNA, 22 bp, Homo sapiens
catgggaggtctgcaaggtgct

SEQ ID NO: 7852661 - DNA, 22 bp, Homo sapiens
catgggaggcctgctgctggtg

SEQ ID NO: 7852662 - DNA, 22 bp, Homo sapiens
catgggaggcctgctgctggtg

SEQ ID NO: 7852663 - DNA, 22 bp, Homo sapiens
catgggaggcctgctgctggtg

SEQ ID NO: 7852664 - DNA, 22 bp, Homo sapiens
tccaggagcatccaggtgaagc

SEQ ID NO: 7852665 - DNA, 22 bp, Homo sapiens
tccaggagcatccaggtgaagc

SEQ ID NO: 7852666 - DNA, 21 bp, Homo sapiens
tccaggagcacgggactagga

SEQ ID NO: 7852667 - DNA, 21 bp, Homo sapiens
tccaggagcacgggactagga

SEQ ID NO: 7852668 - DNA, 21 bp, Homo sapiens
tccaggagcacgggactagga

SEQ ID NO: 7852669 - DNA, 21 bp, Homo sapiens
tccaggagcacgggactagga

SEQ ID NO: 7852670 - DNA, 19 bp, Homo sapiens
tccaggagcaaagccagtt

SEQ ID NO: 7852671 - DNA, 19 bp, Homo sapiens
tccaggagcaaagccagtt

SEQ ID NO: 7852672 - DNA, 19 bp, Homo sapiens
tccaggagcaaagccagtt

SEQ ID NO: 7852673 - DNA, 22 bp, Homo sapiens
tccaggagaggtgtggggactg

SEQ ID NO: 7852674 - DNA, 22 bp, Homo sapiens
tccaggagaggcctgaccaggt

SEQ ID NO: 7852675 - DNA, 22 bp, Homo sapiens
tccaggagaggcctgaccaggt

SEQ ID NO: 7852676 - DNA, 22 bp, Homo sapiens
tccaggagaggcctgaccaggt

SEQ ID NO: 7852677 - DNA, 22 bp, Homo sapiens
tccaggagattcattaggtcat

SEQ ID NO: 7852678 - DNA, 22 bp, Homo sapiens
tccaggagatacactgcaccag

SEQ ID NO: 7852679 - DNA, 22 bp, Homo sapiens
tccaggagatacactgcaccag

SEQ ID NO: 7852680 - DNA, 22 bp, Homo sapiens
tccaggagatacactgcaccag

SEQ ID NO: 7852681 - DNA, 17 bp, Homo sapiens
tccaggagaggcaatgg

SEQ ID NO: 7852682 - DNA, 17 bp, Homo sapiens
tccaggagaggcaatgg

SEQ ID NO: 7852683 - DNA, 22 bp, Homo sapiens
tccaggagaggcctgaccaggt

SEQ ID NO: 7852684 - DNA, 22 bp, Homo sapiens
tccaggagaggcctgaccaggt

SEQ ID NO: 7852685 - DNA, 22 bp, Homo sapiens
tccaggagaggcctgaccaggt

SEQ ID NO: 7852686 - DNA, 17 bp, Homo sapiens
tccaggagaggcaatgg

SEQ ID NO: 7852687 - DNA, 22 bp, Homo sapiens
tccaggagaccagatgtaggcc

SEQ ID NO: 7852688 - DNA, 22 bp, Homo sapiens
tccaggagacacccttgtgtgt

SEQ ID NO: 7852689 - DNA, 22 bp, Homo sapiens
tccaggagacacaaggtacata

SEQ ID NO: 7852690 - DNA, 23 bp, Homo sapiens
tccaggagaattccagggcccgg

SEQ ID NO: 7852691 - DNA, 22 bp, Homo sapiens
tccatcaccacagaggacagag

SEQ ID NO: 7852692 - DNA, 22 bp, Homo sapiens
tccatttaggttccactagtta

SEQ ID NO: 7852693 - DNA, 22 bp, Homo sapiens
tccatttaggttccactagtta

SEQ ID NO: 7852694 - DNA, 22 bp, Homo sapiens
tccatcaccacagaggacagag

SEQ ID NO: 7852695 - DNA, 22 bp, Homo sapiens
catgggctctctgagctccagg

SEQ ID NO: 7852696 - DNA, 22 bp, Homo sapiens
catgggctcaaccttgaccaca

SEQ ID NO: 7852697 - DNA, 22 bp, Homo sapiens
catgggctctctgagctccagg

SEQ ID NO: 7852698 - DNA, 22 bp, Homo sapiens
tccatattaactaaaactagaa

SEQ ID NO: 7852699 - DNA, 22 bp, Homo sapiens
tccattttagaagaaaatccac

SEQ ID NO: 7852700 - DNA, 22 bp, Homo sapiens
tccatttggcctctgtattgta

SEQ ID NO: 7852701 - DNA, 22 bp, Homo sapiens
tccatttggcactctatttcca

SEQ ID NO: 7852702 - DNA, 22 bp, Homo sapiens
catgggcccgtgagaggcaggg

SEQ ID NO: 7852703 - DNA, 22 bp, Homo sapiens
catgggcccgtgagaggcaggg

SEQ ID NO: 7852704 - DNA, 22 bp, Homo sapiens
catgggctacagaagcatgctg

SEQ ID NO: 7852705 - DNA, 22 bp, Homo sapiens
catgggctacagaagcatgctg

SEQ ID NO: 7852706 - DNA, 22 bp, Homo sapiens
catgggctacagaagcatgctg

SEQ ID NO: 7852707 - DNA, 22 bp, Homo sapiens
catgggctacagaagcatgctg

SEQ ID NO: 7852708 - DNA, 22 bp, Homo sapiens
catgggccatggtgaagccagg

SEQ ID NO: 7852709 - DNA, 22 bp, Homo sapiens
catgggcagttggcagggctca

SEQ ID NO: 7852710 - DNA, 22 bp, Homo sapiens
catgggcagttggcagggctca

SEQ ID NO: 7852711 - DNA, 22 bp, Homo sapiens
catgggcagttggcagggctca

SEQ ID NO: 7852712 - DNA, 22 bp, Homo sapiens
catgggcagttggcagggctca

SEQ ID NO: 7852713 - DNA, 20 bp, Homo sapiens
tcccaaaattctactttatc

SEQ ID NO: 7852714 - DNA, 20 bp, Homo sapiens
tcccaaaattctactttatc

SEQ ID NO: 7852715 - DNA, 22 bp, Homo sapiens
tccatttttcatgactcctcaa

SEQ ID NO: 7852716 - DNA, 22 bp, Homo sapiens
tcccaaaaaaggtatgttgaag

SEQ ID NO: 7852717 - DNA, 22 bp, Homo sapiens
tccatttttcatgactcctcaa

SEQ ID NO: 7852718 - DNA, 22 bp, Homo sapiens
tccattttgtaggtatgctaca

SEQ ID NO: 7852719 - DNA, 22 bp, Homo sapiens
tccattttctaagtatcactta

SEQ ID NO: 7852720 - DNA, 22 bp, Homo sapiens
tccattttcttgctctaggtaa

SEQ ID NO: 7852721 - DNA, 22 bp, Homo sapiens
tccattttcatctcatgtataa

SEQ ID NO: 7852722 - DNA, 22 bp, Homo sapiens
tccattttcatctcatgtataa

SEQ ID NO: 7852723 - DNA, 22 bp, Homo sapiens
tccattttcatctcatgtataa

SEQ ID NO: 7852724 - DNA, 22 bp, Homo sapiens
tccattttagagatgaagaaac

SEQ ID NO: 7852725 - DNA, 22 bp, Homo sapiens
tccattttagagatgaagaaac

SEQ ID NO: 7852726 - DNA, 22 bp, Homo sapiens
tccattttcatctcatgtataa

SEQ ID NO: 7852727 - DNA, 22 bp, Homo sapiens
tcccacccatcctgcatctctt

SEQ ID NO: 7852728 - DNA, 22 bp, Homo sapiens
tcccacccatcctgcatctctt

SEQ ID NO: 7852729 - DNA, 22 bp, Homo sapiens
tcccacccatcctgcatctctt

SEQ ID NO: 7852730 - DNA, 22 bp, Homo sapiens
tcccacccatcctgcatctctt

SEQ ID NO: 7852731 - DNA, 22 bp, Homo sapiens
cattcttgaaccaggcactgtg

SEQ ID NO: 7852732 - DNA, 22 bp, Homo sapiens
cattcttgcaccgtgatggctt

SEQ ID NO: 7852733 - DNA, 22 bp, Homo sapiens
cattcttctggatagttagttg

SEQ ID NO: 7852734 - DNA, 22 bp, Homo sapiens
cattcttctcccttaccttcca

SEQ ID NO: 7852735 - DNA, 22 bp, Homo sapiens
tcccacatgtgaatcctcaggt

SEQ ID NO: 7852736 - DNA, 22 bp, Homo sapiens
cattcttgcaccgtgatggctt

SEQ ID NO: 7852737 - DNA, 22 bp, Homo sapiens
cattcttgcaccgtgatggctt

SEQ ID NO: 7852738 - DNA, 22 bp, Homo sapiens
cattcttgaaccaggcactgtg

SEQ ID NO: 7852739 - DNA, 22 bp, Homo sapiens
cattcttgcaccgtgatggctt

SEQ ID NO: 7852740 - DNA, 22 bp, Homo sapiens
tcccacattaccctgactgaca

SEQ ID NO: 7852741 - DNA, 22 bp, Homo sapiens
tcccaccaggtgaccatttcat

SEQ ID NO: 7852742 - DNA, 22 bp, Homo sapiens
tcccacatgtgaatcctcaggt

SEQ ID NO: 7852743 - DNA, 22 bp, Homo sapiens
tcccacattaccctgactgaca

SEQ ID NO: 7852744 - DNA, 22 bp, Homo sapiens
tcccaccccctccaaggaggaa

SEQ ID NO: 7852745 - DNA, 22 bp, Homo sapiens
tcccaccccctccaaggaggaa

SEQ ID NO: 7852746 - DNA, 22 bp, Homo sapiens
tcccaccccctccaaggaggaa

SEQ ID NO: 7852747 - DNA, 22 bp, Homo sapiens
tcccaccccctccaaggaggaa

SEQ ID NO: 7852748 - DNA, 22 bp, Homo sapiens
tcccaccccctccaaggaggaa

SEQ ID NO: 7852749 - DNA, 22 bp, Homo sapiens
tcccaccccggtcaagggctga

SEQ ID NO: 7852750 - DNA, 22 bp, Homo sapiens
tcccaccccggtcaagggctga

SEQ ID NO: 7852751 - DNA, 22 bp, Homo sapiens
tcccaccccggtcaagggctga

SEQ ID NO: 7852752 - DNA, 22 bp, Homo sapiens
tcccaccccggtcaagggctga

SEQ ID NO: 7852753 - DNA, 22 bp, Homo sapiens
tcccaccccttgactctttaag

SEQ ID NO: 7852754 - DNA, 22 bp, Homo sapiens
tcccaccccttgactctttaag

SEQ ID NO: 7852755 - DNA, 22 bp, Homo sapiens
tcccaccccggtcaagggctga

SEQ ID NO: 7852756 - DNA, 22 bp, Homo sapiens
tcccaccccttgactctttaag

SEQ ID NO: 7852757 - DNA, 22 bp, Homo sapiens
tcccaccttccgtggaacccgt

SEQ ID NO: 7852758 - DNA, 22 bp, Homo sapiens
cattcttacacaatattttaat

SEQ ID NO: 7852759 - DNA, 22 bp, Homo sapiens
cattctgtgattctaaatccct

SEQ ID NO: 7852760 - DNA, 22 bp, Homo sapiens
cattcttacacaatattttaat

SEQ ID NO: 7852761 - DNA, 17 bp, Homo sapiens
cattctgtaatctttct

SEQ ID NO: 7852762 - DNA, 17 bp, Homo sapiens
cattctgtaatctttct

SEQ ID NO: 7852763 - DNA, 17 bp, Homo sapiens
cattctgtaatctttct

SEQ ID NO: 7852764 - DNA, 22 bp, Homo sapiens
cattcttatatttactcattca

SEQ ID NO: 7852765 - DNA, 22 bp, Homo sapiens
cattcttatatttactcattca

SEQ ID NO: 7852766 - DNA, 22 bp, Homo sapiens
cattcttctcccttaccttcca

SEQ ID NO: 7852767 - DNA, 22 bp, Homo sapiens
cattcttctggatagttagttg

SEQ ID NO: 7852768 - DNA, 22 bp, Homo sapiens
cattctgaccctatgatttaag

SEQ ID NO: 7852769 - DNA, 22 bp, Homo sapiens
cattctgagtcactctttagca

SEQ ID NO: 7852770 - DNA, 22 bp, Homo sapiens
cattctctgatcttcacatacc

SEQ ID NO: 7852771 - DNA, 22 bp, Homo sapiens
cattctctgatcttcacatacc

SEQ ID NO: 7852772 - DNA, 22 bp, Homo sapiens
cattctctgatcttcacatacc

SEQ ID NO: 7852773 - DNA, 22 bp, Homo sapiens
cattctgacagctgaggtcgtg

SEQ ID NO: 7852774 - DNA, 22 bp, Homo sapiens
cattctcttgacaggacagccc

SEQ ID NO: 7852775 - DNA, 22 bp, Homo sapiens
cattcatttgcccagtaagtca

SEQ ID NO: 7852776 - DNA, 22 bp, Homo sapiens
cattctctacactcctgccctg

SEQ ID NO: 7852777 - DNA, 22 bp, Homo sapiens
cattctctctacttgttttcaa

SEQ ID NO: 7852778 - DNA, 22 bp, Homo sapiens
cattctctctacttgttttcaa

SEQ ID NO: 7852779 - DNA, 22 bp, Homo sapiens
cattctctgatcttcacatacc

SEQ ID NO: 7852780 - DNA, 22 bp, Homo sapiens
cattacatttcaaaatgtttcc

SEQ ID NO: 7852781 - DNA, 22 bp, Homo sapiens
cattacatttcaaaatgtttcc

SEQ ID NO: 7852782 - DNA, 22 bp, Homo sapiens
cattacatttcaaaatgtttcc

SEQ ID NO: 7852783 - DNA, 21 bp, Homo sapiens
cattacatggttttagtgaac

SEQ ID NO: 7852784 - DNA, 21 bp, Homo sapiens
cattacatggttttagtgaac

SEQ ID NO: 7852785 - DNA, 22 bp, Homo sapiens
cattacttctcatgcttcatgc

SEQ ID NO: 7852786 - DNA, 22 bp, Homo sapiens
cattacccttcattacttgagg

SEQ ID NO: 7852787 - DNA, 22 bp, Homo sapiens
cattacatttcaaaatgtttcc

SEQ ID NO: 7852788 - DNA, 19 bp, Homo sapiens
cattaccctgtaagggcag

SEQ ID NO: 7852789 - DNA, 22 bp, Homo sapiens
cattacagtgtcagaggaactg

SEQ ID NO: 7852790 - DNA, 22 bp, Homo sapiens
cattacagtgtcagaggaactg

SEQ ID NO: 7852791 - DNA, 22 bp, Homo sapiens
cattacatggtccaggatatat

SEQ ID NO: 7852792 - DNA, 21 bp, Homo sapiens
cattacatggttttagtgaac

SEQ ID NO: 7852793 - DNA, 22 bp, Homo sapiens
cattacatggtccaggatatat

SEQ ID NO: 7852794 - DNA, 22 bp, Homo sapiens
tcccaaacatttttggccttga

SEQ ID NO: 7852795 - DNA, 22 bp, Homo sapiens
cattacagaatatgtaatgatc

SEQ ID NO: 7852796 - DNA, 22 bp, Homo sapiens
tcccaaagaactgaatagtaat

SEQ ID NO: 7852797 - DNA, 22 bp, Homo sapiens
cattagaattaggttgtttacc

SEQ ID NO: 7852798 - DNA, 22 bp, Homo sapiens
cattagaaggttttaaaggaat

SEQ ID NO: 7852799 - DNA, 22 bp, Homo sapiens
cattagattggtgcaaaaataa

SEQ ID NO: 7852800 - DNA, 22 bp, Homo sapiens
cattagattggtgcaaaaataa

SEQ ID NO: 7852801 - DNA, 22 bp, Homo sapiens
cattagaagaacagttatatta

SEQ ID NO: 7852802 - DNA, 22 bp, Homo sapiens
cattagaactaagatgtccagg

SEQ ID NO: 7852803 - DNA, 22 bp, Homo sapiens
cattagaacctataaaaagcat

SEQ ID NO: 7852804 - DNA, 22 bp, Homo sapiens
cattagaactaagatgtccagg

SEQ ID NO: 7852805 - DNA, 22 bp, Homo sapiens
cattagcattacttcaaagagt

SEQ ID NO: 7852806 - DNA, 22 bp, Homo sapiens
cattagctatctgtttacatta

SEQ ID NO: 7852807 - DNA, 22 bp, Homo sapiens
cattaggtatttaagcacacag

SEQ ID NO: 7852808 - DNA, 22 bp, Homo sapiens
cattagtggacttctggaagga

SEQ ID NO: 7852809 - DNA, 22 bp, Homo sapiens
cattaggtatttaagcacacag

SEQ ID NO: 7852810 - DNA, 18 bp, Homo sapiens
cattagcaccacgtagag

SEQ ID NO: 7852811 - DNA, 18 bp, Homo sapiens
cattagcaccacgtagag

SEQ ID NO: 7852812 - DNA, 22 bp, Homo sapiens
cattagcaggcactaagaaggt

SEQ ID NO: 7852813 - DNA, 22 bp, Homo sapiens
cattagcattacttcaaagagt

SEQ ID NO: 7852814 - DNA, 22 bp, Homo sapiens
cattagcattacttcaaagagt

SEQ ID NO: 7852815 - DNA, 22 bp, Homo sapiens
cattctcaatagtagatgagta

SEQ ID NO: 7852816 - DNA, 22 bp, Homo sapiens
cattctcaatagtagatgagta

SEQ ID NO: 7852817 - DNA, 22 bp, Homo sapiens
cattctcaatagtagatgagta

SEQ ID NO: 7852818 - DNA, 22 bp, Homo sapiens
cattctattgtagcaccctgta

SEQ ID NO: 7852819 - DNA, 22 bp, Homo sapiens
cattctcagtatcagccagccc

SEQ ID NO: 7852820 - DNA, 22 bp, Homo sapiens
cattctctacactcctgccctg

SEQ ID NO: 7852821 - DNA, 22 bp, Homo sapiens
cattcatttgcccagtaagtca

SEQ ID NO: 7852822 - DNA, 22 bp, Homo sapiens
cattcatttatgaaatatctat

SEQ ID NO: 7852823 - DNA, 22 bp, Homo sapiens
cattctaggcctggcttgggcc

SEQ ID NO: 7852824 - DNA, 22 bp, Homo sapiens
cattctatgaaaactaggcaat

SEQ ID NO: 7852825 - DNA, 22 bp, Homo sapiens
cataatatctccgattacttgc

SEQ ID NO: 7852826 - DNA, 22 bp, Homo sapiens
cataatatctccgattacttgc

SEQ ID NO: 7852827 - DNA, 22 bp, Homo sapiens
cataatatctccgattacttgc

SEQ ID NO: 7852828 - DNA, 22 bp, Homo sapiens
cataatatctccgattacttgc

SEQ ID NO: 7852829 - DNA, 22 bp, Homo sapiens
cataatatctccgattacttgc

SEQ ID NO: 7852830 - DNA, 22 bp, Homo sapiens
cataacatccttgctactttga

SEQ ID NO: 7852831 - DNA, 22 bp, Homo sapiens
tcagcagtcctccaggatcaag

SEQ ID NO: 7852832 - DNA, 22 bp, Homo sapiens
tcagcagtcacatgttgtccca

SEQ ID NO: 7852833 - DNA, 22 bp, Homo sapiens
tcagcagtcacatgttgtccca

SEQ ID NO: 7852834 - DNA, 22 bp, Homo sapiens
cataatcagatgtgtacataag

SEQ ID NO: 7852835 - DNA, 22 bp, Homo sapiens
cataatcagatgtgtacataag

SEQ ID NO: 7852836 - DNA, 22 bp, Homo sapiens
cataatccatttgcactgcaga

SEQ ID NO: 7852837 - DNA, 22 bp, Homo sapiens
cataatcccaggcttgcattca

SEQ ID NO: 7852838 - DNA, 22 bp, Homo sapiens
cataatcccccatttgtgacat

SEQ ID NO: 7852839 - DNA, 22 bp, Homo sapiens
cataatcctggtgtagccctct

SEQ ID NO: 7852840 - DNA, 22 bp, Homo sapiens
cataatcctgtcctggattctt

SEQ ID NO: 7852841 - DNA, 22 bp, Homo sapiens
cataatccttgattcaaataat

SEQ ID NO: 7852842 - DNA, 22 bp, Homo sapiens
cataatgtgtgtcatacagact

SEQ ID NO: 7852843 - DNA, 22 bp, Homo sapiens
cataatgtgtgtcatacagact

SEQ ID NO: 7852844 - DNA, 22 bp, Homo sapiens
cataatgtgtgtcatacagact

SEQ ID NO: 7852845 - DNA, 22 bp, Homo sapiens
cataatgtctgacacagtaaga

SEQ ID NO: 7852846 - DNA, 22 bp, Homo sapiens
cataatgtctgacacagtaaga

SEQ ID NO: 7852847 - DNA, 22 bp, Homo sapiens
cataatgtctgacacagtaaga

SEQ ID NO: 7852848 - DNA, 22 bp, Homo sapiens
cataatgtctgacacagtaaga

SEQ ID NO: 7852849 - DNA, 22 bp, Homo sapiens
cataatgtatgcattttccagc

SEQ ID NO: 7852850 - DNA, 22 bp, Homo sapiens
cataatgaacattagctactgt

SEQ ID NO: 7852851 - DNA, 22 bp, Homo sapiens
tcagcaggtggtgggcaggtga

SEQ ID NO: 7852852 - DNA, 22 bp, Homo sapiens
tcagcaggtggtgggcaggtga

SEQ ID NO: 7852853 - DNA, 22 bp, Homo sapiens
tcagcaggtggtgggcaggtga

SEQ ID NO: 7852854 - DNA, 22 bp, Homo sapiens
tcagcaggtggtgggcaggtga

SEQ ID NO: 7852855 - DNA, 22 bp, Homo sapiens
tcagcaggtggtgggcaggtga

SEQ ID NO: 7852856 - DNA, 22 bp, Homo sapiens
tcagcagtagagggggcacagt

SEQ ID NO: 7852857 - DNA, 22 bp, Homo sapiens
tcagcaggtgctttgtttactc

SEQ ID NO: 7852858 - DNA, 22 bp, Homo sapiens
tcagcaggtgcctcagattctt

SEQ ID NO: 7852859 - DNA, 22 bp, Homo sapiens
tcagcaggtgcctcagattctt

SEQ ID NO: 7852860 - DNA, 22 bp, Homo sapiens
tcagcaggtggtgggcaggtga

SEQ ID NO: 7852861 - DNA, 22 bp, Homo sapiens
tcagcaggtgctttgtttactc

SEQ ID NO: 7852862 - DNA, 22 bp, Homo sapiens
tcagcagggtttgacttctaat

SEQ ID NO: 7852863 - DNA, 22 bp, Homo sapiens
tcagcaggtctgaggcggggcc

SEQ ID NO: 7852864 - DNA, 22 bp, Homo sapiens
tcagcagggtttgacttctaat

SEQ ID NO: 7852865 - DNA, 22 bp, Homo sapiens
tcagcaggtctgaggcggggcc

SEQ ID NO: 7852866 - DNA, 22 bp, Homo sapiens
tcagcagggtttgacttctaat

SEQ ID NO: 7852867 - DNA, 22 bp, Homo sapiens
tcagcaggtgcctcagattctt

SEQ ID NO: 7852868 - DNA, 22 bp, Homo sapiens
tcagcaggtgaacatcatgcca

SEQ ID NO: 7852869 - DNA, 22 bp, Homo sapiens
tcagcaggtgaacatcatgcca

SEQ ID NO: 7852870 - DNA, 22 bp, Homo sapiens
tcagcaggtctgaggcggggcc

SEQ ID NO: 7852871 - DNA, 22 bp, Homo sapiens
tcagcaggtctgaggcggggcc

SEQ ID NO: 7852872 - DNA, 22 bp, Homo sapiens
cataattaggcagttgatcatt

SEQ ID NO: 7852873 - DNA, 22 bp, Homo sapiens
cataattagagaattcatgtta

SEQ ID NO: 7852874 - DNA, 22 bp, Homo sapiens
cataattactgatatgctgatt

SEQ ID NO: 7852875 - DNA, 22 bp, Homo sapiens
cataattactgatatgctgatt

SEQ ID NO: 7852876 - DNA, 22 bp, Homo sapiens
cataattaaattctgggcaaga

SEQ ID NO: 7852877 - DNA, 22 bp, Homo sapiens
cataattaaattctgggcaaga

SEQ ID NO: 7852878 - DNA, 22 bp, Homo sapiens
cataatgtgtgtcatacagact

SEQ ID NO: 7852879 - DNA, 22 bp, Homo sapiens
cataatgttaatcttgactcca

SEQ ID NO: 7852880 - DNA, 22 bp, Homo sapiens
cataatgttgtaacacatagag

SEQ ID NO: 7852881 - DNA, 22 bp, Homo sapiens
cataatgttgtaacacatagag

SEQ ID NO: 7852882 - DNA, 22 bp, Homo sapiens
cataatttcccaagagattgaa

SEQ ID NO: 7852883 - DNA, 22 bp, Homo sapiens
cataatttcactgtcgtatggc

SEQ ID NO: 7852884 - DNA, 22 bp, Homo sapiens
cataatttcactgtcgtatggc

SEQ ID NO: 7852885 - DNA, 22 bp, Homo sapiens
cataatttctaccagggccata

SEQ ID NO: 7852886 - DNA, 22 bp, Homo sapiens
cataattataaacgcaagttca

SEQ ID NO: 7852887 - DNA, 22 bp, Homo sapiens
cataattagtcatgttatgcat

SEQ ID NO: 7852888 - DNA, 22 bp, Homo sapiens
cataattataaacgcaagttca

SEQ ID NO: 7852889 - DNA, 22 bp, Homo sapiens
cataattaggcagttgatcatt

SEQ ID NO: 7852890 - DNA, 22 bp, Homo sapiens
cataattaggcagttgatcatt

SEQ ID NO: 7852891 - DNA, 22 bp, Homo sapiens
cataattagtcatgttatgcat

SEQ ID NO: 7852892 - DNA, 22 bp, Homo sapiens
tcaggcccagagtcacggatcc

SEQ ID NO: 7852893 - DNA, 22 bp, Homo sapiens
tcaggcccagagtcacggatcc

SEQ ID NO: 7852894 - DNA, 22 bp, Homo sapiens
tcaggcccagagtcacggatcc

SEQ ID NO: 7852895 - DNA, 22 bp, Homo sapiens
tcaggcagagtggaagctgcaa

SEQ ID NO: 7852896 - DNA, 22 bp, Homo sapiens
tcaggcagagttaatttgctcc

SEQ ID NO: 7852897 - DNA, 22 bp, Homo sapiens
tcaggccaggagatcagattga

SEQ ID NO: 7852898 - DNA, 22 bp, Homo sapiens
tcaggcagagtggaagctgcaa

SEQ ID NO: 7852899 - DNA, 22 bp, Homo sapiens
tcaggcagagtggaagctgcaa

SEQ ID NO: 7852900 - DNA, 18 bp, Homo sapiens
cataattttctttcttta

SEQ ID NO: 7852901 - DNA, 22 bp, Homo sapiens
tcaggcagagtggaagctgcaa

SEQ ID NO: 7852902 - DNA, 18 bp, Homo sapiens
cataattttctttcttta

SEQ ID NO: 7852903 - DNA, 22 bp, Homo sapiens
tcaggcagagtggaagctgcaa

SEQ ID NO: 7852904 - DNA, 22 bp, Homo sapiens
tcaggcagagtggaagctgcaa

SEQ ID NO: 7852905 - DNA, 22 bp, Homo sapiens
tcaggcagagtggaagctgcaa

SEQ ID NO: 7852906 - DNA, 22 bp, Homo sapiens
cataatttgatatgcttgatgg

SEQ ID NO: 7852907 - DNA, 22 bp, Homo sapiens
cataatttgatatgcttgatgg

SEQ ID NO: 7852908 - DNA, 22 bp, Homo sapiens
cataatttgatatgcttgatgg

SEQ ID NO: 7852909 - DNA, 22 bp, Homo sapiens
cataatttctgtatcagcacca

SEQ ID NO: 7852910 - DNA, 22 bp, Homo sapiens
cataatttctgtatcagcacca

SEQ ID NO: 7852911 - DNA, 18 bp, Homo sapiens
cataattttctttcttta

SEQ ID NO: 7852912 - DNA, 18 bp, Homo sapiens
cataattttctttcttta

SEQ ID NO: 7852913 - DNA, 22 bp, Homo sapiens
cataattttccatggtttgcta

SEQ ID NO: 7852914 - DNA, 22 bp, Homo sapiens
cataattttccatggtttgcta

SEQ ID NO: 7852915 - DNA, 22 bp, Homo sapiens
cataatttgtggtagtggggga

SEQ ID NO: 7852916 - DNA, 22 bp, Homo sapiens
catagaaactgagacaaggatt

SEQ ID NO: 7852917 - DNA, 22 bp, Homo sapiens
catagaaactgagacaaggatt

SEQ ID NO: 7852918 - DNA, 22 bp, Homo sapiens
catagaaacttgcagcaagcac

SEQ ID NO: 7852919 - DNA, 22 bp, Homo sapiens
catagaaacttgcagcaagcac

SEQ ID NO: 7852920 - DNA, 22 bp, Homo sapiens
catagaaactgagacaaggatt

SEQ ID NO: 7852921 - DNA, 22 bp, Homo sapiens
catagaaaagagtaggtaatgt

SEQ ID NO: 7852922 - DNA, 22 bp, Homo sapiens
catagaaactgagacaaggatt

SEQ ID NO: 7852923 - DNA, 22 bp, Homo sapiens
tcaggcctgagaaaaatccttt

SEQ ID NO: 7852924 - DNA, 22 bp, Homo sapiens
tcaggcctgagaaaaatccttt

SEQ ID NO: 7852925 - DNA, 22 bp, Homo sapiens
tcaggcctgagaaaaatccttt

SEQ ID NO: 7852926 - DNA, 22 bp, Homo sapiens
tcaggcctgagaaaaatccttt

SEQ ID NO: 7852927 - DNA, 22 bp, Homo sapiens
catagaaaagagtaggtaatgt

SEQ ID NO: 7852928 - DNA, 22 bp, Homo sapiens
catagaaactgagacaaggatt

SEQ ID NO: 7852929 - DNA, 22 bp, Homo sapiens
catagaaactgagacaaggatt

SEQ ID NO: 7852930 - DNA, 22 bp, Homo sapiens
catagaaactgagacaaggatt

SEQ ID NO: 7852931 - DNA, 22 bp, Homo sapiens
catagaaatcaggtgagaatct

SEQ ID NO: 7852932 - DNA, 22 bp, Homo sapiens
catagaaatcaggtgagaatct

SEQ ID NO: 7852933 - DNA, 22 bp, Homo sapiens
catagaaatcaggtgagaatct

SEQ ID NO: 7852934 - DNA, 22 bp, Homo sapiens
catagaaatcaggtgagaatct

SEQ ID NO: 7852935 - DNA, 22 bp, Homo sapiens
catagaaatcaggtgagaatct

SEQ ID NO: 7852936 - DNA, 22 bp, Homo sapiens
catagaaacttgcagcaagcac

SEQ ID NO: 7852937 - DNA, 22 bp, Homo sapiens
catagaaagtattatggaattt

SEQ ID NO: 7852938 - DNA, 22 bp, Homo sapiens
catagaaagtattatggaattt

SEQ ID NO: 7852939 - DNA, 22 bp, Homo sapiens
catagaaagtattatggaattt

SEQ ID NO: 7852940 - DNA, 22 bp, Homo sapiens
tcaggcccttctcccaggactc

SEQ ID NO: 7852941 - DNA, 22 bp, Homo sapiens
tcaggccctttgctgctgcccc

SEQ ID NO: 7852942 - DNA, 22 bp, Homo sapiens
tcaggcccttctcccaggactc

SEQ ID NO: 7852943 - DNA, 22 bp, Homo sapiens
tcaggcccttctcccaggactc

SEQ ID NO: 7852944 - DNA, 22 bp, Homo sapiens
tcaggcccttctcccaggactc

SEQ ID NO: 7852945 - DNA, 22 bp, Homo sapiens
tcaggcccttctcccaggactc

SEQ ID NO: 7852946 - DNA, 22 bp, Homo sapiens
tcaggccccatcccagacttat

SEQ ID NO: 7852947 - DNA, 22 bp, Homo sapiens
tcaggcccagagtcacggatcc

SEQ ID NO: 7852948 - DNA, 22 bp, Homo sapiens
tcaggccccatcccagacttat

SEQ ID NO: 7852949 - DNA, 22 bp, Homo sapiens
tcaggccccatcccagacttat

SEQ ID NO: 7852950 - DNA, 22 bp, Homo sapiens
tcaggccccttgtcagctctgt

SEQ ID NO: 7852951 - DNA, 22 bp, Homo sapiens
tcaggccccttgtcagctctgt

SEQ ID NO: 7852952 - DNA, 22 bp, Homo sapiens
tcaggcctagaacacagcagat

SEQ ID NO: 7852953 - DNA, 22 bp, Homo sapiens
tcaggccctttgctgctgcccc

SEQ ID NO: 7852954 - DNA, 22 bp, Homo sapiens
tcaggcctagaacacagcagat

SEQ ID NO: 7852955 - DNA, 22 bp, Homo sapiens
tcaggcctagggagaaaattca

SEQ ID NO: 7852956 - DNA, 22 bp, Homo sapiens
tcaggcctagggagaaaattca

SEQ ID NO: 7852957 - DNA, 22 bp, Homo sapiens
tcaggcctagggagaaaattca

SEQ ID NO: 7852958 - DNA, 22 bp, Homo sapiens
tcaggcccttctcccaggactc

SEQ ID NO: 7852959 - DNA, 22 bp, Homo sapiens
tcaggcctagggagccacacca

SEQ ID NO: 7852960 - DNA, 22 bp, Homo sapiens
tcaggcctagggagccacacca

SEQ ID NO: 7852961 - DNA, 22 bp, Homo sapiens
tcaggcctagggagccacacca

SEQ ID NO: 7852962 - DNA, 22 bp, Homo sapiens
tcaggcctagggagccacacca

SEQ ID NO: 7852963 - DNA, 22 bp, Homo sapiens
tcaggcctcaagctgctttaag

SEQ ID NO: 7852964 - DNA, 22 bp, Homo sapiens
tcaggcctcaagctgctttaag

SEQ ID NO: 7852965 - DNA, 22 bp, Homo sapiens
tcaggcctcaagctgctttaag

SEQ ID NO: 7852966 - DNA, 22 bp, Homo sapiens
tcaggcctcaagctgctttaag

SEQ ID NO: 7852967 - DNA, 22 bp, Homo sapiens
tcaggcctcagaaattgcactg

SEQ ID NO: 7852968 - DNA, 22 bp, Homo sapiens
tcaggcctcagcagcccacagg

SEQ ID NO: 7852969 - DNA, 22 bp, Homo sapiens
tcaggcctccaggttaccattt

SEQ ID NO: 7852970 - DNA, 22 bp, Homo sapiens
tcaggcctccaggttaccattt

SEQ ID NO: 7852971 - DNA, 22 bp, Homo sapiens
tcaggcctccaggttaccattt

SEQ ID NO: 7852972 - DNA, 22 bp, Homo sapiens
tcaggcctccaggttaccattt

SEQ ID NO: 7852973 - DNA, 22 bp, Homo sapiens
tcaggcctcagcagcccacagg

SEQ ID NO: 7852974 - DNA, 22 bp, Homo sapiens
tcaggcctcagcagcccacagg

SEQ ID NO: 7852975 - DNA, 22 bp, Homo sapiens
catagaaagtattatggaattt

SEQ ID NO: 7852976 - DNA, 21 bp, Homo sapiens
tcaggctgtctgctggttcca

SEQ ID NO: 7852977 - DNA, 21 bp, Homo sapiens
tcaggctgtctgctggttcca

SEQ ID NO: 7852978 - DNA, 22 bp, Homo sapiens
tcaggctgtatatcttgcactc

SEQ ID NO: 7852979 - DNA, 22 bp, Homo sapiens
tcaggctgtatatcttgcactc

SEQ ID NO: 7852980 - DNA, 17 bp, Homo sapiens
tcaggctgtgcctggta

SEQ ID NO: 7852981 - DNA, 21 bp, Homo sapiens
tcaggctgtctgctggttcca

SEQ ID NO: 7852982 - DNA, 21 bp, Homo sapiens
tcaggctgtctgctggttcca

SEQ ID NO: 7852983 - DNA, 17 bp, Homo sapiens
tcaggctgtgcctggta

SEQ ID NO: 7852984 - DNA, 17 bp, Homo sapiens
tcaggctgtgcctggta

SEQ ID NO: 7852985 - DNA, 17 bp, Homo sapiens
tcaggctgtgcctggta

SEQ ID NO: 7852986 - DNA, 17 bp, Homo sapiens
tcaggctgtgcctggta

SEQ ID NO: 7852987 - DNA, 17 bp, Homo sapiens
tcaggctgtgcctggta

SEQ ID NO: 7852988 - DNA, 17 bp, Homo sapiens
tcaggctgtgcctggta

SEQ ID NO: 7852989 - DNA, 22 bp, Homo sapiens
catagaaatcaggtgagaatct

SEQ ID NO: 7852990 - DNA, 22 bp, Homo sapiens
catagaaatcaggtgagaatct

SEQ ID NO: 7852991 - DNA, 22 bp, Homo sapiens
catagaatatgtgtgattgtta

SEQ ID NO: 7852992 - DNA, 22 bp, Homo sapiens
catagaacagctcctagcacat

SEQ ID NO: 7852993 - DNA, 22 bp, Homo sapiens
catagaacagctcctagcacat

SEQ ID NO: 7852994 - DNA, 22 bp, Homo sapiens
catagaatatgtgtgattgtta

SEQ ID NO: 7852995 - DNA, 22 bp, Homo sapiens
catagaatatgtgtgattgtta

SEQ ID NO: 7852996 - DNA, 22 bp, Homo sapiens
catagaacagctcctagcacat

SEQ ID NO: 7852997 - DNA, 22 bp, Homo sapiens
catagaatcatagcacatttga

SEQ ID NO: 7852998 - DNA, 22 bp, Homo sapiens
catagaatcatagcacatttga

SEQ ID NO: 7852999 - DNA, 22 bp, Homo sapiens
catagaatcatagcacatttga

SEQ ID NO: 7853000 - DNA, 22 bp, Homo sapiens
tcaggctgcctatcagactgtg

SEQ ID NO: 7853001 - DNA, 22 bp, Homo sapiens
catagaatggattgacaagatt

SEQ ID NO: 7853002 - DNA, 22 bp, Homo sapiens
catagaatcatagcacatttga

SEQ ID NO: 7853003 - DNA, 22 bp, Homo sapiens
catagaatgcagcaggaaagtt

SEQ ID NO: 7853004 - DNA, 22 bp, Homo sapiens
tcaggctgcctatcagactgtg

SEQ ID NO: 7853005 - DNA, 22 bp, Homo sapiens
tcaggctgtggcttcagttctt

SEQ ID NO: 7853006 - DNA, 22 bp, Homo sapiens
tcaggctgtggcttcagttctt

SEQ ID NO: 7853007 - DNA, 17 bp, Homo sapiens
tcaggctgtgcctggta

SEQ ID NO: 7853008 - DNA, 22 bp, Homo sapiens
tcaggctgtggctttgaccgca

SEQ ID NO: 7853009 - DNA, 22 bp, Homo sapiens
tcaggctgtggcttcagttctt

SEQ ID NO: 7853010 - DNA, 22 bp, Homo sapiens
tcaggctgtgggcactggccat

SEQ ID NO: 7853011 - DNA, 22 bp, Homo sapiens
tcaggctgtgggcactggccat

SEQ ID NO: 7853012 - DNA, 22 bp, Homo sapiens
tcaggctgtggctttgaccgca

SEQ ID NO: 7853013 - DNA, 22 bp, Homo sapiens
tcaggctgtgggcactggccat

SEQ ID NO: 7853014 - DNA, 22 bp, Homo sapiens
tcaggctgtgggcactggccat

SEQ ID NO: 7853015 - DNA, 22 bp, Homo sapiens
tcaggctgtgtctttaaacaat

SEQ ID NO: 7853016 - DNA, 22 bp, Homo sapiens
tcaggctgttagccacctcctc

SEQ ID NO: 7853017 - DNA, 22 bp, Homo sapiens
tcaggctgttagccacctcctc

SEQ ID NO: 7853018 - DNA, 22 bp, Homo sapiens
tcaggctgtgtctttaaacaat

SEQ ID NO: 7853019 - DNA, 22 bp, Homo sapiens
tcagggagagtgacccatccac

SEQ ID NO: 7853020 - DNA, 22 bp, Homo sapiens
tcagggagagtgacccatccac

SEQ ID NO: 7853021 - DNA, 22 bp, Homo sapiens
tcagggagaggtgagagcctgt

SEQ ID NO: 7853022 - DNA, 22 bp, Homo sapiens
tcagggagaggtgagagcctgt

SEQ ID NO: 7853023 - DNA, 22 bp, Homo sapiens
tcagggagaggtgagagcctgt

SEQ ID NO: 7853024 - DNA, 22 bp, Homo sapiens
tcagggagaggtgagagcctgt

SEQ ID NO: 7853025 - DNA, 22 bp, Homo sapiens
tcagggagaggtgagagcctgt

SEQ ID NO: 7853026 - DNA, 22 bp, Homo sapiens
tcagagcaaattcctgtgagcc

SEQ ID NO: 7853027 - DNA, 22 bp, Homo sapiens
tcagagcaaattcctgtgagcc

SEQ ID NO: 7853028 - DNA, 22 bp, Homo sapiens
tcagagcaaattcctgtgagcc

SEQ ID NO: 7853029 - DNA, 22 bp, Homo sapiens
tcagagcaacttttcctgcttt

SEQ ID NO: 7853030 - DNA, 22 bp, Homo sapiens
tcagagattgaaaacatatcca

SEQ ID NO: 7853031 - DNA, 18 bp, Homo sapiens
tcagagcaaacagaagcc

SEQ ID NO: 7853032 - DNA, 23 bp, Homo sapiens
tcagagcaaagggtgcctccgtt

SEQ ID NO: 7853033 - DNA, 22 bp, Homo sapiens
tcagagcaaattcctgtgagcc

SEQ ID NO: 7853034 - DNA, 23 bp, Homo sapiens
tcagagatggaaagcagaccacg

SEQ ID NO: 7853035 - DNA, 22 bp, Homo sapiens
tcagagatggagttagcagtga

SEQ ID NO: 7853036 - DNA, 22 bp, Homo sapiens
tcagagatggagttagcagtga

SEQ ID NO: 7853037 - DNA, 22 bp, Homo sapiens
tcagagattcacgtcagtccca

SEQ ID NO: 7853038 - DNA, 22 bp, Homo sapiens
tcagagattcacgtcagtccca

SEQ ID NO: 7853039 - DNA, 22 bp, Homo sapiens
tcagagattcacgtcagtccca

SEQ ID NO: 7853040 - DNA, 22 bp, Homo sapiens
tcagagatcttcaggatgggac

SEQ ID NO: 7853041 - DNA, 22 bp, Homo sapiens
tcagagatctggagtacaactg

SEQ ID NO: 7853042 - DNA, 22 bp, Homo sapiens
tcagagatcttcaggatgggac

SEQ ID NO: 7853043 - DNA, 22 bp, Homo sapiens
tcagagatgcagtgccacctac

SEQ ID NO: 7853044 - DNA, 22 bp, Homo sapiens
tcagagatgcagtgccacctac

SEQ ID NO: 7853045 - DNA, 22 bp, Homo sapiens
tcagagagttttcactagggtg

SEQ ID NO: 7853046 - DNA, 22 bp, Homo sapiens
tcagagagttttcactagggtg

SEQ ID NO: 7853047 - DNA, 22 bp, Homo sapiens
tcagagagttttcactagggtg

SEQ ID NO: 7853048 - DNA, 22 bp, Homo sapiens
tcagagagttttcactagggtg

SEQ ID NO: 7853049 - DNA, 22 bp, Homo sapiens
tcagagagttttcactagggtg

SEQ ID NO: 7853050 - DNA, 22 bp, Homo sapiens
tcagagatcttcaggatgggac

SEQ ID NO: 7853051 - DNA, 22 bp, Homo sapiens
tcagagatctggagtacaactg

SEQ ID NO: 7853052 - DNA, 22 bp, Homo sapiens
tcagagagtgcaaaatatagct

SEQ ID NO: 7853053 - DNA, 22 bp, Homo sapiens
tcagagagttttcactagggtg

SEQ ID NO: 7853054 - DNA, 22 bp, Homo sapiens
tcagagagttggaaagaattaa

SEQ ID NO: 7853055 - DNA, 22 bp, Homo sapiens
tcagagagttagtgtcttagct

SEQ ID NO: 7853056 - DNA, 22 bp, Homo sapiens
tcagagagttagtgtcttagct

SEQ ID NO: 7853057 - DNA, 22 bp, Homo sapiens
tcagagagttagtgtcttagct

SEQ ID NO: 7853058 - DNA, 22 bp, Homo sapiens
tcagagagttacacaaattgtt

SEQ ID NO: 7853059 - DNA, 21 bp, Homo sapiens
tcagagagtcacagtgaactg

SEQ ID NO: 7853060 - DNA, 21 bp, Homo sapiens
tcagagagtcacagtgaactg

SEQ ID NO: 7853061 - DNA, 22 bp, Homo sapiens
tcagagagtgcaaaatatagct

SEQ ID NO: 7853062 - DNA, 22 bp, Homo sapiens
cagttgtccccaaaatatacgg

SEQ ID NO: 7853063 - DNA, 22 bp, Homo sapiens
cagttgtccccaaaatatacgg

SEQ ID NO: 7853064 - DNA, 22 bp, Homo sapiens
tcagagaggttggtgataagaa

SEQ ID NO: 7853065 - DNA, 22 bp, Homo sapiens
cagttggtgatgaggctagtag

SEQ ID NO: 7853066 - DNA, 22 bp, Homo sapiens
cagttggttttgaggctgtact

SEQ ID NO: 7853067 - DNA, 22 bp, Homo sapiens
cagttggttttgaggctgtact

SEQ ID NO: 7853068 - DNA, 22 bp, Homo sapiens
cagttgtaggcatgtgcatgga

SEQ ID NO: 7853069 - DNA, 22 bp, Homo sapiens
cagttgctggatgtgcagctct

SEQ ID NO: 7853070 - DNA, 22 bp, Homo sapiens
cagttggaggaatgaggctgta

SEQ ID NO: 7853071 - DNA, 17 bp, Homo sapiens
cagttggagacaagtcc

SEQ ID NO: 7853072 - DNA, 23 bp, Homo sapiens
cagttggaggtacagagacactg

SEQ ID NO: 7853073 - DNA, 23 bp, Homo sapiens
cagttggaggtacagagacactg

SEQ ID NO: 7853074 - DNA, 22 bp, Homo sapiens
cagttggaggaatgaggctgta

SEQ ID NO: 7853075 - DNA, 22 bp, Homo sapiens
cagttggaggaatgaggctgta

SEQ ID NO: 7853076 - DNA, 22 bp, Homo sapiens
cagttggaggaatgaggctgta

SEQ ID NO: 7853077 - DNA, 22 bp, Homo sapiens
cagttgcagctgtgacattgcg

SEQ ID NO: 7853078 - DNA, 22 bp, Homo sapiens
cagttgatttttatggtgtgaa

SEQ ID NO: 7853079 - DNA, 22 bp, Homo sapiens
cagttgcctgtttccttgtgtg

SEQ ID NO: 7853080 - DNA, 22 bp, Homo sapiens
cagttgccttatttccttgctg

SEQ ID NO: 7853081 - DNA, 22 bp, Homo sapiens
tcaatattcttctttagtagga

SEQ ID NO: 7853082 - DNA, 22 bp, Homo sapiens
tcaatattcttctttagtagga

SEQ ID NO: 7853083 - DNA, 22 bp, Homo sapiens
tcaatattcttctttagtagga

SEQ ID NO: 7853084 - DNA, 22 bp, Homo sapiens
tcaatatattccatgttttctc

SEQ ID NO: 7853085 - DNA, 22 bp, Homo sapiens
tcaatatagcagtgtacttgag

SEQ ID NO: 7853086 - DNA, 22 bp, Homo sapiens
tcaatagattaggtattagatt

SEQ ID NO: 7853087 - DNA, 22 bp, Homo sapiens
tcaatagattaggtattagatt

SEQ ID NO: 7853088 - DNA, 22 bp, Homo sapiens
tcaatgaaagagcatgcatttt

SEQ ID NO: 7853089 - DNA, 22 bp, Homo sapiens
tcaatctagagattaaaatagg

SEQ ID NO: 7853090 - DNA, 22 bp, Homo sapiens
tcaatcatagtccttctctaga

SEQ ID NO: 7853091 - DNA, 22 bp, Homo sapiens
tcaatcataatgaagtgaagaa

SEQ ID NO: 7853092 - DNA, 22 bp, Homo sapiens
tcaatcacgtgttccatgttct

SEQ ID NO: 7853093 - DNA, 22 bp, Homo sapiens
tcaatcacgtgttccatgttct

SEQ ID NO: 7853094 - DNA, 22 bp, Homo sapiens
cagttgaggactcacctttgaa

SEQ ID NO: 7853095 - DNA, 17 bp, Homo sapiens
cagttgaaatgtttgga

SEQ ID NO: 7853096 - DNA, 20 bp, Homo sapiens
cagttgaaataatttgtttg

SEQ ID NO: 7853097 - DNA, 22 bp, Homo sapiens
cagttctttgtggggagttctc

SEQ ID NO: 7853098 - DNA, 21 bp, Homo sapiens
cagttgatagagatcttgagc

SEQ ID NO: 7853099 - DNA, 22 bp, Homo sapiens
cagttgataataccagagagag

SEQ ID NO: 7853100 - DNA, 22 bp, Homo sapiens
cagttgatatagaaaaaagtga

SEQ ID NO: 7853101 - DNA, 22 bp, Homo sapiens
cagttgatatagaaaaaagtga

SEQ ID NO: 7853102 - DNA, 22 bp, Homo sapiens
cagttgatattgcagacaagca

SEQ ID NO: 7853103 - DNA, 22 bp, Homo sapiens
cagttgatcactataggcttca

SEQ ID NO: 7853104 - DNA, 22 bp, Homo sapiens
cagttgatcactataggcttca

SEQ ID NO: 7853105 - DNA, 22 bp, Homo sapiens
cagttgatgggactcatgtggg

SEQ ID NO: 7853106 - DNA, 23 bp, Homo sapiens
cagttgatgttaccttccttaga

SEQ ID NO: 7853107 - DNA, 22 bp, Homo sapiens
cagttgatgtttagactctgca

SEQ ID NO: 7853108 - DNA, 22 bp, Homo sapiens
cagttgatgtttagactctgca

SEQ ID NO: 7853109 - DNA, 22 bp, Homo sapiens
cagttgattgacttaagtacct

SEQ ID NO: 7853110 - DNA, 22 bp, Homo sapiens
tcaatgaaagagcatgcatttt

SEQ ID NO: 7853111 - DNA, 22 bp, Homo sapiens
cagttactgtatgtcaaagact

SEQ ID NO: 7853112 - DNA, 22 bp, Homo sapiens
cagttagaggaggtaaagatgc

SEQ ID NO: 7853113 - DNA, 22 bp, Homo sapiens
cagttataagactaagctattc

SEQ ID NO: 7853114 - DNA, 22 bp, Homo sapiens
cagttagtaaagcttgttcatg

SEQ ID NO: 7853115 - DNA, 22 bp, Homo sapiens
cagttagcactcagtttccaga

SEQ ID NO: 7853116 - DNA, 22 bp, Homo sapiens
cagttagctgacaagtaggcta

SEQ ID NO: 7853117 - DNA, 22 bp, Homo sapiens
cagttagaggaggtaaagatgc

SEQ ID NO: 7853118 - DNA, 22 bp, Homo sapiens
cagttataagactaagctattc

SEQ ID NO: 7853119 - DNA, 22 bp, Homo sapiens
cagttctggaggctccacatct

SEQ ID NO: 7853120 - DNA, 22 bp, Homo sapiens
cagttcttatttggccagtgtc

SEQ ID NO: 7853121 - DNA, 22 bp, Homo sapiens
cagttcttaataccatgtggtt

SEQ ID NO: 7853122 - DNA, 22 bp, Homo sapiens
cagttctggtttgcagatatat

SEQ ID NO: 7853123 - DNA, 22 bp, Homo sapiens
cagttctggtttgcagatatat

SEQ ID NO: 7853124 - DNA, 22 bp, Homo sapiens
tcagagttggcctttctgtatt

SEQ ID NO: 7853125 - DNA, 22 bp, Homo sapiens
tcagaggattgcctcagcgagc

SEQ ID NO: 7853126 - DNA, 22 bp, Homo sapiens
tcagagttgagctgttttgtgg

SEQ ID NO: 7853127 - DNA, 22 bp, Homo sapiens
tcagagttggcagtaaaacaca

SEQ ID NO: 7853128 - DNA, 22 bp, Homo sapiens
tcagagtttctgatttagtagg

SEQ ID NO: 7853129 - DNA, 22 bp, Homo sapiens
tcagagtttgaaataattttta

SEQ ID NO: 7853130 - DNA, 22 bp, Homo sapiens
tcagagtttctagtcaaatcca

SEQ ID NO: 7853131 - DNA, 22 bp, Homo sapiens
tcagagtttctagtcaaatcca

SEQ ID NO: 7853132 - DNA, 22 bp, Homo sapiens
tcagataaaggagagcttagca

SEQ ID NO: 7853133 - DNA, 22 bp, Homo sapiens
tcagatagtgataatagcatgt

SEQ ID NO: 7853134 - DNA, 22 bp, Homo sapiens
tcagataattaatcatgaaatt

SEQ ID NO: 7853135 - DNA, 22 bp, Homo sapiens
tcagataagtgaagcaaagttt

SEQ ID NO: 7853136 - DNA, 22 bp, Homo sapiens
tcagagtttcaggatacaaata

SEQ ID NO: 7853137 - DNA, 22 bp, Homo sapiens
tcagataccattgaatttgttg

SEQ ID NO: 7853138 - DNA, 21 bp, Homo sapiens
tcagataccagactcaagggg

SEQ ID NO: 7853139 - DNA, 22 bp, Homo sapiens
tcagatactgtggcttatgggc

SEQ ID NO: 7853140 - DNA, 22 bp, Homo sapiens
tcagatatagtcatttaaataa

SEQ ID NO: 7853141 - DNA, 22 bp, Homo sapiens
tcagatattcaattaagttaaa

SEQ ID NO: 7853142 - DNA, 22 bp, Homo sapiens
tcagaggagcaaaagaggggat

SEQ ID NO: 7853143 - DNA, 22 bp, Homo sapiens
tcagaggagccaaagttctgag

SEQ ID NO: 7853144 - DNA, 22 bp, Homo sapiens
tcagaggagctgcagaacgctg

SEQ ID NO: 7853145 - DNA, 22 bp, Homo sapiens
tcagaggagcaaaagaggggat

SEQ ID NO: 7853146 - DNA, 22 bp, Homo sapiens
tcagaggagcaaaagaggggat

SEQ ID NO: 7853147 - DNA, 22 bp, Homo sapiens
tcagaggagcaaaagaggggat

SEQ ID NO: 7853148 - DNA, 18 bp, Homo sapiens
tcagaggagatacctaaa

SEQ ID NO: 7853149 - DNA, 23 bp, Homo sapiens
tcagagcaagatgatgtatgagc

SEQ ID NO: 7853150 - DNA, 23 bp, Homo sapiens
tcagagcaagatgatgtatgagc

SEQ ID NO: 7853151 - DNA, 23 bp, Homo sapiens
tcagagcaagatgatgtatgagc

SEQ ID NO: 7853152 - DNA, 23 bp, Homo sapiens
tcagaggatcatcaaacgttttc

SEQ ID NO: 7853153 - DNA, 22 bp, Homo sapiens
tcagaggatagaaatacttatt

SEQ ID NO: 7853154 - DNA, 22 bp, Homo sapiens
tcagaggatagaaatacttatt

SEQ ID NO: 7853155 - DNA, 22 bp, Homo sapiens
tcagaggaggcatttaaacaga

SEQ ID NO: 7853156 - DNA, 22 bp, Homo sapiens
cataaaaggtagcagtttgaaa

SEQ ID NO: 7853157 - DNA, 22 bp, Homo sapiens
cataaaagccacctatttaaag

SEQ ID NO: 7853158 - DNA, 22 bp, Homo sapiens
cataaaagccacctatttaaag

SEQ ID NO: 7853159 - DNA, 23 bp, Homo sapiens
cataaaatattagtatggtagca

SEQ ID NO: 7853160 - DNA, 23 bp, Homo sapiens
cataaaatattagtatggtagca

SEQ ID NO: 7853161 - DNA, 23 bp, Homo sapiens
cataaaatattagtatggtagca

SEQ ID NO: 7853162 - DNA, 23 bp, Homo sapiens
cataaaatattagtatggtagca

SEQ ID NO: 7853163 - DNA, 23 bp, Homo sapiens
cataaaatattagtatggtagca

SEQ ID NO: 7853164 - DNA, 22 bp, Homo sapiens
cataaaagccacctatttaaag

SEQ ID NO: 7853165 - DNA, 22 bp, Homo sapiens
cataaaagccacctatttaaag

SEQ ID NO: 7853166 - DNA, 17 bp, Homo sapiens
cataaaacagttctatt

SEQ ID NO: 7853167 - DNA, 17 bp, Homo sapiens
cataaaacagttctatt

SEQ ID NO: 7853168 - DNA, 17 bp, Homo sapiens
cataaaacagttctatt

SEQ ID NO: 7853169 - DNA, 22 bp, Homo sapiens
cagtttttcaaaattacatgat

SEQ ID NO: 7853170 - DNA, 22 bp, Homo sapiens
cagtttttgccattaagagtaa

SEQ ID NO: 7853171 - DNA, 22 bp, Homo sapiens
cagtttttcaaaattacatgat

SEQ ID NO: 7853172 - DNA, 22 bp, Homo sapiens
cagtttttcaaaattacatgat

SEQ ID NO: 7853173 - DNA, 22 bp, Homo sapiens
cagtttttcaaaattacatgat

SEQ ID NO: 7853174 - DNA, 22 bp, Homo sapiens
cagtttttcaaaattacatgat

SEQ ID NO: 7853175 - DNA, 22 bp, Homo sapiens
cagtttgtcttgattcagaaca

SEQ ID NO: 7853176 - DNA, 22 bp, Homo sapiens
tcagatctggtgaagttatagt

SEQ ID NO: 7853177 - DNA, 22 bp, Homo sapiens
tcagatgagtgctttcagctgc

SEQ ID NO: 7853178 - DNA, 22 bp, Homo sapiens
tcagatgagtgctttcagctgc

SEQ ID NO: 7853179 - DNA, 23 bp, Homo sapiens
tcagatgaggaatgcatactaat

SEQ ID NO: 7853180 - DNA, 22 bp, Homo sapiens
tcagatctggtgaagttatagt

SEQ ID NO: 7853181 - DNA, 22 bp, Homo sapiens
tcagatctaattggattattat

SEQ ID NO: 7853182 - DNA, 22 bp, Homo sapiens
tcagatattctctaagaacaat

SEQ ID NO: 7853183 - DNA, 22 bp, Homo sapiens
tcagatattctctaagaacaat

SEQ ID NO: 7853184 - DNA, 22 bp, Homo sapiens
tcagatcacaaaagtttctatt

SEQ ID NO: 7853185 - DNA, 22 bp, Homo sapiens
tcagatcatttgtggattcact

SEQ ID NO: 7853186 - DNA, 22 bp, Homo sapiens
tcagatcatggatctattactt

SEQ ID NO: 7853187 - DNA, 22 bp, Homo sapiens
tcagatcatcagctgctttata

SEQ ID NO: 7853188 - DNA, 22 bp, Homo sapiens
cagttttcttgttatatttggg

SEQ ID NO: 7853189 - DNA, 22 bp, Homo sapiens
cagtttttagattagttggtgg

SEQ ID NO: 7853190 - DNA, 22 bp, Homo sapiens
cagtttttagattagttggtgg

SEQ ID NO: 7853191 - DNA, 22 bp, Homo sapiens
cagttttggtgatatttgagaa

SEQ ID NO: 7853192 - DNA, 22 bp, Homo sapiens
cagttttctatggtagaagcat

SEQ ID NO: 7853193 - DNA, 22 bp, Homo sapiens
cagttttctaaagtctctttaa

SEQ ID NO: 7853194 - DNA, 22 bp, Homo sapiens
cagttttctaaagtctctttaa

SEQ ID NO: 7853195 - DNA, 22 bp, Homo sapiens
cagttttccatgactcagagag

SEQ ID NO: 7853196 - DNA, 22 bp, Homo sapiens
cagtttgtgctaggcactattt

SEQ ID NO: 7853197 - DNA, 22 bp, Homo sapiens
catgcatgccgggctgacagag

SEQ ID NO: 7853198 - DNA, 22 bp, Homo sapiens
catgcatgcctggctcacagag

SEQ ID NO: 7853199 - DNA, 22 bp, Homo sapiens
catgcatggtcatgctgggact

SEQ ID NO: 7853200 - DNA, 22 bp, Homo sapiens
catgcatgtttactacagtgac

SEQ ID NO: 7853201 - DNA, 22 bp, Homo sapiens
catgcatgtttactacagtgac

SEQ ID NO: 7853202 - DNA, 22 bp, Homo sapiens
catgcattcagaatctctcaca

SEQ ID NO: 7853203 - DNA, 22 bp, Homo sapiens
catggcagagaaggggaactgg

SEQ ID NO: 7853204 - DNA, 22 bp, Homo sapiens
catggaaggcaaaagacacaga

SEQ ID NO: 7853205 - DNA, 22 bp, Homo sapiens
catggaaggcaaaagacacaga

SEQ ID NO: 7853206 - DNA, 22 bp, Homo sapiens
catggaaggcaaaagacacaga

SEQ ID NO: 7853207 - DNA, 22 bp, Homo sapiens
catggcagagaaggggaactgg

SEQ ID NO: 7853208 - DNA, 22 bp, Homo sapiens
catggcagagcctgcaggtggg

SEQ ID NO: 7853209 - DNA, 22 bp, Homo sapiens
catggcagagaaggggaactgg

SEQ ID NO: 7853210 - DNA, 22 bp, Homo sapiens
catggaactgtataaaggcact

SEQ ID NO: 7853211 - DNA, 22 bp, Homo sapiens
catggaacttcaagaagaaagc

SEQ ID NO: 7853212 - DNA, 22 bp, Homo sapiens
catggaactgtgctgaaaagtg

SEQ ID NO: 7853213 - DNA, 22 bp, Homo sapiens
catggaaggcaaaagacacaga

SEQ ID NO: 7853214 - DNA, 22 bp, Homo sapiens
catgcatttctaccaaggaata

SEQ ID NO: 7853215 - DNA, 22 bp, Homo sapiens
catggcaggaaggacatgcact

SEQ ID NO: 7853216 - DNA, 22 bp, Homo sapiens
catggcaggaaggacatgcact

SEQ ID NO: 7853217 - DNA, 22 bp, Homo sapiens
catggcaggaaggacatgcact

SEQ ID NO: 7853218 - DNA, 22 bp, Homo sapiens
catggcaggaaggacatgcact

SEQ ID NO: 7853219 - DNA, 22 bp, Homo sapiens
catggcaggaaggacatgcact

SEQ ID NO: 7853220 - DNA, 22 bp, Homo sapiens
catggcaggaaggacatgcact

SEQ ID NO: 7853221 - DNA, 22 bp, Homo sapiens
catggcaggaaaatgaacaggc

SEQ ID NO: 7853222 - DNA, 22 bp, Homo sapiens
catggcaggaaaatgaacaggc

SEQ ID NO: 7853223 - DNA, 22 bp, Homo sapiens
catggcaggaaaatgaacaggc

SEQ ID NO: 7853224 - DNA, 22 bp, Homo sapiens
catggcaggaaaatgaacaggc

SEQ ID NO: 7853225 - DNA, 22 bp, Homo sapiens
catggcagctttgggaggagga

SEQ ID NO: 7853226 - DNA, 22 bp, Homo sapiens
catggcagctttgggaggagga

SEQ ID NO: 7853227 - DNA, 22 bp, Homo sapiens
catggcaggaaaatgaacaggc

SEQ ID NO: 7853228 - DNA, 22 bp, Homo sapiens
catggcagctttgggaggagga

SEQ ID NO: 7853229 - DNA, 22 bp, Homo sapiens
catggcagctttgggaggagga

SEQ ID NO: 7853230 - DNA, 23 bp, Homo sapiens
catggcagcaagagctcatggcc

SEQ ID NO: 7853231 - DNA, 23 bp, Homo sapiens
catggcagcaagagctcatggcc

SEQ ID NO: 7853232 - DNA, 22 bp, Homo sapiens
catggcagcctgccctgcttgc

SEQ ID NO: 7853233 - DNA, 22 bp, Homo sapiens
catggcagctcctccagtgtga

SEQ ID NO: 7853234 - DNA, 22 bp, Homo sapiens
catggcagctcctccagtgtga

SEQ ID NO: 7853235 - DNA, 22 bp, Homo sapiens
catggcagctcctccagtgtga

SEQ ID NO: 7853236 - DNA, 22 bp, Homo sapiens
catggcagcctgccctgcttgc

SEQ ID NO: 7853237 - DNA, 22 bp, Homo sapiens
catggcagctcctccagtgtga

SEQ ID NO: 7853238 - DNA, 22 bp, Homo sapiens
catggcagagcctgcaggtggg

SEQ ID NO: 7853239 - DNA, 23 bp, Homo sapiens
catggcagcaagagctcatggcc

SEQ ID NO: 7853240 - DNA, 23 bp, Homo sapiens
catggcagcaagagctcatggcc

SEQ ID NO: 7853241 - DNA, 23 bp, Homo sapiens
catggcagcaagagctcatggcc

SEQ ID NO: 7853242 - DNA, 22 bp, Homo sapiens
catggcagagcctgcaggtggg

SEQ ID NO: 7853243 - DNA, 22 bp, Homo sapiens
catggcagagcctgcaggtggg

SEQ ID NO: 7853244 - DNA, 22 bp, Homo sapiens
catggcagagcctgcaggtggg

SEQ ID NO: 7853245 - DNA, 22 bp, Homo sapiens
catggcagagcctgcaggtggg

SEQ ID NO: 7853246 - DNA, 22 bp, Homo sapiens
catggcagagcctgcaggtggg

SEQ ID NO: 7853247 - DNA, 22 bp, Homo sapiens
catggcaggtgcagattctgtg

SEQ ID NO: 7853248 - DNA, 22 bp, Homo sapiens
catggcaggtgcagattctgtg

SEQ ID NO: 7853249 - DNA, 22 bp, Homo sapiens
catggcagggctgtgggcaggt

SEQ ID NO: 7853250 - DNA, 22 bp, Homo sapiens
catggcagggctgtgggcaggt

SEQ ID NO: 7853251 - DNA, 22 bp, Homo sapiens
catggcagggctgtgggcaggt

SEQ ID NO: 7853252 - DNA, 22 bp, Homo sapiens
catggcagggctgtgggcaggt

SEQ ID NO: 7853253 - DNA, 22 bp, Homo sapiens
catggcagggctgtgggcaggt

SEQ ID NO: 7853254 - DNA, 22 bp, Homo sapiens
catggcagggctgtgggcaggt

SEQ ID NO: 7853255 - DNA, 22 bp, Homo sapiens
catggcagggctgtgggcaggt

SEQ ID NO: 7853256 - DNA, 22 bp, Homo sapiens
catggcattgcataacggggct

SEQ ID NO: 7853257 - DNA, 22 bp, Homo sapiens
catggcattgcataacggggct

SEQ ID NO: 7853258 - DNA, 22 bp, Homo sapiens
catggcagtgattcagcctttg

SEQ ID NO: 7853259 - DNA, 22 bp, Homo sapiens
catggcagtgattcagcctttg

SEQ ID NO: 7853260 - DNA, 22 bp, Homo sapiens
catggcagtgattcagcctttg

SEQ ID NO: 7853261 - DNA, 22 bp, Homo sapiens
catggcagtgattcagcctttg

SEQ ID NO: 7853262 - DNA, 22 bp, Homo sapiens
catggcagtgattcagcctttg

SEQ ID NO: 7853263 - DNA, 22 bp, Homo sapiens
catggcagtgattcagcctttg

SEQ ID NO: 7853264 - DNA, 22 bp, Homo sapiens
catggcagggctgtgggcaggt

SEQ ID NO: 7853265 - DNA, 22 bp, Homo sapiens
catggcagggctgtgggcaggt

SEQ ID NO: 7853266 - DNA, 22 bp, Homo sapiens
catggcagggctgtgggcaggt

SEQ ID NO: 7853267 - DNA, 22 bp, Homo sapiens
catggcaggcttcttcagcctt

SEQ ID NO: 7853268 - DNA, 22 bp, Homo sapiens
catggcaggcttcttcagcctt

SEQ ID NO: 7853269 - DNA, 22 bp, Homo sapiens
catggcaggatctgggcccaca

SEQ ID NO: 7853270 - DNA, 22 bp, Homo sapiens
catggcaggatctgggcccaca

SEQ ID NO: 7853271 - DNA, 22 bp, Homo sapiens
catggcaggatctgggcccaca

SEQ ID NO: 7853272 - DNA, 22 bp, Homo sapiens
catggcaggatctgggcccaca

SEQ ID NO: 7853273 - DNA, 22 bp, Homo sapiens
catggcaggaggctgctggcag

SEQ ID NO: 7853274 - DNA, 22 bp, Homo sapiens
catggcaggaggctgctggcag

SEQ ID NO: 7853275 - DNA, 22 bp, Homo sapiens
catggcaggaggctgctggcag

SEQ ID NO: 7853276 - DNA, 22 bp, Homo sapiens
catggcaggaaggacatgcact

SEQ ID NO: 7853277 - DNA, 22 bp, Homo sapiens
catggcaggaggctgctggcag

SEQ ID NO: 7853278 - DNA, 22 bp, Homo sapiens
catggcaggaaggacatgcact

SEQ ID NO: 7853279 - DNA, 22 bp, Homo sapiens
catggcaggaaggacatgcact

SEQ ID NO: 7853280 - DNA, 22 bp, Homo sapiens
tccaggagaaggccatccagcg

SEQ ID NO: 7853281 - DNA, 22 bp, Homo sapiens
tccaggagaaggccatccagcg

SEQ ID NO: 7853282 - DNA, 22 bp, Homo sapiens
tccaggagaaggccatccagcg

SEQ ID NO: 7853283 - DNA, 22 bp, Homo sapiens
tccaggagaaggccatccagcg

SEQ ID NO: 7853284 - DNA, 22 bp, Homo sapiens
tccaggagaaggccatccagcg

SEQ ID NO: 7853285 - DNA, 22 bp, Homo sapiens
tccaggagaaggccatccagcg

SEQ ID NO: 7853286 - DNA, 22 bp, Homo sapiens
tccaggagaaggccatccagcg

SEQ ID NO: 7853287 - DNA, 23 bp, Homo sapiens
tccaggagaattccagggcccgg

SEQ ID NO: 7853288 - DNA, 22 bp, Homo sapiens
tccaggagaaggccatccagcg

SEQ ID NO: 7853289 - DNA, 20 bp, Homo sapiens
tccagctgggaacagctgat

SEQ ID NO: 7853290 - DNA, 22 bp, Homo sapiens
tccagctggggacatgggcttc

SEQ ID NO: 7853291 - DNA, 22 bp, Homo sapiens
tccagctggggacatgggcttc

SEQ ID NO: 7853292 - DNA, 20 bp, Homo sapiens
tccagctgggaacagctgat

SEQ ID NO: 7853293 - DNA, 22 bp, Homo sapiens
catggccaaggatgctcaacca

SEQ ID NO: 7853294 - DNA, 22 bp, Homo sapiens
catggcattttttcatggagac

SEQ ID NO: 7853295 - DNA, 22 bp, Homo sapiens
catggcattttttcatggagac

SEQ ID NO: 7853296 - DNA, 22 bp, Homo sapiens
catggccacatctagctgcaag

SEQ ID NO: 7853297 - DNA, 22 bp, Homo sapiens
catggccacatctagctgcaag

SEQ ID NO: 7853298 - DNA, 22 bp, Homo sapiens
catggccacatctagctgcaag

SEQ ID NO: 7853299 - DNA, 22 bp, Homo sapiens
catggccacatctagctgcaag

SEQ ID NO: 7853300 - DNA, 22 bp, Homo sapiens
catggccacatctagctgcaag

SEQ ID NO: 7853301 - DNA, 22 bp, Homo sapiens
catgcagtcaataaacatgtgt

SEQ ID NO: 7853302 - DNA, 22 bp, Homo sapiens
catgcagtattcaggacagttc

SEQ ID NO: 7853303 - DNA, 22 bp, Homo sapiens
catgcaggttatatgtgcttct

SEQ ID NO: 7853304 - DNA, 22 bp, Homo sapiens
catgcaggttatatgtgcttct

SEQ ID NO: 7853305 - DNA, 22 bp, Homo sapiens
catgcaggtgaccaggtgtggg

SEQ ID NO: 7853306 - DNA, 22 bp, Homo sapiens
catgcagtgatgcactgcatca

SEQ ID NO: 7853307 - DNA, 22 bp, Homo sapiens
catgcagtgactcagacacagg

SEQ ID NO: 7853308 - DNA, 22 bp, Homo sapiens
catgcagtgactcagacacagg

SEQ ID NO: 7853309 - DNA, 22 bp, Homo sapiens
catgcagtgactcagacacagg

SEQ ID NO: 7853310 - DNA, 22 bp, Homo sapiens
catgcagtctggagccttctgt

SEQ ID NO: 7853311 - DNA, 22 bp, Homo sapiens
catgcagtctggagccttctgt

SEQ ID NO: 7853312 - DNA, 22 bp, Homo sapiens
catgcagtctggagccttctgt

SEQ ID NO: 7853313 - DNA, 22 bp, Homo sapiens
catgcagtgactcagacacagg

SEQ ID NO: 7853314 - DNA, 22 bp, Homo sapiens
catgcaggtctggagcttgggg

SEQ ID NO: 7853315 - DNA, 22 bp, Homo sapiens
catgcaggtctggagcttgggg

SEQ ID NO: 7853316 - DNA, 22 bp, Homo sapiens
catgcaggtgaccaggtgtggg

SEQ ID NO: 7853317 - DNA, 22 bp, Homo sapiens
catgcaggtctggagcttgggg

SEQ ID NO: 7853318 - DNA, 22 bp, Homo sapiens
catgcaggtctggagcttgggg

SEQ ID NO: 7853319 - DNA, 22 bp, Homo sapiens
catgcagggagcagaggagaca

SEQ ID NO: 7853320 - DNA, 22 bp, Homo sapiens
catgcagggacttgtgctccat

SEQ ID NO: 7853321 - DNA, 22 bp, Homo sapiens
catgcagggacttgtgctccat

SEQ ID NO: 7853322 - DNA, 22 bp, Homo sapiens
catgcagggactagagaacagg

SEQ ID NO: 7853323 - DNA, 22 bp, Homo sapiens
catgcatatgtcaaaaaagcta

SEQ ID NO: 7853324 - DNA, 22 bp, Homo sapiens
catgcatattactagcacagca

SEQ ID NO: 7853325 - DNA, 22 bp, Homo sapiens
catgcatcagaatcacctagag

SEQ ID NO: 7853326 - DNA, 22 bp, Homo sapiens
catgcatattactagcacagca

SEQ ID NO: 7853327 - DNA, 22 bp, Homo sapiens
catgcatattactagcacagca

SEQ ID NO: 7853328 - DNA, 20 bp, Homo sapiens
catgcatgacactggaaagg

SEQ ID NO: 7853329 - DNA, 22 bp, Homo sapiens
catgcatctggtcttggaaata

SEQ ID NO: 7853330 - DNA, 22 bp, Homo sapiens
catgcatgccgggctgacagag

SEQ ID NO: 7853331 - DNA, 22 bp, Homo sapiens
catgcagtttctctatgcgtag

SEQ ID NO: 7853332 - DNA, 22 bp, Homo sapiens
catgcatacacaggtcaggcag

SEQ ID NO: 7853333 - DNA, 22 bp, Homo sapiens
catgcagttgaagcacagagag

SEQ ID NO: 7853334 - DNA, 22 bp, Homo sapiens
catgcagttgaagcacagagag

SEQ ID NO: 7853335 - DNA, 22 bp, Homo sapiens
catgcagttgaagcacagagag

SEQ ID NO: 7853336 - DNA, 22 bp, Homo sapiens
catgcagtggtaaaaagtcagg

SEQ ID NO: 7853337 - DNA, 22 bp, Homo sapiens
catgcagtggtaaaaagtcagg

SEQ ID NO: 7853338 - DNA, 22 bp, Homo sapiens
catgcagtgctttgcgccgggc

SEQ ID NO: 7853339 - DNA, 22 bp, Homo sapiens
catgcaggcctatggagcagtg

SEQ ID NO: 7853340 - DNA, 22 bp, Homo sapiens
catgcacacacgtgcatgtacg

SEQ ID NO: 7853341 - DNA, 22 bp, Homo sapiens
catgcacacacgtgcatgtacg

SEQ ID NO: 7853342 - DNA, 22 bp, Homo sapiens
catgcacacacgtgcatgtacg

SEQ ID NO: 7853343 - DNA, 20 bp, Homo sapiens
catgagaagggcagtgtgag

SEQ ID NO: 7853344 - DNA, 22 bp, Homo sapiens
catgagaaccaggtctgtgttt

SEQ ID NO: 7853345 - DNA, 22 bp, Homo sapiens
catgagaaggggtggagttaga

SEQ ID NO: 7853346 - DNA, 22 bp, Homo sapiens
catgagaaggggtggagttaga

SEQ ID NO: 7853347 - DNA, 22 bp, Homo sapiens
catgcacacacagttctaatta

SEQ ID NO: 7853348 - DNA, 22 bp, Homo sapiens
catgagaaggggtggagttaga

SEQ ID NO: 7853349 - DNA, 22 bp, Homo sapiens
catgacatctgcttagtatgaa

SEQ ID NO: 7853350 - DNA, 22 bp, Homo sapiens
catgacatcctgaagctgcaca

SEQ ID NO: 7853351 - DNA, 22 bp, Homo sapiens
catgacagtcctgaagagaacg

SEQ ID NO: 7853352 - DNA, 22 bp, Homo sapiens
catgacagtcctgaagagaacg

SEQ ID NO: 7853353 - DNA, 22 bp, Homo sapiens
catgacagtcctgaagagaacg

SEQ ID NO: 7853354 - DNA, 22 bp, Homo sapiens
catgacagtcctgaagagaacg

SEQ ID NO: 7853355 - DNA, 22 bp, Homo sapiens
catgacagatgcaaaggattgg

SEQ ID NO: 7853356 - DNA, 22 bp, Homo sapiens
catgacagatgcaaaggattgg

SEQ ID NO: 7853357 - DNA, 22 bp, Homo sapiens
catgacacccaggcatagcacc

SEQ ID NO: 7853358 - DNA, 22 bp, Homo sapiens
catgacagatgcaaaggattgg

SEQ ID NO: 7853359 - DNA, 22 bp, Homo sapiens
catgacatctgcttagtatgaa

SEQ ID NO: 7853360 - DNA, 22 bp, Homo sapiens
catgacattttaaaaagaacat

SEQ ID NO: 7853361 - DNA, 22 bp, Homo sapiens
catgaccccccaaggcctgcag

SEQ ID NO: 7853362 - DNA, 22 bp, Homo sapiens
catgactgtgttagaagaatga

SEQ ID NO: 7853363 - DNA, 22 bp, Homo sapiens
catgactgtgttagaagaatga

SEQ ID NO: 7853364 - DNA, 22 bp, Homo sapiens
catgactgtgttagaagaatga

SEQ ID NO: 7853365 - DNA, 22 bp, Homo sapiens
catgaaggaattaaggtaagga

SEQ ID NO: 7853366 - DNA, 22 bp, Homo sapiens
catgaaggctgccagcaggcat

SEQ ID NO: 7853367 - DNA, 22 bp, Homo sapiens
catgaaggctgccagcaggcat

SEQ ID NO: 7853368 - DNA, 23 bp, Homo sapiens
catgaaggtagcacaaagcctct

SEQ ID NO: 7853369 - DNA, 22 bp, Homo sapiens
catgaattagcaatggtgtgca

SEQ ID NO: 7853370 - DNA, 22 bp, Homo sapiens
catgaatttttctgtgggttaa

SEQ ID NO: 7853371 - DNA, 23 bp, Homo sapiens
catgacaaaggatctcatgggcc

SEQ ID NO: 7853372 - DNA, 22 bp, Homo sapiens
catgaattttaagactgttttt

SEQ ID NO: 7853373 - DNA, 22 bp, Homo sapiens
catgaatttatattattagtga

SEQ ID NO: 7853374 - DNA, 22 bp, Homo sapiens
catgaattatttttcacaagat

SEQ ID NO: 7853375 - DNA, 22 bp, Homo sapiens
catgaattatttttcacaagat

SEQ ID NO: 7853376 - DNA, 22 bp, Homo sapiens
catgaattatttttcacaagat

SEQ ID NO: 7853377 - DNA, 22 bp, Homo sapiens
catgaattatttttcacaagat

SEQ ID NO: 7853378 - DNA, 22 bp, Homo sapiens
catgaatttatattattagtga

SEQ ID NO: 7853379 - DNA, 22 bp, Homo sapiens
catgaatttatattattagtga

SEQ ID NO: 7853380 - DNA, 22 bp, Homo sapiens
catgacaataagccagcagaaa

SEQ ID NO: 7853381 - DNA, 22 bp, Homo sapiens
catgacaaatcagaggggcttg

SEQ ID NO: 7853382 - DNA, 22 bp, Homo sapiens
catgacaataagccagcagaaa

SEQ ID NO: 7853383 - DNA, 22 bp, Homo sapiens
catgacaaatcagaggggcttg

SEQ ID NO: 7853384 - DNA, 22 bp, Homo sapiens
catgacaaataaacctttgcca

SEQ ID NO: 7853385 - DNA, 22 bp, Homo sapiens
catgacaatatgttctttcatt

SEQ ID NO: 7853386 - DNA, 22 bp, Homo sapiens
tcagtccataggtgggcctgag

SEQ ID NO: 7853387 - DNA, 22 bp, Homo sapiens
tcagtccataggtgggcctgag

SEQ ID NO: 7853388 - DNA, 22 bp, Homo sapiens
tcagtccaggggctgtgatgtc

SEQ ID NO: 7853389 - DNA, 22 bp, Homo sapiens
tcagtccaggattgggagtgac

SEQ ID NO: 7853390 - DNA, 22 bp, Homo sapiens
tcagtccaggggctgtgatgtc

SEQ ID NO: 7853391 - DNA, 22 bp, Homo sapiens
tcagtccaggattgggagtgac

SEQ ID NO: 7853392 - DNA, 19 bp, Homo sapiens
tcagtccagctgtgaagac

SEQ ID NO: 7853393 - DNA, 22 bp, Homo sapiens
tcagtccctaaggatatgggct

SEQ ID NO: 7853394 - DNA, 22 bp, Homo sapiens
tcagtccccagatgtgtgctgt

SEQ ID NO: 7853395 - DNA, 22 bp, Homo sapiens
tcagtccccagatgtgtgctgt

SEQ ID NO: 7853396 - DNA, 23 bp, Homo sapiens
tcagtcccaacagcttctcctgg

SEQ ID NO: 7853397 - DNA, 22 bp, Homo sapiens
tcagtccataggtgggcctgag

SEQ ID NO: 7853398 - DNA, 23 bp, Homo sapiens
tcagtcccaacagcttctcctgg

SEQ ID NO: 7853399 - DNA, 22 bp, Homo sapiens
tcagtcccaaggtcctgaggtg

SEQ ID NO: 7853400 - DNA, 22 bp, Homo sapiens
tcagtccataggtgggcctgag

SEQ ID NO: 7853401 - DNA, 22 bp, Homo sapiens
tcagtcccaaggtcctgaggtg

SEQ ID NO: 7853402 - DNA, 22 bp, Homo sapiens
tcagtgcattcatgggtggctg

SEQ ID NO: 7853403 - DNA, 22 bp, Homo sapiens
tcagtgcattcatgggtggctg

SEQ ID NO: 7853404 - DNA, 22 bp, Homo sapiens
tcagtcccttctccaggtcagc

SEQ ID NO: 7853405 - DNA, 22 bp, Homo sapiens
tcagtcccttctccaggtcagc

SEQ ID NO: 7853406 - DNA, 22 bp, Homo sapiens
tcagtcccttctccaggtcagc

SEQ ID NO: 7853407 - DNA, 22 bp, Homo sapiens
tcagtcccttaaaggtggcagc

SEQ ID NO: 7853408 - DNA, 22 bp, Homo sapiens
tcagtcccttaaaggtggcagc

SEQ ID NO: 7853409 - DNA, 22 bp, Homo sapiens
tcagtcccttaaaggtggcagc

SEQ ID NO: 7853410 - DNA, 22 bp, Homo sapiens
tcagtccctcgcaccctgccat

SEQ ID NO: 7853411 - DNA, 22 bp, Homo sapiens
tcagtccctaaggatatgggct

SEQ ID NO: 7853412 - DNA, 21 bp, Homo sapiens
tcagtccctgggtgtgtccca

SEQ ID NO: 7853413 - DNA, 21 bp, Homo sapiens
tcagtccctgggtgtgtccca

SEQ ID NO: 7853414 - DNA, 21 bp, Homo sapiens
tcagtccctgggtgtgtccca

SEQ ID NO: 7853415 - DNA, 22 bp, Homo sapiens
tcagtgccagtttgctccttct

SEQ ID NO: 7853416 - DNA, 22 bp, Homo sapiens
tcagtgccatgggcagacaggc

SEQ ID NO: 7853417 - DNA, 22 bp, Homo sapiens
tcagtgccatgggcagacaggc

SEQ ID NO: 7853418 - DNA, 22 bp, Homo sapiens
tcagtgccatgggcagacaggc

SEQ ID NO: 7853419 - DNA, 22 bp, Homo sapiens
tcagtgccaattctgccatggg

SEQ ID NO: 7853420 - DNA, 22 bp, Homo sapiens
tcagtgcattgttcattgtagg

SEQ ID NO: 7853421 - DNA, 22 bp, Homo sapiens
tcagtgccaattctgccatggg

SEQ ID NO: 7853422 - DNA, 22 bp, Homo sapiens
tcagtgcattctaccaaaaggc

SEQ ID NO: 7853423 - DNA, 22 bp, Homo sapiens
tcagtgcattctaccaaaaggc

SEQ ID NO: 7853424 - DNA, 22 bp, Homo sapiens
tcagtgcctactttgatcaatt

SEQ ID NO: 7853425 - DNA, 22 bp, Homo sapiens
tcagtgcctactttgatcaatt

SEQ ID NO: 7853426 - DNA, 22 bp, Homo sapiens
tcagtgccatgggcagacaggc

SEQ ID NO: 7853427 - DNA, 22 bp, Homo sapiens
tcagtgctaaaagagctggtgt

SEQ ID NO: 7853428 - DNA, 22 bp, Homo sapiens
tcagtgctaaaagagctggtgt

SEQ ID NO: 7853429 - DNA, 20 bp, Homo sapiens
tcagtgctcaggcaccaggt

SEQ ID NO: 7853430 - DNA, 20 bp, Homo sapiens
tcagtgctcaggcaccaggt

SEQ ID NO: 7853431 - DNA, 22 bp, Homo sapiens
tcagtgctcctaaagtgaatgc

SEQ ID NO: 7853432 - DNA, 22 bp, Homo sapiens
tcagtgctcctaaagtgaatgc

SEQ ID NO: 7853433 - DNA, 22 bp, Homo sapiens
tcagtgctcaggggagccgagg

SEQ ID NO: 7853434 - DNA, 22 bp, Homo sapiens
tcagtgctcaggggagccgagg

SEQ ID NO: 7853435 - DNA, 22 bp, Homo sapiens
tcagtgctcaggggagccgagg

SEQ ID NO: 7853436 - DNA, 22 bp, Homo sapiens
tcagtgctcctaaagtgaatgc

SEQ ID NO: 7853437 - DNA, 19 bp, Homo sapiens
tcagtgctcctatgtcctt

SEQ ID NO: 7853438 - DNA, 22 bp, Homo sapiens
tcagtgctcctaaagtgaatgc

SEQ ID NO: 7853439 - DNA, 22 bp, Homo sapiens
tcagtgctcctaaagtgaatgc

SEQ ID NO: 7853440 - DNA, 22 bp, Homo sapiens
tcagtgctctgaggtccagggt

SEQ ID NO: 7853441 - DNA, 22 bp, Homo sapiens
tcagtgctctgaggtccagggt

SEQ ID NO: 7853442 - DNA, 22 bp, Homo sapiens
tcagtgctctgaggtccagggt

SEQ ID NO: 7853443 - DNA, 19 bp, Homo sapiens
tcagtgctcctatgtcctt

SEQ ID NO: 7853444 - DNA, 19 bp, Homo sapiens
tcagtgctcctatgtcctt

SEQ ID NO: 7853445 - DNA, 22 bp, Homo sapiens
tcagtgctgccatggcagggcc

SEQ ID NO: 7853446 - DNA, 22 bp, Homo sapiens
tcagtgctgagtagcgtgcacc

SEQ ID NO: 7853447 - DNA, 22 bp, Homo sapiens
tcagtgctgctttatgacagtt

SEQ ID NO: 7853448 - DNA, 22 bp, Homo sapiens
tcagtgctgccatggcagggcc

SEQ ID NO: 7853449 - DNA, 22 bp, Homo sapiens
catctcagtgtacagggagtct

SEQ ID NO: 7853450 - DNA, 22 bp, Homo sapiens
catctcagtgtacagggagtct

SEQ ID NO: 7853451 - DNA, 22 bp, Homo sapiens
catctcaggtctgtggttcact

SEQ ID NO: 7853452 - DNA, 22 bp, Homo sapiens
tcagtgctgctttatgacagtt

SEQ ID NO: 7853453 - DNA, 22 bp, Homo sapiens
tcagtgctgctttatgacagtt

SEQ ID NO: 7853454 - DNA, 22 bp, Homo sapiens
tcagggagggacctgaggctgg

SEQ ID NO: 7853455 - DNA, 22 bp, Homo sapiens
tcagggagggacctgaggctgg

SEQ ID NO: 7853456 - DNA, 22 bp, Homo sapiens
tcagggagggacctgaggctgg

SEQ ID NO: 7853457 - DNA, 22 bp, Homo sapiens
tcagggagggacctgaggctgg

SEQ ID NO: 7853458 - DNA, 22 bp, Homo sapiens
tcagggagggacctgaggctgg

SEQ ID NO: 7853459 - DNA, 22 bp, Homo sapiens
tcagggagggacctgaggctgg

SEQ ID NO: 7853460 - DNA, 22 bp, Homo sapiens
tcagggagggacctgaggctgg

SEQ ID NO: 7853461 - DNA, 22 bp, Homo sapiens
tcagggagatttggggactcaa

SEQ ID NO: 7853462 - DNA, 22 bp, Homo sapiens
tcagggagagtgacccatccac

SEQ ID NO: 7853463 - DNA, 22 bp, Homo sapiens
tcagggagatttggggactcaa

SEQ ID NO: 7853464 - DNA, 22 bp, Homo sapiens
tcagggagatttggggactcaa

SEQ ID NO: 7853465 - DNA, 22 bp, Homo sapiens
tcagggagatttggggactcaa

SEQ ID NO: 7853466 - DNA, 22 bp, Homo sapiens
tcagggagatttggggactcaa

SEQ ID NO: 7853467 - DNA, 22 bp, Homo sapiens
tcagggagcctggacttcaagg

SEQ ID NO: 7853468 - DNA, 22 bp, Homo sapiens
tcagggagtagtttgtgctatg

SEQ ID NO: 7853469 - DNA, 22 bp, Homo sapiens
tcagggagtagtttgtgctatg

SEQ ID NO: 7853470 - DNA, 22 bp, Homo sapiens
tcagggaggtgtctgccagaga

SEQ ID NO: 7853471 - DNA, 22 bp, Homo sapiens
tcagggaggtgtctgccagaga

SEQ ID NO: 7853472 - DNA, 22 bp, Homo sapiens
tcagggagtagtttgtgctatg

SEQ ID NO: 7853473 - DNA, 22 bp, Homo sapiens
tcagggaggtgtctgccagaga

SEQ ID NO: 7853474 - DNA, 22 bp, Homo sapiens
tcagggaggtgtctgccagaga

SEQ ID NO: 7853475 - DNA, 22 bp, Homo sapiens
tcagggaggtgtctgccagaga

SEQ ID NO: 7853476 - DNA, 22 bp, Homo sapiens
tcagggagtgttggcaggatca

SEQ ID NO: 7853477 - DNA, 22 bp, Homo sapiens
tcagggagtgttggcaggatca

SEQ ID NO: 7853478 - DNA, 22 bp, Homo sapiens
tcagggagtgttggcaggatca

SEQ ID NO: 7853479 - DNA, 22 bp, Homo sapiens
tcagggaggtgtctgccagaga

SEQ ID NO: 7853480 - DNA, 22 bp, Homo sapiens
tcagggagtgttggcaggatca

SEQ ID NO: 7853481 - DNA, 19 bp, Homo sapiens
tcagggagtttacagcatg

SEQ ID NO: 7853482 - DNA, 19 bp, Homo sapiens
tcagggagtttacagcatg

SEQ ID NO: 7853483 - DNA, 22 bp, Homo sapiens
tcagggagtgttggcaggatca

SEQ ID NO: 7853484 - DNA, 19 bp, Homo sapiens
tcagggagtttacagcatg

SEQ ID NO: 7853485 - DNA, 22 bp, Homo sapiens
tcagtatttctaaacattggct

SEQ ID NO: 7853486 - DNA, 22 bp, Homo sapiens
tcagtcaacataaatccaaggt

SEQ ID NO: 7853487 - DNA, 22 bp, Homo sapiens
tcagtcaatgtgtcagctctcc

SEQ ID NO: 7853488 - DNA, 22 bp, Homo sapiens
tcagtcaatgccttcctgggca

SEQ ID NO: 7853489 - DNA, 22 bp, Homo sapiens
tcagtcacactcactgaggtag

SEQ ID NO: 7853490 - DNA, 22 bp, Homo sapiens
tcagtcaccaatgggaggagga

SEQ ID NO: 7853491 - DNA, 22 bp, Homo sapiens
tcagtcaccttgactatagctg

SEQ ID NO: 7853492 - DNA, 22 bp, Homo sapiens
tcagtcaccttgactatagctg

SEQ ID NO: 7853493 - DNA, 22 bp, Homo sapiens
tcagggattgcaaaattcatcc

SEQ ID NO: 7853494 - DNA, 22 bp, Homo sapiens
tcagggattgcaaaattcatcc

SEQ ID NO: 7853495 - DNA, 22 bp, Homo sapiens
tcagggattgcaaaattcatcc

SEQ ID NO: 7853496 - DNA, 22 bp, Homo sapiens
tcagtattgctagagttcactg

SEQ ID NO: 7853497 - DNA, 22 bp, Homo sapiens
tcagtcacttttgcctgctaca

SEQ ID NO: 7853498 - DNA, 22 bp, Homo sapiens
tcagtcacttttgcctgctaca

SEQ ID NO: 7853499 - DNA, 22 bp, Homo sapiens
tcagtcaggagatgccagagat

SEQ ID NO: 7853500 - DNA, 22 bp, Homo sapiens
tcagtcagaatcaccagacttt

SEQ ID NO: 7853501 - DNA, 22 bp, Homo sapiens
tcagtcaggttctgatttctgg

SEQ ID NO: 7853502 - DNA, 18 bp, Homo sapiens
tcagtcagtcctgtgaag

SEQ ID NO: 7853503 - DNA, 18 bp, Homo sapiens
tcagtcagtcctgtgaag

SEQ ID NO: 7853504 - DNA, 18 bp, Homo sapiens
tcagtcagtcctgtgaag

SEQ ID NO: 7853505 - DNA, 22 bp, Homo sapiens
tcagtcaggttctgatttctgg

SEQ ID NO: 7853506 - DNA, 19 bp, Homo sapiens
tcagtcatatatctgcacc

SEQ ID NO: 7853507 - DNA, 22 bp, Homo sapiens
tcagtcatctctgacagctagc

SEQ ID NO: 7853508 - DNA, 19 bp, Homo sapiens
tcagtcatatatctgcacc

SEQ ID NO: 7853509 - DNA, 22 bp, Homo sapiens
tcagtccaatgattgtaggaca

SEQ ID NO: 7853510 - DNA, 22 bp, Homo sapiens
tcagtccactaagacccttgtt

SEQ ID NO: 7853511 - DNA, 22 bp, Homo sapiens
catctgttgcttcctaacaagt

SEQ ID NO: 7853512 - DNA, 22 bp, Homo sapiens
catctgttgagttctccgtgct

SEQ ID NO: 7853513 - DNA, 22 bp, Homo sapiens
catctgttcactcggcatgtat

SEQ ID NO: 7853514 - DNA, 22 bp, Homo sapiens
catcttaaaatgtgtcataact

SEQ ID NO: 7853515 - DNA, 22 bp, Homo sapiens
catcttaaaatgtgtcataact

SEQ ID NO: 7853516 - DNA, 22 bp, Homo sapiens
catcttaaattaaagcttaagg

SEQ ID NO: 7853517 - DNA, 22 bp, Homo sapiens
catcttaaattaaagcttaagg

SEQ ID NO: 7853518 - DNA, 22 bp, Homo sapiens
catctgtctgctgttagctgca

SEQ ID NO: 7853519 - DNA, 22 bp, Homo sapiens
catctgtctgctgttagctgca

SEQ ID NO: 7853520 - DNA, 22 bp, Homo sapiens
catctgtctgcatgctctgggt

SEQ ID NO: 7853521 - DNA, 22 bp, Homo sapiens
catctgtctgcatgctctgggt

SEQ ID NO: 7853522 - DNA, 22 bp, Homo sapiens
catctgtctgcatgctctgggt

SEQ ID NO: 7853523 - DNA, 22 bp, Homo sapiens
catctgtcatcaaccctggcta

SEQ ID NO: 7853524 - DNA, 22 bp, Homo sapiens
catctgtcatcaaccctggcta

SEQ ID NO: 7853525 - DNA, 22 bp, Homo sapiens
catctgtgtatctgtgcttaga

SEQ ID NO: 7853526 - DNA, 22 bp, Homo sapiens
catctgttctatccacgttgct

SEQ ID NO: 7853527 - DNA, 22 bp, Homo sapiens
catctgttctatccacgttgct

SEQ ID NO: 7853528 - DNA, 22 bp, Homo sapiens
catctgtgccgggtgtttgtca

SEQ ID NO: 7853529 - DNA, 22 bp, Homo sapiens
catctgttaaagtctaatgaaa

SEQ ID NO: 7853530 - DNA, 22 bp, Homo sapiens
catgaaaataacattgttgtga

SEQ ID NO: 7853531 - DNA, 22 bp, Homo sapiens
catgaaaataacattgttgtga

SEQ ID NO: 7853532 - DNA, 22 bp, Homo sapiens
catgaaaataacattgttgtga

SEQ ID NO: 7853533 - DNA, 22 bp, Homo sapiens
catgaaattgtattggcctcaa

SEQ ID NO: 7853534 - DNA, 22 bp, Homo sapiens
catgaaattgctcctttggtgc

SEQ ID NO: 7853535 - DNA, 22 bp, Homo sapiens
catgaaattgctcctttggtgc

SEQ ID NO: 7853536 - DNA, 22 bp, Homo sapiens
catgaaatttgaagtacagcaa

SEQ ID NO: 7853537 - DNA, 22 bp, Homo sapiens
catgaacaaatcctgcgagtat

SEQ ID NO: 7853538 - DNA, 22 bp, Homo sapiens
catgaacagctaacattttggg

SEQ ID NO: 7853539 - DNA, 22 bp, Homo sapiens
catgaacagattcttcatttct

SEQ ID NO: 7853540 - DNA, 22 bp, Homo sapiens
catgaacaccaggcatgaacaa

SEQ ID NO: 7853541 - DNA, 22 bp, Homo sapiens
catgaacaccaggcatgaacaa

SEQ ID NO: 7853542 - DNA, 22 bp, Homo sapiens
catgaacaccaggcatgaacaa

SEQ ID NO: 7853543 - DNA, 22 bp, Homo sapiens
catgaacaatttgctcactgat

SEQ ID NO: 7853544 - DNA, 22 bp, Homo sapiens
catgaacaatttgctcactgat

SEQ ID NO: 7853545 - DNA, 22 bp, Homo sapiens
catgaacattcagaaatacagc

SEQ ID NO: 7853546 - DNA, 22 bp, Homo sapiens
catgaacattcagaaatacagc

SEQ ID NO: 7853547 - DNA, 22 bp, Homo sapiens
catgaacattcagaaatacagc

SEQ ID NO: 7853548 - DNA, 22 bp, Homo sapiens
catgaacattgcagggatgtga

SEQ ID NO: 7853549 - DNA, 22 bp, Homo sapiens
catgaacatttgtttacatctg

SEQ ID NO: 7853550 - DNA, 22 bp, Homo sapiens
catgaacatttgtttacatctg

SEQ ID NO: 7853551 - DNA, 21 bp, Homo sapiens
catgaagaatcaagacccttg

SEQ ID NO: 7853552 - DNA, 22 bp, Homo sapiens
catgaaccaaaccaaagtgtcc

SEQ ID NO: 7853553 - DNA, 21 bp, Homo sapiens
catgaagaatcaagacccttg

SEQ ID NO: 7853554 - DNA, 22 bp, Homo sapiens
catgaagatcctgtatgttttt

SEQ ID NO: 7853555 - DNA, 22 bp, Homo sapiens
catgaagatcctgtatgttttt

SEQ ID NO: 7853556 - DNA, 22 bp, Homo sapiens
catctgaagtgaattgcttttt

SEQ ID NO: 7853557 - DNA, 22 bp, Homo sapiens
catctgaagagctttgcaagag

SEQ ID NO: 7853558 - DNA, 22 bp, Homo sapiens
catctgaaatctgcctacaagc

SEQ ID NO: 7853559 - DNA, 22 bp, Homo sapiens
catctgaaatctgcctacaagc

SEQ ID NO: 7853560 - DNA, 22 bp, Homo sapiens
catctgaatttgccttagtttc

SEQ ID NO: 7853561 - DNA, 22 bp, Homo sapiens
catctgaatatcccaggcatat

SEQ ID NO: 7853562 - DNA, 22 bp, Homo sapiens
catctgcaggggaagccagttt

SEQ ID NO: 7853563 - DNA, 22 bp, Homo sapiens
catctgccactctctcccacca

SEQ ID NO: 7853564 - DNA, 22 bp, Homo sapiens
catctgcaggggaagccagttt

SEQ ID NO: 7853565 - DNA, 22 bp, Homo sapiens
catctgagggaaaacatgtagt

SEQ ID NO: 7853566 - DNA, 20 bp, Homo sapiens
catctgagcccacagaagtc

SEQ ID NO: 7853567 - DNA, 22 bp, Homo sapiens
catctgaatatcccaggcatat

SEQ ID NO: 7853568 - DNA, 22 bp, Homo sapiens
catctcttgccaaagtttgacc

SEQ ID NO: 7853569 - DNA, 17 bp, Homo sapiens
catctgctctgcccctt

SEQ ID NO: 7853570 - DNA, 17 bp, Homo sapiens
catctgctctgcccctt

SEQ ID NO: 7853571 - DNA, 22 bp, Homo sapiens
catctgctctgtctgccatgtt

SEQ ID NO: 7853572 - DNA, 17 bp, Homo sapiens
catctgctctgcccctt

SEQ ID NO: 7853573 - DNA, 22 bp, Homo sapiens
catctgcctaagtggccctgtt

SEQ ID NO: 7853574 - DNA, 22 bp, Homo sapiens
catctgcctaagtggccctgtt

SEQ ID NO: 7853575 - DNA, 22 bp, Homo sapiens
catctgcctaagtggccctgtt

SEQ ID NO: 7853576 - DNA, 22 bp, Homo sapiens
catctgctgttccttggactca

SEQ ID NO: 7853577 - DNA, 22 bp, Homo sapiens
catctgctgttccttggactca

SEQ ID NO: 7853578 - DNA, 22 bp, Homo sapiens
catctgctgctgaagccagcat

SEQ ID NO: 7853579 - DNA, 22 bp, Homo sapiens
catctgctgtaattaacaagcc

SEQ ID NO: 7853580 - DNA, 22 bp, Homo sapiens
catctgctgacttgacaagtac

SEQ ID NO: 7853581 - DNA, 22 bp, Homo sapiens
catctgctgctacaaaaagctt

SEQ ID NO: 7853582 - DNA, 19 bp, Homo sapiens
catctggatgattctcctg

SEQ ID NO: 7853583 - DNA, 19 bp, Homo sapiens
catctggatgattctcctg

SEQ ID NO: 7853584 - DNA, 22 bp, Homo sapiens
catctggcagaccctgcctccg

SEQ ID NO: 7853585 - DNA, 22 bp, Homo sapiens
catctggcagaccctgcctccg

SEQ ID NO: 7853586 - DNA, 22 bp, Homo sapiens
catctgctgttccttggactca

SEQ ID NO: 7853587 - DNA, 22 bp, Homo sapiens
catctgctgttccttggactca

SEQ ID NO: 7853588 - DNA, 22 bp, Homo sapiens
catctgctgttccttggactca

SEQ ID NO: 7853589 - DNA, 22 bp, Homo sapiens
catctgctgttccttggactca

SEQ ID NO: 7853590 - DNA, 22 bp, Homo sapiens
catctgctgttccttggactca

SEQ ID NO: 7853591 - DNA, 22 bp, Homo sapiens
catctgctgttccttggactca

SEQ ID NO: 7853592 - DNA, 22 bp, Homo sapiens
catctggacaaaactctgaagg

SEQ ID NO: 7853593 - DNA, 23 bp, Homo sapiens
catctggggacatcattaggctg

SEQ ID NO: 7853594 - DNA, 22 bp, Homo sapiens
catctgggttctcagatggata

SEQ ID NO: 7853595 - DNA, 22 bp, Homo sapiens
catctgggttctcagatggata

SEQ ID NO: 7853596 - DNA, 22 bp, Homo sapiens
catctgtaaagtaggaatattg

SEQ ID NO: 7853597 - DNA, 22 bp, Homo sapiens
catctgtaggtgacacatgagt

SEQ ID NO: 7853598 - DNA, 22 bp, Homo sapiens
catctgtcacctgtgaatgttg

SEQ ID NO: 7853599 - DNA, 22 bp, Homo sapiens
catctgtaggtgacacatgagt

SEQ ID NO: 7853600 - DNA, 19 bp, Homo sapiens
catctgtaaggacagaaac

SEQ ID NO: 7853601 - DNA, 22 bp, Homo sapiens
catctgtaaggaagaggatcaa

SEQ ID NO: 7853602 - DNA, 22 bp, Homo sapiens
catctgtaaagtaggaatattg

SEQ ID NO: 7853603 - DNA, 22 bp, Homo sapiens
catctgtaaagtaggaatattg

SEQ ID NO: 7853604 - DNA, 22 bp, Homo sapiens
catctgtagctccatgacaatt

SEQ ID NO: 7853605 - DNA, 19 bp, Homo sapiens
catctgtaaggacagaaac

SEQ ID NO: 7853606 - DNA, 22 bp, Homo sapiens
taagtatgttagaaaatcaagt

SEQ ID NO: 7853607 - DNA, 22 bp, Homo sapiens
taaggcaggaactggctgtttt

SEQ ID NO: 7853608 - DNA, 19 bp, Homo sapiens
taagtagtcaaatagtaac

SEQ ID NO: 7853609 - DNA, 23 bp, Homo sapiens
cagctcagcacataggaggtact

SEQ ID NO: 7853610 - DNA, 22 bp, Homo sapiens
taaggcagctgagcttctaaca

SEQ ID NO: 7853611 - DNA, 22 bp, Homo sapiens
taaggcagcctcagggtagggt

SEQ ID NO: 7853612 - DNA, 23 bp, Homo sapiens
cagctcagagtgtgtcctgtttc

SEQ ID NO: 7853613 - DNA, 23 bp, Homo sapiens
cagctcagcacataggaggtact

SEQ ID NO: 7853614 - DNA, 22 bp, Homo sapiens
taagtcatcacattgcagagat

SEQ ID NO: 7853615 - DNA, 22 bp, Homo sapiens
taagtcatagattaatggccac

SEQ ID NO: 7853616 - DNA, 22 bp, Homo sapiens
taagtcatatgtgtcccaagtc

SEQ ID NO: 7853617 - DNA, 22 bp, Homo sapiens
taagtcataagtcatgatgtta

SEQ ID NO: 7853618 - DNA, 22 bp, Homo sapiens
taagtcatagagcggaagacca

SEQ ID NO: 7853619 - DNA, 22 bp, Homo sapiens
taagtcataagtcatgatgtta

SEQ ID NO: 7853620 - DNA, 22 bp, Homo sapiens
taagtcatgattctgtgttact

SEQ ID NO: 7853621 - DNA, 22 bp, Homo sapiens
taagtcatcgcaggagtttggt

SEQ ID NO: 7853622 - DNA, 22 bp, Homo sapiens
taagtcatcccataacagtgct

SEQ ID NO: 7853623 - DNA, 22 bp, Homo sapiens
taagtcatcccataacagtgct

SEQ ID NO: 7853624 - DNA, 22 bp, Homo sapiens
taagtcataagtcaacaaagga

SEQ ID NO: 7853625 - DNA, 22 bp, Homo sapiens
taagtcacttaagtttgcatgt

SEQ ID NO: 7853626 - DNA, 22 bp, Homo sapiens
taagtattggcctatagctaga

SEQ ID NO: 7853627 - DNA, 22 bp, Homo sapiens
taagtcaaggtggcatttgaga

SEQ ID NO: 7853628 - DNA, 22 bp, Homo sapiens
taagtcttcatagtctaatgtc

SEQ ID NO: 7853629 - DNA, 22 bp, Homo sapiens
taagtgaaataagtcagataca

SEQ ID NO: 7853630 - DNA, 22 bp, Homo sapiens
taagtgaaataagtcagataca

SEQ ID NO: 7853631 - DNA, 22 bp, Homo sapiens
taagtgaaaatggtttcccagc

SEQ ID NO: 7853632 - DNA, 22 bp, Homo sapiens
taagtgaaaatggtttcccagc

SEQ ID NO: 7853633 - DNA, 22 bp, Homo sapiens
taagtgaaatggtgcatcaaat

SEQ ID NO: 7853634 - DNA, 22 bp, Homo sapiens
taagtgaaataagtcagataca

SEQ ID NO: 7853635 - DNA, 22 bp, Homo sapiens
taagtgaaataagtcagataca

SEQ ID NO: 7853636 - DNA, 22 bp, Homo sapiens
caggcaccaatagggatcgtgg

SEQ ID NO: 7853637 - DNA, 22 bp, Homo sapiens
taagtgaaatggtgcatcaaat

SEQ ID NO: 7853638 - DNA, 22 bp, Homo sapiens
taagtcgtggatgattcttcgg

SEQ ID NO: 7853639 - DNA, 22 bp, Homo sapiens
taagtcgtggatgattcttcgg

SEQ ID NO: 7853640 - DNA, 22 bp, Homo sapiens
taagtcctagatgattcacaga

SEQ ID NO: 7853641 - DNA, 22 bp, Homo sapiens
taagtccttcacctaatcctca

SEQ ID NO: 7853642 - DNA, 22 bp, Homo sapiens
taagtcctattccaggtctctc

SEQ ID NO: 7853643 - DNA, 22 bp, Homo sapiens
taagtcctggctggtttgaagc

SEQ ID NO: 7853644 - DNA, 17 bp, Homo sapiens
taagtcctagttatttt

SEQ ID NO: 7853645 - DNA, 22 bp, Homo sapiens
taagtcctaatggcagaagtct

SEQ ID NO: 7853646 - DNA, 22 bp, Homo sapiens
taagtcctagctttggtaggaa

SEQ ID NO: 7853647 - DNA, 18 bp, Homo sapiens
taagtcattttgccagca

SEQ ID NO: 7853648 - DNA, 22 bp, Homo sapiens
taagtcatttggagccactgga

SEQ ID NO: 7853649 - DNA, 22 bp, Homo sapiens
taagtcatggagctgggattga

SEQ ID NO: 7853650 - DNA, 22 bp, Homo sapiens
taagtcattaggctgagttcaa

SEQ ID NO: 7853651 - DNA, 18 bp, Homo sapiens
taagtcatttgaaatgcc

SEQ ID NO: 7853652 - DNA, 22 bp, Homo sapiens
taagtccaagggtatgagttgg

SEQ ID NO: 7853653 - DNA, 22 bp, Homo sapiens
taagtccacaggctgacagcgg

SEQ ID NO: 7853654 - DNA, 22 bp, Homo sapiens
taagtccacaggagttgtgttc

SEQ ID NO: 7853655 - DNA, 22 bp, Homo sapiens
taagtccacctcattcttcagc

SEQ ID NO: 7853656 - DNA, 22 bp, Homo sapiens
taagtccacctcattcttcagc

SEQ ID NO: 7853657 - DNA, 22 bp, Homo sapiens
taagtccagtgttctctctgtg

SEQ ID NO: 7853658 - DNA, 22 bp, Homo sapiens
taagtccactatatccttctct

SEQ ID NO: 7853659 - DNA, 22 bp, Homo sapiens
taagtccactatatccttctct

SEQ ID NO: 7853660 - DNA, 22 bp, Homo sapiens
taagtccataatggcagtaaat

SEQ ID NO: 7853661 - DNA, 22 bp, Homo sapiens
taagtccagtgttctctctgtg

SEQ ID NO: 7853662 - DNA, 22 bp, Homo sapiens
taagtcctaacagactgggggc

SEQ ID NO: 7853663 - DNA, 22 bp, Homo sapiens
taagtcctagatgattcacaga

SEQ ID NO: 7853664 - DNA, 22 bp, Homo sapiens
taagtcctagatgattcacaga

SEQ ID NO: 7853665 - DNA, 22 bp, Homo sapiens
taagtcctaatggcagaagtct

SEQ ID NO: 7853666 - DNA, 22 bp, Homo sapiens
gtgcttctctgctctacccggc

SEQ ID NO: 7853667 - DNA, 22 bp, Homo sapiens
gtgcttctccgttctgcagcac

SEQ ID NO: 7853668 - DNA, 22 bp, Homo sapiens
gtgcttctccgttctgcagcac

SEQ ID NO: 7853669 - DNA, 22 bp, Homo sapiens
gtgcttcctgtattgattccat

SEQ ID NO: 7853670 - DNA, 22 bp, Homo sapiens
gtgcttctccgttctgcagcac

SEQ ID NO: 7853671 - DNA, 22 bp, Homo sapiens
gtgcttcctgcctggtgccttt

SEQ ID NO: 7853672 - DNA, 20 bp, Homo sapiens
gtgcttcctcgcaagttgca

SEQ ID NO: 7853673 - DNA, 22 bp, Homo sapiens
gtgcttcctaggtaagtaggta

SEQ ID NO: 7853674 - DNA, 22 bp, Homo sapiens
gtgcttatgtgggagggagagg

SEQ ID NO: 7853675 - DNA, 22 bp, Homo sapiens
gtgcttatccccattctggagg

SEQ ID NO: 7853676 - DNA, 22 bp, Homo sapiens
gtgcttaatacatgtcaataac

SEQ ID NO: 7853677 - DNA, 22 bp, Homo sapiens
gtgcttcactgacctgttttca

SEQ ID NO: 7853678 - DNA, 20 bp, Homo sapiens
gtgcttcagaagccattgct

SEQ ID NO: 7853679 - DNA, 22 bp, Homo sapiens
gtgcttatccccattctggagg

SEQ ID NO: 7853680 - DNA, 22 bp, Homo sapiens
gtgcttaaggcagtctgtcaaa

SEQ ID NO: 7853681 - DNA, 22 bp, Homo sapiens
gtgcttaagcttctgctttatg

SEQ ID NO: 7853682 - DNA, 22 bp, Homo sapiens
gtgcttaaggcagtctgtcaaa

SEQ ID NO: 7853683 - DNA, 22 bp, Homo sapiens
gtgcttaaaacagaaaacattg

SEQ ID NO: 7853684 - DNA, 22 bp, Homo sapiens
gtgctgttttaagtgttcttat

SEQ ID NO: 7853685 - DNA, 22 bp, Homo sapiens
gtgctgttttgagtgctacccc

SEQ ID NO: 7853686 - DNA, 22 bp, Homo sapiens
gtgcttaacctagtttctagta

SEQ ID NO: 7853687 - DNA, 22 bp, Homo sapiens
gtgcttaacctagtttctagta

SEQ ID NO: 7853688 - DNA, 22 bp, Homo sapiens
cagctattttctcattaaggat

SEQ ID NO: 7853689 - DNA, 22 bp, Homo sapiens
cagctattggtccacaggtatg

SEQ ID NO: 7853690 - DNA, 22 bp, Homo sapiens
cagctattgttctgtataatga

SEQ ID NO: 7853691 - DNA, 22 bp, Homo sapiens
cagctatttatctttcatgata

SEQ ID NO: 7853692 - DNA, 22 bp, Homo sapiens
gtgcttctgccaactaattaac

SEQ ID NO: 7853693 - DNA, 22 bp, Homo sapiens
cagctattggcaagaagtggtg

SEQ ID NO: 7853694 - DNA, 22 bp, Homo sapiens
cagctattgataaatgttgggg

SEQ ID NO: 7853695 - DNA, 22 bp, Homo sapiens
cagctcagacgcaggtcgagca

SEQ ID NO: 7853696 - DNA, 22 bp, Homo sapiens
cagctcagacgcaggtcgagca

SEQ ID NO: 7853697 - DNA, 22 bp, Homo sapiens
cagctcagacgcaggtcgagca

SEQ ID NO: 7853698 - DNA, 22 bp, Homo sapiens
cagctcagacgcaggtcgagca

SEQ ID NO: 7853699 - DNA, 22 bp, Homo sapiens
cagctcagacgcaggtcgagca

SEQ ID NO: 7853700 - DNA, 22 bp, Homo sapiens
cagctcagacgcaggtcgagca

SEQ ID NO: 7853701 - DNA, 22 bp, Homo sapiens
cagctcacagccacgccattcc

SEQ ID NO: 7853702 - DNA, 22 bp, Homo sapiens
cagctcacccatcacgtctgct

SEQ ID NO: 7853703 - DNA, 22 bp, Homo sapiens
cagctcacttgtttcatcttct

SEQ ID NO: 7853704 - DNA, 22 bp, Homo sapiens
cagctcacccatcacgtctgct

SEQ ID NO: 7853705 - DNA, 22 bp, Homo sapiens
cagctcacagccacgccattcc

SEQ ID NO: 7853706 - DNA, 22 bp, Homo sapiens
cagctcaagtttcccaggtcag

SEQ ID NO: 7853707 - DNA, 22 bp, Homo sapiens
cagctcaagtttcccaggtcag

SEQ ID NO: 7853708 - DNA, 22 bp, Homo sapiens
taataattggcaatgttgagca

SEQ ID NO: 7853709 - DNA, 22 bp, Homo sapiens
taataattggcaatgttgagca

SEQ ID NO: 7853710 - DNA, 22 bp, Homo sapiens
taataattggcaatgttgagca

SEQ ID NO: 7853711 - DNA, 22 bp, Homo sapiens
taataattagttattgatcgtg

SEQ ID NO: 7853712 - DNA, 22 bp, Homo sapiens
taataattttaaagaaggctag

SEQ ID NO: 7853713 - DNA, 22 bp, Homo sapiens
taataattggctaaccctggga

SEQ ID NO: 7853714 - DNA, 22 bp, Homo sapiens
taatacaaggcaggaagcagta

SEQ ID NO: 7853715 - DNA, 22 bp, Homo sapiens
taatacaaggcaggaagcagta

SEQ ID NO: 7853716 - DNA, 22 bp, Homo sapiens
taatacaaggcaggaagcagta

SEQ ID NO: 7853717 - DNA, 22 bp, Homo sapiens
taatacaaggcaggaagcagta

SEQ ID NO: 7853718 - DNA, 22 bp, Homo sapiens
taatacaaggcaggaagcagta

SEQ ID NO: 7853719 - DNA, 22 bp, Homo sapiens
taatacaatggagttgggcccc

SEQ ID NO: 7853720 - DNA, 22 bp, Homo sapiens
taatacaatggagttgggcccc

SEQ ID NO: 7853721 - DNA, 22 bp, Homo sapiens
taatacaatggagttgggcccc

SEQ ID NO: 7853722 - DNA, 22 bp, Homo sapiens
taatacaatggagttgggcccc

SEQ ID NO: 7853723 - DNA, 22 bp, Homo sapiens
taatacactgctttttgtaact

SEQ ID NO: 7853724 - DNA, 22 bp, Homo sapiens
taatacagaagtgtattaaaat

SEQ ID NO: 7853725 - DNA, 22 bp, Homo sapiens
taatacaatggagttgggcccc

SEQ ID NO: 7853726 - DNA, 22 bp, Homo sapiens
taatacaatggagttgggcccc

SEQ ID NO: 7853727 - DNA, 22 bp, Homo sapiens
taatacactgctttttgtaact

SEQ ID NO: 7853728 - DNA, 21 bp, Homo sapiens
taataattccactacagagta

SEQ ID NO: 7853729 - DNA, 21 bp, Homo sapiens
taataattccactacagagta

SEQ ID NO: 7853730 - DNA, 21 bp, Homo sapiens
taataattccactacagagta

SEQ ID NO: 7853731 - DNA, 21 bp, Homo sapiens
taataattccactacagagta

SEQ ID NO: 7853732 - DNA, 22 bp, Homo sapiens
caggcagcagaggagtgtggga

SEQ ID NO: 7853733 - DNA, 22 bp, Homo sapiens
caggcagcagaggagtgtggga

SEQ ID NO: 7853734 - DNA, 22 bp, Homo sapiens
caggcagcagccactctggtat

SEQ ID NO: 7853735 - DNA, 22 bp, Homo sapiens
taataattagttattgatcgtg

SEQ ID NO: 7853736 - DNA, 22 bp, Homo sapiens
caggcagatttgctgccctcca

SEQ ID NO: 7853737 - DNA, 22 bp, Homo sapiens
caggcagatttgctgccctcca

SEQ ID NO: 7853738 - DNA, 22 bp, Homo sapiens
caggcagatttgctgccctcca

SEQ ID NO: 7853739 - DNA, 22 bp, Homo sapiens
caggcagatgctgacaagagtt

SEQ ID NO: 7853740 - DNA, 22 bp, Homo sapiens
caggcagatgctgacaagagtt

SEQ ID NO: 7853741 - DNA, 22 bp, Homo sapiens
caggcagatgctgacaagagtt

SEQ ID NO: 7853742 - DNA, 22 bp, Homo sapiens
caggcagatttgctgccctcca

SEQ ID NO: 7853743 - DNA, 22 bp, Homo sapiens
caggcagatttgctgccctcca

SEQ ID NO: 7853744 - DNA, 22 bp, Homo sapiens
caggcagatttgctgccctcca

SEQ ID NO: 7853745 - DNA, 22 bp, Homo sapiens
caggcagatttgctgccctcca

SEQ ID NO: 7853746 - DNA, 22 bp, Homo sapiens
caggcagcagaggagtgtggga

SEQ ID NO: 7853747 - DNA, 22 bp, Homo sapiens
caggcagcagaggagtgtggga

SEQ ID NO: 7853748 - DNA, 22 bp, Homo sapiens
caggcagcagaggagtgtggga

SEQ ID NO: 7853749 - DNA, 22 bp, Homo sapiens
caggcagcagaggagtgtggga

SEQ ID NO: 7853750 - DNA, 22 bp, Homo sapiens
caggcaccctctgaggggaagc

SEQ ID NO: 7853751 - DNA, 22 bp, Homo sapiens
caggcacctcacgtgggtccca

SEQ ID NO: 7853752 - DNA, 22 bp, Homo sapiens
caggcacctcacgtgggtccca

SEQ ID NO: 7853753 - DNA, 22 bp, Homo sapiens
caggcacctcacgtgggtccca

SEQ ID NO: 7853754 - DNA, 22 bp, Homo sapiens
caggcaccctctgaggggaagc

SEQ ID NO: 7853755 - DNA, 22 bp, Homo sapiens
caggcacctgtgtgtctcaggg

SEQ ID NO: 7853756 - DNA, 22 bp, Homo sapiens
caggcacctgtgtgtctcaggg

SEQ ID NO: 7853757 - DNA, 22 bp, Homo sapiens
caggcacctgtgtgtctcaggg

SEQ ID NO: 7853758 - DNA, 22 bp, Homo sapiens
caggcacctgtgtgtctcaggg

SEQ ID NO: 7853759 - DNA, 22 bp, Homo sapiens
caggcacctttgtgcatgggca

SEQ ID NO: 7853760 - DNA, 22 bp, Homo sapiens
caggcacctttgtgcatgggca

SEQ ID NO: 7853761 - DNA, 22 bp, Homo sapiens
caggcacctgtgtgtctcaggg

SEQ ID NO: 7853762 - DNA, 22 bp, Homo sapiens
caggcaccccaggtgagcactg

SEQ ID NO: 7853763 - DNA, 22 bp, Homo sapiens
caggcaccccaggtgagcactg

SEQ ID NO: 7853764 - DNA, 22 bp, Homo sapiens
caggcaccccaggtgagcactg

SEQ ID NO: 7853765 - DNA, 22 bp, Homo sapiens
caggcacccagcccagtcgcac

SEQ ID NO: 7853766 - DNA, 22 bp, Homo sapiens
caggcacccagcccagtcgcac

SEQ ID NO: 7853767 - DNA, 22 bp, Homo sapiens
caggcaccacactaggggctga

SEQ ID NO: 7853768 - DNA, 22 bp, Homo sapiens
caggcaccaatagggatcgtgg

SEQ ID NO: 7853769 - DNA, 22 bp, Homo sapiens
caggcaccacactaggggctga

SEQ ID NO: 7853770 - DNA, 22 bp, Homo sapiens
caggcaccagtgagaagggcct

SEQ ID NO: 7853771 - DNA, 22 bp, Homo sapiens
caggcacccagcccagtcgcac

SEQ ID NO: 7853772 - DNA, 22 bp, Homo sapiens
caggcagagttagagcaactgg

SEQ ID NO: 7853773 - DNA, 22 bp, Homo sapiens
caggcagagttagagcaactgg

SEQ ID NO: 7853774 - DNA, 22 bp, Homo sapiens
caggcagagttagagcaactgg

SEQ ID NO: 7853775 - DNA, 22 bp, Homo sapiens
caggcagagctgaagatagatg

SEQ ID NO: 7853776 - DNA, 22 bp, Homo sapiens
caggcagagctgaagatagatg

SEQ ID NO: 7853777 - DNA, 22 bp, Homo sapiens
caggcagagctgaagatagatg

SEQ ID NO: 7853778 - DNA, 22 bp, Homo sapiens
caggcagagttagagcaactgg

SEQ ID NO: 7853779 - DNA, 22 bp, Homo sapiens
caggcagagttagagcaactgg

SEQ ID NO: 7853780 - DNA, 22 bp, Homo sapiens
caggcagagttagagcaactgg

SEQ ID NO: 7853781 - DNA, 22 bp, Homo sapiens
caggcagagttagagcaactgg

SEQ ID NO: 7853782 - DNA, 22 bp, Homo sapiens
caggcagagttagagcaactgg

SEQ ID NO: 7853783 - DNA, 22 bp, Homo sapiens
caggcagagttagagcaactgg

SEQ ID NO: 7853784 - DNA, 22 bp, Homo sapiens
caggcagagctgaagatagatg

SEQ ID NO: 7853785 - DNA, 22 bp, Homo sapiens
caggcagagctgaagatagatg

SEQ ID NO: 7853786 - DNA, 22 bp, Homo sapiens
caggcagagccaatcgtggggt

SEQ ID NO: 7853787 - DNA, 22 bp, Homo sapiens
caggcagagccaatcgtggggt

SEQ ID NO: 7853788 - DNA, 22 bp, Homo sapiens
caggcagagccaatcgtggggt

SEQ ID NO: 7853789 - DNA, 22 bp, Homo sapiens
caggcagatatgttcgctttaa

SEQ ID NO: 7853790 - DNA, 22 bp, Homo sapiens
caggcagatatgttcgctttaa

SEQ ID NO: 7853791 - DNA, 22 bp, Homo sapiens
caggcagagttagtgatttagg

SEQ ID NO: 7853792 - DNA, 22 bp, Homo sapiens
caggcagagttagtgatttagg

SEQ ID NO: 7853793 - DNA, 22 bp, Homo sapiens
caggcagagttagtgatttagg

SEQ ID NO: 7853794 - DNA, 22 bp, Homo sapiens
caggcagagttagtgatttagg

SEQ ID NO: 7853795 - DNA, 22 bp, Homo sapiens
caggcagagttagagcaactgg

SEQ ID NO: 7853796 - DNA, 22 bp, Homo sapiens
caggcagagttagagcaactgg

SEQ ID NO: 7853797 - DNA, 22 bp, Homo sapiens
caggcagatgctgacaagagtt

SEQ ID NO: 7853798 - DNA, 22 bp, Homo sapiens
caggcagatgctgacaagagtt

SEQ ID NO: 7853799 - DNA, 22 bp, Homo sapiens
caggcagatgctgacaagagtt

SEQ ID NO: 7853800 - DNA, 22 bp, Homo sapiens
caggcagatgctgacaagagtt

SEQ ID NO: 7853801 - DNA, 22 bp, Homo sapiens
caggcagatatgttcgctttaa

SEQ ID NO: 7853802 - DNA, 22 bp, Homo sapiens
caggcagatatgttcgctttaa

SEQ ID NO: 7853803 - DNA, 22 bp, Homo sapiens
caggcagatgctgacaagagtt

SEQ ID NO: 7853804 - DNA, 22 bp, Homo sapiens
caggcagatgctgacaagagtt

SEQ ID NO: 7853805 - DNA, 22 bp, Homo sapiens
caggcagatgctgacaagagtt

SEQ ID NO: 7853806 - DNA, 22 bp, Homo sapiens
taatatttctaccctgctgcct

SEQ ID NO: 7853807 - DNA, 22 bp, Homo sapiens
taatatttctaccctgctgcct

SEQ ID NO: 7853808 - DNA, 22 bp, Homo sapiens
taatatttctaccctgctgcct

SEQ ID NO: 7853809 - DNA, 22 bp, Homo sapiens
taatatgtgttactgacttttt

SEQ ID NO: 7853810 - DNA, 22 bp, Homo sapiens
taatatggacggctccaaggga

SEQ ID NO: 7853811 - DNA, 22 bp, Homo sapiens
taatatggatctttccaatgtt

SEQ ID NO: 7853812 - DNA, 22 bp, Homo sapiens
taatatctggcattcaaacatg

SEQ ID NO: 7853813 - DNA, 22 bp, Homo sapiens
taatatctggcattcaaacatg

SEQ ID NO: 7853814 - DNA, 22 bp, Homo sapiens
taatatctggcattcaaacatg

SEQ ID NO: 7853815 - DNA, 22 bp, Homo sapiens
taatacagacaacttgccaaat

SEQ ID NO: 7853816 - DNA, 22 bp, Homo sapiens
taatcacaattcagatgtctta

SEQ ID NO: 7853817 - DNA, 22 bp, Homo sapiens
taatcacaattcagatgtctta

SEQ ID NO: 7853818 - DNA, 22 bp, Homo sapiens
taatcacaattcagatgtctta

SEQ ID NO: 7853819 - DNA, 22 bp, Homo sapiens
taatcacagaaacagactgttt

SEQ ID NO: 7853820 - DNA, 22 bp, Homo sapiens
taatcacaattcagatgtctta

SEQ ID NO: 7853821 - DNA, 22 bp, Homo sapiens
taatatttctaccctgctgcct

SEQ ID NO: 7853822 - DNA, 22 bp, Homo sapiens
taatcacagaaacagactgttt

SEQ ID NO: 7853823 - DNA, 22 bp, Homo sapiens
taatcacagaaacagactgttt

SEQ ID NO: 7853824 - DNA, 22 bp, Homo sapiens
taatcacagaaacagactgttt

SEQ ID NO: 7853825 - DNA, 22 bp, Homo sapiens
taatcacagaaacagactgttt

SEQ ID NO: 7853826 - DNA, 22 bp, Homo sapiens
taatcacatcagggtaaatggg

SEQ ID NO: 7853827 - DNA, 22 bp, Homo sapiens
taatcacatcagggtaaatggg

SEQ ID NO: 7853828 - DNA, 22 bp, Homo sapiens
taatcacatcagggtaaatggg

SEQ ID NO: 7853829 - DNA, 22 bp, Homo sapiens
taatcacatcagggtaaatggg

SEQ ID NO: 7853830 - DNA, 22 bp, Homo sapiens
taatgtataacaaatactcatc

SEQ ID NO: 7853831 - DNA, 22 bp, Homo sapiens
taatgtataacaaatactcatc

SEQ ID NO: 7853832 - DNA, 22 bp, Homo sapiens
taatgtaggggtgtaacacaca

SEQ ID NO: 7853833 - DNA, 18 bp, Homo sapiens
taatccagggcaggtgat

SEQ ID NO: 7853834 - DNA, 18 bp, Homo sapiens
taatccagggcaggtgat

SEQ ID NO: 7853835 - DNA, 22 bp, Homo sapiens
taatccagcgggtgattgcaca

SEQ ID NO: 7853836 - DNA, 22 bp, Homo sapiens
taatccagcgggtgattgcaca

SEQ ID NO: 7853837 - DNA, 22 bp, Homo sapiens
taatccagcgggtgattgcaca

SEQ ID NO: 7853838 - DNA, 22 bp, Homo sapiens
taatgtcaaggtcattctagag

SEQ ID NO: 7853839 - DNA, 22 bp, Homo sapiens
taatcatatgggtaatccaatg

SEQ ID NO: 7853840 - DNA, 22 bp, Homo sapiens
taatcatatgggtaatccaatg

SEQ ID NO: 7853841 - DNA, 22 bp, Homo sapiens
taatcacttttcattagtacct

SEQ ID NO: 7853842 - DNA, 22 bp, Homo sapiens
taatcagaagttacattagggt

SEQ ID NO: 7853843 - DNA, 22 bp, Homo sapiens
taatcactgggcgtttggtact

SEQ ID NO: 7853844 - DNA, 20 bp, Homo sapiens
taatcacttataagacaatg

SEQ ID NO: 7853845 - DNA, 22 bp, Homo sapiens
taatcactgtcaacctttgttc

SEQ ID NO: 7853846 - DNA, 22 bp, Homo sapiens
taatcactgtcaacctttgttc

SEQ ID NO: 7853847 - DNA, 22 bp, Homo sapiens
taatcactgtgagtctgttttc

SEQ ID NO: 7853848 - DNA, 22 bp, Homo sapiens
taatccaaaactgaatctgtgg

SEQ ID NO: 7853849 - DNA, 22 bp, Homo sapiens
caggcagggagctggaaaggat

SEQ ID NO: 7853850 - DNA, 22 bp, Homo sapiens
caggcagggagctggaaaggat

SEQ ID NO: 7853851 - DNA, 22 bp, Homo sapiens
caggcagggagctggaaaggat

SEQ ID NO: 7853852 - DNA, 22 bp, Homo sapiens
caggcagggagctggaaaggat

SEQ ID NO: 7853853 - DNA, 22 bp, Homo sapiens
taatgttacactgcatggttca

SEQ ID NO: 7853854 - DNA, 22 bp, Homo sapiens
caggcagggagctggaaaggat

SEQ ID NO: 7853855 - DNA, 22 bp, Homo sapiens
taatgttacactgcatggttca

SEQ ID NO: 7853856 - DNA, 22 bp, Homo sapiens
taatgtgttgaatatttgtaca

SEQ ID NO: 7853857 - DNA, 22 bp, Homo sapiens
taatgtgtgtcatcagtagagt

SEQ ID NO: 7853858 - DNA, 22 bp, Homo sapiens
taatgtgaagacataaatcaga

SEQ ID NO: 7853859 - DNA, 22 bp, Homo sapiens
taatgtgaagacataaatcaga

SEQ ID NO: 7853860 - DNA, 22 bp, Homo sapiens
taatgtgaagacataaatcaga

SEQ ID NO: 7853861 - DNA, 22 bp, Homo sapiens
taatgtgaagacataaatcaga

SEQ ID NO: 7853862 - DNA, 22 bp, Homo sapiens
taatgtctttaagagcattggg

SEQ ID NO: 7853863 - DNA, 22 bp, Homo sapiens
taatgtctttaagagcattggg

SEQ ID NO: 7853864 - DNA, 22 bp, Homo sapiens
taatgtcttgtgagagctggag

SEQ ID NO: 7853865 - DNA, 22 bp, Homo sapiens
taatgtcttgccttcctccccc

SEQ ID NO: 7853866 - DNA, 22 bp, Homo sapiens
taatgtctccagggttgaccta

SEQ ID NO: 7853867 - DNA, 22 bp, Homo sapiens
taatgtctgatagtgatggctc

SEQ ID NO: 7853868 - DNA, 22 bp, Homo sapiens
taatgtctgatagtgatggctc

SEQ ID NO: 7853869 - DNA, 22 bp, Homo sapiens
taatgtcttcttttaatttggc

SEQ ID NO: 7853870 - DNA, 22 bp, Homo sapiens
taatgtcttcttttaatttggc

SEQ ID NO: 7853871 - DNA, 22 bp, Homo sapiens
taatgtcttgccttcctccccc

SEQ ID NO: 7853872 - DNA, 22 bp, Homo sapiens
taatgtcttagtaccttaattt

SEQ ID NO: 7853873 - DNA, 22 bp, Homo sapiens
taatgtctgtgtttcagtgcag

SEQ ID NO: 7853874 - DNA, 22 bp, Homo sapiens
taatgtctatgggccagataat

SEQ ID NO: 7853875 - DNA, 22 bp, Homo sapiens
taatgtctagatcagacctcga

SEQ ID NO: 7853876 - DNA, 22 bp, Homo sapiens
taatgtcaaggtgatagatttg

SEQ ID NO: 7853877 - DNA, 22 bp, Homo sapiens
taatgtcaaggtgatagatttg

SEQ ID NO: 7853878 - DNA, 22 bp, Homo sapiens
caggcatgcttctgtctgggca

SEQ ID NO: 7853879 - DNA, 22 bp, Homo sapiens
caggcatggaaaagcccagagg

SEQ ID NO: 7853880 - DNA, 22 bp, Homo sapiens
caggcatgcttctgtctgggca

SEQ ID NO: 7853881 - DNA, 22 bp, Homo sapiens
caggcatgatgggaagtgcctg

SEQ ID NO: 7853882 - DNA, 22 bp, Homo sapiens
caggcatgcttctgtctgggca

SEQ ID NO: 7853883 - DNA, 22 bp, Homo sapiens
caggcatgcttctgtctgggca

SEQ ID NO: 7853884 - DNA, 22 bp, Homo sapiens
caggcatgcttctgtctgggca

SEQ ID NO: 7853885 - DNA, 22 bp, Homo sapiens
caggcatgatgggaagtgcctg

SEQ ID NO: 7853886 - DNA, 22 bp, Homo sapiens
caggcatgatgggaagtgcctg

SEQ ID NO: 7853887 - DNA, 22 bp, Homo sapiens
caggcatgatcataggagttta

SEQ ID NO: 7853888 - DNA, 22 bp, Homo sapiens
caggcatgatcataggagttta

SEQ ID NO: 7853889 - DNA, 22 bp, Homo sapiens
caggcatgagccaggcccctcc

SEQ ID NO: 7853890 - DNA, 22 bp, Homo sapiens
caggcagggagctggaaaggat

SEQ ID NO: 7853891 - DNA, 22 bp, Homo sapiens
caggcagggagctggaaaggat

SEQ ID NO: 7853892 - DNA, 22 bp, Homo sapiens
caggcagggagctggaaaggat

SEQ ID NO: 7853893 - DNA, 22 bp, Homo sapiens
caggcagggagctggaaaggat

SEQ ID NO: 7853894 - DNA, 22 bp, Homo sapiens
caggcatggagaggcagagact

SEQ ID NO: 7853895 - DNA, 22 bp, Homo sapiens
caggcatggagaggcagagact

SEQ ID NO: 7853896 - DNA, 22 bp, Homo sapiens
caggcatggagaggcagagact

SEQ ID NO: 7853897 - DNA, 22 bp, Homo sapiens
caggcatggagaggcagagact

SEQ ID NO: 7853898 - DNA, 22 bp, Homo sapiens
caggcatggagaggcagagact

SEQ ID NO: 7853899 - DNA, 22 bp, Homo sapiens
caggcatggaaaagcccagagg

SEQ ID NO: 7853900 - DNA, 22 bp, Homo sapiens
caggcatggaaaagcccagagg

SEQ ID NO: 7853901 - DNA, 22 bp, Homo sapiens
caggcatggaaaagcccagagg

SEQ ID NO: 7853902 - DNA, 22 bp, Homo sapiens
caggcatggaaaagcccagagg

SEQ ID NO: 7853903 - DNA, 22 bp, Homo sapiens
caggcatggatctggaatcatt

SEQ ID NO: 7853904 - DNA, 22 bp, Homo sapiens
caggcatggagaggcagagact

SEQ ID NO: 7853905 - DNA, 22 bp, Homo sapiens
caggcatggatctggaatcatt

SEQ ID NO: 7853906 - DNA, 22 bp, Homo sapiens
caggcatgggccatgggaagtg

SEQ ID NO: 7853907 - DNA, 22 bp, Homo sapiens
caggcatggagaggcagagact

SEQ ID NO: 7853908 - DNA, 22 bp, Homo sapiens
caggcatggagaggcagagact

SEQ ID NO: 7853909 - DNA, 22 bp, Homo sapiens
caggcatggagaggcagagact

SEQ ID NO: 7853910 - DNA, 19 bp, Homo sapiens
caggccagtgtcagggggc

SEQ ID NO: 7853911 - DNA, 22 bp, Homo sapiens
caggccagtgtgcttcccaggc

SEQ ID NO: 7853912 - DNA, 22 bp, Homo sapiens
caggccagtgtgcttcccaggc

SEQ ID NO: 7853913 - DNA, 22 bp, Homo sapiens
caggccagtgtgcttcccaggc

SEQ ID NO: 7853914 - DNA, 22 bp, Homo sapiens
caggccagtgtgcttcccaggc

SEQ ID NO: 7853915 - DNA, 22 bp, Homo sapiens
caggccagtgtgcttcccaggc

SEQ ID NO: 7853916 - DNA, 22 bp, Homo sapiens
caggccattaccgctgagaccc

SEQ ID NO: 7853917 - DNA, 22 bp, Homo sapiens
caggcccaaatgcaaccttctt

SEQ ID NO: 7853918 - DNA, 22 bp, Homo sapiens
caggccagtgtgcttcccaggc

SEQ ID NO: 7853919 - DNA, 22 bp, Homo sapiens
caggccagttttgatttaagcc

SEQ ID NO: 7853920 - DNA, 22 bp, Homo sapiens
caggccagtgtgcttcccaggc

SEQ ID NO: 7853921 - DNA, 22 bp, Homo sapiens
caggccagtgtgcttcccaggc

SEQ ID NO: 7853922 - DNA, 22 bp, Homo sapiens
caggccagtgtgcttcccaggc

SEQ ID NO: 7853923 - DNA, 22 bp, Homo sapiens
caggcccactgcttgtctagtc

SEQ ID NO: 7853924 - DNA, 22 bp, Homo sapiens
caggcccactgcttgtctagtc

SEQ ID NO: 7853925 - DNA, 22 bp, Homo sapiens
caggcccactgcttgtctagtc

SEQ ID NO: 7853926 - DNA, 22 bp, Homo sapiens
caggcccagaggcctcttccca

SEQ ID NO: 7853927 - DNA, 22 bp, Homo sapiens
caggcccacgaggcacacagag

SEQ ID NO: 7853928 - DNA, 22 bp, Homo sapiens
caggcccactgcttgtctagtc

SEQ ID NO: 7853929 - DNA, 22 bp, Homo sapiens
caggcccactgcttgtctagtc

SEQ ID NO: 7853930 - DNA, 22 bp, Homo sapiens
caggcccacgaggcacacagag

SEQ ID NO: 7853931 - DNA, 22 bp, Homo sapiens
caggcccacgaggcacacagag

SEQ ID NO: 7853932 - DNA, 22 bp, Homo sapiens
caggcccacgaggcacacagag

SEQ ID NO: 7853933 - DNA, 22 bp, Homo sapiens
caggcccacgaggcacacagag

SEQ ID NO: 7853934 - DNA, 22 bp, Homo sapiens
caggcccaagactgatgagtct

SEQ ID NO: 7853935 - DNA, 22 bp, Homo sapiens
caggcccacgaggcacacagag

SEQ ID NO: 7853936 - DNA, 22 bp, Homo sapiens
caggcccaagactgatgagtct

SEQ ID NO: 7853937 - DNA, 22 bp, Homo sapiens
caggcccaaatgcaaccttctt

SEQ ID NO: 7853938 - DNA, 22 bp, Homo sapiens
caggcccaagactgatgagtct

SEQ ID NO: 7853939 - DNA, 22 bp, Homo sapiens
caggcccaagactgatgagtct

SEQ ID NO: 7853940 - DNA, 22 bp, Homo sapiens
caggcccaagactgatgagtct

SEQ ID NO: 7853941 - DNA, 22 bp, Homo sapiens
caggccaggtgctctagaatca

SEQ ID NO: 7853942 - DNA, 22 bp, Homo sapiens
caggccaggtgctctagaatca

SEQ ID NO: 7853943 - DNA, 22 bp, Homo sapiens
caggccaggtgctctagaatca

SEQ ID NO: 7853944 - DNA, 22 bp, Homo sapiens
caggccaggtgctctagaatca

SEQ ID NO: 7853945 - DNA, 22 bp, Homo sapiens
caggccaggtggcaggcaaaac

SEQ ID NO: 7853946 - DNA, 22 bp, Homo sapiens
caggccaggtgctctagaatca

SEQ ID NO: 7853947 - DNA, 22 bp, Homo sapiens
caggccagggttgagaagagaa

SEQ ID NO: 7853948 - DNA, 22 bp, Homo sapiens
caggccagggttgagaagagaa

SEQ ID NO: 7853949 - DNA, 22 bp, Homo sapiens
caggccagggttgagaagagaa

SEQ ID NO: 7853950 - DNA, 22 bp, Homo sapiens
caggccagggttgagaagagaa

SEQ ID NO: 7853951 - DNA, 22 bp, Homo sapiens
caggccagggttgagaagagaa

SEQ ID NO: 7853952 - DNA, 22 bp, Homo sapiens
caggccagggttgagaagagaa

SEQ ID NO: 7853953 - DNA, 22 bp, Homo sapiens
caggccagtgggaaatagggat

SEQ ID NO: 7853954 - DNA, 22 bp, Homo sapiens
caggccagtgggaaatagggat

SEQ ID NO: 7853955 - DNA, 22 bp, Homo sapiens
caggccagtgggaaatagggat

SEQ ID NO: 7853956 - DNA, 22 bp, Homo sapiens
caggccagtgggaaatagggat

SEQ ID NO: 7853957 - DNA, 22 bp, Homo sapiens
caggccagtgggaaatagggat

SEQ ID NO: 7853958 - DNA, 22 bp, Homo sapiens
caggccaggtggcaggcaaaac

SEQ ID NO: 7853959 - DNA, 22 bp, Homo sapiens
caggccaggtggcaggcaaaac

SEQ ID NO: 7853960 - DNA, 19 bp, Homo sapiens
caggccagtgtcagggggc

SEQ ID NO: 7853961 - DNA, 19 bp, Homo sapiens
caggccagtgtcagggggc

SEQ ID NO: 7853962 - DNA, 19 bp, Homo sapiens
caggccagtgtcagggggc

SEQ ID NO: 7853963 - DNA, 19 bp, Homo sapiens
caggccagtgtcagggggc

SEQ ID NO: 7853964 - DNA, 19 bp, Homo sapiens
caggccagtgtcagggggc

SEQ ID NO: 7853965 - DNA, 22 bp, Homo sapiens
caggccagtgggaaatagggat

SEQ ID NO: 7853966 - DNA, 22 bp, Homo sapiens
caggcattagagaattgtgata

SEQ ID NO: 7853967 - DNA, 22 bp, Homo sapiens
caggcatgtggcccaggggtga

SEQ ID NO: 7853968 - DNA, 22 bp, Homo sapiens
caggcatttcgcaaaggctgag

SEQ ID NO: 7853969 - DNA, 22 bp, Homo sapiens
caggcatttaactctctaatgg

SEQ ID NO: 7853970 - DNA, 22 bp, Homo sapiens
caggcatgggccatgggaagtg

SEQ ID NO: 7853971 - DNA, 22 bp, Homo sapiens
caggcatggtgagaactcagcc

SEQ ID NO: 7853972 - DNA, 22 bp, Homo sapiens
caggcatggtgagaactcagcc

SEQ ID NO: 7853973 - DNA, 22 bp, Homo sapiens
caggcatgtggcccaggggtga

SEQ ID NO: 7853974 - DNA, 22 bp, Homo sapiens
caggcatgtggcccaggggtga

SEQ ID NO: 7853975 - DNA, 22 bp, Homo sapiens
tacaaaaaattgatactgacga

SEQ ID NO: 7853976 - DNA, 22 bp, Homo sapiens
tacaaaaaattgatactgacga

SEQ ID NO: 7853977 - DNA, 22 bp, Homo sapiens
tacaaaaaattgatactgacga

SEQ ID NO: 7853978 - DNA, 22 bp, Homo sapiens
tacaaaaaattgatactgacga

SEQ ID NO: 7853979 - DNA, 22 bp, Homo sapiens
tacaaaaaattgatactgacga

SEQ ID NO: 7853980 - DNA, 22 bp, Homo sapiens
tacaaaaaattgatactgacga

SEQ ID NO: 7853981 - DNA, 22 bp, Homo sapiens
tacaaaaaattgatactgacga

SEQ ID NO: 7853982 - DNA, 22 bp, Homo sapiens
tacaaaaaattgatactgacga

SEQ ID NO: 7853983 - DNA, 22 bp, Homo sapiens
tacaaaaaattgatactgacga

SEQ ID NO: 7853984 - DNA, 21 bp, Homo sapiens
caggccaaaaggttcaacatt

SEQ ID NO: 7853985 - DNA, 22 bp, Homo sapiens
tacaaaaaattgatactgacga

SEQ ID NO: 7853986 - DNA, 22 bp, Homo sapiens
tacaaaaaattgatactgacga

SEQ ID NO: 7853987 - DNA, 22 bp, Homo sapiens
tacaaaacagtgctctggtcct

SEQ ID NO: 7853988 - DNA, 22 bp, Homo sapiens
tacaaaacagtgctctggtcct

SEQ ID NO: 7853989 - DNA, 22 bp, Homo sapiens
tacaaaacagtgctctggtcct

SEQ ID NO: 7853990 - DNA, 22 bp, Homo sapiens
tacaaaacagtgctctggtcct

SEQ ID NO: 7853991 - DNA, 22 bp, Homo sapiens
tacaaaaggaagagggatctta

SEQ ID NO: 7853992 - DNA, 22 bp, Homo sapiens
tacaaaacagtgctctggtcct

SEQ ID NO: 7853993 - DNA, 22 bp, Homo sapiens
tacaaaaggaagagggatctta

SEQ ID NO: 7853994 - DNA, 22 bp, Homo sapiens
tacaaaaggaagagggatctta

SEQ ID NO: 7853995 - DNA, 22 bp, Homo sapiens
tacaaaagtaattacggttttt

SEQ ID NO: 7853996 - DNA, 22 bp, Homo sapiens
tacaaaagtaattacggttttt

SEQ ID NO: 7853997 - DNA, 22 bp, Homo sapiens
tacaaaagtaattacggttttt

SEQ ID NO: 7853998 - DNA, 20 bp, Homo sapiens
tacaaacctccacactggtg

SEQ ID NO: 7853999 - DNA, 22 bp, Homo sapiens
tacaaaccaaggaacagtgatc

SEQ ID NO: 7854000 - DNA, 22 bp, Homo sapiens
caggccagagcgcgtggttggg

SEQ ID NO: 7854001 - DNA, 22 bp, Homo sapiens
caggccagagcgcgtggttggg

SEQ ID NO: 7854002 - DNA, 22 bp, Homo sapiens
caggccagagcgcgtggttggg

SEQ ID NO: 7854003 - DNA, 22 bp, Homo sapiens
caggccagagcgcgtggttggg

SEQ ID NO: 7854004 - DNA, 22 bp, Homo sapiens
caggccagggttgagaagagaa

SEQ ID NO: 7854005 - DNA, 22 bp, Homo sapiens
caggccagagcgcgtggttggg

SEQ ID NO: 7854006 - DNA, 22 bp, Homo sapiens
tacattgtacttacaaatagtg

SEQ ID NO: 7854007 - DNA, 22 bp, Homo sapiens
tacattgtacttacaaatagtg

SEQ ID NO: 7854008 - DNA, 20 bp, Homo sapiens
tacattgtagaaatattcaa

SEQ ID NO: 7854009 - DNA, 20 bp, Homo sapiens
tacattgtagaaatattcaa

SEQ ID NO: 7854010 - DNA, 20 bp, Homo sapiens
tacattgtagaaatattcaa

SEQ ID NO: 7854011 - DNA, 22 bp, Homo sapiens
tacattgtacttacaaatagtg

SEQ ID NO: 7854012 - DNA, 20 bp, Homo sapiens
tacattgtagaaatattcaa

SEQ ID NO: 7854013 - DNA, 22 bp, Homo sapiens
tacattgtacttacaaatagtg

SEQ ID NO: 7854014 - DNA, 22 bp, Homo sapiens
tacattgctttctaatacatct

SEQ ID NO: 7854015 - DNA, 19 bp, Homo sapiens
tacattgctggtggggatg

SEQ ID NO: 7854016 - DNA, 19 bp, Homo sapiens
tacattgctggtggggatg

SEQ ID NO: 7854017 - DNA, 22 bp, Homo sapiens
tacattgcttatttgatagtac

SEQ ID NO: 7854018 - DNA, 22 bp, Homo sapiens
tacattgctttctaatacatct

SEQ ID NO: 7854019 - DNA, 22 bp, Homo sapiens
tacattgatggagtacctagct

SEQ ID NO: 7854020 - DNA, 22 bp, Homo sapiens
tacattgctcattatattgctt

SEQ ID NO: 7854021 - DNA, 22 bp, Homo sapiens
tacattgctagaaatgtatttt

SEQ ID NO: 7854022 - DNA, 22 bp, Homo sapiens
tacattgcactttattagatac

SEQ ID NO: 7854023 - DNA, 22 bp, Homo sapiens
tacatgtttactccaagtcagg

SEQ ID NO: 7854024 - DNA, 22 bp, Homo sapiens
tacatgtttggtaaatgatggc

SEQ ID NO: 7854025 - DNA, 22 bp, Homo sapiens
tacatgtttggtaaatgatggc

SEQ ID NO: 7854026 - DNA, 22 bp, Homo sapiens
tacatgtttactccaagtcagg

SEQ ID NO: 7854027 - DNA, 22 bp, Homo sapiens
caggcctgagtgtggaagtctt

SEQ ID NO: 7854028 - DNA, 22 bp, Homo sapiens
caggcctgagacatctgagata

SEQ ID NO: 7854029 - DNA, 22 bp, Homo sapiens
caggcctgcaggaaaggctccc

SEQ ID NO: 7854030 - DNA, 22 bp, Homo sapiens
caggcctgcaggaaaggctccc

SEQ ID NO: 7854031 - DNA, 22 bp, Homo sapiens
caggcctgagtgtggaagtctt

SEQ ID NO: 7854032 - DNA, 22 bp, Homo sapiens
caggcctgatacactgaactct

SEQ ID NO: 7854033 - DNA, 22 bp, Homo sapiens
caggcctgcttcttacccttca

SEQ ID NO: 7854034 - DNA, 22 bp, Homo sapiens
caggcctggagtgcaatggcac

SEQ ID NO: 7854035 - DNA, 22 bp, Homo sapiens
caggcctgcttcttacccttca

SEQ ID NO: 7854036 - DNA, 22 bp, Homo sapiens
tacatgttcaaatttgtctttc

SEQ ID NO: 7854037 - DNA, 22 bp, Homo sapiens
tacatgttcaaatttgtctttc

SEQ ID NO: 7854038 - DNA, 22 bp, Homo sapiens
caggcctgcaggaaaggctccc

SEQ ID NO: 7854039 - DNA, 22 bp, Homo sapiens
caggcctgcaggaaaggctccc

SEQ ID NO: 7854040 - DNA, 22 bp, Homo sapiens
caggcctgcttcttacccttca

SEQ ID NO: 7854041 - DNA, 22 bp, Homo sapiens
caggcctgagacatctgagata

SEQ ID NO: 7854042 - DNA, 22 bp, Homo sapiens
caggcctgagacatctgagata

SEQ ID NO: 7854043 - DNA, 22 bp, Homo sapiens
caggcctgagacatctgagata

SEQ ID NO: 7854044 - DNA, 22 bp, Homo sapiens
caggcctgagacatctgagata

SEQ ID NO: 7854045 - DNA, 22 bp, Homo sapiens
caggcctgagacatctgagata

SEQ ID NO: 7854046 - DNA, 22 bp, Homo sapiens
caggcctgagacatctgagata

SEQ ID NO: 7854047 - DNA, 22 bp, Homo sapiens
caggcctgagtgtggaagtctt

SEQ ID NO: 7854048 - DNA, 22 bp, Homo sapiens
caggcctgaccctgagcttcac

SEQ ID NO: 7854049 - DNA, 22 bp, Homo sapiens
caggcctgagacatctgagata

SEQ ID NO: 7854050 - DNA, 22 bp, Homo sapiens
caggcctcttccatgcagcagc

SEQ ID NO: 7854051 - DNA, 22 bp, Homo sapiens
caggcctcttccatgcagcagc

SEQ ID NO: 7854052 - DNA, 22 bp, Homo sapiens
caggcctcttccatgcagcagc

SEQ ID NO: 7854053 - DNA, 22 bp, Homo sapiens
caggcctcttccatgcagcagc

SEQ ID NO: 7854054 - DNA, 22 bp, Homo sapiens
caggcctcttccatgcagcagc

SEQ ID NO: 7854055 - DNA, 19 bp, Homo sapiens
caggcctcttaccctctct

SEQ ID NO: 7854056 - DNA, 19 bp, Homo sapiens
caggcctcttaccctctct

SEQ ID NO: 7854057 - DNA, 18 bp, Homo sapiens
caggcctcttgatcttcc

SEQ ID NO: 7854058 - DNA, 18 bp, Homo sapiens
caggcctcttgatcttcc

SEQ ID NO: 7854059 - DNA, 22 bp, Homo sapiens
caggcctgaccctgagcttcac

SEQ ID NO: 7854060 - DNA, 18 bp, Homo sapiens
caggcctcttgatcttcc

SEQ ID NO: 7854061 - DNA, 18 bp, Homo sapiens
caggcctcttgatcttcc

SEQ ID NO: 7854062 - DNA, 18 bp, Homo sapiens
caggcctcttgatcttcc

SEQ ID NO: 7854063 - DNA, 20 bp, Homo sapiens
caggcctctgggggccctgg

SEQ ID NO: 7854064 - DNA, 19 bp, Homo sapiens
caggcctctggtctgctgt

SEQ ID NO: 7854065 - DNA, 19 bp, Homo sapiens
caggcctctggtctgctgt

SEQ ID NO: 7854066 - DNA, 19 bp, Homo sapiens
caggcctcttaccctctct

SEQ ID NO: 7854067 - DNA, 19 bp, Homo sapiens
caggcctctggtctgctgt

SEQ ID NO: 7854068 - DNA, 19 bp, Homo sapiens
caggcctctggtctgctgt

SEQ ID NO: 7854069 - DNA, 19 bp, Homo sapiens
caggcctctggtctgctgt

SEQ ID NO: 7854070 - DNA, 22 bp, Homo sapiens
caggcctctccttagtctggca

SEQ ID NO: 7854071 - DNA, 20 bp, Homo sapiens
caggcctctgggggccctgg

SEQ ID NO: 7854072 - DNA, 20 bp, Homo sapiens
caggcctctgggggccctgg

SEQ ID NO: 7854073 - DNA, 22 bp, Homo sapiens
caggcctctccttagtctggca

SEQ ID NO: 7854074 - DNA, 22 bp, Homo sapiens
caggcctcgaggagacagctac

SEQ ID NO: 7854075 - DNA, 22 bp, Homo sapiens
caggcctcgaggagacagctac

SEQ ID NO: 7854076 - DNA, 22 bp, Homo sapiens
caggcctcgaggagacagctac

SEQ ID NO: 7854077 - DNA, 22 bp, Homo sapiens
caggcctcgaggagacagctac

SEQ ID NO: 7854078 - DNA, 22 bp, Homo sapiens
caggcctctatggtcagctgag

SEQ ID NO: 7854079 - DNA, 22 bp, Homo sapiens
caggcctctatggtcagctgag

SEQ ID NO: 7854080 - DNA, 22 bp, Homo sapiens
caggcctctatggtcagctgag

SEQ ID NO: 7854081 - DNA, 22 bp, Homo sapiens
caggcctctatggtcagctgag

SEQ ID NO: 7854082 - DNA, 22 bp, Homo sapiens
caggcctctatggtcagctgag

SEQ ID NO: 7854083 - DNA, 22 bp, Homo sapiens
caggcctctatggtcagctgag

SEQ ID NO: 7854084 - DNA, 22 bp, Homo sapiens
caggcctctccttagtctggca

SEQ ID NO: 7854085 - DNA, 22 bp, Homo sapiens
caggcctctatggtcagctgag

SEQ ID NO: 7854086 - DNA, 22 bp, Homo sapiens
caggcctctatggtcagctgag

SEQ ID NO: 7854087 - DNA, 22 bp, Homo sapiens
caggcccagggagggagaccaa

SEQ ID NO: 7854088 - DNA, 22 bp, Homo sapiens
caggcccagggagggagaccaa

SEQ ID NO: 7854089 - DNA, 22 bp, Homo sapiens
caggcccagggagggagaccaa

SEQ ID NO: 7854090 - DNA, 22 bp, Homo sapiens
caggcccagggagggagaccaa

SEQ ID NO: 7854091 - DNA, 22 bp, Homo sapiens
caggcccagggagggagaccaa

SEQ ID NO: 7854092 - DNA, 22 bp, Homo sapiens
caggccgggcactgcgctaggt

SEQ ID NO: 7854093 - DNA, 22 bp, Homo sapiens
caggccggggcggcgccatctt

SEQ ID NO: 7854094 - DNA, 22 bp, Homo sapiens
caggcccagcccttagccaggt

SEQ ID NO: 7854095 - DNA, 22 bp, Homo sapiens
caggccgggcactgcgctaggt

SEQ ID NO: 7854096 - DNA, 22 bp, Homo sapiens
caggcccagggagggagaccaa

SEQ ID NO: 7854097 - DNA, 22 bp, Homo sapiens
caggcctcgaggagacagctac

SEQ ID NO: 7854098 - DNA, 22 bp, Homo sapiens
caggcctcgaggagacagctac

SEQ ID NO: 7854099 - DNA, 22 bp, Homo sapiens
caggcctcctatgagcactagc

SEQ ID NO: 7854100 - DNA, 22 bp, Homo sapiens
caggcctcctatgagcactagc

SEQ ID NO: 7854101 - DNA, 22 bp, Homo sapiens
caggcctcctatgagcactagc

SEQ ID NO: 7854102 - DNA, 22 bp, Homo sapiens
caggcctcctatgagcactagc

SEQ ID NO: 7854103 - DNA, 21 bp, Homo sapiens
caggccgggtgagcaggcagc

SEQ ID NO: 7854104 - DNA, 22 bp, Homo sapiens
caggcctcctatgagcactagc

SEQ ID NO: 7854105 - DNA, 22 bp, Homo sapiens
caggcctcctatgagcactagc

SEQ ID NO: 7854106 - DNA, 22 bp, Homo sapiens
caggcctcctatgagcactagc

SEQ ID NO: 7854107 - DNA, 21 bp, Homo sapiens
caggccgggtgagcaggcagc

SEQ ID NO: 7854108 - DNA, 22 bp, Homo sapiens
caggccgggcactgcgctaggt

SEQ ID NO: 7854109 - DNA, 22 bp, Homo sapiens
caggccgggcactgcgctaggt

SEQ ID NO: 7854110 - DNA, 22 bp, Homo sapiens
caggcccagcccttagccaggt

SEQ ID NO: 7854111 - DNA, 22 bp, Homo sapiens
caggcccagcccttagccaggt

SEQ ID NO: 7854112 - DNA, 22 bp, Homo sapiens
caggcccaggccagtggttccc

SEQ ID NO: 7854113 - DNA, 22 bp, Homo sapiens
caggcccaggccagtggttccc

SEQ ID NO: 7854114 - DNA, 22 bp, Homo sapiens
caggcccagggagggagaccaa

SEQ ID NO: 7854115 - DNA, 22 bp, Homo sapiens
caggcccaggccagtggttccc

SEQ ID NO: 7854116 - DNA, 22 bp, Homo sapiens
caggcccaggccagtggttccc

SEQ ID NO: 7854117 - DNA, 22 bp, Homo sapiens
caggcccaggccagtggttccc

SEQ ID NO: 7854118 - DNA, 22 bp, Homo sapiens
caggcccagcccttagccaggt

SEQ ID NO: 7854119 - DNA, 22 bp, Homo sapiens
caggcccagcccttagccaggt

SEQ ID NO: 7854120 - DNA, 22 bp, Homo sapiens
caggcccagcccttagccaggt

SEQ ID NO: 7854121 - DNA, 22 bp, Homo sapiens
caggcccagcccagcccttcga

SEQ ID NO: 7854122 - DNA, 22 bp, Homo sapiens
caggcccagcccttagccaggt

SEQ ID NO: 7854123 - DNA, 22 bp, Homo sapiens
caggcccagcccttagccaggt

SEQ ID NO: 7854124 - DNA, 22 bp, Homo sapiens
caggcccagcccttagccaggt

SEQ ID NO: 7854125 - DNA, 22 bp, Homo sapiens
caggcccagcccagcccttcga

SEQ ID NO: 7854126 - DNA, 22 bp, Homo sapiens
caggcccagcccagcccttcga

SEQ ID NO: 7854127 - DNA, 22 bp, Homo sapiens
caggcccagcccagcccttcga

SEQ ID NO: 7854128 - DNA, 22 bp, Homo sapiens
caggcccagaggcctcttccca

SEQ ID NO: 7854129 - DNA, 22 bp, Homo sapiens
caggcccactgcttgtctagtc

SEQ ID NO: 7854130 - DNA, 22 bp, Homo sapiens
caggcccagaggcctcttccca

SEQ ID NO: 7854131 - DNA, 22 bp, Homo sapiens
tactttattgtaaatgctgatg

SEQ ID NO: 7854132 - DNA, 22 bp, Homo sapiens
tactttattgtaaatgctgatg

SEQ ID NO: 7854133 - DNA, 18 bp, Homo sapiens
tactttattccccctcca

SEQ ID NO: 7854134 - DNA, 22 bp, Homo sapiens
tactttattgtaaatgctgatg

SEQ ID NO: 7854135 - DNA, 22 bp, Homo sapiens
tactttattgtaaatgctgatg

SEQ ID NO: 7854136 - DNA, 22 bp, Homo sapiens
tactttattgtaaatgctgatg

SEQ ID NO: 7854137 - DNA, 22 bp, Homo sapiens
tactttattcaggaaggctggt

SEQ ID NO: 7854138 - DNA, 22 bp, Homo sapiens
tactttatcagcgtcaaaggta

SEQ ID NO: 7854139 - DNA, 22 bp, Homo sapiens
tactttaaaaactgataattca

SEQ ID NO: 7854140 - DNA, 22 bp, Homo sapiens
tactttaaagaggtgtaatgag

SEQ ID NO: 7854141 - DNA, 22 bp, Homo sapiens
tactttaaagaggtgtaatgag

SEQ ID NO: 7854142 - DNA, 22 bp, Homo sapiens
tactttacagtattagataatt

SEQ ID NO: 7854143 - DNA, 22 bp, Homo sapiens
tactttacagtattagataatt

SEQ ID NO: 7854144 - DNA, 22 bp, Homo sapiens
tactttagaaggaaataagttc

SEQ ID NO: 7854145 - DNA, 22 bp, Homo sapiens
tactttacagtattagataatt

SEQ ID NO: 7854146 - DNA, 22 bp, Homo sapiens
tactttatattgtggctggcca

SEQ ID NO: 7854147 - DNA, 22 bp, Homo sapiens
tacttgttctttcaagagatag

SEQ ID NO: 7854148 - DNA, 22 bp, Homo sapiens
tacttgttatcatcttttcctt

SEQ ID NO: 7854149 - DNA, 22 bp, Homo sapiens
tactgtggggatattgattgta

SEQ ID NO: 7854150 - DNA, 22 bp, Homo sapiens
tactgtggtaacattttaaatt

SEQ ID NO: 7854151 - DNA, 22 bp, Homo sapiens
tactttaaaaactgataattca

SEQ ID NO: 7854152 - DNA, 22 bp, Homo sapiens
tactttaaaaactgataattca

SEQ ID NO: 7854153 - DNA, 22 bp, Homo sapiens
tactttaaaaactgataattca

SEQ ID NO: 7854154 - DNA, 22 bp, Homo sapiens
tacttgttttgtgttcctaaac

SEQ ID NO: 7854155 - DNA, 22 bp, Homo sapiens
tacttgttttgtgttcctaaac

SEQ ID NO: 7854156 - DNA, 22 bp, Homo sapiens
tactttaaaaactgataattca

SEQ ID NO: 7854157 - DNA, 22 bp, Homo sapiens
tactttaaaaactgataattca

SEQ ID NO: 7854158 - DNA, 22 bp, Homo sapiens
caggctacatttgctctgagaa

SEQ ID NO: 7854159 - DNA, 22 bp, Homo sapiens
caggctactggggcttggatgg

SEQ ID NO: 7854160 - DNA, 22 bp, Homo sapiens
caggctacatttgctctgagaa

SEQ ID NO: 7854161 - DNA, 22 bp, Homo sapiens
caggctacatttgctctgagaa

SEQ ID NO: 7854162 - DNA, 22 bp, Homo sapiens
caggctacatttgctctgagaa

SEQ ID NO: 7854163 - DNA, 22 bp, Homo sapiens
caggctagattggggccagtag

SEQ ID NO: 7854164 - DNA, 22 bp, Homo sapiens
caggctagattggggccagtag

SEQ ID NO: 7854165 - DNA, 22 bp, Homo sapiens
caggctagattggggccagtag

SEQ ID NO: 7854166 - DNA, 22 bp, Homo sapiens
caggctagattggggccagtag

SEQ ID NO: 7854167 - DNA, 22 bp, Homo sapiens
tactgtgggatgttgtgattag

SEQ ID NO: 7854168 - DNA, 22 bp, Homo sapiens
caggctcaagccctgcttatat

SEQ ID NO: 7854169 - DNA, 22 bp, Homo sapiens
caggctatgccttccatctgca

SEQ ID NO: 7854170 - DNA, 22 bp, Homo sapiens
tacattgtgatgtttcaataca

SEQ ID NO: 7854171 - DNA, 22 bp, Homo sapiens
tacattgtgatgtttcaataca

SEQ ID NO: 7854172 - DNA, 22 bp, Homo sapiens
tacattgtgataggaagtcacc

SEQ ID NO: 7854173 - DNA, 22 bp, Homo sapiens
tacattgtgataggaagtcacc

SEQ ID NO: 7854174 - DNA, 22 bp, Homo sapiens
tacattgtgatgtttcaataca

SEQ ID NO: 7854175 - DNA, 20 bp, Homo sapiens
tacattgtgagactaatgga

SEQ ID NO: 7854176 - DNA, 22 bp, Homo sapiens
tacattgtctgcaattttctct

SEQ ID NO: 7854177 - DNA, 20 bp, Homo sapiens
tacattgtgagactaatgga

SEQ ID NO: 7854178 - DNA, 20 bp, Homo sapiens
tacattgtgagactaatgga

SEQ ID NO: 7854179 - DNA, 22 bp, Homo sapiens
tacattgtctgcaattttctct

SEQ ID NO: 7854180 - DNA, 22 bp, Homo sapiens
tacattgtattatccgtgattg

SEQ ID NO: 7854181 - DNA, 22 bp, Homo sapiens
tacattgttcatgcatgagaaa

SEQ ID NO: 7854182 - DNA, 22 bp, Homo sapiens
tacattgttcatgcatgagaaa

SEQ ID NO: 7854183 - DNA, 22 bp, Homo sapiens
tacattgttcatgcatgagaaa

SEQ ID NO: 7854184 - DNA, 22 bp, Homo sapiens
tacattgtttgagatagtttgt

SEQ ID NO: 7854185 - DNA, 22 bp, Homo sapiens
tacattgtgtctctatctagtc

SEQ ID NO: 7854186 - DNA, 23 bp, Homo sapiens
tacattgtggatggagtcctggg

SEQ ID NO: 7854187 - DNA, 23 bp, Homo sapiens
tacattgtggatggagtcctggg

SEQ ID NO: 7854188 - DNA, 22 bp, Homo sapiens
tacattgtgttaaaacagaaga

SEQ ID NO: 7854189 - DNA, 22 bp, Homo sapiens
tacattgtgttaaaacagaaga

SEQ ID NO: 7854190 - DNA, 22 bp, Homo sapiens
tacattgtgtctctatctagtc

SEQ ID NO: 7854191 - DNA, 22 bp, Homo sapiens
tacattgtgtctctatctagtc

SEQ ID NO: 7854192 - DNA, 22 bp, Homo sapiens
tacattgttttttcttgccatc

SEQ ID NO: 7854193 - DNA, 22 bp, Homo sapiens
tacattgttttttcttgccatc

SEQ ID NO: 7854194 - DNA, 22 bp, Homo sapiens
tacattgtttgagatagtttgt

SEQ ID NO: 7854195 - DNA, 22 bp, Homo sapiens
tacattgtttgagatagtttgt

SEQ ID NO: 7854196 - DNA, 22 bp, Homo sapiens
tacatttcagagctcctctctg

SEQ ID NO: 7854197 - DNA, 22 bp, Homo sapiens
tacatttataaggcttctctgt

SEQ ID NO: 7854198 - DNA, 22 bp, Homo sapiens
tacatttataaggcttctctgt

SEQ ID NO: 7854199 - DNA, 22 bp, Homo sapiens
tacatttataaggcttctctgt

SEQ ID NO: 7854200 - DNA, 22 bp, Homo sapiens
tacatttataaggcttctctgt

SEQ ID NO: 7854201 - DNA, 22 bp, Homo sapiens
caggccttgtcaagaaaatgcc

SEQ ID NO: 7854202 - DNA, 22 bp, Homo sapiens
tacatttcctgtcagagatata

SEQ ID NO: 7854203 - DNA, 22 bp, Homo sapiens
caggcctttctggggaagtgag

SEQ ID NO: 7854204 - DNA, 22 bp, Homo sapiens
caggcctttctggggaagtgag

SEQ ID NO: 7854205 - DNA, 22 bp, Homo sapiens
caggcctttctggggaagtgag

SEQ ID NO: 7854206 - DNA, 22 bp, Homo sapiens
caggcctttctggggaagtgag

SEQ ID NO: 7854207 - DNA, 22 bp, Homo sapiens
caggcctttcttggggcttaga

SEQ ID NO: 7854208 - DNA, 22 bp, Homo sapiens
caggcctttgcagggagagaga

SEQ ID NO: 7854209 - DNA, 22 bp, Homo sapiens
caggcctttgggaatcaccaca

SEQ ID NO: 7854210 - DNA, 22 bp, Homo sapiens
caggcctttgggaatcaccaca

SEQ ID NO: 7854211 - DNA, 22 bp, Homo sapiens
caggcctttgcacgtgcagttg

SEQ ID NO: 7854212 - DNA, 18 bp, Homo sapiens
caggcctttgagacagaa

SEQ ID NO: 7854213 - DNA, 22 bp, Homo sapiens
caggcctttcttggggcttaga

SEQ ID NO: 7854214 - DNA, 18 bp, Homo sapiens
caggcctttgagacagaa

SEQ ID NO: 7854215 - DNA, 18 bp, Homo sapiens
caggcctttgagacagaa

SEQ ID NO: 7854216 - DNA, 22 bp, Homo sapiens
caggcggccatgatctggcagg

SEQ ID NO: 7854217 - DNA, 22 bp, Homo sapiens
caggcggccatgatctggcagg

SEQ ID NO: 7854218 - DNA, 22 bp, Homo sapiens
caggcgcagtcaaagaaatact

SEQ ID NO: 7854219 - DNA, 22 bp, Homo sapiens
caggcgggacgtgggaggatca

SEQ ID NO: 7854220 - DNA, 22 bp, Homo sapiens
caggctaaagctttgagcatgt

SEQ ID NO: 7854221 - DNA, 22 bp, Homo sapiens
caggcgagggccctgaggagcc

SEQ ID NO: 7854222 - DNA, 22 bp, Homo sapiens
caggcgagggccctgaggagcc

SEQ ID NO: 7854223 - DNA, 22 bp, Homo sapiens
caggccttttttcctgcagtgt

SEQ ID NO: 7854224 - DNA, 22 bp, Homo sapiens
caggccttttttcctgcagtgt

SEQ ID NO: 7854225 - DNA, 22 bp, Homo sapiens
caggccttttttcctgcagtgt

SEQ ID NO: 7854226 - DNA, 22 bp, Homo sapiens
cagggaagagccgatgctgcag

SEQ ID NO: 7854227 - DNA, 22 bp, Homo sapiens
cagggaagagccgatgctgcag

SEQ ID NO: 7854228 - DNA, 22 bp, Homo sapiens
cagggaagagccgatgctgcag

SEQ ID NO: 7854229 - DNA, 22 bp, Homo sapiens
cagggaaggctgcaaatgttaa

SEQ ID NO: 7854230 - DNA, 22 bp, Homo sapiens
cagggaagagccgatgctgcag

SEQ ID NO: 7854231 - DNA, 22 bp, Homo sapiens
cagggaagagccgatgctgcag

SEQ ID NO: 7854232 - DNA, 22 bp, Homo sapiens
cagggaacaagatgagaatgga

SEQ ID NO: 7854233 - DNA, 22 bp, Homo sapiens
cagggaaattaagtgacgatga

SEQ ID NO: 7854234 - DNA, 22 bp, Homo sapiens
cagggaaattaagtgacgatga

SEQ ID NO: 7854235 - DNA, 22 bp, Homo sapiens
cagggaaagttcttgtccactc

SEQ ID NO: 7854236 - DNA, 22 bp, Homo sapiens
cagggaaagttcttgtccactc

SEQ ID NO: 7854237 - DNA, 22 bp, Homo sapiens
cagggaaagttcttgtccactc

SEQ ID NO: 7854238 - DNA, 22 bp, Homo sapiens
cagggaagaatagttagcaaag

SEQ ID NO: 7854239 - DNA, 22 bp, Homo sapiens
cagggaacaagatgagaatgga

SEQ ID NO: 7854240 - DNA, 22 bp, Homo sapiens
cagggaagaatagttagcaaag

SEQ ID NO: 7854241 - DNA, 22 bp, Homo sapiens
cagggaagaatagttagcaaag

SEQ ID NO: 7854242 - DNA, 22 bp, Homo sapiens
cagggaagaatagttagcaaag

SEQ ID NO: 7854243 - DNA, 22 bp, Homo sapiens
caggctttttctgctgtcctct

SEQ ID NO: 7854244 - DNA, 22 bp, Homo sapiens
cagggaaactaggaaataagct

SEQ ID NO: 7854245 - DNA, 22 bp, Homo sapiens
caggctttttctgctgtcctct

SEQ ID NO: 7854246 - DNA, 22 bp, Homo sapiens
caggctttttctgctgtcctct

SEQ ID NO: 7854247 - DNA, 22 bp, Homo sapiens
caggctttttctgctgtcctct

SEQ ID NO: 7854248 - DNA, 22 bp, Homo sapiens
caggctttttctgctgtcctct

SEQ ID NO: 7854249 - DNA, 22 bp, Homo sapiens
cagggaaagtcccaccccacac

SEQ ID NO: 7854250 - DNA, 22 bp, Homo sapiens
cagggaaagtcccaccccacac

SEQ ID NO: 7854251 - DNA, 22 bp, Homo sapiens
cagggaaactaggaaataagct

SEQ ID NO: 7854252 - DNA, 18 bp, Homo sapiens
caggctttgattttggag

SEQ ID NO: 7854253 - DNA, 22 bp, Homo sapiens
caggcttttatgaatttcagtg

SEQ ID NO: 7854254 - DNA, 22 bp, Homo sapiens
caggctttcaggacagcgagcc

SEQ ID NO: 7854255 - DNA, 22 bp, Homo sapiens
caggctttactttctctctgaa

SEQ ID NO: 7854256 - DNA, 22 bp, Homo sapiens
caggctttactttctctctgaa

SEQ ID NO: 7854257 - DNA, 22 bp, Homo sapiens
caggctttactttctctctgaa

SEQ ID NO: 7854258 - DNA, 22 bp, Homo sapiens
caggctttcaggacagcgagcc

SEQ ID NO: 7854259 - DNA, 22 bp, Homo sapiens
caggcttttgcatagcactggg

SEQ ID NO: 7854260 - DNA, 22 bp, Homo sapiens
caggcttttatgaatttcagtg

SEQ ID NO: 7854261 - DNA, 22 bp, Homo sapiens
caggcttttgcatagcactggg

SEQ ID NO: 7854262 - DNA, 22 bp, Homo sapiens
tagaaacaaagacctgggtgct

SEQ ID NO: 7854263 - DNA, 22 bp, Homo sapiens
tagaaacaagggagaggattct

SEQ ID NO: 7854264 - DNA, 22 bp, Homo sapiens
tagaaacaagggagaggattct

SEQ ID NO: 7854265 - DNA, 22 bp, Homo sapiens
tagaaacaagggagaggattct

SEQ ID NO: 7854266 - DNA, 22 bp, Homo sapiens
caggctgtctgaatggaggccc

SEQ ID NO: 7854267 - DNA, 22 bp, Homo sapiens
caggctgtctgaatggaggccc

SEQ ID NO: 7854268 - DNA, 22 bp, Homo sapiens
tagaaacaagggagaggattct

SEQ ID NO: 7854269 - DNA, 22 bp, Homo sapiens
tagaaacaagggagaggattct

SEQ ID NO: 7854270 - DNA, 22 bp, Homo sapiens
caggctgtctgaatggaggccc

SEQ ID NO: 7854271 - DNA, 22 bp, Homo sapiens
caggcttggcagggaggctggt

SEQ ID NO: 7854272 - DNA, 22 bp, Homo sapiens
caggcttggcagggaggctggt

SEQ ID NO: 7854273 - DNA, 22 bp, Homo sapiens
caggcttggagggcagtggcat

SEQ ID NO: 7854274 - DNA, 22 bp, Homo sapiens
caggcttggagggcagtggcat

SEQ ID NO: 7854275 - DNA, 22 bp, Homo sapiens
caggcttggagggcagtggcat

SEQ ID NO: 7854276 - DNA, 22 bp, Homo sapiens
caggcttgctgctagagcactt

SEQ ID NO: 7854277 - DNA, 22 bp, Homo sapiens
caggcttggagggcagtggcat

SEQ ID NO: 7854278 - DNA, 22 bp, Homo sapiens
caggcttgctgctagagcactt

SEQ ID NO: 7854279 - DNA, 22 bp, Homo sapiens
caggcttggttggggcgaggga

SEQ ID NO: 7854280 - DNA, 22 bp, Homo sapiens
caggcttgggttctctgagtta

SEQ ID NO: 7854281 - DNA, 22 bp, Homo sapiens
caggcttgggttctctgagtta

SEQ ID NO: 7854282 - DNA, 22 bp, Homo sapiens
caggcttgtgctccactttcag

SEQ ID NO: 7854283 - DNA, 22 bp, Homo sapiens
caggcttgtgctccactttcag

SEQ ID NO: 7854284 - DNA, 22 bp, Homo sapiens
caggctttactttctctctgaa

SEQ ID NO: 7854285 - DNA, 22 bp, Homo sapiens
caggcttgtgtctcagctgcag

SEQ ID NO: 7854286 - DNA, 22 bp, Homo sapiens
caggcttgtgtctcagctgcag

SEQ ID NO: 7854287 - DNA, 22 bp, Homo sapiens
caggcttgtgtctcagctgcag

SEQ ID NO: 7854288 - DNA, 22 bp, Homo sapiens
caggcttggcagggaggctggt

SEQ ID NO: 7854289 - DNA, 22 bp, Homo sapiens
caggcttggcagggaggctggt

SEQ ID NO: 7854290 - DNA, 22 bp, Homo sapiens
caggcttgggagcagagccact

SEQ ID NO: 7854291 - DNA, 22 bp, Homo sapiens
caggcttgggagcagagccact

SEQ ID NO: 7854292 - DNA, 22 bp, Homo sapiens
caggcttgggttctctgagtta

SEQ ID NO: 7854293 - DNA, 22 bp, Homo sapiens
caggcttgggagcagagccact

SEQ ID NO: 7854294 - DNA, 22 bp, Homo sapiens
cagggacagagactgcaccttg

SEQ ID NO: 7854295 - DNA, 22 bp, Homo sapiens
cagggacagagactgcaccttg

SEQ ID NO: 7854296 - DNA, 22 bp, Homo sapiens
cagggacaatggcagagcctga

SEQ ID NO: 7854297 - DNA, 22 bp, Homo sapiens
cagggacagacagatatatttg

SEQ ID NO: 7854298 - DNA, 22 bp, Homo sapiens
cagggacagagactgcaccttg

SEQ ID NO: 7854299 - DNA, 22 bp, Homo sapiens
cagggacagagactgcaccttg

SEQ ID NO: 7854300 - DNA, 22 bp, Homo sapiens
cagggacagcactaaactcttg

SEQ ID NO: 7854301 - DNA, 22 bp, Homo sapiens
cagggacagcactaaactcttg

SEQ ID NO: 7854302 - DNA, 20 bp, Homo sapiens
cagggacagcagtgggtttt

SEQ ID NO: 7854303 - DNA, 20 bp, Homo sapiens
cagggacagcagtgggtttt

SEQ ID NO: 7854304 - DNA, 20 bp, Homo sapiens
cagggacagcagtgggtttt

SEQ ID NO: 7854305 - DNA, 22 bp, Homo sapiens
cagggacaatggcagagcctga

SEQ ID NO: 7854306 - DNA, 22 bp, Homo sapiens
cagggacaatggcagagcctga

SEQ ID NO: 7854307 - DNA, 22 bp, Homo sapiens
cagggacaatggcagagcctga

SEQ ID NO: 7854308 - DNA, 22 bp, Homo sapiens
cagggacaatggcagagcctga

SEQ ID NO: 7854309 - DNA, 22 bp, Homo sapiens
cagggacaatggcagagcctga

SEQ ID NO: 7854310 - DNA, 22 bp, Homo sapiens
cagggacaaggaataagattag

SEQ ID NO: 7854311 - DNA, 22 bp, Homo sapiens
cagggacaatggcagagcctga

SEQ ID NO: 7854312 - DNA, 22 bp, Homo sapiens
cagggacaatggcagagcctga

SEQ ID NO: 7854313 - DNA, 22 bp, Homo sapiens
cagggacaaagtgagaaaggaa

SEQ ID NO: 7854314 - DNA, 22 bp, Homo sapiens
cagggacaaacaaggttgggga

SEQ ID NO: 7854315 - DNA, 22 bp, Homo sapiens
cagggacaaagtgagaaaggaa

SEQ ID NO: 7854316 - DNA, 22 bp, Homo sapiens
cagggacaaacaaggttgggga

SEQ ID NO: 7854317 - DNA, 22 bp, Homo sapiens
cagggaaggctgcaaatgttaa

SEQ ID NO: 7854318 - DNA, 22 bp, Homo sapiens
cagggaaggctgcaaatgttaa

SEQ ID NO: 7854319 - DNA, 22 bp, Homo sapiens
tagattctacagctcagctgtc

SEQ ID NO: 7854320 - DNA, 22 bp, Homo sapiens
tagattctaagattctaagaat

SEQ ID NO: 7854321 - DNA, 22 bp, Homo sapiens
tagattctaagattctaagaat

SEQ ID NO: 7854322 - DNA, 22 bp, Homo sapiens
tagattcatgcagtatgctagt

SEQ ID NO: 7854323 - DNA, 22 bp, Homo sapiens
tagattcagatatttaggacaa

SEQ ID NO: 7854324 - DNA, 22 bp, Homo sapiens
tagattcagatatttaggacaa

SEQ ID NO: 7854325 - DNA, 22 bp, Homo sapiens
tagatacaggctctctgagcct

SEQ ID NO: 7854326 - DNA, 22 bp, Homo sapiens
tagattatccctgatttgtcca

SEQ ID NO: 7854327 - DNA, 22 bp, Homo sapiens
cagggacagccttggggtggcg

SEQ ID NO: 7854328 - DNA, 22 bp, Homo sapiens
tagatacacacacagtcatgtg

SEQ ID NO: 7854329 - DNA, 22 bp, Homo sapiens
tagatacaggcaagattatgaa

SEQ ID NO: 7854330 - DNA, 20 bp, Homo sapiens
cagggacagcagtgggtttt

SEQ ID NO: 7854331 - DNA, 22 bp, Homo sapiens
tagatacaggcaagattatgaa

SEQ ID NO: 7854332 - DNA, 22 bp, Homo sapiens
tagattctgtatgtctgctctc

SEQ ID NO: 7854333 - DNA, 20 bp, Homo sapiens
tagattctgtctgtccaaac

SEQ ID NO: 7854334 - DNA, 22 bp, Homo sapiens
tagattctgtatgtctgctctc

SEQ ID NO: 7854335 - DNA, 20 bp, Homo sapiens
tagattctgtctgtccaaac

SEQ ID NO: 7854336 - DNA, 22 bp, Homo sapiens
tagattctgtgagagtcaaagt

SEQ ID NO: 7854337 - DNA, 22 bp, Homo sapiens
tagattctgtgagagtcaaagt

SEQ ID NO: 7854338 - DNA, 22 bp, Homo sapiens
tagattctgtgagagtcaaagt

SEQ ID NO: 7854339 - DNA, 22 bp, Homo sapiens
tagattctgtttcctctggttt

SEQ ID NO: 7854340 - DNA, 22 bp, Homo sapiens
tagattcttcttttgagtctct

SEQ ID NO: 7854341 - DNA, 22 bp, Homo sapiens
tagattcttcttttgagtctct

SEQ ID NO: 7854342 - DNA, 22 bp, Homo sapiens
tagattcttctaggtctttagc

SEQ ID NO: 7854343 - DNA, 22 bp, Homo sapiens
tagattcttcttttgagtctct

SEQ ID NO: 7854344 - DNA, 22 bp, Homo sapiens
tagattcttgaaccagtgcctc

SEQ ID NO: 7854345 - DNA, 22 bp, Homo sapiens
tagattcttgaaccagtgcctc

SEQ ID NO: 7854346 - DNA, 22 bp, Homo sapiens
tagattctttgctagatcattg

SEQ ID NO: 7854347 - DNA, 22 bp, Homo sapiens
tagattcttagtttcatagaat

SEQ ID NO: 7854348 - DNA, 22 bp, Homo sapiens
tagattcttctaggtctttagc

SEQ ID NO: 7854349 - DNA, 22 bp, Homo sapiens
tagattcttctaggtctttagc

SEQ ID NO: 7854350 - DNA, 22 bp, Homo sapiens
tagattcttagtttcatagaat

SEQ ID NO: 7854351 - DNA, 22 bp, Homo sapiens
tagattcttagtttcatagaat

SEQ ID NO: 7854352 - DNA, 22 bp, Homo sapiens
tagattctacagctcagctgtc

SEQ ID NO: 7854353 - DNA, 22 bp, Homo sapiens
tagattctactgtcacttagtt

SEQ ID NO: 7854354 - DNA, 22 bp, Homo sapiens
tagattctactgtcacttagtt

SEQ ID NO: 7854355 - DNA, 22 bp, Homo sapiens
tagattctcagaattttagaaa

SEQ ID NO: 7854356 - DNA, 22 bp, Homo sapiens
tagattctcagaattttagaaa

SEQ ID NO: 7854357 - DNA, 22 bp, Homo sapiens
tagattctccacatgtagcaat

SEQ ID NO: 7854358 - DNA, 22 bp, Homo sapiens
tagattctccacatgtagcaat

SEQ ID NO: 7854359 - DNA, 22 bp, Homo sapiens
tagattctcccacctgccaggc

SEQ ID NO: 7854360 - DNA, 22 bp, Homo sapiens
tagattctcccacctgccaggc

SEQ ID NO: 7854361 - DNA, 22 bp, Homo sapiens
tagattctcccacctgccaggc

SEQ ID NO: 7854362 - DNA, 22 bp, Homo sapiens
tagattctcccatcatgagatg

SEQ ID NO: 7854363 - DNA, 22 bp, Homo sapiens
tagattctcccatcatgagatg

SEQ ID NO: 7854364 - DNA, 22 bp, Homo sapiens
tagattctcccatcatgagatg

SEQ ID NO: 7854365 - DNA, 22 bp, Homo sapiens
tagattctcccatcatgagatg

SEQ ID NO: 7854366 - DNA, 22 bp, Homo sapiens
tagattctctgctggctgacat

SEQ ID NO: 7854367 - DNA, 22 bp, Homo sapiens
tagattctgtaaataatcaagg

SEQ ID NO: 7854368 - DNA, 22 bp, Homo sapiens
tagattctgtaaataatcaagg

SEQ ID NO: 7854369 - DNA, 22 bp, Homo sapiens
tagattctgaccctctttttac

SEQ ID NO: 7854370 - DNA, 22 bp, Homo sapiens
tagattctggagagacagcagt

SEQ ID NO: 7854371 - DNA, 22 bp, Homo sapiens
tagattctggagagacagcagt

SEQ ID NO: 7854372 - DNA, 22 bp, Homo sapiens
caggctggagtgcagtggtgcc

SEQ ID NO: 7854373 - DNA, 22 bp, Homo sapiens
caggctggagtgcagtggtgcc

SEQ ID NO: 7854374 - DNA, 22 bp, Homo sapiens
caggctggagtgcagtggtgcc

SEQ ID NO: 7854375 - DNA, 22 bp, Homo sapiens
caggctggagtgcagtggtgcc

SEQ ID NO: 7854376 - DNA, 22 bp, Homo sapiens
caggctggagtgcagtggtgcc

SEQ ID NO: 7854377 - DNA, 22 bp, Homo sapiens
caggctggagtgcagtggtgcc

SEQ ID NO: 7854378 - DNA, 22 bp, Homo sapiens
caggctggagtgcagtggtgcc

SEQ ID NO: 7854379 - DNA, 22 bp, Homo sapiens
caggctggagttcagtggtgtg

SEQ ID NO: 7854380 - DNA, 22 bp, Homo sapiens
caggctggagtgcagtggtgcc

SEQ ID NO: 7854381 - DNA, 22 bp, Homo sapiens
caggctggagtgcagtggtgcc

SEQ ID NO: 7854382 - DNA, 22 bp, Homo sapiens
caggctgccgtggggtccaggc

SEQ ID NO: 7854383 - DNA, 22 bp, Homo sapiens
caggctgccgtggggtccaggc

SEQ ID NO: 7854384 - DNA, 22 bp, Homo sapiens
caggctgccgtgaagcaggcct

SEQ ID NO: 7854385 - DNA, 22 bp, Homo sapiens
caggctgccgtggggtccaggc

SEQ ID NO: 7854386 - DNA, 22 bp, Homo sapiens
caggctgccgtgaagcaggcct

SEQ ID NO: 7854387 - DNA, 22 bp, Homo sapiens
caggctgccgtgaagcaggcct

SEQ ID NO: 7854388 - DNA, 22 bp, Homo sapiens
caggctggagttcagtggtgtg

SEQ ID NO: 7854389 - DNA, 22 bp, Homo sapiens
caggctggagttcagtggtgtg

SEQ ID NO: 7854390 - DNA, 22 bp, Homo sapiens
caggctggagttcagtggtgtg

SEQ ID NO: 7854391 - DNA, 22 bp, Homo sapiens
caggctggagttcagtggtgtg

SEQ ID NO: 7854392 - DNA, 22 bp, Homo sapiens
caggctggagttcagtggtgtg

SEQ ID NO: 7854393 - DNA, 22 bp, Homo sapiens
caggctggagttcagtggtgtg

SEQ ID NO: 7854394 - DNA, 22 bp, Homo sapiens
caggctggagttcagtggtgtg

SEQ ID NO: 7854395 - DNA, 22 bp, Homo sapiens
caggctggagttcagtggtgtg

SEQ ID NO: 7854396 - DNA, 22 bp, Homo sapiens
caggctggagttcagtggtgtg

SEQ ID NO: 7854397 - DNA, 22 bp, Homo sapiens
caggctggagttcagtggtgtg

SEQ ID NO: 7854398 - DNA, 22 bp, Homo sapiens
caggctggagttcagtggtgtg

SEQ ID NO: 7854399 - DNA, 22 bp, Homo sapiens
caggctgccgtgaagcaggcct

SEQ ID NO: 7854400 - DNA, 22 bp, Homo sapiens
caggctgccgtgaagcaggcct

SEQ ID NO: 7854401 - DNA, 22 bp, Homo sapiens
caggctgccgtgaagcaggcct

SEQ ID NO: 7854402 - DNA, 22 bp, Homo sapiens
caggctgccgtgaagcaggcct

SEQ ID NO: 7854403 - DNA, 22 bp, Homo sapiens
caggctgccctagcttggacat

SEQ ID NO: 7854404 - DNA, 22 bp, Homo sapiens
caggctgccctagcttggacat

SEQ ID NO: 7854405 - DNA, 22 bp, Homo sapiens
caggctgccctagcttggacat

SEQ ID NO: 7854406 - DNA, 22 bp, Homo sapiens
caggctgccctagcttggacat

SEQ ID NO: 7854407 - DNA, 22 bp, Homo sapiens
caggctgcccggcaagttgcgc

SEQ ID NO: 7854408 - DNA, 22 bp, Homo sapiens
caggctgccgaggctgcagaat

SEQ ID NO: 7854409 - DNA, 22 bp, Homo sapiens
caggctgccgaggctgcagaat

SEQ ID NO: 7854410 - DNA, 22 bp, Homo sapiens
caggctgccctagcttggacat

SEQ ID NO: 7854411 - DNA, 22 bp, Homo sapiens
caggctgccgaggctgcagaat

SEQ ID NO: 7854412 - DNA, 22 bp, Homo sapiens
caggctgccaaggctggggagg

SEQ ID NO: 7854413 - DNA, 22 bp, Homo sapiens
caggctgccaaggctggggagg

SEQ ID NO: 7854414 - DNA, 22 bp, Homo sapiens
caggctgccaaggctggggagg

SEQ ID NO: 7854415 - DNA, 22 bp, Homo sapiens
caggctgcccggcaagttgcgc

SEQ ID NO: 7854416 - DNA, 22 bp, Homo sapiens
caggctgccaaggctggggagg

SEQ ID NO: 7854417 - DNA, 22 bp, Homo sapiens
caggctgccaaggctggggagg

SEQ ID NO: 7854418 - DNA, 22 bp, Homo sapiens
caggctgccaaggctggggagg

SEQ ID NO: 7854419 - DNA, 22 bp, Homo sapiens
caggctgcagtgcagtggctat

SEQ ID NO: 7854420 - DNA, 22 bp, Homo sapiens
caggctgcagtgcagtggctat

SEQ ID NO: 7854421 - DNA, 22 bp, Homo sapiens
caggctgcagtgcagtggctat

SEQ ID NO: 7854422 - DNA, 22 bp, Homo sapiens
caggctgcatggaggggtacag

SEQ ID NO: 7854423 - DNA, 22 bp, Homo sapiens
caggctgcatggaggggtacag

SEQ ID NO: 7854424 - DNA, 22 bp, Homo sapiens
tagaaaatagggcctgtggagc

SEQ ID NO: 7854425 - DNA, 22 bp, Homo sapiens
tagaaaagctctaaggcctctc

SEQ ID NO: 7854426 - DNA, 22 bp, Homo sapiens
tagaaaagtatgggactgacat

SEQ ID NO: 7854427 - DNA, 22 bp, Homo sapiens
tagaaaatagggcctgtggagc

SEQ ID NO: 7854428 - DNA, 22 bp, Homo sapiens
tagaaaatccagtgtggggaga

SEQ ID NO: 7854429 - DNA, 22 bp, Homo sapiens
tagaaaatggccaagcaggact

SEQ ID NO: 7854430 - DNA, 22 bp, Homo sapiens
tagaaaatggccaagcaggact

SEQ ID NO: 7854431 - DNA, 22 bp, Homo sapiens
tagaaaatggccaagcaggact

SEQ ID NO: 7854432 - DNA, 22 bp, Homo sapiens
tagaaacaaagacctgggtgct

SEQ ID NO: 7854433 - DNA, 22 bp, Homo sapiens
tagaaacaaagacctgggtgct

SEQ ID NO: 7854434 - DNA, 22 bp, Homo sapiens
tagaaacaaagacctgggtgct

SEQ ID NO: 7854435 - DNA, 22 bp, Homo sapiens
tagaaacaaagacctgggtgct

SEQ ID NO: 7854436 - DNA, 22 bp, Homo sapiens
tagaaacaaaatctgatgactc

SEQ ID NO: 7854437 - DNA, 22 bp, Homo sapiens
tagaaacaaaatctgatgactc

SEQ ID NO: 7854438 - DNA, 22 bp, Homo sapiens
tagaaacaaaatctgatgactc

SEQ ID NO: 7854439 - DNA, 22 bp, Homo sapiens
tagaaacaaaatctgatgactc

SEQ ID NO: 7854440 - DNA, 22 bp, Homo sapiens
tagaaacaaaatctgatgactc

SEQ ID NO: 7854441 - DNA, 22 bp, Homo sapiens
tagaaacaaaatctgatgactc

SEQ ID NO: 7854442 - DNA, 22 bp, Homo sapiens
tagaaaatgttccactgccatt

SEQ ID NO: 7854443 - DNA, 22 bp, Homo sapiens
tagaaaatgttccactgccatt

SEQ ID NO: 7854444 - DNA, 22 bp, Homo sapiens
tagaaacaaaatctgatgactc

SEQ ID NO: 7854445 - DNA, 22 bp, Homo sapiens
tagaaaatgttccactgccatt

SEQ ID NO: 7854446 - DNA, 22 bp, Homo sapiens
tagaaaatgttccactgccatt

SEQ ID NO: 7854447 - DNA, 22 bp, Homo sapiens
tagaaaatgttccactgccatt

SEQ ID NO: 7854448 - DNA, 22 bp, Homo sapiens
tagaaaatgttccactgccatt

SEQ ID NO: 7854449 - DNA, 22 bp, Homo sapiens
caggctggcaatgcgtcaagca

SEQ ID NO: 7854450 - DNA, 22 bp, Homo sapiens
caggctggcaatgcgtcaagca

SEQ ID NO: 7854451 - DNA, 22 bp, Homo sapiens
caggctggcaatgcgtcaagca

SEQ ID NO: 7854452 - DNA, 22 bp, Homo sapiens
caggctggcaatgcgtcaagca

SEQ ID NO: 7854453 - DNA, 22 bp, Homo sapiens
caggctggcaatgcgtcaagca

SEQ ID NO: 7854454 - DNA, 22 bp, Homo sapiens
caggctgggaacgccacccgct

SEQ ID NO: 7854455 - DNA, 22 bp, Homo sapiens
caggctgggaacgccacccgct

SEQ ID NO: 7854456 - DNA, 22 bp, Homo sapiens
caggctgggaacgccacccgct

SEQ ID NO: 7854457 - DNA, 22 bp, Homo sapiens
caggctgggaacgccacccgct

SEQ ID NO: 7854458 - DNA, 22 bp, Homo sapiens
caggctgggactgacccctgct

SEQ ID NO: 7854459 - DNA, 22 bp, Homo sapiens
caggctgggactgacccctgct

SEQ ID NO: 7854460 - DNA, 22 bp, Homo sapiens
caggctgggactgacccctgct

SEQ ID NO: 7854461 - DNA, 22 bp, Homo sapiens
caggctgggactgacccctgct

SEQ ID NO: 7854462 - DNA, 22 bp, Homo sapiens
caggctgggactgacccctgct

SEQ ID NO: 7854463 - DNA, 22 bp, Homo sapiens
caggctgggactgacccctgct

SEQ ID NO: 7854464 - DNA, 22 bp, Homo sapiens
tagaaaagctctaaggcctctc

SEQ ID NO: 7854465 - DNA, 22 bp, Homo sapiens
tagaaaagctctaaggcctctc

SEQ ID NO: 7854466 - DNA, 22 bp, Homo sapiens
tagaaaagtatgggactgacat

SEQ ID NO: 7854467 - DNA, 22 bp, Homo sapiens
tagaaaagtatgggactgacat

SEQ ID NO: 7854468 - DNA, 22 bp, Homo sapiens
cagtcaggggtgggatcaaggc

SEQ ID NO: 7854469 - DNA, 22 bp, Homo sapiens
cagtcagggacaccagctagga

SEQ ID NO: 7854470 - DNA, 22 bp, Homo sapiens
cagtcagggacaccagctagga

SEQ ID NO: 7854471 - DNA, 22 bp, Homo sapiens
cagtcagggacaccagctagga

SEQ ID NO: 7854472 - DNA, 22 bp, Homo sapiens
cagtcagggacaccagctagga

SEQ ID NO: 7854473 - DNA, 22 bp, Homo sapiens
cagtcagtaatgtggcacctgt

SEQ ID NO: 7854474 - DNA, 22 bp, Homo sapiens
cagtcagttatccacacaccag

SEQ ID NO: 7854475 - DNA, 22 bp, Homo sapiens
cagtcatccaggaaatgtatcc

SEQ ID NO: 7854476 - DNA, 22 bp, Homo sapiens
cagtccaacctgccccttgggc

SEQ ID NO: 7854477 - DNA, 22 bp, Homo sapiens
cagtccaacctgccccttgggc

SEQ ID NO: 7854478 - DNA, 22 bp, Homo sapiens
cagtcactggaatagctgagga

SEQ ID NO: 7854479 - DNA, 22 bp, Homo sapiens
cagtcagaaggaagatgcttaa

SEQ ID NO: 7854480 - DNA, 22 bp, Homo sapiens
cagtcagaaggaagatgcttaa

SEQ ID NO: 7854481 - DNA, 22 bp, Homo sapiens
cagtcaccttgaggactcagac

SEQ ID NO: 7854482 - DNA, 22 bp, Homo sapiens
cagtcagaggtcttctaaaaca

SEQ ID NO: 7854483 - DNA, 22 bp, Homo sapiens
cagtcagagtcacagtaatttg

SEQ ID NO: 7854484 - DNA, 22 bp, Homo sapiens
cagtcagagtcacagtaatttg

SEQ ID NO: 7854485 - DNA, 22 bp, Homo sapiens
cagtcagagtcacagtaatttg

SEQ ID NO: 7854486 - DNA, 22 bp, Homo sapiens
cagtcaggaatgcctccttcct

SEQ ID NO: 7854487 - DNA, 22 bp, Homo sapiens
cagtcaggaatgcctccttcct

SEQ ID NO: 7854488 - DNA, 22 bp, Homo sapiens
cagtcaggctgcgcttctctga

SEQ ID NO: 7854489 - DNA, 22 bp, Homo sapiens
cagtcaggctgcgcttctctga

SEQ ID NO: 7854490 - DNA, 22 bp, Homo sapiens
tattttaaagtgaagggtcttg

SEQ ID NO: 7854491 - DNA, 22 bp, Homo sapiens
tattttaaagtgaagggtcttg

SEQ ID NO: 7854492 - DNA, 22 bp, Homo sapiens
tattttaaagtgaagggtcttg

SEQ ID NO: 7854493 - DNA, 22 bp, Homo sapiens
tattttaaagtgaagggtcttg

SEQ ID NO: 7854494 - DNA, 22 bp, Homo sapiens
tattttacaaatgggaatgctg

SEQ ID NO: 7854495 - DNA, 22 bp, Homo sapiens
tattttaaagtgaagggtcttg

SEQ ID NO: 7854496 - DNA, 22 bp, Homo sapiens
tattttacagactactttagat

SEQ ID NO: 7854497 - DNA, 22 bp, Homo sapiens
tattttacagactactttagat

SEQ ID NO: 7854498 - DNA, 22 bp, Homo sapiens
tattttacagactactttagat

SEQ ID NO: 7854499 - DNA, 22 bp, Homo sapiens
tattttacagactactttagat

SEQ ID NO: 7854500 - DNA, 22 bp, Homo sapiens
tattttacagactactttagat

SEQ ID NO: 7854501 - DNA, 22 bp, Homo sapiens
tattttacagactactttagat

SEQ ID NO: 7854502 - DNA, 22 bp, Homo sapiens
tattttaaagactgccagccta

SEQ ID NO: 7854503 - DNA, 22 bp, Homo sapiens
tattttaaagactgccagccta

SEQ ID NO: 7854504 - DNA, 22 bp, Homo sapiens
tattttaaagactgccagccta

SEQ ID NO: 7854505 - DNA, 22 bp, Homo sapiens
tattttaaagactgccagccta

SEQ ID NO: 7854506 - DNA, 22 bp, Homo sapiens
cagtccaagagagataaaatgg

SEQ ID NO: 7854507 - DNA, 20 bp, Homo sapiens
tatttgaaatggccaagtgt

SEQ ID NO: 7854508 - DNA, 22 bp, Homo sapiens
tatttgaagattcttctgatgt

SEQ ID NO: 7854509 - DNA, 22 bp, Homo sapiens
tatttgaagattcttctgatgt

SEQ ID NO: 7854510 - DNA, 22 bp, Homo sapiens
cagtattttccttgttaactta

SEQ ID NO: 7854511 - DNA, 22 bp, Homo sapiens
cagtattttccttgttaactta

SEQ ID NO: 7854512 - DNA, 22 bp, Homo sapiens
cagtatttttaagctgctttgt

SEQ ID NO: 7854513 - DNA, 22 bp, Homo sapiens
cagtattttcaggatttggaag

SEQ ID NO: 7854514 - DNA, 22 bp, Homo sapiens
cagtattttcaggatttggaag

SEQ ID NO: 7854515 - DNA, 22 bp, Homo sapiens
cagtattttcaggatttggaag

SEQ ID NO: 7854516 - DNA, 22 bp, Homo sapiens
cagtatattctgcagagcctta

SEQ ID NO: 7854517 - DNA, 22 bp, Homo sapiens
cagtatattttagagaagtccc

SEQ ID NO: 7854518 - DNA, 22 bp, Homo sapiens
cagtatattttagagaagtccc

SEQ ID NO: 7854519 - DNA, 22 bp, Homo sapiens
cagtatctccacatgtaaagtg

SEQ ID NO: 7854520 - DNA, 21 bp, Homo sapiens
cagtattttaagcagtgagtt

SEQ ID NO: 7854521 - DNA, 22 bp, Homo sapiens
caggtgggtgtatgaatgcaaa

SEQ ID NO: 7854522 - DNA, 22 bp, Homo sapiens
caggtgggtgtatgaatgcaaa

SEQ ID NO: 7854523 - DNA, 22 bp, Homo sapiens
caggtgggtgtatgaatgcaaa

SEQ ID NO: 7854524 - DNA, 22 bp, Homo sapiens
caggtgggtgtatgaatgcaaa

SEQ ID NO: 7854525 - DNA, 22 bp, Homo sapiens
caggtggtacttaaagtcagaa

SEQ ID NO: 7854526 - DNA, 19 bp, Homo sapiens
caggtggtaatctgagcct

SEQ ID NO: 7854527 - DNA, 22 bp, Homo sapiens
cagtatatgctctttcatcaaa

SEQ ID NO: 7854528 - DNA, 22 bp, Homo sapiens
cagtatatgctctttcatcaaa

SEQ ID NO: 7854529 - DNA, 22 bp, Homo sapiens
cagtcacattgccctgcattta

SEQ ID NO: 7854530 - DNA, 22 bp, Homo sapiens
cagtcacattgccctgcattta

SEQ ID NO: 7854531 - DNA, 22 bp, Homo sapiens
cagtcacattgccctgcattta

SEQ ID NO: 7854532 - DNA, 22 bp, Homo sapiens
cagtcacattgccctgcattta

SEQ ID NO: 7854533 - DNA, 22 bp, Homo sapiens
cagtcacatggatgatggatag

SEQ ID NO: 7854534 - DNA, 22 bp, Homo sapiens
cagtcacatggatgatggatag

SEQ ID NO: 7854535 - DNA, 22 bp, Homo sapiens
cagtcacatggatgatggatag

SEQ ID NO: 7854536 - DNA, 22 bp, Homo sapiens
cagtcacatttcgacataacta

SEQ ID NO: 7854537 - DNA, 22 bp, Homo sapiens
cagtcaccaccaggtggcagta

SEQ ID NO: 7854538 - DNA, 22 bp, Homo sapiens
cagtcaccaccaggtggcagta

SEQ ID NO: 7854539 - DNA, 22 bp, Homo sapiens
cagtcaccttgaggactcagac

SEQ ID NO: 7854540 - DNA, 22 bp, Homo sapiens
cagtcactccagcctgcctcag

SEQ ID NO: 7854541 - DNA, 22 bp, Homo sapiens
cagtcactccagcctgcctcag

SEQ ID NO: 7854542 - DNA, 22 bp, Homo sapiens
cagtcactggaatagctgagga

SEQ ID NO: 7854543 - DNA, 22 bp, Homo sapiens
cagtcaccatagaataaaacat

SEQ ID NO: 7854544 - DNA, 22 bp, Homo sapiens
cagtcacctagacagaacttac

SEQ ID NO: 7854545 - DNA, 22 bp, Homo sapiens
cagtcacctgaagacttgacca

SEQ ID NO: 7854546 - DNA, 22 bp, Homo sapiens
cagtcacacaagtggacttggg

SEQ ID NO: 7854547 - DNA, 22 bp, Homo sapiens
cagtcacaagcgtacctaattt

SEQ ID NO: 7854548 - DNA, 17 bp, Homo sapiens
cagtcacaggtcttttc

SEQ ID NO: 7854549 - DNA, 22 bp, Homo sapiens
cagtcacacaagtggacttggg

SEQ ID NO: 7854550 - DNA, 22 bp, Homo sapiens
cagtcaaacttataggcacatt

SEQ ID NO: 7854551 - DNA, 22 bp, Homo sapiens
cagtcacaagcgtacctaattt

SEQ ID NO: 7854552 - DNA, 22 bp, Homo sapiens
cagtcaacagagagcccgtcag

SEQ ID NO: 7854553 - DNA, 22 bp, Homo sapiens
cagtcaaacttataggcacatt

SEQ ID NO: 7854554 - DNA, 22 bp, Homo sapiens
cagtcacataggtatacacata

SEQ ID NO: 7854555 - DNA, 22 bp, Homo sapiens
cagtcacataggtatacacata

SEQ ID NO: 7854556 - DNA, 22 bp, Homo sapiens
cagtcacataggtatacacata

SEQ ID NO: 7854557 - DNA, 22 bp, Homo sapiens
cagtcacagtgacaggatgtgg

SEQ ID NO: 7854558 - DNA, 22 bp, Homo sapiens
tcaacaaatacttaaagcagag

SEQ ID NO: 7854559 - DNA, 22 bp, Homo sapiens
tcaacaaatacttaaagcagag

SEQ ID NO: 7854560 - DNA, 22 bp, Homo sapiens
tcaacaaatacttaaagcagag

SEQ ID NO: 7854561 - DNA, 22 bp, Homo sapiens
tcaaaacactattacctttaat

SEQ ID NO: 7854562 - DNA, 22 bp, Homo sapiens
tcaaaacactattacctttaat

SEQ ID NO: 7854563 - DNA, 22 bp, Homo sapiens
tcaaaacactattacctttaat

SEQ ID NO: 7854564 - DNA, 22 bp, Homo sapiens
tcaagatgaaccaggacattca

SEQ ID NO: 7854565 - DNA, 20 bp, Homo sapiens
tcaagatgaggtcatactgg

SEQ ID NO: 7854566 - DNA, 22 bp, Homo sapiens
tcaagatgaaccaggacattca

SEQ ID NO: 7854567 - DNA, 22 bp, Homo sapiens
tcaacaaatacttaaagcagag

SEQ ID NO: 7854568 - DNA, 20 bp, Homo sapiens
tcaagatgaggtcatactgg

SEQ ID NO: 7854569 - DNA, 22 bp, Homo sapiens
tcaagatgattgcttcaggccc

SEQ ID NO: 7854570 - DNA, 22 bp, Homo sapiens
tcaagatgcatgggtggcataa

SEQ ID NO: 7854571 - DNA, 22 bp, Homo sapiens
tcaagatgcatgggtggcataa

SEQ ID NO: 7854572 - DNA, 19 bp, Homo sapiens
tcaagatggatggctccca

SEQ ID NO: 7854573 - DNA, 22 bp, Homo sapiens
tcaagatgtccagtgcctataa

SEQ ID NO: 7854574 - DNA, 19 bp, Homo sapiens
tcaagatggatggctccca

SEQ ID NO: 7854575 - DNA, 19 bp, Homo sapiens
tcaagatggatggctccca

SEQ ID NO: 7854576 - DNA, 22 bp, Homo sapiens
tcaagcaactgaattctaaaag

SEQ ID NO: 7854577 - DNA, 22 bp, Homo sapiens
tcaagcaactgaattctaaaag

SEQ ID NO: 7854578 - DNA, 22 bp, Homo sapiens
tcaagcaacagaactgtgagac

SEQ ID NO: 7854579 - DNA, 22 bp, Homo sapiens
tcaagcaagtgtttggtgtaaa

SEQ ID NO: 7854580 - DNA, 22 bp, Homo sapiens
tcaagcaagtgtttggtgtaaa

SEQ ID NO: 7854581 - DNA, 22 bp, Homo sapiens
tcaagcaagttgcatattgcta

SEQ ID NO: 7854582 - DNA, 22 bp, Homo sapiens
tcaagcaagttgcatattgcta

SEQ ID NO: 7854583 - DNA, 22 bp, Homo sapiens
tcaagatgtccagtgcctataa

SEQ ID NO: 7854584 - DNA, 22 bp, Homo sapiens
tcaagatgtccagtgcctataa

SEQ ID NO: 7854585 - DNA, 22 bp, Homo sapiens
tcaagatgtgatgtaacttttg

SEQ ID NO: 7854586 - DNA, 22 bp, Homo sapiens
tcaagcaaactctgagaaataa

SEQ ID NO: 7854587 - DNA, 22 bp, Homo sapiens
tcaagcaaagatacaaatggaa

SEQ ID NO: 7854588 - DNA, 22 bp, Homo sapiens
tcaagcaaatgtccttttgttc

SEQ ID NO: 7854589 - DNA, 22 bp, Homo sapiens
tcaagcaaagtttagctggtta

SEQ ID NO: 7854590 - DNA, 22 bp, Homo sapiens
tcaagcaaagtttagctggtta

SEQ ID NO: 7854591 - DNA, 22 bp, Homo sapiens
tcaagcaaagatacaaatggaa

SEQ ID NO: 7854592 - DNA, 23 bp, Homo sapiens
tcaagcaataattggtaatagtg

SEQ ID NO: 7854593 - DNA, 22 bp, Homo sapiens
tcaagcaattctcctgcctcag

SEQ ID NO: 7854594 - DNA, 22 bp, Homo sapiens
tcaagcaatctctgtgtccctg

SEQ ID NO: 7854595 - DNA, 23 bp, Homo sapiens
tcaagcaataattggtaatagtg

SEQ ID NO: 7854596 - DNA, 23 bp, Homo sapiens
tcaagcaattctcctgcctcggc

SEQ ID NO: 7854597 - DNA, 22 bp, Homo sapiens
tcaagcagagtcaaaagtacca

SEQ ID NO: 7854598 - DNA, 22 bp, Homo sapiens
tcaagcagagtcaaaagtacca

SEQ ID NO: 7854599 - DNA, 22 bp, Homo sapiens
tcaagcagcttttacagaagag

SEQ ID NO: 7854600 - DNA, 22 bp, Homo sapiens
tcaagcagcttttacagaagag

SEQ ID NO: 7854601 - DNA, 22 bp, Homo sapiens
tcaagcagcagatcaagagcta

SEQ ID NO: 7854602 - DNA, 19 bp, Homo sapiens
tcaagcagtctgatttagg

SEQ ID NO: 7854603 - DNA, 22 bp, Homo sapiens
tcaagcagggtagcaagctggt

SEQ ID NO: 7854604 - DNA, 22 bp, Homo sapiens
tcaagcagggtagcaagctggt

SEQ ID NO: 7854605 - DNA, 22 bp, Homo sapiens
tcaatagagccttctttcaggt

SEQ ID NO: 7854606 - DNA, 22 bp, Homo sapiens
tcaatagagccttctttcaggt

SEQ ID NO: 7854607 - DNA, 22 bp, Homo sapiens
tcaatagataaagctacataaa

SEQ ID NO: 7854608 - DNA, 22 bp, Homo sapiens
tcaatagattaggtattagatt

SEQ ID NO: 7854609 - DNA, 22 bp, Homo sapiens
tcaagcggactgagatactctg

SEQ ID NO: 7854610 - DNA, 22 bp, Homo sapiens
tcaagcggactgagatactctg

SEQ ID NO: 7854611 - DNA, 22 bp, Homo sapiens
tcaagccatcaggcagcgggtt

SEQ ID NO: 7854612 - DNA, 22 bp, Homo sapiens
tcaagccatcaggcagcgggtt

SEQ ID NO: 7854613 - DNA, 22 bp, Homo sapiens
tcaagccactggcagaagatta

SEQ ID NO: 7854614 - DNA, 22 bp, Homo sapiens
tcaagccactggcagaagatta

SEQ ID NO: 7854615 - DNA, 22 bp, Homo sapiens
tcaagcatcttggtctacgatc

SEQ ID NO: 7854616 - DNA, 19 bp, Homo sapiens
tcaaaacacaaatggttga

SEQ ID NO: 7854617 - DNA, 22 bp, Homo sapiens
tcaaaacactattacctttaat

SEQ ID NO: 7854618 - DNA, 22 bp, Homo sapiens
tcaaaacactattacctttaat

SEQ ID NO: 7854619 - DNA, 19 bp, Homo sapiens
tcaaaacacaaatggttga

SEQ ID NO: 7854620 - DNA, 19 bp, Homo sapiens
tcaaaacacaaatggttga

SEQ ID NO: 7854621 - DNA, 19 bp, Homo sapiens
tcaaaacacaaatggttga

SEQ ID NO: 7854622 - DNA, 19 bp, Homo sapiens
tcaaaacacaaatggttga

SEQ ID NO: 7854623 - DNA, 19 bp, Homo sapiens
tcaaaacacaaatggttga

SEQ ID NO: 7854624 - DNA, 19 bp, Homo sapiens
tcaaaacacaaatggttga

SEQ ID NO: 7854625 - DNA, 19 bp, Homo sapiens
tcaaaacacaaatggttga

SEQ ID NO: 7854626 - DNA, 19 bp, Homo sapiens
tcaaaacacaaatggttga

SEQ ID NO: 7854627 - DNA, 22 bp, Homo sapiens
tcaaaacaatcattggatgtgc

SEQ ID NO: 7854628 - DNA, 22 bp, Homo sapiens
tcaaaacaatcattggatgtgc

SEQ ID NO: 7854629 - DNA, 22 bp, Homo sapiens
tcaaaacaatcattggatgtgc

SEQ ID NO: 7854630 - DNA, 22 bp, Homo sapiens
tcaaaacaatcattggatgtgc

SEQ ID NO: 7854631 - DNA, 22 bp, Homo sapiens
tcaaaacaacactcaggtgtaa

SEQ ID NO: 7854632 - DNA, 22 bp, Homo sapiens
tcaaaacaacactcaggtgtaa

SEQ ID NO: 7854633 - DNA, 22 bp, Homo sapiens
tcaaaacaacactcaggtgtaa

SEQ ID NO: 7854634 - DNA, 22 bp, Homo sapiens
tcaaaaattttctgaggatgag

SEQ ID NO: 7854635 - DNA, 22 bp, Homo sapiens
tcaaaaattttctgaggatgag

SEQ ID NO: 7854636 - DNA, 22 bp, Homo sapiens
tcaaaaattttctgaggatgag

SEQ ID NO: 7854637 - DNA, 22 bp, Homo sapiens
tcaaaaattttctgaggatgag

SEQ ID NO: 7854638 - DNA, 22 bp, Homo sapiens
tcaaaaattttctgaggatgag

SEQ ID NO: 7854639 - DNA, 22 bp, Homo sapiens
tattttactttaaagcgagaga

SEQ ID NO: 7854640 - DNA, 22 bp, Homo sapiens
tattttaggtaatatccattgt

SEQ ID NO: 7854641 - DNA, 22 bp, Homo sapiens
tattttaggtaatatccattgt

SEQ ID NO: 7854642 - DNA, 22 bp, Homo sapiens
tattttaggtaatatccattgt

SEQ ID NO: 7854643 - DNA, 22 bp, Homo sapiens
tattttacatgatccagagttg

SEQ ID NO: 7854644 - DNA, 22 bp, Homo sapiens
tattttacatgacaggtgttta

SEQ ID NO: 7854645 - DNA, 22 bp, Homo sapiens
tattttacatgacaggtgttta

SEQ ID NO: 7854646 - DNA, 22 bp, Homo sapiens
tattttactatttggcaaagtc

SEQ ID NO: 7854647 - DNA, 22 bp, Homo sapiens
tattttactttaaagcgagaga

SEQ ID NO: 7854648 - DNA, 22 bp, Homo sapiens
tcaaaaatgttttatattggta

SEQ ID NO: 7854649 - DNA, 22 bp, Homo sapiens
tcaaaaatgttttatattggta

SEQ ID NO: 7854650 - DNA, 22 bp, Homo sapiens
tcaaaaatgttttatattggta

SEQ ID NO: 7854651 - DNA, 22 bp, Homo sapiens
tcaaaaatgttttatattggta

SEQ ID NO: 7854652 - DNA, 22 bp, Homo sapiens
tcaaaaattttctgaggatgag

SEQ ID NO: 7854653 - DNA, 22 bp, Homo sapiens
tcaaaaatgttttatattggta

SEQ ID NO: 7854654 - DNA, 22 bp, Homo sapiens
tattttcaccatgtatccctgt

SEQ ID NO: 7854655 - DNA, 22 bp, Homo sapiens
tattttatctgccagagtggag

SEQ ID NO: 7854656 - DNA, 22 bp, Homo sapiens
tattttatctgccagagtggag

SEQ ID NO: 7854657 - DNA, 22 bp, Homo sapiens
tattttatctgccagagtggag

SEQ ID NO: 7854658 - DNA, 22 bp, Homo sapiens
caggtaggcagccggtctctgg

SEQ ID NO: 7854659 - DNA, 22 bp, Homo sapiens
caggtagggatatgatggtgat

SEQ ID NO: 7854660 - DNA, 22 bp, Homo sapiens
caggtagggatatgatggtgat

SEQ ID NO: 7854661 - DNA, 22 bp, Homo sapiens
caggtagggatatgatggtgat

SEQ ID NO: 7854662 - DNA, 22 bp, Homo sapiens
caggtagggatatgatggtgat

SEQ ID NO: 7854663 - DNA, 22 bp, Homo sapiens
caggtatgaggacactgacagc

SEQ ID NO: 7854664 - DNA, 22 bp, Homo sapiens
caggtatgaggacactgacagc

SEQ ID NO: 7854665 - DNA, 22 bp, Homo sapiens
caggtatgaggacactgacagc

SEQ ID NO: 7854666 - DNA, 22 bp, Homo sapiens
caggtatatgtgcatccataga

SEQ ID NO: 7854667 - DNA, 22 bp, Homo sapiens
caggtagtccagctctgggacc

SEQ ID NO: 7854668 - DNA, 22 bp, Homo sapiens
caggtagtccacagtgagggag

SEQ ID NO: 7854669 - DNA, 22 bp, Homo sapiens
caggtaggtatggtgcagtctt

SEQ ID NO: 7854670 - DNA, 22 bp, Homo sapiens
caggtcagaggtagatgagatg

SEQ ID NO: 7854671 - DNA, 22 bp, Homo sapiens
caggtcagaggtagatgagatg

SEQ ID NO: 7854672 - DNA, 22 bp, Homo sapiens
caggtcagaggtagatgagatg

SEQ ID NO: 7854673 - DNA, 22 bp, Homo sapiens
caggtcagagtccccctgtcct

SEQ ID NO: 7854674 - DNA, 22 bp, Homo sapiens
caggtcagaggtagatgagatg

SEQ ID NO: 7854675 - DNA, 22 bp, Homo sapiens
caggtcagaggtagatgagatg

SEQ ID NO: 7854676 - DNA, 22 bp, Homo sapiens
caggtcagaggtagatgagatg

SEQ ID NO: 7854677 - DNA, 22 bp, Homo sapiens
caggtcagaggcgcagccccca

SEQ ID NO: 7854678 - DNA, 23 bp, Homo sapiens
caggtattgatttttcttctagg

SEQ ID NO: 7854679 - DNA, 22 bp, Homo sapiens
caggtacaaagctactgcctga

SEQ ID NO: 7854680 - DNA, 22 bp, Homo sapiens
caggtaaggtcacattctgaag

SEQ ID NO: 7854681 - DNA, 22 bp, Homo sapiens
caggtaaggtcacattctgaag

SEQ ID NO: 7854682 - DNA, 22 bp, Homo sapiens
caggtaaggtcacattctgaag

SEQ ID NO: 7854683 - DNA, 22 bp, Homo sapiens
caggtaaagcttcaaatcactt

SEQ ID NO: 7854684 - DNA, 22 bp, Homo sapiens
caggtaaaggttaactattaga

SEQ ID NO: 7854685 - DNA, 22 bp, Homo sapiens
cagggtttctgttgagaagtcc

SEQ ID NO: 7854686 - DNA, 22 bp, Homo sapiens
cagggtttcaccatgttagcag

SEQ ID NO: 7854687 - DNA, 22 bp, Homo sapiens
cagggtggggctggctatcaaa

SEQ ID NO: 7854688 - DNA, 22 bp, Homo sapiens
cagggtggggctggctatcaaa

SEQ ID NO: 7854689 - DNA, 22 bp, Homo sapiens
caggtaggcagccggtctctgg

SEQ ID NO: 7854690 - DNA, 22 bp, Homo sapiens
caggtaggatggaagggctcaa

SEQ ID NO: 7854691 - DNA, 22 bp, Homo sapiens
caggtaggatggaagggctcaa

SEQ ID NO: 7854692 - DNA, 22 bp, Homo sapiens
caggtaggatggaagggctcaa

SEQ ID NO: 7854693 - DNA, 22 bp, Homo sapiens
caggtaggaaaagggtgtcagg

SEQ ID NO: 7854694 - DNA, 22 bp, Homo sapiens
caggtagcttttgatattaggg

SEQ ID NO: 7854695 - DNA, 22 bp, Homo sapiens
caggtaggaaaagggtgtcagg

SEQ ID NO: 7854696 - DNA, 22 bp, Homo sapiens
caggtaggatggaagggctcaa

SEQ ID NO: 7854697 - DNA, 22 bp, Homo sapiens
caggtacattcgtagacccatt

SEQ ID NO: 7854698 - DNA, 17 bp, Homo sapiens
caggtacattgctactg

SEQ ID NO: 7854699 - DNA, 22 bp, Homo sapiens
caggtacattcgtagacccatt

SEQ ID NO: 7854700 - DNA, 22 bp, Homo sapiens
caggtacccaggctctttccaa

SEQ ID NO: 7854701 - DNA, 22 bp, Homo sapiens
caggtagctgctggccatgtac

SEQ ID NO: 7854702 - DNA, 22 bp, Homo sapiens
caggtagctgcagagactattt

SEQ ID NO: 7854703 - DNA, 22 bp, Homo sapiens
caggtagctgctggccatgtac

SEQ ID NO: 7854704 - DNA, 22 bp, Homo sapiens
caggtagcttttgatattaggg

SEQ ID NO: 7854705 - DNA, 22 bp, Homo sapiens
caggtcagcacttggaggtgca

SEQ ID NO: 7854706 - DNA, 22 bp, Homo sapiens
caggtcagagtccccctgtcct

SEQ ID NO: 7854707 - DNA, 22 bp, Homo sapiens
caggtcagagtccccctgtcct

SEQ ID NO: 7854708 - DNA, 22 bp, Homo sapiens
caggtcagcacttggaggtgca

SEQ ID NO: 7854709 - DNA, 22 bp, Homo sapiens
caggtcagcacttggaggtgca

SEQ ID NO: 7854710 - DNA, 18 bp, Homo sapiens
caggtcagcctggcctca

SEQ ID NO: 7854711 - DNA, 18 bp, Homo sapiens
caggtcagcctggcctca

SEQ ID NO: 7854712 - DNA, 18 bp, Homo sapiens
caggtcagcctggcctca

SEQ ID NO: 7854713 - DNA, 18 bp, Homo sapiens
caggtcagcctggcctca

SEQ ID NO: 7854714 - DNA, 22 bp, Homo sapiens
caggtcagctggtgccccaggt

SEQ ID NO: 7854715 - DNA, 22 bp, Homo sapiens
caggtcagctggtgccccaggt

SEQ ID NO: 7854716 - DNA, 22 bp, Homo sapiens
caggtcagctggtgccccaggt

SEQ ID NO: 7854717 - DNA, 22 bp, Homo sapiens
caggtcagctggtgccccaggt

SEQ ID NO: 7854718 - DNA, 22 bp, Homo sapiens
caggtccaactatttatctgtg

SEQ ID NO: 7854719 - DNA, 22 bp, Homo sapiens
caggtccaactatttatctgtg

SEQ ID NO: 7854720 - DNA, 22 bp, Homo sapiens
caggtccaactatttatctgtg

SEQ ID NO: 7854721 - DNA, 22 bp, Homo sapiens
caggtccaagagatcctcctac

SEQ ID NO: 7854722 - DNA, 22 bp, Homo sapiens
caggtgaagaggataaaaagtt

SEQ ID NO: 7854723 - DNA, 22 bp, Homo sapiens
caggtgaatcacttgagtccag

SEQ ID NO: 7854724 - DNA, 22 bp, Homo sapiens
caggtgcccagctcctgctgtg

SEQ ID NO: 7854725 - DNA, 22 bp, Homo sapiens
caggtccacagcccatcactgc

SEQ ID NO: 7854726 - DNA, 22 bp, Homo sapiens
caggtccacagcccatcactgc

SEQ ID NO: 7854727 - DNA, 22 bp, Homo sapiens
caggtccacagcccatcactgc

SEQ ID NO: 7854728 - DNA, 22 bp, Homo sapiens
caggtccacagcccatcactgc

SEQ ID NO: 7854729 - DNA, 22 bp, Homo sapiens
caggtccaagagatcctcctac

SEQ ID NO: 7854730 - DNA, 22 bp, Homo sapiens
caggtccaagagatcctcctac

SEQ ID NO: 7854731 - DNA, 22 bp, Homo sapiens
caggtccaattgcgctaaaatc

SEQ ID NO: 7854732 - DNA, 22 bp, Homo sapiens
caggtccaattgcgctaaaatc

SEQ ID NO: 7854733 - DNA, 22 bp, Homo sapiens
caggtgctgcgtggcggagctg

SEQ ID NO: 7854734 - DNA, 22 bp, Homo sapiens
caggtgctgcagggctggcgtc

SEQ ID NO: 7854735 - DNA, 22 bp, Homo sapiens
caggtgctgtcctgcacatgtc

SEQ ID NO: 7854736 - DNA, 22 bp, Homo sapiens
caggtgctgtcctgcacatgtc

SEQ ID NO: 7854737 - DNA, 22 bp, Homo sapiens
caggtgctgcagggctggcgtc

SEQ ID NO: 7854738 - DNA, 22 bp, Homo sapiens
caggtgctgcgtggcggagctg

SEQ ID NO: 7854739 - DNA, 22 bp, Homo sapiens
caggtgctgcgtggcggagctg

SEQ ID NO: 7854740 - DNA, 22 bp, Homo sapiens
caggtgctgcagggctggcgtc

SEQ ID NO: 7854741 - DNA, 22 bp, Homo sapiens
caggtgctctgctgcaggtaag

SEQ ID NO: 7854742 - DNA, 22 bp, Homo sapiens
caggtgctctgctgcaggtaag

SEQ ID NO: 7854743 - DNA, 22 bp, Homo sapiens
caggtgctcccagagaagtgct

SEQ ID NO: 7854744 - DNA, 22 bp, Homo sapiens
caggtgcctcaggatgagacaa

SEQ ID NO: 7854745 - DNA, 22 bp, Homo sapiens
caggtgccgggaatgcagcaat

SEQ ID NO: 7854746 - DNA, 22 bp, Homo sapiens
caggtgccgggaatgcagcaat

SEQ ID NO: 7854747 - DNA, 22 bp, Homo sapiens
caggtgcctcaggatgagacaa

SEQ ID NO: 7854748 - DNA, 22 bp, Homo sapiens
caggtgctcccagagaagtgct

SEQ ID NO: 7854749 - DNA, 22 bp, Homo sapiens
caggtgccgggaatgcagcaat

SEQ ID NO: 7854750 - DNA, 22 bp, Homo sapiens
caggtgcccaggggacagtggc

SEQ ID NO: 7854751 - DNA, 22 bp, Homo sapiens
caggtgcccaggggacagtggc

SEQ ID NO: 7854752 - DNA, 22 bp, Homo sapiens
caggtgcccagctcctgctgtg

SEQ ID NO: 7854753 - DNA, 20 bp, Homo sapiens
tattaggtagcactgggata

SEQ ID NO: 7854754 - DNA, 22 bp, Homo sapiens
tattaaatgttatttgggttgt

SEQ ID NO: 7854755 - DNA, 22 bp, Homo sapiens
caggtggctgagctgacctttg

SEQ ID NO: 7854756 - DNA, 22 bp, Homo sapiens
caggtggctgagctgacctttg

SEQ ID NO: 7854757 - DNA, 22 bp, Homo sapiens
tattaaatgttatttgggttgt

SEQ ID NO: 7854758 - DNA, 22 bp, Homo sapiens
tattaggttggtgcaacagtaa

SEQ ID NO: 7854759 - DNA, 22 bp, Homo sapiens
tattaggttggtgcaaaattaa

SEQ ID NO: 7854760 - DNA, 22 bp, Homo sapiens
tattaggttggtgcaaaagtca

SEQ ID NO: 7854761 - DNA, 22 bp, Homo sapiens
tattaggttgttgcaaaagtaa

SEQ ID NO: 7854762 - DNA, 22 bp, Homo sapiens
tattaggttggtgcaacagtaa

SEQ ID NO: 7854763 - DNA, 22 bp, Homo sapiens
tattagtaatacctgtctcata

SEQ ID NO: 7854764 - DNA, 22 bp, Homo sapiens
tattagtaatacctgtctcata

SEQ ID NO: 7854765 - DNA, 22 bp, Homo sapiens
tattagtaaattccatgggagt

SEQ ID NO: 7854766 - DNA, 22 bp, Homo sapiens
tattagtagcttgaaattggtg

SEQ ID NO: 7854767 - DNA, 22 bp, Homo sapiens
tattaggttggtgcaaaaagta

SEQ ID NO: 7854768 - DNA, 22 bp, Homo sapiens
tattaggttggtgcaaaagtaa

SEQ ID NO: 7854769 - DNA, 22 bp, Homo sapiens
tattaggttggtgcaaaattaa

SEQ ID NO: 7854770 - DNA, 22 bp, Homo sapiens
tattaggttagtgcaaaagttt

SEQ ID NO: 7854771 - DNA, 22 bp, Homo sapiens
tattaggtgtaccttgttaaac

SEQ ID NO: 7854772 - DNA, 22 bp, Homo sapiens
tattaggtgtgtttataagacc

SEQ ID NO: 7854773 - DNA, 22 bp, Homo sapiens
tattaggtatgaactggcaacc

SEQ ID NO: 7854774 - DNA, 22 bp, Homo sapiens
tattaggtatgaactggcaacc

SEQ ID NO: 7854775 - DNA, 23 bp, Homo sapiens
caggtggctccacgaggggtggg

SEQ ID NO: 7854776 - DNA, 23 bp, Homo sapiens
caggtggctccacgaggggtggg

SEQ ID NO: 7854777 - DNA, 22 bp, Homo sapiens
caggtggctaacggcctcatag

SEQ ID NO: 7854778 - DNA, 22 bp, Homo sapiens
caggtggctaacggcctcatag

SEQ ID NO: 7854779 - DNA, 23 bp, Homo sapiens
caggtggctccacgaggggtggg

SEQ ID NO: 7854780 - DNA, 23 bp, Homo sapiens
caggtggctccacgaggggtggg

SEQ ID NO: 7854781 - DNA, 19 bp, Homo sapiens
caggtggcgctctacaggg

SEQ ID NO: 7854782 - DNA, 19 bp, Homo sapiens
caggtggcgctctacaggg

SEQ ID NO: 7854783 - DNA, 22 bp, Homo sapiens
caggtggctaacggcctcatag

SEQ ID NO: 7854784 - DNA, 22 bp, Homo sapiens
caggtggctaacggcctcatag

SEQ ID NO: 7854785 - DNA, 19 bp, Homo sapiens
caggtggcgctctacaggg

SEQ ID NO: 7854786 - DNA, 19 bp, Homo sapiens
caggtggcgctctacaggg

SEQ ID NO: 7854787 - DNA, 22 bp, Homo sapiens
caggtggccttgccatctcctg

SEQ ID NO: 7854788 - DNA, 19 bp, Homo sapiens
caggtggcgctctacaggg

SEQ ID NO: 7854789 - DNA, 22 bp, Homo sapiens
caggtggagctgactgagggca

SEQ ID NO: 7854790 - DNA, 22 bp, Homo sapiens
caggtggagctgactgagggca

SEQ ID NO: 7854791 - DNA, 22 bp, Homo sapiens
caggtggatctctaaggactga

SEQ ID NO: 7854792 - DNA, 22 bp, Homo sapiens
caggtggatctctaaggactga

SEQ ID NO: 7854793 - DNA, 22 bp, Homo sapiens
caggtggcaaatgagtagcatt

SEQ ID NO: 7854794 - DNA, 22 bp, Homo sapiens
caggtggcaaatgagtagcatt

SEQ ID NO: 7854795 - DNA, 22 bp, Homo sapiens
caggtggcagtgcctgcattct

SEQ ID NO: 7854796 - DNA, 22 bp, Homo sapiens
caggtggcagtgcctgcattct

SEQ ID NO: 7854797 - DNA, 22 bp, Homo sapiens
caggtggcagaggtctctggaa

SEQ ID NO: 7854798 - DNA, 22 bp, Homo sapiens
caggtggcagaggtctctggaa

SEQ ID NO: 7854799 - DNA, 22 bp, Homo sapiens
caggtggcagtgcctgcattct

SEQ ID NO: 7854800 - DNA, 22 bp, Homo sapiens
caggtggcagaggtctctggaa

SEQ ID NO: 7854801 - DNA, 22 bp, Homo sapiens
caggtggcagaggtctctggaa

SEQ ID NO: 7854802 - DNA, 22 bp, Homo sapiens
caggtggcagaggtctctggaa

SEQ ID NO: 7854803 - DNA, 22 bp, Homo sapiens
caggtggcaaatgagtagcatt

SEQ ID NO: 7854804 - DNA, 22 bp, Homo sapiens
caggtggcagaggtctctggaa

SEQ ID NO: 7854805 - DNA, 22 bp, Homo sapiens
caggtggccagtactcaaggat

SEQ ID NO: 7854806 - DNA, 22 bp, Homo sapiens
caggtggccagtactcaaggat

SEQ ID NO: 7854807 - DNA, 22 bp, Homo sapiens
caggtggccagtactcaaggat

SEQ ID NO: 7854808 - DNA, 22 bp, Homo sapiens
caggtggccagtactcaaggat

SEQ ID NO: 7854809 - DNA, 22 bp, Homo sapiens
caggtggccttgccatctcctg

SEQ ID NO: 7854810 - DNA, 22 bp, Homo sapiens
caggtggccttgccatctcctg

SEQ ID NO: 7854811 - DNA, 22 bp, Homo sapiens
caggtggccttgccatctcctg

SEQ ID NO: 7854812 - DNA, 22 bp, Homo sapiens
caggtggcatgactgcctacaa

SEQ ID NO: 7854813 - DNA, 22 bp, Homo sapiens
caggtggcatgactgcctacaa

SEQ ID NO: 7854814 - DNA, 22 bp, Homo sapiens
caggtggcatgactgcctacaa

SEQ ID NO: 7854815 - DNA, 22 bp, Homo sapiens
caggtggcattgtcccgccagc

SEQ ID NO: 7854816 - DNA, 22 bp, Homo sapiens
caggtggcattgtcccgccagc

SEQ ID NO: 7854817 - DNA, 22 bp, Homo sapiens
caggtggcattgtcccgccagc

SEQ ID NO: 7854818 - DNA, 22 bp, Homo sapiens
caggtggcatgactgcctacaa

SEQ ID NO: 7854819 - DNA, 22 bp, Homo sapiens
tattatggggggaacatcactc

SEQ ID NO: 7854820 - DNA, 22 bp, Homo sapiens
tattatggcagcattcagtatg

SEQ ID NO: 7854821 - DNA, 22 bp, Homo sapiens
tattatggggggaacatcactc

SEQ ID NO: 7854822 - DNA, 22 bp, Homo sapiens
tattatggttgtaggttaacaa

SEQ ID NO: 7854823 - DNA, 22 bp, Homo sapiens
tattattaaatggcagaatttt

SEQ ID NO: 7854824 - DNA, 22 bp, Homo sapiens
tattatgtaaaggttattgcag

SEQ ID NO: 7854825 - DNA, 22 bp, Homo sapiens
tattatggggggaacatcactc

SEQ ID NO: 7854826 - DNA, 22 bp, Homo sapiens
tattattaaatggcagaatttt

SEQ ID NO: 7854827 - DNA, 22 bp, Homo sapiens
tattattaaatggcagaatttt

SEQ ID NO: 7854828 - DNA, 22 bp, Homo sapiens
tattattaaatggcagaatttt

SEQ ID NO: 7854829 - DNA, 22 bp, Homo sapiens
tattattaaatggcagaatttt

SEQ ID NO: 7854830 - DNA, 22 bp, Homo sapiens
caggtgggtacatcacagagac

SEQ ID NO: 7854831 - DNA, 22 bp, Homo sapiens
caggtgggtacatcacagagac

SEQ ID NO: 7854832 - DNA, 22 bp, Homo sapiens
caggtgggtacatcacagagac

SEQ ID NO: 7854833 - DNA, 22 bp, Homo sapiens
caggtgggtacatcacagagac

SEQ ID NO: 7854834 - DNA, 22 bp, Homo sapiens
caggtgggtacatcacagagac

SEQ ID NO: 7854835 - DNA, 22 bp, Homo sapiens
caggtgggtacatcacagagac

SEQ ID NO: 7854836 - DNA, 22 bp, Homo sapiens
caggtgggtacatcacagagac

SEQ ID NO: 7854837 - DNA, 18 bp, Homo sapiens
caggtgggtctcctgccc

SEQ ID NO: 7854838 - DNA, 18 bp, Homo sapiens
caggtgggtctcctgccc

SEQ ID NO: 7854839 - DNA, 18 bp, Homo sapiens
caggtgggtctcctgccc

SEQ ID NO: 7854840 - DNA, 18 bp, Homo sapiens
caggtgggtctcctgccc

SEQ ID NO: 7854841 - DNA, 18 bp, Homo sapiens
caggtgggtctcctgccc

SEQ ID NO: 7854842 - DNA, 18 bp, Homo sapiens
caggtgggtctcctgccc

SEQ ID NO: 7854843 - DNA, 18 bp, Homo sapiens
caggtgggtctcctgccc

SEQ ID NO: 7854844 - DNA, 22 bp, Homo sapiens
tattatcattaactgttgaatt

SEQ ID NO: 7854845 - DNA, 22 bp, Homo sapiens
tattataatttagggcttggat

SEQ ID NO: 7854846 - DNA, 22 bp, Homo sapiens
tattataatttagggcttggat

SEQ ID NO: 7854847 - DNA, 22 bp, Homo sapiens
tattatatttagtaatgtggag

SEQ ID NO: 7854848 - DNA, 22 bp, Homo sapiens
tattatatttagtaatgtggag

SEQ ID NO: 7854849 - DNA, 22 bp, Homo sapiens
tattatatttagtaatgtggag

SEQ ID NO: 7854850 - DNA, 22 bp, Homo sapiens
tattagtgaaagaattagtttg

SEQ ID NO: 7854851 - DNA, 22 bp, Homo sapiens
tattataaaattactggcaggg

SEQ ID NO: 7854852 - DNA, 20 bp, Homo sapiens
tattatgacctgtgttctgg

SEQ ID NO: 7854853 - DNA, 22 bp, Homo sapiens
cagggagcaggctctgtccatc

SEQ ID NO: 7854854 - DNA, 22 bp, Homo sapiens
cagggagcaggctctgtccatc

SEQ ID NO: 7854855 - DNA, 22 bp, Homo sapiens
cagggagcaggctctgtccatc

SEQ ID NO: 7854856 - DNA, 22 bp, Homo sapiens
cagggagcaggctctgtccatc

SEQ ID NO: 7854857 - DNA, 22 bp, Homo sapiens
cagggagcaggctctgtccatc

SEQ ID NO: 7854858 - DNA, 22 bp, Homo sapiens
cagggagcaggctctgtccatc

SEQ ID NO: 7854859 - DNA, 22 bp, Homo sapiens
cagggagcagcgctggggcctc

SEQ ID NO: 7854860 - DNA, 22 bp, Homo sapiens
cagggagcagcgctggggcctc

SEQ ID NO: 7854861 - DNA, 22 bp, Homo sapiens
cagggagcagcgctggggcctc

SEQ ID NO: 7854862 - DNA, 22 bp, Homo sapiens
cagggagcagcgctggggcctc

SEQ ID NO: 7854863 - DNA, 22 bp, Homo sapiens
cagggagcagcgctggggcctc

SEQ ID NO: 7854864 - DNA, 22 bp, Homo sapiens
cagggagcagcgctggggcctc

SEQ ID NO: 7854865 - DNA, 22 bp, Homo sapiens
cagggagcagcccctagaagta

SEQ ID NO: 7854866 - DNA, 22 bp, Homo sapiens
cagggagcagcccctagaagta

SEQ ID NO: 7854867 - DNA, 22 bp, Homo sapiens
cagggagcagcccctagaagta

SEQ ID NO: 7854868 - DNA, 22 bp, Homo sapiens
cagggagcagcccctagaagta

SEQ ID NO: 7854869 - DNA, 22 bp, Homo sapiens
cagggagcagcccctagaagta

SEQ ID NO: 7854870 - DNA, 22 bp, Homo sapiens
cagggagcagcccctagaagta

SEQ ID NO: 7854871 - DNA, 22 bp, Homo sapiens
cagggagcactgcgagcggcag

SEQ ID NO: 7854872 - DNA, 22 bp, Homo sapiens
cagggagcactgcgagcggcag

SEQ ID NO: 7854873 - DNA, 22 bp, Homo sapiens
cagggagcactgcgagcggcag

SEQ ID NO: 7854874 - DNA, 22 bp, Homo sapiens
cagggagatcttggctcctggt

SEQ ID NO: 7854875 - DNA, 22 bp, Homo sapiens
cagggagcactgcgagcggcag

SEQ ID NO: 7854876 - DNA, 22 bp, Homo sapiens
cagggagatcttggctcctggt

SEQ ID NO: 7854877 - DNA, 22 bp, Homo sapiens
cagggagcagcccctagaagta

SEQ ID NO: 7854878 - DNA, 22 bp, Homo sapiens
cagggagcagcccctagaagta

SEQ ID NO: 7854879 - DNA, 22 bp, Homo sapiens
cagggagcagcatgggcaaagg

SEQ ID NO: 7854880 - DNA, 22 bp, Homo sapiens
cagggagcagcatgggcaaagg

SEQ ID NO: 7854881 - DNA, 22 bp, Homo sapiens
cagggagcactgcgagcggcag

SEQ ID NO: 7854882 - DNA, 22 bp, Homo sapiens
cagggagcactgcgagcggcag

SEQ ID NO: 7854883 - DNA, 22 bp, Homo sapiens
cagggagcactgcgagcggcag

SEQ ID NO: 7854884 - DNA, 22 bp, Homo sapiens
cagggagcactgcgagcggcag

SEQ ID NO: 7854885 - DNA, 22 bp, Homo sapiens
cagggagcactgcgagcggcag

SEQ ID NO: 7854886 - DNA, 20 bp, Homo sapiens
tagatttcatacttctcttt

SEQ ID NO: 7854887 - DNA, 22 bp, Homo sapiens
tagatttcgctgcatctcaatc

SEQ ID NO: 7854888 - DNA, 22 bp, Homo sapiens
tagatttcgctgcatctcaatc

SEQ ID NO: 7854889 - DNA, 22 bp, Homo sapiens
tagatttcaggagacaaaatgg

SEQ ID NO: 7854890 - DNA, 22 bp, Homo sapiens
tagatttcaggctggcttgcgg

SEQ ID NO: 7854891 - DNA, 22 bp, Homo sapiens
tagatttcaggagacaaaatgg

SEQ ID NO: 7854892 - DNA, 22 bp, Homo sapiens
tagatttaagaccctgaatttg

SEQ ID NO: 7854893 - DNA, 22 bp, Homo sapiens
tagattgttcttaactttataa

SEQ ID NO: 7854894 - DNA, 22 bp, Homo sapiens
tagattgtgaacaagtatttgg

SEQ ID NO: 7854895 - DNA, 22 bp, Homo sapiens
tagattgtaagctccttgaggg

SEQ ID NO: 7854896 - DNA, 22 bp, Homo sapiens
tagattgtgaacaagtatttgg

SEQ ID NO: 7854897 - DNA, 22 bp, Homo sapiens
tagattctttgctagatcattg

SEQ ID NO: 7854898 - DNA, 22 bp, Homo sapiens
tagattctttgctagatcattg

SEQ ID NO: 7854899 - DNA, 22 bp, Homo sapiens
tagattgcatatggaatgtatt

SEQ ID NO: 7854900 - DNA, 23 bp, Homo sapiens
tagattgctacaagtcattgaat

SEQ ID NO: 7854901 - DNA, 22 bp, Homo sapiens
tagatttgtgcaagaagggatt

SEQ ID NO: 7854902 - DNA, 22 bp, Homo sapiens
tagatttgtgcaagaagggatt

SEQ ID NO: 7854903 - DNA, 22 bp, Homo sapiens
tagatttgtgtttgggatgaga

SEQ ID NO: 7854904 - DNA, 22 bp, Homo sapiens
tagatttgtgcaagaagggatt

SEQ ID NO: 7854905 - DNA, 22 bp, Homo sapiens
tagatttgtgtttgggatgaga

SEQ ID NO: 7854906 - DNA, 22 bp, Homo sapiens
tagatttgcctgggaaagctca

SEQ ID NO: 7854907 - DNA, 22 bp, Homo sapiens
tagatttgcctgggaaagctca

SEQ ID NO: 7854908 - DNA, 22 bp, Homo sapiens
tagatttgctccaatgagttaa

SEQ ID NO: 7854909 - DNA, 22 bp, Homo sapiens
tagatttgctccaatgagttaa

SEQ ID NO: 7854910 - DNA, 22 bp, Homo sapiens
tagatttgtttccttctctcca

SEQ ID NO: 7854911 - DNA, 22 bp, Homo sapiens
tagatttgtttccttctctcca

SEQ ID NO: 7854912 - DNA, 22 bp, Homo sapiens
cagggagatcttggctcctggt

SEQ ID NO: 7854913 - DNA, 22 bp, Homo sapiens
cagggagatcttggctcctggt

SEQ ID NO: 7854914 - DNA, 22 bp, Homo sapiens
cagggagatcttggctcctggt

SEQ ID NO: 7854915 - DNA, 22 bp, Homo sapiens
cagggagatcttggctcctggt

SEQ ID NO: 7854916 - DNA, 22 bp, Homo sapiens
tagatttgatgtaagcatagtc

SEQ ID NO: 7854917 - DNA, 22 bp, Homo sapiens
tagatttgatgtaagcatagtc

SEQ ID NO: 7854918 - DNA, 22 bp, Homo sapiens
tagatttgatgtaagcatagtc

SEQ ID NO: 7854919 - DNA, 22 bp, Homo sapiens
tagatttgaatgatgtaaagag

SEQ ID NO: 7854920 - DNA, 22 bp, Homo sapiens
tagatttgatgcaattggattg

SEQ ID NO: 7854921 - DNA, 19 bp, Homo sapiens
tagatttgatcatctggat

SEQ ID NO: 7854922 - DNA, 22 bp, Homo sapiens
tagatttgaatgatgtaaagag

SEQ ID NO: 7854923 - DNA, 22 bp, Homo sapiens
tagatttctaacagtgtgcttg

SEQ ID NO: 7854924 - DNA, 22 bp, Homo sapiens
tagatttctaacagtgtgcttg

SEQ ID NO: 7854925 - DNA, 22 bp, Homo sapiens
cagggagccccaattccatgcc

SEQ ID NO: 7854926 - DNA, 22 bp, Homo sapiens
cagggagccccaattccatgcc

SEQ ID NO: 7854927 - DNA, 22 bp, Homo sapiens
cagggagcctccaaagctttca

SEQ ID NO: 7854928 - DNA, 22 bp, Homo sapiens
cagggagccccaattccatgcc

SEQ ID NO: 7854929 - DNA, 22 bp, Homo sapiens
cagggagccccaattccatgcc

SEQ ID NO: 7854930 - DNA, 22 bp, Homo sapiens
cagggagcaggctctgtccatc

SEQ ID NO: 7854931 - DNA, 22 bp, Homo sapiens
cagggagcaggctctgtccatc

SEQ ID NO: 7854932 - DNA, 22 bp, Homo sapiens
cagggagccaccagataattac

SEQ ID NO: 7854933 - DNA, 22 bp, Homo sapiens
cagggagccaccagataattac

SEQ ID NO: 7854934 - DNA, 22 bp, Homo sapiens
cagggccactgtagatgaggag

SEQ ID NO: 7854935 - DNA, 22 bp, Homo sapiens
cagggccactgcatgaggttca

SEQ ID NO: 7854936 - DNA, 22 bp, Homo sapiens
cagggccaggctgatggcctgg

SEQ ID NO: 7854937 - DNA, 22 bp, Homo sapiens
cagggagcctccaaagctttca

SEQ ID NO: 7854938 - DNA, 22 bp, Homo sapiens
cagggagcctccaaagctttca

SEQ ID NO: 7854939 - DNA, 22 bp, Homo sapiens
cagggagcctccaaagctttca

SEQ ID NO: 7854940 - DNA, 22 bp, Homo sapiens
cagggccactgcatgaggttca

SEQ ID NO: 7854941 - DNA, 22 bp, Homo sapiens
cagggccagttctcgcagcagt

SEQ ID NO: 7854942 - DNA, 22 bp, Homo sapiens
cagggccactgcatgaggttca

SEQ ID NO: 7854943 - DNA, 22 bp, Homo sapiens
cagggccagttctcgcagcagt

SEQ ID NO: 7854944 - DNA, 22 bp, Homo sapiens
cagggccagttctcgcagcagt

SEQ ID NO: 7854945 - DNA, 22 bp, Homo sapiens
cagggccagggctccatttcct

SEQ ID NO: 7854946 - DNA, 22 bp, Homo sapiens
cagggccagttctcgcagcagt

SEQ ID NO: 7854947 - DNA, 22 bp, Homo sapiens
cagggccagggctatggtgaag

SEQ ID NO: 7854948 - DNA, 22 bp, Homo sapiens
cagggccagggctatggtgaag

SEQ ID NO: 7854949 - DNA, 22 bp, Homo sapiens
cagggccagggctatggtgaag

SEQ ID NO: 7854950 - DNA, 22 bp, Homo sapiens
cagggccagggacacgctgtca

SEQ ID NO: 7854951 - DNA, 22 bp, Homo sapiens
cagggccagggctatggtgaag

SEQ ID NO: 7854952 - DNA, 22 bp, Homo sapiens
cagggccaggctgatggcctgg

SEQ ID NO: 7854953 - DNA, 22 bp, Homo sapiens
cagggccaggctgatggcctgg

SEQ ID NO: 7854954 - DNA, 22 bp, Homo sapiens
cagggccaggctgatggcctgg

SEQ ID NO: 7854955 - DNA, 22 bp, Homo sapiens
cagggccagggacacgctgtca

SEQ ID NO: 7854956 - DNA, 22 bp, Homo sapiens
cagggccaggctgatggcctgg

SEQ ID NO: 7854957 - DNA, 22 bp, Homo sapiens
cagggccaggctgatggcctgg

SEQ ID NO: 7854958 - DNA, 22 bp, Homo sapiens
cagggccattggaacaaagagg

SEQ ID NO: 7854959 - DNA, 22 bp, Homo sapiens
cagggccattggaacaaagagg

SEQ ID NO: 7854960 - DNA, 22 bp, Homo sapiens
cagggccattggaacaaagagg

SEQ ID NO: 7854961 - DNA, 22 bp, Homo sapiens
cagggccattggcgtggctgtc

SEQ ID NO: 7854962 - DNA, 22 bp, Homo sapiens
cagggccattggcgtggctgtc

SEQ ID NO: 7854963 - DNA, 22 bp, Homo sapiens
cagggccattggaacaaagagg

SEQ ID NO: 7854964 - DNA, 22 bp, Homo sapiens
tagcttaaggcaggcccttgtc

SEQ ID NO: 7854965 - DNA, 22 bp, Homo sapiens
tagcttaatatgaaacacataa

SEQ ID NO: 7854966 - DNA, 22 bp, Homo sapiens
tagcttaatatgaaacacataa

SEQ ID NO: 7854967 - DNA, 22 bp, Homo sapiens
tagcttaaggagtaccagatca

SEQ ID NO: 7854968 - DNA, 22 bp, Homo sapiens
tagcttaaggagtaccagatca

SEQ ID NO: 7854969 - DNA, 22 bp, Homo sapiens
cagggccattggcgtggctgtc

SEQ ID NO: 7854970 - DNA, 22 bp, Homo sapiens
cagggccattggcgtggctgtc

SEQ ID NO: 7854971 - DNA, 22 bp, Homo sapiens
cagggccatatcttgtgcacca

SEQ ID NO: 7854972 - DNA, 22 bp, Homo sapiens
cagggccatgaggcacagggtc

SEQ ID NO: 7854973 - DNA, 22 bp, Homo sapiens
cagggccatgaggcacagggtc

SEQ ID NO: 7854974 - DNA, 22 bp, Homo sapiens
cagggccatgaggcacagggtc

SEQ ID NO: 7854975 - DNA, 22 bp, Homo sapiens
cagggccatgaggcacagggtc

SEQ ID NO: 7854976 - DNA, 22 bp, Homo sapiens
cagggccatgaggcacagggtc

SEQ ID NO: 7854977 - DNA, 22 bp, Homo sapiens
cagggccatgaggcacagggtc

SEQ ID NO: 7854978 - DNA, 22 bp, Homo sapiens
cagggccagttctcgcagcagt

SEQ ID NO: 7854979 - DNA, 22 bp, Homo sapiens
cagggccatatcttgtgcacca

SEQ ID NO: 7854980 - DNA, 22 bp, Homo sapiens
cagggccatatcttgtgcacca

SEQ ID NO: 7854981 - DNA, 22 bp, Homo sapiens
cagggccatatcttgtgcacca

SEQ ID NO: 7854982 - DNA, 22 bp, Homo sapiens
cagggccatatcttgtgcacca

SEQ ID NO: 7854983 - DNA, 22 bp, Homo sapiens
tagcttctcataatttatgctg

SEQ ID NO: 7854984 - DNA, 22 bp, Homo sapiens
tagcttctaatacttaccaatt

SEQ ID NO: 7854985 - DNA, 22 bp, Homo sapiens
tagcttcagggaaaccactgct

SEQ ID NO: 7854986 - DNA, 22 bp, Homo sapiens
tagcttatctatacagactttt

SEQ ID NO: 7854987 - DNA, 22 bp, Homo sapiens
tagcttatctatacagactttt

SEQ ID NO: 7854988 - DNA, 22 bp, Homo sapiens
tagcttatcccacagtgcccag

SEQ ID NO: 7854989 - DNA, 22 bp, Homo sapiens
tagcttatcccacagtgcccag

SEQ ID NO: 7854990 - DNA, 22 bp, Homo sapiens
tagcttataaaggttttcaaag

SEQ ID NO: 7854991 - DNA, 22 bp, Homo sapiens
tagctttaaaaatcatcaaagc

SEQ ID NO: 7854992 - DNA, 22 bp, Homo sapiens
tagcttcttgagaaagggtgcc

SEQ ID NO: 7854993 - DNA, 22 bp, Homo sapiens
tagcttggaataaaatgagaat

SEQ ID NO: 7854994 - DNA, 22 bp, Homo sapiens
tagcttcttgagaaagggtgcc

SEQ ID NO: 7854995 - DNA, 22 bp, Homo sapiens
tagcttctgggagtgtttacta

SEQ ID NO: 7854996 - DNA, 22 bp, Homo sapiens
tagcttgactattctatgatgt

SEQ ID NO: 7854997 - DNA, 22 bp, Homo sapiens
taggaggcatttgctcccaggg

SEQ ID NO: 7854998 - DNA, 18 bp, Homo sapiens
taggaggctcctgggggc

SEQ ID NO: 7854999 - DNA, 22 bp, Homo sapiens
taggaggcttaaagctgctcag

SEQ ID NO: 7855000 - DNA, 22 bp, Homo sapiens
taggcagggattagggttgatt

SEQ ID NO: 7855001 - DNA, 22 bp, Homo sapiens
taggagggccctgaaaatggca

SEQ ID NO: 7855002 - DNA, 22 bp, Homo sapiens
taggcaggtgtgcactgcccac

SEQ ID NO: 7855003 - DNA, 22 bp, Homo sapiens
taggcaggtgtgcactgcccac

SEQ ID NO: 7855004 - DNA, 22 bp, Homo sapiens
taggcatgcaaataaatgtgca

SEQ ID NO: 7855005 - DNA, 22 bp, Homo sapiens
taggcagtagcaggatctgcca

SEQ ID NO: 7855006 - DNA, 22 bp, Homo sapiens
taggcatgcaaataaatgtgca

SEQ ID NO: 7855007 - DNA, 22 bp, Homo sapiens
taggcagtgctctgtgcttcag

SEQ ID NO: 7855008 - DNA, 22 bp, Homo sapiens
taggcagtgctctgtgcttcag

SEQ ID NO: 7855009 - DNA, 22 bp, Homo sapiens
taggcagtagcaggatctgcca

SEQ ID NO: 7855010 - DNA, 22 bp, Homo sapiens
taggcagtagcttgagatataa

SEQ ID NO: 7855011 - DNA, 22 bp, Homo sapiens
taggcagtagcaggatctgcca

SEQ ID NO: 7855012 - DNA, 22 bp, Homo sapiens
taggccaaatgacttgatgttt

SEQ ID NO: 7855013 - DNA, 22 bp, Homo sapiens
taggccaacgtggaagggtcca

SEQ ID NO: 7855014 - DNA, 22 bp, Homo sapiens
taggccaaggacagtaaggaca

SEQ ID NO: 7855015 - DNA, 22 bp, Homo sapiens
taggccaaatgacttgatgttt

SEQ ID NO: 7855016 - DNA, 22 bp, Homo sapiens
taggcatttaagatggataagg

SEQ ID NO: 7855017 - DNA, 22 bp, Homo sapiens
taggcattttattgaacgtaac

SEQ ID NO: 7855018 - DNA, 22 bp, Homo sapiens
taggcattttattgaacgtaac

SEQ ID NO: 7855019 - DNA, 22 bp, Homo sapiens
taggcattttcagtgttgttgt

SEQ ID NO: 7855020 - DNA, 22 bp, Homo sapiens
taggcattttcagtgttgttgt

SEQ ID NO: 7855021 - DNA, 22 bp, Homo sapiens
taggcattacctaacattacct

SEQ ID NO: 7855022 - DNA, 22 bp, Homo sapiens
taggcattattttaccacggtc

SEQ ID NO: 7855023 - DNA, 22 bp, Homo sapiens
cagggctccatgcagggactcc

SEQ ID NO: 7855024 - DNA, 22 bp, Homo sapiens
cagggctccatgcagggactcc

SEQ ID NO: 7855025 - DNA, 22 bp, Homo sapiens
cagggctccatgcagggactcc

SEQ ID NO: 7855026 - DNA, 22 bp, Homo sapiens
cagggctccatgcagggactcc

SEQ ID NO: 7855027 - DNA, 22 bp, Homo sapiens
cagggcctcattgtcagtcctg

SEQ ID NO: 7855028 - DNA, 22 bp, Homo sapiens
cagggcctcatcctcagagatt

SEQ ID NO: 7855029 - DNA, 20 bp, Homo sapiens
cagggcctatgattgagctt

SEQ ID NO: 7855030 - DNA, 20 bp, Homo sapiens
cagggcctaagagctgaaaa

SEQ ID NO: 7855031 - DNA, 20 bp, Homo sapiens
cagggcctaagagctgaaaa

SEQ ID NO: 7855032 - DNA, 20 bp, Homo sapiens
cagggcctaagagctgaaaa

SEQ ID NO: 7855033 - DNA, 22 bp, Homo sapiens
cagggccctaagatacacatca

SEQ ID NO: 7855034 - DNA, 23 bp, Homo sapiens
cagggccctgctcaatttctcca

SEQ ID NO: 7855035 - DNA, 22 bp, Homo sapiens
cagggcccatggctcaggtagg

SEQ ID NO: 7855036 - DNA, 22 bp, Homo sapiens
cagggcccatggctcaggtagg

SEQ ID NO: 7855037 - DNA, 22 bp, Homo sapiens
cagggccctaagatacacatca

SEQ ID NO: 7855038 - DNA, 22 bp, Homo sapiens
cagggccccagggatgtctgct

SEQ ID NO: 7855039 - DNA, 22 bp, Homo sapiens
taggccagaggagcagctttgg

SEQ ID NO: 7855040 - DNA, 22 bp, Homo sapiens
taggccactctcctttgtctca

SEQ ID NO: 7855041 - DNA, 19 bp, Homo sapiens
taggccagaagttttccac

SEQ ID NO: 7855042 - DNA, 22 bp, Homo sapiens
taggccacgaaggagatgatag

SEQ ID NO: 7855043 - DNA, 22 bp, Homo sapiens
taggccacggaaagcaggttgc

SEQ ID NO: 7855044 - DNA, 22 bp, Homo sapiens
taggccaagttgatcagacatc

SEQ ID NO: 7855045 - DNA, 22 bp, Homo sapiens
taggccaaggacagtaaggaca

SEQ ID NO: 7855046 - DNA, 22 bp, Homo sapiens
taggccacaaataagatcctgt

SEQ ID NO: 7855047 - DNA, 22 bp, Homo sapiens
taggccacagagaggagatttc

SEQ ID NO: 7855048 - DNA, 22 bp, Homo sapiens
taggccacagatgagacataag

SEQ ID NO: 7855049 - DNA, 21 bp, Homo sapiens
taggccacatgggttggagat

SEQ ID NO: 7855050 - DNA, 22 bp, Homo sapiens
taggccaccagggttccattta

SEQ ID NO: 7855051 - DNA, 22 bp, Homo sapiens
cagggcccagtccctgctgtca

SEQ ID NO: 7855052 - DNA, 22 bp, Homo sapiens
cagggcccagtccctgctgtca

SEQ ID NO: 7855053 - DNA, 22 bp, Homo sapiens
cagggcccagtccctgctgtca

SEQ ID NO: 7855054 - DNA, 22 bp, Homo sapiens
cagggcccaggccactgggttg

SEQ ID NO: 7855055 - DNA, 22 bp, Homo sapiens
cagggcccagtccctgctgtca

SEQ ID NO: 7855056 - DNA, 22 bp, Homo sapiens
cagggcccaggccactgggttg

SEQ ID NO: 7855057 - DNA, 22 bp, Homo sapiens
cagggcccagtccctgctgtca

SEQ ID NO: 7855058 - DNA, 22 bp, Homo sapiens
cagggcccaagacacaatgagg

SEQ ID NO: 7855059 - DNA, 22 bp, Homo sapiens
taggccagaggagcagctttgg

SEQ ID NO: 7855060 - DNA, 20 bp, Homo sapiens
cagggctctgggcctggcct

SEQ ID NO: 7855061 - DNA, 20 bp, Homo sapiens
cagggctctgggcctggcct

SEQ ID NO: 7855062 - DNA, 20 bp, Homo sapiens
cagggctctgggcctggcct

SEQ ID NO: 7855063 - DNA, 20 bp, Homo sapiens
cagggctctgggcctggcct

SEQ ID NO: 7855064 - DNA, 20 bp, Homo sapiens
cagggctctgggcctggcct

SEQ ID NO: 7855065 - DNA, 22 bp, Homo sapiens
cagggctcttcatcacacagta

SEQ ID NO: 7855066 - DNA, 22 bp, Homo sapiens
cagggctcttccggagcaggga

SEQ ID NO: 7855067 - DNA, 22 bp, Homo sapiens
cagggctcttccggagcaggga

SEQ ID NO: 7855068 - DNA, 22 bp, Homo sapiens
cagggctcttccggagcaggga

SEQ ID NO: 7855069 - DNA, 22 bp, Homo sapiens
cagggctcttccggagcaggga

SEQ ID NO: 7855070 - DNA, 22 bp, Homo sapiens
cagggctgaaatcaaggtgtag

SEQ ID NO: 7855071 - DNA, 22 bp, Homo sapiens
cagggctgaactgagcttgtga

SEQ ID NO: 7855072 - DNA, 22 bp, Homo sapiens
cagggctgaactgagcttgtga

SEQ ID NO: 7855073 - DNA, 22 bp, Homo sapiens
cagggctgaaatcaaggtgtag

SEQ ID NO: 7855074 - DNA, 22 bp, Homo sapiens
cagggctgaaatcaaggtgtag

SEQ ID NO: 7855075 - DNA, 22 bp, Homo sapiens
cagggctgaaatcaaggtgtag

SEQ ID NO: 7855076 - DNA, 22 bp, Homo sapiens
cagggctgaaatcaaggtgtag

SEQ ID NO: 7855077 - DNA, 22 bp, Homo sapiens
cagggctgaaatcaaggtgtag

SEQ ID NO: 7855078 - DNA, 22 bp, Homo sapiens
cagggctgaaatcaaggtgtag

SEQ ID NO: 7855079 - DNA, 22 bp, Homo sapiens
cagggctcttccggagcaggga

SEQ ID NO: 7855080 - DNA, 22 bp, Homo sapiens
taggctgggctgagctggacgg

SEQ ID NO: 7855081 - DNA, 22 bp, Homo sapiens
taggctgggctgagctggacgg

SEQ ID NO: 7855082 - DNA, 22 bp, Homo sapiens
taggctgggctgagctggacgg

SEQ ID NO: 7855083 - DNA, 22 bp, Homo sapiens
taggctgggctgagctggacgg

SEQ ID NO: 7855084 - DNA, 22 bp, Homo sapiens
taggctgggggtaggaattgag

SEQ ID NO: 7855085 - DNA, 22 bp, Homo sapiens
taggctgtaagagagggcagag

SEQ ID NO: 7855086 - DNA, 18 bp, Homo sapiens
taggctgggggctgtagt

SEQ ID NO: 7855087 - DNA, 22 bp, Homo sapiens
taggctgggcctgccttccagg

SEQ ID NO: 7855088 - DNA, 22 bp, Homo sapiens
taggctgggcctgccttccagg

SEQ ID NO: 7855089 - DNA, 22 bp, Homo sapiens
taggctgggcctgccttccagg

SEQ ID NO: 7855090 - DNA, 22 bp, Homo sapiens
cagggctgagaatttagagaca

SEQ ID NO: 7855091 - DNA, 22 bp, Homo sapiens
cagggctgaactgagcttgtga

SEQ ID NO: 7855092 - DNA, 22 bp, Homo sapiens
cagggctgaagaaattcaaaag

SEQ ID NO: 7855093 - DNA, 22 bp, Homo sapiens
cagggctgaagaaattcaaaag

SEQ ID NO: 7855094 - DNA, 22 bp, Homo sapiens
cagggctgaagaaattcaaaag

SEQ ID NO: 7855095 - DNA, 22 bp, Homo sapiens
cagggctgaagaaattcaaaag

SEQ ID NO: 7855096 - DNA, 22 bp, Homo sapiens
cagggctgagaatttagagaca

SEQ ID NO: 7855097 - DNA, 22 bp, Homo sapiens
taggcttttccagtataagaga

SEQ ID NO: 7855098 - DNA, 22 bp, Homo sapiens
tagggaaaagacttcactgttt

SEQ ID NO: 7855099 - DNA, 22 bp, Homo sapiens
tagggaaaagacttcactgttt

SEQ ID NO: 7855100 - DNA, 22 bp, Homo sapiens
taggcttttccagtataagaga

SEQ ID NO: 7855101 - DNA, 22 bp, Homo sapiens
taggctttgtgcaggatacagg

SEQ ID NO: 7855102 - DNA, 22 bp, Homo sapiens
taggctttgtgttttgggaaca

SEQ ID NO: 7855103 - DNA, 22 bp, Homo sapiens
taggctttgtgttttgggaaca

SEQ ID NO: 7855104 - DNA, 22 bp, Homo sapiens
taggctttccttgttgccatgt

SEQ ID NO: 7855105 - DNA, 22 bp, Homo sapiens
taggctttcacagctggactcc

SEQ ID NO: 7855106 - DNA, 22 bp, Homo sapiens
taggctttcacagctggactcc

SEQ ID NO: 7855107 - DNA, 22 bp, Homo sapiens
taggctttagtccctggaatta

SEQ ID NO: 7855108 - DNA, 22 bp, Homo sapiens
taggctttggaggattaagggg

SEQ ID NO: 7855109 - DNA, 22 bp, Homo sapiens
taggctttggaggattaagggg

SEQ ID NO: 7855110 - DNA, 22 bp, Homo sapiens
taggctttccttgttgccatgt

SEQ ID NO: 7855111 - DNA, 22 bp, Homo sapiens
taggctttggaagatcaagcaa

SEQ ID NO: 7855112 - DNA, 22 bp, Homo sapiens
taggcttgttacaaaacagtca

SEQ ID NO: 7855113 - DNA, 22 bp, Homo sapiens
taggcttgcaattaggatggaa

SEQ ID NO: 7855114 - DNA, 22 bp, Homo sapiens
taggcttcccgctcacatgccc

SEQ ID NO: 7855115 - DNA, 23 bp, Homo sapiens
taggcttctgctgtccccgacgc

SEQ ID NO: 7855116 - DNA, 22 bp, Homo sapiens
cagggctggatttcatttctag

SEQ ID NO: 7855117 - DNA, 22 bp, Homo sapiens
cagggctgggttaaaagcaggg

SEQ ID NO: 7855118 - DNA, 23 bp, Homo sapiens
cagggctggtagggaagagcgtg

SEQ ID NO: 7855119 - DNA, 23 bp, Homo sapiens
cagggctggtagggaagagcgtg

SEQ ID NO: 7855120 - DNA, 23 bp, Homo sapiens
cagggctggtagggaagagcgtg

SEQ ID NO: 7855121 - DNA, 22 bp, Homo sapiens
cagggctggatttcatttctag

SEQ ID NO: 7855122 - DNA, 22 bp, Homo sapiens
cagggctggatttcatttctag

SEQ ID NO: 7855123 - DNA, 22 bp, Homo sapiens
tagggaagctcctgattcccct

SEQ ID NO: 7855124 - DNA, 22 bp, Homo sapiens
tagggaagagcattcaaccttt

SEQ ID NO: 7855125 - DNA, 22 bp, Homo sapiens
tagggaagctcctgattcccct

SEQ ID NO: 7855126 - DNA, 22 bp, Homo sapiens
tagggaaatatagatttagggc

SEQ ID NO: 7855127 - DNA, 22 bp, Homo sapiens
tagggaagagcattcaaccttt

SEQ ID NO: 7855128 - DNA, 22 bp, Homo sapiens
tagggaaaagacttcactgttt

SEQ ID NO: 7855129 - DNA, 22 bp, Homo sapiens
tagggaaatatagatttagggc

SEQ ID NO: 7855130 - DNA, 22 bp, Homo sapiens
tagggaaatatagatttagggc

SEQ ID NO: 7855131 - DNA, 22 bp, Homo sapiens
cagggctgtaaattagtgctga

SEQ ID NO: 7855132 - DNA, 22 bp, Homo sapiens
cagggctgtaaattagtgctga

SEQ ID NO: 7855133 - DNA, 22 bp, Homo sapiens
cagggctgtaaattagtgctga

SEQ ID NO: 7855134 - DNA, 22 bp, Homo sapiens
cagggctgtaaattagtgctga

SEQ ID NO: 7855135 - DNA, 22 bp, Homo sapiens
cagggctgtaaattagtgctga

SEQ ID NO: 7855136 - DNA, 22 bp, Homo sapiens
cagggctgtctccaaaggcccc

SEQ ID NO: 7855137 - DNA, 22 bp, Homo sapiens
cagggctgtctccaaaggcccc

SEQ ID NO: 7855138 - DNA, 22 bp, Homo sapiens
cagggctgtctccaaaggcccc

SEQ ID NO: 7855139 - DNA, 22 bp, Homo sapiens
cagggctgtctccaaaggcccc

SEQ ID NO: 7855140 - DNA, 22 bp, Homo sapiens
cagggctgtctccaaaggcccc

SEQ ID NO: 7855141 - DNA, 22 bp, Homo sapiens
cagggctgtaaattagtgctga

SEQ ID NO: 7855142 - DNA, 22 bp, Homo sapiens
cagggctgtctccaaaggcccc

SEQ ID NO: 7855143 - DNA, 22 bp, Homo sapiens
cagggctgtctccaaaggcccc

SEQ ID NO: 7855144 - DNA, 22 bp, Homo sapiens
cagggctggtttgtcgaagaaa

SEQ ID NO: 7855145 - DNA, 22 bp, Homo sapiens
cagggctggtttgtcgaagaaa

SEQ ID NO: 7855146 - DNA, 22 bp, Homo sapiens
cagggctggtttgtcgaagaaa

SEQ ID NO: 7855147 - DNA, 22 bp, Homo sapiens
cagggctggtttgtcgaagaaa

SEQ ID NO: 7855148 - DNA, 22 bp, Homo sapiens
cagggctggtttgtcgaagaaa

SEQ ID NO: 7855149 - DNA, 23 bp, Homo sapiens
cagggctggtagggaagagcgtg

SEQ ID NO: 7855150 - DNA, 23 bp, Homo sapiens
cagggctggtagggaagagcgtg

SEQ ID NO: 7855151 - DNA, 23 bp, Homo sapiens
cagggctggtagggaagagcgtg

SEQ ID NO: 7855152 - DNA, 22 bp, Homo sapiens
cagggctggtttgtcgaagaaa

SEQ ID NO: 7855153 - DNA, 22 bp, Homo sapiens
cagggtggggaaatagcgccct

SEQ ID NO: 7855154 - DNA, 22 bp, Homo sapiens
cagggtggggctggctatcaaa

SEQ ID NO: 7855155 - DNA, 22 bp, Homo sapiens
cagggtggggctggctatcaaa

SEQ ID NO: 7855156 - DNA, 22 bp, Homo sapiens
cagggtggggctggctatcaaa

SEQ ID NO: 7855157 - DNA, 22 bp, Homo sapiens
cagggtccggctgcctggctgt

SEQ ID NO: 7855158 - DNA, 22 bp, Homo sapiens
cagggtccggctgcctggctgt

SEQ ID NO: 7855159 - DNA, 22 bp, Homo sapiens
cagggtctgatggtcctcactt

SEQ ID NO: 7855160 - DNA, 22 bp, Homo sapiens
cagggtccccgggtctcctgtg

SEQ ID NO: 7855161 - DNA, 22 bp, Homo sapiens
cagggtccggctgcctggctgt

SEQ ID NO: 7855162 - DNA, 22 bp, Homo sapiens
cagggtccggctgcctggctgt

SEQ ID NO: 7855163 - DNA, 22 bp, Homo sapiens
cagggtccccgggtctcctgtg

SEQ ID NO: 7855164 - DNA, 22 bp, Homo sapiens
cagggtcccaggagctgctttc

SEQ ID NO: 7855165 - DNA, 22 bp, Homo sapiens
cagggtcccaggagctgctttc

SEQ ID NO: 7855166 - DNA, 22 bp, Homo sapiens
cagggtcatggcacctgcacgg

SEQ ID NO: 7855167 - DNA, 22 bp, Homo sapiens
cagggtcatggcacctgcacgg

SEQ ID NO: 7855168 - DNA, 22 bp, Homo sapiens
cagggtcaggctgctagaagct

SEQ ID NO: 7855169 - DNA, 22 bp, Homo sapiens
cagggtccatctttcatcactg

SEQ ID NO: 7855170 - DNA, 22 bp, Homo sapiens
cagggtcaggaggatctggctt

SEQ ID NO: 7855171 - DNA, 22 bp, Homo sapiens
cagggtcaggctgctagaagct

SEQ ID NO: 7855172 - DNA, 22 bp, Homo sapiens
cagggtagtaatttaatacaag

SEQ ID NO: 7855173 - DNA, 22 bp, Homo sapiens
cagggtagtaatttaatacaag

SEQ ID NO: 7855174 - DNA, 22 bp, Homo sapiens
cagggtagggcaagggaacctg

SEQ ID NO: 7855175 - DNA, 22 bp, Homo sapiens
cagggtagggcaagggaacctg

SEQ ID NO: 7855176 - DNA, 22 bp, Homo sapiens
cagggtagggcaagggaacctg

SEQ ID NO: 7855177 - DNA, 22 bp, Homo sapiens
cagggtagggcaagggaacctg

SEQ ID NO: 7855178 - DNA, 22 bp, Homo sapiens
cagggtagacagtaggtgtctg

SEQ ID NO: 7855179 - DNA, 22 bp, Homo sapiens
cagggtagacagtaggtgtctg

SEQ ID NO: 7855180 - DNA, 22 bp, Homo sapiens
cagggtagacagtaggtgtctg

SEQ ID NO: 7855181 - DNA, 22 bp, Homo sapiens
cagggtagacagtaggtgtctg

SEQ ID NO: 7855182 - DNA, 22 bp, Homo sapiens
caggggtgtttttggccaggag

SEQ ID NO: 7855183 - DNA, 22 bp, Homo sapiens
caggggtgtttttggccaggag

SEQ ID NO: 7855184 - DNA, 22 bp, Homo sapiens
caggggtgtttttggccaggag

SEQ ID NO: 7855185 - DNA, 22 bp, Homo sapiens
caggggtgtttttggccaggag

SEQ ID NO: 7855186 - DNA, 22 bp, Homo sapiens
cagggtagacagtaggtgtctg

SEQ ID NO: 7855187 - DNA, 22 bp, Homo sapiens
cagggtacagagttttctaaac

SEQ ID NO: 7855188 - DNA, 22 bp, Homo sapiens
cagggtagacagtaggtgtctg

SEQ ID NO: 7855189 - DNA, 22 bp, Homo sapiens
caggggtggctgcagcagaggt

SEQ ID NO: 7855190 - DNA, 22 bp, Homo sapiens
caggggtggctgcagcagaggt

SEQ ID NO: 7855191 - DNA, 22 bp, Homo sapiens
caggggtggctgcagcagaggt

SEQ ID NO: 7855192 - DNA, 22 bp, Homo sapiens
caggggtgtttttggccaggag

SEQ ID NO: 7855193 - DNA, 22 bp, Homo sapiens
caggggtgtttttggccaggag

SEQ ID NO: 7855194 - DNA, 22 bp, Homo sapiens
cagggggtggtccaggctgcgc

SEQ ID NO: 7855195 - DNA, 22 bp, Homo sapiens
caggggtggctgcagcagaggt

SEQ ID NO: 7855196 - DNA, 22 bp, Homo sapiens
caggggtggctgcagcagaggt

SEQ ID NO: 7855197 - DNA, 22 bp, Homo sapiens
cagggggtggtccaggctgcgc

SEQ ID NO: 7855198 - DNA, 22 bp, Homo sapiens
cagggggtggtccaggctgcgc

SEQ ID NO: 7855199 - DNA, 22 bp, Homo sapiens
cagggggctcaaaggagagtgc

SEQ ID NO: 7855200 - DNA, 22 bp, Homo sapiens
cagggggctcaaaggagagtgc

SEQ ID NO: 7855201 - DNA, 22 bp, Homo sapiens
cagggggcagcgtagaaaatga

SEQ ID NO: 7855202 - DNA, 22 bp, Homo sapiens
cagggggctcaaaggagagtgc

SEQ ID NO: 7855203 - DNA, 22 bp, Homo sapiens
cagggggcagcgtagaaaatga

SEQ ID NO: 7855204 - DNA, 22 bp, Homo sapiens
cagggggctgtggctgtccagt

SEQ ID NO: 7855205 - DNA, 22 bp, Homo sapiens
cagggggctgtggctgtccagt

SEQ ID NO: 7855206 - DNA, 22 bp, Homo sapiens
cagggggctgtggctgtccagt

SEQ ID NO: 7855207 - DNA, 22 bp, Homo sapiens
cagggggctgtggctgtccagt

SEQ ID NO: 7855208 - DNA, 22 bp, Homo sapiens
cagggggctgtggctgtccagt

SEQ ID NO: 7855209 - DNA, 22 bp, Homo sapiens
caggggcttaagtgacagaagg

SEQ ID NO: 7855210 - DNA, 22 bp, Homo sapiens
caggggcttaagtgacagaagg

SEQ ID NO: 7855211 - DNA, 22 bp, Homo sapiens
caggggctgtttgcctcaggcc

SEQ ID NO: 7855212 - DNA, 22 bp, Homo sapiens
caggggcctgtcctggcttctg

SEQ ID NO: 7855213 - DNA, 22 bp, Homo sapiens
cagggctgtggctttgtgctgt

SEQ ID NO: 7855214 - DNA, 22 bp, Homo sapiens
cagggctgtggctttgtgctgt

SEQ ID NO: 7855215 - DNA, 22 bp, Homo sapiens
cagggctgtggctttgtgctgt

SEQ ID NO: 7855216 - DNA, 22 bp, Homo sapiens
cagggctgtggctttgtgctgt

SEQ ID NO: 7855217 - DNA, 22 bp, Homo sapiens
caggggcctgtcctggcttctg

SEQ ID NO: 7855218 - DNA, 22 bp, Homo sapiens
cagggctgtggaaaactggtgc

SEQ ID NO: 7855219 - DNA, 22 bp, Homo sapiens
cagggctgtgcccatcttcccc

SEQ ID NO: 7855220 - DNA, 22 bp, Homo sapiens
cagggctgtggaaaactggtgc

SEQ ID NO: 7855221 - DNA, 22 bp, Homo sapiens
cagggctgtggaaaactggtgc

SEQ ID NO: 7855222 - DNA, 22 bp, Homo sapiens
cagggctgtggctttgtgctgt

SEQ ID NO: 7855223 - DNA, 22 bp, Homo sapiens
cagggctgtgcccatcttcccc

SEQ ID NO: 7855224 - DNA, 22 bp, Homo sapiens
cagggctgtggaaaactggtgc

SEQ ID NO: 7855225 - DNA, 22 bp, Homo sapiens
cagggctgtggaaaactggtgc

SEQ ID NO: 7855226 - DNA, 17 bp, Homo sapiens
cagggctgtctgcctag

SEQ ID NO: 7855227 - DNA, 17 bp, Homo sapiens
cagggctgtctgcctag

SEQ ID NO: 7855228 - DNA, 17 bp, Homo sapiens
cagggctgtctgcctag

SEQ ID NO: 7855229 - DNA, 22 bp, Homo sapiens
cagggctgtgcccatcttcccc

SEQ ID NO: 7855230 - DNA, 22 bp, Homo sapiens
cagggctgtgcccatcttcccc

SEQ ID NO: 7855231 - DNA, 22 bp, Homo sapiens
cagggctgtgcccatcttcccc

SEQ ID NO: 7855232 - DNA, 22 bp, Homo sapiens
cagggctgtgcccatcttcccc

SEQ ID NO: 7855233 - DNA, 17 bp, Homo sapiens
cagggctgtctgcctag

SEQ ID NO: 7855234 - DNA, 17 bp, Homo sapiens
cagggctgtctgcctag

SEQ ID NO: 7855235 - DNA, 17 bp, Homo sapiens
cagggctgtctgcctag

SEQ ID NO: 7855236 - DNA, 17 bp, Homo sapiens
cagggctgtctgcctag

SEQ ID NO: 7855237 - DNA, 17 bp, Homo sapiens
tggctctgtcctcagct

SEQ ID NO: 7855238 - DNA, 17 bp, Homo sapiens
tggctctgtcctcagct

SEQ ID NO: 7855239 - DNA, 22 bp, Homo sapiens
tggctctgtcactgtgagctat

SEQ ID NO: 7855240 - DNA, 17 bp, Homo sapiens
tggctctgtcctcagct

SEQ ID NO: 7855241 - DNA, 22 bp, Homo sapiens
tggctctgtcactgtgagctat

SEQ ID NO: 7855242 - DNA, 22 bp, Homo sapiens
tggctctgtcactgtgagctat

SEQ ID NO: 7855243 - DNA, 22 bp, Homo sapiens
tggctctgtcactgtgagctat

SEQ ID NO: 7855244 - DNA, 22 bp, Homo sapiens
tggctctgtcactgtgagctat

SEQ ID NO: 7855245 - DNA, 17 bp, Homo sapiens
tggctctgtcctcagct

SEQ ID NO: 7855246 - DNA, 17 bp, Homo sapiens
tggctctgtcctcagct

SEQ ID NO: 7855247 - DNA, 19 bp, Homo sapiens
tggctctgtcgaaggcaca

SEQ ID NO: 7855248 - DNA, 19 bp, Homo sapiens
tggctctgtcgaaggcaca

SEQ ID NO: 7855249 - DNA, 17 bp, Homo sapiens
tggctctgtcctcagct

SEQ ID NO: 7855250 - DNA, 22 bp, Homo sapiens
tggctgagaatgggatgatgcc

SEQ ID NO: 7855251 - DNA, 22 bp, Homo sapiens
tggctgagaatgggatgatgcc

SEQ ID NO: 7855252 - DNA, 22 bp, Homo sapiens
tggctgagaatgggatgatgcc

SEQ ID NO: 7855253 - DNA, 19 bp, Homo sapiens
tggctctgtcgaaggcaca

SEQ ID NO: 7855254 - DNA, 22 bp, Homo sapiens
tggctgagaccatcagggtgta

SEQ ID NO: 7855255 - DNA, 22 bp, Homo sapiens
tggctgagaccatcagggtgta

SEQ ID NO: 7855256 - DNA, 22 bp, Homo sapiens
tggctgagaccatcagggtgta

SEQ ID NO: 7855257 - DNA, 22 bp, Homo sapiens
tggctgagaccatcagggtgta

SEQ ID NO: 7855258 - DNA, 22 bp, Homo sapiens
tggctgagaccatcagggtgta

SEQ ID NO: 7855259 - DNA, 22 bp, Homo sapiens
tggctgagaccatcagggtgta

SEQ ID NO: 7855260 - DNA, 22 bp, Homo sapiens
tggctgagaccatcagggtgta

SEQ ID NO: 7855261 - DNA, 22 bp, Homo sapiens
tggctgagaatgggatgatgcc

SEQ ID NO: 7855262 - DNA, 22 bp, Homo sapiens
tggctggctggaccacacctgc

SEQ ID NO: 7855263 - DNA, 22 bp, Homo sapiens
tggctggctggaccacacctgc

SEQ ID NO: 7855264 - DNA, 18 bp, Homo sapiens
tggctggctctgtcatct

SEQ ID NO: 7855265 - DNA, 18 bp, Homo sapiens
tggctggctctgtcatct

SEQ ID NO: 7855266 - DNA, 22 bp, Homo sapiens
tggctggctagtgggcaggatt

SEQ ID NO: 7855267 - DNA, 22 bp, Homo sapiens
tggctggctagtgggcaggatt

SEQ ID NO: 7855268 - DNA, 22 bp, Homo sapiens
tggctggctagtgggcaggatt

SEQ ID NO: 7855269 - DNA, 22 bp, Homo sapiens
tggctggctagtgggcaggatt

SEQ ID NO: 7855270 - DNA, 22 bp, Homo sapiens
tggctgctcaagggaggaggct

SEQ ID NO: 7855271 - DNA, 22 bp, Homo sapiens
tggctgctcaagggaggaggct

SEQ ID NO: 7855272 - DNA, 22 bp, Homo sapiens
tggctgctagccagagcttcag

SEQ ID NO: 7855273 - DNA, 22 bp, Homo sapiens
tggctgctagccagagcttcag

SEQ ID NO: 7855274 - DNA, 22 bp, Homo sapiens
tggctgagaccttcccaaattc

SEQ ID NO: 7855275 - DNA, 22 bp, Homo sapiens
tggctgagaccttcccaaattc

SEQ ID NO: 7855276 - DNA, 22 bp, Homo sapiens
tggctgagaccatcagggtgta

SEQ ID NO: 7855277 - DNA, 22 bp, Homo sapiens
tggctgagagaagacggggaag

SEQ ID NO: 7855278 - DNA, 22 bp, Homo sapiens
tggctgagagaagacggggaag

SEQ ID NO: 7855279 - DNA, 22 bp, Homo sapiens
tggctgagagaagacggggaag

SEQ ID NO: 7855280 - DNA, 22 bp, Homo sapiens
tggctgagaccttcccaaattc

SEQ ID NO: 7855281 - DNA, 16 bp, Homo sapiens
tggctgagagagggtt

SEQ ID NO: 7855282 - DNA, 16 bp, Homo sapiens
tggctgagagagggtt

SEQ ID NO: 7855283 - DNA, 22 bp, Homo sapiens
tggctgagagaagacggggaag

SEQ ID NO: 7855284 - DNA, 22 bp, Homo sapiens
tggctgagagaagacggggaag

SEQ ID NO: 7855285 - DNA, 22 bp, Homo sapiens
tggctgctagccagagcttcag

SEQ ID NO: 7855286 - DNA, 22 bp, Homo sapiens
tggctgctagccagagcttcag

SEQ ID NO: 7855287 - DNA, 16 bp, Homo sapiens
tggctgagagagggtt

SEQ ID NO: 7855288 - DNA, 16 bp, Homo sapiens
tggctgagagagggtt

SEQ ID NO: 7855289 - DNA, 22 bp, Homo sapiens
tggcttcattcagcatgacagt

SEQ ID NO: 7855290 - DNA, 22 bp, Homo sapiens
tggcttcattcagcatgacagt

SEQ ID NO: 7855291 - DNA, 22 bp, Homo sapiens
tggcttccaaattatccctaga

SEQ ID NO: 7855292 - DNA, 22 bp, Homo sapiens
tggcttcattctgtagttaaaa

SEQ ID NO: 7855293 - DNA, 22 bp, Homo sapiens
tggcttcattattgtttttcct

SEQ ID NO: 7855294 - DNA, 22 bp, Homo sapiens
tggcttcattcagcatgacagt

SEQ ID NO: 7855295 - DNA, 22 bp, Homo sapiens
tggcttcattcagcatgacagt

SEQ ID NO: 7855296 - DNA, 22 bp, Homo sapiens
tggcttcatgtagtttgagttg

SEQ ID NO: 7855297 - DNA, 22 bp, Homo sapiens
tggcttcatggcaagtcttagt

SEQ ID NO: 7855298 - DNA, 17 bp, Homo sapiens
tggcttcaggctgagca

SEQ ID NO: 7855299 - DNA, 22 bp, Homo sapiens
tggcttcagttcctgtgttgtt

SEQ ID NO: 7855300 - DNA, 22 bp, Homo sapiens
tggcttcagtctcatcttggaa

SEQ ID NO: 7855301 - DNA, 17 bp, Homo sapiens
tggcttcaggctgagca

SEQ ID NO: 7855302 - DNA, 22 bp, Homo sapiens
tggcttcagtctcatcttggaa

SEQ ID NO: 7855303 - DNA, 22 bp, Homo sapiens
tggcttcagtttcccagtctgg

SEQ ID NO: 7855304 - DNA, 22 bp, Homo sapiens
tggcttcatcactcgggctgcc

SEQ ID NO: 7855305 - DNA, 22 bp, Homo sapiens
tggcttcatctgcagcactgcc

SEQ ID NO: 7855306 - DNA, 22 bp, Homo sapiens
tggcttcatctgcagcactgcc

SEQ ID NO: 7855307 - DNA, 22 bp, Homo sapiens
tggcttcatctgcagcactgcc

SEQ ID NO: 7855308 - DNA, 22 bp, Homo sapiens
tggcttcatggcaagtcttagt

SEQ ID NO: 7855309 - DNA, 22 bp, Homo sapiens
tggctgggagctggaactgggc

SEQ ID NO: 7855310 - DNA, 22 bp, Homo sapiens
tggctgggagctggaactgggc

SEQ ID NO: 7855311 - DNA, 22 bp, Homo sapiens
tggctgggagctggaactgggc

SEQ ID NO: 7855312 - DNA, 22 bp, Homo sapiens
tggctgggagctggaactgggc

SEQ ID NO: 7855313 - DNA, 22 bp, Homo sapiens
tggctggctttcttgtatttac

SEQ ID NO: 7855314 - DNA, 22 bp, Homo sapiens
tggctgggagctggaactgggc

SEQ ID NO: 7855315 - DNA, 20 bp, Homo sapiens
tggctggcttgtatttcctt

SEQ ID NO: 7855316 - DNA, 22 bp, Homo sapiens
tggctggcttgttcactgactg

SEQ ID NO: 7855317 - DNA, 22 bp, Homo sapiens
tggctggcttgttcactgactg

SEQ ID NO: 7855318 - DNA, 20 bp, Homo sapiens
tggctggcttgtatttcctt

SEQ ID NO: 7855319 - DNA, 22 bp, Homo sapiens
tggctggcttgttcactgactg

SEQ ID NO: 7855320 - DNA, 22 bp, Homo sapiens
tggctggctgtcaaggaaagcc

SEQ ID NO: 7855321 - DNA, 22 bp, Homo sapiens
tggctggctgtcaaggaaagcc

SEQ ID NO: 7855322 - DNA, 22 bp, Homo sapiens
tggctggctgtcaaggaaagcc

SEQ ID NO: 7855323 - DNA, 22 bp, Homo sapiens
tggctggctgtcagtaggctgt

SEQ ID NO: 7855324 - DNA, 22 bp, Homo sapiens
tggctggctgtcagtaggctgt

SEQ ID NO: 7855325 - DNA, 22 bp, Homo sapiens
tggctggctgtcagtaggctgt

SEQ ID NO: 7855326 - DNA, 22 bp, Homo sapiens
tggctggctgtcagtaggctgt

SEQ ID NO: 7855327 - DNA, 22 bp, Homo sapiens
tggctggctgtcagtaggctgt

SEQ ID NO: 7855328 - DNA, 22 bp, Homo sapiens
tggctggctgtcaaggaaagcc

SEQ ID NO: 7855329 - DNA, 22 bp, Homo sapiens
tggctggctgtcaaggaaagcc

SEQ ID NO: 7855330 - DNA, 22 bp, Homo sapiens
tggctggctgtccagctgggca

SEQ ID NO: 7855331 - DNA, 22 bp, Homo sapiens
tggctggctgtccagctgggca

SEQ ID NO: 7855332 - DNA, 22 bp, Homo sapiens
tggctggctgtccagctgggca

SEQ ID NO: 7855333 - DNA, 22 bp, Homo sapiens
tggctggctgtccagctgggca

SEQ ID NO: 7855334 - DNA, 22 bp, Homo sapiens
tggctggctgtccagctgggca

SEQ ID NO: 7855335 - DNA, 22 bp, Homo sapiens
cctctgctccctggtgtctgag

SEQ ID NO: 7855336 - DNA, 21 bp, Homo sapiens
cctctgctcgggcatgcgttt

SEQ ID NO: 7855337 - DNA, 22 bp, Homo sapiens
cctctgctctggtccatgtgct

SEQ ID NO: 7855338 - DNA, 22 bp, Homo sapiens
cctctgctgctgttgagcaccg

SEQ ID NO: 7855339 - DNA, 22 bp, Homo sapiens
cctctgctctggtccatgtgct

SEQ ID NO: 7855340 - DNA, 20 bp, Homo sapiens
cctctgcctttctagtctga

SEQ ID NO: 7855341 - DNA, 20 bp, Homo sapiens
cctctgcctttctagtctga

SEQ ID NO: 7855342 - DNA, 22 bp, Homo sapiens
cctctgcgcccttgatcagcca

SEQ ID NO: 7855343 - DNA, 22 bp, Homo sapiens
cctctgcctttagtgaaagttg

SEQ ID NO: 7855344 - DNA, 20 bp, Homo sapiens
cctctgcctttctagtctga

SEQ ID NO: 7855345 - DNA, 22 bp, Homo sapiens
cctctgcctttagtgaaagttg

SEQ ID NO: 7855346 - DNA, 20 bp, Homo sapiens
cctctgcctttctagtctga

SEQ ID NO: 7855347 - DNA, 20 bp, Homo sapiens
cctctgcctttctagtctga

SEQ ID NO: 7855348 - DNA, 22 bp, Homo sapiens
tggcttccagaactgagcaaca

SEQ ID NO: 7855349 - DNA, 22 bp, Homo sapiens
tggcttccagaactgagcaaca

SEQ ID NO: 7855350 - DNA, 22 bp, Homo sapiens
tggcttccactgtgtgccccct

SEQ ID NO: 7855351 - DNA, 22 bp, Homo sapiens
tggcttccagagctgctccacc

SEQ ID NO: 7855352 - DNA, 22 bp, Homo sapiens
tggcttccagtaatcaggattt

SEQ ID NO: 7855353 - DNA, 16 bp, Homo sapiens
tggcttcccagagata

SEQ ID NO: 7855354 - DNA, 19 bp, Homo sapiens
tggcttccatctctctcat

SEQ ID NO: 7855355 - DNA, 22 bp, Homo sapiens
tggcttccagtaatcaggattt

SEQ ID NO: 7855356 - DNA, 22 bp, Homo sapiens
cctctgagtagactggacatga

SEQ ID NO: 7855357 - DNA, 22 bp, Homo sapiens
cctctgagtcatgcgcatagga

SEQ ID NO: 7855358 - DNA, 22 bp, Homo sapiens
cctctgagtacagtgatggatt

SEQ ID NO: 7855359 - DNA, 22 bp, Homo sapiens
cctctgcctgcacatcatcctg

SEQ ID NO: 7855360 - DNA, 22 bp, Homo sapiens
cctctgcctgcacatcatcctg

SEQ ID NO: 7855361 - DNA, 22 bp, Homo sapiens
cctctgcccttttcctgtatca

SEQ ID NO: 7855362 - DNA, 22 bp, Homo sapiens
cctctgagtcatgcgcatagga

SEQ ID NO: 7855363 - DNA, 22 bp, Homo sapiens
cctctgagtcctccctggttgc

SEQ ID NO: 7855364 - DNA, 20 bp, Homo sapiens
cctctgccccggggctgcta

SEQ ID NO: 7855365 - DNA, 20 bp, Homo sapiens
cctctgccccggggctgcta

SEQ ID NO: 7855366 - DNA, 20 bp, Homo sapiens
cctctgccccggggctgcta

SEQ ID NO: 7855367 - DNA, 22 bp, Homo sapiens
cctcttccagctgttgcttcca

SEQ ID NO: 7855368 - DNA, 22 bp, Homo sapiens
cctcttccagctgttgcttcca

SEQ ID NO: 7855369 - DNA, 22 bp, Homo sapiens
cctcttccagctgttgcttcca

SEQ ID NO: 7855370 - DNA, 22 bp, Homo sapiens
cctcttccagctgttgcttcca

SEQ ID NO: 7855371 - DNA, 19 bp, Homo sapiens
cctctgtgggagtcagtga

SEQ ID NO: 7855372 - DNA, 22 bp, Homo sapiens
cctctgtggccttggaccagct

SEQ ID NO: 7855373 - DNA, 22 bp, Homo sapiens
cctctgtggccctgactctctt

SEQ ID NO: 7855374 - DNA, 22 bp, Homo sapiens
tgggaaggcagtcactgtccta

SEQ ID NO: 7855375 - DNA, 22 bp, Homo sapiens
tgggaaggcagtcactgtccta

SEQ ID NO: 7855376 - DNA, 22 bp, Homo sapiens
tgggaaggcagtcactgtccta

SEQ ID NO: 7855377 - DNA, 22 bp, Homo sapiens
tgggaaggacgtgtcagtggca

SEQ ID NO: 7855378 - DNA, 22 bp, Homo sapiens
tgggaaggacgtgtcagtggca

SEQ ID NO: 7855379 - DNA, 22 bp, Homo sapiens
tgggaaggacgtgtcagtggca

SEQ ID NO: 7855380 - DNA, 22 bp, Homo sapiens
tgggaaggacgtgtcagtggca

SEQ ID NO: 7855381 - DNA, 22 bp, Homo sapiens
tgggaaggacgtgtcagtggca

SEQ ID NO: 7855382 - DNA, 22 bp, Homo sapiens
tgggaaggacgtgtcagtggca

SEQ ID NO: 7855383 - DNA, 22 bp, Homo sapiens
tgggaaggatacgttacaagat

SEQ ID NO: 7855384 - DNA, 22 bp, Homo sapiens
tgggaaggataccttggaacat

SEQ ID NO: 7855385 - DNA, 22 bp, Homo sapiens
tgggaaggataccttggaacat

SEQ ID NO: 7855386 - DNA, 22 bp, Homo sapiens
tgggaaggcagtcactgtccta

SEQ ID NO: 7855387 - DNA, 22 bp, Homo sapiens
tgggaaggatacgttacaagat

SEQ ID NO: 7855388 - DNA, 22 bp, Homo sapiens
cctctggagtcagaccagcttg

SEQ ID NO: 7855389 - DNA, 22 bp, Homo sapiens
cctctggaggctctaagagaga

SEQ ID NO: 7855390 - DNA, 22 bp, Homo sapiens
cctctggaggctctaagagaga

SEQ ID NO: 7855391 - DNA, 22 bp, Homo sapiens
cctctggacttgggacagtgag

SEQ ID NO: 7855392 - DNA, 22 bp, Homo sapiens
cctctggacttgggacagtgag

SEQ ID NO: 7855393 - DNA, 22 bp, Homo sapiens
cctctgctgctgttgagcaccg

SEQ ID NO: 7855394 - DNA, 22 bp, Homo sapiens
tgggaagctgcattttaacaag

SEQ ID NO: 7855395 - DNA, 22 bp, Homo sapiens
tgggaagctgcattttaacaag

SEQ ID NO: 7855396 - DNA, 22 bp, Homo sapiens
tgggaagctgcattttaacaag

SEQ ID NO: 7855397 - DNA, 22 bp, Homo sapiens
tgggaagctgcattttaacaag

SEQ ID NO: 7855398 - DNA, 22 bp, Homo sapiens
tgggaaggaactgcctttagct

SEQ ID NO: 7855399 - DNA, 22 bp, Homo sapiens
tgggaagctttaaatgggtgtc

SEQ ID NO: 7855400 - DNA, 22 bp, Homo sapiens
tgggaaggaactgcctttagct

SEQ ID NO: 7855401 - DNA, 22 bp, Homo sapiens
tgggaaggaactgcctttagct

SEQ ID NO: 7855402 - DNA, 22 bp, Homo sapiens
tgggaaggaactgcctttagct

SEQ ID NO: 7855403 - DNA, 22 bp, Homo sapiens
tgggaaggacgtgtcagtggca

SEQ ID NO: 7855404 - DNA, 22 bp, Homo sapiens
tgggaaggaatggtgattaata

SEQ ID NO: 7855405 - DNA, 22 bp, Homo sapiens
tgggaaggacagaacataattg

SEQ ID NO: 7855406 - DNA, 22 bp, Homo sapiens
tgggaaggaatggtgattaata

SEQ ID NO: 7855407 - DNA, 22 bp, Homo sapiens
tgggctccttgggagcaagtga

SEQ ID NO: 7855408 - DNA, 22 bp, Homo sapiens
tgggctccttgggagcaagtga

SEQ ID NO: 7855409 - DNA, 22 bp, Homo sapiens
tgggctccttgggagcaagtga

SEQ ID NO: 7855410 - DNA, 22 bp, Homo sapiens
tgggctctagactttagtgtgg

SEQ ID NO: 7855411 - DNA, 23 bp, Homo sapiens
tgggcccttggaatctctatttt

SEQ ID NO: 7855412 - DNA, 22 bp, Homo sapiens
tgggcccttatgaagctcaaga

SEQ ID NO: 7855413 - DNA, 22 bp, Homo sapiens
tgggcccttatgaagctcaaga

SEQ ID NO: 7855414 - DNA, 22 bp, Homo sapiens
tgggcccttatgaagctcaaga

SEQ ID NO: 7855415 - DNA, 22 bp, Homo sapiens
tgggctgcggataggcctcgga

SEQ ID NO: 7855416 - DNA, 22 bp, Homo sapiens
tgggctgcggataggcctcgga

SEQ ID NO: 7855417 - DNA, 22 bp, Homo sapiens
tgggctgcggataggcctcgga

SEQ ID NO: 7855418 - DNA, 22 bp, Homo sapiens
tgggctgcggataggcctcgga

SEQ ID NO: 7855419 - DNA, 18 bp, Homo sapiens
tgggctgcctggcctctg

SEQ ID NO: 7855420 - DNA, 18 bp, Homo sapiens
tgggctgcctggcctctg

SEQ ID NO: 7855421 - DNA, 18 bp, Homo sapiens
tgggctgcctggcctctg

SEQ ID NO: 7855422 - DNA, 22 bp, Homo sapiens
tgggctgctgagaatgagagag

SEQ ID NO: 7855423 - DNA, 22 bp, Homo sapiens
tgggctgctgagaatgagagag

SEQ ID NO: 7855424 - DNA, 22 bp, Homo sapiens
tgggctgctgagaatgagagag

SEQ ID NO: 7855425 - DNA, 22 bp, Homo sapiens
tgggctgctgtctgcacatgct

SEQ ID NO: 7855426 - DNA, 22 bp, Homo sapiens
tgggctgctgtctgcacatgct

SEQ ID NO: 7855427 - DNA, 22 bp, Homo sapiens
tgggctgctgtctgcacatgct

SEQ ID NO: 7855428 - DNA, 22 bp, Homo sapiens
tgggctgctgtctgcacatgct

SEQ ID NO: 7855429 - DNA, 22 bp, Homo sapiens
tgggctgctgtctgcacatgct

SEQ ID NO: 7855430 - DNA, 22 bp, Homo sapiens
tgggctgctgttacaggggctg

SEQ ID NO: 7855431 - DNA, 22 bp, Homo sapiens
tgggctgctgttacaggggctg

SEQ ID NO: 7855432 - DNA, 22 bp, Homo sapiens
tgggctgctgtctgcacatgct

SEQ ID NO: 7855433 - DNA, 22 bp, Homo sapiens
tgggcccaagtgcaatgcagtg

SEQ ID NO: 7855434 - DNA, 21 bp, Homo sapiens
tgggcccagctctgtctgttt

SEQ ID NO: 7855435 - DNA, 22 bp, Homo sapiens
tgggcccaagagagtctccaac

SEQ ID NO: 7855436 - DNA, 22 bp, Homo sapiens
tgggcccaagagagtctccaac

SEQ ID NO: 7855437 - DNA, 22 bp, Homo sapiens
tgggcccaagtgcaatgcagtg

SEQ ID NO: 7855438 - DNA, 22 bp, Homo sapiens
tgggcccaggtcctgggagaag

SEQ ID NO: 7855439 - DNA, 22 bp, Homo sapiens
tgggcccatcattgctgtgggc

SEQ ID NO: 7855440 - DNA, 22 bp, Homo sapiens
tgggcccatcattgctgtgggc

SEQ ID NO: 7855441 - DNA, 21 bp, Homo sapiens
tgggcccagttcccgctgggc

SEQ ID NO: 7855442 - DNA, 21 bp, Homo sapiens
tgggcccagttcccgctgggc

SEQ ID NO: 7855443 - DNA, 22 bp, Homo sapiens
tgggccctgacttcaagcatcc

SEQ ID NO: 7855444 - DNA, 22 bp, Homo sapiens
tgggccctgacttcaagcatcc

SEQ ID NO: 7855445 - DNA, 22 bp, Homo sapiens
tgggccctgacttcaagcatcc

SEQ ID NO: 7855446 - DNA, 22 bp, Homo sapiens
tgggccctgacttcaagcatcc

SEQ ID NO: 7855447 - DNA, 22 bp, Homo sapiens
tgggccccttggtttcctgagc

SEQ ID NO: 7855448 - DNA, 22 bp, Homo sapiens
tgggcccatcattgctgtgggc

SEQ ID NO: 7855449 - DNA, 22 bp, Homo sapiens
tgggcccatcattgctgtgggc

SEQ ID NO: 7855450 - DNA, 22 bp, Homo sapiens
tgggccccagcacgtctgggga

SEQ ID NO: 7855451 - DNA, 22 bp, Homo sapiens
tgggccccagcacgtctgggga

SEQ ID NO: 7855452 - DNA, 22 bp, Homo sapiens
tgggccctgcccttgtctgtcc

SEQ ID NO: 7855453 - DNA, 23 bp, Homo sapiens
tgggccctggagtcgccagtctg

SEQ ID NO: 7855454 - DNA, 22 bp, Homo sapiens
tgggccctgcccttgtctgtcc

SEQ ID NO: 7855455 - DNA, 22 bp, Homo sapiens
tgggccctgcccttgtctgtcc

SEQ ID NO: 7855456 - DNA, 22 bp, Homo sapiens
tgggccctggtggccatgcctc

SEQ ID NO: 7855457 - DNA, 22 bp, Homo sapiens
tgggccctggtggccatgcctc

SEQ ID NO: 7855458 - DNA, 22 bp, Homo sapiens
tgggccctggtggccatgcctc

SEQ ID NO: 7855459 - DNA, 23 bp, Homo sapiens
tgggccctggagtcgccagtctg

SEQ ID NO: 7855460 - DNA, 23 bp, Homo sapiens
tgggccctggagtcgccagtctg

SEQ ID NO: 7855461 - DNA, 23 bp, Homo sapiens
tgggccctggagtcgccagtctg

SEQ ID NO: 7855462 - DNA, 22 bp, Homo sapiens
cctgagctgaactaagcagttt

SEQ ID NO: 7855463 - DNA, 22 bp, Homo sapiens
cctgagctgaactaagcagttt

SEQ ID NO: 7855464 - DNA, 22 bp, Homo sapiens
cctgagctccagtagcagccag

SEQ ID NO: 7855465 - DNA, 22 bp, Homo sapiens
cctgagctcaagaaggtgacca

SEQ ID NO: 7855466 - DNA, 22 bp, Homo sapiens
cctgagctctgcactttttaga

SEQ ID NO: 7855467 - DNA, 22 bp, Homo sapiens
cctgagctccagtagcagccag

SEQ ID NO: 7855468 - DNA, 22 bp, Homo sapiens
cctgagctcaagaaggtgacca

SEQ ID NO: 7855469 - DNA, 22 bp, Homo sapiens
cctgagctcaagaaggtgacca

SEQ ID NO: 7855470 - DNA, 22 bp, Homo sapiens
cctgagctcaagaaggtgacca

SEQ ID NO: 7855471 - DNA, 22 bp, Homo sapiens
cctgagctagggaaggaagacc

SEQ ID NO: 7855472 - DNA, 22 bp, Homo sapiens
cctgagctcaagaaggtgacca

SEQ ID NO: 7855473 - DNA, 22 bp, Homo sapiens
cctgagctcaagaaggtgacca

SEQ ID NO: 7855474 - DNA, 22 bp, Homo sapiens
cctgagctcaaagggtgcctgg

SEQ ID NO: 7855475 - DNA, 22 bp, Homo sapiens
cctgagctcaaagggtgcctgg

SEQ ID NO: 7855476 - DNA, 22 bp, Homo sapiens
cctgagctcaaagggtgcctgg

SEQ ID NO: 7855477 - DNA, 22 bp, Homo sapiens
cctgagctgactctcctttcag

SEQ ID NO: 7855478 - DNA, 22 bp, Homo sapiens
cctgagctgaactaagcagttt

SEQ ID NO: 7855479 - DNA, 22 bp, Homo sapiens
cctgagctgactctcctttcag

SEQ ID NO: 7855480 - DNA, 22 bp, Homo sapiens
cctgagctgcggggcagtgctc

SEQ ID NO: 7855481 - DNA, 22 bp, Homo sapiens
cctgagctgcggggcagtgctc

SEQ ID NO: 7855482 - DNA, 22 bp, Homo sapiens
cctgagctggaagagcttgtgc

SEQ ID NO: 7855483 - DNA, 22 bp, Homo sapiens
cctgagctgcggggcagtgctc

SEQ ID NO: 7855484 - DNA, 22 bp, Homo sapiens
cctgagctgcggggcagtgctc

SEQ ID NO: 7855485 - DNA, 22 bp, Homo sapiens
cctgagctgcggggcagtgctc

SEQ ID NO: 7855486 - DNA, 22 bp, Homo sapiens
cctgagctgcggggcagtgctc

SEQ ID NO: 7855487 - DNA, 22 bp, Homo sapiens
cctgagctgcggggcagtgctc

SEQ ID NO: 7855488 - DNA, 22 bp, Homo sapiens
tggggaggaagtcagatttcag

SEQ ID NO: 7855489 - DNA, 22 bp, Homo sapiens
cctgagctggcagtgacctgga

SEQ ID NO: 7855490 - DNA, 22 bp, Homo sapiens
cctgagctggcagtgacctgga

SEQ ID NO: 7855491 - DNA, 22 bp, Homo sapiens
cctgagctggaagagcttgtgc

SEQ ID NO: 7855492 - DNA, 22 bp, Homo sapiens
cctgagctggaagagcttgtgc

SEQ ID NO: 7855493 - DNA, 22 bp, Homo sapiens
cctgagctggagacattacata

SEQ ID NO: 7855494 - DNA, 22 bp, Homo sapiens
cctgagctggagacattacata

SEQ ID NO: 7855495 - DNA, 22 bp, Homo sapiens
cctgagctagggaaggaagacc

SEQ ID NO: 7855496 - DNA, 21 bp, Homo sapiens
cctgagcctgtttatccagaa

SEQ ID NO: 7855497 - DNA, 22 bp, Homo sapiens
cctgagctagggaaggaagacc

SEQ ID NO: 7855498 - DNA, 21 bp, Homo sapiens
cctgagcctgtttatccagaa

SEQ ID NO: 7855499 - DNA, 21 bp, Homo sapiens
cctgagcctgtttatccagaa

SEQ ID NO: 7855500 - DNA, 22 bp, Homo sapiens
tgggctggcccaccacacctcg

SEQ ID NO: 7855501 - DNA, 22 bp, Homo sapiens
tgggctggagcttgttgcttcc

SEQ ID NO: 7855502 - DNA, 22 bp, Homo sapiens
tgggctggcccaccacacctcg

SEQ ID NO: 7855503 - DNA, 22 bp, Homo sapiens
tgggctggcccaccacacctcg

SEQ ID NO: 7855504 - DNA, 22 bp, Homo sapiens
tgggctggcccaccacacctcg

SEQ ID NO: 7855505 - DNA, 22 bp, Homo sapiens
cctgagcctggctcatgcactc

SEQ ID NO: 7855506 - DNA, 22 bp, Homo sapiens
tgggctgcttcctcagctgaga

SEQ ID NO: 7855507 - DNA, 22 bp, Homo sapiens
tgggctgcttcctcagctgaga

SEQ ID NO: 7855508 - DNA, 22 bp, Homo sapiens
tgggctgcttcctcagctgaga

SEQ ID NO: 7855509 - DNA, 22 bp, Homo sapiens
tgggctgcttcctcagctgaga

SEQ ID NO: 7855510 - DNA, 22 bp, Homo sapiens
tgggctgcttctattggtggtc

SEQ ID NO: 7855511 - DNA, 22 bp, Homo sapiens
tgggctgcttctcaaatgtctc

SEQ ID NO: 7855512 - DNA, 22 bp, Homo sapiens
tgggctggagcttgttgcttcc

SEQ ID NO: 7855513 - DNA, 22 bp, Homo sapiens
tgggctggagcttgttgcttcc

SEQ ID NO: 7855514 - DNA, 22 bp, Homo sapiens
tgggctggagcttgttgcttcc

SEQ ID NO: 7855515 - DNA, 22 bp, Homo sapiens
tgggctggagcttgttgcttcc

SEQ ID NO: 7855516 - DNA, 22 bp, Homo sapiens
tgggctggcccaccacacctcg

SEQ ID NO: 7855517 - DNA, 22 bp, Homo sapiens
tgggctggagcttgttgcttcc

SEQ ID NO: 7855518 - DNA, 22 bp, Homo sapiens
cctgagatttcattgtctggcc

SEQ ID NO: 7855519 - DNA, 22 bp, Homo sapiens
cctgagatttgtaatttttgta

SEQ ID NO: 7855520 - DNA, 22 bp, Homo sapiens
cctgagatttgtaatttttgta

SEQ ID NO: 7855521 - DNA, 22 bp, Homo sapiens
cctgagcaaaggcccagaggga

SEQ ID NO: 7855522 - DNA, 22 bp, Homo sapiens
cctgagcacacatcagaatcac

SEQ ID NO: 7855523 - DNA, 22 bp, Homo sapiens
cctgagcacacatcagaatcac

SEQ ID NO: 7855524 - DNA, 19 bp, Homo sapiens
cctgagattcctccttttc

SEQ ID NO: 7855525 - DNA, 22 bp, Homo sapiens
cctgagatggggattattccaa

SEQ ID NO: 7855526 - DNA, 22 bp, Homo sapiens
cctgagatggccagtgctggga

SEQ ID NO: 7855527 - DNA, 21 bp, Homo sapiens
cctgagatctggagtggcttt

SEQ ID NO: 7855528 - DNA, 23 bp, Homo sapiens
cctgagatctgtaagggaccttg

SEQ ID NO: 7855529 - DNA, 21 bp, Homo sapiens
cctgagatctggagtggcttt

SEQ ID NO: 7855530 - DNA, 22 bp, Homo sapiens
cctgagatggccagtgctggga

SEQ ID NO: 7855531 - DNA, 23 bp, Homo sapiens
cctgagatctgtaagggaccttg

SEQ ID NO: 7855532 - DNA, 23 bp, Homo sapiens
cctgagatctgtaagggaccttg

SEQ ID NO: 7855533 - DNA, 22 bp, Homo sapiens
cctgagagagaagcgacctggt

SEQ ID NO: 7855534 - DNA, 21 bp, Homo sapiens
cctgagatctggagtggcttt

SEQ ID NO: 7855535 - DNA, 22 bp, Homo sapiens
cctgagatcagtgcatttggtg

SEQ ID NO: 7855536 - DNA, 22 bp, Homo sapiens
cctgagaccaagttgcagccat

SEQ ID NO: 7855537 - DNA, 22 bp, Homo sapiens
tgggagttgggtgggagacttc

SEQ ID NO: 7855538 - DNA, 23 bp, Homo sapiens
tgggagttgagtgaggttgcttt

SEQ ID NO: 7855539 - DNA, 22 bp, Homo sapiens
tgggagtgttcttggcttgctt

SEQ ID NO: 7855540 - DNA, 23 bp, Homo sapiens
tgggagtgttgggatctctgctc

SEQ ID NO: 7855541 - DNA, 22 bp, Homo sapiens
cctgagcctgcagccgagcaga

SEQ ID NO: 7855542 - DNA, 22 bp, Homo sapiens
cctgagcctgcagccgagcaga

SEQ ID NO: 7855543 - DNA, 22 bp, Homo sapiens
tgggccagtttctcattgaaat

SEQ ID NO: 7855544 - DNA, 22 bp, Homo sapiens
tgggccagtttctcattgaaat

SEQ ID NO: 7855545 - DNA, 22 bp, Homo sapiens
cctgagcctggctcatgcactc

SEQ ID NO: 7855546 - DNA, 22 bp, Homo sapiens
tgggcccaagagagtctccaac

SEQ ID NO: 7855547 - DNA, 22 bp, Homo sapiens
tgggccatttttggaagactgg

SEQ ID NO: 7855548 - DNA, 22 bp, Homo sapiens
cctgagcctgagtggtgcaggg

SEQ ID NO: 7855549 - DNA, 22 bp, Homo sapiens
cctgagcctgcagccgagcaga

SEQ ID NO: 7855550 - DNA, 22 bp, Homo sapiens
cctgagcctgcagccgagcaga

SEQ ID NO: 7855551 - DNA, 22 bp, Homo sapiens
cctgagcctgagtggtgcaggg

SEQ ID NO: 7855552 - DNA, 22 bp, Homo sapiens
cctgagcctgagtggtgcaggg

SEQ ID NO: 7855553 - DNA, 22 bp, Homo sapiens
cctgagcctgagtggtgcaggg

SEQ ID NO: 7855554 - DNA, 22 bp, Homo sapiens
cctgagccgagcgctctttctc

SEQ ID NO: 7855555 - DNA, 22 bp, Homo sapiens
cctgagccgagcgctctttctc

SEQ ID NO: 7855556 - DNA, 22 bp, Homo sapiens
cctgagccaagagtcagaatct

SEQ ID NO: 7855557 - DNA, 22 bp, Homo sapiens
cctgagccgagcgctctttctc

SEQ ID NO: 7855558 - DNA, 22 bp, Homo sapiens
cctgagccaagagtcagaatct

SEQ ID NO: 7855559 - DNA, 18 bp, Homo sapiens
cctgagccctgcttactt

SEQ ID NO: 7855560 - DNA, 18 bp, Homo sapiens
cctgagccctgcttactt

SEQ ID NO: 7855561 - DNA, 22 bp, Homo sapiens
cctgagcatcagcgcctcctta

SEQ ID NO: 7855562 - DNA, 22 bp, Homo sapiens
cctgagcatcagcgcctcctta

SEQ ID NO: 7855563 - DNA, 22 bp, Homo sapiens
cctgagcagggctctgcagggc

SEQ ID NO: 7855564 - DNA, 22 bp, Homo sapiens
cctgagcagggctctgcagggc

SEQ ID NO: 7855565 - DNA, 22 bp, Homo sapiens
cctgagcagggctctgcagggc

SEQ ID NO: 7855566 - DNA, 22 bp, Homo sapiens
cctgagcagctctgaggggcga

SEQ ID NO: 7855567 - DNA, 22 bp, Homo sapiens
cctgagcagggctctgcagggc

SEQ ID NO: 7855568 - DNA, 22 bp, Homo sapiens
cctcttcctgcactgacatttt

SEQ ID NO: 7855569 - DNA, 22 bp, Homo sapiens
cctcttccttctcactgtggaa

SEQ ID NO: 7855570 - DNA, 22 bp, Homo sapiens
cctcttccttctcactgtggaa

SEQ ID NO: 7855571 - DNA, 22 bp, Homo sapiens
cctcttccttctcactgtggaa

SEQ ID NO: 7855572 - DNA, 19 bp, Homo sapiens
cctcttcctctgacactat

SEQ ID NO: 7855573 - DNA, 19 bp, Homo sapiens
cctcttcctctgacactat

SEQ ID NO: 7855574 - DNA, 19 bp, Homo sapiens
cctcttcctctgacactat

SEQ ID NO: 7855575 - DNA, 17 bp, Homo sapiens
cctcttcctctcagctg

SEQ ID NO: 7855576 - DNA, 17 bp, Homo sapiens
cctcttcctctcagctg

SEQ ID NO: 7855577 - DNA, 17 bp, Homo sapiens
cctcttcctctcagctg

SEQ ID NO: 7855578 - DNA, 17 bp, Homo sapiens
cctcttcctctcagctg

SEQ ID NO: 7855579 - DNA, 17 bp, Homo sapiens
cctcttcctctcagctg

SEQ ID NO: 7855580 - DNA, 17 bp, Homo sapiens
cctcttcctctcagctg

SEQ ID NO: 7855581 - DNA, 22 bp, Homo sapiens
cctcttcctcaccatctacaac

SEQ ID NO: 7855582 - DNA, 17 bp, Homo sapiens
cctcttcctctcagctg

SEQ ID NO: 7855583 - DNA, 17 bp, Homo sapiens
cctcttcctctcagctg

SEQ ID NO: 7855584 - DNA, 22 bp, Homo sapiens
cctcttctaggacgtccttgtg

SEQ ID NO: 7855585 - DNA, 22 bp, Homo sapiens
cctcttctaggtttcagcctgc

SEQ ID NO: 7855586 - DNA, 22 bp, Homo sapiens
cctcttctaggtttcagcctgc

SEQ ID NO: 7855587 - DNA, 22 bp, Homo sapiens
cctcttctaggtttcagcctgc

SEQ ID NO: 7855588 - DNA, 22 bp, Homo sapiens
cctcttctaggtttcagcctgc

SEQ ID NO: 7855589 - DNA, 22 bp, Homo sapiens
cctcttctcaactccagccaga

SEQ ID NO: 7855590 - DNA, 22 bp, Homo sapiens
cctcttctaggtttcagcctgc

SEQ ID NO: 7855591 - DNA, 22 bp, Homo sapiens
cctcttctaggacgtccttgtg

SEQ ID NO: 7855592 - DNA, 22 bp, Homo sapiens
cctcttctaggacgtccttgtg

SEQ ID NO: 7855593 - DNA, 22 bp, Homo sapiens
cctcttccttctcactgtggaa

SEQ ID NO: 7855594 - DNA, 22 bp, Homo sapiens
cctcttctaggacgtccttgtg

SEQ ID NO: 7855595 - DNA, 22 bp, Homo sapiens
cctcttctaggacgtccttgtg

SEQ ID NO: 7855596 - DNA, 22 bp, Homo sapiens
tgggagtggggcatagaaggta

SEQ ID NO: 7855597 - DNA, 22 bp, Homo sapiens
tgggagtggggcatagaaggta

SEQ ID NO: 7855598 - DNA, 22 bp, Homo sapiens
tgggagtggggcatagaaggta

SEQ ID NO: 7855599 - DNA, 22 bp, Homo sapiens
tgggagtggggcatagaaggta

SEQ ID NO: 7855600 - DNA, 19 bp, Homo sapiens
tgggagtggggaaggtcct

SEQ ID NO: 7855601 - DNA, 19 bp, Homo sapiens
tgggagtggggaaggtcct

SEQ ID NO: 7855602 - DNA, 19 bp, Homo sapiens
tgggagtggggaaggtcct

SEQ ID NO: 7855603 - DNA, 22 bp, Homo sapiens
tgggagtgttcttggcttgctt

SEQ ID NO: 7855604 - DNA, 22 bp, Homo sapiens
tgggagtgttcttggcttgctt

SEQ ID NO: 7855605 - DNA, 22 bp, Homo sapiens
tgggagtgttcttggcttgctt

SEQ ID NO: 7855606 - DNA, 22 bp, Homo sapiens
tgggagtgttcttggcttgctt

SEQ ID NO: 7855607 - DNA, 22 bp, Homo sapiens
tgggagtgttcttggcttgctt

SEQ ID NO: 7855608 - DNA, 22 bp, Homo sapiens
tgggagtggggcatagaaggta

SEQ ID NO: 7855609 - DNA, 22 bp, Homo sapiens
tgggagtggggcatagaaggta

SEQ ID NO: 7855610 - DNA, 22 bp, Homo sapiens
tgggagtgtaaattagttcaac

SEQ ID NO: 7855611 - DNA, 18 bp, Homo sapiens
tgggagtgggagtggata

SEQ ID NO: 7855612 - DNA, 18 bp, Homo sapiens
tgggagtgggagtggata

SEQ ID NO: 7855613 - DNA, 18 bp, Homo sapiens
tgggagtgggagtggata

SEQ ID NO: 7855614 - DNA, 18 bp, Homo sapiens
tgggagtgggagtggata

SEQ ID NO: 7855615 - DNA, 19 bp, Homo sapiens
tgggagtggggaaggtcct

SEQ ID NO: 7855616 - DNA, 19 bp, Homo sapiens
tgggagtggggaaggtcct

SEQ ID NO: 7855617 - DNA, 18 bp, Homo sapiens
tgggagtgggagtggata

SEQ ID NO: 7855618 - DNA, 18 bp, Homo sapiens
tgggagtgggagtggata

SEQ ID NO: 7855619 - DNA, 19 bp, Homo sapiens
cctcttctctggcagcaga

SEQ ID NO: 7855620 - DNA, 18 bp, Homo sapiens
tgggagtgggagtggata

SEQ ID NO: 7855621 - DNA, 18 bp, Homo sapiens
tgggagtgggagtggata

SEQ ID NO: 7855622 - DNA, 18 bp, Homo sapiens
tgggagtgggagtggata

SEQ ID NO: 7855623 - DNA, 22 bp, Homo sapiens
cctcttctcaactccagccaga

SEQ ID NO: 7855624 - DNA, 22 bp, Homo sapiens
cctcttctcaactccagccaga

SEQ ID NO: 7855625 - DNA, 22 bp, Homo sapiens
tggctctgtcaaactgcacaca

SEQ ID NO: 7855626 - DNA, 22 bp, Homo sapiens
tggctctgtcaaactgcacaca

SEQ ID NO: 7855627 - DNA, 22 bp, Homo sapiens
tggctctggtgcgggctcctgc

SEQ ID NO: 7855628 - DNA, 22 bp, Homo sapiens
tggctctgtcaaactgcacaca

SEQ ID NO: 7855629 - DNA, 22 bp, Homo sapiens
tggctctgtcaaactgcacaca

SEQ ID NO: 7855630 - DNA, 22 bp, Homo sapiens
tggctctgtcaaactgcacaca

SEQ ID NO: 7855631 - DNA, 22 bp, Homo sapiens
tggctctgtcactgtgagctat

SEQ ID NO: 7855632 - DNA, 22 bp, Homo sapiens
tggctctgtcaaactgcacaca

SEQ ID NO: 7855633 - DNA, 22 bp, Homo sapiens
tggctctggtgcgggctcctgc

SEQ ID NO: 7855634 - DNA, 22 bp, Homo sapiens
tggctctggtgcgggctcctgc

SEQ ID NO: 7855635 - DNA, 22 bp, Homo sapiens
tggcctggggaagaccatgggc

SEQ ID NO: 7855636 - DNA, 22 bp, Homo sapiens
tggctctggtgcgggctcctgc

SEQ ID NO: 7855637 - DNA, 22 bp, Homo sapiens
tggctctggtgcgggctcctgc

SEQ ID NO: 7855638 - DNA, 22 bp, Homo sapiens
tggctctggtgcgggctcctgc

SEQ ID NO: 7855639 - DNA, 22 bp, Homo sapiens
tggctctggtaacattgggtag

SEQ ID NO: 7855640 - DNA, 22 bp, Homo sapiens
tggctctggtgcgggctcctgc

SEQ ID NO: 7855641 - DNA, 21 bp, Homo sapiens
tggctctgggtaggagagtgc

SEQ ID NO: 7855642 - DNA, 21 bp, Homo sapiens
tggctctgggtaggagagtgc

SEQ ID NO: 7855643 - DNA, 22 bp, Homo sapiens
tggctctgagacacaggctctc

SEQ ID NO: 7855644 - DNA, 22 bp, Homo sapiens
tggctctgagacacaggctctc

SEQ ID NO: 7855645 - DNA, 22 bp, Homo sapiens
tggctctgagacacaggctctc

SEQ ID NO: 7855646 - DNA, 22 bp, Homo sapiens
tggctctgagacacaggctctc

SEQ ID NO: 7855647 - DNA, 22 bp, Homo sapiens
tggctctgagacacaggctctc

SEQ ID NO: 7855648 - DNA, 22 bp, Homo sapiens
tggctctgagacacaggctctc

SEQ ID NO: 7855649 - DNA, 22 bp, Homo sapiens
tggctctgagacacaggctctc

SEQ ID NO: 7855650 - DNA, 21 bp, Homo sapiens
tggctctgggtaggagagtgc

SEQ ID NO: 7855651 - DNA, 21 bp, Homo sapiens
tggctctgggtaggagagtgc

SEQ ID NO: 7855652 - DNA, 21 bp, Homo sapiens
tggctctgggtaggagagtgc

SEQ ID NO: 7855653 - DNA, 21 bp, Homo sapiens
tggctctgggtaggagagtgc

SEQ ID NO: 7855654 - DNA, 22 bp, Homo sapiens
tggctctggtaacattgggtag

SEQ ID NO: 7855655 - DNA, 22 bp, Homo sapiens
tggctctggtaacattgggtag

SEQ ID NO: 7855656 - DNA, 22 bp, Homo sapiens
tggctctggtaacattgggtag

SEQ ID NO: 7855657 - DNA, 21 bp, Homo sapiens
tggctctgggtaggagagtgc

SEQ ID NO: 7855658 - DNA, 22 bp, Homo sapiens
tggcctgggcctgccggtgcaa

SEQ ID NO: 7855659 - DNA, 22 bp, Homo sapiens
tggcctgggcctgccggtgcaa

SEQ ID NO: 7855660 - DNA, 22 bp, Homo sapiens
tggcctggggaagaccatgggc

SEQ ID NO: 7855661 - DNA, 22 bp, Homo sapiens
tggcctggggaagaccatgggc

SEQ ID NO: 7855662 - DNA, 22 bp, Homo sapiens
tggcctggggaagaccatgggc

SEQ ID NO: 7855663 - DNA, 22 bp, Homo sapiens
tggcctggggaagaccatgggc

SEQ ID NO: 7855664 - DNA, 22 bp, Homo sapiens
tggcctggggaagaccatgggc

SEQ ID NO: 7855665 - DNA, 22 bp, Homo sapiens
tggcctggggacctgtgagacc

SEQ ID NO: 7855666 - DNA, 22 bp, Homo sapiens
tggcctggggacctgtgagacc

SEQ ID NO: 7855667 - DNA, 22 bp, Homo sapiens
tggcctggggacctgtgagacc

SEQ ID NO: 7855668 - DNA, 22 bp, Homo sapiens
tggcctgggcatgaagcatcgt

SEQ ID NO: 7855669 - DNA, 22 bp, Homo sapiens
tggcctgggcatgaagcatcgt

SEQ ID NO: 7855670 - DNA, 22 bp, Homo sapiens
tggcctgggcatgaagcatcgt

SEQ ID NO: 7855671 - DNA, 22 bp, Homo sapiens
tggcctggctgccctgtctgga

SEQ ID NO: 7855672 - DNA, 22 bp, Homo sapiens
tggcctggctgccctgtctgga

SEQ ID NO: 7855673 - DNA, 22 bp, Homo sapiens
tggcctggctgccctgtctgga

SEQ ID NO: 7855674 - DNA, 22 bp, Homo sapiens
tggcctgggccggcagatatac

SEQ ID NO: 7855675 - DNA, 22 bp, Homo sapiens
tggcctgggccggcagatatac

SEQ ID NO: 7855676 - DNA, 22 bp, Homo sapiens
tggcctgggcctgccggtgcaa

SEQ ID NO: 7855677 - DNA, 22 bp, Homo sapiens
tggcctgggccggcagatatac

SEQ ID NO: 7855678 - DNA, 22 bp, Homo sapiens
tggcctgggccggcagatatac

SEQ ID NO: 7855679 - DNA, 22 bp, Homo sapiens
tggcctgggcatgaagcatcgt

SEQ ID NO: 7855680 - DNA, 22 bp, Homo sapiens
tggcctgggcatgaagcatcgt

SEQ ID NO: 7855681 - DNA, 22 bp, Homo sapiens
tggcctgggccggcagatatac

SEQ ID NO: 7855682 - DNA, 23 bp, Homo sapiens
cctcatgaaggtctgcttcctgg

SEQ ID NO: 7855683 - DNA, 19 bp, Homo sapiens
cctcatcttggtgtgtgca

SEQ ID NO: 7855684 - DNA, 22 bp, Homo sapiens
cctcatggccttgagctgaggg

SEQ ID NO: 7855685 - DNA, 22 bp, Homo sapiens
cctcatggacctcagactgtcc

SEQ ID NO: 7855686 - DNA, 22 bp, Homo sapiens
cctcatggccttgagctgaggg

SEQ ID NO: 7855687 - DNA, 22 bp, Homo sapiens
cctcatggccttgagctgaggg

SEQ ID NO: 7855688 - DNA, 22 bp, Homo sapiens
cctccaaccataggtccagggg

SEQ ID NO: 7855689 - DNA, 22 bp, Homo sapiens
cctccaaccataggtccagggg

SEQ ID NO: 7855690 - DNA, 22 bp, Homo sapiens
tggcctggctgccctgtctgga

SEQ ID NO: 7855691 - DNA, 22 bp, Homo sapiens
tggcctggctgccctgtctgga

SEQ ID NO: 7855692 - DNA, 22 bp, Homo sapiens
tggcctggctgccctgtctgga

SEQ ID NO: 7855693 - DNA, 22 bp, Homo sapiens
tggcctggctgccctgtctgga

SEQ ID NO: 7855694 - DNA, 22 bp, Homo sapiens
tggcctggctgccctgtctgga

SEQ ID NO: 7855695 - DNA, 22 bp, Homo sapiens
tggcctggctcacagtgagatt

SEQ ID NO: 7855696 - DNA, 22 bp, Homo sapiens
cctccaagtgagagatggtaca

SEQ ID NO: 7855697 - DNA, 22 bp, Homo sapiens
cctccaagcttcatctcaacca

SEQ ID NO: 7855698 - DNA, 22 bp, Homo sapiens
cctccaagctggtcctctgtgt

SEQ ID NO: 7855699 - DNA, 22 bp, Homo sapiens
cctccaagctggtcctctgtgt

SEQ ID NO: 7855700 - DNA, 22 bp, Homo sapiens
cctccaagcttcatctcaacca

SEQ ID NO: 7855701 - DNA, 22 bp, Homo sapiens
cctccaaggctgagttaatgaa

SEQ ID NO: 7855702 - DNA, 22 bp, Homo sapiens
cctccaaggtgagagaggatgg

SEQ ID NO: 7855703 - DNA, 18 bp, Homo sapiens
cctccaagtccccagcct

SEQ ID NO: 7855704 - DNA, 18 bp, Homo sapiens
cctccaagtccccagcct

SEQ ID NO: 7855705 - DNA, 22 bp, Homo sapiens
cctccaaggtgagagaggatgg

SEQ ID NO: 7855706 - DNA, 22 bp, Homo sapiens
cctccaaggtgagagaggatgg

SEQ ID NO: 7855707 - DNA, 22 bp, Homo sapiens
cctcagtttatcctctgtaaca

SEQ ID NO: 7855708 - DNA, 22 bp, Homo sapiens
cctcagttttctcatctgtaaa

SEQ ID NO: 7855709 - DNA, 22 bp, Homo sapiens
cctcatctgtcatcctagggaa

SEQ ID NO: 7855710 - DNA, 22 bp, Homo sapiens
cctcatcgtttccagaatgtgg

SEQ ID NO: 7855711 - DNA, 22 bp, Homo sapiens
cctcatcgtttccagaatgtgg

SEQ ID NO: 7855712 - DNA, 20 bp, Homo sapiens
cctcatctcaagggcagtcc

SEQ ID NO: 7855713 - DNA, 20 bp, Homo sapiens
cctcagtgtcctggactggg

SEQ ID NO: 7855714 - DNA, 20 bp, Homo sapiens
cctcagtgtcctggactggg

SEQ ID NO: 7855715 - DNA, 22 bp, Homo sapiens
cctcagtgtgcagcagcatctg

SEQ ID NO: 7855716 - DNA, 22 bp, Homo sapiens
cctcagtgtgcagcagcatctg

SEQ ID NO: 7855717 - DNA, 22 bp, Homo sapiens
cctcagtgtgcagcagcatctg

SEQ ID NO: 7855718 - DNA, 22 bp, Homo sapiens
cctcagtgtgtggatgttagag

SEQ ID NO: 7855719 - DNA, 22 bp, Homo sapiens
cctcagtgtgtttggggtgagg

SEQ ID NO: 7855720 - DNA, 22 bp, Homo sapiens
cctcagtgtgtttggggtgagg

SEQ ID NO: 7855721 - DNA, 22 bp, Homo sapiens
cctcagtgtgtggatgttagag

SEQ ID NO: 7855722 - DNA, 22 bp, Homo sapiens
cctcagtgttaggataagagaa

SEQ ID NO: 7855723 - DNA, 22 bp, Homo sapiens
cctcagtgtgtttggggtgagg

SEQ ID NO: 7855724 - DNA, 18 bp, Homo sapiens
cctcagggagagagacgc

SEQ ID NO: 7855725 - DNA, 22 bp, Homo sapiens
cctcagggactccatgctgcag

SEQ ID NO: 7855726 - DNA, 18 bp, Homo sapiens
cctcagggagagagacgc

SEQ ID NO: 7855727 - DNA, 22 bp, Homo sapiens
cctcagtgagtgtttccttctt

SEQ ID NO: 7855728 - DNA, 22 bp, Homo sapiens
cctcagtgagtgtttccttctt

SEQ ID NO: 7855729 - DNA, 22 bp, Homo sapiens
cctcagtgagtgtttccttctt

SEQ ID NO: 7855730 - DNA, 22 bp, Homo sapiens
cctcagtgcgtactgaacagtg

SEQ ID NO: 7855731 - DNA, 20 bp, Homo sapiens
cctcagtgtcctggactggg

SEQ ID NO: 7855732 - DNA, 20 bp, Homo sapiens
cctcagtgtcctggactggg

SEQ ID NO: 7855733 - DNA, 22 bp, Homo sapiens
cctcagtgcgtactgaacagtg

SEQ ID NO: 7855734 - DNA, 22 bp, Homo sapiens
cctcagtgcgtactgaacagtg

SEQ ID NO: 7855735 - DNA, 22 bp, Homo sapiens
cctcaggctagctactgtccct

SEQ ID NO: 7855736 - DNA, 22 bp, Homo sapiens
cctcaggctagctactgtccct

SEQ ID NO: 7855737 - DNA, 22 bp, Homo sapiens
cctcaggcctgccagagcccca

SEQ ID NO: 7855738 - DNA, 22 bp, Homo sapiens
cctcaggctctgggtgcctacc

SEQ ID NO: 7855739 - DNA, 22 bp, Homo sapiens
cctcaggctctgggtgcctacc

SEQ ID NO: 7855740 - DNA, 22 bp, Homo sapiens
cctcaggctagctactgtccct

SEQ ID NO: 7855741 - DNA, 22 bp, Homo sapiens
cctcaggcctgccagagcccca

SEQ ID NO: 7855742 - DNA, 22 bp, Homo sapiens
cctcaggcctgccagagcccca

SEQ ID NO: 7855743 - DNA, 22 bp, Homo sapiens
cctcaggcctctgcctcattgg

SEQ ID NO: 7855744 - DNA, 22 bp, Homo sapiens
cctcagcttgatttctgcagag

SEQ ID NO: 7855745 - DNA, 22 bp, Homo sapiens
cctcaggcctctgcctcattgg

SEQ ID NO: 7855746 - DNA, 22 bp, Homo sapiens
cctcaggcctgccagagcccca

SEQ ID NO: 7855747 - DNA, 22 bp, Homo sapiens
cctcaggcctctgcctcattgg

SEQ ID NO: 7855748 - DNA, 22 bp, Homo sapiens
cctcaggctgggctgcccctgg

SEQ ID NO: 7855749 - DNA, 22 bp, Homo sapiens
cctcaggctgggctgcccctgg

SEQ ID NO: 7855750 - DNA, 22 bp, Homo sapiens
cctcaggctgctcacacttgtc

SEQ ID NO: 7855751 - DNA, 22 bp, Homo sapiens
cctcaggctgctcacacttgtc

SEQ ID NO: 7855752 - DNA, 22 bp, Homo sapiens
cctcaggctgctcacacttgtc

SEQ ID NO: 7855753 - DNA, 22 bp, Homo sapiens
cctcaggctctgggtgcctacc

SEQ ID NO: 7855754 - DNA, 22 bp, Homo sapiens
cctcaggctctgggtgcctacc

SEQ ID NO: 7855755 - DNA, 22 bp, Homo sapiens
cctcagggaatgggaggctggg

SEQ ID NO: 7855756 - DNA, 22 bp, Homo sapiens
cctcagggaatgggaggctggg

SEQ ID NO: 7855757 - DNA, 22 bp, Homo sapiens
cctcagggaatgggaggctggg

SEQ ID NO: 7855758 - DNA, 22 bp, Homo sapiens
cctcagggaatgggaggctggg

SEQ ID NO: 7855759 - DNA, 22 bp, Homo sapiens
cctcaggcttgtgagccttcag

SEQ ID NO: 7855760 - DNA, 22 bp, Homo sapiens
cctcagggaatgggaggctggg

SEQ ID NO: 7855761 - DNA, 22 bp, Homo sapiens
cctcagggaatgggaggctggg

SEQ ID NO: 7855762 - DNA, 22 bp, Homo sapiens
cctcaggcttgtgagccttcag

SEQ ID NO: 7855763 - DNA, 22 bp, Homo sapiens
cctcaggcttgtgagccttcag

SEQ ID NO: 7855764 - DNA, 22 bp, Homo sapiens
cctcaggcttgtgagccttcag

SEQ ID NO: 7855765 - DNA, 22 bp, Homo sapiens
cctcaggcttctagttcagtga

SEQ ID NO: 7855766 - DNA, 22 bp, Homo sapiens
cctcaggcttctagttcagtga

SEQ ID NO: 7855767 - DNA, 22 bp, Homo sapiens
cctcaggcttctagttcagtga

SEQ ID NO: 7855768 - DNA, 22 bp, Homo sapiens
cctcaggcttgtgagccttcag

SEQ ID NO: 7855769 - DNA, 22 bp, Homo sapiens
cctcaggcttcgtcttccaccc

SEQ ID NO: 7855770 - DNA, 22 bp, Homo sapiens
cctcaggcttacgggcaatgga

SEQ ID NO: 7855771 - DNA, 22 bp, Homo sapiens
cctcaggcttacgggcaatgga

SEQ ID NO: 7855772 - DNA, 22 bp, Homo sapiens
cctcaggcttacgggcaatgga

SEQ ID NO: 7855773 - DNA, 22 bp, Homo sapiens
cctcaggctgtcttccttctgg

SEQ ID NO: 7855774 - DNA, 22 bp, Homo sapiens
cctcaggcttaacttgtcttga

SEQ ID NO: 7855775 - DNA, 22 bp, Homo sapiens
cctcaggctgggctgcccctgg

SEQ ID NO: 7855776 - DNA, 22 bp, Homo sapiens
cctcaggcttacgggcaatgga

SEQ ID NO: 7855777 - DNA, 22 bp, Homo sapiens
cctcaggcttacgggcaatgga

SEQ ID NO: 7855778 - DNA, 22 bp, Homo sapiens
cctcaggcttacgggcaatgga

SEQ ID NO: 7855779 - DNA, 22 bp, Homo sapiens
cctcaggcttcgtcttccaccc

SEQ ID NO: 7855780 - DNA, 22 bp, Homo sapiens
cctcaggcttcgtcttccaccc

SEQ ID NO: 7855781 - DNA, 22 bp, Homo sapiens
tggcccagagcactgctgggca

SEQ ID NO: 7855782 - DNA, 22 bp, Homo sapiens
tggcccagagcactgctgggca

SEQ ID NO: 7855783 - DNA, 22 bp, Homo sapiens
cctcagcatcctcctgctcagt

SEQ ID NO: 7855784 - DNA, 22 bp, Homo sapiens
tggcccagagcactgctgggca

SEQ ID NO: 7855785 - DNA, 22 bp, Homo sapiens
cctcagcatcctcatgctcagt

SEQ ID NO: 7855786 - DNA, 22 bp, Homo sapiens
cctcagcatcctcctgctcagt

SEQ ID NO: 7855787 - DNA, 22 bp, Homo sapiens
cctcagcatcctcctgctcagt

SEQ ID NO: 7855788 - DNA, 22 bp, Homo sapiens
cctcagcatcctcatgctcagt

SEQ ID NO: 7855789 - DNA, 22 bp, Homo sapiens
cctcagagttggccacgagagc

SEQ ID NO: 7855790 - DNA, 22 bp, Homo sapiens
cctcagagtttaagatgtcaga

SEQ ID NO: 7855791 - DNA, 22 bp, Homo sapiens
cctcagagtttaagatgtcaga

SEQ ID NO: 7855792 - DNA, 22 bp, Homo sapiens
cctcagagtttaagatgtcaga

SEQ ID NO: 7855793 - DNA, 22 bp, Homo sapiens
cctcagagtttaagatgtcaga

SEQ ID NO: 7855794 - DNA, 22 bp, Homo sapiens
cctcagcagacacgcttctcac

SEQ ID NO: 7855795 - DNA, 22 bp, Homo sapiens
cctcagcagacacgcttctcac

SEQ ID NO: 7855796 - DNA, 22 bp, Homo sapiens
cctcagcagacacgcttctcac

SEQ ID NO: 7855797 - DNA, 22 bp, Homo sapiens
cctcagagtaggtctcagctgt

SEQ ID NO: 7855798 - DNA, 22 bp, Homo sapiens
cctcagagtaggtctcagctgt

SEQ ID NO: 7855799 - DNA, 22 bp, Homo sapiens
cctcagagtaggtctcagctgt

SEQ ID NO: 7855800 - DNA, 22 bp, Homo sapiens
cctcagagtaggtctcagctgt

SEQ ID NO: 7855801 - DNA, 22 bp, Homo sapiens
cctcagaggttttcattctgta

SEQ ID NO: 7855802 - DNA, 22 bp, Homo sapiens
cctcagaggttttcattctgta

SEQ ID NO: 7855803 - DNA, 22 bp, Homo sapiens
cctcagagttatttgaagtgaa

SEQ ID NO: 7855804 - DNA, 22 bp, Homo sapiens
cctcagagttatttgaagtgaa

SEQ ID NO: 7855805 - DNA, 22 bp, Homo sapiens
cctcagagttatttgaagtgaa

SEQ ID NO: 7855806 - DNA, 22 bp, Homo sapiens
cctcagagttggaatcacattt

SEQ ID NO: 7855807 - DNA, 22 bp, Homo sapiens
cctcagagttatttgaagtgaa

SEQ ID NO: 7855808 - DNA, 22 bp, Homo sapiens
cctcagagttggccacgagagc

SEQ ID NO: 7855809 - DNA, 22 bp, Homo sapiens
cctcagagttggaatcacattt

SEQ ID NO: 7855810 - DNA, 19 bp, Homo sapiens
tggcccagatggtcctggg

SEQ ID NO: 7855811 - DNA, 19 bp, Homo sapiens
tggcccagatggtcctggg

SEQ ID NO: 7855812 - DNA, 19 bp, Homo sapiens
tggcccagatggtcctggg

SEQ ID NO: 7855813 - DNA, 19 bp, Homo sapiens
tggcccagatggtcctggg

SEQ ID NO: 7855814 - DNA, 19 bp, Homo sapiens
tggcccagatggtcctggg

SEQ ID NO: 7855815 - DNA, 19 bp, Homo sapiens
tggcccagatggtcctggg

SEQ ID NO: 7855816 - DNA, 19 bp, Homo sapiens
tggcccagatggtcctggg

SEQ ID NO: 7855817 - DNA, 22 bp, Homo sapiens
tggcccagatctctgaccttga

SEQ ID NO: 7855818 - DNA, 22 bp, Homo sapiens
tggcccagatctctgaccttga

SEQ ID NO: 7855819 - DNA, 22 bp, Homo sapiens
tggcccagatctctgaccttga

SEQ ID NO: 7855820 - DNA, 22 bp, Homo sapiens
tggcccagagcactgctgggca

SEQ ID NO: 7855821 - DNA, 22 bp, Homo sapiens
tggcccagagcactgctgggca

SEQ ID NO: 7855822 - DNA, 22 bp, Homo sapiens
tggcccagagcactgctgggca

SEQ ID NO: 7855823 - DNA, 22 bp, Homo sapiens
tggcccagcactccaagtaggg

SEQ ID NO: 7855824 - DNA, 20 bp, Homo sapiens
tggcccagcacgacgaggac

SEQ ID NO: 7855825 - DNA, 20 bp, Homo sapiens
tggcccagcacgacgaggac

SEQ ID NO: 7855826 - DNA, 20 bp, Homo sapiens
tggcccagcacgacgaggac

SEQ ID NO: 7855827 - DNA, 20 bp, Homo sapiens
tggcccagcacgacgaggac

SEQ ID NO: 7855828 - DNA, 20 bp, Homo sapiens
tggcccagcacgacgaggac

SEQ ID NO: 7855829 - DNA, 22 bp, Homo sapiens
tggcccagcagttctgccccag

SEQ ID NO: 7855830 - DNA, 22 bp, Homo sapiens
tggcccagcactccaagtaggg

SEQ ID NO: 7855831 - DNA, 22 bp, Homo sapiens
tggcccagcactccaagtaggg

SEQ ID NO: 7855832 - DNA, 22 bp, Homo sapiens
tggcccagcactccaagtaggg

SEQ ID NO: 7855833 - DNA, 22 bp, Homo sapiens
tggagcagggcatcactgtgcg

SEQ ID NO: 7855834 - DNA, 22 bp, Homo sapiens
tggagcaggccggaagtggctt

SEQ ID NO: 7855835 - DNA, 22 bp, Homo sapiens
tggagcagggcatcactgtgcg

SEQ ID NO: 7855836 - DNA, 22 bp, Homo sapiens
tggagcagggcatcactgtgcg

SEQ ID NO: 7855837 - DNA, 22 bp, Homo sapiens
tggagcagggcatcactgtgcg

SEQ ID NO: 7855838 - DNA, 22 bp, Homo sapiens
tggagcagggcatcactgtgcg

SEQ ID NO: 7855839 - DNA, 22 bp, Homo sapiens
tggagcagggcatcactgtgcg

SEQ ID NO: 7855840 - DNA, 22 bp, Homo sapiens
tggagcaggccggaagtggctt

SEQ ID NO: 7855841 - DNA, 22 bp, Homo sapiens
tggagcaggccggaagtggctt

SEQ ID NO: 7855842 - DNA, 22 bp, Homo sapiens
tggagcaggccggaagtggctt

SEQ ID NO: 7855843 - DNA, 22 bp, Homo sapiens
tggagcaggccggaagtggctt

SEQ ID NO: 7855844 - DNA, 22 bp, Homo sapiens
tggagcaggccggaagtggctt

SEQ ID NO: 7855845 - DNA, 22 bp, Homo sapiens
tggagcaggccggaagtggctt

SEQ ID NO: 7855846 - DNA, 22 bp, Homo sapiens
tggagcaggccggaagtggctt

SEQ ID NO: 7855847 - DNA, 22 bp, Homo sapiens
tggagcaggcatctttctctct

SEQ ID NO: 7855848 - DNA, 22 bp, Homo sapiens
tggagcaggccggaagtggctt

SEQ ID NO: 7855849 - DNA, 22 bp, Homo sapiens
tggagcaggcatctttctctct

SEQ ID NO: 7855850 - DNA, 22 bp, Homo sapiens
tggagcaggcatctttctctct

SEQ ID NO: 7855851 - DNA, 22 bp, Homo sapiens
ccctgcagccttgcatgccttc

SEQ ID NO: 7855852 - DNA, 22 bp, Homo sapiens
ccctgcagccttgcatgccttc

SEQ ID NO: 7855853 - DNA, 22 bp, Homo sapiens
ccctgcagccttgcatgccttc

SEQ ID NO: 7855854 - DNA, 22 bp, Homo sapiens
ccctgcagccttgcatgccttc

SEQ ID NO: 7855855 - DNA, 18 bp, Homo sapiens
tggagcaggtaggcatga

SEQ ID NO: 7855856 - DNA, 18 bp, Homo sapiens
tggagcaggtaggcatga

SEQ ID NO: 7855857 - DNA, 19 bp, Homo sapiens
tggagcagggcccttgttt

SEQ ID NO: 7855858 - DNA, 19 bp, Homo sapiens
tggagcagggcccttgttt

SEQ ID NO: 7855859 - DNA, 19 bp, Homo sapiens
tggagcagggcccttgttt

SEQ ID NO: 7855860 - DNA, 18 bp, Homo sapiens
tggagcaggtaggcatga

SEQ ID NO: 7855861 - DNA, 18 bp, Homo sapiens
tggagcaggtaggcatga

SEQ ID NO: 7855862 - DNA, 18 bp, Homo sapiens
tggagcaggtaggcatga

SEQ ID NO: 7855863 - DNA, 18 bp, Homo sapiens
tggagcaggtaggcatga

SEQ ID NO: 7855864 - DNA, 18 bp, Homo sapiens
tggagcaggtaggcatga

SEQ ID NO: 7855865 - DNA, 23 bp, Homo sapiens
ccctgcagtcagggtgagatggt

SEQ ID NO: 7855866 - DNA, 23 bp, Homo sapiens
ccctgcagtcagggtgagatggt

SEQ ID NO: 7855867 - DNA, 22 bp, Homo sapiens
ccctgtgggccatgtgtctaca

SEQ ID NO: 7855868 - DNA, 22 bp, Homo sapiens
ccctgtgggccatgtgtctaca

SEQ ID NO: 7855869 - DNA, 22 bp, Homo sapiens
ccctgcaggggacctgcagcct

SEQ ID NO: 7855870 - DNA, 22 bp, Homo sapiens
ccctgcaggggacctgcagcct

SEQ ID NO: 7855871 - DNA, 22 bp, Homo sapiens
ccctgcaggggacctgcagcct

SEQ ID NO: 7855872 - DNA, 23 bp, Homo sapiens
ccctgcagtcagggtgagatggt

SEQ ID NO: 7855873 - DNA, 22 bp, Homo sapiens
ccctgcaggggacctgcagcct

SEQ ID NO: 7855874 - DNA, 22 bp, Homo sapiens
ccctgcaggctcagactggagt

SEQ ID NO: 7855875 - DNA, 22 bp, Homo sapiens
ccctgcaggggacctgcagcct

SEQ ID NO: 7855876 - DNA, 22 bp, Homo sapiens
ccctgcaggggacctgcagcct

SEQ ID NO: 7855877 - DNA, 22 bp, Homo sapiens
ccctgcagcttttgcatagtca

SEQ ID NO: 7855878 - DNA, 22 bp, Homo sapiens
ccctgcagcttttgcatagtca

SEQ ID NO: 7855879 - DNA, 21 bp, Homo sapiens
ccctgcaggccagggctgagc

SEQ ID NO: 7855880 - DNA, 22 bp, Homo sapiens
ccctgcagccttgcatgccttc

SEQ ID NO: 7855881 - DNA, 22 bp, Homo sapiens
ccctgcagcttttgcatagtca

SEQ ID NO: 7855882 - DNA, 22 bp, Homo sapiens
ccctgcaggctcagactggagt

SEQ ID NO: 7855883 - DNA, 22 bp, Homo sapiens
ccctgcaggctcagactggagt

SEQ ID NO: 7855884 - DNA, 22 bp, Homo sapiens
ccctgcaggctcagactggagt

SEQ ID NO: 7855885 - DNA, 22 bp, Homo sapiens
ccctgcaggctcagactggagt

SEQ ID NO: 7855886 - DNA, 22 bp, Homo sapiens
ccctgcaggctcagactggagt

SEQ ID NO: 7855887 - DNA, 21 bp, Homo sapiens
ccctgcaggccagggctgagc

SEQ ID NO: 7855888 - DNA, 21 bp, Homo sapiens
ccctgcaggccagggctgagc

SEQ ID NO: 7855889 - DNA, 21 bp, Homo sapiens
ccctgcaggccagggctgagc

SEQ ID NO: 7855890 - DNA, 22 bp, Homo sapiens
cccttccttgtgactggtgggg

SEQ ID NO: 7855891 - DNA, 22 bp, Homo sapiens
cccttccttgtgactggtgggg

SEQ ID NO: 7855892 - DNA, 22 bp, Homo sapiens
cccttctctttcactcactatt

SEQ ID NO: 7855893 - DNA, 22 bp, Homo sapiens
cccttctctttcactcactatt

SEQ ID NO: 7855894 - DNA, 22 bp, Homo sapiens
cccttctctttcactcactatt

SEQ ID NO: 7855895 - DNA, 22 bp, Homo sapiens
cccttctctttcactcactatt

SEQ ID NO: 7855896 - DNA, 21 bp, Homo sapiens
cccttcttactcaagctcatt

SEQ ID NO: 7855897 - DNA, 22 bp, Homo sapiens
cccttctgtaaatgctgactgg

SEQ ID NO: 7855898 - DNA, 21 bp, Homo sapiens
cccttctgctccagctttgcc

SEQ ID NO: 7855899 - DNA, 21 bp, Homo sapiens
cccttctgctccagctttgcc

SEQ ID NO: 7855900 - DNA, 22 bp, Homo sapiens
cccttctctttcactcactatt

SEQ ID NO: 7855901 - DNA, 21 bp, Homo sapiens
cccttcttgggtcaaagtata

SEQ ID NO: 7855902 - DNA, 21 bp, Homo sapiens
cccttcttgggtcaaagtata

SEQ ID NO: 7855903 - DNA, 22 bp, Homo sapiens
cccttctgtaaatgctgactgg

SEQ ID NO: 7855904 - DNA, 22 bp, Homo sapiens
cccttctttgtaataaagatta

SEQ ID NO: 7855905 - DNA, 22 bp, Homo sapiens
cccttctttgtaataaagatta

SEQ ID NO: 7855906 - DNA, 22 bp, Homo sapiens
cccttctttgtaataaagatta

SEQ ID NO: 7855907 - DNA, 22 bp, Homo sapiens
tggcagaggaaaaagtcactgg

SEQ ID NO: 7855908 - DNA, 19 bp, Homo sapiens
tggcagaggacaaggactt

SEQ ID NO: 7855909 - DNA, 19 bp, Homo sapiens
tggcagaggacaaggactt

SEQ ID NO: 7855910 - DNA, 19 bp, Homo sapiens
tggcagaggacaaggactt

SEQ ID NO: 7855911 - DNA, 19 bp, Homo sapiens
tggcagaggacaaggactt

SEQ ID NO: 7855912 - DNA, 19 bp, Homo sapiens
tggcagaggacaaggactt

SEQ ID NO: 7855913 - DNA, 19 bp, Homo sapiens
tggcagaggacaaggactt

SEQ ID NO: 7855914 - DNA, 19 bp, Homo sapiens
tggcagaggacaaggactt

SEQ ID NO: 7855915 - DNA, 22 bp, Homo sapiens
tggcagaggagaattaagatta

SEQ ID NO: 7855916 - DNA, 22 bp, Homo sapiens
tggcagaggagaattaagatta

SEQ ID NO: 7855917 - DNA, 22 bp, Homo sapiens
tggcagaggagaattaagatta

SEQ ID NO: 7855918 - DNA, 22 bp, Homo sapiens
cccttcctcccaggcttctgtg

SEQ ID NO: 7855919 - DNA, 22 bp, Homo sapiens
cccttcctcccaggcttctgtg

SEQ ID NO: 7855920 - DNA, 22 bp, Homo sapiens
cccttcctcccaggcttctgtg

SEQ ID NO: 7855921 - DNA, 22 bp, Homo sapiens
ccctgtggtgacaggcctgtct

SEQ ID NO: 7855922 - DNA, 22 bp, Homo sapiens
ccctgtggggtccgcctgtccg

SEQ ID NO: 7855923 - DNA, 22 bp, Homo sapiens
cccttcctcaaggagctgtgtt

SEQ ID NO: 7855924 - DNA, 22 bp, Homo sapiens
cccttcccttctgggagatcca

SEQ ID NO: 7855925 - DNA, 22 bp, Homo sapiens
cccttccttgattttaactgga

SEQ ID NO: 7855926 - DNA, 22 bp, Homo sapiens
cccttcctgggtgtcccggagt

SEQ ID NO: 7855927 - DNA, 22 bp, Homo sapiens
cccttcctgggtgtcccggagt

SEQ ID NO: 7855928 - DNA, 22 bp, Homo sapiens
cccttcctggagtaccctctgt

SEQ ID NO: 7855929 - DNA, 22 bp, Homo sapiens
cccttcctcctcgcctgtcaga

SEQ ID NO: 7855930 - DNA, 22 bp, Homo sapiens
cccttcctcctcgcctgtcaga

SEQ ID NO: 7855931 - DNA, 22 bp, Homo sapiens
cccttcctcctcgcctgtcaga

SEQ ID NO: 7855932 - DNA, 22 bp, Homo sapiens
cccttcctggagtaccctctgt

SEQ ID NO: 7855933 - DNA, 22 bp, Homo sapiens
cccttcctggagtaccctctgt

SEQ ID NO: 7855934 - DNA, 22 bp, Homo sapiens
cctagcagggaagcagtgagga

SEQ ID NO: 7855935 - DNA, 23 bp, Homo sapiens
cctagattcaaagcttataattc

SEQ ID NO: 7855936 - DNA, 22 bp, Homo sapiens
cctagcagggagaggatacctg

SEQ ID NO: 7855937 - DNA, 22 bp, Homo sapiens
cctagatggattatgtaagatt

SEQ ID NO: 7855938 - DNA, 22 bp, Homo sapiens
cctagatgggatggcggccggg

SEQ ID NO: 7855939 - DNA, 19 bp, Homo sapiens
cctagagggaaggcaggac

SEQ ID NO: 7855940 - DNA, 22 bp, Homo sapiens
cctagagtgattgagagcatca

SEQ ID NO: 7855941 - DNA, 21 bp, Homo sapiens
cctagcctcttacccagcttt

SEQ ID NO: 7855942 - DNA, 18 bp, Homo sapiens
cctagcctccaagctcat

SEQ ID NO: 7855943 - DNA, 22 bp, Homo sapiens
cctagccttcggcctacccatc

SEQ ID NO: 7855944 - DNA, 22 bp, Homo sapiens
cctagccttcggcctacccatc

SEQ ID NO: 7855945 - DNA, 22 bp, Homo sapiens
cctagagctctgctttatctaa

SEQ ID NO: 7855946 - DNA, 19 bp, Homo sapiens
cctagagcagtacctggta

SEQ ID NO: 7855947 - DNA, 22 bp, Homo sapiens
cctagactagaggcagggagcc

SEQ ID NO: 7855948 - DNA, 22 bp, Homo sapiens
cctaagatctggtatgtgacag

SEQ ID NO: 7855949 - DNA, 22 bp, Homo sapiens
cctaaggaaagccaaagaggcc

SEQ ID NO: 7855950 - DNA, 22 bp, Homo sapiens
cctagaggctgcaaggagaggc

SEQ ID NO: 7855951 - DNA, 22 bp, Homo sapiens
cctagaggctgcaaggagaggc

SEQ ID NO: 7855952 - DNA, 22 bp, Homo sapiens
cctagaggctgcaaggagaggc

SEQ ID NO: 7855953 - DNA, 22 bp, Homo sapiens
cctagagctctgctttatctaa

SEQ ID NO: 7855954 - DNA, 22 bp, Homo sapiens
cctagagctctgctttatctaa

SEQ ID NO: 7855955 - DNA, 22 bp, Homo sapiens
tggcagaggtaattcaaatccc

SEQ ID NO: 7855956 - DNA, 22 bp, Homo sapiens
cctaagaattaatgaatacacc

SEQ ID NO: 7855957 - DNA, 22 bp, Homo sapiens
cctaagaattaatgaatacacc

SEQ ID NO: 7855958 - DNA, 18 bp, Homo sapiens
cctaagctccagccccag

SEQ ID NO: 7855959 - DNA, 22 bp, Homo sapiens
tggcagaggtaattcaaatccc

SEQ ID NO: 7855960 - DNA, 22 bp, Homo sapiens
tggcagaggtaattcaaatccc

SEQ ID NO: 7855961 - DNA, 22 bp, Homo sapiens
tggcagaggtaattcaaatccc

SEQ ID NO: 7855962 - DNA, 22 bp, Homo sapiens
tggcagaggtaattcaaatccc

SEQ ID NO: 7855963 - DNA, 22 bp, Homo sapiens
tggcagaggctctgtgatgttg

SEQ ID NO: 7855964 - DNA, 22 bp, Homo sapiens
tggcagaggctctgtgatgttg

SEQ ID NO: 7855965 - DNA, 22 bp, Homo sapiens
tggcagaggctctgtgatgttg

SEQ ID NO: 7855966 - DNA, 22 bp, Homo sapiens
tggcagaggctctgtgatgttg

SEQ ID NO: 7855967 - DNA, 19 bp, Homo sapiens
tggcagaggcagtttgtac

SEQ ID NO: 7855968 - DNA, 22 bp, Homo sapiens
tggcagaggctctgtgatgttg

SEQ ID NO: 7855969 - DNA, 22 bp, Homo sapiens
tggcagaggctctgtgatgttg

SEQ ID NO: 7855970 - DNA, 22 bp, Homo sapiens
tggcagaggctctgtgatgttg

SEQ ID NO: 7855971 - DNA, 19 bp, Homo sapiens
tggcagaggcagtttgtac

SEQ ID NO: 7855972 - DNA, 19 bp, Homo sapiens
tggcagaggcagtttgtac

SEQ ID NO: 7855973 - DNA, 19 bp, Homo sapiens
tggcagaggcagtttgtac

SEQ ID NO: 7855974 - DNA, 19 bp, Homo sapiens
tggcagaggcagtttgtac

SEQ ID NO: 7855975 - DNA, 22 bp, Homo sapiens
tggcagaggagaattaagatta

SEQ ID NO: 7855976 - DNA, 22 bp, Homo sapiens
tggcagaggagaattaagatta

SEQ ID NO: 7855977 - DNA, 22 bp, Homo sapiens
tggcagaggaggctcagattga

SEQ ID NO: 7855978 - DNA, 22 bp, Homo sapiens
tggcagaggaggctcagattga

SEQ ID NO: 7855979 - DNA, 22 bp, Homo sapiens
tggcagaggaggctcagattga

SEQ ID NO: 7855980 - DNA, 22 bp, Homo sapiens
tggcaggtacccattggctgta

SEQ ID NO: 7855981 - DNA, 18 bp, Homo sapiens
tggcaggtagactcaggt

SEQ ID NO: 7855982 - DNA, 22 bp, Homo sapiens
tggcagggttggccaccttacc

SEQ ID NO: 7855983 - DNA, 22 bp, Homo sapiens
tggcaggtacccattggctgta

SEQ ID NO: 7855984 - DNA, 22 bp, Homo sapiens
tggcaggtagagttctgagatg

SEQ ID NO: 7855985 - DNA, 22 bp, Homo sapiens
tggcaggtacccattggctgta

SEQ ID NO: 7855986 - DNA, 22 bp, Homo sapiens
tggcaggtagtcagaggcgaca

SEQ ID NO: 7855987 - DNA, 22 bp, Homo sapiens
tggcaggtagagttctgagatg

SEQ ID NO: 7855988 - DNA, 22 bp, Homo sapiens
cctcagaaggacaagagacaaa

SEQ ID NO: 7855989 - DNA, 22 bp, Homo sapiens
cctcagaggtgaacatcagtgc

SEQ ID NO: 7855990 - DNA, 22 bp, Homo sapiens
cctcagaggtgaacatcagtgc

SEQ ID NO: 7855991 - DNA, 22 bp, Homo sapiens
cctcagaggtgtggcatctctg

SEQ ID NO: 7855992 - DNA, 22 bp, Homo sapiens
cctcagaggtgtggcatctctg

SEQ ID NO: 7855993 - DNA, 22 bp, Homo sapiens
cctcagaggtgtggcatctctg

SEQ ID NO: 7855994 - DNA, 22 bp, Homo sapiens
cctcagaaggacaagagacaaa

SEQ ID NO: 7855995 - DNA, 22 bp, Homo sapiens
cctcagaatagtcctcagatca

SEQ ID NO: 7855996 - DNA, 22 bp, Homo sapiens
cctcagaggcagatggtaagaa

SEQ ID NO: 7855997 - DNA, 22 bp, Homo sapiens
tggcagggttggccaccttacc

SEQ ID NO: 7855998 - DNA, 22 bp, Homo sapiens
tggcagggttggccaccttacc

SEQ ID NO: 7855999 - DNA, 22 bp, Homo sapiens
tggcagggttggccaccttacc

SEQ ID NO: 7856000 - DNA, 22 bp, Homo sapiens
tggcagggtgggcttcagcccc

SEQ ID NO: 7856001 - DNA, 22 bp, Homo sapiens
tggcagggtgggcttcagcccc

SEQ ID NO: 7856002 - DNA, 22 bp, Homo sapiens
tggcagggtgggcttcagcccc

SEQ ID NO: 7856003 - DNA, 22 bp, Homo sapiens
tggcagggtggcaacttttggt

SEQ ID NO: 7856004 - DNA, 22 bp, Homo sapiens
tggcagggtgggcttcagcccc

SEQ ID NO: 7856005 - DNA, 22 bp, Homo sapiens
tggcagggtgggcttcagcccc

SEQ ID NO: 7856006 - DNA, 22 bp, Homo sapiens
tggcagggtgggcttcagcccc

SEQ ID NO: 7856007 - DNA, 22 bp, Homo sapiens
cctaggaaggagtatagtaaat

SEQ ID NO: 7856008 - DNA, 22 bp, Homo sapiens
cctaggagttcgaagctgcagt

SEQ ID NO: 7856009 - DNA, 22 bp, Homo sapiens
cctaggcccattaattcccctt

SEQ ID NO: 7856010 - DNA, 22 bp, Homo sapiens
tggcagggtggcaacttttggt

SEQ ID NO: 7856011 - DNA, 19 bp, Homo sapiens
cctaggcattgtccaaggg

SEQ ID NO: 7856012 - DNA, 22 bp, Homo sapiens
cctaggcacccgagttatgttc

SEQ ID NO: 7856013 - DNA, 22 bp, Homo sapiens
cccagggtagctgagctggcag

SEQ ID NO: 7856014 - DNA, 22 bp, Homo sapiens
cccagggtagctgagctggcag

SEQ ID NO: 7856015 - DNA, 22 bp, Homo sapiens
cccagggtaatcatgtgaagcc

SEQ ID NO: 7856016 - DNA, 22 bp, Homo sapiens
cccagggtaatcatgtgaagcc

SEQ ID NO: 7856017 - DNA, 22 bp, Homo sapiens
cccagggtaatcatgtgaagcc

SEQ ID NO: 7856018 - DNA, 20 bp, Homo sapiens
cccaggggttgtggtgagga

SEQ ID NO: 7856019 - DNA, 20 bp, Homo sapiens
cccaggggttgtggtgagga

SEQ ID NO: 7856020 - DNA, 20 bp, Homo sapiens
cccaggggttgtggtgagga

SEQ ID NO: 7856021 - DNA, 20 bp, Homo sapiens
cccaggggttgtggtgagga

SEQ ID NO: 7856022 - DNA, 22 bp, Homo sapiens
cccaggggttctgagcagcagc

SEQ ID NO: 7856023 - DNA, 22 bp, Homo sapiens
cccaggggttctgagcagcagc

SEQ ID NO: 7856024 - DNA, 22 bp, Homo sapiens
cccaggggttctgagcagcagc

SEQ ID NO: 7856025 - DNA, 20 bp, Homo sapiens
cccaggggttgtggtgagga

SEQ ID NO: 7856026 - DNA, 20 bp, Homo sapiens
cccaggggttgtggtgagga

SEQ ID NO: 7856027 - DNA, 22 bp, Homo sapiens
cccaggggttctagaccagctt

SEQ ID NO: 7856028 - DNA, 22 bp, Homo sapiens
cccaggggttctagaccagctt

SEQ ID NO: 7856029 - DNA, 22 bp, Homo sapiens
cccaggggttcaaggctgcagt

SEQ ID NO: 7856030 - DNA, 22 bp, Homo sapiens
cccaggggttctagaccagctt

SEQ ID NO: 7856031 - DNA, 22 bp, Homo sapiens
cccaggggttctagaccagctt

SEQ ID NO: 7856032 - DNA, 22 bp, Homo sapiens
cccaggggttctagaccagctt

SEQ ID NO: 7856033 - DNA, 22 bp, Homo sapiens
cccaggggttcaaggctgcagt

SEQ ID NO: 7856034 - DNA, 22 bp, Homo sapiens
cccaggggttcaaggctgcagt

SEQ ID NO: 7856035 - DNA, 22 bp, Homo sapiens
cccagggattataaaggtgaaa

SEQ ID NO: 7856036 - DNA, 22 bp, Homo sapiens
cccaggggttcaaggctgcagt

SEQ ID NO: 7856037 - DNA, 22 bp, Homo sapiens
cccaggggttcaaggctgcagt

SEQ ID NO: 7856038 - DNA, 22 bp, Homo sapiens
cccaggggttcaaggctgcagt

SEQ ID NO: 7856039 - DNA, 22 bp, Homo sapiens
cccaggggttcaaggctgcagt

SEQ ID NO: 7856040 - DNA, 22 bp, Homo sapiens
cccagggtccctgctctctgtg

SEQ ID NO: 7856041 - DNA, 22 bp, Homo sapiens
cccagggtagctgagctggcag

SEQ ID NO: 7856042 - DNA, 22 bp, Homo sapiens
cccagggtccctgctctctgtg

SEQ ID NO: 7856043 - DNA, 22 bp, Homo sapiens
cccagggtccctgctctctgtg

SEQ ID NO: 7856044 - DNA, 22 bp, Homo sapiens
cccagggtccctgctctctgtg

SEQ ID NO: 7856045 - DNA, 22 bp, Homo sapiens
cccagggtagctgagctggcag

SEQ ID NO: 7856046 - DNA, 22 bp, Homo sapiens
cccagggtagctgagctggcag

SEQ ID NO: 7856047 - DNA, 22 bp, Homo sapiens
cccagggtccggataaccctgg

SEQ ID NO: 7856048 - DNA, 22 bp, Homo sapiens
cccagggtccggataaccctgg

SEQ ID NO: 7856049 - DNA, 22 bp, Homo sapiens
cccagggtccctgctctctgtg

SEQ ID NO: 7856050 - DNA, 22 bp, Homo sapiens
cccagggtgctaattaaatatg

SEQ ID NO: 7856051 - DNA, 22 bp, Homo sapiens
cccagggtgcggccctggctgg

SEQ ID NO: 7856052 - DNA, 22 bp, Homo sapiens
cccagggtgctaattaaatatg

SEQ ID NO: 7856053 - DNA, 22 bp, Homo sapiens
cccagggtgcggccctggctgg

SEQ ID NO: 7856054 - DNA, 19 bp, Homo sapiens
cccagggtttcctctctcc

SEQ ID NO: 7856055 - DNA, 22 bp, Homo sapiens
cccagggttgcctgcctctgct

SEQ ID NO: 7856056 - DNA, 22 bp, Homo sapiens
cccagggttgcctgcctctgct

SEQ ID NO: 7856057 - DNA, 22 bp, Homo sapiens
cccagggttgcctgcctctgct

SEQ ID NO: 7856058 - DNA, 22 bp, Homo sapiens
cccagggtggatgcaagcagca

SEQ ID NO: 7856059 - DNA, 22 bp, Homo sapiens
cccagggtggatgcaagcagca

SEQ ID NO: 7856060 - DNA, 19 bp, Homo sapiens
cccagggtttcctctctcc

SEQ ID NO: 7856061 - DNA, 19 bp, Homo sapiens
cccagggtttcctctctcc

SEQ ID NO: 7856062 - DNA, 23 bp, Homo sapiens
cccaggtagccctctagagcctg

SEQ ID NO: 7856063 - DNA, 22 bp, Homo sapiens
cccaggtagtgagaaatggagg

SEQ ID NO: 7856064 - DNA, 22 bp, Homo sapiens
cccaggtagttggaagagacaa

SEQ ID NO: 7856065 - DNA, 22 bp, Homo sapiens
cccaggtagttggaagagacaa

SEQ ID NO: 7856066 - DNA, 22 bp, Homo sapiens
tgccttcaccaggccttcagcc

SEQ ID NO: 7856067 - DNA, 22 bp, Homo sapiens
tgccttcaccaggccttcagcc

SEQ ID NO: 7856068 - DNA, 22 bp, Homo sapiens
tgccttcaatcaggatggtctc

SEQ ID NO: 7856069 - DNA, 22 bp, Homo sapiens
tgccttcaatcaggatggtctc

SEQ ID NO: 7856070 - DNA, 22 bp, Homo sapiens
tgccttcaagacccatcctcca

SEQ ID NO: 7856071 - DNA, 22 bp, Homo sapiens
tgccttcaagacccatcctcca

SEQ ID NO: 7856072 - DNA, 23 bp, Homo sapiens
tgccttagttagcacatttctaa

SEQ ID NO: 7856073 - DNA, 23 bp, Homo sapiens
tgccttagttagcacatttctaa

SEQ ID NO: 7856074 - DNA, 22 bp, Homo sapiens
tgccttagggtacctggtgctt

SEQ ID NO: 7856075 - DNA, 22 bp, Homo sapiens
tgccttagggtacctggtgctt

SEQ ID NO: 7856076 - DNA, 22 bp, Homo sapiens
tgccttagaggatagtgaagcc

SEQ ID NO: 7856077 - DNA, 22 bp, Homo sapiens
tgccttagagcactcaagagtg

SEQ ID NO: 7856078 - DNA, 20 bp, Homo sapiens
tgccttagagataaaggctt

SEQ ID NO: 7856079 - DNA, 22 bp, Homo sapiens
tgccttaattttctaagctgtg

SEQ ID NO: 7856080 - DNA, 22 bp, Homo sapiens
tgcctgttaagggtgtagatat

SEQ ID NO: 7856081 - DNA, 22 bp, Homo sapiens
tgcctgttgcccacctgataaa

SEQ ID NO: 7856082 - DNA, 22 bp, Homo sapiens
tgcctgttaagggtgtagatat

SEQ ID NO: 7856083 - DNA, 22 bp, Homo sapiens
tgcctgttgcccacctgataaa

SEQ ID NO: 7856084 - DNA, 22 bp, Homo sapiens
tgccttaaaaaattctaaacat

SEQ ID NO: 7856085 - DNA, 22 bp, Homo sapiens
tgccttaagtaagactgaacag

SEQ ID NO: 7856086 - DNA, 22 bp, Homo sapiens
tgccttcatccatgttatagtg

SEQ ID NO: 7856087 - DNA, 22 bp, Homo sapiens
tgccttcctaatggtggggttt

SEQ ID NO: 7856088 - DNA, 22 bp, Homo sapiens
tgccttcctgctttgagttctg

SEQ ID NO: 7856089 - DNA, 22 bp, Homo sapiens
tgccttcactgagcttatggga

SEQ ID NO: 7856090 - DNA, 22 bp, Homo sapiens
tgccttcaccaggccttcagcc

SEQ ID NO: 7856091 - DNA, 22 bp, Homo sapiens
tgccttcatccatgttatagtg

SEQ ID NO: 7856092 - DNA, 22 bp, Homo sapiens
tgccttcactgagcttatggga

SEQ ID NO: 7856093 - DNA, 22 bp, Homo sapiens
tgccttcctggagctgaaggct

SEQ ID NO: 7856094 - DNA, 22 bp, Homo sapiens
cccagggattataaaggtgaaa

SEQ ID NO: 7856095 - DNA, 22 bp, Homo sapiens
cccagggattataaaggtgaaa

SEQ ID NO: 7856096 - DNA, 22 bp, Homo sapiens
cccagggattataaaggtgaaa

SEQ ID NO: 7856097 - DNA, 22 bp, Homo sapiens
cccagggccctggacagctaca

SEQ ID NO: 7856098 - DNA, 22 bp, Homo sapiens
cccagggattataaaggtgaaa

SEQ ID NO: 7856099 - DNA, 22 bp, Homo sapiens
cccagggacagatgggcagcta

SEQ ID NO: 7856100 - DNA, 22 bp, Homo sapiens
cccagggacagatgggcagcta

SEQ ID NO: 7856101 - DNA, 22 bp, Homo sapiens
cccagggacagatgggcagcta

SEQ ID NO: 7856102 - DNA, 22 bp, Homo sapiens
cccagggacagatgggcagcta

SEQ ID NO: 7856103 - DNA, 22 bp, Homo sapiens
cccagggacagatgggcagcta

SEQ ID NO: 7856104 - DNA, 22 bp, Homo sapiens
cccagggacagatgggcagcta

SEQ ID NO: 7856105 - DNA, 22 bp, Homo sapiens
cccagggacagatgggcagcta

SEQ ID NO: 7856106 - DNA, 22 bp, Homo sapiens
cccagggacagatgggcagcta

SEQ ID NO: 7856107 - DNA, 17 bp, Homo sapiens
cccagggaccactgctt

SEQ ID NO: 7856108 - DNA, 17 bp, Homo sapiens
cccagggaccactgctt

SEQ ID NO: 7856109 - DNA, 22 bp, Homo sapiens
cccagggacagctaggtggggc

SEQ ID NO: 7856110 - DNA, 22 bp, Homo sapiens
cccagggacagctaggtggggc

SEQ ID NO: 7856111 - DNA, 22 bp, Homo sapiens
cccagggacagatgggcagcta

SEQ ID NO: 7856112 - DNA, 22 bp, Homo sapiens
cccagggacagatgggcagcta

SEQ ID NO: 7856113 - DNA, 22 bp, Homo sapiens
cccagggacagatgggcagcta

SEQ ID NO: 7856114 - DNA, 22 bp, Homo sapiens
cccagggacagctaggtggggc

SEQ ID NO: 7856115 - DNA, 22 bp, Homo sapiens
cccagggacagctaggtggggc

SEQ ID NO: 7856116 - DNA, 22 bp, Homo sapiens
cccagggacagctaggtggggc

SEQ ID NO: 7856117 - DNA, 17 bp, Homo sapiens
cccagggaccactgctt

SEQ ID NO: 7856118 - DNA, 17 bp, Homo sapiens
cccagggaccactgctt

SEQ ID NO: 7856119 - DNA, 17 bp, Homo sapiens
cccagggaccactgctt

SEQ ID NO: 7856120 - DNA, 22 bp, Homo sapiens
tgcctgtgtggggtctgccgcc

SEQ ID NO: 7856121 - DNA, 22 bp, Homo sapiens
tgcctgtgttgattactttgtc

SEQ ID NO: 7856122 - DNA, 22 bp, Homo sapiens
tgcctgtgttgattactttgtc

SEQ ID NO: 7856123 - DNA, 22 bp, Homo sapiens
tgcctgtgttgattactttgtc

SEQ ID NO: 7856124 - DNA, 22 bp, Homo sapiens
tgcctgtgtggggtctgccgcc

SEQ ID NO: 7856125 - DNA, 22 bp, Homo sapiens
tgcctgtgtggtctgcgcatta

SEQ ID NO: 7856126 - DNA, 22 bp, Homo sapiens
cccaggctgagttagaggtgtc

SEQ ID NO: 7856127 - DNA, 22 bp, Homo sapiens
cccaggctgagttagaggtgtc

SEQ ID NO: 7856128 - DNA, 22 bp, Homo sapiens
cccaggctggaattccaggcct

SEQ ID NO: 7856129 - DNA, 22 bp, Homo sapiens
cccaggctgagttagaggtgtc

SEQ ID NO: 7856130 - DNA, 22 bp, Homo sapiens
cccaggctggagggcagtgtca

SEQ ID NO: 7856131 - DNA, 22 bp, Homo sapiens
cccaggctggagggcagtgtca

SEQ ID NO: 7856132 - DNA, 22 bp, Homo sapiens
cccaggctggagggcagtgtca

SEQ ID NO: 7856133 - DNA, 22 bp, Homo sapiens
cccaggctggagggcagtgtca

SEQ ID NO: 7856134 - DNA, 22 bp, Homo sapiens
cccaggctggagggcagtgtca

SEQ ID NO: 7856135 - DNA, 22 bp, Homo sapiens
tgccctggtgaagtgctctcct

SEQ ID NO: 7856136 - DNA, 22 bp, Homo sapiens
tgccctggtgaagtgctctcct

SEQ ID NO: 7856137 - DNA, 22 bp, Homo sapiens
tgccctggtgaagtgctctcct

SEQ ID NO: 7856138 - DNA, 22 bp, Homo sapiens
tgccctggtgaagtgctctcct

SEQ ID NO: 7856139 - DNA, 22 bp, Homo sapiens
tgccctggttacactggagtcc

SEQ ID NO: 7856140 - DNA, 22 bp, Homo sapiens
tgccctggtagacacagactgt

SEQ ID NO: 7856141 - DNA, 22 bp, Homo sapiens
tgccctggtagacacagactgt

SEQ ID NO: 7856142 - DNA, 22 bp, Homo sapiens
tgccctggtagacacagactgt

SEQ ID NO: 7856143 - DNA, 22 bp, Homo sapiens
tgccctggtagacacagactgt

SEQ ID NO: 7856144 - DNA, 22 bp, Homo sapiens
tgccctggtagacacagactgt

SEQ ID NO: 7856145 - DNA, 22 bp, Homo sapiens
tgccctggtgaagtgctctcct

SEQ ID NO: 7856146 - DNA, 22 bp, Homo sapiens
tgccctggtgaagtgctctcct

SEQ ID NO: 7856147 - DNA, 22 bp, Homo sapiens
cccaggctggagtgcaatggtg

SEQ ID NO: 7856148 - DNA, 22 bp, Homo sapiens
cccaggctggagtgcaatggca

SEQ ID NO: 7856149 - DNA, 22 bp, Homo sapiens
cccaggctggagtgcaatggtg

SEQ ID NO: 7856150 - DNA, 22 bp, Homo sapiens
cccaggctggagtgcaatggtg

SEQ ID NO: 7856151 - DNA, 22 bp, Homo sapiens
cccaggctggagtgcaatggca

SEQ ID NO: 7856152 - DNA, 22 bp, Homo sapiens
cccaggctggagggcagtgtca

SEQ ID NO: 7856153 - DNA, 22 bp, Homo sapiens
cccaggctggagggcagtgtca

SEQ ID NO: 7856154 - DNA, 22 bp, Homo sapiens
cccaggctggagtgcaatggca

SEQ ID NO: 7856155 - DNA, 22 bp, Homo sapiens
cccaggctggagtgcaatggca

SEQ ID NO: 7856156 - DNA, 22 bp, Homo sapiens
cccaggctggagtgcaatggca

SEQ ID NO: 7856157 - DNA, 22 bp, Homo sapiens
cccaggctggagtgcaatggtg

SEQ ID NO: 7856158 - DNA, 22 bp, Homo sapiens
cccaggctggagtgcaatggtg

SEQ ID NO: 7856159 - DNA, 22 bp, Homo sapiens
cccaggctggagtgcagtggcg

SEQ ID NO: 7856160 - DNA, 22 bp, Homo sapiens
cccaggctggagtgcagtggcg

SEQ ID NO: 7856161 - DNA, 22 bp, Homo sapiens
cccaggctggagtgcagtggcg

SEQ ID NO: 7856162 - DNA, 22 bp, Homo sapiens
cccaggctggagtgcagtggcg

SEQ ID NO: 7856163 - DNA, 22 bp, Homo sapiens
cccaggctggagtgcagtggcg

SEQ ID NO: 7856164 - DNA, 22 bp, Homo sapiens
cccaggctggagtgcagtggcg

SEQ ID NO: 7856165 - DNA, 22 bp, Homo sapiens
cccaggctggagtgcagtggcg

SEQ ID NO: 7856166 - DNA, 22 bp, Homo sapiens
cccaggctggagtgtaatggtg

SEQ ID NO: 7856167 - DNA, 22 bp, Homo sapiens
cccaggctggagtgtaatggtg

SEQ ID NO: 7856168 - DNA, 22 bp, Homo sapiens
cccaggctggatttcggtggca

SEQ ID NO: 7856169 - DNA, 22 bp, Homo sapiens
cccaggctggatttcggtggca

SEQ ID NO: 7856170 - DNA, 22 bp, Homo sapiens
cccaggctggatttcggtggca

SEQ ID NO: 7856171 - DNA, 22 bp, Homo sapiens
cccaggctggatttcggtggca

SEQ ID NO: 7856172 - DNA, 22 bp, Homo sapiens
cccaggctggcactgctgaagt

SEQ ID NO: 7856173 - DNA, 22 bp, Homo sapiens
cccaggctggcactgctgaagt

SEQ ID NO: 7856174 - DNA, 22 bp, Homo sapiens
cccaggctggcactgctgaagt

SEQ ID NO: 7856175 - DNA, 22 bp, Homo sapiens
cccaggctggcactgctgaagt

SEQ ID NO: 7856176 - DNA, 22 bp, Homo sapiens
cccaggctggcactgctgaagt

SEQ ID NO: 7856177 - DNA, 22 bp, Homo sapiens
cccaggctggcctccgcagtgc

SEQ ID NO: 7856178 - DNA, 22 bp, Homo sapiens
cccaggctggcctccgcagtgc

SEQ ID NO: 7856179 - DNA, 22 bp, Homo sapiens
cccaggctggcctccgcagtgc

SEQ ID NO: 7856180 - DNA, 22 bp, Homo sapiens
cccaggctggggctcctccagc

SEQ ID NO: 7856181 - DNA, 22 bp, Homo sapiens
cccaggctggggctcctccagc

SEQ ID NO: 7856182 - DNA, 22 bp, Homo sapiens
cccaggctggggctcctccagc

SEQ ID NO: 7856183 - DNA, 22 bp, Homo sapiens
cccaggctgggaacgattctag

SEQ ID NO: 7856184 - DNA, 22 bp, Homo sapiens
cccaggctgggaacgattctag

SEQ ID NO: 7856185 - DNA, 22 bp, Homo sapiens
cccaggctgggaacgattctag

SEQ ID NO: 7856186 - DNA, 22 bp, Homo sapiens
cccaggctggggctcctccagc

SEQ ID NO: 7856187 - DNA, 22 bp, Homo sapiens
cccagggaagggctacctgagg

SEQ ID NO: 7856188 - DNA, 22 bp, Homo sapiens
cccagggaaggcagatggagga

SEQ ID NO: 7856189 - DNA, 22 bp, Homo sapiens
cccagggaagggctacctgagg

SEQ ID NO: 7856190 - DNA, 22 bp, Homo sapiens
cccagggaaggcagatggagga

SEQ ID NO: 7856191 - DNA, 22 bp, Homo sapiens
cccagggaaggcagatggagga

SEQ ID NO: 7856192 - DNA, 22 bp, Homo sapiens
cccagggaagggctacctgagg

SEQ ID NO: 7856193 - DNA, 22 bp, Homo sapiens
cccagggaatgactctggcctt

SEQ ID NO: 7856194 - DNA, 22 bp, Homo sapiens
cccagggaatgactctggcctt

SEQ ID NO: 7856195 - DNA, 22 bp, Homo sapiens
cccagggaagggctacctgagg

SEQ ID NO: 7856196 - DNA, 22 bp, Homo sapiens
cccagggaatgactctggcctt

SEQ ID NO: 7856197 - DNA, 23 bp, Homo sapiens
cccagggacacgatgacacctcc

SEQ ID NO: 7856198 - DNA, 22 bp, Homo sapiens
cccagggaatgactctggcctt

SEQ ID NO: 7856199 - DNA, 23 bp, Homo sapiens
cccagggacacgatgacacctcc

SEQ ID NO: 7856200 - DNA, 23 bp, Homo sapiens
cccagggacacgatgacacctcc

SEQ ID NO: 7856201 - DNA, 23 bp, Homo sapiens
cccagggacacgatgacacctcc

SEQ ID NO: 7856202 - DNA, 23 bp, Homo sapiens
cccagggacacgatgacacctcc

SEQ ID NO: 7856203 - DNA, 22 bp, Homo sapiens
cccaggctggtcctgaactcct

SEQ ID NO: 7856204 - DNA, 22 bp, Homo sapiens
cccaggctggtcctgaactcct

SEQ ID NO: 7856205 - DNA, 22 bp, Homo sapiens
cccaggctggtcctgaactcct

SEQ ID NO: 7856206 - DNA, 22 bp, Homo sapiens
cccaggctggtcctgaactcct

SEQ ID NO: 7856207 - DNA, 22 bp, Homo sapiens
cccaggctggtcctgaactcct

SEQ ID NO: 7856208 - DNA, 22 bp, Homo sapiens
cccaggctggggctcctccagc

SEQ ID NO: 7856209 - DNA, 21 bp, Homo sapiens
cccagggaagccgcagtcacc

SEQ ID NO: 7856210 - DNA, 21 bp, Homo sapiens
cccagggaagccgcagtcacc

SEQ ID NO: 7856211 - DNA, 21 bp, Homo sapiens
cccagggaagccgcagtcacc

SEQ ID NO: 7856212 - DNA, 22 bp, Homo sapiens
cccaggctggtcctgaactcct

SEQ ID NO: 7856213 - DNA, 21 bp, Homo sapiens
cccagggaagccgcagtcacc

SEQ ID NO: 7856214 - DNA, 22 bp, Homo sapiens
cccagggaaggcagatggagga

SEQ ID NO: 7856215 - DNA, 22 bp, Homo sapiens
cccagggaaggcagatggagga

SEQ ID NO: 7856216 - DNA, 22 bp, Homo sapiens
tgccatagcaatggtaagctga

SEQ ID NO: 7856217 - DNA, 22 bp, Homo sapiens
tgccatagcaatggtaagctga

SEQ ID NO: 7856218 - DNA, 22 bp, Homo sapiens
tgccagttgggaaaacagacat

SEQ ID NO: 7856219 - DNA, 22 bp, Homo sapiens
tgccagttgggaaaacagacat

SEQ ID NO: 7856220 - DNA, 22 bp, Homo sapiens
tgccagtgtggaactaggaaga

SEQ ID NO: 7856221 - DNA, 22 bp, Homo sapiens
tgccagtgtggaactaggaaga

SEQ ID NO: 7856222 - DNA, 22 bp, Homo sapiens
tgcccagccagtttatggtaat

SEQ ID NO: 7856223 - DNA, 22 bp, Homo sapiens
tgcccagccaatttgttatgtt

SEQ ID NO: 7856224 - DNA, 22 bp, Homo sapiens
tgcccagcccctatccctggga

SEQ ID NO: 7856225 - DNA, 22 bp, Homo sapiens
tgcccagccagtttatggtaat

SEQ ID NO: 7856226 - DNA, 22 bp, Homo sapiens
tgcccagccagtttatggtaat

SEQ ID NO: 7856227 - DNA, 22 bp, Homo sapiens
tgcccagccagtttatggtaat

SEQ ID NO: 7856228 - DNA, 22 bp, Homo sapiens
tgccatattattgagcatatta

SEQ ID NO: 7856229 - DNA, 22 bp, Homo sapiens
tgccatagcaatggtaagctga

SEQ ID NO: 7856230 - DNA, 22 bp, Homo sapiens
tgccatattgcaaagtgtctgc

SEQ ID NO: 7856231 - DNA, 22 bp, Homo sapiens
tgccatattgcaaagtgtctgc

SEQ ID NO: 7856232 - DNA, 22 bp, Homo sapiens
cccaggcagtgtgtgcatgcgt

SEQ ID NO: 7856233 - DNA, 22 bp, Homo sapiens
cccaggcatcccattaaggagc

SEQ ID NO: 7856234 - DNA, 19 bp, Homo sapiens
cccaggctacatggagagg

SEQ ID NO: 7856235 - DNA, 19 bp, Homo sapiens
cccaggctacatggagagg

SEQ ID NO: 7856236 - DNA, 19 bp, Homo sapiens
cccaggctacatggagagg

SEQ ID NO: 7856237 - DNA, 22 bp, Homo sapiens
tgcccagctgtcaaagtagata

SEQ ID NO: 7856238 - DNA, 22 bp, Homo sapiens
tgcccagctgtcaaagtagata

SEQ ID NO: 7856239 - DNA, 22 bp, Homo sapiens
tgcccagctgtcaaagtagata

SEQ ID NO: 7856240 - DNA, 22 bp, Homo sapiens
cccaggcagtgtgtgcatgcgt

SEQ ID NO: 7856241 - DNA, 22 bp, Homo sapiens
cccaggcagtgtgtgcatgcgt

SEQ ID NO: 7856242 - DNA, 22 bp, Homo sapiens
tgcccagcttcttacttttaaa

SEQ ID NO: 7856243 - DNA, 22 bp, Homo sapiens
tgcccagctgtcaaagtagata

SEQ ID NO: 7856244 - DNA, 22 bp, Homo sapiens
tgcccagcctaaacttggcaag

SEQ ID NO: 7856245 - DNA, 22 bp, Homo sapiens
tgcccagcctaaacttggcaag

SEQ ID NO: 7856246 - DNA, 22 bp, Homo sapiens
tgcccagcctaaacttggcaag

SEQ ID NO: 7856247 - DNA, 22 bp, Homo sapiens
tgcccagcctaaacttggcaag

SEQ ID NO: 7856248 - DNA, 22 bp, Homo sapiens
tgcccagcccctatccctggga

SEQ ID NO: 7856249 - DNA, 22 bp, Homo sapiens
tgcccagcctaaacttggcaag

SEQ ID NO: 7856250 - DNA, 22 bp, Homo sapiens
tgcccagcccctatccctggga

SEQ ID NO: 7856251 - DNA, 22 bp, Homo sapiens
tgcccagctattcctttcttag

SEQ ID NO: 7856252 - DNA, 22 bp, Homo sapiens
tgcccagctattcctttcttag

SEQ ID NO: 7856253 - DNA, 22 bp, Homo sapiens
tgcccagcgcccacattctgtc

SEQ ID NO: 7856254 - DNA, 22 bp, Homo sapiens
tgcccagcgcccacattctgtc

SEQ ID NO: 7856255 - DNA, 22 bp, Homo sapiens
tgcccagcgcccacattctgtc

SEQ ID NO: 7856256 - DNA, 22 bp, Homo sapiens
tgcccagcgcccacattctgtc

SEQ ID NO: 7856257 - DNA, 22 bp, Homo sapiens
tgccctggggtctggagcagca

SEQ ID NO: 7856258 - DNA, 21 bp, Homo sapiens
tgccctggggctcttccctca

SEQ ID NO: 7856259 - DNA, 21 bp, Homo sapiens
tgccctggggctcttccctca

SEQ ID NO: 7856260 - DNA, 22 bp, Homo sapiens
tgccctggggtctggagcagca

SEQ ID NO: 7856261 - DNA, 22 bp, Homo sapiens
tgccctggggtctggagcagca

SEQ ID NO: 7856262 - DNA, 22 bp, Homo sapiens
tgccctggggtctggagcagca

SEQ ID NO: 7856263 - DNA, 22 bp, Homo sapiens
tgccctggggtctggagcagca

SEQ ID NO: 7856264 - DNA, 22 bp, Homo sapiens
tgccctggggagcccagccagg

SEQ ID NO: 7856265 - DNA, 21 bp, Homo sapiens
tgccctggggctcttccctca

SEQ ID NO: 7856266 - DNA, 21 bp, Homo sapiens
tgccctggggctcttccctca

SEQ ID NO: 7856267 - DNA, 22 bp, Homo sapiens
tgccctggggagcccagccagg

SEQ ID NO: 7856268 - DNA, 22 bp, Homo sapiens
tgccctggggagcccagccagg

SEQ ID NO: 7856269 - DNA, 22 bp, Homo sapiens
tgccctggggagcccagccagg

SEQ ID NO: 7856270 - DNA, 22 bp, Homo sapiens
tgccctggggagcccagccagg

SEQ ID NO: 7856271 - DNA, 22 bp, Homo sapiens
tgccctgggctttgctatgact

SEQ ID NO: 7856272 - DNA, 22 bp, Homo sapiens
tgccctgggctttgctatgact

SEQ ID NO: 7856273 - DNA, 22 bp, Homo sapiens
tgccctgggctttgctatgact

SEQ ID NO: 7856274 - DNA, 22 bp, Homo sapiens
tgccctgggctttgctatgact

SEQ ID NO: 7856275 - DNA, 22 bp, Homo sapiens
tgccctgggagttggagctgct

SEQ ID NO: 7856276 - DNA, 22 bp, Homo sapiens
cccaggctcccaggtgggacaa

SEQ ID NO: 7856277 - DNA, 22 bp, Homo sapiens
tgccctgggagttggagctgct

SEQ ID NO: 7856278 - DNA, 22 bp, Homo sapiens
tgccctgggagttggagctgct

SEQ ID NO: 7856279 - DNA, 22 bp, Homo sapiens
tgccctgggagttggagctgct

SEQ ID NO: 7856280 - DNA, 22 bp, Homo sapiens
cccaggctcctactgtattctg

SEQ ID NO: 7856281 - DNA, 22 bp, Homo sapiens
cccaggctcctactgtattctg

SEQ ID NO: 7856282 - DNA, 22 bp, Homo sapiens
cccaggctcagactggcttgtt

SEQ ID NO: 7856283 - DNA, 22 bp, Homo sapiens
cccaggctcagactggcttgtt

SEQ ID NO: 7856284 - DNA, 22 bp, Homo sapiens
cccaggctcagactggcttgtt

SEQ ID NO: 7856285 - DNA, 22 bp, Homo sapiens
cccaggctcccaggtgggacaa

SEQ ID NO: 7856286 - DNA, 22 bp, Homo sapiens
cccaggctcccaggtgggacaa

SEQ ID NO: 7856287 - DNA, 22 bp, Homo sapiens
cccaggctcccaggtgggacaa

SEQ ID NO: 7856288 - DNA, 22 bp, Homo sapiens
cccaggctcccaggtgggacaa

SEQ ID NO: 7856289 - DNA, 22 bp, Homo sapiens
cccaggctcactgtccgcttcc

SEQ ID NO: 7856290 - DNA, 22 bp, Homo sapiens
cccaggctcactgtccgcttcc

SEQ ID NO: 7856291 - DNA, 22 bp, Homo sapiens
cccaggctcactgtccgcttcc

SEQ ID NO: 7856292 - DNA, 22 bp, Homo sapiens
cccaggctcagactggcttgtt

SEQ ID NO: 7856293 - DNA, 22 bp, Homo sapiens
cccaggctcagactggcttgtt

SEQ ID NO: 7856294 - DNA, 22 bp, Homo sapiens
cccaggctcagactggcttgtt

SEQ ID NO: 7856295 - DNA, 22 bp, Homo sapiens
cccaggctagtatgatatcagt

SEQ ID NO: 7856296 - DNA, 22 bp, Homo sapiens
cccaggctagtatgatatcagt

SEQ ID NO: 7856297 - DNA, 22 bp, Homo sapiens
cccaggctagtatgatatcagt

SEQ ID NO: 7856298 - DNA, 22 bp, Homo sapiens
cccaggctagtatgatatcagt

SEQ ID NO: 7856299 - DNA, 22 bp, Homo sapiens
cccaggctagtatgatatcagt

SEQ ID NO: 7856300 - DNA, 22 bp, Homo sapiens
cccaggctagaaaggccaacaa

SEQ ID NO: 7856301 - DNA, 22 bp, Homo sapiens
cccaggctagaaaggccaacaa

SEQ ID NO: 7856302 - DNA, 22 bp, Homo sapiens
cccaggctagaaaggccaacaa

SEQ ID NO: 7856303 - DNA, 19 bp, Homo sapiens
cccaggctacatggagagg

SEQ ID NO: 7856304 - DNA, 19 bp, Homo sapiens
cccaggctacatggagagg

SEQ ID NO: 7856305 - DNA, 22 bp, Homo sapiens
cccaggctagaaaggccaacaa

SEQ ID NO: 7856306 - DNA, 22 bp, Homo sapiens
tgccagtgcttgtgtctgagca

SEQ ID NO: 7856307 - DNA, 22 bp, Homo sapiens
tgccagtgcctgctgcccaata

SEQ ID NO: 7856308 - DNA, 22 bp, Homo sapiens
tgccagtgggtgtgcagagact

SEQ ID NO: 7856309 - DNA, 22 bp, Homo sapiens
tgccagtgaaacgtggtctcat

SEQ ID NO: 7856310 - DNA, 22 bp, Homo sapiens
tgccagtgaaacgtggtctcat

SEQ ID NO: 7856311 - DNA, 22 bp, Homo sapiens
tgccagtgaaacgtggtctcat

SEQ ID NO: 7856312 - DNA, 22 bp, Homo sapiens
tgccaggctaagtggaggactt

SEQ ID NO: 7856313 - DNA, 22 bp, Homo sapiens
tgccaggctaagtggaggactt

SEQ ID NO: 7856314 - DNA, 22 bp, Homo sapiens
cccaggagataacgttcccaag

SEQ ID NO: 7856315 - DNA, 22 bp, Homo sapiens
tgccaggctaagtggaggactt

SEQ ID NO: 7856316 - DNA, 22 bp, Homo sapiens
tgccagtctcaccctgggtcct

SEQ ID NO: 7856317 - DNA, 22 bp, Homo sapiens
tgccaggctaagtggaggactt

SEQ ID NO: 7856318 - DNA, 22 bp, Homo sapiens
cccaggagagaggccagttggc

SEQ ID NO: 7856319 - DNA, 22 bp, Homo sapiens
cccaggagagaggggataaagc

SEQ ID NO: 7856320 - DNA, 22 bp, Homo sapiens
cccaggagagaggggataaagc

SEQ ID NO: 7856321 - DNA, 22 bp, Homo sapiens
cccaggagagaggggataaagc

SEQ ID NO: 7856322 - DNA, 22 bp, Homo sapiens
cccaggagagggaaccaaatgt

SEQ ID NO: 7856323 - DNA, 22 bp, Homo sapiens
cccaggagagaggccagttggc

SEQ ID NO: 7856324 - DNA, 22 bp, Homo sapiens
cccaggagacctgtgaaaggac

SEQ ID NO: 7856325 - DNA, 22 bp, Homo sapiens
cccaggagacctgtgaaaggac

SEQ ID NO: 7856326 - DNA, 22 bp, Homo sapiens
cccaggagacctgtgaaaggac

SEQ ID NO: 7856327 - DNA, 22 bp, Homo sapiens
cccaggagacctagatctgttt

SEQ ID NO: 7856328 - DNA, 22 bp, Homo sapiens
cccaggagacctagatctgttt

SEQ ID NO: 7856329 - DNA, 22 bp, Homo sapiens
cccaggagagagacttgaatct

SEQ ID NO: 7856330 - DNA, 22 bp, Homo sapiens
cccaggagagagacttgaatct

SEQ ID NO: 7856331 - DNA, 22 bp, Homo sapiens
cccaggagagagacttgaatct

SEQ ID NO: 7856332 - DNA, 22 bp, Homo sapiens
cccaggagactgagctgtaacc

SEQ ID NO: 7856333 - DNA, 22 bp, Homo sapiens
cccaggagactgagctgtaacc

SEQ ID NO: 7856334 - DNA, 22 bp, Homo sapiens
cccaggagactgagctgtaacc

SEQ ID NO: 7856335 - DNA, 22 bp, Homo sapiens
tgccaggatggccagggggcca

SEQ ID NO: 7856336 - DNA, 22 bp, Homo sapiens
cccaggagacatatagaaggac

SEQ ID NO: 7856337 - DNA, 22 bp, Homo sapiens
cccaggagacatatagaaggac

SEQ ID NO: 7856338 - DNA, 22 bp, Homo sapiens
cccaggagacatatagaaggac

SEQ ID NO: 7856339 - DNA, 22 bp, Homo sapiens
cccaggagacctagatctgttt

SEQ ID NO: 7856340 - DNA, 22 bp, Homo sapiens
cccaggagacctagatctgttt

SEQ ID NO: 7856341 - DNA, 22 bp, Homo sapiens
cccaggagacatatagaaggac

SEQ ID NO: 7856342 - DNA, 22 bp, Homo sapiens
tgccaggagtcaggccaggcag

SEQ ID NO: 7856343 - DNA, 22 bp, Homo sapiens
tgccaggaggcggcttgggaaa

SEQ ID NO: 7856344 - DNA, 22 bp, Homo sapiens
tgccaggagtcaggccaggcag

SEQ ID NO: 7856345 - DNA, 22 bp, Homo sapiens
tgccaggatataagagtgcgat

SEQ ID NO: 7856346 - DNA, 22 bp, Homo sapiens
tgccaggatataagagtgcgat

SEQ ID NO: 7856347 - DNA, 22 bp, Homo sapiens
tgccaggagtgtagagtggttt

SEQ ID NO: 7856348 - DNA, 22 bp, Homo sapiens
tgccaggagtgtagagtggttt

SEQ ID NO: 7856349 - DNA, 22 bp, Homo sapiens
tgccagcttgtggtcagaggct

SEQ ID NO: 7856350 - DNA, 22 bp, Homo sapiens
tgccagcttttgactatcttag

SEQ ID NO: 7856351 - DNA, 22 bp, Homo sapiens
tgccagcttcttacggctgcct

SEQ ID NO: 7856352 - DNA, 22 bp, Homo sapiens
tgccagcttctaaggacccagg

SEQ ID NO: 7856353 - DNA, 22 bp, Homo sapiens
tgccagcttctaaggacccagg

SEQ ID NO: 7856354 - DNA, 22 bp, Homo sapiens
tgccagcttgtggtcagaggct

SEQ ID NO: 7856355 - DNA, 22 bp, Homo sapiens
tgccagcttgtggtcagaggct

SEQ ID NO: 7856356 - DNA, 22 bp, Homo sapiens
tgccagcttcttacggctgcct

SEQ ID NO: 7856357 - DNA, 22 bp, Homo sapiens
tgccagcttcttacggctgcct

SEQ ID NO: 7856358 - DNA, 22 bp, Homo sapiens
tgccagctgttcccacccaaaa

SEQ ID NO: 7856359 - DNA, 22 bp, Homo sapiens
tgccagcttctaaggacccagg

SEQ ID NO: 7856360 - DNA, 22 bp, Homo sapiens
tgccagctgcttgtcccccaca

SEQ ID NO: 7856361 - DNA, 22 bp, Homo sapiens
tgccagctgacagcagagacaa

SEQ ID NO: 7856362 - DNA, 22 bp, Homo sapiens
tgccagctgacagcagagacaa

SEQ ID NO: 7856363 - DNA, 21 bp, Homo sapiens
tgccagctgctgcatctgtct

SEQ ID NO: 7856364 - DNA, 22 bp, Homo sapiens
tgccagctgacagcagagacaa

SEQ ID NO: 7856365 - DNA, 22 bp, Homo sapiens
tgccagctcctgcagctcctgt

SEQ ID NO: 7856366 - DNA, 22 bp, Homo sapiens
tgccagctgacagcagagacaa

SEQ ID NO: 7856367 - DNA, 22 bp, Homo sapiens
tgccagctcctgcagctcctgt

SEQ ID NO: 7856368 - DNA, 19 bp, Homo sapiens
tgccaggaatactccagaa

SEQ ID NO: 7856369 - DNA, 22 bp, Homo sapiens
tgccaggaagtgtgtgggcctg

SEQ ID NO: 7856370 - DNA, 22 bp, Homo sapiens
tgccaggacaaggaccacatgg

SEQ ID NO: 7856371 - DNA, 22 bp, Homo sapiens
tgccaggacaaggaccacatgg

SEQ ID NO: 7856372 - DNA, 19 bp, Homo sapiens
tgccaggaatactccagaa

SEQ ID NO: 7856373 - DNA, 19 bp, Homo sapiens
tgccaggaatactccagaa

SEQ ID NO: 7856374 - DNA, 19 bp, Homo sapiens
tgccaggaatactccagaa

SEQ ID NO: 7856375 - DNA, 22 bp, Homo sapiens
tgccaggaagtgtgtgggcctg

SEQ ID NO: 7856376 - DNA, 22 bp, Homo sapiens
tgccaggaggaggtgggacaga

SEQ ID NO: 7856377 - DNA, 22 bp, Homo sapiens
tgccaggaggaggtgggacaga

SEQ ID NO: 7856378 - DNA, 22 bp, Homo sapiens
tgccaggaggaggtgggacaga

SEQ ID NO: 7856379 - DNA, 22 bp, Homo sapiens
tgccaggaggaggtgggacaga

SEQ ID NO: 7856380 - DNA, 22 bp, Homo sapiens
tgccaggagagtgcatgcaggg

SEQ ID NO: 7856381 - DNA, 22 bp, Homo sapiens
tgccaggagagtgcatgcaggg

SEQ ID NO: 7856382 - DNA, 22 bp, Homo sapiens
tgccaggaaactgtatatcttg

SEQ ID NO: 7856383 - DNA, 22 bp, Homo sapiens
tgccacagaggtgaagcccact

SEQ ID NO: 7856384 - DNA, 22 bp, Homo sapiens
tgccacagaggtgaagcccact

SEQ ID NO: 7856385 - DNA, 22 bp, Homo sapiens
tgccacaggcaatccctgcacg

SEQ ID NO: 7856386 - DNA, 19 bp, Homo sapiens
tgccacagataaaaactga

SEQ ID NO: 7856387 - DNA, 22 bp, Homo sapiens
tgccagctcctgcagctcctgt

SEQ ID NO: 7856388 - DNA, 22 bp, Homo sapiens
tgccagctccgaggagctgcag

SEQ ID NO: 7856389 - DNA, 22 bp, Homo sapiens
tgccagctcctgcagctcctgt

SEQ ID NO: 7856390 - DNA, 22 bp, Homo sapiens
tgccagctccgaggagctgcag

SEQ ID NO: 7856391 - DNA, 22 bp, Homo sapiens
tgccagctcctgcagctcctgt

SEQ ID NO: 7856392 - DNA, 22 bp, Homo sapiens
tgccagctccgaggagctgcag

SEQ ID NO: 7856393 - DNA, 22 bp, Homo sapiens
tgccagctcccttttctcctcc

SEQ ID NO: 7856394 - DNA, 22 bp, Homo sapiens
tgccagctcccttttctcctcc

SEQ ID NO: 7856395 - DNA, 22 bp, Homo sapiens
tgcacagagcaggcaccagcgg

SEQ ID NO: 7856396 - DNA, 22 bp, Homo sapiens
tgcacagagcaggcaccagcgg

SEQ ID NO: 7856397 - DNA, 22 bp, Homo sapiens
tgcacagagcaggcaccagcgg

SEQ ID NO: 7856398 - DNA, 22 bp, Homo sapiens
tgcacagagggaggcataaaat

SEQ ID NO: 7856399 - DNA, 22 bp, Homo sapiens
tgcacagagctggactccgcgg

SEQ ID NO: 7856400 - DNA, 22 bp, Homo sapiens
tgcacagatagtgatagatagc

SEQ ID NO: 7856401 - DNA, 22 bp, Homo sapiens
tgcacagatagtgatagatagc

SEQ ID NO: 7856402 - DNA, 22 bp, Homo sapiens
tgcacagagagatgagacacgt

SEQ ID NO: 7856403 - DNA, 22 bp, Homo sapiens
tgcacagagagatgagacacgt

SEQ ID NO: 7856404 - DNA, 22 bp, Homo sapiens
tgcacagagagatgagacacgt

SEQ ID NO: 7856405 - DNA, 22 bp, Homo sapiens
tgcacagagagatgagacacgt

SEQ ID NO: 7856406 - DNA, 20 bp, Homo sapiens
tgcacagacaatgagcccag

SEQ ID NO: 7856407 - DNA, 22 bp, Homo sapiens
tgcacagacatacacatatatg

SEQ ID NO: 7856408 - DNA, 22 bp, Homo sapiens
tgcacagacatacacatatatg

SEQ ID NO: 7856409 - DNA, 18 bp, Homo sapiens
cccggctaatttttggta

SEQ ID NO: 7856410 - DNA, 18 bp, Homo sapiens
cccggctaatttttggta

SEQ ID NO: 7856411 - DNA, 18 bp, Homo sapiens
cccggctaatttttggta

SEQ ID NO: 7856412 - DNA, 22 bp, Homo sapiens
tgctgtgctccattgtcttcac

SEQ ID NO: 7856413 - DNA, 18 bp, Homo sapiens
cccggctaatttttggta

SEQ ID NO: 7856414 - DNA, 22 bp, Homo sapiens
tgctgtggattcagagatgaaa

SEQ ID NO: 7856415 - DNA, 23 bp, Homo sapiens
tgctgtggatggcaggtccttgc

SEQ ID NO: 7856416 - DNA, 22 bp, Homo sapiens
tgctgtgctggcggcagaggcc

SEQ ID NO: 7856417 - DNA, 22 bp, Homo sapiens
tgctgtgctctttaaggtgctg

SEQ ID NO: 7856418 - DNA, 22 bp, Homo sapiens
tgctgtgctggcggcagaggcc

SEQ ID NO: 7856419 - DNA, 22 bp, Homo sapiens
tgctgtgctggcggcagaggcc

SEQ ID NO: 7856420 - DNA, 22 bp, Homo sapiens
tgctgtgtaaaaggtgattgaa

SEQ ID NO: 7856421 - DNA, 22 bp, Homo sapiens
tgctgtgtaaaaggtgattgaa

SEQ ID NO: 7856422 - DNA, 22 bp, Homo sapiens
tgctgtgtctttctgtgaaaag

SEQ ID NO: 7856423 - DNA, 22 bp, Homo sapiens
tgctgtgtaaaaggtgattgaa

SEQ ID NO: 7856424 - DNA, 22 bp, Homo sapiens
tgctgtgtaaaaggtgattgaa

SEQ ID NO: 7856425 - DNA, 22 bp, Homo sapiens
tgctgtggttcccagagtggat

SEQ ID NO: 7856426 - DNA, 22 bp, Homo sapiens
tgctgtggttcccagagtggat

SEQ ID NO: 7856427 - DNA, 22 bp, Homo sapiens
tgctgtgggcagtacataagct

SEQ ID NO: 7856428 - DNA, 22 bp, Homo sapiens
tgctgtgggatatatgttcaaa

SEQ ID NO: 7856429 - DNA, 22 bp, Homo sapiens
tgctgtgggatatatgttcaaa

SEQ ID NO: 7856430 - DNA, 22 bp, Homo sapiens
tgctgtggattcagagatgaaa

SEQ ID NO: 7856431 - DNA, 22 bp, Homo sapiens
tgctgtggattcagagatgaaa

SEQ ID NO: 7856432 - DNA, 22 bp, Homo sapiens
tgctgtggcagtttatgtatag

SEQ ID NO: 7856433 - DNA, 22 bp, Homo sapiens
tgctgttatacttagctggtta

SEQ ID NO: 7856434 - DNA, 22 bp, Homo sapiens
tgctgttagtaaggaacatgac

SEQ ID NO: 7856435 - DNA, 22 bp, Homo sapiens
tgctgtgttctcctgactcacc

SEQ ID NO: 7856436 - DNA, 22 bp, Homo sapiens
tgctgtgttctcctgactcacc

SEQ ID NO: 7856437 - DNA, 22 bp, Homo sapiens
tggaagggagctggaatttgga

SEQ ID NO: 7856438 - DNA, 22 bp, Homo sapiens
tggaagggagctggaatttgga

SEQ ID NO: 7856439 - DNA, 22 bp, Homo sapiens
tggaagggagctggaatttgga

SEQ ID NO: 7856440 - DNA, 22 bp, Homo sapiens
tggaagggagctggaatttgga

SEQ ID NO: 7856441 - DNA, 22 bp, Homo sapiens
tggaagggagctggaatttgga

SEQ ID NO: 7856442 - DNA, 22 bp, Homo sapiens
tggaagggagctggaatttgga

SEQ ID NO: 7856443 - DNA, 22 bp, Homo sapiens
tggaagggagctggaatttgga

SEQ ID NO: 7856444 - DNA, 22 bp, Homo sapiens
tggaatggaaacaaactgagga

SEQ ID NO: 7856445 - DNA, 22 bp, Homo sapiens
tggaatggaaacaaactgagga

SEQ ID NO: 7856446 - DNA, 22 bp, Homo sapiens
tggaatggaaacaaactgagga

SEQ ID NO: 7856447 - DNA, 22 bp, Homo sapiens
tggaatggaaacaaactgagga

SEQ ID NO: 7856448 - DNA, 22 bp, Homo sapiens
tggaatggaaacaaactgagga

SEQ ID NO: 7856449 - DNA, 22 bp, Homo sapiens
tggaagggagctggaatttgga

SEQ ID NO: 7856450 - DNA, 22 bp, Homo sapiens
tgctgtgtggatgtgaagaatc

SEQ ID NO: 7856451 - DNA, 20 bp, Homo sapiens
tgctgtgtggcccagcatga

SEQ ID NO: 7856452 - DNA, 22 bp, Homo sapiens
tgctgtgtggatgtgaagaatc

SEQ ID NO: 7856453 - DNA, 20 bp, Homo sapiens
tgctgtgtggcccagcatga

SEQ ID NO: 7856454 - DNA, 22 bp, Homo sapiens
tgctgtgttaaatacaagcatg

SEQ ID NO: 7856455 - DNA, 20 bp, Homo sapiens
tgctgtgtggcccagcatga

SEQ ID NO: 7856456 - DNA, 22 bp, Homo sapiens
tgctgtgtggatgtgaagaatc

SEQ ID NO: 7856457 - DNA, 22 bp, Homo sapiens
tgctgtgtctttctgtgaaaag

SEQ ID NO: 7856458 - DNA, 22 bp, Homo sapiens
tgctgtgtctttctgtgaaaag

SEQ ID NO: 7856459 - DNA, 22 bp, Homo sapiens
tgctgtgtggatgtgaagaatc

SEQ ID NO: 7856460 - DNA, 22 bp, Homo sapiens
tgctgtgttcctcagtttcatg

SEQ ID NO: 7856461 - DNA, 22 bp, Homo sapiens
tgctgtgttcctcagtttcatg

SEQ ID NO: 7856462 - DNA, 22 bp, Homo sapiens
tgctgtgttcaccaatatgtgt

SEQ ID NO: 7856463 - DNA, 22 bp, Homo sapiens
tgctgtgttaaatacaagcatg

SEQ ID NO: 7856464 - DNA, 22 bp, Homo sapiens
tgctgtgttaaatacaagcatg

SEQ ID NO: 7856465 - DNA, 22 bp, Homo sapiens
tgctgtgttaaatacaagcatg

SEQ ID NO: 7856466 - DNA, 22 bp, Homo sapiens
tgctgtgttactgagatccggc

SEQ ID NO: 7856467 - DNA, 22 bp, Homo sapiens
ccctcctctccctaagagtcac

SEQ ID NO: 7856468 - DNA, 22 bp, Homo sapiens
ccctcctctccctaagagtcac

SEQ ID NO: 7856469 - DNA, 22 bp, Homo sapiens
ccctcctctccctaagagtcac

SEQ ID NO: 7856470 - DNA, 22 bp, Homo sapiens
ccctcctctccctaagagtcac

SEQ ID NO: 7856471 - DNA, 22 bp, Homo sapiens
tggaatgttaaacctcaatgat

SEQ ID NO: 7856472 - DNA, 22 bp, Homo sapiens
tggaatgtgttctattttacag

SEQ ID NO: 7856473 - DNA, 22 bp, Homo sapiens
ccctcctctccctaagagtcac

SEQ ID NO: 7856474 - DNA, 22 bp, Homo sapiens
ccctcctcaactctggcttcca

SEQ ID NO: 7856475 - DNA, 22 bp, Homo sapiens
ccctcctgtgcctgaggccagc

SEQ ID NO: 7856476 - DNA, 22 bp, Homo sapiens
ccctcctgtgcctgaggccagc

SEQ ID NO: 7856477 - DNA, 22 bp, Homo sapiens
ccctcctggaggcggatgccca

SEQ ID NO: 7856478 - DNA, 22 bp, Homo sapiens
ccctcctggaggcggatgccca

SEQ ID NO: 7856479 - DNA, 22 bp, Homo sapiens
ccctcctctccctaagagtcac

SEQ ID NO: 7856480 - DNA, 22 bp, Homo sapiens
ccctccttaccaccacagctcc

SEQ ID NO: 7856481 - DNA, 22 bp, Homo sapiens
ccctccttaccaccacagctcc

SEQ ID NO: 7856482 - DNA, 22 bp, Homo sapiens
ccctcctgtgcctgaggccagc

SEQ ID NO: 7856483 - DNA, 22 bp, Homo sapiens
ccctccttaccaccacagctcc

SEQ ID NO: 7856484 - DNA, 22 bp, Homo sapiens
ccctcgccgcagctgcttcccg

SEQ ID NO: 7856485 - DNA, 22 bp, Homo sapiens
ccctcctttctaggcttccagc

SEQ ID NO: 7856486 - DNA, 22 bp, Homo sapiens
ccctcgctctaggcagccctgt

SEQ ID NO: 7856487 - DNA, 22 bp, Homo sapiens
ccctcgccgcagctgcttcccg

SEQ ID NO: 7856488 - DNA, 22 bp, Homo sapiens
ccctcgctctaggcagccctgt

SEQ ID NO: 7856489 - DNA, 22 bp, Homo sapiens
ccctctacagggaagcgctttc

SEQ ID NO: 7856490 - DNA, 22 bp, Homo sapiens
ccctcgtgcatccatcatttag

SEQ ID NO: 7856491 - DNA, 21 bp, Homo sapiens
tggaatgtacctccctctctt

SEQ ID NO: 7856492 - DNA, 22 bp, Homo sapiens
tggaatgtagcaagtgttgtca

SEQ ID NO: 7856493 - DNA, 20 bp, Homo sapiens
tggaatgtagtcggtgagag

SEQ ID NO: 7856494 - DNA, 22 bp, Homo sapiens
tggaatgtagtgtccatggaat

SEQ ID NO: 7856495 - DNA, 22 bp, Homo sapiens
tggaatgtaaagggtatgggat

SEQ ID NO: 7856496 - DNA, 22 bp, Homo sapiens
tggaatgtaatcagaatatgaa

SEQ ID NO: 7856497 - DNA, 22 bp, Homo sapiens
tggaatgtaatcatgtggtggt

SEQ ID NO: 7856498 - DNA, 22 bp, Homo sapiens
tggaatgtaaagcgtgtgataa

SEQ ID NO: 7856499 - DNA, 22 bp, Homo sapiens
tggaatgtaaacctcaggtggg

SEQ ID NO: 7856500 - DNA, 22 bp, Homo sapiens
tggaatgtaaacctcaggtggg

SEQ ID NO: 7856501 - DNA, 22 bp, Homo sapiens
tggaatgtaaactctgtgaggg

SEQ ID NO: 7856502 - DNA, 22 bp, Homo sapiens
tggaatggggactttgggacat

SEQ ID NO: 7856503 - DNA, 22 bp, Homo sapiens
tggaatggaaacaaactgagga

SEQ ID NO: 7856504 - DNA, 22 bp, Homo sapiens
tggaatggaaacaaactgagga

SEQ ID NO: 7856505 - DNA, 22 bp, Homo sapiens
tggaatgtatagatgttatgta

SEQ ID NO: 7856506 - DNA, 22 bp, Homo sapiens
tggaatgtattaagtattgagt

SEQ ID NO: 7856507 - DNA, 22 bp, Homo sapiens
tggaatgtcaaaagtctgctat

SEQ ID NO: 7856508 - DNA, 22 bp, Homo sapiens
tggaatgtcaagaagcagtaag

SEQ ID NO: 7856509 - DNA, 23 bp, Homo sapiens
tggaatgtctgattctgctctag

SEQ ID NO: 7856510 - DNA, 22 bp, Homo sapiens
tggaatgtcataccataaaaga

SEQ ID NO: 7856511 - DNA, 22 bp, Homo sapiens
tggaatgtcagctacaagaggg

SEQ ID NO: 7856512 - DNA, 22 bp, Homo sapiens
tggaatgtgctagggctgtggc

SEQ ID NO: 7856513 - DNA, 22 bp, Homo sapiens
tggaatgtgctagggctgtggc

SEQ ID NO: 7856514 - DNA, 22 bp, Homo sapiens
tggaatgtggataagggtgtct

SEQ ID NO: 7856515 - DNA, 22 bp, Homo sapiens
tggaatgtggtatcagtagaaa

SEQ ID NO: 7856516 - DNA, 22 bp, Homo sapiens
tggaatgtgagaataccgtttt

SEQ ID NO: 7856517 - DNA, 22 bp, Homo sapiens
tggaatgtgctactgttgattt

SEQ ID NO: 7856518 - DNA, 22 bp, Homo sapiens
tggaatgtcttgatatagaggt

SEQ ID NO: 7856519 - DNA, 22 bp, Homo sapiens
tggaatgtgaacatacaaggta

SEQ ID NO: 7856520 - DNA, 22 bp, Homo sapiens
ccctctccctgcagaatgtggc

SEQ ID NO: 7856521 - DNA, 22 bp, Homo sapiens
ccctctccctgcagaatgtggc

SEQ ID NO: 7856522 - DNA, 22 bp, Homo sapiens
ccctctcagtcagagccagata

SEQ ID NO: 7856523 - DNA, 18 bp, Homo sapiens
ccctctcctgctagtggg

SEQ ID NO: 7856524 - DNA, 18 bp, Homo sapiens
ccctctcctgctagtggg

SEQ ID NO: 7856525 - DNA, 18 bp, Homo sapiens
ccctctcctgctagtggg

SEQ ID NO: 7856526 - DNA, 18 bp, Homo sapiens
ccctctcctgctagtggg

SEQ ID NO: 7856527 - DNA, 22 bp, Homo sapiens
ccctctccctgcagaatgtggc

SEQ ID NO: 7856528 - DNA, 22 bp, Homo sapiens
ccctctcctggctgcatggagc

SEQ ID NO: 7856529 - DNA, 18 bp, Homo sapiens
ccctctcctgctagtggg

SEQ ID NO: 7856530 - DNA, 22 bp, Homo sapiens
ccctctcctggctgcatggagc

SEQ ID NO: 7856531 - DNA, 22 bp, Homo sapiens
ccctctcctggctgcatggagc

SEQ ID NO: 7856532 - DNA, 22 bp, Homo sapiens
ccctctcctggctgcatggagc

SEQ ID NO: 7856533 - DNA, 22 bp, Homo sapiens
ccctctcctggctgcatggagc

SEQ ID NO: 7856534 - DNA, 19 bp, Homo sapiens
ccctcttgcacaaagcaaa

SEQ ID NO: 7856535 - DNA, 19 bp, Homo sapiens
ccctcttgcacaaagcaaa

SEQ ID NO: 7856536 - DNA, 22 bp, Homo sapiens
ccctctctcaggctgacagcct

SEQ ID NO: 7856537 - DNA, 19 bp, Homo sapiens
ccctcttgcacaaagcaaa

SEQ ID NO: 7856538 - DNA, 19 bp, Homo sapiens
ccctcttgcacaaagcaaa

SEQ ID NO: 7856539 - DNA, 22 bp, Homo sapiens
ccctctctcaggctgacagcct

SEQ ID NO: 7856540 - DNA, 22 bp, Homo sapiens
ccctctctcaggctgacagcct

SEQ ID NO: 7856541 - DNA, 19 bp, Homo sapiens
ccctcttgcacaaagcaaa

SEQ ID NO: 7856542 - DNA, 19 bp, Homo sapiens
ccctcttgcacaaagcaaa

SEQ ID NO: 7856543 - DNA, 19 bp, Homo sapiens
ccctcttgcacaaagcaaa

SEQ ID NO: 7856544 - DNA, 22 bp, Homo sapiens
ccctgacttgatctttgacttg

SEQ ID NO: 7856545 - DNA, 20 bp, Homo sapiens
ccctgagacaaaggaggggc

SEQ ID NO: 7856546 - DNA, 20 bp, Homo sapiens
ccctgagacaaaggaggggc

SEQ ID NO: 7856547 - DNA, 22 bp, Homo sapiens
ccctgaccctatcagagggcca

SEQ ID NO: 7856548 - DNA, 22 bp, Homo sapiens
ccctgaccccacggctggagaa

SEQ ID NO: 7856549 - DNA, 22 bp, Homo sapiens
ccctgaccctatcagagggcca

SEQ ID NO: 7856550 - DNA, 22 bp, Homo sapiens
ccctgaccctatcagagggcca

SEQ ID NO: 7856551 - DNA, 22 bp, Homo sapiens
ccctgagaacaacttaggggtc

SEQ ID NO: 7856552 - DNA, 22 bp, Homo sapiens
ccctgacagatggcaggggagc

SEQ ID NO: 7856553 - DNA, 18 bp, Homo sapiens
ccctgaagggcaagataa

SEQ ID NO: 7856554 - DNA, 22 bp, Homo sapiens
ccctgaacagtgagagataggg

SEQ ID NO: 7856555 - DNA, 18 bp, Homo sapiens
ccctgaagggcaagataa

SEQ ID NO: 7856556 - DNA, 22 bp, Homo sapiens
ccctgaccatcccgcactgact

SEQ ID NO: 7856557 - DNA, 22 bp, Homo sapiens
ccctgaccaccagctccatttg

SEQ ID NO: 7856558 - DNA, 22 bp, Homo sapiens
ccctgaccagcagtacttggta

SEQ ID NO: 7856559 - DNA, 22 bp, Homo sapiens
ccctgacccaaaactgtcagaa

SEQ ID NO: 7856560 - DNA, 22 bp, Homo sapiens
ccctgacccaaaactgtcagaa

SEQ ID NO: 7856561 - DNA, 20 bp, Homo sapiens
ccctgagacgactgagctcc

SEQ ID NO: 7856562 - DNA, 22 bp, Homo sapiens
ccctgagagcagggtctttctc

SEQ ID NO: 7856563 - DNA, 20 bp, Homo sapiens
ccctgagacgactgagctcc

SEQ ID NO: 7856564 - DNA, 20 bp, Homo sapiens
ccctgagacgactgagctcc

SEQ ID NO: 7856565 - DNA, 20 bp, Homo sapiens
ccctgagacgactgagctcc

SEQ ID NO: 7856566 - DNA, 20 bp, Homo sapiens
ccctgagaccagagagcagc

SEQ ID NO: 7856567 - DNA, 20 bp, Homo sapiens
ccctgagaccagagagcagc

SEQ ID NO: 7856568 - DNA, 20 bp, Homo sapiens
ccctgagacaaaggaggggc

SEQ ID NO: 7856569 - DNA, 20 bp, Homo sapiens
ccctgagacaaaggaggggc

SEQ ID NO: 7856570 - DNA, 20 bp, Homo sapiens
ccctgagacaaaggaggggc

SEQ ID NO: 7856571 - DNA, 22 bp, Homo sapiens
ccctgagccgctgctccaacct

SEQ ID NO: 7856572 - DNA, 22 bp, Homo sapiens
ccctgagccgcctgccgtgtcc

SEQ ID NO: 7856573 - DNA, 22 bp, Homo sapiens
ccctgagccgctgctccaacct

SEQ ID NO: 7856574 - DNA, 22 bp, Homo sapiens
ccctgagccacacagagcaggt

SEQ ID NO: 7856575 - DNA, 22 bp, Homo sapiens
ccctgagccacacagagcaggt

SEQ ID NO: 7856576 - DNA, 22 bp, Homo sapiens
ccctgagcattcatgtgagctt

SEQ ID NO: 7856577 - DNA, 22 bp, Homo sapiens
ccctgagcattcatgtgagctt

SEQ ID NO: 7856578 - DNA, 22 bp, Homo sapiens
ccctgagcattcatgtgagctt

SEQ ID NO: 7856579 - DNA, 22 bp, Homo sapiens
ccctgagcaacaaactgaatac

SEQ ID NO: 7856580 - DNA, 22 bp, Homo sapiens
ccctgagcacacctggcagaca

SEQ ID NO: 7856581 - DNA, 22 bp, Homo sapiens
ccctgagcaacaaactgaatac

SEQ ID NO: 7856582 - DNA, 22 bp, Homo sapiens
ccctgagcacacctggcagaca

SEQ ID NO: 7856583 - DNA, 22 bp, Homo sapiens
ccctgagcacacctggcagaca

SEQ ID NO: 7856584 - DNA, 22 bp, Homo sapiens
ccctgagaggttgagtgtctgc

SEQ ID NO: 7856585 - DNA, 22 bp, Homo sapiens
ccctgagatgcctcaccctagt

SEQ ID NO: 7856586 - DNA, 18 bp, Homo sapiens
ccctgagatgatgctgtg

SEQ ID NO: 7856587 - DNA, 22 bp, Homo sapiens
ccctgaggaaagggtggagggc

SEQ ID NO: 7856588 - DNA, 22 bp, Homo sapiens
ccctgaggaaagggtggagggc

SEQ ID NO: 7856589 - DNA, 22 bp, Homo sapiens
ccctgaggaaagggtggagggc

SEQ ID NO: 7856590 - DNA, 23 bp, Homo sapiens
ccctgagctggtccaggctcaac

SEQ ID NO: 7856591 - DNA, 23 bp, Homo sapiens
ccctgagctggtccaggctcaac

SEQ ID NO: 7856592 - DNA, 19 bp, Homo sapiens
tggagcacctaggaataga

SEQ ID NO: 7856593 - DNA, 22 bp, Homo sapiens
ccctgaggaccaggaaggaggg

SEQ ID NO: 7856594 - DNA, 22 bp, Homo sapiens
ccctgaggaccaggaaggaggg

SEQ ID NO: 7856595 - DNA, 22 bp, Homo sapiens
ccctgaggaccaggaaggaggg

SEQ ID NO: 7856596 - DNA, 22 bp, Homo sapiens
tggagcaggactgctgccctca

SEQ ID NO: 7856597 - DNA, 22 bp, Homo sapiens
tggagcaggacggggagtggta

SEQ ID NO: 7856598 - DNA, 22 bp, Homo sapiens
tggagcaggacggggagtggta

SEQ ID NO: 7856599 - DNA, 22 bp, Homo sapiens
tggagcaggacggggagtggta

SEQ ID NO: 7856600 - DNA, 22 bp, Homo sapiens
tggagcagaaatggcctcttgt

SEQ ID NO: 7856601 - DNA, 22 bp, Homo sapiens
tggagcagaaatggcctcttgt

SEQ ID NO: 7856602 - DNA, 22 bp, Homo sapiens
tggagcagaaatggcctcttgt

SEQ ID NO: 7856603 - DNA, 22 bp, Homo sapiens
tggagcaggactgctgccctca

SEQ ID NO: 7856604 - DNA, 22 bp, Homo sapiens
tggagcaggactgctgccctca

SEQ ID NO: 7856605 - DNA, 16 bp, Homo sapiens
tggagcaggcaggatg

SEQ ID NO: 7856606 - DNA, 16 bp, Homo sapiens
tggagcaggcaggatg

SEQ ID NO: 7856607 - DNA, 16 bp, Homo sapiens
tggagcaggcaggatg

SEQ ID NO: 7856608 - DNA, 22 bp, Homo sapiens
ccccacactctttacattcata

SEQ ID NO: 7856609 - DNA, 22 bp, Homo sapiens
ccccacagccgccagcagggag

SEQ ID NO: 7856610 - DNA, 22 bp, Homo sapiens
ccccacagcttgtggagagaat

SEQ ID NO: 7856611 - DNA, 22 bp, Homo sapiens
ccccacagtccgtgaggagcca

SEQ ID NO: 7856612 - DNA, 22 bp, Homo sapiens
ccccacagtccgtgaggagcca

SEQ ID NO: 7856613 - DNA, 22 bp, Homo sapiens
ccccacagtccgtgaggagcca

SEQ ID NO: 7856614 - DNA, 22 bp, Homo sapiens
ccccacagtccgtgaggagcca

SEQ ID NO: 7856615 - DNA, 22 bp, Homo sapiens
ccccacaactcatgttgaaact

SEQ ID NO: 7856616 - DNA, 22 bp, Homo sapiens
ccccacaactcatgttgaaact

SEQ ID NO: 7856617 - DNA, 22 bp, Homo sapiens
ccccacaactcatgttgaaact

SEQ ID NO: 7856618 - DNA, 22 bp, Homo sapiens
ccccacaactcatgttgaaact

SEQ ID NO: 7856619 - DNA, 22 bp, Homo sapiens
ccccacacctgccgggcagcag

SEQ ID NO: 7856620 - DNA, 22 bp, Homo sapiens
ccccacacctgccgggcagcag

SEQ ID NO: 7856621 - DNA, 22 bp, Homo sapiens
ccccacacctgccgggcagcag

SEQ ID NO: 7856622 - DNA, 20 bp, Homo sapiens
ccccacactattgagcactt

SEQ ID NO: 7856623 - DNA, 20 bp, Homo sapiens
ccccacactattgagcactt

SEQ ID NO: 7856624 - DNA, 20 bp, Homo sapiens
ccccacactattgagcactt

SEQ ID NO: 7856625 - DNA, 22 bp, Homo sapiens
ccccacacctgccgggcagcag

SEQ ID NO: 7856626 - DNA, 20 bp, Homo sapiens
ccccacactattgagcactt

SEQ ID NO: 7856627 - DNA, 22 bp, Homo sapiens
ccccacactctttacattcata

SEQ ID NO: 7856628 - DNA, 22 bp, Homo sapiens
ccccacagccgccagcagggag

SEQ ID NO: 7856629 - DNA, 22 bp, Homo sapiens
ccccacccacctaagagaaact

SEQ ID NO: 7856630 - DNA, 22 bp, Homo sapiens
ccccacccacctaagagaaact

SEQ ID NO: 7856631 - DNA, 22 bp, Homo sapiens
ccccacccacctaagagaaact

SEQ ID NO: 7856632 - DNA, 22 bp, Homo sapiens
ccccacccacctaagagaaact

SEQ ID NO: 7856633 - DNA, 22 bp, Homo sapiens
ccccaccctcgctccatttcgg

SEQ ID NO: 7856634 - DNA, 22 bp, Homo sapiens
ccccaccctcgctccatttcgg

SEQ ID NO: 7856635 - DNA, 22 bp, Homo sapiens
ccccaccctcgctccatttcgg

SEQ ID NO: 7856636 - DNA, 22 bp, Homo sapiens
ccccaccctcgctccatttcgg

SEQ ID NO: 7856637 - DNA, 22 bp, Homo sapiens
ccccaccctcgctccatttcgg

SEQ ID NO: 7856638 - DNA, 22 bp, Homo sapiens
ccccaccagcaccctctctatc

SEQ ID NO: 7856639 - DNA, 22 bp, Homo sapiens
ccccaccagcaccctctctatc

SEQ ID NO: 7856640 - DNA, 22 bp, Homo sapiens
ccccaccagcaccctctctatc

SEQ ID NO: 7856641 - DNA, 22 bp, Homo sapiens
ccccaccagcaccctctctatc

SEQ ID NO: 7856642 - DNA, 22 bp, Homo sapiens
ccccaccaccaaggctcagttt

SEQ ID NO: 7856643 - DNA, 22 bp, Homo sapiens
ccccaccaccaaggctcagttt

SEQ ID NO: 7856644 - DNA, 22 bp, Homo sapiens
ccccacccacctaagagaaact

SEQ ID NO: 7856645 - DNA, 22 bp, Homo sapiens
ccccaccatgtagaaactgaga

SEQ ID NO: 7856646 - DNA, 22 bp, Homo sapiens
ccccaccatgtagaaactgaga

SEQ ID NO: 7856647 - DNA, 22 bp, Homo sapiens
tgctggagcccaggcggccttt

SEQ ID NO: 7856648 - DNA, 22 bp, Homo sapiens
tgctggagcccaggcggccttt

SEQ ID NO: 7856649 - DNA, 21 bp, Homo sapiens
tgctggccatgtgctgggcat

SEQ ID NO: 7856650 - DNA, 21 bp, Homo sapiens
tgctggccatgtgctgggcat

SEQ ID NO: 7856651 - DNA, 21 bp, Homo sapiens
tgctggccatgtgctgggcat

SEQ ID NO: 7856652 - DNA, 21 bp, Homo sapiens
tgctggccatgtgctgggcat

SEQ ID NO: 7856653 - DNA, 21 bp, Homo sapiens
tgctggccatgtgctgggcat

SEQ ID NO: 7856654 - DNA, 22 bp, Homo sapiens
tgctggccaatggcagaggcgg

SEQ ID NO: 7856655 - DNA, 22 bp, Homo sapiens
tgctggccaatggcagaggcgg

SEQ ID NO: 7856656 - DNA, 22 bp, Homo sapiens
tgctggccaatggcagaggcgg

SEQ ID NO: 7856657 - DNA, 22 bp, Homo sapiens
tgctggccaatggcagaggcgg

SEQ ID NO: 7856658 - DNA, 22 bp, Homo sapiens
tgctggccaatggcagaggcgg

SEQ ID NO: 7856659 - DNA, 22 bp, Homo sapiens
cccaggtctccctgcagccctg

SEQ ID NO: 7856660 - DNA, 22 bp, Homo sapiens
cccaggtctatgccagctctga

SEQ ID NO: 7856661 - DNA, 22 bp, Homo sapiens
cccaggtctatgccagctctga

SEQ ID NO: 7856662 - DNA, 22 bp, Homo sapiens
cccagtttcaactttccagtgg

SEQ ID NO: 7856663 - DNA, 22 bp, Homo sapiens
cccagtttcaactttccagtgg

SEQ ID NO: 7856664 - DNA, 22 bp, Homo sapiens
cccattcatcctcgcttccttc

SEQ ID NO: 7856665 - DNA, 22 bp, Homo sapiens
cccattcatcctcgcttccttc

SEQ ID NO: 7856666 - DNA, 22 bp, Homo sapiens
cccattcatcctcgcttccttc

SEQ ID NO: 7856667 - DNA, 22 bp, Homo sapiens
cccattcatcctcgcttccttc

SEQ ID NO: 7856668 - DNA, 21 bp, Homo sapiens
cccaggtcgtggtcttcccag

SEQ ID NO: 7856669 - DNA, 21 bp, Homo sapiens
cccaggtcgtggtcttcccag

SEQ ID NO: 7856670 - DNA, 22 bp, Homo sapiens
cccaggtcgtcagcagtgtggt

SEQ ID NO: 7856671 - DNA, 22 bp, Homo sapiens
cccaggtcgtcagcagtgtggt

SEQ ID NO: 7856672 - DNA, 23 bp, Homo sapiens
cccaggtcaaaattcacaggcct

SEQ ID NO: 7856673 - DNA, 23 bp, Homo sapiens
cccaggtcaaaattcacaggcct

SEQ ID NO: 7856674 - DNA, 22 bp, Homo sapiens
cccaggtccccacctgtctgct

SEQ ID NO: 7856675 - DNA, 22 bp, Homo sapiens
cccaggtcccgccccagctcta

SEQ ID NO: 7856676 - DNA, 22 bp, Homo sapiens
ccccaaagcctcagcctgcctg

SEQ ID NO: 7856677 - DNA, 22 bp, Homo sapiens
ccccaaagctgagttcccgcct

SEQ ID NO: 7856678 - DNA, 22 bp, Homo sapiens
ccccaaagtgttggataattga

SEQ ID NO: 7856679 - DNA, 19 bp, Homo sapiens
ccccaaagtttagatgttg

SEQ ID NO: 7856680 - DNA, 22 bp, Homo sapiens
ccccaaaattcttaagttgaat

SEQ ID NO: 7856681 - DNA, 22 bp, Homo sapiens
ccccaaaattcttaagttgaat

SEQ ID NO: 7856682 - DNA, 18 bp, Homo sapiens
ccccaaaagtcaccctgg

SEQ ID NO: 7856683 - DNA, 22 bp, Homo sapiens
ccccaaaacttggtgacttcca

SEQ ID NO: 7856684 - DNA, 22 bp, Homo sapiens
ccccaaaacttagtgacttaaa

SEQ ID NO: 7856685 - DNA, 22 bp, Homo sapiens
cccattttgcttatgctgctgt

SEQ ID NO: 7856686 - DNA, 22 bp, Homo sapiens
cccatttgtccaaagtataaaa

SEQ ID NO: 7856687 - DNA, 22 bp, Homo sapiens
cccatttgtatagagccttata

SEQ ID NO: 7856688 - DNA, 22 bp, Homo sapiens
cccatttgtatagagccttata

SEQ ID NO: 7856689 - DNA, 23 bp, Homo sapiens
cccatttgctcacaggacagcag

SEQ ID NO: 7856690 - DNA, 22 bp, Homo sapiens
cccatttgtccaaagtataaaa

SEQ ID NO: 7856691 - DNA, 22 bp, Homo sapiens
cccattgtggttgttgaggata

SEQ ID NO: 7856692 - DNA, 22 bp, Homo sapiens
cccattgtggttgttgaggata

SEQ ID NO: 7856693 - DNA, 22 bp, Homo sapiens
cccattcttcatacaagtctaa

SEQ ID NO: 7856694 - DNA, 22 bp, Homo sapiens
cccgagtgtctactcactccca

SEQ ID NO: 7856695 - DNA, 22 bp, Homo sapiens
cccgagcctcggtttcttttct

SEQ ID NO: 7856696 - DNA, 22 bp, Homo sapiens
cccgaggaaccagaggtagctc

SEQ ID NO: 7856697 - DNA, 22 bp, Homo sapiens
cccgactagctgggattacagg

SEQ ID NO: 7856698 - DNA, 22 bp, Homo sapiens
cccgagcctcggtttcttttct

SEQ ID NO: 7856699 - DNA, 22 bp, Homo sapiens
cccgactagctgggattacagg

SEQ ID NO: 7856700 - DNA, 22 bp, Homo sapiens
cccgctccttacctgtccaacc

SEQ ID NO: 7856701 - DNA, 21 bp, Homo sapiens
cccgcacagcggtaggccgcc

SEQ ID NO: 7856702 - DNA, 18 bp, Homo sapiens
cccggctaatttttggta

SEQ ID NO: 7856703 - DNA, 22 bp, Homo sapiens
cccggacagaggggcagagtgt

SEQ ID NO: 7856704 - DNA, 22 bp, Homo sapiens
ccccttctgtgtcctgtcagcc

SEQ ID NO: 7856705 - DNA, 22 bp, Homo sapiens
ccccttctgtgtcctgtcagcc

SEQ ID NO: 7856706 - DNA, 22 bp, Homo sapiens
ccccttctggtcttcaatggtg

SEQ ID NO: 7856707 - DNA, 22 bp, Homo sapiens
ccccttctgtgtcctgtcagcc

SEQ ID NO: 7856708 - DNA, 22 bp, Homo sapiens
ccccttctggtcttcaatggtg

SEQ ID NO: 7856709 - DNA, 22 bp, Homo sapiens
ccccttctctgcaagcctgctc

SEQ ID NO: 7856710 - DNA, 22 bp, Homo sapiens
ccccttctctgcaagcctgctc

SEQ ID NO: 7856711 - DNA, 22 bp, Homo sapiens
ccccttctctgcaagcctgctc

SEQ ID NO: 7856712 - DNA, 22 bp, Homo sapiens
ccccttctctgcaagcctgctc

SEQ ID NO: 7856713 - DNA, 22 bp, Homo sapiens
ccccttctctgcaagcctgctc

SEQ ID NO: 7856714 - DNA, 22 bp, Homo sapiens
ccccttctgtgtcctgtcagcc

SEQ ID NO: 7856715 - DNA, 22 bp, Homo sapiens
ccccttctgtgtcctgtcagcc

SEQ ID NO: 7856716 - DNA, 22 bp, Homo sapiens
ccccttggctgctctcaagtcc

SEQ ID NO: 7856717 - DNA, 22 bp, Homo sapiens
cccctttctcccgcgtctggcc

SEQ ID NO: 7856718 - DNA, 22 bp, Homo sapiens
cccctttctcccgcgactggcc

SEQ ID NO: 7856719 - DNA, 22 bp, Homo sapiens
cccctttctcccgcgtctggcc

SEQ ID NO: 7856720 - DNA, 22 bp, Homo sapiens
cccctttctcccgcgtctggcc

SEQ ID NO: 7856721 - DNA, 22 bp, Homo sapiens
cccctttctcccgcgactggcc

SEQ ID NO: 7856722 - DNA, 19 bp, Homo sapiens
ccccttgtgtaactagcct

SEQ ID NO: 7856723 - DNA, 22 bp, Homo sapiens
ccccttccttcctcagacagcc

SEQ ID NO: 7856724 - DNA, 22 bp, Homo sapiens
ccccttccttcctcagacagcc

SEQ ID NO: 7856725 - DNA, 22 bp, Homo sapiens
ccccttccttcctcagacagcc

SEQ ID NO: 7856726 - DNA, 22 bp, Homo sapiens
ccccttccttcctcagacagcc

SEQ ID NO: 7856727 - DNA, 22 bp, Homo sapiens
ccccttccttcctcagacagcc

SEQ ID NO: 7856728 - DNA, 22 bp, Homo sapiens
cccctcttgtgggctcaggtca

SEQ ID NO: 7856729 - DNA, 22 bp, Homo sapiens
cccctcttgtgggctcaggtca

SEQ ID NO: 7856730 - DNA, 22 bp, Homo sapiens
cccctcttgtgggctcaggtca

SEQ ID NO: 7856731 - DNA, 22 bp, Homo sapiens
cccctcttggcattgagtgcca

SEQ ID NO: 7856732 - DNA, 22 bp, Homo sapiens
tgctggctttttggtccttgct

SEQ ID NO: 7856733 - DNA, 22 bp, Homo sapiens
tgctggctttttgtgtcaaaga

SEQ ID NO: 7856734 - DNA, 22 bp, Homo sapiens
tgctggctttttgtgtcaaaga

SEQ ID NO: 7856735 - DNA, 22 bp, Homo sapiens
tgctggctttttggtccttgct

SEQ ID NO: 7856736 - DNA, 22 bp, Homo sapiens
tgctggctttttggtccttgct

SEQ ID NO: 7856737 - DNA, 22 bp, Homo sapiens
tgctggctttttggtccttgct

SEQ ID NO: 7856738 - DNA, 22 bp, Homo sapiens
tgctgggatatagcttctaggg

SEQ ID NO: 7856739 - DNA, 22 bp, Homo sapiens
tgctggctttttgtgtcaaaga

SEQ ID NO: 7856740 - DNA, 22 bp, Homo sapiens
tgctgggattacagtcatgagc

SEQ ID NO: 7856741 - DNA, 22 bp, Homo sapiens
tgctgggattacagtcatgagc

SEQ ID NO: 7856742 - DNA, 22 bp, Homo sapiens
tgctgggcacacagtaggtgct

SEQ ID NO: 7856743 - DNA, 22 bp, Homo sapiens
tgctgggcacacagtaggtgct

SEQ ID NO: 7856744 - DNA, 22 bp, Homo sapiens
tgctgggcacacagtaggtgct

SEQ ID NO: 7856745 - DNA, 22 bp, Homo sapiens
tgctgggatatagcttctaggg

SEQ ID NO: 7856746 - DNA, 22 bp, Homo sapiens
tgctgggatatagcttctaggg

SEQ ID NO: 7856747 - DNA, 22 bp, Homo sapiens
tgctgggatatagcttctaggg

SEQ ID NO: 7856748 - DNA, 22 bp, Homo sapiens
tgctggctttagtgattggggt

SEQ ID NO: 7856749 - DNA, 22 bp, Homo sapiens
tgctggctttagtgattggggt

SEQ ID NO: 7856750 - DNA, 22 bp, Homo sapiens
tgctggctttagtgattggggt

SEQ ID NO: 7856751 - DNA, 22 bp, Homo sapiens
tgctggctttaaggttaaagtg

SEQ ID NO: 7856752 - DNA, 22 bp, Homo sapiens
tgctggctttaaggttaaagtg

SEQ ID NO: 7856753 - DNA, 22 bp, Homo sapiens
tgctggctactgatggcaggcc

SEQ ID NO: 7856754 - DNA, 22 bp, Homo sapiens
tgctggctacattattgctgtc

SEQ ID NO: 7856755 - DNA, 22 bp, Homo sapiens
tgctggctacattattgctgtc

SEQ ID NO: 7856756 - DNA, 23 bp, Homo sapiens
tgctggctaagaatctgcatttt

SEQ ID NO: 7856757 - DNA, 23 bp, Homo sapiens
tgctggctaagaatctgcatttt

SEQ ID NO: 7856758 - DNA, 22 bp, Homo sapiens
tgctggcctgtccacgggctgt

SEQ ID NO: 7856759 - DNA, 22 bp, Homo sapiens
tgctggcctgtccacgggctgt

SEQ ID NO: 7856760 - DNA, 23 bp, Homo sapiens
tgctggctaagaatctgcatttt

SEQ ID NO: 7856761 - DNA, 22 bp, Homo sapiens
tgctggctacattattgctgtc

SEQ ID NO: 7856762 - DNA, 22 bp, Homo sapiens
tgctggctaatggaaaccagat

SEQ ID NO: 7856763 - DNA, 22 bp, Homo sapiens
tgctggctaatggaaaccagat

SEQ ID NO: 7856764 - DNA, 22 bp, Homo sapiens
tgctggctaatggaaaccagat

SEQ ID NO: 7856765 - DNA, 22 bp, Homo sapiens
tgctggctttctgtccctggca

SEQ ID NO: 7856766 - DNA, 22 bp, Homo sapiens
tgctggctttctgtccctggca

SEQ ID NO: 7856767 - DNA, 22 bp, Homo sapiens
tgctggctttctgtccctggca

SEQ ID NO: 7856768 - DNA, 22 bp, Homo sapiens
tgctggctttagtgattggggt

SEQ ID NO: 7856769 - DNA, 22 bp, Homo sapiens
tgctggctttgcgagatgcatt

SEQ ID NO: 7856770 - DNA, 22 bp, Homo sapiens
tgctggctttgcgagatgcatt

SEQ ID NO: 7856771 - DNA, 22 bp, Homo sapiens
tgctggctttgcgagatgcatt

SEQ ID NO: 7856772 - DNA, 22 bp, Homo sapiens
tgctggctttgcgagatgcatt

SEQ ID NO: 7856773 - DNA, 22 bp, Homo sapiens
tgctggcttttccttcaggcag

SEQ ID NO: 7856774 - DNA, 22 bp, Homo sapiens
tgctggcttttccttcaggcag

SEQ ID NO: 7856775 - DNA, 22 bp, Homo sapiens
tgctggcttttccttcaggcag

SEQ ID NO: 7856776 - DNA, 23 bp, Homo sapiens
tgctggcttttatctggtcccta

SEQ ID NO: 7856777 - DNA, 23 bp, Homo sapiens
tgctggcttttatctggtcccta

SEQ ID NO: 7856778 - DNA, 23 bp, Homo sapiens
tgctggcttttatctggtcccta

SEQ ID NO: 7856779 - DNA, 23 bp, Homo sapiens
tgctggcttttatctggtcccta

SEQ ID NO: 7856780 - DNA, 22 bp, Homo sapiens
tgctggctttgcgagatgcatt

SEQ ID NO: 7856781 - DNA, 22 bp, Homo sapiens
tgctggctttgcgagatgcatt

SEQ ID NO: 7856782 - DNA, 21 bp, Homo sapiens
tgctggccatgtgctgggcat

SEQ ID NO: 7856783 - DNA, 21 bp, Homo sapiens
tgctggccatgtgctgggcat

SEQ ID NO: 7856784 - DNA, 22 bp, Homo sapiens
tgctggcccagtatggactgca

SEQ ID NO: 7856785 - DNA, 22 bp, Homo sapiens
tgctggcccagtatggactgca

SEQ ID NO: 7856786 - DNA, 22 bp, Homo sapiens
tgctggcccagtatggactgca

SEQ ID NO: 7856787 - DNA, 22 bp, Homo sapiens
tgctggcccagtactaatgtct

SEQ ID NO: 7856788 - DNA, 22 bp, Homo sapiens
tgctggcccagtatggactgca

SEQ ID NO: 7856789 - DNA, 22 bp, Homo sapiens
tgctggcccagtatggactgca

SEQ ID NO: 7856790 - DNA, 22 bp, Homo sapiens
tgctggcccatgaagacgcagt

SEQ ID NO: 7856791 - DNA, 22 bp, Homo sapiens
tgctggcccatgaagacgcagt

SEQ ID NO: 7856792 - DNA, 22 bp, Homo sapiens
tgctggcccatgaagacgcagt

SEQ ID NO: 7856793 - DNA, 22 bp, Homo sapiens
tgctggccggccaggtgctgag

SEQ ID NO: 7856794 - DNA, 22 bp, Homo sapiens
tgctggccggccaggtgctgag

SEQ ID NO: 7856795 - DNA, 22 bp, Homo sapiens
tgctggccggccaggtgctgag

SEQ ID NO: 7856796 - DNA, 22 bp, Homo sapiens
tgctggccggccaggtgctgag

SEQ ID NO: 7856797 - DNA, 22 bp, Homo sapiens
tgctggccctggctcagggaac

SEQ ID NO: 7856798 - DNA, 22 bp, Homo sapiens
tgctggccctggctcagggaac

SEQ ID NO: 7856799 - DNA, 22 bp, Homo sapiens
tgctggccctggctcagggaac

SEQ ID NO: 7856800 - DNA, 22 bp, Homo sapiens
tgctggccctggctcagggaac

SEQ ID NO: 7856801 - DNA, 22 bp, Homo sapiens
tgctggcctcggcgctgggcct

SEQ ID NO: 7856802 - DNA, 22 bp, Homo sapiens
tgctggcctgggctgcaccttg

SEQ ID NO: 7856803 - DNA, 22 bp, Homo sapiens
tgctggcctgggctgcaccttg

SEQ ID NO: 7856804 - DNA, 22 bp, Homo sapiens
tgctggcctgggctgcaccttg

SEQ ID NO: 7856805 - DNA, 22 bp, Homo sapiens
tgctggcctgggctgcaccttg

SEQ ID NO: 7856806 - DNA, 22 bp, Homo sapiens
tgctggcctggttagaaagggg

SEQ ID NO: 7856807 - DNA, 22 bp, Homo sapiens
tgctggcctggttagaaagggg

SEQ ID NO: 7856808 - DNA, 22 bp, Homo sapiens
tgctggcctgtccacgggctgt

SEQ ID NO: 7856809 - DNA, 22 bp, Homo sapiens
tgctggcctgtccacgggctgt

SEQ ID NO: 7856810 - DNA, 22 bp, Homo sapiens
tgctggcctggttagaaagggg

SEQ ID NO: 7856811 - DNA, 22 bp, Homo sapiens
tgctggcctcggcgctgggcct

SEQ ID NO: 7856812 - DNA, 22 bp, Homo sapiens
tgctggcctcggcgctgggcct

SEQ ID NO: 7856813 - DNA, 22 bp, Homo sapiens
tgctggcctcggcgctgggcct

SEQ ID NO: 7856814 - DNA, 22 bp, Homo sapiens
tgctggcctcggcgctgggcct

SEQ ID NO: 7856815 - DNA, 22 bp, Homo sapiens
tgctggcctcggcgctgggcct

SEQ ID NO: 7856816 - DNA, 22 bp, Homo sapiens
tgctggccgtgagctctcggga

SEQ ID NO: 7856817 - DNA, 22 bp, Homo sapiens
tgctggccgtgagctctcggga

SEQ ID NO: 7856818 - DNA, 22 bp, Homo sapiens
tgctggccgtgagctctcggga

SEQ ID NO: 7856819 - DNA, 21 bp, Homo sapiens
tgctggcctcaagggtgactt

SEQ ID NO: 7856820 - DNA, 21 bp, Homo sapiens
tgctggcctcaagggtgactt

SEQ ID NO: 7856821 - DNA, 22 bp, Homo sapiens
tgctggcctcggcgctgggcct

SEQ ID NO: 7856822 - DNA, 21 bp, Homo sapiens
tgctggcctcaagggtgactt

SEQ ID NO: 7856823 - DNA, 21 bp, Homo sapiens
ccagggtccagctgccatggt

SEQ ID NO: 7856824 - DNA, 22 bp, Homo sapiens
ccagggtcacaaataactgcag

SEQ ID NO: 7856825 - DNA, 21 bp, Homo sapiens
ccagggtccagctgccatggt

SEQ ID NO: 7856826 - DNA, 22 bp, Homo sapiens
ccagggtagctgagctaagcct

SEQ ID NO: 7856827 - DNA, 22 bp, Homo sapiens
ccagggtaccccaagggcaggt

SEQ ID NO: 7856828 - DNA, 22 bp, Homo sapiens
ccagggtagctgagctaagcct

SEQ ID NO: 7856829 - DNA, 22 bp, Homo sapiens
ccagggtcacaaataactgcag

SEQ ID NO: 7856830 - DNA, 17 bp, Homo sapiens
ccaggtctccttgcttt

SEQ ID NO: 7856831 - DNA, 17 bp, Homo sapiens
ccaggtctccttgcttt

SEQ ID NO: 7856832 - DNA, 22 bp, Homo sapiens
ccaggtctcgggtctgctcgtg

SEQ ID NO: 7856833 - DNA, 22 bp, Homo sapiens
ccagggtaccccaagggcaggt

SEQ ID NO: 7856834 - DNA, 22 bp, Homo sapiens
ccaggggttggaggttgcagtg

SEQ ID NO: 7856835 - DNA, 22 bp, Homo sapiens
ccaggggggcgtagatgctggg

SEQ ID NO: 7856836 - DNA, 22 bp, Homo sapiens
ccaggggggcgtagatgctggg

SEQ ID NO: 7856837 - DNA, 22 bp, Homo sapiens
ccaggggggcgtagatgctggg

SEQ ID NO: 7856838 - DNA, 22 bp, Homo sapiens
ccaggggggcgtagatgctggg

SEQ ID NO: 7856839 - DNA, 22 bp, Homo sapiens
ccaggggctggtgctgagctgg

SEQ ID NO: 7856840 - DNA, 22 bp, Homo sapiens
ccaggggctggtgctgagctgg

SEQ ID NO: 7856841 - DNA, 22 bp, Homo sapiens
ccagggggcttggtgaggccat

SEQ ID NO: 7856842 - DNA, 22 bp, Homo sapiens
ccagggggcttggtgaggccat

SEQ ID NO: 7856843 - DNA, 22 bp, Homo sapiens
ccaggtgctcttgccagggctg

SEQ ID NO: 7856844 - DNA, 22 bp, Homo sapiens
ccaggtgctcttgccagggctg

SEQ ID NO: 7856845 - DNA, 22 bp, Homo sapiens
ccaggtgctagcaatcactgtc

SEQ ID NO: 7856846 - DNA, 22 bp, Homo sapiens
ccaggtgctcttgccagggctg

SEQ ID NO: 7856847 - DNA, 22 bp, Homo sapiens
ccaggtgctcttgccagggctg

SEQ ID NO: 7856848 - DNA, 19 bp, Homo sapiens
ccaggtggaactgaggtag

SEQ ID NO: 7856849 - DNA, 19 bp, Homo sapiens
ccaggtggaactgaggtag

SEQ ID NO: 7856850 - DNA, 19 bp, Homo sapiens
ccaggtggaactgaggtag

SEQ ID NO: 7856851 - DNA, 22 bp, Homo sapiens
ccaggtggaaggtctgtgctct

SEQ ID NO: 7856852 - DNA, 17 bp, Homo sapiens
ccaggtggaatcgtgga

SEQ ID NO: 7856853 - DNA, 22 bp, Homo sapiens
ccaggtggacggcgagtacagg

SEQ ID NO: 7856854 - DNA, 22 bp, Homo sapiens
ccaggtggacaaggctttcaca

SEQ ID NO: 7856855 - DNA, 17 bp, Homo sapiens
ccaggtggaatcgtgga

SEQ ID NO: 7856856 - DNA, 22 bp, Homo sapiens
ccaggtggaaggtctgtgctct

SEQ ID NO: 7856857 - DNA, 22 bp, Homo sapiens
ccaggtggaaggtctgtgctct

SEQ ID NO: 7856858 - DNA, 22 bp, Homo sapiens
ccaggtggaaggtctgtgctct

SEQ ID NO: 7856859 - DNA, 22 bp, Homo sapiens
tgagaatcagctgcacagaggt

SEQ ID NO: 7856860 - DNA, 22 bp, Homo sapiens
tgagaatcagctgcacagaggt

SEQ ID NO: 7856861 - DNA, 22 bp, Homo sapiens
tgagaatatttgaagatgttag

SEQ ID NO: 7856862 - DNA, 22 bp, Homo sapiens
tgagaatcatccagaggcttct

SEQ ID NO: 7856863 - DNA, 22 bp, Homo sapiens
tgagaatcatccagaggcttct

SEQ ID NO: 7856864 - DNA, 22 bp, Homo sapiens
tgagaatagcaaaagctgtcag

SEQ ID NO: 7856865 - DNA, 22 bp, Homo sapiens
tgagaatagcaaaagctgtcag

SEQ ID NO: 7856866 - DNA, 22 bp, Homo sapiens
tgagaatagaaagagctgtcat

SEQ ID NO: 7856867 - DNA, 22 bp, Homo sapiens
tgagaatagaaagagctgtcat

SEQ ID NO: 7856868 - DNA, 22 bp, Homo sapiens
tgagaatagaaagagctgtcat

SEQ ID NO: 7856869 - DNA, 22 bp, Homo sapiens
tgagaatactgcattgttagga

SEQ ID NO: 7856870 - DNA, 22 bp, Homo sapiens
tgagaatagcaaaagctgtcag

SEQ ID NO: 7856871 - DNA, 22 bp, Homo sapiens
tgagaataggcatagaacctgg

SEQ ID NO: 7856872 - DNA, 22 bp, Homo sapiens
ccaggggctctcagggtgtgtg

SEQ ID NO: 7856873 - DNA, 22 bp, Homo sapiens
ccaggggctctcagggtgtgtg

SEQ ID NO: 7856874 - DNA, 22 bp, Homo sapiens
ccaggggctgcagatccatggt

SEQ ID NO: 7856875 - DNA, 22 bp, Homo sapiens
ccaggggctgcagatccatggt

SEQ ID NO: 7856876 - DNA, 22 bp, Homo sapiens
ccaggggctggtgctgagctgg

SEQ ID NO: 7856877 - DNA, 22 bp, Homo sapiens
ccaggggctggtgctgagctgg

SEQ ID NO: 7856878 - DNA, 22 bp, Homo sapiens
ccaggggctggtgctgagctgg

SEQ ID NO: 7856879 - DNA, 22 bp, Homo sapiens
ccaggggctggtgctgagctgg

SEQ ID NO: 7856880 - DNA, 20 bp, Homo sapiens
tgagaaggggtcagctgtac

SEQ ID NO: 7856881 - DNA, 22 bp, Homo sapiens
tgagaagggttggagaaataat

SEQ ID NO: 7856882 - DNA, 20 bp, Homo sapiens
tgagaaggggtcagctgtac

SEQ ID NO: 7856883 - DNA, 20 bp, Homo sapiens
tgagaaggggtcagctgtac

SEQ ID NO: 7856884 - DNA, 22 bp, Homo sapiens
tgagaaggctcaggcttagaga

SEQ ID NO: 7856885 - DNA, 22 bp, Homo sapiens
tgagaaggctcaggcttagaga

SEQ ID NO: 7856886 - DNA, 19 bp, Homo sapiens
tgagaaggcagtggggagc

SEQ ID NO: 7856887 - DNA, 19 bp, Homo sapiens
tgagaaggcagtggggagc

SEQ ID NO: 7856888 - DNA, 19 bp, Homo sapiens
tgagaaggcagtggggagc

SEQ ID NO: 7856889 - DNA, 22 bp, Homo sapiens
tgagaaggcctgtgtgacaggg

SEQ ID NO: 7856890 - DNA, 22 bp, Homo sapiens
tgagaaggcctgtgtgacaggg

SEQ ID NO: 7856891 - DNA, 22 bp, Homo sapiens
tgagaataactgatttaaatgc

SEQ ID NO: 7856892 - DNA, 22 bp, Homo sapiens
tgagaataactgatttaaatgc

SEQ ID NO: 7856893 - DNA, 22 bp, Homo sapiens
tgagaataagagatagtttatt

SEQ ID NO: 7856894 - DNA, 22 bp, Homo sapiens
tgagaataagagatagtttatt

SEQ ID NO: 7856895 - DNA, 22 bp, Homo sapiens
tgagaatactgcattgttagga

SEQ ID NO: 7856896 - DNA, 22 bp, Homo sapiens
tgagaataagagatagtttatt

SEQ ID NO: 7856897 - DNA, 22 bp, Homo sapiens
tgagaataagagatagtttatt

SEQ ID NO: 7856898 - DNA, 21 bp, Homo sapiens
tgagaagtatgtcttcagcca

SEQ ID NO: 7856899 - DNA, 22 bp, Homo sapiens
tgagaagtgacattattgaatg

SEQ ID NO: 7856900 - DNA, 19 bp, Homo sapiens
tgagaaggtttccgtgggt

SEQ ID NO: 7856901 - DNA, 22 bp, Homo sapiens
tgagaataacagcctgtgttcc

SEQ ID NO: 7856902 - DNA, 22 bp, Homo sapiens
tgagaataacagcctgtgttcc

SEQ ID NO: 7856903 - DNA, 22 bp, Homo sapiens
tgagaaggtgaaagtgtggaga

SEQ ID NO: 7856904 - DNA, 22 bp, Homo sapiens
tgagaaggtgaaagtgtggaga

SEQ ID NO: 7856905 - DNA, 22 bp, Homo sapiens
tgagaaggtgaaagtgtggaga

SEQ ID NO: 7856906 - DNA, 19 bp, Homo sapiens
tgagaaggtttccgtgggt

SEQ ID NO: 7856907 - DNA, 21 bp, Homo sapiens
tgagaagtatgtcttcagcca

SEQ ID NO: 7856908 - DNA, 17 bp, Homo sapiens
tgagaagtaggcatcat

SEQ ID NO: 7856909 - DNA, 22 bp, Homo sapiens
ccaggtgtcatgcgtgtgaccc

SEQ ID NO: 7856910 - DNA, 22 bp, Homo sapiens
ccaggtgtaggacaccaaggga

SEQ ID NO: 7856911 - DNA, 22 bp, Homo sapiens
ccaggtgtctgtggccagccct

SEQ ID NO: 7856912 - DNA, 22 bp, Homo sapiens
ccaggtgtccccgtcactgcag

SEQ ID NO: 7856913 - DNA, 17 bp, Homo sapiens
ccaggtgggaggtgggg

SEQ ID NO: 7856914 - DNA, 17 bp, Homo sapiens
ccaggtgggaggtgggg

SEQ ID NO: 7856915 - DNA, 22 bp, Homo sapiens
tgagacgaagtcttgctctgtt

SEQ ID NO: 7856916 - DNA, 22 bp, Homo sapiens
tgagacgaagtcttgctctgtt

SEQ ID NO: 7856917 - DNA, 22 bp, Homo sapiens
tgagacgaagtcttgctctgtt

SEQ ID NO: 7856918 - DNA, 17 bp, Homo sapiens
ccaggtgggaggtgggg

SEQ ID NO: 7856919 - DNA, 22 bp, Homo sapiens
ccaggtgtaagacatggtccta

SEQ ID NO: 7856920 - DNA, 22 bp, Homo sapiens
ccaggtgtagcactgctcacag

SEQ ID NO: 7856921 - DNA, 22 bp, Homo sapiens
tgagaccttggggagccctgtt

SEQ ID NO: 7856922 - DNA, 22 bp, Homo sapiens
tgagacgaagtcttgctctgtt

SEQ ID NO: 7856923 - DNA, 23 bp, Homo sapiens
tgagaccctaatttagcaagtgt

SEQ ID NO: 7856924 - DNA, 22 bp, Homo sapiens
tgagacctgcccaacgcagacc

SEQ ID NO: 7856925 - DNA, 20 bp, Homo sapiens
tgagacccgctgacaagttc

SEQ ID NO: 7856926 - DNA, 23 bp, Homo sapiens
tgagaccctaatttagcaagtgt

SEQ ID NO: 7856927 - DNA, 22 bp, Homo sapiens
tgagacatgtgaatatttgtac

SEQ ID NO: 7856928 - DNA, 20 bp, Homo sapiens
tgagacccgctgacaagttc

SEQ ID NO: 7856929 - DNA, 22 bp, Homo sapiens
tgagacatgctgtccaagaagt

SEQ ID NO: 7856930 - DNA, 22 bp, Homo sapiens
tgagacatgctgtccaagaagt

SEQ ID NO: 7856931 - DNA, 22 bp, Homo sapiens
tgagacatcacaaaatcctcaa

SEQ ID NO: 7856932 - DNA, 22 bp, Homo sapiens
tgagacatcatggctgaaagta

SEQ ID NO: 7856933 - DNA, 22 bp, Homo sapiens
tgagacatcatggctgaaagta

SEQ ID NO: 7856934 - DNA, 22 bp, Homo sapiens
tgagacatcacaaaatcctcaa

SEQ ID NO: 7856935 - DNA, 22 bp, Homo sapiens
tgagacagtttttctatttcca

SEQ ID NO: 7856936 - DNA, 22 bp, Homo sapiens
tgagacagtttttctatttcca

SEQ ID NO: 7856937 - DNA, 22 bp, Homo sapiens
tgagacagttggtgaaatctaa

SEQ ID NO: 7856938 - DNA, 22 bp, Homo sapiens
tgagacagttggtgaaatctaa

SEQ ID NO: 7856939 - DNA, 22 bp, Homo sapiens
tgagacagttctgcagctgggt

SEQ ID NO: 7856940 - DNA, 22 bp, Homo sapiens
tgagacagttctgcagctgggt

SEQ ID NO: 7856941 - DNA, 22 bp, Homo sapiens
tgagacagttctgcagctgggt

SEQ ID NO: 7856942 - DNA, 22 bp, Homo sapiens
tgagacagttctgcagctgggt

SEQ ID NO: 7856943 - DNA, 22 bp, Homo sapiens
tgagacagttctgcagctgggt

SEQ ID NO: 7856944 - DNA, 22 bp, Homo sapiens
ccaggtggacggcgagtacagg

SEQ ID NO: 7856945 - DNA, 22 bp, Homo sapiens
ccaggtgtgctctgcagtggat

SEQ ID NO: 7856946 - DNA, 22 bp, Homo sapiens
ccaggtgtgccagcagggactg

SEQ ID NO: 7856947 - DNA, 22 bp, Homo sapiens
ccaggtgtgctctgcagtggat

SEQ ID NO: 7856948 - DNA, 22 bp, Homo sapiens
ccaggtgtgatttggcagtgtc

SEQ ID NO: 7856949 - DNA, 22 bp, Homo sapiens
ccaggtgtgccagcagggactg

SEQ ID NO: 7856950 - DNA, 22 bp, Homo sapiens
ccaggtgtgatttggcagtgtc

SEQ ID NO: 7856951 - DNA, 22 bp, Homo sapiens
ccaggtgtgatttggcagtgtc

SEQ ID NO: 7856952 - DNA, 22 bp, Homo sapiens
ccaggtgtggccacatggctgg

SEQ ID NO: 7856953 - DNA, 22 bp, Homo sapiens
ccaggtgtggggaggactcaca

SEQ ID NO: 7856954 - DNA, 22 bp, Homo sapiens
ccaggtgtgctctgcagtggat

SEQ ID NO: 7856955 - DNA, 22 bp, Homo sapiens
ccaggtgtgctctgcagtggat

SEQ ID NO: 7856956 - DNA, 22 bp, Homo sapiens
ccaggtgtggtggcatacacct

SEQ ID NO: 7856957 - DNA, 22 bp, Homo sapiens
ccaggtgtggtggcatacacct

SEQ ID NO: 7856958 - DNA, 22 bp, Homo sapiens
ccaggtgtggggaggactcaca

SEQ ID NO: 7856959 - DNA, 22 bp, Homo sapiens
tgaggactacctggggtgggag

SEQ ID NO: 7856960 - DNA, 22 bp, Homo sapiens
tgaggactttccatgttaatgt

SEQ ID NO: 7856961 - DNA, 22 bp, Homo sapiens
tgaggcagaaaatagcagttca

SEQ ID NO: 7856962 - DNA, 22 bp, Homo sapiens
tgaggcagaaaatagcagttca

SEQ ID NO: 7856963 - DNA, 22 bp, Homo sapiens
tgaggcagaaattcctgttttc

SEQ ID NO: 7856964 - DNA, 22 bp, Homo sapiens
tgaggcagaaattcctgttttc

SEQ ID NO: 7856965 - DNA, 22 bp, Homo sapiens
tgaggcagatatttattgggtt

SEQ ID NO: 7856966 - DNA, 22 bp, Homo sapiens
tgaggcagatatttattgggtt

SEQ ID NO: 7856967 - DNA, 22 bp, Homo sapiens
tgaggcagagtaagatacatga

SEQ ID NO: 7856968 - DNA, 22 bp, Homo sapiens
tgaggcagcaattgattattca

SEQ ID NO: 7856969 - DNA, 22 bp, Homo sapiens
tgacaagctttacagaattgaa

SEQ ID NO: 7856970 - DNA, 22 bp, Homo sapiens
tgacaagtacataatttcatgt

SEQ ID NO: 7856971 - DNA, 22 bp, Homo sapiens
tgacaagtacataatttcatgt

SEQ ID NO: 7856972 - DNA, 22 bp, Homo sapiens
tgacaagtacataatttcatgt

SEQ ID NO: 7856973 - DNA, 22 bp, Homo sapiens
tgacaagcatttttgagtatct

SEQ ID NO: 7856974 - DNA, 19 bp, Homo sapiens
tgacaagataatagccttg

SEQ ID NO: 7856975 - DNA, 22 bp, Homo sapiens
tgacaagatagattgagtttta

SEQ ID NO: 7856976 - DNA, 22 bp, Homo sapiens
tgacaagatcacagtcaagtgt

SEQ ID NO: 7856977 - DNA, 22 bp, Homo sapiens
tgacaagaggcagaatcagctg

SEQ ID NO: 7856978 - DNA, 22 bp, Homo sapiens
tgacaagaggcagaatcagctg

SEQ ID NO: 7856979 - DNA, 22 bp, Homo sapiens
tgacaagaggcagaatcagctg

SEQ ID NO: 7856980 - DNA, 22 bp, Homo sapiens
tgacaagaggcagaatcagctg

SEQ ID NO: 7856981 - DNA, 22 bp, Homo sapiens
tgacaagtcactgttcttcaat

SEQ ID NO: 7856982 - DNA, 23 bp, Homo sapiens
tgacaagtctcagccaatgcaga

SEQ ID NO: 7856983 - DNA, 23 bp, Homo sapiens
tgacaagtctcagccaatgcaga

SEQ ID NO: 7856984 - DNA, 22 bp, Homo sapiens
tgacaagtcactgttcttcaat

SEQ ID NO: 7856985 - DNA, 22 bp, Homo sapiens
tgacaagttggaaagcagtgca

SEQ ID NO: 7856986 - DNA, 22 bp, Homo sapiens
tgacaagttctaataagaaatg

SEQ ID NO: 7856987 - DNA, 22 bp, Homo sapiens
tgacaagttctaataagaaatg

SEQ ID NO: 7856988 - DNA, 22 bp, Homo sapiens
tgacaagtttcctggtgatttt

SEQ ID NO: 7856989 - DNA, 22 bp, Homo sapiens
tgacaatagcgatttatcttgc

SEQ ID NO: 7856990 - DNA, 22 bp, Homo sapiens
tgacaatagcgatttatcttgc

SEQ ID NO: 7856991 - DNA, 22 bp, Homo sapiens
ccagggctgctgtgggactcca

SEQ ID NO: 7856992 - DNA, 22 bp, Homo sapiens
ccagggctgctgtgggactcca

SEQ ID NO: 7856993 - DNA, 22 bp, Homo sapiens
ccagggctgctgtgggactcca

SEQ ID NO: 7856994 - DNA, 19 bp, Homo sapiens
tgacaatgggcacctgtgt

SEQ ID NO: 7856995 - DNA, 22 bp, Homo sapiens
ccagggcttcagttagtggtga

SEQ ID NO: 7856996 - DNA, 22 bp, Homo sapiens
ccagggcttcagaggttttggc

SEQ ID NO: 7856997 - DNA, 22 bp, Homo sapiens
ccagggcttcagaggttttggc

SEQ ID NO: 7856998 - DNA, 22 bp, Homo sapiens
ccagggctggaccagtgcttgg

SEQ ID NO: 7856999 - DNA, 22 bp, Homo sapiens
ccagggcttcagttagtggtga

SEQ ID NO: 7857000 - DNA, 22 bp, Homo sapiens
ccagggcttcagttagtggtga

SEQ ID NO: 7857001 - DNA, 22 bp, Homo sapiens
ccagggcttcccacgtgccctg

SEQ ID NO: 7857002 - DNA, 22 bp, Homo sapiens
ccagggcttcagttagtggtga

SEQ ID NO: 7857003 - DNA, 22 bp, Homo sapiens
ccagggcttcccacgtgccctg

SEQ ID NO: 7857004 - DNA, 22 bp, Homo sapiens
ccagggcttcccacgtgccctg

SEQ ID NO: 7857005 - DNA, 19 bp, Homo sapiens
ccagggctttaagttgagg

SEQ ID NO: 7857006 - DNA, 19 bp, Homo sapiens
ccagggctttaagttgagg

SEQ ID NO: 7857007 - DNA, 22 bp, Homo sapiens
ccagggcttggtggcttgtatc

SEQ ID NO: 7857008 - DNA, 19 bp, Homo sapiens
ccagggctttaagttgagg

SEQ ID NO: 7857009 - DNA, 22 bp, Homo sapiens
ccagggcttggtggcttgtatc

SEQ ID NO: 7857010 - DNA, 22 bp, Homo sapiens
ccagggcttggtggcttgtatc

SEQ ID NO: 7857011 - DNA, 22 bp, Homo sapiens
ccagggcttcccacgtgccctg

SEQ ID NO: 7857012 - DNA, 22 bp, Homo sapiens
ccagggctttgccaaagtccag

SEQ ID NO: 7857013 - DNA, 22 bp, Homo sapiens
ccagggctttgccaaagtccag

SEQ ID NO: 7857014 - DNA, 22 bp, Homo sapiens
ccagggctttgccaaagtccag

SEQ ID NO: 7857015 - DNA, 22 bp, Homo sapiens
ccagggctttgccaaagtccag

SEQ ID NO: 7857016 - DNA, 22 bp, Homo sapiens
ccagggctttatctgcctttga

SEQ ID NO: 7857017 - DNA, 19 bp, Homo sapiens
ccagggctttaagttgagg

SEQ ID NO: 7857018 - DNA, 22 bp, Homo sapiens
ccagggctttatctgcctttga

SEQ ID NO: 7857019 - DNA, 22 bp, Homo sapiens
ccagggctttatctgcctttga

SEQ ID NO: 7857020 - DNA, 22 bp, Homo sapiens
ccaggggaaacagggagcactc

SEQ ID NO: 7857021 - DNA, 22 bp, Homo sapiens
ccaggggaaacagggagcactc

SEQ ID NO: 7857022 - DNA, 22 bp, Homo sapiens
ccaggggaaacagggagcactc

SEQ ID NO: 7857023 - DNA, 21 bp, Homo sapiens
ccaggggcaaattgtcgtttc

SEQ ID NO: 7857024 - DNA, 22 bp, Homo sapiens
ccaggggaaacagggagcactc

SEQ ID NO: 7857025 - DNA, 22 bp, Homo sapiens
ccaggggaaacagggagcactc

SEQ ID NO: 7857026 - DNA, 22 bp, Homo sapiens
tgagaaggaaacaatggctttt

SEQ ID NO: 7857027 - DNA, 22 bp, Homo sapiens
tgagaaggaaacaatggctttt

SEQ ID NO: 7857028 - DNA, 22 bp, Homo sapiens
tgagaaaagtacatggagaagc

SEQ ID NO: 7857029 - DNA, 22 bp, Homo sapiens
tgagaaaaggttgagatgataa

SEQ ID NO: 7857030 - DNA, 22 bp, Homo sapiens
tgacatcctgagtacataagag

SEQ ID NO: 7857031 - DNA, 22 bp, Homo sapiens
tgacatccggccactagactcc

SEQ ID NO: 7857032 - DNA, 22 bp, Homo sapiens
tgacatcctgagtacataagag

SEQ ID NO: 7857033 - DNA, 22 bp, Homo sapiens
tgacatctagtaggtagagacc

SEQ ID NO: 7857034 - DNA, 22 bp, Homo sapiens
tgacatctagtaggtagagacc

SEQ ID NO: 7857035 - DNA, 22 bp, Homo sapiens
tgacatcattagtaacatagct

SEQ ID NO: 7857036 - DNA, 22 bp, Homo sapiens
tgacatccggccactagactcc

SEQ ID NO: 7857037 - DNA, 22 bp, Homo sapiens
tgacatcattagtaacatagct

SEQ ID NO: 7857038 - DNA, 22 bp, Homo sapiens
tgacatcattggccattgggga

SEQ ID NO: 7857039 - DNA, 22 bp, Homo sapiens
tgacataataatccaaacatac

SEQ ID NO: 7857040 - DNA, 22 bp, Homo sapiens
tgacataataatccaaacatac

SEQ ID NO: 7857041 - DNA, 22 bp, Homo sapiens
tgacataatgctttgaagttgc

SEQ ID NO: 7857042 - DNA, 22 bp, Homo sapiens
tgacataatgctttgaagttgc

SEQ ID NO: 7857043 - DNA, 22 bp, Homo sapiens
tgacataatgctttgaagttgc

SEQ ID NO: 7857044 - DNA, 22 bp, Homo sapiens
tgacatagggcaaaagagtagg

SEQ ID NO: 7857045 - DNA, 22 bp, Homo sapiens
tgacatacttttagatagatgg

SEQ ID NO: 7857046 - DNA, 22 bp, Homo sapiens
tgacatcacaagccatctgcag

SEQ ID NO: 7857047 - DNA, 22 bp, Homo sapiens
tgacatcacaagccatctgcag

SEQ ID NO: 7857048 - DNA, 22 bp, Homo sapiens
tgacatcacgtcctttcagaga

SEQ ID NO: 7857049 - DNA, 22 bp, Homo sapiens
tgacatcagaatggcatagaaa

SEQ ID NO: 7857050 - DNA, 22 bp, Homo sapiens
tgacatcagggcaggggttgag

SEQ ID NO: 7857051 - DNA, 22 bp, Homo sapiens
tgacatcagaatggcatagaaa

SEQ ID NO: 7857052 - DNA, 22 bp, Homo sapiens
tgacagtgtcagtttcctaata

SEQ ID NO: 7857053 - DNA, 22 bp, Homo sapiens
tgacagtgtcagtttcctaata

SEQ ID NO: 7857054 - DNA, 22 bp, Homo sapiens
tgacagtgttgggggtaaattt

SEQ ID NO: 7857055 - DNA, 21 bp, Homo sapiens
tgacagtgtggcatggaaggt

SEQ ID NO: 7857056 - DNA, 22 bp, Homo sapiens
tgacagttaaggtatacattca

SEQ ID NO: 7857057 - DNA, 22 bp, Homo sapiens
tgacagtgtttgcacttcaggt

SEQ ID NO: 7857058 - DNA, 22 bp, Homo sapiens
ccaggggcctgtgaaggtgccc

SEQ ID NO: 7857059 - DNA, 22 bp, Homo sapiens
tgacagtgcgggtacatcatag

SEQ ID NO: 7857060 - DNA, 22 bp, Homo sapiens
tgacagtggtgacaggatgggg

SEQ ID NO: 7857061 - DNA, 22 bp, Homo sapiens
tgacagtgcgggtacatcatag

SEQ ID NO: 7857062 - DNA, 22 bp, Homo sapiens
ccaggggcctgtgaaggtgccc

SEQ ID NO: 7857063 - DNA, 22 bp, Homo sapiens
ccaggggcctgtgaaggtgccc

SEQ ID NO: 7857064 - DNA, 20 bp, Homo sapiens
tgacagtttcatatggttca

SEQ ID NO: 7857065 - DNA, 22 bp, Homo sapiens
tgacagttttttgatgaggaat

SEQ ID NO: 7857066 - DNA, 22 bp, Homo sapiens
tgacataaaccagtgagcaaaa

SEQ ID NO: 7857067 - DNA, 22 bp, Homo sapiens
tgacataaaccagtgagcaaaa

SEQ ID NO: 7857068 - DNA, 22 bp, Homo sapiens
tgacagtttagtgtaatagtta

SEQ ID NO: 7857069 - DNA, 22 bp, Homo sapiens
tgacagttgagcatgtaagaga

SEQ ID NO: 7857070 - DNA, 22 bp, Homo sapiens
tgacagttaaggtatacattca

SEQ ID NO: 7857071 - DNA, 22 bp, Homo sapiens
ccaggctggagtgcagtggcac

SEQ ID NO: 7857072 - DNA, 22 bp, Homo sapiens
ccaggctggagtgcagtggcac

SEQ ID NO: 7857073 - DNA, 22 bp, Homo sapiens
ccaggctggagtgcagtggcac

SEQ ID NO: 7857074 - DNA, 22 bp, Homo sapiens
ccaggctggagtgcagtggcac

SEQ ID NO: 7857075 - DNA, 22 bp, Homo sapiens
ccaggctggagtgcagtggcac

SEQ ID NO: 7857076 - DNA, 22 bp, Homo sapiens
ccaggctggagtgcagtggcac

SEQ ID NO: 7857077 - DNA, 22 bp, Homo sapiens
ccaggctggagtgcagtggcac

SEQ ID NO: 7857078 - DNA, 22 bp, Homo sapiens
ccaggctggagtgcagtggcac

SEQ ID NO: 7857079 - DNA, 22 bp, Homo sapiens
ccaggctggagtgcagtggcac

SEQ ID NO: 7857080 - DNA, 22 bp, Homo sapiens
ccaggctggagtgcagtggcac

SEQ ID NO: 7857081 - DNA, 22 bp, Homo sapiens
ccaggctggagtgcagtggcac

SEQ ID NO: 7857082 - DNA, 22 bp, Homo sapiens
ccaggctggagtgcagtggcac

SEQ ID NO: 7857083 - DNA, 22 bp, Homo sapiens
ccaggctggagtgcagtggcac

SEQ ID NO: 7857084 - DNA, 22 bp, Homo sapiens
ccaggctggagtgcagtagtgt

SEQ ID NO: 7857085 - DNA, 22 bp, Homo sapiens
ccaggctggagtgcagtagtgt

SEQ ID NO: 7857086 - DNA, 22 bp, Homo sapiens
ccaggctggagtgcagtagtgt

SEQ ID NO: 7857087 - DNA, 22 bp, Homo sapiens
ccaggctggagtgcagtagtgt

SEQ ID NO: 7857088 - DNA, 22 bp, Homo sapiens
ccaggctggagtgcagtagtgt

SEQ ID NO: 7857089 - DNA, 22 bp, Homo sapiens
ccaggctggagtgcagtagtgt

SEQ ID NO: 7857090 - DNA, 22 bp, Homo sapiens
ccaggctggagtgcagtagtgt

SEQ ID NO: 7857091 - DNA, 22 bp, Homo sapiens
ccaggctggagtgcaatggtgc

SEQ ID NO: 7857092 - DNA, 22 bp, Homo sapiens
ccaggctggagtgcaatggtgc

SEQ ID NO: 7857093 - DNA, 22 bp, Homo sapiens
ccaggctggagtgcaatggtgc

SEQ ID NO: 7857094 - DNA, 22 bp, Homo sapiens
ccaggctggagtgcaatggtgc

SEQ ID NO: 7857095 - DNA, 22 bp, Homo sapiens
ccaggctggattttgcagttca

SEQ ID NO: 7857096 - DNA, 22 bp, Homo sapiens
ccaggctggattttgcagttca

SEQ ID NO: 7857097 - DNA, 22 bp, Homo sapiens
ccaggctggattttgcagttca

SEQ ID NO: 7857098 - DNA, 22 bp, Homo sapiens
ccaggctggattttgcagttca

SEQ ID NO: 7857099 - DNA, 22 bp, Homo sapiens
ccaggctggattttgcagttca

SEQ ID NO: 7857100 - DNA, 22 bp, Homo sapiens
ccaggctggagtgtagtcgcat

SEQ ID NO: 7857101 - DNA, 22 bp, Homo sapiens
ccaggctggagtgtagtcgcat

SEQ ID NO: 7857102 - DNA, 22 bp, Homo sapiens
ccaggctggagtgtagtcgcat

SEQ ID NO: 7857103 - DNA, 22 bp, Homo sapiens
ccaggctggagtgcagtggcac

SEQ ID NO: 7857104 - DNA, 22 bp, Homo sapiens
ccaggctggagtgtagtcgcat

SEQ ID NO: 7857105 - DNA, 22 bp, Homo sapiens
ccaggctggagtgtagtcgcat

SEQ ID NO: 7857106 - DNA, 22 bp, Homo sapiens
ccaggctggagtgtagtcgcat

SEQ ID NO: 7857107 - DNA, 20 bp, Homo sapiens
ccaggctggcaaatgggggc

SEQ ID NO: 7857108 - DNA, 20 bp, Homo sapiens
ccaggctggcaaatgggggc

SEQ ID NO: 7857109 - DNA, 20 bp, Homo sapiens
ccaggctggcaaatgggggc

SEQ ID NO: 7857110 - DNA, 22 bp, Homo sapiens
ccaggctggattttgcagttca

SEQ ID NO: 7857111 - DNA, 20 bp, Homo sapiens
ccaggctggcaaatgggggc

SEQ ID NO: 7857112 - DNA, 20 bp, Homo sapiens
ccaggctggcaaatgggggc

SEQ ID NO: 7857113 - DNA, 21 bp, Homo sapiens
ccaggctggccatggtattga

SEQ ID NO: 7857114 - DNA, 22 bp, Homo sapiens
tgaagttcaagggctacatttg

SEQ ID NO: 7857115 - DNA, 20 bp, Homo sapiens
ccaggctggcaaatgggggc

SEQ ID NO: 7857116 - DNA, 21 bp, Homo sapiens
ccaggctggccatggtattga

SEQ ID NO: 7857117 - DNA, 21 bp, Homo sapiens
ccaggctggccatggtattga

SEQ ID NO: 7857118 - DNA, 22 bp, Homo sapiens
tgaatgcaagtcacacatttct

SEQ ID NO: 7857119 - DNA, 22 bp, Homo sapiens
tgaatgcaaatcatgattgtaa

SEQ ID NO: 7857120 - DNA, 22 bp, Homo sapiens
tgaatgcaagaaggaacatgaa

SEQ ID NO: 7857121 - DNA, 22 bp, Homo sapiens
tgacaacaaggatcctgcctgg

SEQ ID NO: 7857122 - DNA, 20 bp, Homo sapiens
tgacaacaaaatggtaattt

SEQ ID NO: 7857123 - DNA, 22 bp, Homo sapiens
tgaatgctcacatgcctaggtc

SEQ ID NO: 7857124 - DNA, 22 bp, Homo sapiens
tgaatgcagagactgtgggaaa

SEQ ID NO: 7857125 - DNA, 22 bp, Homo sapiens
tgaatgcatggcttagatctac

SEQ ID NO: 7857126 - DNA, 22 bp, Homo sapiens
tgaatgcagagactgtgggaaa

SEQ ID NO: 7857127 - DNA, 22 bp, Homo sapiens
tgacaactttacaaaattcttc

SEQ ID NO: 7857128 - DNA, 22 bp, Homo sapiens
tgacaagaaagcgtcttctttt

SEQ ID NO: 7857129 - DNA, 22 bp, Homo sapiens
tgacaagaagacctggtaatga

SEQ ID NO: 7857130 - DNA, 22 bp, Homo sapiens
tgacaactctagttaatgaatt

SEQ ID NO: 7857131 - DNA, 20 bp, Homo sapiens
tgacaactctgagaacgttc

SEQ ID NO: 7857132 - DNA, 22 bp, Homo sapiens
tgacaagagcattcccacacct

SEQ ID NO: 7857133 - DNA, 22 bp, Homo sapiens
tgacaagagacccctccgcagg

SEQ ID NO: 7857134 - DNA, 22 bp, Homo sapiens
tgacaagaagacctggtaatga

SEQ ID NO: 7857135 - DNA, 22 bp, Homo sapiens
tgacaagaatttgggactgtta

SEQ ID NO: 7857136 - DNA, 22 bp, Homo sapiens
tgacaacattgagttatgtgca

SEQ ID NO: 7857137 - DNA, 20 bp, Homo sapiens
tgacaacatgccttttgctt

SEQ ID NO: 7857138 - DNA, 22 bp, Homo sapiens
tgacaacatcatttttgtgtgg

SEQ ID NO: 7857139 - DNA, 23 bp, Homo sapiens
tgacaacagctctcagccatgtc

SEQ ID NO: 7857140 - DNA, 22 bp, Homo sapiens
tgacaacagccatcacttttag

SEQ ID NO: 7857141 - DNA, 21 bp, Homo sapiens
tgacaacagaactgggcaagc

SEQ ID NO: 7857142 - DNA, 22 bp, Homo sapiens
tgaatgatggtgtgttcttgcc

SEQ ID NO: 7857143 - DNA, 22 bp, Homo sapiens
tgaatgatgtataatattgaga

SEQ ID NO: 7857144 - DNA, 22 bp, Homo sapiens
tgaatgatacagaattatgtag

SEQ ID NO: 7857145 - DNA, 22 bp, Homo sapiens
tgaatgatacagaattatgtag

SEQ ID NO: 7857146 - DNA, 22 bp, Homo sapiens
tgaatgagtttggctgctgttc

SEQ ID NO: 7857147 - DNA, 21 bp, Homo sapiens
tgaagttcgcgggcaagatta

SEQ ID NO: 7857148 - DNA, 22 bp, Homo sapiens
tgaagttgttaaggttgccatt

SEQ ID NO: 7857149 - DNA, 22 bp, Homo sapiens
tgaagttgttaaggttgccatt

SEQ ID NO: 7857150 - DNA, 22 bp, Homo sapiens
tgaatgagtggattctgagtag

SEQ ID NO: 7857151 - DNA, 22 bp, Homo sapiens
tgaatgagtggattctgagtag

SEQ ID NO: 7857152 - DNA, 22 bp, Homo sapiens
tgaatgagtggattctgagtag

SEQ ID NO: 7857153 - DNA, 22 bp, Homo sapiens
tgaatgagtgagttcagacctc

SEQ ID NO: 7857154 - DNA, 22 bp, Homo sapiens
tgcaaatagcctgatgaaagaa

SEQ ID NO: 7857155 - DNA, 22 bp, Homo sapiens
tgcaaatagcctgatgaaagaa

SEQ ID NO: 7857156 - DNA, 22 bp, Homo sapiens
tgcaaatagcctgatgaaagaa

SEQ ID NO: 7857157 - DNA, 22 bp, Homo sapiens
tgcaaatagcctgatgaaagaa

SEQ ID NO: 7857158 - DNA, 22 bp, Homo sapiens
tgcaaataggggacaactcttt

SEQ ID NO: 7857159 - DNA, 22 bp, Homo sapiens
tgcaaatagcctgatgaaagaa

SEQ ID NO: 7857160 - DNA, 22 bp, Homo sapiens
tgcaaataggggacaactcttt

SEQ ID NO: 7857161 - DNA, 22 bp, Homo sapiens
tgcaaatattccatgctgttca

SEQ ID NO: 7857162 - DNA, 22 bp, Homo sapiens
cccacccctggacaggtgagtg

SEQ ID NO: 7857163 - DNA, 22 bp, Homo sapiens
cccacccctggacaggtgagtg

SEQ ID NO: 7857164 - DNA, 22 bp, Homo sapiens
cccacccctggacaggtgagtg

SEQ ID NO: 7857165 - DNA, 18 bp, Homo sapiens
cccaccctggctcttagt

SEQ ID NO: 7857166 - DNA, 22 bp, Homo sapiens
cccacccctggacaggtgagtg

SEQ ID NO: 7857167 - DNA, 22 bp, Homo sapiens
cccactgtgttgcagtctagtg

SEQ ID NO: 7857168 - DNA, 22 bp, Homo sapiens
cccactgtgttgcagtctagtg

SEQ ID NO: 7857169 - DNA, 20 bp, Homo sapiens
cccagaagcttaacagagca

SEQ ID NO: 7857170 - DNA, 20 bp, Homo sapiens
cccagaagcttaacagagca

SEQ ID NO: 7857171 - DNA, 22 bp, Homo sapiens
cccactttggttgcactctgcc

SEQ ID NO: 7857172 - DNA, 22 bp, Homo sapiens
cccactgtttccctgaggctct

SEQ ID NO: 7857173 - DNA, 22 bp, Homo sapiens
cccacttcatgggcaggaagga

SEQ ID NO: 7857174 - DNA, 23 bp, Homo sapiens
tgcaaataacaaggagtttaagg

SEQ ID NO: 7857175 - DNA, 23 bp, Homo sapiens
tgcaaataacaaggagtttaagg

SEQ ID NO: 7857176 - DNA, 22 bp, Homo sapiens
tgcaaataaatttctgttcatt

SEQ ID NO: 7857177 - DNA, 22 bp, Homo sapiens
tgcaaataaatttctgttcatt

SEQ ID NO: 7857178 - DNA, 22 bp, Homo sapiens
tgcaaatagcctatatttatag

SEQ ID NO: 7857179 - DNA, 23 bp, Homo sapiens
tgcaaataacaaggagtttaagg

SEQ ID NO: 7857180 - DNA, 22 bp, Homo sapiens
tgcaaagggctttgcatacaga

SEQ ID NO: 7857181 - DNA, 22 bp, Homo sapiens
tgcaaaggaggccaaaccaagt

SEQ ID NO: 7857182 - DNA, 18 bp, Homo sapiens
tgcaaaggacactgagat

SEQ ID NO: 7857183 - DNA, 18 bp, Homo sapiens
tgcaaaggacactgagat

SEQ ID NO: 7857184 - DNA, 22 bp, Homo sapiens
tgcaaaggaggatgggaaagaa

SEQ ID NO: 7857185 - DNA, 21 bp, Homo sapiens
tgcaaagctgctgaagtggta

SEQ ID NO: 7857186 - DNA, 23 bp, Homo sapiens
tgcaaagcacttaagaggccctg

SEQ ID NO: 7857187 - DNA, 22 bp, Homo sapiens
tgcaaagatttatctttctcca

SEQ ID NO: 7857188 - DNA, 22 bp, Homo sapiens
cccagaaggtcgaggctgcagt

SEQ ID NO: 7857189 - DNA, 22 bp, Homo sapiens
cccagaaggtcgaggctgcagt

SEQ ID NO: 7857190 - DNA, 22 bp, Homo sapiens
cccagaataggtaagcccaggg

SEQ ID NO: 7857191 - DNA, 22 bp, Homo sapiens
cccagaataggtaagcccaggg

SEQ ID NO: 7857192 - DNA, 22 bp, Homo sapiens
cccagaataggtaagcccaggg

SEQ ID NO: 7857193 - DNA, 20 bp, Homo sapiens
cccagaagtcacctccactc

SEQ ID NO: 7857194 - DNA, 21 bp, Homo sapiens
cccagaagttccatggggggc

SEQ ID NO: 7857195 - DNA, 22 bp, Homo sapiens
cccagaaggctaagcgtggatt

SEQ ID NO: 7857196 - DNA, 22 bp, Homo sapiens
cccagaaggctaagcgtggatt

SEQ ID NO: 7857197 - DNA, 20 bp, Homo sapiens
cccagaagcttaacagagca

SEQ ID NO: 7857198 - DNA, 22 bp, Homo sapiens
cccagaaggcttgccaggaagc

SEQ ID NO: 7857199 - DNA, 22 bp, Homo sapiens
cccagaaggcttgccaggaagc

SEQ ID NO: 7857200 - DNA, 22 bp, Homo sapiens
cccagaaggcttgccaggaagc

SEQ ID NO: 7857201 - DNA, 22 bp, Homo sapiens
cccagaaggtcgaggctgcagt

SEQ ID NO: 7857202 - DNA, 22 bp, Homo sapiens
cccagaaggcttgccaggaagc

SEQ ID NO: 7857203 - DNA, 22 bp, Homo sapiens
cccagacataacagcagagagg

SEQ ID NO: 7857204 - DNA, 22 bp, Homo sapiens
cccagacataacagcagagagg

SEQ ID NO: 7857205 - DNA, 22 bp, Homo sapiens
cccagacattgcagggactggt

SEQ ID NO: 7857206 - DNA, 22 bp, Homo sapiens
cccagacccagagggaggcagg

SEQ ID NO: 7857207 - DNA, 22 bp, Homo sapiens
cccagacataacagcagagagg

SEQ ID NO: 7857208 - DNA, 22 bp, Homo sapiens
cccagacataacagcagagagg

SEQ ID NO: 7857209 - DNA, 22 bp, Homo sapiens
cccagaatgttatagtgcccct

SEQ ID NO: 7857210 - DNA, 22 bp, Homo sapiens
cccagacagtcaagaggcctgc

SEQ ID NO: 7857211 - DNA, 22 bp, Homo sapiens
cccagacagtcaagaggcctgc

SEQ ID NO: 7857212 - DNA, 22 bp, Homo sapiens
cccagaattattctcttctcct

SEQ ID NO: 7857213 - DNA, 22 bp, Homo sapiens
cccagaatgttatagtgcccct

SEQ ID NO: 7857214 - DNA, 22 bp, Homo sapiens
cccagaatgattcagcgacagt

SEQ ID NO: 7857215 - DNA, 22 bp, Homo sapiens
cccagacagtcaagaggcctgc

SEQ ID NO: 7857216 - DNA, 22 bp, Homo sapiens
cccagacagtcaagaggcctgc

SEQ ID NO: 7857217 - DNA, 22 bp, Homo sapiens
cccagacagtcaagaggcctgc

SEQ ID NO: 7857218 - DNA, 22 bp, Homo sapiens
tgcacacatgtttacaagcatc

SEQ ID NO: 7857219 - DNA, 22 bp, Homo sapiens
tgcacacatgtttacaagcatc

SEQ ID NO: 7857220 - DNA, 22 bp, Homo sapiens
tgcacacattaaggatacacag

SEQ ID NO: 7857221 - DNA, 22 bp, Homo sapiens
tgcacacattaaggatacacag

SEQ ID NO: 7857222 - DNA, 22 bp, Homo sapiens
tgcacacattaaggatacacag

SEQ ID NO: 7857223 - DNA, 22 bp, Homo sapiens
tgcacacattaaggatacacag

SEQ ID NO: 7857224 - DNA, 22 bp, Homo sapiens
tgcacacattaaggatacacag

SEQ ID NO: 7857225 - DNA, 22 bp, Homo sapiens
tgcacacattaaggatacacag

SEQ ID NO: 7857226 - DNA, 22 bp, Homo sapiens
tgcacacattctatggggctga

SEQ ID NO: 7857227 - DNA, 22 bp, Homo sapiens
tgcacacattctatggggctga

SEQ ID NO: 7857228 - DNA, 22 bp, Homo sapiens
tgcacacctctccaccactctc

SEQ ID NO: 7857229 - DNA, 22 bp, Homo sapiens
tgcacacttagtatgactacat

SEQ ID NO: 7857230 - DNA, 22 bp, Homo sapiens
tgcacacctctccaccactctc

SEQ ID NO: 7857231 - DNA, 22 bp, Homo sapiens
tgcacagacaactctttctaga

SEQ ID NO: 7857232 - DNA, 22 bp, Homo sapiens
tgcacacatatgagcatgtgtg

SEQ ID NO: 7857233 - DNA, 22 bp, Homo sapiens
tgcacacatatgagcatgtgtg

SEQ ID NO: 7857234 - DNA, 22 bp, Homo sapiens
tgcacacatgtatgtatatgtg

SEQ ID NO: 7857235 - DNA, 22 bp, Homo sapiens
tgcacacatgtatgtatatgtg

SEQ ID NO: 7857236 - DNA, 22 bp, Homo sapiens
cccagactcctctggctggtgg

SEQ ID NO: 7857237 - DNA, 22 bp, Homo sapiens
tgcacacatgtttacaagcatc

SEQ ID NO: 7857238 - DNA, 22 bp, Homo sapiens
tgcacacatgtttacaagcatc

SEQ ID NO: 7857239 - DNA, 22 bp, Homo sapiens
tgcacacatgtttacaagcatc

SEQ ID NO: 7857240 - DNA, 22 bp, Homo sapiens
tgcacacatgtttacaagcatc

SEQ ID NO: 7857241 - DNA, 22 bp, Homo sapiens
tgcacacatgtttacaagcatc

SEQ ID NO: 7857242 - DNA, 22 bp, Homo sapiens
tgcacacatgtttacaagcatc

SEQ ID NO: 7857243 - DNA, 22 bp, Homo sapiens
tgcacacatgtttacaagcatc

SEQ ID NO: 7857244 - DNA, 23 bp, Homo sapiens
ccattcatctcagtcattgcttt

SEQ ID NO: 7857245 - DNA, 22 bp, Homo sapiens
ccattcatagcaagctacatct

SEQ ID NO: 7857246 - DNA, 22 bp, Homo sapiens
ccattcacttttgccctgtcct

SEQ ID NO: 7857247 - DNA, 22 bp, Homo sapiens
ccattcacctcttcacgtgctc

SEQ ID NO: 7857248 - DNA, 22 bp, Homo sapiens
ccattattataggaggctcatt

SEQ ID NO: 7857249 - DNA, 22 bp, Homo sapiens
ccattagaagatgtaatagaga

SEQ ID NO: 7857250 - DNA, 22 bp, Homo sapiens
ccattactttccaatatatcag

SEQ ID NO: 7857251 - DNA, 22 bp, Homo sapiens
ccattagtacctctggaaaatt

SEQ ID NO: 7857252 - DNA, 22 bp, Homo sapiens
ccattaaagcaccactgtaata

SEQ ID NO: 7857253 - DNA, 22 bp, Homo sapiens
ccattaaagcaccactgtaata

SEQ ID NO: 7857254 - DNA, 22 bp, Homo sapiens
ccattaaagcaccactgtaata

SEQ ID NO: 7857255 - DNA, 22 bp, Homo sapiens
ccatgttgtatctcttatcggc

SEQ ID NO: 7857256 - DNA, 22 bp, Homo sapiens
ccattaaacttgtggacccagt

SEQ ID NO: 7857257 - DNA, 22 bp, Homo sapiens
ccattaaaattgtgacatagga

SEQ ID NO: 7857258 - DNA, 22 bp, Homo sapiens
ccattaaaattgtgacatagga

SEQ ID NO: 7857259 - DNA, 22 bp, Homo sapiens
ccattaaaattgtgacatagga

SEQ ID NO: 7857260 - DNA, 22 bp, Homo sapiens
ccattaaaatggaatgtagtga

SEQ ID NO: 7857261 - DNA, 22 bp, Homo sapiens
ccattaaaatggaatgtagtga

SEQ ID NO: 7857262 - DNA, 22 bp, Homo sapiens
ccattaaaatggaatgtagtga

SEQ ID NO: 7857263 - DNA, 21 bp, Homo sapiens
ccattcttagtcaagtgtctc

SEQ ID NO: 7857264 - DNA, 22 bp, Homo sapiens
ccattctttcagtgtctcatgt

SEQ ID NO: 7857265 - DNA, 22 bp, Homo sapiens
ccattctttcagtgtctcatgt

SEQ ID NO: 7857266 - DNA, 22 bp, Homo sapiens
ccattctgtttaatgaatgaaa

SEQ ID NO: 7857267 - DNA, 22 bp, Homo sapiens
ccattctgtgtctctccacagc

SEQ ID NO: 7857268 - DNA, 19 bp, Homo sapiens
ccattctgtctctgccaca

SEQ ID NO: 7857269 - DNA, 19 bp, Homo sapiens
ccattctgtctctgccaca

SEQ ID NO: 7857270 - DNA, 22 bp, Homo sapiens
ccattggagccaagagttttac

SEQ ID NO: 7857271 - DNA, 22 bp, Homo sapiens
ccattgattaccagcagcagtt

SEQ ID NO: 7857272 - DNA, 22 bp, Homo sapiens
ccattgcactccatcctgggca

SEQ ID NO: 7857273 - DNA, 22 bp, Homo sapiens
ccattggagagttttaagaagg

SEQ ID NO: 7857274 - DNA, 19 bp, Homo sapiens
ccattcatatagacagcag

SEQ ID NO: 7857275 - DNA, 23 bp, Homo sapiens
ccattcatctcagtcattgcttt

SEQ ID NO: 7857276 - DNA, 22 bp, Homo sapiens
ccattcatgtttttgaactatg

SEQ ID NO: 7857277 - DNA, 22 bp, Homo sapiens
ccattcattgtctccaattcta

SEQ ID NO: 7857278 - DNA, 19 bp, Homo sapiens
ccattcctctagaatttgg

SEQ ID NO: 7857279 - DNA, 22 bp, Homo sapiens
ccattccatgtgctacacataa

SEQ ID NO: 7857280 - DNA, 19 bp, Homo sapiens
ccattcctctagaatttgg

SEQ ID NO: 7857281 - DNA, 22 bp, Homo sapiens
ccattccttcatcaaaaggcct

SEQ ID NO: 7857282 - DNA, 22 bp, Homo sapiens
ccattccttcatcaaaaggcct

SEQ ID NO: 7857283 - DNA, 22 bp, Homo sapiens
ccattctgaacaattcttgtct

SEQ ID NO: 7857284 - DNA, 22 bp, Homo sapiens
ccattccttcatcaaaaggcct

SEQ ID NO: 7857285 - DNA, 22 bp, Homo sapiens
ccattctgaagtgcaggctaag

SEQ ID NO: 7857286 - DNA, 22 bp, Homo sapiens
ccattctgacttcattgcctca

SEQ ID NO: 7857287 - DNA, 22 bp, Homo sapiens
ccattctgacttcattgcctca

SEQ ID NO: 7857288 - DNA, 22 bp, Homo sapiens
ccattctgacacctaattctgt

SEQ ID NO: 7857289 - DNA, 22 bp, Homo sapiens
ccattctgccatgcttcatcta

SEQ ID NO: 7857290 - DNA, 22 bp, Homo sapiens
ccattctgagtcttatgtcttt

SEQ ID NO: 7857291 - DNA, 20 bp, Homo sapiens
ccattctgggtgcagtctgg

SEQ ID NO: 7857292 - DNA, 22 bp, Homo sapiens
ccattctgccatgcttcatcta

SEQ ID NO: 7857293 - DNA, 20 bp, Homo sapiens
ccattctgggtgcagtctgg

SEQ ID NO: 7857294 - DNA, 20 bp, Homo sapiens
ccattctgggtgcagtctgg

SEQ ID NO: 7857295 - DNA, 22 bp, Homo sapiens
tgattttacttagcatgatgtt

SEQ ID NO: 7857296 - DNA, 22 bp, Homo sapiens
tgattttacttagcatgatgtt

SEQ ID NO: 7857297 - DNA, 23 bp, Homo sapiens
tgattttaaaaagtaagttatca

SEQ ID NO: 7857298 - DNA, 23 bp, Homo sapiens
tgattttaaaaagtaagttatca

SEQ ID NO: 7857299 - DNA, 22 bp, Homo sapiens
tgattttattgaaacttcactt

SEQ ID NO: 7857300 - DNA, 22 bp, Homo sapiens
tgattttattggtgaggaaatt

SEQ ID NO: 7857301 - DNA, 22 bp, Homo sapiens
tgcaaagatttatctttctcca

SEQ ID NO: 7857302 - DNA, 22 bp, Homo sapiens
tgattttacttagcatgatgtt

SEQ ID NO: 7857303 - DNA, 22 bp, Homo sapiens
tgattttacttagcatgatgtt

SEQ ID NO: 7857304 - DNA, 22 bp, Homo sapiens
tgattttattgaaacttcactt

SEQ ID NO: 7857305 - DNA, 22 bp, Homo sapiens
tgattttacttagcatgatgtt

SEQ ID NO: 7857306 - DNA, 22 bp, Homo sapiens
tgatttgaactctgggacttgt

SEQ ID NO: 7857307 - DNA, 22 bp, Homo sapiens
tgatttgaaacctttggcaaga

SEQ ID NO: 7857308 - DNA, 22 bp, Homo sapiens
tgatttgaattttaaaacactg

SEQ ID NO: 7857309 - DNA, 22 bp, Homo sapiens
tgatttgcatggagaataacag

SEQ ID NO: 7857310 - DNA, 22 bp, Homo sapiens
tgatttgattcttcttggagta

SEQ ID NO: 7857311 - DNA, 20 bp, Homo sapiens
tgatttgatcatggctgcat

SEQ ID NO: 7857312 - DNA, 20 bp, Homo sapiens
tgatttgagaagctgctggt

SEQ ID NO: 7857313 - DNA, 22 bp, Homo sapiens
tgatttgaggtacataaatcca

SEQ ID NO: 7857314 - DNA, 22 bp, Homo sapiens
tgatttgaggtacataaatcca

SEQ ID NO: 7857315 - DNA, 22 bp, Homo sapiens
tgatttgaggtacataaatcca

SEQ ID NO: 7857316 - DNA, 23 bp, Homo sapiens
tgattttaaaaagtaagttatca

SEQ ID NO: 7857317 - DNA, 23 bp, Homo sapiens
tgattttaaaaagtaagttatca

SEQ ID NO: 7857318 - DNA, 23 bp, Homo sapiens
tgattttaaaaagtaagttatca

SEQ ID NO: 7857319 - DNA, 22 bp, Homo sapiens
tgatttgcgtctcatttgaaat

SEQ ID NO: 7857320 - DNA, 23 bp, Homo sapiens
tgattttaaaaagtaagttatca

SEQ ID NO: 7857321 - DNA, 23 bp, Homo sapiens
tgattttaaaaagtaagttatca

SEQ ID NO: 7857322 - DNA, 22 bp, Homo sapiens
tgatttgcgtctcatttgaaat

SEQ ID NO: 7857323 - DNA, 20 bp, Homo sapiens
tgatttctcttctattcctt

SEQ ID NO: 7857324 - DNA, 20 bp, Homo sapiens
tgatttctcttctattcctt

SEQ ID NO: 7857325 - DNA, 22 bp, Homo sapiens
tgatttctctccgttatttcag

SEQ ID NO: 7857326 - DNA, 22 bp, Homo sapiens
tgatttctctccgttatttcag

SEQ ID NO: 7857327 - DNA, 20 bp, Homo sapiens
tgatttctcttctattcctt

SEQ ID NO: 7857328 - DNA, 22 bp, Homo sapiens
tgatttcttccttgtcattaga

SEQ ID NO: 7857329 - DNA, 22 bp, Homo sapiens
tgatttcttccttgtcattaga

SEQ ID NO: 7857330 - DNA, 21 bp, Homo sapiens
tgatttctgccaagttcacta

SEQ ID NO: 7857331 - DNA, 21 bp, Homo sapiens
tgatttctgccaagttcacta

SEQ ID NO: 7857332 - DNA, 21 bp, Homo sapiens
tgatttctgccaagttcacta

SEQ ID NO: 7857333 - DNA, 22 bp, Homo sapiens
tgatttctcatattgttcaaaa

SEQ ID NO: 7857334 - DNA, 22 bp, Homo sapiens
ccattggagccaagagttttac

SEQ ID NO: 7857335 - DNA, 22 bp, Homo sapiens
ccattgtaaagagtatactttg

SEQ ID NO: 7857336 - DNA, 22 bp, Homo sapiens
ccattgtaaattctgtggaagt

SEQ ID NO: 7857337 - DNA, 22 bp, Homo sapiens
ccatgccagctgctaggtcaca

SEQ ID NO: 7857338 - DNA, 22 bp, Homo sapiens
ccatgcatggcactggactggg

SEQ ID NO: 7857339 - DNA, 22 bp, Homo sapiens
ccatgcatatgcacgtaaatta

SEQ ID NO: 7857340 - DNA, 22 bp, Homo sapiens
ccatgcagtgctggagctgatt

SEQ ID NO: 7857341 - DNA, 19 bp, Homo sapiens
ccatgccatcattttaaag

SEQ ID NO: 7857342 - DNA, 22 bp, Homo sapiens
ccatgccatactggccacccgg

SEQ ID NO: 7857343 - DNA, 19 bp, Homo sapiens
ccatgccatcattttaaag

SEQ ID NO: 7857344 - DNA, 22 bp, Homo sapiens
ccatgcccacgttgtggctcag

SEQ ID NO: 7857345 - DNA, 22 bp, Homo sapiens
ccatgcccacgttgtggctcag

SEQ ID NO: 7857346 - DNA, 22 bp, Homo sapiens
ccatgccccaccaggacgctgc

SEQ ID NO: 7857347 - DNA, 22 bp, Homo sapiens
ccatcctgcattgctattcaga

SEQ ID NO: 7857348 - DNA, 22 bp, Homo sapiens
ccagtgtttccgtcagtacacg

SEQ ID NO: 7857349 - DNA, 22 bp, Homo sapiens
ccatcctgcattgctattcaga

SEQ ID NO: 7857350 - DNA, 22 bp, Homo sapiens
ccagtgtttccgtcagtacacg

SEQ ID NO: 7857351 - DNA, 22 bp, Homo sapiens
ccatcctggcctcgctgtccac

SEQ ID NO: 7857352 - DNA, 22 bp, Homo sapiens
ccatcctggcctcgctgtccac

SEQ ID NO: 7857353 - DNA, 22 bp, Homo sapiens
ccatcctggccttgctgtccac

SEQ ID NO: 7857354 - DNA, 22 bp, Homo sapiens
ccatcctggccttgctgtccac

SEQ ID NO: 7857355 - DNA, 22 bp, Homo sapiens
ccatgcagtgctggagctgatt

SEQ ID NO: 7857356 - DNA, 22 bp, Homo sapiens
ccatcctgtctgtggcctcagg

SEQ ID NO: 7857357 - DNA, 22 bp, Homo sapiens
ccatgctgaccctgtgcaggca

SEQ ID NO: 7857358 - DNA, 22 bp, Homo sapiens
ccatgctgaccctgtgcaggca

SEQ ID NO: 7857359 - DNA, 22 bp, Homo sapiens
ccatgctggagtccctagctgt

SEQ ID NO: 7857360 - DNA, 22 bp, Homo sapiens
ccatgctgaccctgtgcaggca

SEQ ID NO: 7857361 - DNA, 22 bp, Homo sapiens
ccatgctaggaactctcaggga

SEQ ID NO: 7857362 - DNA, 22 bp, Homo sapiens
ccatgctccttaccactcactt

SEQ ID NO: 7857363 - DNA, 22 bp, Homo sapiens
ccatgctgtgacacagtagtta

SEQ ID NO: 7857364 - DNA, 22 bp, Homo sapiens
ccatgcttaaataagaggcagc

SEQ ID NO: 7857365 - DNA, 22 bp, Homo sapiens
ccatgctgggatgctccaagtg

SEQ ID NO: 7857366 - DNA, 22 bp, Homo sapiens
ccatgctgtgacacagtagtta

SEQ ID NO: 7857367 - DNA, 22 bp, Homo sapiens
ccatgctggagtccctagctgt

SEQ ID NO: 7857368 - DNA, 22 bp, Homo sapiens
ccatgctggagtccctagctgt

SEQ ID NO: 7857369 - DNA, 22 bp, Homo sapiens
ccatgctgggatgctccaagtg

SEQ ID NO: 7857370 - DNA, 22 bp, Homo sapiens
ccatgctgggatgctccaagtg

SEQ ID NO: 7857371 - DNA, 22 bp, Homo sapiens
ccatgccttcctttccctggaa

SEQ ID NO: 7857372 - DNA, 22 bp, Homo sapiens
ccatgccttcctttccctggaa

SEQ ID NO: 7857373 - DNA, 22 bp, Homo sapiens
ccatgcgcacccaggggaagct

SEQ ID NO: 7857374 - DNA, 22 bp, Homo sapiens
ccatgcctttcactgaaccagt

SEQ ID NO: 7857375 - DNA, 22 bp, Homo sapiens
ccatgcctcgggaagagtctgt

SEQ ID NO: 7857376 - DNA, 22 bp, Homo sapiens
ccatgccctaaaggactggcag

SEQ ID NO: 7857377 - DNA, 22 bp, Homo sapiens
ccatgccctaaaggactggcag

SEQ ID NO: 7857378 - DNA, 22 bp, Homo sapiens
ccatgcctcgggaagagtctgt

SEQ ID NO: 7857379 - DNA, 22 bp, Homo sapiens
ccatgcctcgggaagagtctgt

SEQ ID NO: 7857380 - DNA, 22 bp, Homo sapiens
ccatgccctaaaggactggcag

SEQ ID NO: 7857381 - DNA, 22 bp, Homo sapiens
ccatgccctaaaggactggcag

SEQ ID NO: 7857382 - DNA, 22 bp, Homo sapiens
ccatgccccaccaggacgctgc

SEQ ID NO: 7857383 - DNA, 22 bp, Homo sapiens
tgaggtaggtgtcgagagaggt

SEQ ID NO: 7857384 - DNA, 22 bp, Homo sapiens
tgaggtagggaaggctggtatt

SEQ ID NO: 7857385 - DNA, 22 bp, Homo sapiens
ccatgcttaaataagaggcagc

SEQ ID NO: 7857386 - DNA, 22 bp, Homo sapiens
tgaggtagtaaaggtgttagtt

SEQ ID NO: 7857387 - DNA, 22 bp, Homo sapiens
tgaggtagtgcttgtcatgttt

SEQ ID NO: 7857388 - DNA, 22 bp, Homo sapiens
tgaggtagtgcttgtcatgttt

SEQ ID NO: 7857389 - DNA, 22 bp, Homo sapiens
tgaggtagtttttcaagtattt

SEQ ID NO: 7857390 - DNA, 22 bp, Homo sapiens
tgaggtatacgttggttcagtc

SEQ ID NO: 7857391 - DNA, 20 bp, Homo sapiens
tgaggtatcaattcaaggca

SEQ ID NO: 7857392 - DNA, 22 bp, Homo sapiens
tgaggtatccagtgaagcagcc

SEQ ID NO: 7857393 - DNA, 22 bp, Homo sapiens
tgaggtagtttgttgtacagta

SEQ ID NO: 7857394 - DNA, 21 bp, Homo sapiens
tgaggtagtgtttgtcaagtt

SEQ ID NO: 7857395 - DNA, 21 bp, Homo sapiens
tgaggtagtgtttgtcaagtt

SEQ ID NO: 7857396 - DNA, 22 bp, Homo sapiens
ccatgtggggtcagtgtttggg

SEQ ID NO: 7857397 - DNA, 22 bp, Homo sapiens
ccatgtggctgctgacaacaga

SEQ ID NO: 7857398 - DNA, 22 bp, Homo sapiens
ccatggcctgaaggagtgcatc

SEQ ID NO: 7857399 - DNA, 22 bp, Homo sapiens
ccatggctaagtatctgtagaa

SEQ ID NO: 7857400 - DNA, 22 bp, Homo sapiens
ccatgtgtcgggcctgcagtgg

SEQ ID NO: 7857401 - DNA, 22 bp, Homo sapiens
ccatgtggtgggaaggagaatg

SEQ ID NO: 7857402 - DNA, 22 bp, Homo sapiens
tgaggtcacctggaggcagcct

SEQ ID NO: 7857403 - DNA, 22 bp, Homo sapiens
tgaggtcaagcccagagcagca

SEQ ID NO: 7857404 - DNA, 22 bp, Homo sapiens
tgaggtcagcccttcctatgat

SEQ ID NO: 7857405 - DNA, 22 bp, Homo sapiens
ccatggcctgaaggagtgcatc

SEQ ID NO: 7857406 - DNA, 22 bp, Homo sapiens
ccatggcctgaaggagtgcatc

SEQ ID NO: 7857407 - DNA, 22 bp, Homo sapiens
tgaggtatggtaaggtaaaatc

SEQ ID NO: 7857408 - DNA, 22 bp, Homo sapiens
tgaggtattttttaaagcacaa

SEQ ID NO: 7857409 - DNA, 22 bp, Homo sapiens
tgaggtattttttaaagcacaa

SEQ ID NO: 7857410 - DNA, 22 bp, Homo sapiens
tgaggtatgctgaactctgttt

SEQ ID NO: 7857411 - DNA, 22 bp, Homo sapiens
tgaggtatgatttacatgcagt

SEQ ID NO: 7857412 - DNA, 22 bp, Homo sapiens
tgaggtatgatttacatgcagt

SEQ ID NO: 7857413 - DNA, 22 bp, Homo sapiens
tgaggtatgagtgtgccaggtg

SEQ ID NO: 7857414 - DNA, 22 bp, Homo sapiens
tgaggtatccagtgaagcagcc

SEQ ID NO: 7857415 - DNA, 22 bp, Homo sapiens
tgaggtatgaggttctatgatc

SEQ ID NO: 7857416 - DNA, 22 bp, Homo sapiens
ccagtcctgtgtgaccctgcac

SEQ ID NO: 7857417 - DNA, 22 bp, Homo sapiens
ccagtcctttgagccagttctg

SEQ ID NO: 7857418 - DNA, 22 bp, Homo sapiens
ccagtcctggccagtaacatga

SEQ ID NO: 7857419 - DNA, 22 bp, Homo sapiens
ccagtcctggccagtaacatga

SEQ ID NO: 7857420 - DNA, 22 bp, Homo sapiens
ccagtcctgggagcttgcactg

SEQ ID NO: 7857421 - DNA, 22 bp, Homo sapiens
ccagtcctgggagcttgcactg

SEQ ID NO: 7857422 - DNA, 22 bp, Homo sapiens
ccagtcctcagatggtctgtgc

SEQ ID NO: 7857423 - DNA, 19 bp, Homo sapiens
ccagtcctctttgggcctg

SEQ ID NO: 7857424 - DNA, 22 bp, Homo sapiens
ccagtcctgccaccctgtctat

SEQ ID NO: 7857425 - DNA, 22 bp, Homo sapiens
ccagtcctcagatggtctgtgc

SEQ ID NO: 7857426 - DNA, 22 bp, Homo sapiens
ccagtcctgccaccctgtctat

SEQ ID NO: 7857427 - DNA, 23 bp, Homo sapiens
ccagtctcacgtatacaggattt

SEQ ID NO: 7857428 - DNA, 19 bp, Homo sapiens
ccagtctccttgcagcatc

SEQ ID NO: 7857429 - DNA, 19 bp, Homo sapiens
ccagtctccttgcagcatc

SEQ ID NO: 7857430 - DNA, 20 bp, Homo sapiens
ccagtctctggccagcatca

SEQ ID NO: 7857431 - DNA, 20 bp, Homo sapiens
ccagtctctatcagaaataa

SEQ ID NO: 7857432 - DNA, 20 bp, Homo sapiens
ccagtctctatcagaaataa

SEQ ID NO: 7857433 - DNA, 22 bp, Homo sapiens
ccagtctcgttgaggcgcttgt

SEQ ID NO: 7857434 - DNA, 23 bp, Homo sapiens
ccagtctctttccaaaatcacat

SEQ ID NO: 7857435 - DNA, 23 bp, Homo sapiens
ccagtctctttccaaaatcacat

SEQ ID NO: 7857436 - DNA, 22 bp, Homo sapiens
ccagtctcttccctcctgccag

SEQ ID NO: 7857437 - DNA, 22 bp, Homo sapiens
ccagtcctagaagaggagtcga

SEQ ID NO: 7857438 - DNA, 22 bp, Homo sapiens
ccagtcctagaagaggagtcga

SEQ ID NO: 7857439 - DNA, 22 bp, Homo sapiens
ccagtcctagaagaggagtcga

SEQ ID NO: 7857440 - DNA, 20 bp, Homo sapiens
ccagtccctgagcaccaggg

SEQ ID NO: 7857441 - DNA, 20 bp, Homo sapiens
ccagtccctgagcaccaggg

SEQ ID NO: 7857442 - DNA, 22 bp, Homo sapiens
ccagtcccgcatggtccagaat

SEQ ID NO: 7857443 - DNA, 22 bp, Homo sapiens
ccagtcccgcatggtccagaat

SEQ ID NO: 7857444 - DNA, 22 bp, Homo sapiens
tgaggcagcctgcattaaagag

SEQ ID NO: 7857445 - DNA, 22 bp, Homo sapiens
tgaggcagcattcttcaagaca

SEQ ID NO: 7857446 - DNA, 22 bp, Homo sapiens
tgaggcagcattcttcaagaca

SEQ ID NO: 7857447 - DNA, 22 bp, Homo sapiens
tgaggcagcaattgtattgtat

SEQ ID NO: 7857448 - DNA, 22 bp, Homo sapiens
tgaggcagcccactttccttag

SEQ ID NO: 7857449 - DNA, 22 bp, Homo sapiens
tgaggcagcccactttccttag

SEQ ID NO: 7857450 - DNA, 22 bp, Homo sapiens
tgaggcagcccactttccttag

SEQ ID NO: 7857451 - DNA, 22 bp, Homo sapiens
tgaggcagcccactttccttag

SEQ ID NO: 7857452 - DNA, 22 bp, Homo sapiens
tgagggctgacaggaggacagc

SEQ ID NO: 7857453 - DNA, 22 bp, Homo sapiens
tgagggctgcttccagagctag

SEQ ID NO: 7857454 - DNA, 22 bp, Homo sapiens
tgagggctgcttccagagctag

SEQ ID NO: 7857455 - DNA, 22 bp, Homo sapiens
ccagtgttccctcgggttcatg

SEQ ID NO: 7857456 - DNA, 22 bp, Homo sapiens
ccagtgttccctcgggttcatg

SEQ ID NO: 7857457 - DNA, 22 bp, Homo sapiens
tgaggggaactgatgcccattg

SEQ ID NO: 7857458 - DNA, 22 bp, Homo sapiens
tgaggggaactgatgcccattg

SEQ ID NO: 7857459 - DNA, 22 bp, Homo sapiens
ccagtgtttaggaataaaatgt

SEQ ID NO: 7857460 - DNA, 22 bp, Homo sapiens
ccagtgtttacagttgaacaaa

SEQ ID NO: 7857461 - DNA, 22 bp, Homo sapiens
ccagtgttggaggatggcttgc

SEQ ID NO: 7857462 - DNA, 22 bp, Homo sapiens
tgagggctaaattgtggcaggt

SEQ ID NO: 7857463 - DNA, 22 bp, Homo sapiens
tgagggctaaattgtggcaggt

SEQ ID NO: 7857464 - DNA, 22 bp, Homo sapiens
tgagggctaaattgtggcaggt

SEQ ID NO: 7857465 - DNA, 22 bp, Homo sapiens
tgagggccgaggagctgtgggt

SEQ ID NO: 7857466 - DNA, 22 bp, Homo sapiens
tgagggccgaggagctgtgggt

SEQ ID NO: 7857467 - DNA, 22 bp, Homo sapiens
tgagggcagagcactggggagc

SEQ ID NO: 7857468 - DNA, 22 bp, Homo sapiens
tgagggctaaattgtggcaggt

SEQ ID NO: 7857469 - DNA, 22 bp, Homo sapiens
tgagggcagagcactggggagc

SEQ ID NO: 7857470 - DNA, 22 bp, Homo sapiens
tgagggcagagcactggggagc

SEQ ID NO: 7857471 - DNA, 22 bp, Homo sapiens
tgagggatggtgagagtctgat

SEQ ID NO: 7857472 - DNA, 22 bp, Homo sapiens
tgagggattgatgtttgacatg

SEQ ID NO: 7857473 - DNA, 22 bp, Homo sapiens
tgagggcaaagtggtgctgagg

SEQ ID NO: 7857474 - DNA, 22 bp, Homo sapiens
tgagggcaaagtggtgctgagg

SEQ ID NO: 7857475 - DNA, 22 bp, Homo sapiens
tgagggcaaagtggtgctgagg

SEQ ID NO: 7857476 - DNA, 22 bp, Homo sapiens
tgagggcaaagtggtgctgagg

SEQ ID NO: 7857477 - DNA, 22 bp, Homo sapiens
tgagggcaaagtggtgctgagg

SEQ ID NO: 7857478 - DNA, 22 bp, Homo sapiens
tgagggcacctgggattaatgg

SEQ ID NO: 7857479 - DNA, 22 bp, Homo sapiens
ccagtctgaggcctggtgaggg

SEQ ID NO: 7857480 - DNA, 23 bp, Homo sapiens
tgaggctgattgatttttgctca

SEQ ID NO: 7857481 - DNA, 23 bp, Homo sapiens
tgaggctgattgatttttgctca

SEQ ID NO: 7857482 - DNA, 22 bp, Homo sapiens
tgagggatccagaggcagtggt

SEQ ID NO: 7857483 - DNA, 22 bp, Homo sapiens
tgaggctgccttgggaagaggg

SEQ ID NO: 7857484 - DNA, 22 bp, Homo sapiens
tgaggctgccttgggaagaggg

SEQ ID NO: 7857485 - DNA, 22 bp, Homo sapiens
tctggtcaagacatcctaacat

SEQ ID NO: 7857486 - DNA, 22 bp, Homo sapiens
tctggtcactgtccaattctat

SEQ ID NO: 7857487 - DNA, 22 bp, Homo sapiens
tctggtcagtaataagaagtgg

SEQ ID NO: 7857488 - DNA, 22 bp, Homo sapiens
tctggtcagtctccattctacc

SEQ ID NO: 7857489 - DNA, 20 bp, Homo sapiens
tctggtccaggtcttcatgg

SEQ ID NO: 7857490 - DNA, 22 bp, Homo sapiens
tctggtcagtctccattctacc

SEQ ID NO: 7857491 - DNA, 22 bp, Homo sapiens
tctggtcatcggaaagatcaaa

SEQ ID NO: 7857492 - DNA, 22 bp, Homo sapiens
tctggtccccattccaggtggg

SEQ ID NO: 7857493 - DNA, 22 bp, Homo sapiens
tctggtccccattccaggtggg

SEQ ID NO: 7857494 - DNA, 22 bp, Homo sapiens
tctggtcccttttcctgcagtc

SEQ ID NO: 7857495 - DNA, 22 bp, Homo sapiens
tctggtcccttttcctgcagtc

SEQ ID NO: 7857496 - DNA, 22 bp, Homo sapiens
tctggtccctgctcacttcttg

SEQ ID NO: 7857497 - DNA, 22 bp, Homo sapiens
tctggtcctctctgtgatgcta

SEQ ID NO: 7857498 - DNA, 22 bp, Homo sapiens
tctggtcccttttcctgcagtc

SEQ ID NO: 7857499 - DNA, 22 bp, Homo sapiens
tctggtcccttttcctgcagtc

SEQ ID NO: 7857500 - DNA, 22 bp, Homo sapiens
tctggtgtcagtattctttgaa

SEQ ID NO: 7857501 - DNA, 22 bp, Homo sapiens
tctggtgtcagtattctttgaa

SEQ ID NO: 7857502 - DNA, 19 bp, Homo sapiens
tctggttcatttctgctgt

SEQ ID NO: 7857503 - DNA, 22 bp, Homo sapiens
tctggtgtcagtattctttgaa

SEQ ID NO: 7857504 - DNA, 22 bp, Homo sapiens
tctggtgtcaggctgtcctcgg

SEQ ID NO: 7857505 - DNA, 22 bp, Homo sapiens
tctggtggtgggccacaagcat

SEQ ID NO: 7857506 - DNA, 22 bp, Homo sapiens
tctggtggtgggccacaagcat

SEQ ID NO: 7857507 - DNA, 21 bp, Homo sapiens
tctggtctgctgtggacctgg

SEQ ID NO: 7857508 - DNA, 22 bp, Homo sapiens
tctggtggcacgtgtcttgcat

SEQ ID NO: 7857509 - DNA, 22 bp, Homo sapiens
tctggtggtatacatctaggag

SEQ ID NO: 7857510 - DNA, 22 bp, Homo sapiens
tctggtggcacgtgtcttgcat

SEQ ID NO: 7857511 - DNA, 22 bp, Homo sapiens
tctggtggtatacatctaggag

SEQ ID NO: 7857512 - DNA, 21 bp, Homo sapiens
tctggtctgctgtggacctgg

SEQ ID NO: 7857513 - DNA, 22 bp, Homo sapiens
tctggtcctctctgtgatgcta

SEQ ID NO: 7857514 - DNA, 22 bp, Homo sapiens
ccaggagaataatggcagatta

SEQ ID NO: 7857515 - DNA, 22 bp, Homo sapiens
ccaggagaataatggcagatta

SEQ ID NO: 7857516 - DNA, 22 bp, Homo sapiens
ccaggagaataatggcagatta

SEQ ID NO: 7857517 - DNA, 22 bp, Homo sapiens
ccaggagaataatggcagatta

SEQ ID NO: 7857518 - DNA, 22 bp, Homo sapiens
ccaggagaataatggcagatta

SEQ ID NO: 7857519 - DNA, 22 bp, Homo sapiens
ccaggagaataatggcagatta

SEQ ID NO: 7857520 - DNA, 22 bp, Homo sapiens
ccaggagaataatggcagatta

SEQ ID NO: 7857521 - DNA, 22 bp, Homo sapiens
ccaggagaataatggcagatta

SEQ ID NO: 7857522 - DNA, 22 bp, Homo sapiens
ccaggagaagcatctgagtgta

SEQ ID NO: 7857523 - DNA, 22 bp, Homo sapiens
ccaggagaagcatctgagtgta

SEQ ID NO: 7857524 - DNA, 22 bp, Homo sapiens
ccaggagaagcatctgagtgta

SEQ ID NO: 7857525 - DNA, 22 bp, Homo sapiens
ccaggagaagcatctgagtgta

SEQ ID NO: 7857526 - DNA, 22 bp, Homo sapiens
ccaggagaagcatctgagtgta

SEQ ID NO: 7857527 - DNA, 22 bp, Homo sapiens
ccaggagaagcatctgagtgta

SEQ ID NO: 7857528 - DNA, 22 bp, Homo sapiens
ccaggagaagcatctgagtgta

SEQ ID NO: 7857529 - DNA, 22 bp, Homo sapiens
ccaggagaagcatctgagtgta

SEQ ID NO: 7857530 - DNA, 22 bp, Homo sapiens
ccaggagaagcatctgagtgta

SEQ ID NO: 7857531 - DNA, 22 bp, Homo sapiens
ccaggactttaagtccagcact

SEQ ID NO: 7857532 - DNA, 19 bp, Homo sapiens
ccaggactttgcagacact

SEQ ID NO: 7857533 - DNA, 22 bp, Homo sapiens
ccaggacttcgaggctacagtg

SEQ ID NO: 7857534 - DNA, 19 bp, Homo sapiens
tctggttcatttctgctgt

SEQ ID NO: 7857535 - DNA, 22 bp, Homo sapiens
tctggtttcaatgggtacgatt

SEQ ID NO: 7857536 - DNA, 22 bp, Homo sapiens
tctgggagcagatgatggtata

SEQ ID NO: 7857537 - DNA, 22 bp, Homo sapiens
tctgggagcagatgatggtata

SEQ ID NO: 7857538 - DNA, 22 bp, Homo sapiens
tctgggagcagatgatggtata

SEQ ID NO: 7857539 - DNA, 22 bp, Homo sapiens
tctgggagcagatgatggtata

SEQ ID NO: 7857540 - DNA, 22 bp, Homo sapiens
tctgggagcacacgcagtgatc

SEQ ID NO: 7857541 - DNA, 22 bp, Homo sapiens
tctgggagcacacgcagtgatc

SEQ ID NO: 7857542 - DNA, 22 bp, Homo sapiens
tctgggagcacacgcagtgatc

SEQ ID NO: 7857543 - DNA, 22 bp, Homo sapiens
tctgggagcagatgatggtata

SEQ ID NO: 7857544 - DNA, 22 bp, Homo sapiens
tctgggagcacacgcagtgatc

SEQ ID NO: 7857545 - DNA, 22 bp, Homo sapiens
tctgggagatccaagcagaact

SEQ ID NO: 7857546 - DNA, 22 bp, Homo sapiens
tctgggagcacacgcagtgatc

SEQ ID NO: 7857547 - DNA, 19 bp, Homo sapiens
tctgggagagtgaatctga

SEQ ID NO: 7857548 - DNA, 22 bp, Homo sapiens
tctgggagatccaagcagaact

SEQ ID NO: 7857549 - DNA, 22 bp, Homo sapiens
ccaggactcaatgaccacaggg

SEQ ID NO: 7857550 - DNA, 19 bp, Homo sapiens
ccaggacctttccagggtc

SEQ ID NO: 7857551 - DNA, 21 bp, Homo sapiens
ccaggactccatggggtctct

SEQ ID NO: 7857552 - DNA, 22 bp, Homo sapiens
tctgggagatccaagcagaact

SEQ ID NO: 7857553 - DNA, 22 bp, Homo sapiens
tctgggagagtcacaggcattg

SEQ ID NO: 7857554 - DNA, 22 bp, Homo sapiens
ccaggactgcagggggcgagga

SEQ ID NO: 7857555 - DNA, 22 bp, Homo sapiens
ccaggactgcagggggcgagga

SEQ ID NO: 7857556 - DNA, 22 bp, Homo sapiens
tctgggagccatgccttggagt

SEQ ID NO: 7857557 - DNA, 22 bp, Homo sapiens
tctgggagcagctcagcagatt

SEQ ID NO: 7857558 - DNA, 22 bp, Homo sapiens
tctgggagcagctcagcagatt

SEQ ID NO: 7857559 - DNA, 22 bp, Homo sapiens
tctgggagcagctcagcagatt

SEQ ID NO: 7857560 - DNA, 22 bp, Homo sapiens
tctgggagcagctcagcagatt

SEQ ID NO: 7857561 - DNA, 22 bp, Homo sapiens
tctgggagcagctcagcagatt

SEQ ID NO: 7857562 - DNA, 22 bp, Homo sapiens
tctgggagcagctcagcagatt

SEQ ID NO: 7857563 - DNA, 22 bp, Homo sapiens
tctgggagcagctcagcagatt

SEQ ID NO: 7857564 - DNA, 22 bp, Homo sapiens
tctgggagcctgaaagtgaatg

SEQ ID NO: 7857565 - DNA, 22 bp, Homo sapiens
tctgggagccatgccttggagt

SEQ ID NO: 7857566 - DNA, 22 bp, Homo sapiens
tctgggagcctgaaagtgaatg

SEQ ID NO: 7857567 - DNA, 22 bp, Homo sapiens
tctgggagcgctgtttttccca

SEQ ID NO: 7857568 - DNA, 22 bp, Homo sapiens
tctggtagaagaagtgaagctg

SEQ ID NO: 7857569 - DNA, 22 bp, Homo sapiens
tctggtcaagacatcctaacat

SEQ ID NO: 7857570 - DNA, 22 bp, Homo sapiens
tctggtcaaggagcagtgactg

SEQ ID NO: 7857571 - DNA, 22 bp, Homo sapiens
tctgggagctggctttgcctca

SEQ ID NO: 7857572 - DNA, 22 bp, Homo sapiens
tctggggatgaggtccagtgat

SEQ ID NO: 7857573 - DNA, 22 bp, Homo sapiens
tctggggatgaggtccagtgat

SEQ ID NO: 7857574 - DNA, 20 bp, Homo sapiens
tctggggatgaggtctagga

SEQ ID NO: 7857575 - DNA, 20 bp, Homo sapiens
tctggggatgaggtctagga

SEQ ID NO: 7857576 - DNA, 22 bp, Homo sapiens
tctggggatgaggtccagtgat

SEQ ID NO: 7857577 - DNA, 17 bp, Homo sapiens
tctggccttcctgaact

SEQ ID NO: 7857578 - DNA, 17 bp, Homo sapiens
tctggccttcctgaact

SEQ ID NO: 7857579 - DNA, 22 bp, Homo sapiens
tctggctcaaaatacgtactct

SEQ ID NO: 7857580 - DNA, 22 bp, Homo sapiens
tctggctcaaaatacgtactct

SEQ ID NO: 7857581 - DNA, 22 bp, Homo sapiens
tctggctcacttcaggcttcac

SEQ ID NO: 7857582 - DNA, 22 bp, Homo sapiens
tctggctcacttcaggcttcac

SEQ ID NO: 7857583 - DNA, 22 bp, Homo sapiens
tctggctcacttcaggcttcac

SEQ ID NO: 7857584 - DNA, 22 bp, Homo sapiens
tctggctcacttcaggcttcac

SEQ ID NO: 7857585 - DNA, 22 bp, Homo sapiens
tctggctcacttcaggcttcac

SEQ ID NO: 7857586 - DNA, 18 bp, Homo sapiens
tctggctcaggactgaac

SEQ ID NO: 7857587 - DNA, 22 bp, Homo sapiens
tctggctcagggctctgaggga

SEQ ID NO: 7857588 - DNA, 22 bp, Homo sapiens
tctggctcagggctctgaggga

SEQ ID NO: 7857589 - DNA, 22 bp, Homo sapiens
tctggctcaggagctgtgttca

SEQ ID NO: 7857590 - DNA, 18 bp, Homo sapiens
tctggctcaggactgaac

SEQ ID NO: 7857591 - DNA, 22 bp, Homo sapiens
tctggctcagggctctgaggga

SEQ ID NO: 7857592 - DNA, 22 bp, Homo sapiens
tctggctcagggctctgaggga

SEQ ID NO: 7857593 - DNA, 22 bp, Homo sapiens
tctggctcagggctctgaggga

SEQ ID NO: 7857594 - DNA, 22 bp, Homo sapiens
tctggctcagggctctgaggga

SEQ ID NO: 7857595 - DNA, 21 bp, Homo sapiens
ccaggaaggactgagctccct

SEQ ID NO: 7857596 - DNA, 21 bp, Homo sapiens
ccaggaaggactgagctccct

SEQ ID NO: 7857597 - DNA, 22 bp, Homo sapiens
tctggctcaggtcagacaggga

SEQ ID NO: 7857598 - DNA, 22 bp, Homo sapiens
ccaggacacgatttttagtctg

SEQ ID NO: 7857599 - DNA, 22 bp, Homo sapiens
ccaggacactgcttcacagcag

SEQ ID NO: 7857600 - DNA, 22 bp, Homo sapiens
ccaggacactgcttcacagcag

SEQ ID NO: 7857601 - DNA, 22 bp, Homo sapiens
ccaggacactgcttcacagcag

SEQ ID NO: 7857602 - DNA, 22 bp, Homo sapiens
ccaggacactgcttcacagcag

SEQ ID NO: 7857603 - DNA, 22 bp, Homo sapiens
ccaggacaattcgtcactttct

SEQ ID NO: 7857604 - DNA, 22 bp, Homo sapiens
ccaggaaggatcgtttgggagt

SEQ ID NO: 7857605 - DNA, 22 bp, Homo sapiens
ccaggacagtgaacatgtaaga

SEQ ID NO: 7857606 - DNA, 22 bp, Homo sapiens
ccaggacagtgaacatgtaaga

SEQ ID NO: 7857607 - DNA, 22 bp, Homo sapiens
ccaggacagtgaacatgtaaga

SEQ ID NO: 7857608 - DNA, 22 bp, Homo sapiens
ccaggacagtgaacatgtaaga

SEQ ID NO: 7857609 - DNA, 22 bp, Homo sapiens
ccaggacagtgaacatgtaaga

SEQ ID NO: 7857610 - DNA, 22 bp, Homo sapiens
ccaggacatgttgcaagtttat

SEQ ID NO: 7857611 - DNA, 22 bp, Homo sapiens
ccaggaccacacgacaggagag

SEQ ID NO: 7857612 - DNA, 22 bp, Homo sapiens
ccaggaccctgcaaaccctgtt

SEQ ID NO: 7857613 - DNA, 22 bp, Homo sapiens
ccaggacctggagctctatgaa

SEQ ID NO: 7857614 - DNA, 19 bp, Homo sapiens
ccaggacctttccagggtc

SEQ ID NO: 7857615 - DNA, 19 bp, Homo sapiens
ccaggacctttccagggtc

SEQ ID NO: 7857616 - DNA, 19 bp, Homo sapiens
ccaggacctttccagggtc

SEQ ID NO: 7857617 - DNA, 22 bp, Homo sapiens
ccaggacaggagttggcttcgc

SEQ ID NO: 7857618 - DNA, 18 bp, Homo sapiens
ccaggacaggcaaaaggt

SEQ ID NO: 7857619 - DNA, 18 bp, Homo sapiens
ccaggacaggcaaaaggt

SEQ ID NO: 7857620 - DNA, 18 bp, Homo sapiens
ccaggacaggcaaaaggt

SEQ ID NO: 7857621 - DNA, 22 bp, Homo sapiens
ccaggacactgcttcacagcag

SEQ ID NO: 7857622 - DNA, 22 bp, Homo sapiens
ccaggacaggagttggcttcgc

SEQ ID NO: 7857623 - DNA, 22 bp, Homo sapiens
ccaggacactgcttcacagcag

SEQ ID NO: 7857624 - DNA, 22 bp, Homo sapiens
ccaggacactgcttcacagcag

SEQ ID NO: 7857625 - DNA, 22 bp, Homo sapiens
ccaggacagggagacgggagcc

SEQ ID NO: 7857626 - DNA, 22 bp, Homo sapiens
ccaggacagggagacgggagcc

SEQ ID NO: 7857627 - DNA, 22 bp, Homo sapiens
ccaggacagggagacgggagcc

SEQ ID NO: 7857628 - DNA, 18 bp, Homo sapiens
ccaggacaggcaaaaggt

SEQ ID NO: 7857629 - DNA, 18 bp, Homo sapiens
ccaggacaggcaaaaggt

SEQ ID NO: 7857630 - DNA, 22 bp, Homo sapiens
ccaggacagggagacgggagcc

SEQ ID NO: 7857631 - DNA, 22 bp, Homo sapiens
ccaggacagggagacgggagcc

SEQ ID NO: 7857632 - DNA, 22 bp, Homo sapiens
ccaggacagggagacgggagcc

SEQ ID NO: 7857633 - DNA, 22 bp, Homo sapiens
tctggcagctcagttcaggtct

SEQ ID NO: 7857634 - DNA, 22 bp, Homo sapiens
tctggcagctctcctcggcgga

SEQ ID NO: 7857635 - DNA, 22 bp, Homo sapiens
tctggcagctctcctcggcgga

SEQ ID NO: 7857636 - DNA, 22 bp, Homo sapiens
tctggcaggacatgctgaccat

SEQ ID NO: 7857637 - DNA, 21 bp, Homo sapiens
tctggcaggaagacggatggg

SEQ ID NO: 7857638 - DNA, 21 bp, Homo sapiens
tctggcaggaagacggatggg

SEQ ID NO: 7857639 - DNA, 22 bp, Homo sapiens
tctggcagctatcctctggcca

SEQ ID NO: 7857640 - DNA, 22 bp, Homo sapiens
tctggcagctatcctctggcca

SEQ ID NO: 7857641 - DNA, 22 bp, Homo sapiens
tctggcagcgaagcgtgtactt

SEQ ID NO: 7857642 - DNA, 21 bp, Homo sapiens
tctggcagcagtttgttgagt

SEQ ID NO: 7857643 - DNA, 22 bp, Homo sapiens
tctggcaggatatcgaagtgaa

SEQ ID NO: 7857644 - DNA, 22 bp, Homo sapiens
tctggcaggatatcgaagtgaa

SEQ ID NO: 7857645 - DNA, 22 bp, Homo sapiens
tctggcaggatatcgaagtgaa

SEQ ID NO: 7857646 - DNA, 22 bp, Homo sapiens
tctggcaggacatgctgaccat

SEQ ID NO: 7857647 - DNA, 22 bp, Homo sapiens
tctggcaggaccatgaagcgta

SEQ ID NO: 7857648 - DNA, 22 bp, Homo sapiens
tctggcaggaccatgaagcgta

SEQ ID NO: 7857649 - DNA, 22 bp, Homo sapiens
tctggcaggccttgtcaatctg

SEQ ID NO: 7857650 - DNA, 22 bp, Homo sapiens
tctggcaggccttgtcaatctg

SEQ ID NO: 7857651 - DNA, 21 bp, Homo sapiens
tctggcaggcacgggcccagc

SEQ ID NO: 7857652 - DNA, 22 bp, Homo sapiens
tctggcaggcaatcggctctgg

SEQ ID NO: 7857653 - DNA, 22 bp, Homo sapiens
tctggcaggcaatcggctctgg

SEQ ID NO: 7857654 - DNA, 22 bp, Homo sapiens
tctggcaggccttgtcaatctg

SEQ ID NO: 7857655 - DNA, 22 bp, Homo sapiens
tctggcaggggttctgcacttg

SEQ ID NO: 7857656 - DNA, 22 bp, Homo sapiens
tctggcaggggttctgcacttg

SEQ ID NO: 7857657 - DNA, 22 bp, Homo sapiens
tctggcaggggttctgcacttg

SEQ ID NO: 7857658 - DNA, 22 bp, Homo sapiens
tctggcagggtcagggcccagg

SEQ ID NO: 7857659 - DNA, 22 bp, Homo sapiens
tctggcaggggttctgcacttg

SEQ ID NO: 7857660 - DNA, 22 bp, Homo sapiens
tctggcctactggagtccatga

SEQ ID NO: 7857661 - DNA, 22 bp, Homo sapiens
tctggcctactggagtccatga

SEQ ID NO: 7857662 - DNA, 22 bp, Homo sapiens
tctggcctactggagtccatga

SEQ ID NO: 7857663 - DNA, 22 bp, Homo sapiens
tctggccctgctgctgtgagca

SEQ ID NO: 7857664 - DNA, 22 bp, Homo sapiens
tctggccctgctgctgtgagca

SEQ ID NO: 7857665 - DNA, 22 bp, Homo sapiens
tctggccctgctgctgtgagca

SEQ ID NO: 7857666 - DNA, 22 bp, Homo sapiens
tctggcctatttctgtcagatc

SEQ ID NO: 7857667 - DNA, 22 bp, Homo sapiens
tctggcctcttgggatgctccc

SEQ ID NO: 7857668 - DNA, 22 bp, Homo sapiens
tctggcctcttgggatgctccc

SEQ ID NO: 7857669 - DNA, 22 bp, Homo sapiens
tctggcctcctccaccagggaa

SEQ ID NO: 7857670 - DNA, 22 bp, Homo sapiens
tctggcctcttgggatgctccc

SEQ ID NO: 7857671 - DNA, 22 bp, Homo sapiens
tctggcctgaaagtccatgctt

SEQ ID NO: 7857672 - DNA, 22 bp, Homo sapiens
tctggcctgaaagtccatgctt

SEQ ID NO: 7857673 - DNA, 22 bp, Homo sapiens
tctggccttatctgtccaagcc

SEQ ID NO: 7857674 - DNA, 22 bp, Homo sapiens
tctggccttatctgtccaagcc

SEQ ID NO: 7857675 - DNA, 22 bp, Homo sapiens
tctggcctgtgttggtggcccc

SEQ ID NO: 7857676 - DNA, 22 bp, Homo sapiens
tctggcctgtgttggtggcccc

SEQ ID NO: 7857677 - DNA, 22 bp, Homo sapiens
tctggcctgggcctgccggtgc

SEQ ID NO: 7857678 - DNA, 22 bp, Homo sapiens
tctggcctgaaagtccatgctt

SEQ ID NO: 7857679 - DNA, 22 bp, Homo sapiens
tctggcctgggcctgccggtgc

SEQ ID NO: 7857680 - DNA, 22 bp, Homo sapiens
tctggcagcagcatcagtggct

SEQ ID NO: 7857681 - DNA, 22 bp, Homo sapiens
tctggcagcagcatcagtggct

SEQ ID NO: 7857682 - DNA, 22 bp, Homo sapiens
tctggaggccatagggaaggat

SEQ ID NO: 7857683 - DNA, 22 bp, Homo sapiens
tctggcagcaagtctgtttctc

SEQ ID NO: 7857684 - DNA, 22 bp, Homo sapiens
ccagctgctgtgcagggaggct

SEQ ID NO: 7857685 - DNA, 22 bp, Homo sapiens
ccagctgctgtgcagggaggct

SEQ ID NO: 7857686 - DNA, 22 bp, Homo sapiens
ccagctgcttgggaaaatgtct

SEQ ID NO: 7857687 - DNA, 22 bp, Homo sapiens
ccagctgcttgggaaaatgtct

SEQ ID NO: 7857688 - DNA, 22 bp, Homo sapiens
ccagctgcttgggaaaatgtct

SEQ ID NO: 7857689 - DNA, 22 bp, Homo sapiens
ccagctgctgcaccgtgcatgg

SEQ ID NO: 7857690 - DNA, 22 bp, Homo sapiens
ccagctgctgtgaggaccacag

SEQ ID NO: 7857691 - DNA, 22 bp, Homo sapiens
ccagctgctgtgaggaccacag

SEQ ID NO: 7857692 - DNA, 22 bp, Homo sapiens
ccagctgctgcaccgtgcatgg

SEQ ID NO: 7857693 - DNA, 22 bp, Homo sapiens
ccagctgctgtgcagggaggct

SEQ ID NO: 7857694 - DNA, 22 bp, Homo sapiens
ccagctgctgtgcagggaggct

SEQ ID NO: 7857695 - DNA, 22 bp, Homo sapiens
ccagctgctgtgaggaccacag

SEQ ID NO: 7857696 - DNA, 22 bp, Homo sapiens
ccagctgctgtgaggaccacag

SEQ ID NO: 7857697 - DNA, 22 bp, Homo sapiens
ccagctgctgacatgggcaggt

SEQ ID NO: 7857698 - DNA, 22 bp, Homo sapiens
ccagctgctgacatgggcaggt

SEQ ID NO: 7857699 - DNA, 22 bp, Homo sapiens
ccagctgctctcttctccgcca

SEQ ID NO: 7857700 - DNA, 22 bp, Homo sapiens
ccagctgctctcttctccgcca

SEQ ID NO: 7857701 - DNA, 22 bp, Homo sapiens
ccagctgctctcttctccgcca

SEQ ID NO: 7857702 - DNA, 22 bp, Homo sapiens
ccagctgctgacatgggcaggt

SEQ ID NO: 7857703 - DNA, 22 bp, Homo sapiens
ccagctgctgcaccgtgcatgg

SEQ ID NO: 7857704 - DNA, 22 bp, Homo sapiens
ccagctgctgacatgggcaggt

SEQ ID NO: 7857705 - DNA, 22 bp, Homo sapiens
ccagctgctgacatgggcaggt

SEQ ID NO: 7857706 - DNA, 22 bp, Homo sapiens
ccagctgctatcatgccatttc

SEQ ID NO: 7857707 - DNA, 22 bp, Homo sapiens
ccagctgctatcatgccatttc

SEQ ID NO: 7857708 - DNA, 22 bp, Homo sapiens
ccagctgctatcatgccatttc

SEQ ID NO: 7857709 - DNA, 17 bp, Homo sapiens
ccagctgctccctcaga

SEQ ID NO: 7857710 - DNA, 17 bp, Homo sapiens
ccagctgctccctcaga

SEQ ID NO: 7857711 - DNA, 21 bp, Homo sapiens
ccagctgctccttgaggttcc

SEQ ID NO: 7857712 - DNA, 21 bp, Homo sapiens
ccagctgctccttgaggttcc

SEQ ID NO: 7857713 - DNA, 21 bp, Homo sapiens
ccagctgctccttgaggttcc

SEQ ID NO: 7857714 - DNA, 22 bp, Homo sapiens
ccagctgcgggcatcgagagtt

SEQ ID NO: 7857715 - DNA, 22 bp, Homo sapiens
ccagctgctaacacaaaggagt

SEQ ID NO: 7857716 - DNA, 22 bp, Homo sapiens
ccagctgctaacacaaaggagt

SEQ ID NO: 7857717 - DNA, 22 bp, Homo sapiens
ccagctgctaacacaaaggagt

SEQ ID NO: 7857718 - DNA, 22 bp, Homo sapiens
ccagctgcggtctcccaaagtt

SEQ ID NO: 7857719 - DNA, 22 bp, Homo sapiens
ccagctgcggtctcccaaagtt

SEQ ID NO: 7857720 - DNA, 22 bp, Homo sapiens
ccagctgcggtctcccaaagtt

SEQ ID NO: 7857721 - DNA, 22 bp, Homo sapiens
ccagctgcggtctcccaaagtt

SEQ ID NO: 7857722 - DNA, 22 bp, Homo sapiens
ccagctgcgggcatcgagagtt

SEQ ID NO: 7857723 - DNA, 22 bp, Homo sapiens
ccagctgcgggcatcgagagtt

SEQ ID NO: 7857724 - DNA, 22 bp, Homo sapiens
ccagctgcgggcatcgagagtt

SEQ ID NO: 7857725 - DNA, 22 bp, Homo sapiens
ccagctgcgggcatcgagagtt

SEQ ID NO: 7857726 - DNA, 18 bp, Homo sapiens
ccagctgcgctgaaccga

SEQ ID NO: 7857727 - DNA, 18 bp, Homo sapiens
ccagctgcgctgaaccga

SEQ ID NO: 7857728 - DNA, 18 bp, Homo sapiens
ccagctgcgctgaaccga

SEQ ID NO: 7857729 - DNA, 22 bp, Homo sapiens
ccagctgcctaagcaatccata

SEQ ID NO: 7857730 - DNA, 21 bp, Homo sapiens
ccagctgcctgcactttggac

SEQ ID NO: 7857731 - DNA, 18 bp, Homo sapiens
ccagctgcgctgaaccga

SEQ ID NO: 7857732 - DNA, 21 bp, Homo sapiens
ccagctgcctgcactttggac

SEQ ID NO: 7857733 - DNA, 22 bp, Homo sapiens
ccagctgcccactatgtgttct

SEQ ID NO: 7857734 - DNA, 22 bp, Homo sapiens
ccagctgcccactatgtgttct

SEQ ID NO: 7857735 - DNA, 22 bp, Homo sapiens
ccagctgcctaagcaatccata

SEQ ID NO: 7857736 - DNA, 22 bp, Homo sapiens
ccagctgcctaagcaatccata

SEQ ID NO: 7857737 - DNA, 22 bp, Homo sapiens
ccagctgcccaagaggcatcct

SEQ ID NO: 7857738 - DNA, 22 bp, Homo sapiens
ccagctgcccaagaggcatcct

SEQ ID NO: 7857739 - DNA, 22 bp, Homo sapiens
ccagctgcccaagaggcatcct

SEQ ID NO: 7857740 - DNA, 22 bp, Homo sapiens
ccagctgcccaagaggcatcct

SEQ ID NO: 7857741 - DNA, 22 bp, Homo sapiens
ccagctgcccaagaggcatcct

SEQ ID NO: 7857742 - DNA, 22 bp, Homo sapiens
ccagctgcccaagaggcatcct

SEQ ID NO: 7857743 - DNA, 22 bp, Homo sapiens
ccagctctctgcagaaaggact

SEQ ID NO: 7857744 - DNA, 22 bp, Homo sapiens
ccagctctctgcagaaaggact

SEQ ID NO: 7857745 - DNA, 22 bp, Homo sapiens
ccagctctctgtcctccccaca

SEQ ID NO: 7857746 - DNA, 22 bp, Homo sapiens
ccagctctctgtcctccccaca

SEQ ID NO: 7857747 - DNA, 22 bp, Homo sapiens
ccagctctctgtcctccccaca

SEQ ID NO: 7857748 - DNA, 22 bp, Homo sapiens
ccagctctctgtcctccccaca

SEQ ID NO: 7857749 - DNA, 22 bp, Homo sapiens
ccagctctctgtcctccccaca

SEQ ID NO: 7857750 - DNA, 22 bp, Homo sapiens
ccagctctctttgaagcataaa

SEQ ID NO: 7857751 - DNA, 22 bp, Homo sapiens
ccagctctctttgaagcataaa

SEQ ID NO: 7857752 - DNA, 22 bp, Homo sapiens
ccagctctcttcaagcccactc

SEQ ID NO: 7857753 - DNA, 22 bp, Homo sapiens
ccagctctcttcaagcccactc

SEQ ID NO: 7857754 - DNA, 22 bp, Homo sapiens
ccagctctgattttgacctcca

SEQ ID NO: 7857755 - DNA, 22 bp, Homo sapiens
ccagctctgattttgacctcca

SEQ ID NO: 7857756 - DNA, 22 bp, Homo sapiens
ccagctctctttgaagcataaa

SEQ ID NO: 7857757 - DNA, 22 bp, Homo sapiens
ccagctctgcagggcctggggt

SEQ ID NO: 7857758 - DNA, 22 bp, Homo sapiens
ccagctctgccaagcgtcagct

SEQ ID NO: 7857759 - DNA, 22 bp, Homo sapiens
ccagctctgccaagcgtcagct

SEQ ID NO: 7857760 - DNA, 22 bp, Homo sapiens
ccagctctgattttgacctcca

SEQ ID NO: 7857761 - DNA, 22 bp, Homo sapiens
ccagctctgattttgacctcca

SEQ ID NO: 7857762 - DNA, 22 bp, Homo sapiens
ccagctctgattttgacctcca

SEQ ID NO: 7857763 - DNA, 22 bp, Homo sapiens
ccagctctgattttgacctcca

SEQ ID NO: 7857764 - DNA, 22 bp, Homo sapiens
ccagctctgcagggcctggggt

SEQ ID NO: 7857765 - DNA, 22 bp, Homo sapiens
ccagctctgcagggcctggggt

SEQ ID NO: 7857766 - DNA, 22 bp, Homo sapiens
ccagctctgcagggcctggggt

SEQ ID NO: 7857767 - DNA, 22 bp, Homo sapiens
ccagctctgattttgacctcca

SEQ ID NO: 7857768 - DNA, 22 bp, Homo sapiens
ccagctgcaggggagcagtgga

SEQ ID NO: 7857769 - DNA, 22 bp, Homo sapiens
ccagctgcaggggagcagtgga

SEQ ID NO: 7857770 - DNA, 22 bp, Homo sapiens
ccagctgcaggggagcagtgga

SEQ ID NO: 7857771 - DNA, 22 bp, Homo sapiens
ccagctgcagaatgttggggaa

SEQ ID NO: 7857772 - DNA, 22 bp, Homo sapiens
ccagctgcagaatgttggggaa

SEQ ID NO: 7857773 - DNA, 22 bp, Homo sapiens
ccagctgcagaatgttggggaa

SEQ ID NO: 7857774 - DNA, 20 bp, Homo sapiens
ccagctgagccaaggggaga

SEQ ID NO: 7857775 - DNA, 22 bp, Homo sapiens
ccagctgaggcagccacacagg

SEQ ID NO: 7857776 - DNA, 22 bp, Homo sapiens
ccagctctgccaagcgtcagct

SEQ ID NO: 7857777 - DNA, 22 bp, Homo sapiens
ccagctctgccaagcgtcagct

SEQ ID NO: 7857778 - DNA, 22 bp, Homo sapiens
ccagctctgccaagcgtcagct

SEQ ID NO: 7857779 - DNA, 22 bp, Homo sapiens
ccagctgcccaagaggcatcct

SEQ ID NO: 7857780 - DNA, 22 bp, Homo sapiens
ccagctgcatgacattaggtga

SEQ ID NO: 7857781 - DNA, 22 bp, Homo sapiens
ccagctgcatgacattaggtga

SEQ ID NO: 7857782 - DNA, 22 bp, Homo sapiens
ccagctgcatcctattcactgc

SEQ ID NO: 7857783 - DNA, 22 bp, Homo sapiens
ccagctgcatcctattcactgc

SEQ ID NO: 7857784 - DNA, 22 bp, Homo sapiens
ccagctgcatcctattcactgc

SEQ ID NO: 7857785 - DNA, 20 bp, Homo sapiens
ccagctgcagttcttaatga

SEQ ID NO: 7857786 - DNA, 22 bp, Homo sapiens
ccagctgcaggtgttccagatg

SEQ ID NO: 7857787 - DNA, 22 bp, Homo sapiens
ccagctgcaggggagcagtgga

SEQ ID NO: 7857788 - DNA, 22 bp, Homo sapiens
ccagctgcaggtgttccagatg

SEQ ID NO: 7857789 - DNA, 22 bp, Homo sapiens
ccagctgcaggtgttccagatg

SEQ ID NO: 7857790 - DNA, 20 bp, Homo sapiens
ccagctgcagttcttaatga

SEQ ID NO: 7857791 - DNA, 22 bp, Homo sapiens
ccagctgcaggtgttccagatg

SEQ ID NO: 7857792 - DNA, 22 bp, Homo sapiens
ccagagagaaatggatttgagt

SEQ ID NO: 7857793 - DNA, 22 bp, Homo sapiens
tctcagaagggtggtgctggag

SEQ ID NO: 7857794 - DNA, 22 bp, Homo sapiens
tctcagaagtgatcaggatgtt

SEQ ID NO: 7857795 - DNA, 22 bp, Homo sapiens
tctcagaagtgatcaggatgtt

SEQ ID NO: 7857796 - DNA, 22 bp, Homo sapiens
tctcagaagtgatcaggatgtt

SEQ ID NO: 7857797 - DNA, 22 bp, Homo sapiens
tctcagaataaattcctaactt

SEQ ID NO: 7857798 - DNA, 22 bp, Homo sapiens
tctcagaataaattcctaactt

SEQ ID NO: 7857799 - DNA, 22 bp, Homo sapiens
tctcagaagtgatcaggatgtt

SEQ ID NO: 7857800 - DNA, 22 bp, Homo sapiens
tctcagaagggtggtgctggag

SEQ ID NO: 7857801 - DNA, 22 bp, Homo sapiens
tctcagaaggcaagggctgggg

SEQ ID NO: 7857802 - DNA, 22 bp, Homo sapiens
ccagagagagaggtcaatggca

SEQ ID NO: 7857803 - DNA, 22 bp, Homo sapiens
tctcagaagggtggtgctggag

SEQ ID NO: 7857804 - DNA, 22 bp, Homo sapiens
ccagagagaaaatggagggcca

SEQ ID NO: 7857805 - DNA, 22 bp, Homo sapiens
ccagagagaaaatggagggcca

SEQ ID NO: 7857806 - DNA, 22 bp, Homo sapiens
ccagagagaaaatggagggcca

SEQ ID NO: 7857807 - DNA, 22 bp, Homo sapiens
ccagagagaaaatggagggcca

SEQ ID NO: 7857808 - DNA, 22 bp, Homo sapiens
ccagagagaaaatggagggcca

SEQ ID NO: 7857809 - DNA, 22 bp, Homo sapiens
ccagagagaaaatggagggcca

SEQ ID NO: 7857810 - DNA, 22 bp, Homo sapiens
ccagagagaaaatggagggcca

SEQ ID NO: 7857811 - DNA, 22 bp, Homo sapiens
ccagagagaaaatggagggcca

SEQ ID NO: 7857812 - DNA, 22 bp, Homo sapiens
ccagagagaaaatggagggcca

SEQ ID NO: 7857813 - DNA, 22 bp, Homo sapiens
ccagagacgtcggtcagggcgc

SEQ ID NO: 7857814 - DNA, 22 bp, Homo sapiens
ccagagacgtcggtcagggcgc

SEQ ID NO: 7857815 - DNA, 22 bp, Homo sapiens
ccagagacgtcggtcagggcgc

SEQ ID NO: 7857816 - DNA, 22 bp, Homo sapiens
ccagagactggctgagagatct

SEQ ID NO: 7857817 - DNA, 22 bp, Homo sapiens
ccagagagaaaatggagggcca

SEQ ID NO: 7857818 - DNA, 22 bp, Homo sapiens
ccagagagaaaatggagggcca

SEQ ID NO: 7857819 - DNA, 22 bp, Homo sapiens
tctcagaatcaggacctacttc

SEQ ID NO: 7857820 - DNA, 22 bp, Homo sapiens
tctcagaataaattcctaactt

SEQ ID NO: 7857821 - DNA, 22 bp, Homo sapiens
tctcagaatcaggacctacttc

SEQ ID NO: 7857822 - DNA, 22 bp, Homo sapiens
tctcagaatccttgcccaggtg

SEQ ID NO: 7857823 - DNA, 22 bp, Homo sapiens
tctcagaatccttgcccaggtg

SEQ ID NO: 7857824 - DNA, 19 bp, Homo sapiens
tctcagaattaagagtgct

SEQ ID NO: 7857825 - DNA, 19 bp, Homo sapiens
tctcagaattaagagtgct

SEQ ID NO: 7857826 - DNA, 19 bp, Homo sapiens
tctcagaattggcaatcat

SEQ ID NO: 7857827 - DNA, 19 bp, Homo sapiens
tctcagaattggcaatcat

SEQ ID NO: 7857828 - DNA, 19 bp, Homo sapiens
tctcagaattggcaatcat

SEQ ID NO: 7857829 - DNA, 19 bp, Homo sapiens
tctcagaattaagagtgct

SEQ ID NO: 7857830 - DNA, 22 bp, Homo sapiens
tctcagaatccttgcccaggtg

SEQ ID NO: 7857831 - DNA, 19 bp, Homo sapiens
tctcagaattaagagtgct

SEQ ID NO: 7857832 - DNA, 19 bp, Homo sapiens
tctcagaattaagagtgct

SEQ ID NO: 7857833 - DNA, 22 bp, Homo sapiens
tctcagaattgtgtccactggg

SEQ ID NO: 7857834 - DNA, 22 bp, Homo sapiens
tctcagaattgtgtccactggg

SEQ ID NO: 7857835 - DNA, 22 bp, Homo sapiens
tctcagacatgtaatctctacc

SEQ ID NO: 7857836 - DNA, 22 bp, Homo sapiens
tctcagacatgtaatctctacc

SEQ ID NO: 7857837 - DNA, 22 bp, Homo sapiens
tctcagaattgtgtccactggg

SEQ ID NO: 7857838 - DNA, 22 bp, Homo sapiens
tctgctattttctatctgtgtg

SEQ ID NO: 7857839 - DNA, 22 bp, Homo sapiens
tctgctacagggaaggacccct

SEQ ID NO: 7857840 - DNA, 22 bp, Homo sapiens
tctgctaatgtggttatttcta

SEQ ID NO: 7857841 - DNA, 22 bp, Homo sapiens
tctcagagaacagttggtgctt

SEQ ID NO: 7857842 - DNA, 22 bp, Homo sapiens
tctcagagaaatgtgtcaccat

SEQ ID NO: 7857843 - DNA, 22 bp, Homo sapiens
tctcagagaaatgtgtcaccat

SEQ ID NO: 7857844 - DNA, 22 bp, Homo sapiens
tctcagagaacagttggtgctt

SEQ ID NO: 7857845 - DNA, 19 bp, Homo sapiens
tctcagactgtgcttctgt

SEQ ID NO: 7857846 - DNA, 19 bp, Homo sapiens
tctcagactgtgcttctgt

SEQ ID NO: 7857847 - DNA, 22 bp, Homo sapiens
tctcagagaaatgtgtcaccat

SEQ ID NO: 7857848 - DNA, 22 bp, Homo sapiens
tctcagactctttagtgaaggt

SEQ ID NO: 7857849 - DNA, 19 bp, Homo sapiens
tctcagactgtgcttctgt

SEQ ID NO: 7857850 - DNA, 23 bp, Homo sapiens
tctcagacccgaagccagaggaa

SEQ ID NO: 7857851 - DNA, 22 bp, Homo sapiens
tctcagactatagtagagattc

SEQ ID NO: 7857852 - DNA, 22 bp, Homo sapiens
tctgcttatcactagagacaga

SEQ ID NO: 7857853 - DNA, 22 bp, Homo sapiens
tctgcttcacttccccaagctt

SEQ ID NO: 7857854 - DNA, 22 bp, Homo sapiens
tctgcttatcactagagacaga

SEQ ID NO: 7857855 - DNA, 22 bp, Homo sapiens
tctgcttctcctacttcatggg

SEQ ID NO: 7857856 - DNA, 22 bp, Homo sapiens
tctgcttctcctacttcatggg

SEQ ID NO: 7857857 - DNA, 18 bp, Homo sapiens
tctgctattagaattgcc

SEQ ID NO: 7857858 - DNA, 22 bp, Homo sapiens
tctgctgtttactgtgtgatat

SEQ ID NO: 7857859 - DNA, 22 bp, Homo sapiens
tctgcttctgtgaaggcagtct

SEQ ID NO: 7857860 - DNA, 22 bp, Homo sapiens
tctgcttgcgttctgctccctc

SEQ ID NO: 7857861 - DNA, 22 bp, Homo sapiens
tctgcttgtgtctgtccagcct

SEQ ID NO: 7857862 - DNA, 22 bp, Homo sapiens
tctgcttgcgttctgctccctc

SEQ ID NO: 7857863 - DNA, 22 bp, Homo sapiens
tctgcttgtgtctgtccagcct

SEQ ID NO: 7857864 - DNA, 22 bp, Homo sapiens
tctgcttgtgtctgtccagcct

SEQ ID NO: 7857865 - DNA, 22 bp, Homo sapiens
tctgctttagaatccagtagct

SEQ ID NO: 7857866 - DNA, 22 bp, Homo sapiens
tctgctttagaatccagtagct

SEQ ID NO: 7857867 - DNA, 22 bp, Homo sapiens
tctgctttagacataaaaggta

SEQ ID NO: 7857868 - DNA, 22 bp, Homo sapiens
tctgctttagacataaaaggta

SEQ ID NO: 7857869 - DNA, 22 bp, Homo sapiens
tctgctttatggctcagagact

SEQ ID NO: 7857870 - DNA, 22 bp, Homo sapiens
tctgctttagtgcaaagtctta

SEQ ID NO: 7857871 - DNA, 22 bp, Homo sapiens
tctgctttatggctcagagact

SEQ ID NO: 7857872 - DNA, 22 bp, Homo sapiens
tctgctttagtgcaaagtctta

SEQ ID NO: 7857873 - DNA, 22 bp, Homo sapiens
tctgctttcttactaaaaatga

SEQ ID NO: 7857874 - DNA, 22 bp, Homo sapiens
tctgctttcttactaaaaatga

SEQ ID NO: 7857875 - DNA, 22 bp, Homo sapiens
tctgctttcttactaaaaatga

SEQ ID NO: 7857876 - DNA, 22 bp, Homo sapiens
tctgctttcaaattcacttagt

SEQ ID NO: 7857877 - DNA, 22 bp, Homo sapiens
tctgctttcaaattcacttagt

SEQ ID NO: 7857878 - DNA, 22 bp, Homo sapiens
tctggaaataaaattatagttg

SEQ ID NO: 7857879 - DNA, 22 bp, Homo sapiens
tctggaaatggaagtaactatg

SEQ ID NO: 7857880 - DNA, 22 bp, Homo sapiens
tctggaaataaaattatagttg

SEQ ID NO: 7857881 - DNA, 22 bp, Homo sapiens
tctggaaataaaattatagttg

SEQ ID NO: 7857882 - DNA, 22 bp, Homo sapiens
tctggaaagatcattaaatcca

SEQ ID NO: 7857883 - DNA, 22 bp, Homo sapiens
tctggaaagatcattaaatcca

SEQ ID NO: 7857884 - DNA, 22 bp, Homo sapiens
tctggaaaagcgataaaccatt

SEQ ID NO: 7857885 - DNA, 22 bp, Homo sapiens
tctggaaagatcattaaatcca

SEQ ID NO: 7857886 - DNA, 22 bp, Homo sapiens
tctggaaaagcgataaaccatt

SEQ ID NO: 7857887 - DNA, 22 bp, Homo sapiens
tctgctttgctgcctcctgatc

SEQ ID NO: 7857888 - DNA, 22 bp, Homo sapiens
tctgctttgctgcctcctgatc

SEQ ID NO: 7857889 - DNA, 22 bp, Homo sapiens
tctgctttcttgcgcagatgtg

SEQ ID NO: 7857890 - DNA, 22 bp, Homo sapiens
tctgctttcttgcgcagatgtg

SEQ ID NO: 7857891 - DNA, 22 bp, Homo sapiens
tctgctttcttgcgcagatgtg

SEQ ID NO: 7857892 - DNA, 22 bp, Homo sapiens
tctggaacagttacttgctgat

SEQ ID NO: 7857893 - DNA, 18 bp, Homo sapiens
tctggaacaacttcatgt

SEQ ID NO: 7857894 - DNA, 22 bp, Homo sapiens
tctggaaatttcagttttagag

SEQ ID NO: 7857895 - DNA, 22 bp, Homo sapiens
tctggaaatggaagtaactatg

SEQ ID NO: 7857896 - DNA, 22 bp, Homo sapiens
tctggaaatttcagttttagag

SEQ ID NO: 7857897 - DNA, 22 bp, Homo sapiens
tctggaaatttcagttttagag

SEQ ID NO: 7857898 - DNA, 22 bp, Homo sapiens
tctggaaatttcagttttagag

SEQ ID NO: 7857899 - DNA, 18 bp, Homo sapiens
tctggaacaacttcatgt

SEQ ID NO: 7857900 - DNA, 18 bp, Homo sapiens
tctggaacaacttcatgt

SEQ ID NO: 7857901 - DNA, 22 bp, Homo sapiens
ccagctctctgcagaaaggact

SEQ ID NO: 7857902 - DNA, 22 bp, Homo sapiens
ccagctctcagcgggagactca

SEQ ID NO: 7857903 - DNA, 22 bp, Homo sapiens
ccagctctcagcgggagactca

SEQ ID NO: 7857904 - DNA, 22 bp, Homo sapiens
ccagctctcagcgggagactca

SEQ ID NO: 7857905 - DNA, 22 bp, Homo sapiens
tctggaacagttacttgctgat

SEQ ID NO: 7857906 - DNA, 21 bp, Homo sapiens
tctggaagaaaaaagtattat

SEQ ID NO: 7857907 - DNA, 22 bp, Homo sapiens
tctggaacagttacttgctgat

SEQ ID NO: 7857908 - DNA, 22 bp, Homo sapiens
tctttcaatccattcatatgtc

SEQ ID NO: 7857909 - DNA, 22 bp, Homo sapiens
tctttcaatccattcatatgtc

SEQ ID NO: 7857910 - DNA, 22 bp, Homo sapiens
tctttcaagggccctagtttgg

SEQ ID NO: 7857911 - DNA, 22 bp, Homo sapiens
tctttcaatccattcatatgtc

SEQ ID NO: 7857912 - DNA, 22 bp, Homo sapiens
tctttcaatccattcatatgtc

SEQ ID NO: 7857913 - DNA, 22 bp, Homo sapiens
tctttcaatgagcattctttcc

SEQ ID NO: 7857914 - DNA, 22 bp, Homo sapiens
tctttcttattagccattgttc

SEQ ID NO: 7857915 - DNA, 22 bp, Homo sapiens
tctttcaaatgcttgaattgga

SEQ ID NO: 7857916 - DNA, 22 bp, Homo sapiens
tctttcaagggccctagtttgg

SEQ ID NO: 7857917 - DNA, 22 bp, Homo sapiens
tctttcaagggccctagtttgg

SEQ ID NO: 7857918 - DNA, 22 bp, Homo sapiens
tctttcaaatgcttgaattgga

SEQ ID NO: 7857919 - DNA, 22 bp, Homo sapiens
ccaggcccccgagcagaagaca

SEQ ID NO: 7857920 - DNA, 22 bp, Homo sapiens
ccaggccccagggctggctttc

SEQ ID NO: 7857921 - DNA, 22 bp, Homo sapiens
ccaggccccagggctggctttc

SEQ ID NO: 7857922 - DNA, 22 bp, Homo sapiens
ccaggccccagggctggctttc

SEQ ID NO: 7857923 - DNA, 22 bp, Homo sapiens
ccaggccccagggctggctttc

SEQ ID NO: 7857924 - DNA, 22 bp, Homo sapiens
ccaggcccagggtactgaccaa

SEQ ID NO: 7857925 - DNA, 22 bp, Homo sapiens
ccaggccccagggctggctttc

SEQ ID NO: 7857926 - DNA, 22 bp, Homo sapiens
ccaggcccaccttggccactta

SEQ ID NO: 7857927 - DNA, 22 bp, Homo sapiens
ccaggcccagggtactgaccaa

SEQ ID NO: 7857928 - DNA, 22 bp, Homo sapiens
ccaggcccagggtactgaccaa

SEQ ID NO: 7857929 - DNA, 22 bp, Homo sapiens
ccaggcccagggtactgaccaa

SEQ ID NO: 7857930 - DNA, 22 bp, Homo sapiens
ccaggcccaccttggccactta

SEQ ID NO: 7857931 - DNA, 22 bp, Homo sapiens
ccaggcccaccttggccactta

SEQ ID NO: 7857932 - DNA, 22 bp, Homo sapiens
ccaggcccaccttggccactta

SEQ ID NO: 7857933 - DNA, 22 bp, Homo sapiens
ccaggcccaccttggccactta

SEQ ID NO: 7857934 - DNA, 22 bp, Homo sapiens
ccaggcccaccttggccactta

SEQ ID NO: 7857935 - DNA, 22 bp, Homo sapiens
ccaggcccaccttggccactta

SEQ ID NO: 7857936 - DNA, 22 bp, Homo sapiens
ccaggccattcccagagttgct

SEQ ID NO: 7857937 - DNA, 22 bp, Homo sapiens
ccaggccattcccagagttgct

SEQ ID NO: 7857938 - DNA, 18 bp, Homo sapiens
ccaggccatgaacctctg

SEQ ID NO: 7857939 - DNA, 18 bp, Homo sapiens
ccaggccatgaacctctg

SEQ ID NO: 7857940 - DNA, 18 bp, Homo sapiens
ccaggccatgaacctctg

SEQ ID NO: 7857941 - DNA, 22 bp, Homo sapiens
ccaggccattcccagagttgct

SEQ ID NO: 7857942 - DNA, 19 bp, Homo sapiens
ccaggccatcccagttccc

SEQ ID NO: 7857943 - DNA, 19 bp, Homo sapiens
ccaggccatcccagttccc

SEQ ID NO: 7857944 - DNA, 19 bp, Homo sapiens
ccaggccatcccagttccc

SEQ ID NO: 7857945 - DNA, 22 bp, Homo sapiens
ccaggccagtgtttggtccagg

SEQ ID NO: 7857946 - DNA, 22 bp, Homo sapiens
ccaggccagtgtttggtccagg

SEQ ID NO: 7857947 - DNA, 22 bp, Homo sapiens
ccaggccagtgtttggtccagg

SEQ ID NO: 7857948 - DNA, 22 bp, Homo sapiens
ccaggccaggagagcgaggttt

SEQ ID NO: 7857949 - DNA, 22 bp, Homo sapiens
ccaggccaggagagcgaggttt

SEQ ID NO: 7857950 - DNA, 21 bp, Homo sapiens
ccaggccaggcctacggggat

SEQ ID NO: 7857951 - DNA, 22 bp, Homo sapiens
ccaggccaggagagcgaggttt

SEQ ID NO: 7857952 - DNA, 22 bp, Homo sapiens
ccaggccagggctgcagcgagc

SEQ ID NO: 7857953 - DNA, 22 bp, Homo sapiens
ccaggccagggctgcagcgagc

SEQ ID NO: 7857954 - DNA, 22 bp, Homo sapiens
ccaggccagggctgcagcgagc

SEQ ID NO: 7857955 - DNA, 21 bp, Homo sapiens
ccaggccaggcctacggggat

SEQ ID NO: 7857956 - DNA, 22 bp, Homo sapiens
ccaggccagggctgcagcgagc

SEQ ID NO: 7857957 - DNA, 22 bp, Homo sapiens
ccaggccagggctgcagcgagc

SEQ ID NO: 7857958 - DNA, 22 bp, Homo sapiens
ccaggccagggctgcagcgagc

SEQ ID NO: 7857959 - DNA, 22 bp, Homo sapiens
ccaggccagggctgcagcgagc

SEQ ID NO: 7857960 - DNA, 22 bp, Homo sapiens
ccaggccagggctgcagcgagc

SEQ ID NO: 7857961 - DNA, 22 bp, Homo sapiens
ccaggccagtgtttggtccagg

SEQ ID NO: 7857962 - DNA, 22 bp, Homo sapiens
ccaggccagtgtttggtccagg

SEQ ID NO: 7857963 - DNA, 22 bp, Homo sapiens
ccaggccagtgtttggtccagg

SEQ ID NO: 7857964 - DNA, 22 bp, Homo sapiens
ccaggccagtgtttggtccagg

SEQ ID NO: 7857965 - DNA, 22 bp, Homo sapiens
ccaggccagtgtttggtccagg

SEQ ID NO: 7857966 - DNA, 22 bp, Homo sapiens
ccaggccagtgtttggtccagg

SEQ ID NO: 7857967 - DNA, 22 bp, Homo sapiens
tctttgaaaagggagatagaaa

SEQ ID NO: 7857968 - DNA, 22 bp, Homo sapiens
tctttgaaaagggagatagaaa

SEQ ID NO: 7857969 - DNA, 22 bp, Homo sapiens
tctttctttatcacctgatatg

SEQ ID NO: 7857970 - DNA, 22 bp, Homo sapiens
tctttctttatcacctgatatg

SEQ ID NO: 7857971 - DNA, 22 bp, Homo sapiens
tctttgaaaagatattcctcct

SEQ ID NO: 7857972 - DNA, 22 bp, Homo sapiens
tctttgaaaagatattcctcct

SEQ ID NO: 7857973 - DNA, 22 bp, Homo sapiens
tctttgaaagctgttctagagt

SEQ ID NO: 7857974 - DNA, 22 bp, Homo sapiens
tctttgaaagctgttctagagt

SEQ ID NO: 7857975 - DNA, 22 bp, Homo sapiens
tctttgaaacaccctaaccttt

SEQ ID NO: 7857976 - DNA, 22 bp, Homo sapiens
tctttgaaagctgttctagagt

SEQ ID NO: 7857977 - DNA, 22 bp, Homo sapiens
ccaggcctgcatctgctgcgca

SEQ ID NO: 7857978 - DNA, 22 bp, Homo sapiens
ccaggcctgcatctgctgcgca

SEQ ID NO: 7857979 - DNA, 22 bp, Homo sapiens
ccaggcctgcatctgctgcgca

SEQ ID NO: 7857980 - DNA, 22 bp, Homo sapiens
ccaggcctgcatctgctgcgca

SEQ ID NO: 7857981 - DNA, 22 bp, Homo sapiens
tctttgaaagctgttctagagt

SEQ ID NO: 7857982 - DNA, 22 bp, Homo sapiens
tctttgaaagctgttctagagt

SEQ ID NO: 7857983 - DNA, 19 bp, Homo sapiens
ccaggcctgcgggcgttgg

SEQ ID NO: 7857984 - DNA, 19 bp, Homo sapiens
ccaggcctgcgggcgttgg

SEQ ID NO: 7857985 - DNA, 19 bp, Homo sapiens
ccaggcctgcgggcgttgg

SEQ ID NO: 7857986 - DNA, 19 bp, Homo sapiens
ccaggcctgcgggcgttgg

SEQ ID NO: 7857987 - DNA, 22 bp, Homo sapiens
ccaggcctggaccatgccaggg

SEQ ID NO: 7857988 - DNA, 22 bp, Homo sapiens
ccaggcctggaccatgccaggg

SEQ ID NO: 7857989 - DNA, 22 bp, Homo sapiens
ccaggcctggaccatgccaggg

SEQ ID NO: 7857990 - DNA, 22 bp, Homo sapiens
ccaggcctggaccatgccaggg

SEQ ID NO: 7857991 - DNA, 22 bp, Homo sapiens
ccaggcctgcatctgctgcgca

SEQ ID NO: 7857992 - DNA, 22 bp, Homo sapiens
ccaggcctgcattccctctcag

SEQ ID NO: 7857993 - DNA, 22 bp, Homo sapiens
ccaggcctgcattccctctcag

SEQ ID NO: 7857994 - DNA, 22 bp, Homo sapiens
ccaggcctgcattccctctcag

SEQ ID NO: 7857995 - DNA, 22 bp, Homo sapiens
ccaggcctgcattccctctcag

SEQ ID NO: 7857996 - DNA, 22 bp, Homo sapiens
ccaggcctgcattccctctcag

SEQ ID NO: 7857997 - DNA, 19 bp, Homo sapiens
ccaggcctgcgggcgttgg

SEQ ID NO: 7857998 - DNA, 22 bp, Homo sapiens
tctttcttggtattctgagcta

SEQ ID NO: 7857999 - DNA, 22 bp, Homo sapiens
tctttcttggtattctgagcta

SEQ ID NO: 7858000 - DNA, 22 bp, Homo sapiens
tctttctttatcacctgatatg

SEQ ID NO: 7858001 - DNA, 22 bp, Homo sapiens
tctttcttgtgggtgccctttt

SEQ ID NO: 7858002 - DNA, 22 bp, Homo sapiens
tctttcttgtgggtgccctttt

SEQ ID NO: 7858003 - DNA, 22 bp, Homo sapiens
tctttcttgtgggtgccctttt

SEQ ID NO: 7858004 - DNA, 22 bp, Homo sapiens
tctttcttggtattctgagcta

SEQ ID NO: 7858005 - DNA, 22 bp, Homo sapiens
tctttcttggtataaagcaggg

SEQ ID NO: 7858006 - DNA, 22 bp, Homo sapiens
tctttcttggtataaagcaggg

SEQ ID NO: 7858007 - DNA, 22 bp, Homo sapiens
tctttcttggtataaagcaggg

SEQ ID NO: 7858008 - DNA, 22 bp, Homo sapiens
tctttcttggtataaagcaggg

SEQ ID NO: 7858009 - DNA, 22 bp, Homo sapiens
tctttcttctttcatagtgtga

SEQ ID NO: 7858010 - DNA, 22 bp, Homo sapiens
tctttcttgcaaggatgcagga

SEQ ID NO: 7858011 - DNA, 22 bp, Homo sapiens
tctttcttcctggagcccaaca

SEQ ID NO: 7858012 - DNA, 22 bp, Homo sapiens
tctttcttcctggagcccaaca

SEQ ID NO: 7858013 - DNA, 22 bp, Homo sapiens
tctttcttcctggagcccaaca

SEQ ID NO: 7858014 - DNA, 22 bp, Homo sapiens
tctttcttcagccctgtaagat

SEQ ID NO: 7858015 - DNA, 22 bp, Homo sapiens
tctttcttattatgctcaatgt

SEQ ID NO: 7858016 - DNA, 22 bp, Homo sapiens
tctttcttattatgctcaatgt

SEQ ID NO: 7858017 - DNA, 22 bp, Homo sapiens
tctttcttcagccctgtaagat

SEQ ID NO: 7858018 - DNA, 22 bp, Homo sapiens
tctttcttcagccctgtaagat

SEQ ID NO: 7858019 - DNA, 22 bp, Homo sapiens
tctttcttcagccctgtaagat

SEQ ID NO: 7858020 - DNA, 22 bp, Homo sapiens
ccaggctctgttccccgaggag

SEQ ID NO: 7858021 - DNA, 22 bp, Homo sapiens
ccaggctctgttccccgaggag

SEQ ID NO: 7858022 - DNA, 22 bp, Homo sapiens
ccaggctctgttccccgaggag

SEQ ID NO: 7858023 - DNA, 22 bp, Homo sapiens
ccaggctctgttccccgaggag

SEQ ID NO: 7858024 - DNA, 22 bp, Homo sapiens
ccaggctctgttccccgaggag

SEQ ID NO: 7858025 - DNA, 22 bp, Homo sapiens
ccaggctctgttccccgaggag

SEQ ID NO: 7858026 - DNA, 22 bp, Homo sapiens
ccaggctctgtgtgggctagag

SEQ ID NO: 7858027 - DNA, 22 bp, Homo sapiens
ccaggctctgtgtgggctagag

SEQ ID NO: 7858028 - DNA, 22 bp, Homo sapiens
ccaggctctgtgtgggctagag

SEQ ID NO: 7858029 - DNA, 22 bp, Homo sapiens
ccaggctctgtgtgggctagag

SEQ ID NO: 7858030 - DNA, 22 bp, Homo sapiens
ccaggctctgtgtgggctagag

SEQ ID NO: 7858031 - DNA, 23 bp, Homo sapiens
ccaggctctttcacctgctattc

SEQ ID NO: 7858032 - DNA, 23 bp, Homo sapiens
ccaggctctttcacctgctattc

SEQ ID NO: 7858033 - DNA, 23 bp, Homo sapiens
ccaggctctttcacctgctattc

SEQ ID NO: 7858034 - DNA, 23 bp, Homo sapiens
ccaggctctttcacctgctattc

SEQ ID NO: 7858035 - DNA, 22 bp, Homo sapiens
ccaggctgaatatgttccaggg

SEQ ID NO: 7858036 - DNA, 22 bp, Homo sapiens
ccaggctgaatatgttccaggg

SEQ ID NO: 7858037 - DNA, 22 bp, Homo sapiens
ccaggctgaatatgttccaggg

SEQ ID NO: 7858038 - DNA, 22 bp, Homo sapiens
ccaggctgaatatgttccaggg

SEQ ID NO: 7858039 - DNA, 22 bp, Homo sapiens
ccaggctgaatatgttccaggg

SEQ ID NO: 7858040 - DNA, 22 bp, Homo sapiens
ccaggctgaatatgttccaggg

SEQ ID NO: 7858041 - DNA, 22 bp, Homo sapiens
ccaggcctggccaggggatgcc

SEQ ID NO: 7858042 - DNA, 22 bp, Homo sapiens
ccaggcctggccaggggatgcc

SEQ ID NO: 7858043 - DNA, 22 bp, Homo sapiens
ccaggcctggccaggggatgcc

SEQ ID NO: 7858044 - DNA, 22 bp, Homo sapiens
ccaggcctggacgggtggcctg

SEQ ID NO: 7858045 - DNA, 22 bp, Homo sapiens
ccaggcctggccaggggatgcc

SEQ ID NO: 7858046 - DNA, 22 bp, Homo sapiens
ccaggcctggacgggtggcctg

SEQ ID NO: 7858047 - DNA, 22 bp, Homo sapiens
ccaggcctggacgggtggcctg

SEQ ID NO: 7858048 - DNA, 22 bp, Homo sapiens
ccaggcctggaccatgccaggg

SEQ ID NO: 7858049 - DNA, 22 bp, Homo sapiens
ccaggcctggacgggtggcctg

SEQ ID NO: 7858050 - DNA, 22 bp, Homo sapiens
ccaggcctggacgggtggcctg

SEQ ID NO: 7858051 - DNA, 22 bp, Homo sapiens
ccaggcctggacgggtggcctg

SEQ ID NO: 7858052 - DNA, 22 bp, Homo sapiens
ccaggcctggacgggtggcctg

SEQ ID NO: 7858053 - DNA, 22 bp, Homo sapiens
ccaggcctggccaggggatgcc

SEQ ID NO: 7858054 - DNA, 22 bp, Homo sapiens
ccaggcctggccaggggatgcc

SEQ ID NO: 7858055 - DNA, 22 bp, Homo sapiens
ccaggcctggccaggggatgcc

SEQ ID NO: 7858056 - DNA, 21 bp, Homo sapiens
ccaggctcctgaggctggtca

SEQ ID NO: 7858057 - DNA, 21 bp, Homo sapiens
ccaggctcctgaggctggtca

SEQ ID NO: 7858058 - DNA, 21 bp, Homo sapiens
ccaggctcctgaggctggtca

SEQ ID NO: 7858059 - DNA, 22 bp, Homo sapiens
ccaggctctgcgctggacatgg

SEQ ID NO: 7858060 - DNA, 22 bp, Homo sapiens
ccaggctctgtctggtcagaag

SEQ ID NO: 7858061 - DNA, 22 bp, Homo sapiens
ccaggctctgtgtgggctagag

SEQ ID NO: 7858062 - DNA, 22 bp, Homo sapiens
tctttggtcatcatgggaagca

SEQ ID NO: 7858063 - DNA, 22 bp, Homo sapiens
tctttggtcagaaagattacac

SEQ ID NO: 7858064 - DNA, 22 bp, Homo sapiens
tctttggtcagaaagattacac

SEQ ID NO: 7858065 - DNA, 22 bp, Homo sapiens
tctttggtcagaaagattacac

SEQ ID NO: 7858066 - DNA, 23 bp, Homo sapiens
tctttggtaaataaagtggggat

SEQ ID NO: 7858067 - DNA, 22 bp, Homo sapiens
tctttggtattcacttgtgaag

SEQ ID NO: 7858068 - DNA, 22 bp, Homo sapiens
tctttgggagaaggggtcccag

SEQ ID NO: 7858069 - DNA, 22 bp, Homo sapiens
tctttggggcatctgggagatt

SEQ ID NO: 7858070 - DNA, 22 bp, Homo sapiens
tctttggggcatctgggagatt

SEQ ID NO: 7858071 - DNA, 22 bp, Homo sapiens
tctttggggcatctgggagatt

SEQ ID NO: 7858072 - DNA, 22 bp, Homo sapiens
tctttggcttgtctcctcagtt

SEQ ID NO: 7858073 - DNA, 22 bp, Homo sapiens
tctttggcttgtctcctcagtt

SEQ ID NO: 7858074 - DNA, 22 bp, Homo sapiens
tctttggctttgccacacccaa

SEQ ID NO: 7858075 - DNA, 22 bp, Homo sapiens
tctttggctttgccacacccaa

SEQ ID NO: 7858076 - DNA, 22 bp, Homo sapiens
tctttggctgcctgaagcccaa

SEQ ID NO: 7858077 - DNA, 19 bp, Homo sapiens
tctttggcttctggatcag

SEQ ID NO: 7858078 - DNA, 22 bp, Homo sapiens
tctttggctatgatttactgtt

SEQ ID NO: 7858079 - DNA, 22 bp, Homo sapiens
tctttggccttaggagcccttg

SEQ ID NO: 7858080 - DNA, 22 bp, Homo sapiens
ccaggctgagcatgattggagc

SEQ ID NO: 7858081 - DNA, 22 bp, Homo sapiens
ccaggctgagcatgattggagc

SEQ ID NO: 7858082 - DNA, 22 bp, Homo sapiens
ccaggctgctgttggtgtccgc

SEQ ID NO: 7858083 - DNA, 22 bp, Homo sapiens
tctttggtgatatctctttggt

SEQ ID NO: 7858084 - DNA, 22 bp, Homo sapiens
ccaggctgctgttggtgtccgc

SEQ ID NO: 7858085 - DNA, 22 bp, Homo sapiens
tctttggtgatatctctttggt

SEQ ID NO: 7858086 - DNA, 22 bp, Homo sapiens
tctttggtgaatggtcatccag

SEQ ID NO: 7858087 - DNA, 22 bp, Homo sapiens
tctttggtcatcatgggaagca

SEQ ID NO: 7858088 - DNA, 22 bp, Homo sapiens
tctttggtcatcatgggaagca

SEQ ID NO: 7858089 - DNA, 22 bp, Homo sapiens
ccaggctggagtgcaatggcat

SEQ ID NO: 7858090 - DNA, 22 bp, Homo sapiens
ccaggctggagtgcaatggcat

SEQ ID NO: 7858091 - DNA, 22 bp, Homo sapiens
ccaggctggagtgcaatggcat

SEQ ID NO: 7858092 - DNA, 22 bp, Homo sapiens
ccaggctgctgttggtgtccgc

SEQ ID NO: 7858093 - DNA, 22 bp, Homo sapiens
ccaggctgctgttggtgtccgc

SEQ ID NO: 7858094 - DNA, 22 bp, Homo sapiens
ccaggctgctgttggtgtccgc

SEQ ID NO: 7858095 - DNA, 22 bp, Homo sapiens
ccaggctgctgttggtgtccgc

SEQ ID NO: 7858096 - DNA, 22 bp, Homo sapiens
ccaggctgctgttggtgtccgc

SEQ ID NO: 7858097 - DNA, 22 bp, Homo sapiens
ccaggctggagtgcaatggcat

SEQ ID NO: 7858098 - DNA, 22 bp, Homo sapiens
ccaggctggagtgcaatggtgc

SEQ ID NO: 7858099 - DNA, 22 bp, Homo sapiens
ccaggctggagtgcaatggtgc

SEQ ID NO: 7858100 - DNA, 22 bp, Homo sapiens
ccaggctggagtgcaatggcgt

SEQ ID NO: 7858101 - DNA, 22 bp, Homo sapiens
ccaggctggagtgcaatggcgt

SEQ ID NO: 7858102 - DNA, 22 bp, Homo sapiens
ccaggctggagtgcaatggcgt

SEQ ID NO: 7858103 - DNA, 22 bp, Homo sapiens
ccaggctggagtgcaatggcgt

SEQ ID NO: 7858104 - DNA, 22 bp, Homo sapiens
ccaggctggagtgcaatggcgt

SEQ ID NO: 7858105 - DNA, 22 bp, Homo sapiens
ccaggctggagtgcaatggcgt

SEQ ID NO: 7858106 - DNA, 22 bp, Homo sapiens
ccaggctggagtgcaatggcgt

SEQ ID NO: 7858107 - DNA, 22 bp, Homo sapiens
ccaggctggagtgcaatggcat

SEQ ID NO: 7858108 - DNA, 22 bp, Homo sapiens
ccaggctggagtgcaatggcgt

SEQ ID NO: 7858109 - DNA, 22 bp, Homo sapiens
ccaggctggagtgcaatggcgt

SEQ ID NO: 7858110 - DNA, 22 bp, Homo sapiens
tcttcacatggagaagcaactc

SEQ ID NO: 7858111 - DNA, 22 bp, Homo sapiens
tcttcacattcacgtaacatag

SEQ ID NO: 7858112 - DNA, 22 bp, Homo sapiens
tcttcacattcacgtaacatag

SEQ ID NO: 7858113 - DNA, 22 bp, Homo sapiens
tcttcacatggagaagcaactc

SEQ ID NO: 7858114 - DNA, 22 bp, Homo sapiens
tcttcacattcacgtaacatag

SEQ ID NO: 7858115 - DNA, 22 bp, Homo sapiens
tcttcaccatcaacagaatgaa

SEQ ID NO: 7858116 - DNA, 22 bp, Homo sapiens
tcttcaccatcaacagaatgaa

SEQ ID NO: 7858117 - DNA, 22 bp, Homo sapiens
tcttcacattttaagaagttct

SEQ ID NO: 7858118 - DNA, 22 bp, Homo sapiens
tcttcacattttaagaagttct

SEQ ID NO: 7858119 - DNA, 22 bp, Homo sapiens
tcttagaatgtcaactgatgtt

SEQ ID NO: 7858120 - DNA, 22 bp, Homo sapiens
tcttagaatgtcaactgatgtt

SEQ ID NO: 7858121 - DNA, 22 bp, Homo sapiens
ccaggcaaggtctcctagagag

SEQ ID NO: 7858122 - DNA, 22 bp, Homo sapiens
tcttagaagtttatggcacgga

SEQ ID NO: 7858123 - DNA, 22 bp, Homo sapiens
ccaggcaaggtctcctagagag

SEQ ID NO: 7858124 - DNA, 22 bp, Homo sapiens
tcttagaatgtcaactgatgtt

SEQ ID NO: 7858125 - DNA, 22 bp, Homo sapiens
tcttagaatgtcaactgatgtt

SEQ ID NO: 7858126 - DNA, 22 bp, Homo sapiens
tcttagaatgtcaactgatgtt

SEQ ID NO: 7858127 - DNA, 20 bp, Homo sapiens
ccaggcaactatcctgtctc

SEQ ID NO: 7858128 - DNA, 22 bp, Homo sapiens
ccaggcaagagaggctctggca

SEQ ID NO: 7858129 - DNA, 22 bp, Homo sapiens
ccaggcaagagaggctctggca

SEQ ID NO: 7858130 - DNA, 22 bp, Homo sapiens
ccaggcaaggacatgaaactga

SEQ ID NO: 7858131 - DNA, 22 bp, Homo sapiens
ccaggcaaggtctcctagagag

SEQ ID NO: 7858132 - DNA, 22 bp, Homo sapiens
ccaggcaaggtctcctagagag

SEQ ID NO: 7858133 - DNA, 22 bp, Homo sapiens
ccaggcaagctctgctgtgccc

SEQ ID NO: 7858134 - DNA, 22 bp, Homo sapiens
ccaggagttggaggttgcagtg

SEQ ID NO: 7858135 - DNA, 22 bp, Homo sapiens
ccaggagtttgaggctgcagtg

SEQ ID NO: 7858136 - DNA, 22 bp, Homo sapiens
ccaggagtttgaggctgcagtg

SEQ ID NO: 7858137 - DNA, 22 bp, Homo sapiens
ccaggagttggaggctgcagtg

SEQ ID NO: 7858138 - DNA, 22 bp, Homo sapiens
ccaggagttggaggctgcagtg

SEQ ID NO: 7858139 - DNA, 22 bp, Homo sapiens
ccaggagttggaagctgccatg

SEQ ID NO: 7858140 - DNA, 22 bp, Homo sapiens
ccaggatggggagcagatagaa

SEQ ID NO: 7858141 - DNA, 22 bp, Homo sapiens
ccaggatggggagcagatagaa

SEQ ID NO: 7858142 - DNA, 22 bp, Homo sapiens
ccaggcaaatccctctggcaga

SEQ ID NO: 7858143 - DNA, 22 bp, Homo sapiens
ccaggcaaatccctctggcaga

SEQ ID NO: 7858144 - DNA, 22 bp, Homo sapiens
ccaggcaaagcccatgcaagag

SEQ ID NO: 7858145 - DNA, 22 bp, Homo sapiens
ccaggcaaagcccatgcaagag

SEQ ID NO: 7858146 - DNA, 22 bp, Homo sapiens
ccaggcaaagcccatgcaagag

SEQ ID NO: 7858147 - DNA, 22 bp, Homo sapiens
ccaggatgacccccactttcct

SEQ ID NO: 7858148 - DNA, 22 bp, Homo sapiens
ccaggatctgggtccatgggac

SEQ ID NO: 7858149 - DNA, 22 bp, Homo sapiens
ccaggatctgggtccatgggac

SEQ ID NO: 7858150 - DNA, 22 bp, Homo sapiens
ccaggatctgtacacctctgag

SEQ ID NO: 7858151 - DNA, 22 bp, Homo sapiens
ccaggatagtatgagtagggat

SEQ ID NO: 7858152 - DNA, 22 bp, Homo sapiens
ccaggatctgatattgggctcc

SEQ ID NO: 7858153 - DNA, 22 bp, Homo sapiens
ccaggatactgctctctgctgc

SEQ ID NO: 7858154 - DNA, 22 bp, Homo sapiens
ccaggaggttgaggctgcagtg

SEQ ID NO: 7858155 - DNA, 22 bp, Homo sapiens
ccaggaggttgaggctgcagtg

SEQ ID NO: 7858156 - DNA, 22 bp, Homo sapiens
ccaggaggttgaggctgcagtg

SEQ ID NO: 7858157 - DNA, 22 bp, Homo sapiens
ccaggaggttgaggctgcagtg

SEQ ID NO: 7858158 - DNA, 22 bp, Homo sapiens
ccaggaggttgaggctgcagtg

SEQ ID NO: 7858159 - DNA, 22 bp, Homo sapiens
ccaggaggttgaggctgcagtg

SEQ ID NO: 7858160 - DNA, 22 bp, Homo sapiens
ccaggagtggctggtgaccttc

SEQ ID NO: 7858161 - DNA, 22 bp, Homo sapiens
ccaggagtggctggtgaccttc

SEQ ID NO: 7858162 - DNA, 19 bp, Homo sapiens
ccaggagtggtggggtgag

SEQ ID NO: 7858163 - DNA, 19 bp, Homo sapiens
ccaggagtggtggggtgag

SEQ ID NO: 7858164 - DNA, 22 bp, Homo sapiens
ccaggagtctggatgaggtgtc

SEQ ID NO: 7858165 - DNA, 22 bp, Homo sapiens
ccaggagtctggatgaggtgtc

SEQ ID NO: 7858166 - DNA, 22 bp, Homo sapiens
ccaggagtgcagggatggtatc

SEQ ID NO: 7858167 - DNA, 22 bp, Homo sapiens
ccaggagtcaataaaggaagct

SEQ ID NO: 7858168 - DNA, 22 bp, Homo sapiens
ccaggagtcaataaaggaagct

SEQ ID NO: 7858169 - DNA, 22 bp, Homo sapiens
ccaggagtcaataaaggaagct

SEQ ID NO: 7858170 - DNA, 22 bp, Homo sapiens
ccaggagactgtactgatattt

SEQ ID NO: 7858171 - DNA, 22 bp, Homo sapiens
ccaggagactgtactgatattt

SEQ ID NO: 7858172 - DNA, 22 bp, Homo sapiens
ccaggagactgtactgatattt

SEQ ID NO: 7858173 - DNA, 22 bp, Homo sapiens
ccaggagactgtactgatattt

SEQ ID NO: 7858174 - DNA, 22 bp, Homo sapiens
ccaggagacccagggaaggagc

SEQ ID NO: 7858175 - DNA, 22 bp, Homo sapiens
ccaggagacccagggaaggagc

SEQ ID NO: 7858176 - DNA, 22 bp, Homo sapiens
ccaggagacccagggaaggagc

SEQ ID NO: 7858177 - DNA, 22 bp, Homo sapiens
ccaggagacccagggaaggagc

SEQ ID NO: 7858178 - DNA, 22 bp, Homo sapiens
ccaggagacaaagatgactgct

SEQ ID NO: 7858179 - DNA, 22 bp, Homo sapiens
ccaggagacaaagatgactgct

SEQ ID NO: 7858180 - DNA, 22 bp, Homo sapiens
ccaggagacaaagatgactgct

SEQ ID NO: 7858181 - DNA, 22 bp, Homo sapiens
ccaggagacaaagatgactgct

SEQ ID NO: 7858182 - DNA, 22 bp, Homo sapiens
ccaggagaatgggattacccta

SEQ ID NO: 7858183 - DNA, 22 bp, Homo sapiens
ccaggagaatgggattacccta

SEQ ID NO: 7858184 - DNA, 22 bp, Homo sapiens
ccaggagacccagggaaggagc

SEQ ID NO: 7858185 - DNA, 22 bp, Homo sapiens
ccaggaggttgaggctgcagtg

SEQ ID NO: 7858186 - DNA, 22 bp, Homo sapiens
ccaggaggttgaggctgcagtg

SEQ ID NO: 7858187 - DNA, 22 bp, Homo sapiens
ccaggaggttgaggctgcagtg

SEQ ID NO: 7858188 - DNA, 22 bp, Homo sapiens
ccaggaggttgaggctgcagtg

SEQ ID NO: 7858189 - DNA, 22 bp, Homo sapiens
ccaggaggttgaggctgcagtg

SEQ ID NO: 7858190 - DNA, 22 bp, Homo sapiens
ccaggaggttgaggctgcagtg

SEQ ID NO: 7858191 - DNA, 22 bp, Homo sapiens
ccaggaggttgaggctgcagtg

SEQ ID NO: 7858192 - DNA, 22 bp, Homo sapiens
ccaggaggttgaggctgcagtg

SEQ ID NO: 7858193 - DNA, 22 bp, Homo sapiens
ccaggagggaggagttcctgag

SEQ ID NO: 7858194 - DNA, 17 bp, Homo sapiens
ccaggagagatgcttgt

SEQ ID NO: 7858195 - DNA, 22 bp, Homo sapiens
ccaggagggaccgcggcatccc

SEQ ID NO: 7858196 - DNA, 22 bp, Homo sapiens
ccaggagggaccgcggcatccc

SEQ ID NO: 7858197 - DNA, 22 bp, Homo sapiens
ccaggagggaccgcggcatccc

SEQ ID NO: 7858198 - DNA, 22 bp, Homo sapiens
ccaggagggaccgcggcatccc

SEQ ID NO: 7858199 - DNA, 22 bp, Homo sapiens
tcttcccattagtaatgaagtg

SEQ ID NO: 7858200 - DNA, 22 bp, Homo sapiens
tcttcccattagtaatgaagtg

SEQ ID NO: 7858201 - DNA, 22 bp, Homo sapiens
tcttcccattagtaatgaagtg

SEQ ID NO: 7858202 - DNA, 21 bp, Homo sapiens
tcttcccattatgttccaatt

SEQ ID NO: 7858203 - DNA, 21 bp, Homo sapiens
tcttcccattatgttccaatt

SEQ ID NO: 7858204 - DNA, 22 bp, Homo sapiens
tcttcccccgtgctccagtgca

SEQ ID NO: 7858205 - DNA, 22 bp, Homo sapiens
tcttcccccgtgctccagtgca

SEQ ID NO: 7858206 - DNA, 22 bp, Homo sapiens
tcttcccccgtgctccagtgca

SEQ ID NO: 7858207 - DNA, 21 bp, Homo sapiens
tcttcccattatgttccaatt

SEQ ID NO: 7858208 - DNA, 21 bp, Homo sapiens
tcttccctcaggatgtcctgc

SEQ ID NO: 7858209 - DNA, 21 bp, Homo sapiens
tcttccctcaggatgtcctgc

SEQ ID NO: 7858210 - DNA, 22 bp, Homo sapiens
tcttccctcttctgccaaatac

SEQ ID NO: 7858211 - DNA, 21 bp, Homo sapiens
tcttccctcaggatgtcctgc

SEQ ID NO: 7858212 - DNA, 22 bp, Homo sapiens
tcttccctcttctgccaaatac

SEQ ID NO: 7858213 - DNA, 22 bp, Homo sapiens
tcttccctcttctgccaaatac

SEQ ID NO: 7858214 - DNA, 22 bp, Homo sapiens
tcttccctaatcaccatcttca

SEQ ID NO: 7858215 - DNA, 22 bp, Homo sapiens
tcttccctaatcaccatcttca

SEQ ID NO: 7858216 - DNA, 22 bp, Homo sapiens
tcttccctaatcaccatcttca

SEQ ID NO: 7858217 - DNA, 21 bp, Homo sapiens
tcttccctcaggatgtcctgc

SEQ ID NO: 7858218 - DNA, 21 bp, Homo sapiens
tcttccctcaggatgtcctgc

SEQ ID NO: 7858219 - DNA, 22 bp, Homo sapiens
ccaggcaggctagaatgtaaat

SEQ ID NO: 7858220 - DNA, 22 bp, Homo sapiens
ccaggcaggctagaatgtaaat

SEQ ID NO: 7858221 - DNA, 22 bp, Homo sapiens
ccaggcaggctagaatgtaaat

SEQ ID NO: 7858222 - DNA, 22 bp, Homo sapiens
ccaggcaggctagaatgtaaat

SEQ ID NO: 7858223 - DNA, 22 bp, Homo sapiens
ccaggcaggctagaatgtaaat

SEQ ID NO: 7858224 - DNA, 22 bp, Homo sapiens
ccaggcagggagctgtttggcc

SEQ ID NO: 7858225 - DNA, 22 bp, Homo sapiens
ccaggccagagtgcagtggcac

SEQ ID NO: 7858226 - DNA, 22 bp, Homo sapiens
ccaggcagggagctgtttggcc

SEQ ID NO: 7858227 - DNA, 22 bp, Homo sapiens
ccaggcagggagctgtttggcc

SEQ ID NO: 7858228 - DNA, 22 bp, Homo sapiens
ccaggcagggagctgtttggcc

SEQ ID NO: 7858229 - DNA, 22 bp, Homo sapiens
ccaggcagggagctgtttggcc

SEQ ID NO: 7858230 - DNA, 19 bp, Homo sapiens
tcttccctggctgtcagtc

SEQ ID NO: 7858231 - DNA, 19 bp, Homo sapiens
tcttccctggctgtcagtc

SEQ ID NO: 7858232 - DNA, 22 bp, Homo sapiens
tcttcctagaaggaagaaatct

SEQ ID NO: 7858233 - DNA, 22 bp, Homo sapiens
ccaggcaggcgatggtgcagtg

SEQ ID NO: 7858234 - DNA, 22 bp, Homo sapiens
tcttcctatgccaacattctgt

SEQ ID NO: 7858235 - DNA, 22 bp, Homo sapiens
tcttcctagttacatatgcaca

SEQ ID NO: 7858236 - DNA, 22 bp, Homo sapiens
tcttcctatgccaacattctgt

SEQ ID NO: 7858237 - DNA, 22 bp, Homo sapiens
ccaggccagcgctggctggagg

SEQ ID NO: 7858238 - DNA, 22 bp, Homo sapiens
ccaggccagcgctggctggagg

SEQ ID NO: 7858239 - DNA, 22 bp, Homo sapiens
ccaggccagcgctggctggagg

SEQ ID NO: 7858240 - DNA, 22 bp, Homo sapiens
ccaggccagcgctggctggagg

SEQ ID NO: 7858241 - DNA, 22 bp, Homo sapiens
ccaggccagcgctggctggagg

SEQ ID NO: 7858242 - DNA, 22 bp, Homo sapiens
ccaggccagcgctggctggagg

SEQ ID NO: 7858243 - DNA, 22 bp, Homo sapiens
ccaggccagcctggagcatggc

SEQ ID NO: 7858244 - DNA, 22 bp, Homo sapiens
ccaggccagcctggagcatggc

SEQ ID NO: 7858245 - DNA, 22 bp, Homo sapiens
ccaggccagcgctggctggagg

SEQ ID NO: 7858246 - DNA, 22 bp, Homo sapiens
ccaggccagcgctggctggagg

SEQ ID NO: 7858247 - DNA, 22 bp, Homo sapiens
ccaggccagcctggagcatggc

SEQ ID NO: 7858248 - DNA, 22 bp, Homo sapiens
ccaggccagagtgcagtggcac

SEQ ID NO: 7858249 - DNA, 22 bp, Homo sapiens
ccaggccagagtgcagtggcac

SEQ ID NO: 7858250 - DNA, 22 bp, Homo sapiens
ccaggccagagtgcagtggcac

SEQ ID NO: 7858251 - DNA, 22 bp, Homo sapiens
ccaggccagagtgcagtggcac

SEQ ID NO: 7858252 - DNA, 22 bp, Homo sapiens
ccaggccagagtgcagtggcac

SEQ ID NO: 7858253 - DNA, 22 bp, Homo sapiens
ccaggccagagtgcagtggcac

SEQ ID NO: 7858254 - DNA, 22 bp, Homo sapiens
ccaggccagagtgcagtggcac

SEQ ID NO: 7858255 - DNA, 22 bp, Homo sapiens
ccaggccagcaggcacacctgc

SEQ ID NO: 7858256 - DNA, 22 bp, Homo sapiens
ccaggccagcaggcacacctgc

SEQ ID NO: 7858257 - DNA, 22 bp, Homo sapiens
ccaggccagcaggcacacctgc

SEQ ID NO: 7858258 - DNA, 22 bp, Homo sapiens
ccaggccagcaggcacacctgc

SEQ ID NO: 7858259 - DNA, 22 bp, Homo sapiens
ccaggccagcaggcacacctgc

SEQ ID NO: 7858260 - DNA, 22 bp, Homo sapiens
ccaggccagcctggagcatggc

SEQ ID NO: 7858261 - DNA, 22 bp, Homo sapiens
ccaggccagcaggcacacctgc

SEQ ID NO: 7858262 - DNA, 22 bp, Homo sapiens
ccaggccagcaggcacacctgc

SEQ ID NO: 7858263 - DNA, 22 bp, Homo sapiens
ccaggccagcaggcacacctgc

SEQ ID NO: 7858264 - DNA, 22 bp, Homo sapiens
tcttcagagcatttctgaggta

SEQ ID NO: 7858265 - DNA, 22 bp, Homo sapiens
tcttcagagcatttctgaggta

SEQ ID NO: 7858266 - DNA, 22 bp, Homo sapiens
tcttcagaggaagtcagtcttt

SEQ ID NO: 7858267 - DNA, 22 bp, Homo sapiens
tcttcagaggaagtcagtcttt

SEQ ID NO: 7858268 - DNA, 22 bp, Homo sapiens
tcttcagaggagctgaatatat

SEQ ID NO: 7858269 - DNA, 22 bp, Homo sapiens
tcttcagagatgtaacatatgg

SEQ ID NO: 7858270 - DNA, 22 bp, Homo sapiens
tcttcagagatgtaacatatgg

SEQ ID NO: 7858271 - DNA, 22 bp, Homo sapiens
tcttcagagatgtaacatatgg

SEQ ID NO: 7858272 - DNA, 22 bp, Homo sapiens
tcttcagagcatttctgaggta

SEQ ID NO: 7858273 - DNA, 22 bp, Homo sapiens
tcttcagaagatcacatcagtg

SEQ ID NO: 7858274 - DNA, 22 bp, Homo sapiens
tcttcagaagatcacatcagtg

SEQ ID NO: 7858275 - DNA, 22 bp, Homo sapiens
tcttcagaagatcacatcagtg

SEQ ID NO: 7858276 - DNA, 22 bp, Homo sapiens
tcttcagaaaattatcacttgt

SEQ ID NO: 7858277 - DNA, 22 bp, Homo sapiens
tcttcagaaaattatcacttgt

SEQ ID NO: 7858278 - DNA, 22 bp, Homo sapiens
tcttcagaaaattatcacttgt

SEQ ID NO: 7858279 - DNA, 22 bp, Homo sapiens
tcttcagacccttagctgtgat

SEQ ID NO: 7858280 - DNA, 22 bp, Homo sapiens
tcttcagacccttagctgtgat

SEQ ID NO: 7858281 - DNA, 22 bp, Homo sapiens
tcttcagacccttagctgtgat

SEQ ID NO: 7858282 - DNA, 22 bp, Homo sapiens
tcttcagactgttgttcttttg

SEQ ID NO: 7858283 - DNA, 22 bp, Homo sapiens
tcttcagactgttgttcttttg

SEQ ID NO: 7858284 - DNA, 22 bp, Homo sapiens
tcttcagactccaaatgtttta

SEQ ID NO: 7858285 - DNA, 22 bp, Homo sapiens
tcttcccagaggaggtgccagc

SEQ ID NO: 7858286 - DNA, 22 bp, Homo sapiens
tcttcccagaggaggtgccagc

SEQ ID NO: 7858287 - DNA, 22 bp, Homo sapiens
tcttcccagaccttacatgtga

SEQ ID NO: 7858288 - DNA, 22 bp, Homo sapiens
tcttcccagctgctgcgatgcc

SEQ ID NO: 7858289 - DNA, 22 bp, Homo sapiens
tcttcccagctgctgcgatgcc

SEQ ID NO: 7858290 - DNA, 22 bp, Homo sapiens
tcttcccagtgagacttatggg

SEQ ID NO: 7858291 - DNA, 22 bp, Homo sapiens
tcttcccactgcccatgggcag

SEQ ID NO: 7858292 - DNA, 22 bp, Homo sapiens
tcttcccagaccttacatgtga

SEQ ID NO: 7858293 - DNA, 22 bp, Homo sapiens
tcttcccaatgcaaagtaggac

SEQ ID NO: 7858294 - DNA, 22 bp, Homo sapiens
tcttccagtgtagacatctgcc

SEQ ID NO: 7858295 - DNA, 22 bp, Homo sapiens
tcttccagtgtagacatctgcc

SEQ ID NO: 7858296 - DNA, 22 bp, Homo sapiens
tcttccagtgtagacatctgcc

SEQ ID NO: 7858297 - DNA, 22 bp, Homo sapiens
tcttccagtgtagacatctgcc

SEQ ID NO: 7858298 - DNA, 22 bp, Homo sapiens
tcttccagtgctgtgtagagct

SEQ ID NO: 7858299 - DNA, 22 bp, Homo sapiens
tcttccagtctgtaggactagg

SEQ ID NO: 7858300 - DNA, 19 bp, Homo sapiens
tcttccagtcacataacaa

SEQ ID NO: 7858301 - DNA, 22 bp, Homo sapiens
tcttccagtgctgtgtagagct

SEQ ID NO: 7858302 - DNA, 22 bp, Homo sapiens
tcttccagtgctgtgtagagct

SEQ ID NO: 7858303 - DNA, 22 bp, Homo sapiens
tcttccagtgctgtgtagagct

SEQ ID NO: 7858304 - DNA, 22 bp, Homo sapiens
tcttccagtctgtaggactagg

SEQ ID NO: 7858305 - DNA, 22 bp, Homo sapiens
tcttccagtctgtaggactagg

SEQ ID NO: 7858306 - DNA, 22 bp, Homo sapiens
tcttccagtctgtaggactagg

SEQ ID NO: 7858307 - DNA, 19 bp, Homo sapiens
tcttccagtcacataacaa

SEQ ID NO: 7858308 - DNA, 22 bp, Homo sapiens
tcttccaggtatgtttctagtt

SEQ ID NO: 7858309 - DNA, 22 bp, Homo sapiens
tcttccaggtatgtttctagtt

SEQ ID NO: 7858310 - DNA, 22 bp, Homo sapiens
tcttccaggtatgtttctagtt

SEQ ID NO: 7858311 - DNA, 22 bp, Homo sapiens
tcttcagagtgagcagtgtcat

SEQ ID NO: 7858312 - DNA, 22 bp, Homo sapiens
tcttcagagtgagcagtgtcat

SEQ ID NO: 7858313 - DNA, 22 bp, Homo sapiens
tcttcagagtgaaagtctgtga

SEQ ID NO: 7858314 - DNA, 22 bp, Homo sapiens
tcttcagataaagggagagtat

SEQ ID NO: 7858315 - DNA, 22 bp, Homo sapiens
tcttcagataaagggagagtat

SEQ ID NO: 7858316 - DNA, 20 bp, Homo sapiens
tcttcagatgcttttggagt

SEQ ID NO: 7858317 - DNA, 20 bp, Homo sapiens
tcttccaggtacagtctgca

SEQ ID NO: 7858318 - DNA, 22 bp, Homo sapiens
tcttcagataaagggagagtat

SEQ ID NO: 7858319 - DNA, 22 bp, Homo sapiens
tgtggccagccacaggcatggt

SEQ ID NO: 7858320 - DNA, 22 bp, Homo sapiens
tgtggccagccacaggcatggt

SEQ ID NO: 7858321 - DNA, 20 bp, Homo sapiens
tgtggccagctctctactgg

SEQ ID NO: 7858322 - DNA, 22 bp, Homo sapiens
tgtggccagccacaggcatggt

SEQ ID NO: 7858323 - DNA, 22 bp, Homo sapiens
tgtggccagccacaggcatggt

SEQ ID NO: 7858324 - DNA, 22 bp, Homo sapiens
tgtggccaggaaaaggagatgg

SEQ ID NO: 7858325 - DNA, 22 bp, Homo sapiens
tgtggccaggaaaaggagatgg

SEQ ID NO: 7858326 - DNA, 22 bp, Homo sapiens
tgtggccaggaaaaggagatgg

SEQ ID NO: 7858327 - DNA, 22 bp, Homo sapiens
tgtggccagggggccatgtccc

SEQ ID NO: 7858328 - DNA, 22 bp, Homo sapiens
tgtggccaggcccctgatggtg

SEQ ID NO: 7858329 - DNA, 22 bp, Homo sapiens
tgtggccaggcccctgatggtg

SEQ ID NO: 7858330 - DNA, 19 bp, Homo sapiens
tgtggccatggttcagctg

SEQ ID NO: 7858331 - DNA, 19 bp, Homo sapiens
tgtggccatggttcagctg

SEQ ID NO: 7858332 - DNA, 22 bp, Homo sapiens
tgtggccataaagcttaaaatg

SEQ ID NO: 7858333 - DNA, 22 bp, Homo sapiens
tgtggccatatactttgttgtg

SEQ ID NO: 7858334 - DNA, 22 bp, Homo sapiens
tgtggccatatactttgttgtg

SEQ ID NO: 7858335 - DNA, 22 bp, Homo sapiens
tgtggccatggtcagaatattg

SEQ ID NO: 7858336 - DNA, 22 bp, Homo sapiens
tgtggccatggtcagaatattg

SEQ ID NO: 7858337 - DNA, 22 bp, Homo sapiens
tgtggccataaagcttaaaatg

SEQ ID NO: 7858338 - DNA, 22 bp, Homo sapiens
tgtggccattcttgaggtcgac

SEQ ID NO: 7858339 - DNA, 22 bp, Homo sapiens
tgtggcccagatgagtgtgcta

SEQ ID NO: 7858340 - DNA, 22 bp, Homo sapiens
tgtggcccagatgagtgtgcta

SEQ ID NO: 7858341 - DNA, 20 bp, Homo sapiens
tgtggccatgttccaactca

SEQ ID NO: 7858342 - DNA, 22 bp, Homo sapiens
tgtggcccagatgagtgtgcta

SEQ ID NO: 7858343 - DNA, 22 bp, Homo sapiens
tgtggcctagttaaggacgcct

SEQ ID NO: 7858344 - DNA, 22 bp, Homo sapiens
tgtggcagtataagagctagaa

SEQ ID NO: 7858345 - DNA, 22 bp, Homo sapiens
tgtggcagtataagagctagaa

SEQ ID NO: 7858346 - DNA, 22 bp, Homo sapiens
tgtggcagtataagagctagaa

SEQ ID NO: 7858347 - DNA, 22 bp, Homo sapiens
tgtggcagtctcactggagggc

SEQ ID NO: 7858348 - DNA, 22 bp, Homo sapiens
tgtggcagtctcactggagggc

SEQ ID NO: 7858349 - DNA, 22 bp, Homo sapiens
tgtggcagtctcactggagggc

SEQ ID NO: 7858350 - DNA, 22 bp, Homo sapiens
tgtggcagtctcactggagggc

SEQ ID NO: 7858351 - DNA, 22 bp, Homo sapiens
tgtggcagtataagagctagaa

SEQ ID NO: 7858352 - DNA, 22 bp, Homo sapiens
tgtggcagtaaaattgggcaac

SEQ ID NO: 7858353 - DNA, 22 bp, Homo sapiens
tgtggcagtaaaattgggcaac

SEQ ID NO: 7858354 - DNA, 22 bp, Homo sapiens
tgtggcagtaaaattgggcaac

SEQ ID NO: 7858355 - DNA, 18 bp, Homo sapiens
tgtggcaggggtgggaga

SEQ ID NO: 7858356 - DNA, 18 bp, Homo sapiens
tgtggcaggggtgggaga

SEQ ID NO: 7858357 - DNA, 22 bp, Homo sapiens
tgtggcagctgctgcaggagct

SEQ ID NO: 7858358 - DNA, 22 bp, Homo sapiens
tgtggcagctgctgcaggagct

SEQ ID NO: 7858359 - DNA, 22 bp, Homo sapiens
tgtggcagtctcactggagggc

SEQ ID NO: 7858360 - DNA, 21 bp, Homo sapiens
tgtggcatcattgatctgtga

SEQ ID NO: 7858361 - DNA, 22 bp, Homo sapiens
tgtggcatacacatgaggtggt

SEQ ID NO: 7858362 - DNA, 22 bp, Homo sapiens
tgtggccactgtttcttttcct

SEQ ID NO: 7858363 - DNA, 22 bp, Homo sapiens
tgtggccagcaggtggctgtgt

SEQ ID NO: 7858364 - DNA, 22 bp, Homo sapiens
tgtggccagaggtactatttta

SEQ ID NO: 7858365 - DNA, 22 bp, Homo sapiens
tgtggccaccagagctgctatt

SEQ ID NO: 7858366 - DNA, 22 bp, Homo sapiens
tgtggcattgaataaccttgga

SEQ ID NO: 7858367 - DNA, 22 bp, Homo sapiens
tgtggccaaaataaaatgaggt

SEQ ID NO: 7858368 - DNA, 22 bp, Homo sapiens
tgtggccaaaataaaatgaggt

SEQ ID NO: 7858369 - DNA, 22 bp, Homo sapiens
tgtggaggattctgatgccagc

SEQ ID NO: 7858370 - DNA, 22 bp, Homo sapiens
tgtggaggattctgatgccagc

SEQ ID NO: 7858371 - DNA, 22 bp, Homo sapiens
tgtggaggattctgatgccagc

SEQ ID NO: 7858372 - DNA, 22 bp, Homo sapiens
tgtggaggattctgatgccagc

SEQ ID NO: 7858373 - DNA, 22 bp, Homo sapiens
tgtggaggtttaagtaatggga

SEQ ID NO: 7858374 - DNA, 22 bp, Homo sapiens
tgtggaggtttaagtaatggga

SEQ ID NO: 7858375 - DNA, 22 bp, Homo sapiens
tgtggaggtttaagtaatggga

SEQ ID NO: 7858376 - DNA, 20 bp, Homo sapiens
tgtggatgaggtaaggatag

SEQ ID NO: 7858377 - DNA, 22 bp, Homo sapiens
tgtggatgagggagtgaacaaa

SEQ ID NO: 7858378 - DNA, 22 bp, Homo sapiens
tgtggcacagaaagatgaaggg

SEQ ID NO: 7858379 - DNA, 22 bp, Homo sapiens
tgtggcaaagaccatttctttc

SEQ ID NO: 7858380 - DNA, 22 bp, Homo sapiens
tgtggatgaataaagtgcagac

SEQ ID NO: 7858381 - DNA, 22 bp, Homo sapiens
tgtggagtggtctgaaggctcc

SEQ ID NO: 7858382 - DNA, 22 bp, Homo sapiens
tgtggatgaataaagtgcagac

SEQ ID NO: 7858383 - DNA, 22 bp, Homo sapiens
tgtggcagaaagcatgtggaca

SEQ ID NO: 7858384 - DNA, 22 bp, Homo sapiens
tgtggcagaaagcatgtggaca

SEQ ID NO: 7858385 - DNA, 22 bp, Homo sapiens
tgtggcacttctctccttgtaa

SEQ ID NO: 7858386 - DNA, 22 bp, Homo sapiens
tgtggcagaaagcatgtggaca

SEQ ID NO: 7858387 - DNA, 22 bp, Homo sapiens
tgtggcacatacacaggagggc

SEQ ID NO: 7858388 - DNA, 22 bp, Homo sapiens
tgtggcacatacacaggagggc

SEQ ID NO: 7858389 - DNA, 22 bp, Homo sapiens
tgtggcacatacacaggagggc

SEQ ID NO: 7858390 - DNA, 22 bp, Homo sapiens
tgtggcagaaagcatgtggaca

SEQ ID NO: 7858391 - DNA, 22 bp, Homo sapiens
tgtggcagaaccagaattcaaa

SEQ ID NO: 7858392 - DNA, 22 bp, Homo sapiens
tgtggcagaaccagaattcaaa

SEQ ID NO: 7858393 - DNA, 22 bp, Homo sapiens
tgtggcagaaccagaattcaaa

SEQ ID NO: 7858394 - DNA, 22 bp, Homo sapiens
tgtggcagaaccagaattcaaa

SEQ ID NO: 7858395 - DNA, 22 bp, Homo sapiens
tgtggcagaaagcatgtggaca

SEQ ID NO: 7858396 - DNA, 22 bp, Homo sapiens
tgtggcagaactgggactcaaa

SEQ ID NO: 7858397 - DNA, 22 bp, Homo sapiens
tgtggcagaactgggactcaaa

SEQ ID NO: 7858398 - DNA, 22 bp, Homo sapiens
tgtggcagaactgggactcaaa

SEQ ID NO: 7858399 - DNA, 22 bp, Homo sapiens
tgtggcagaactgggactcaaa

SEQ ID NO: 7858400 - DNA, 22 bp, Homo sapiens
tgtggcagctgctgcaggagct

SEQ ID NO: 7858401 - DNA, 22 bp, Homo sapiens
tgtggcagctgctgcaggagct

SEQ ID NO: 7858402 - DNA, 22 bp, Homo sapiens
tgtggcagattttataaattgc

SEQ ID NO: 7858403 - DNA, 22 bp, Homo sapiens
tgtggcagattttataaattgc

SEQ ID NO: 7858404 - DNA, 21 bp, Homo sapiens
tgtggcagatgttgggaggca

SEQ ID NO: 7858405 - DNA, 21 bp, Homo sapiens
tgtggcagatgttgggaggca

SEQ ID NO: 7858406 - DNA, 21 bp, Homo sapiens
tgtggcagatgttgggaggca

SEQ ID NO: 7858407 - DNA, 21 bp, Homo sapiens
tgtggcagatgttgggaggca

SEQ ID NO: 7858408 - DNA, 21 bp, Homo sapiens
tgtggcagatgttgggaggca

SEQ ID NO: 7858409 - DNA, 21 bp, Homo sapiens
tgtggcagatgttgggaggca

SEQ ID NO: 7858410 - DNA, 21 bp, Homo sapiens
tgtggcagatgttgggaggca

SEQ ID NO: 7858411 - DNA, 22 bp, Homo sapiens
tgtggcagagtaaggacccagt

SEQ ID NO: 7858412 - DNA, 22 bp, Homo sapiens
tgtggcagagtaaggacccagt

SEQ ID NO: 7858413 - DNA, 22 bp, Homo sapiens
tgtggcagagtaaggacccagt

SEQ ID NO: 7858414 - DNA, 22 bp, Homo sapiens
tgtggcagatacagaagatcaa

SEQ ID NO: 7858415 - DNA, 22 bp, Homo sapiens
tgtggcagatacagaagatcaa

SEQ ID NO: 7858416 - DNA, 22 bp, Homo sapiens
tgtggcagatacagaagatcaa

SEQ ID NO: 7858417 - DNA, 22 bp, Homo sapiens
tgtggcagaggaggcagcgtcc

SEQ ID NO: 7858418 - DNA, 22 bp, Homo sapiens
tgtggcagaggaggcagcgtcc

SEQ ID NO: 7858419 - DNA, 22 bp, Homo sapiens
tgtggcagaggaggcagcgtcc

SEQ ID NO: 7858420 - DNA, 22 bp, Homo sapiens
tgtggcagagtaaggacccagt

SEQ ID NO: 7858421 - DNA, 22 bp, Homo sapiens
tgtggcagaggaggcagcgtcc

SEQ ID NO: 7858422 - DNA, 22 bp, Homo sapiens
tgtggcagagtaaggacccagt

SEQ ID NO: 7858423 - DNA, 22 bp, Homo sapiens
tgtggcagaggaggcagcgtcc

SEQ ID NO: 7858424 - DNA, 22 bp, Homo sapiens
tgtggcagaaggctaaggtgtc

SEQ ID NO: 7858425 - DNA, 21 bp, Homo sapiens
tgtggcagagacaatgctagt

SEQ ID NO: 7858426 - DNA, 22 bp, Homo sapiens
tgtggcagacaagattctatgt

SEQ ID NO: 7858427 - DNA, 21 bp, Homo sapiens
tgtggcagagacaatgctagt

SEQ ID NO: 7858428 - DNA, 22 bp, Homo sapiens
tgtggcagaaggctaaggtgtc

SEQ ID NO: 7858429 - DNA, 22 bp, Homo sapiens
tgtggcagaaggctaaggtgtc

SEQ ID NO: 7858430 - DNA, 22 bp, Homo sapiens
tgtggcagaactgggactcaaa

SEQ ID NO: 7858431 - DNA, 22 bp, Homo sapiens
tgtggcagagagagcttccttg

SEQ ID NO: 7858432 - DNA, 22 bp, Homo sapiens
tgtggcagagagagcttccttg

SEQ ID NO: 7858433 - DNA, 21 bp, Homo sapiens
tgtggcagagacaatgctagt

SEQ ID NO: 7858434 - DNA, 22 bp, Homo sapiens
tgtggcagagagagcttccttg

SEQ ID NO: 7858435 - DNA, 22 bp, Homo sapiens
tgtggagaagaaggccactgca

SEQ ID NO: 7858436 - DNA, 22 bp, Homo sapiens
tgtggagatgtgagcaagggga

SEQ ID NO: 7858437 - DNA, 22 bp, Homo sapiens
tgtggagatgtgagcaagggga

SEQ ID NO: 7858438 - DNA, 22 bp, Homo sapiens
tgtggagatgtgagcaagggga

SEQ ID NO: 7858439 - DNA, 22 bp, Homo sapiens
tgtggactttggcattggactt

SEQ ID NO: 7858440 - DNA, 22 bp, Homo sapiens
tgtggactttattttagggagg

SEQ ID NO: 7858441 - DNA, 22 bp, Homo sapiens
tgtggagaagaaggccactgca

SEQ ID NO: 7858442 - DNA, 22 bp, Homo sapiens
tgtggacttgaaattacttttc

SEQ ID NO: 7858443 - DNA, 22 bp, Homo sapiens
tgtggactttagtaggtgagag

SEQ ID NO: 7858444 - DNA, 22 bp, Homo sapiens
tgtggactttagtaggtgagag

SEQ ID NO: 7858445 - DNA, 22 bp, Homo sapiens
tgtggagcactgttcctggcat

SEQ ID NO: 7858446 - DNA, 22 bp, Homo sapiens
tgtggagcagcgtcacagcctt

SEQ ID NO: 7858447 - DNA, 22 bp, Homo sapiens
tgtggagcaattggtggtgtct

SEQ ID NO: 7858448 - DNA, 22 bp, Homo sapiens
tgtggagccaggaggtggggac

SEQ ID NO: 7858449 - DNA, 22 bp, Homo sapiens
tgtggagcccccaggagtgggg

SEQ ID NO: 7858450 - DNA, 22 bp, Homo sapiens
tgtggagcccccaggagtgggg

SEQ ID NO: 7858451 - DNA, 22 bp, Homo sapiens
tgtggagcagcgtcacagcctt

SEQ ID NO: 7858452 - DNA, 22 bp, Homo sapiens
tgtggagctcagaagtagcagt

SEQ ID NO: 7858453 - DNA, 22 bp, Homo sapiens
tgtggagcctcaaggccatctc

SEQ ID NO: 7858454 - DNA, 22 bp, Homo sapiens
tgtggaggattctgatgccagc

SEQ ID NO: 7858455 - DNA, 22 bp, Homo sapiens
tgtggagctggcaatatgggca

SEQ ID NO: 7858456 - DNA, 22 bp, Homo sapiens
tgtggacatagaagcatgtgga

SEQ ID NO: 7858457 - DNA, 22 bp, Homo sapiens
tgtggacaggcagttggtggga

SEQ ID NO: 7858458 - DNA, 22 bp, Homo sapiens
tgtggacagtgatccctagtca

SEQ ID NO: 7858459 - DNA, 22 bp, Homo sapiens
tgtggacatactaggcctaggc

SEQ ID NO: 7858460 - DNA, 18 bp, Homo sapiens
tgtggacatggctcttca

SEQ ID NO: 7858461 - DNA, 18 bp, Homo sapiens
tgtggacatggctcttca

SEQ ID NO: 7858462 - DNA, 22 bp, Homo sapiens
tgtggacattttttgtcagtag

SEQ ID NO: 7858463 - DNA, 22 bp, Homo sapiens
tgtggacgtcattaaagcagtg

SEQ ID NO: 7858464 - DNA, 22 bp, Homo sapiens
tgtggactagtgtttggatttt

SEQ ID NO: 7858465 - DNA, 20 bp, Homo sapiens
tgtggactcagtttcttgct

SEQ ID NO: 7858466 - DNA, 22 bp, Homo sapiens
tgtggactcgcatggctgaggc

SEQ ID NO: 7858467 - DNA, 22 bp, Homo sapiens
tgtggactcgcatggctgaggc

SEQ ID NO: 7858468 - DNA, 22 bp, Homo sapiens
tgtggactgtgctgccacagtg

SEQ ID NO: 7858469 - DNA, 22 bp, Homo sapiens
tgtggactgtgctgccacagtg

SEQ ID NO: 7858470 - DNA, 22 bp, Homo sapiens
tgtggacagagccctggtttgg

SEQ ID NO: 7858471 - DNA, 22 bp, Homo sapiens
tgtggacagctctttgagtgct

SEQ ID NO: 7858472 - DNA, 22 bp, Homo sapiens
tgtggacagctcttcccatatg

SEQ ID NO: 7858473 - DNA, 22 bp, Homo sapiens
tgtggacacctattaccagtga

SEQ ID NO: 7858474 - DNA, 22 bp, Homo sapiens
tgtggacactacgataggggaa

SEQ ID NO: 7858475 - DNA, 22 bp, Homo sapiens
tgtggacactagcagatacggt

SEQ ID NO: 7858476 - DNA, 22 bp, Homo sapiens
tgtggacagagcagaaggtcat

SEQ ID NO: 7858477 - DNA, 22 bp, Homo sapiens
tcccctgcagatgagggcagtg

SEQ ID NO: 7858478 - DNA, 22 bp, Homo sapiens
tcccctgcagcgcctgcttcta

SEQ ID NO: 7858479 - DNA, 22 bp, Homo sapiens
tcccctgcagcgcctgcttcta

SEQ ID NO: 7858480 - DNA, 22 bp, Homo sapiens
tcccctgcagatgagggcagtg

SEQ ID NO: 7858481 - DNA, 18 bp, Homo sapiens
tcccctgctctggtgctc

SEQ ID NO: 7858482 - DNA, 22 bp, Homo sapiens
tcccctctggttgacccaggag

SEQ ID NO: 7858483 - DNA, 22 bp, Homo sapiens
tcccctgcagcgcctgcttcta

SEQ ID NO: 7858484 - DNA, 22 bp, Homo sapiens
tcccctctggaggctgcagggg

SEQ ID NO: 7858485 - DNA, 22 bp, Homo sapiens
tcccctctggttgacccaggag

SEQ ID NO: 7858486 - DNA, 22 bp, Homo sapiens
tcccctgagacccctcagcact

SEQ ID NO: 7858487 - DNA, 22 bp, Homo sapiens
tcccctctttctggaaacacaa

SEQ ID NO: 7858488 - DNA, 22 bp, Homo sapiens
tcccctctggaggctgcagggg

SEQ ID NO: 7858489 - DNA, 22 bp, Homo sapiens
tcccctctggaggctgcagggg

SEQ ID NO: 7858490 - DNA, 22 bp, Homo sapiens
tcccctctggaggctgcagggg

SEQ ID NO: 7858491 - DNA, 22 bp, Homo sapiens
tcccctctctgcgctcccaggt

SEQ ID NO: 7858492 - DNA, 22 bp, Homo sapiens
tcccctctctgcgctcccaggt

SEQ ID NO: 7858493 - DNA, 22 bp, Homo sapiens
tcccctctctgcgctcccaggt

SEQ ID NO: 7858494 - DNA, 21 bp, Homo sapiens
tcccctcacttgtcttctgag

SEQ ID NO: 7858495 - DNA, 22 bp, Homo sapiens
tccccctcctgtggttttctgc

SEQ ID NO: 7858496 - DNA, 22 bp, Homo sapiens
tccccctccaattgccatgtta

SEQ ID NO: 7858497 - DNA, 22 bp, Homo sapiens
tccccctccaattgccatgtta

SEQ ID NO: 7858498 - DNA, 22 bp, Homo sapiens
tccccctcattacctcattcaa

SEQ ID NO: 7858499 - DNA, 22 bp, Homo sapiens
tccccctcattacctcattcaa

SEQ ID NO: 7858500 - DNA, 22 bp, Homo sapiens
tccccctcattacctcattcaa

SEQ ID NO: 7858501 - DNA, 22 bp, Homo sapiens
tccccccagcctttcacatgag

SEQ ID NO: 7858502 - DNA, 17 bp, Homo sapiens
tcccccagggctctctc

SEQ ID NO: 7858503 - DNA, 17 bp, Homo sapiens
tcccccagggctctctc

SEQ ID NO: 7858504 - DNA, 22 bp, Homo sapiens
tccccccagcctttcacatgag

SEQ ID NO: 7858505 - DNA, 22 bp, Homo sapiens
tcccctcccttccaacagagct

SEQ ID NO: 7858506 - DNA, 22 bp, Homo sapiens
tcccctcccttccaacagagct

SEQ ID NO: 7858507 - DNA, 22 bp, Homo sapiens
tcccctcccttccaacagagct

SEQ ID NO: 7858508 - DNA, 22 bp, Homo sapiens
tcccctcctctcctgatatggg

SEQ ID NO: 7858509 - DNA, 22 bp, Homo sapiens
tcccctcctctcctgatatggg

SEQ ID NO: 7858510 - DNA, 22 bp, Homo sapiens
tcccctccaactccaactatgg

SEQ ID NO: 7858511 - DNA, 22 bp, Homo sapiens
tcccctccaactccaactatgg

SEQ ID NO: 7858512 - DNA, 23 bp, Homo sapiens
tcccctcaggcagccagtgccct

SEQ ID NO: 7858513 - DNA, 23 bp, Homo sapiens
tcccctcaggcagccagtgccct

SEQ ID NO: 7858514 - DNA, 22 bp, Homo sapiens
tcccctccaactccaactatgg

SEQ ID NO: 7858515 - DNA, 22 bp, Homo sapiens
tccccaggtcctgtcggctcct

SEQ ID NO: 7858516 - DNA, 22 bp, Homo sapiens
tccccagtaagcctgcactgtg

SEQ ID NO: 7858517 - DNA, 22 bp, Homo sapiens
tccccaggtcctgtcggctcct

SEQ ID NO: 7858518 - DNA, 22 bp, Homo sapiens
tccccagtcccggcggtgggtg

SEQ ID NO: 7858519 - DNA, 22 bp, Homo sapiens
tccccatgggtggggacacata

SEQ ID NO: 7858520 - DNA, 22 bp, Homo sapiens
tccccagggtccctgcttccat

SEQ ID NO: 7858521 - DNA, 22 bp, Homo sapiens
tccccaggtcctgtcggctcct

SEQ ID NO: 7858522 - DNA, 22 bp, Homo sapiens
tccccaggtcctgtcggctcct

SEQ ID NO: 7858523 - DNA, 22 bp, Homo sapiens
tccccaggtcctgtcggctcct

SEQ ID NO: 7858524 - DNA, 22 bp, Homo sapiens
tccccaggtcctgtcggctcct

SEQ ID NO: 7858525 - DNA, 22 bp, Homo sapiens
tcccccaggctggagtgcagtg

SEQ ID NO: 7858526 - DNA, 20 bp, Homo sapiens
tcccccactgtttctgctac

SEQ ID NO: 7858527 - DNA, 20 bp, Homo sapiens
tcccccactgtttctgctac

SEQ ID NO: 7858528 - DNA, 20 bp, Homo sapiens
tcccccactgtttctgctac

SEQ ID NO: 7858529 - DNA, 20 bp, Homo sapiens
tcccccactgtttctgctac

SEQ ID NO: 7858530 - DNA, 22 bp, Homo sapiens
tcccccactctaaaggagcctt

SEQ ID NO: 7858531 - DNA, 22 bp, Homo sapiens
tcccccaggctggagtgcagtg

SEQ ID NO: 7858532 - DNA, 22 bp, Homo sapiens
tccccatgtctgcagggagggt

SEQ ID NO: 7858533 - DNA, 22 bp, Homo sapiens
tcccccactctaaaggagcctt

SEQ ID NO: 7858534 - DNA, 22 bp, Homo sapiens
tcccccactctaaaggagcctt

SEQ ID NO: 7858535 - DNA, 22 bp, Homo sapiens
tcccccactctaaaggagcctt

SEQ ID NO: 7858536 - DNA, 22 bp, Homo sapiens
tcccccactctaaaggagcctt

SEQ ID NO: 7858537 - DNA, 22 bp, Homo sapiens
tgtgtctttggcgatgtctgga

SEQ ID NO: 7858538 - DNA, 22 bp, Homo sapiens
tgtgtctttgttccaggtacga

SEQ ID NO: 7858539 - DNA, 22 bp, Homo sapiens
tgtgtctttgttccaggtacga

SEQ ID NO: 7858540 - DNA, 20 bp, Homo sapiens
tgtgtgaacacggactctgt

SEQ ID NO: 7858541 - DNA, 22 bp, Homo sapiens
tgtgtctttggcgatgtctgga

SEQ ID NO: 7858542 - DNA, 22 bp, Homo sapiens
tgtgtctttggcgatgtctgga

SEQ ID NO: 7858543 - DNA, 22 bp, Homo sapiens
tgtgtcttggccaccttgggaa

SEQ ID NO: 7858544 - DNA, 20 bp, Homo sapiens
tgtgtcttcctttctttatg

SEQ ID NO: 7858545 - DNA, 22 bp, Homo sapiens
tgtgtcttggccaccttgggaa

SEQ ID NO: 7858546 - DNA, 22 bp, Homo sapiens
tgtgtctgttttgctcaccatt

SEQ ID NO: 7858547 - DNA, 22 bp, Homo sapiens
tgtgtctgttttgctcaccatt

SEQ ID NO: 7858548 - DNA, 22 bp, Homo sapiens
tgtgtctgttttgctcaccatt

SEQ ID NO: 7858549 - DNA, 22 bp, Homo sapiens
tgtgtcttaagttccaagacat

SEQ ID NO: 7858550 - DNA, 20 bp, Homo sapiens
tgtgtcttcctttctttatg

SEQ ID NO: 7858551 - DNA, 22 bp, Homo sapiens
tgtgtcttacataattacatgt

SEQ ID NO: 7858552 - DNA, 22 bp, Homo sapiens
tgtgtgaaggagccactgttca

SEQ ID NO: 7858553 - DNA, 22 bp, Homo sapiens
tgtgtgaaggagccactgttca

SEQ ID NO: 7858554 - DNA, 22 bp, Homo sapiens
tgtgtgaaggaatatatactca

SEQ ID NO: 7858555 - DNA, 22 bp, Homo sapiens
tgtgtgaagcacatgttcaagg

SEQ ID NO: 7858556 - DNA, 22 bp, Homo sapiens
tgtgtgaactctctgatgtaca

SEQ ID NO: 7858557 - DNA, 22 bp, Homo sapiens
tgtgtgaggtggttctgagaag

SEQ ID NO: 7858558 - DNA, 19 bp, Homo sapiens
tgtgtgcaaatggaagcca

SEQ ID NO: 7858559 - DNA, 19 bp, Homo sapiens
tgtgtgcaaatggaagcca

SEQ ID NO: 7858560 - DNA, 19 bp, Homo sapiens
tgtgtgcaaatggaagcca

SEQ ID NO: 7858561 - DNA, 22 bp, Homo sapiens
tgtgtgcaagtgacattagaaa

SEQ ID NO: 7858562 - DNA, 22 bp, Homo sapiens
tgtgtgcaagtgacattagaaa

SEQ ID NO: 7858563 - DNA, 22 bp, Homo sapiens
tgtgtgattgcaggagatgtgg

SEQ ID NO: 7858564 - DNA, 22 bp, Homo sapiens
tgtgtgattgcaggagatgtgg

SEQ ID NO: 7858565 - DNA, 22 bp, Homo sapiens
tgtgtgacctggggtgagatag

SEQ ID NO: 7858566 - DNA, 22 bp, Homo sapiens
tgtgtgacacattgatatgtgc

SEQ ID NO: 7858567 - DNA, 22 bp, Homo sapiens
tgtgtgacacattgatatgtgc

SEQ ID NO: 7858568 - DNA, 22 bp, Homo sapiens
tgtgtgacctggggtgagatag

SEQ ID NO: 7858569 - DNA, 22 bp, Homo sapiens
tgtgtgagacaattggctgtgg

SEQ ID NO: 7858570 - DNA, 22 bp, Homo sapiens
tgtgtgaggtggttctgagaag

SEQ ID NO: 7858571 - DNA, 22 bp, Homo sapiens
tgtgtgagacaattggctgtgg

SEQ ID NO: 7858572 - DNA, 22 bp, Homo sapiens
tgtgtccaacccagggacaagt

SEQ ID NO: 7858573 - DNA, 22 bp, Homo sapiens
tgtgtccacgcactggcatgat

SEQ ID NO: 7858574 - DNA, 22 bp, Homo sapiens
tgtgtccacgcactggcatgat

SEQ ID NO: 7858575 - DNA, 22 bp, Homo sapiens
tgtgtccactgaatgtgtatta

SEQ ID NO: 7858576 - DNA, 22 bp, Homo sapiens
tgtgtccatctgacaggagagg

SEQ ID NO: 7858577 - DNA, 20 bp, Homo sapiens
tgtgtccatcatctgggcac

SEQ ID NO: 7858578 - DNA, 22 bp, Homo sapiens
tgtgtccatctgacaggagagg

SEQ ID NO: 7858579 - DNA, 22 bp, Homo sapiens
tgtgtcatctgtgttacataat

SEQ ID NO: 7858580 - DNA, 22 bp, Homo sapiens
tgtgtcatattagtattgagag

SEQ ID NO: 7858581 - DNA, 22 bp, Homo sapiens
tgtgtcattgccatgaaaaggc

SEQ ID NO: 7858582 - DNA, 22 bp, Homo sapiens
tgtgtcatctgtgttacataat

SEQ ID NO: 7858583 - DNA, 21 bp, Homo sapiens
tgtgtcagtctttggaagcaa

SEQ ID NO: 7858584 - DNA, 21 bp, Homo sapiens
tgtgtcagtctttggaagcaa

SEQ ID NO: 7858585 - DNA, 22 bp, Homo sapiens
tgtgtcaggccttatcggtggc

SEQ ID NO: 7858586 - DNA, 22 bp, Homo sapiens
tgtgtccattcaggcactgacc

SEQ ID NO: 7858587 - DNA, 22 bp, Homo sapiens
tgtgtccattcaggcactgacc

SEQ ID NO: 7858588 - DNA, 22 bp, Homo sapiens
tgtgtcctcactgtatgcaagg

SEQ ID NO: 7858589 - DNA, 22 bp, Homo sapiens
tgtgtcgcaccctacacccagg

SEQ ID NO: 7858590 - DNA, 22 bp, Homo sapiens
tgtgtctgttttgctcaccatt

SEQ ID NO: 7858591 - DNA, 22 bp, Homo sapiens
tgtgtcctttctaatgcccaga

SEQ ID NO: 7858592 - DNA, 23 bp, Homo sapiens
tgtgtccttaactgtatatacta

SEQ ID NO: 7858593 - DNA, 22 bp, Homo sapiens
tgtgtcctccagggagatgtaa

SEQ ID NO: 7858594 - DNA, 22 bp, Homo sapiens
tgtgtcctcatgtggcagagag

SEQ ID NO: 7858595 - DNA, 22 bp, Homo sapiens
tgtgtcctgtccccttgctgct

SEQ ID NO: 7858596 - DNA, 22 bp, Homo sapiens
tgtgtcctggtgttaattttat

SEQ ID NO: 7858597 - DNA, 22 bp, Homo sapiens
tgtgtcctgcaggtgctgcctg

SEQ ID NO: 7858598 - DNA, 22 bp, Homo sapiens
tgtgtcctgtccccttgctgct

SEQ ID NO: 7858599 - DNA, 22 bp, Homo sapiens
tgtgtcctgtccccttgctgct

SEQ ID NO: 7858600 - DNA, 22 bp, Homo sapiens
tgtggggaggctgcagtgctgc

SEQ ID NO: 7858601 - DNA, 22 bp, Homo sapiens
tgtggggaggctgcagtgctgc

SEQ ID NO: 7858602 - DNA, 19 bp, Homo sapiens
tgtggggagtcagggggct

SEQ ID NO: 7858603 - DNA, 22 bp, Homo sapiens
tgtggggaggctgcagtgctgc

SEQ ID NO: 7858604 - DNA, 19 bp, Homo sapiens
tgtggcctggggacaggcc

SEQ ID NO: 7858605 - DNA, 17 bp, Homo sapiens
tgtggccttctgagctt

SEQ ID NO: 7858606 - DNA, 22 bp, Homo sapiens
tgtggggactgagtggaggctt

SEQ ID NO: 7858607 - DNA, 17 bp, Homo sapiens
tgtggccttctgagctt

SEQ ID NO: 7858608 - DNA, 22 bp, Homo sapiens
tgtggggactttcaaagccaat

SEQ ID NO: 7858609 - DNA, 22 bp, Homo sapiens
tgtggcctgggagctgaggtct

SEQ ID NO: 7858610 - DNA, 22 bp, Homo sapiens
tgtggcctgggagctgaggtct

SEQ ID NO: 7858611 - DNA, 20 bp, Homo sapiens
tgtggcctctagagacagcc

SEQ ID NO: 7858612 - DNA, 22 bp, Homo sapiens
tgtggcctgattttgcatctct

SEQ ID NO: 7858613 - DNA, 22 bp, Homo sapiens
tgtggcctcctgttcctgggta

SEQ ID NO: 7858614 - DNA, 22 bp, Homo sapiens
tgtggcctctaagctcacgaag

SEQ ID NO: 7858615 - DNA, 20 bp, Homo sapiens
tgtggcctctagagacagcc

SEQ ID NO: 7858616 - DNA, 22 bp, Homo sapiens
tgtggcctcctgttcctgggta

SEQ ID NO: 7858617 - DNA, 22 bp, Homo sapiens
tgtggcctccccacttctgggg

SEQ ID NO: 7858618 - DNA, 22 bp, Homo sapiens
tgtggcctcaaggctgccctca

SEQ ID NO: 7858619 - DNA, 22 bp, Homo sapiens
tgtggtgccgagagtctggacg

SEQ ID NO: 7858620 - DNA, 22 bp, Homo sapiens
tgtggtgccgagagtctggacg

SEQ ID NO: 7858621 - DNA, 19 bp, Homo sapiens
tgtggtctctgttctcagg

SEQ ID NO: 7858622 - DNA, 22 bp, Homo sapiens
tgtggtctccccagtgccagct

SEQ ID NO: 7858623 - DNA, 22 bp, Homo sapiens
tgtgggtggcatcgtcctggcc

SEQ ID NO: 7858624 - DNA, 22 bp, Homo sapiens
tgtgggtggcatcgtcctggcc

SEQ ID NO: 7858625 - DNA, 19 bp, Homo sapiens
tgtggggagtcagggggct

SEQ ID NO: 7858626 - DNA, 22 bp, Homo sapiens
tgtgggtgttctcacttagata

SEQ ID NO: 7858627 - DNA, 22 bp, Homo sapiens
tgtggtagagggcagatgggca

SEQ ID NO: 7858628 - DNA, 22 bp, Homo sapiens
tgtggtagagggcagatgggca

SEQ ID NO: 7858629 - DNA, 22 bp, Homo sapiens
tgtggtcccaaggcaactggaa

SEQ ID NO: 7858630 - DNA, 22 bp, Homo sapiens
tgtggtcagctactggtcatct

SEQ ID NO: 7858631 - DNA, 22 bp, Homo sapiens
tgtgtacaaactaacaacatat

SEQ ID NO: 7858632 - DNA, 22 bp, Homo sapiens
tgtgtacaaactaacaacatat

SEQ ID NO: 7858633 - DNA, 22 bp, Homo sapiens
tgtgtacaaactaacaacatat

SEQ ID NO: 7858634 - DNA, 22 bp, Homo sapiens
tgtgtacaaactaacaacatat

SEQ ID NO: 7858635 - DNA, 22 bp, Homo sapiens
tgtgtcagcacagtatcaatta

SEQ ID NO: 7858636 - DNA, 22 bp, Homo sapiens
tgtgtcagatttaggctcaaac

SEQ ID NO: 7858637 - DNA, 19 bp, Homo sapiens
tgtgtcagatttgctcctt

SEQ ID NO: 7858638 - DNA, 20 bp, Homo sapiens
tgtgtcaggccctgattaaa

SEQ ID NO: 7858639 - DNA, 22 bp, Homo sapiens
tgtgtcaggagatagcaaaggg

SEQ ID NO: 7858640 - DNA, 19 bp, Homo sapiens
tgtgtcagcagggggcttc

SEQ ID NO: 7858641 - DNA, 22 bp, Homo sapiens
tgtgtcagcacagtatcaatta

SEQ ID NO: 7858642 - DNA, 22 bp, Homo sapiens
tgtgtcagcaggggagggaact

SEQ ID NO: 7858643 - DNA, 22 bp, Homo sapiens
tgtgtaaatttatttacataaa

SEQ ID NO: 7858644 - DNA, 21 bp, Homo sapiens
tgtgtaattggccaaatgcac

SEQ ID NO: 7858645 - DNA, 21 bp, Homo sapiens
tgtgtaatatgtataagaata

SEQ ID NO: 7858646 - DNA, 22 bp, Homo sapiens
tgtgtaaatggcatctctcagc

SEQ ID NO: 7858647 - DNA, 22 bp, Homo sapiens
tgtgtaaatggactgtgaatta

SEQ ID NO: 7858648 - DNA, 22 bp, Homo sapiens
tgtgtaaaatctgattaatact

SEQ ID NO: 7858649 - DNA, 22 bp, Homo sapiens
tgtgtaaagcttgttccagaaa

SEQ ID NO: 7858650 - DNA, 20 bp, Homo sapiens
tgtggtttttgccagttgaa

SEQ ID NO: 7858651 - DNA, 22 bp, Homo sapiens
tgtgtaaaagattagtttacta

SEQ ID NO: 7858652 - DNA, 22 bp, Homo sapiens
tgtgtaaaatctgattaatact

SEQ ID NO: 7858653 - DNA, 22 bp, Homo sapiens
tgtgtaaaatctgattaatact

SEQ ID NO: 7858654 - DNA, 22 bp, Homo sapiens
tgtggttggaatgcagccatgc

SEQ ID NO: 7858655 - DNA, 22 bp, Homo sapiens
tgtggttttggttcagaaacaa

SEQ ID NO: 7858656 - DNA, 22 bp, Homo sapiens
tgtggttttggttcagaaacaa

SEQ ID NO: 7858657 - DNA, 22 bp, Homo sapiens
tgtggtttttcagttgctggag

SEQ ID NO: 7858658 - DNA, 22 bp, Homo sapiens
tgtggtggtaatgagccagatg

SEQ ID NO: 7858659 - DNA, 22 bp, Homo sapiens
tgtggtgtatcaggaagccaat

SEQ ID NO: 7858660 - DNA, 22 bp, Homo sapiens
tgtggtggctattctggtctca

SEQ ID NO: 7858661 - DNA, 18 bp, Homo sapiens
tgtggtggagctgccttc

SEQ ID NO: 7858662 - DNA, 22 bp, Homo sapiens
tgtggtggctattctggtctca

SEQ ID NO: 7858663 - DNA, 22 bp, Homo sapiens
tgtggtggggtctggtattcca

SEQ ID NO: 7858664 - DNA, 22 bp, Homo sapiens
tgtttcatgaaacatgtttagg

SEQ ID NO: 7858665 - DNA, 22 bp, Homo sapiens
tgtttcatgaaacatgtttagg

SEQ ID NO: 7858666 - DNA, 22 bp, Homo sapiens
tgtttcatgaaacatgtttagg

SEQ ID NO: 7858667 - DNA, 20 bp, Homo sapiens
tgtttcataagctgtcctat

SEQ ID NO: 7858668 - DNA, 22 bp, Homo sapiens
tgtttcagtccctgtgttcaat

SEQ ID NO: 7858669 - DNA, 22 bp, Homo sapiens
tgtttcagtccctgtgttcaat

SEQ ID NO: 7858670 - DNA, 21 bp, Homo sapiens
tgtttcatgctattttcttgt

SEQ ID NO: 7858671 - DNA, 22 bp, Homo sapiens
tgtttcatgattgctgtcattt

SEQ ID NO: 7858672 - DNA, 22 bp, Homo sapiens
tgtttccatggtgacagcagct

SEQ ID NO: 7858673 - DNA, 22 bp, Homo sapiens
tgtttccctaaggtctggctct

SEQ ID NO: 7858674 - DNA, 22 bp, Homo sapiens
tgtttccctggaagaggagaga

SEQ ID NO: 7858675 - DNA, 22 bp, Homo sapiens
tgtttccccaaccccacaagta

SEQ ID NO: 7858676 - DNA, 22 bp, Homo sapiens
tgtttcattagtactgacaata

SEQ ID NO: 7858677 - DNA, 22 bp, Homo sapiens
tgtttccaaagtcttttcttaa

SEQ ID NO: 7858678 - DNA, 18 bp, Homo sapiens
tgtttccaaggaggaagt

SEQ ID NO: 7858679 - DNA, 22 bp, Homo sapiens
tgtttacatggaggttttcagc

SEQ ID NO: 7858680 - DNA, 22 bp, Homo sapiens
tgtttacatggaggttttcagc

SEQ ID NO: 7858681 - DNA, 22 bp, Homo sapiens
tgtttacatggaggttttcagc

SEQ ID NO: 7858682 - DNA, 19 bp, Homo sapiens
tgtttacatgtttcttcag

SEQ ID NO: 7858683 - DNA, 22 bp, Homo sapiens
tgtttactagccaacatggaga

SEQ ID NO: 7858684 - DNA, 22 bp, Homo sapiens
tgtttactagccaacatggaga

SEQ ID NO: 7858685 - DNA, 22 bp, Homo sapiens
tgtttactagccaacatggaga

SEQ ID NO: 7858686 - DNA, 22 bp, Homo sapiens
tgtttacatgcataagcttaag

SEQ ID NO: 7858687 - DNA, 22 bp, Homo sapiens
tgtttacatatttggtctcaga

SEQ ID NO: 7858688 - DNA, 22 bp, Homo sapiens
tgtttacatgcataagcttaag

SEQ ID NO: 7858689 - DNA, 22 bp, Homo sapiens
tgtttacatgcataagcttaag

SEQ ID NO: 7858690 - DNA, 22 bp, Homo sapiens
tgtttactatgatgtaacctat

SEQ ID NO: 7858691 - DNA, 22 bp, Homo sapiens
tgtttactatgatgtaacctat

SEQ ID NO: 7858692 - DNA, 22 bp, Homo sapiens
tgtttactagccaacatggaga

SEQ ID NO: 7858693 - DNA, 22 bp, Homo sapiens
tgtttactatgatgtaacctat

SEQ ID NO: 7858694 - DNA, 22 bp, Homo sapiens
tgtttactccagctgatggaac

SEQ ID NO: 7858695 - DNA, 22 bp, Homo sapiens
tgtttactcactgtatccacaa

SEQ ID NO: 7858696 - DNA, 22 bp, Homo sapiens
tgtttcaactgttaagatatgc

SEQ ID NO: 7858697 - DNA, 22 bp, Homo sapiens
tgtttactatgatgtaacctat

SEQ ID NO: 7858698 - DNA, 22 bp, Homo sapiens
tgtttcaagcaatagcatttca

SEQ ID NO: 7858699 - DNA, 22 bp, Homo sapiens
tgtttcaagcaatagcatttca

SEQ ID NO: 7858700 - DNA, 22 bp, Homo sapiens
tgtttcaactgttaagatatgc

SEQ ID NO: 7858701 - DNA, 22 bp, Homo sapiens
tgtttcaactgttaagatatgc

SEQ ID NO: 7858702 - DNA, 22 bp, Homo sapiens
tgtttcaagtttgctcaaagga

SEQ ID NO: 7858703 - DNA, 22 bp, Homo sapiens
tgtttcagagcactgggcttat

SEQ ID NO: 7858704 - DNA, 22 bp, Homo sapiens
tgtttcaggcttctgggatttt

SEQ ID NO: 7858705 - DNA, 22 bp, Homo sapiens
tgtttcaggcttctgggatttt

SEQ ID NO: 7858706 - DNA, 22 bp, Homo sapiens
tgtttcaggacctatcttttag

SEQ ID NO: 7858707 - DNA, 22 bp, Homo sapiens
tgtttgagttctagcgcattta

SEQ ID NO: 7858708 - DNA, 22 bp, Homo sapiens
tgtttgagttctagcgcattta

SEQ ID NO: 7858709 - DNA, 22 bp, Homo sapiens
tgtttgaattttgctaacgtgt

SEQ ID NO: 7858710 - DNA, 22 bp, Homo sapiens
tgtttgaataacttggatatat

SEQ ID NO: 7858711 - DNA, 22 bp, Homo sapiens
tgtttgaataacttggatatat

SEQ ID NO: 7858712 - DNA, 22 bp, Homo sapiens
tgtttgaagttcttctgtgact

SEQ ID NO: 7858713 - DNA, 22 bp, Homo sapiens
tgtttgaagttcttctgtgact

SEQ ID NO: 7858714 - DNA, 22 bp, Homo sapiens
tgtttgaagttcttctgtgact

SEQ ID NO: 7858715 - DNA, 22 bp, Homo sapiens
tgtttgaactgaataacatagt

SEQ ID NO: 7858716 - DNA, 22 bp, Homo sapiens
tgtttgaaactttgatcactaa

SEQ ID NO: 7858717 - DNA, 22 bp, Homo sapiens
tgtttgaaactttgatcactaa

SEQ ID NO: 7858718 - DNA, 22 bp, Homo sapiens
tgtttgaaagcacctacatttt

SEQ ID NO: 7858719 - DNA, 22 bp, Homo sapiens
tgttttctcttgaaaagcagtc

SEQ ID NO: 7858720 - DNA, 22 bp, Homo sapiens
tgttttctcttgaaaagcagtc

SEQ ID NO: 7858721 - DNA, 22 bp, Homo sapiens
tgttttctcttgaaaagcagtc

SEQ ID NO: 7858722 - DNA, 22 bp, Homo sapiens
tgttttctcttgaaaagcagtc

SEQ ID NO: 7858723 - DNA, 22 bp, Homo sapiens
tgttttcagtcatatagcaggt

SEQ ID NO: 7858724 - DNA, 22 bp, Homo sapiens
tgttttcagtcatatagcaggt

SEQ ID NO: 7858725 - DNA, 22 bp, Homo sapiens
tgttttcagtcatatagcaggt

SEQ ID NO: 7858726 - DNA, 22 bp, Homo sapiens
tgttttcacaatgatgtcagat

SEQ ID NO: 7858727 - DNA, 22 bp, Homo sapiens
tgttttcacaatgatgtcagat

SEQ ID NO: 7858728 - DNA, 22 bp, Homo sapiens
tgttttcacaatgatgtcagat

SEQ ID NO: 7858729 - DNA, 20 bp, Homo sapiens
tgtttcttttaatgagcggc

SEQ ID NO: 7858730 - DNA, 20 bp, Homo sapiens
tgtttctttaaggtgagaca

SEQ ID NO: 7858731 - DNA, 22 bp, Homo sapiens
tgtttcttgggtgctcacatca

SEQ ID NO: 7858732 - DNA, 22 bp, Homo sapiens
tgtttccttctgtctctttgga

SEQ ID NO: 7858733 - DNA, 22 bp, Homo sapiens
tgtttcctttctggtgagcata

SEQ ID NO: 7858734 - DNA, 23 bp, Homo sapiens
tgtttctagaatcattgatgtct

SEQ ID NO: 7858735 - DNA, 23 bp, Homo sapiens
tgtttctagaatcattgatgtct

SEQ ID NO: 7858736 - DNA, 23 bp, Homo sapiens
tgtttctagaatcattgatgtct

SEQ ID NO: 7858737 - DNA, 22 bp, Homo sapiens
tgtttcttgataaagcagaaaa

SEQ ID NO: 7858738 - DNA, 22 bp, Homo sapiens
tgtttcttgataaagcagaaaa

SEQ ID NO: 7858739 - DNA, 22 bp, Homo sapiens
tgtttcctaagtgtctctgaag

SEQ ID NO: 7858740 - DNA, 22 bp, Homo sapiens
tgtttcctaagtgtctctgaag

SEQ ID NO: 7858741 - DNA, 18 bp, Homo sapiens
tgtttcctcctggaggct

SEQ ID NO: 7858742 - DNA, 22 bp, Homo sapiens
tgtttccttctgtctctttgga

SEQ ID NO: 7858743 - DNA, 22 bp, Homo sapiens
tgtttccttctgtctctttgga

SEQ ID NO: 7858744 - DNA, 22 bp, Homo sapiens
tgtttaataattctatgatagt

SEQ ID NO: 7858745 - DNA, 22 bp, Homo sapiens
tgtttaataattctatgatagt

SEQ ID NO: 7858746 - DNA, 21 bp, Homo sapiens
tgtttaatacatatttgtgga

SEQ ID NO: 7858747 - DNA, 21 bp, Homo sapiens
tgtttaatacatatttgtgga

SEQ ID NO: 7858748 - DNA, 22 bp, Homo sapiens
tgtttaatctataaaatggaga

SEQ ID NO: 7858749 - DNA, 22 bp, Homo sapiens
tgtttaatctataaaatggaga

SEQ ID NO: 7858750 - DNA, 22 bp, Homo sapiens
tgtttaatctataaaatggaga

SEQ ID NO: 7858751 - DNA, 22 bp, Homo sapiens
tgtttaatcttcaggacagtct

SEQ ID NO: 7858752 - DNA, 22 bp, Homo sapiens
tgtttaatgaagatggtttttc

SEQ ID NO: 7858753 - DNA, 22 bp, Homo sapiens
tgtttaatcttcaggacagtct

SEQ ID NO: 7858754 - DNA, 22 bp, Homo sapiens
tgtttaattcaccatcatgttc

SEQ ID NO: 7858755 - DNA, 22 bp, Homo sapiens
tgtttaatgcattgaccttggg

SEQ ID NO: 7858756 - DNA, 22 bp, Homo sapiens
tgtttaattcaccatcatgttc

SEQ ID NO: 7858757 - DNA, 22 bp, Homo sapiens
tgtttaattcaccatcatgttc

SEQ ID NO: 7858758 - DNA, 22 bp, Homo sapiens
tgtttaattcaccatcatgttc

SEQ ID NO: 7858759 - DNA, 22 bp, Homo sapiens
tgtttaatttcacaaagttgac

SEQ ID NO: 7858760 - DNA, 22 bp, Homo sapiens
tgtttaatttttcatgagccaa

SEQ ID NO: 7858761 - DNA, 22 bp, Homo sapiens
tgtttaattgggccaacagcgg

SEQ ID NO: 7858762 - DNA, 22 bp, Homo sapiens
tgtttaatttcacaaagttgac

SEQ ID NO: 7858763 - DNA, 22 bp, Homo sapiens
tgtttacaaggagtttatattg

SEQ ID NO: 7858764 - DNA, 22 bp, Homo sapiens
tgtttacaaggagtttatattg

SEQ ID NO: 7858765 - DNA, 22 bp, Homo sapiens
tgtttacaaggagtttatattg

SEQ ID NO: 7858766 - DNA, 22 bp, Homo sapiens
tgtttacaaggagtttatattg

SEQ ID NO: 7858767 - DNA, 22 bp, Homo sapiens
tgtttacaaaaccgtggtactg

SEQ ID NO: 7858768 - DNA, 22 bp, Homo sapiens
tgtttacaaaaccgtggtactg

SEQ ID NO: 7858769 - DNA, 22 bp, Homo sapiens
tgtttacaagccacttgttaag

SEQ ID NO: 7858770 - DNA, 22 bp, Homo sapiens
tgtttacaagccacttgttaag

SEQ ID NO: 7858771 - DNA, 22 bp, Homo sapiens
tgtttacagctgatcaggcatc

SEQ ID NO: 7858772 - DNA, 22 bp, Homo sapiens
tgtttacagctgatcaggcatc

SEQ ID NO: 7858773 - DNA, 22 bp, Homo sapiens
tgtttacagggtgattttacct

SEQ ID NO: 7858774 - DNA, 22 bp, Homo sapiens
tgtttacagggtgattttacct

SEQ ID NO: 7858775 - DNA, 22 bp, Homo sapiens
tgtttacagggtgattttacct

SEQ ID NO: 7858776 - DNA, 22 bp, Homo sapiens
tgtttacagggtgattttacct

SEQ ID NO: 7858777 - DNA, 22 bp, Homo sapiens
tgtttacagtttttagtaccct

SEQ ID NO: 7858778 - DNA, 22 bp, Homo sapiens
tgtttacagtttttagtaccct

SEQ ID NO: 7858779 - DNA, 22 bp, Homo sapiens
tgtttacacttcaaggttaagg

SEQ ID NO: 7858780 - DNA, 22 bp, Homo sapiens
tgtttacagcactgcacactgc

SEQ ID NO: 7858781 - DNA, 22 bp, Homo sapiens
tgtttacagaaggcagacttcc

SEQ ID NO: 7858782 - DNA, 22 bp, Homo sapiens
tgttctcttttcctgctgagcc

SEQ ID NO: 7858783 - DNA, 22 bp, Homo sapiens
tgttctggagataagaggtaga

SEQ ID NO: 7858784 - DNA, 22 bp, Homo sapiens
tgttctggagataagaggtaga

SEQ ID NO: 7858785 - DNA, 17 bp, Homo sapiens
tgttctcttcagaaatc

SEQ ID NO: 7858786 - DNA, 22 bp, Homo sapiens
tgttctcttttcctgctgagcc

SEQ ID NO: 7858787 - DNA, 22 bp, Homo sapiens
tgttctggtgaggccatggggt

SEQ ID NO: 7858788 - DNA, 22 bp, Homo sapiens
tgttctggggttgagagacaat

SEQ ID NO: 7858789 - DNA, 22 bp, Homo sapiens
tgttctgtacctgtcctggggc

SEQ ID NO: 7858790 - DNA, 22 bp, Homo sapiens
tgttctgtacctgtcctggggc

SEQ ID NO: 7858791 - DNA, 22 bp, Homo sapiens
tgttctgtacctgtcctggggc

SEQ ID NO: 7858792 - DNA, 22 bp, Homo sapiens
tgttctggggttgagagacaat

SEQ ID NO: 7858793 - DNA, 22 bp, Homo sapiens
tgttctggggttgagagacaat

SEQ ID NO: 7858794 - DNA, 22 bp, Homo sapiens
tgttctggggttgagagacaat

SEQ ID NO: 7858795 - DNA, 22 bp, Homo sapiens
tgttctggggacagcgtcccat

SEQ ID NO: 7858796 - DNA, 22 bp, Homo sapiens
tgttctggctccttttaaatgt

SEQ ID NO: 7858797 - DNA, 22 bp, Homo sapiens
tgtttaagttctgctccttatt

SEQ ID NO: 7858798 - DNA, 22 bp, Homo sapiens
tgtttaagtgctggtagggttg

SEQ ID NO: 7858799 - DNA, 22 bp, Homo sapiens
tgtttaataattctatgatagt

SEQ ID NO: 7858800 - DNA, 21 bp, Homo sapiens
tgtttaagtactcctttctgg

SEQ ID NO: 7858801 - DNA, 22 bp, Homo sapiens
tgtttaagtagtctcagggcct

SEQ ID NO: 7858802 - DNA, 22 bp, Homo sapiens
tgtttaagtagtctcagggcct

SEQ ID NO: 7858803 - DNA, 22 bp, Homo sapiens
tgttctgtgcatctagccagta

SEQ ID NO: 7858804 - DNA, 22 bp, Homo sapiens
tgttctgtgcatctagccagta

SEQ ID NO: 7858805 - DNA, 20 bp, Homo sapiens
tgttctgtcgtctttcttca

SEQ ID NO: 7858806 - DNA, 20 bp, Homo sapiens
tgttctgtcgtctttcttca

SEQ ID NO: 7858807 - DNA, 22 bp, Homo sapiens
tgttctctaagaaaagaagcat

SEQ ID NO: 7858808 - DNA, 22 bp, Homo sapiens
tgttctctctccttttgaagtg

SEQ ID NO: 7858809 - DNA, 22 bp, Homo sapiens
tgttctctaagaaaagaagcat

SEQ ID NO: 7858810 - DNA, 22 bp, Homo sapiens
tgttctcatctggatctcagga

SEQ ID NO: 7858811 - DNA, 22 bp, Homo sapiens
tgttctcagtaattctatttta

SEQ ID NO: 7858812 - DNA, 22 bp, Homo sapiens
tgttctcactggatgcttcaca

SEQ ID NO: 7858813 - DNA, 22 bp, Homo sapiens
tgttctcatctggatctcagga

SEQ ID NO: 7858814 - DNA, 22 bp, Homo sapiens
tgttctcatctggatctcagga

SEQ ID NO: 7858815 - DNA, 22 bp, Homo sapiens
tgttctcactggatgcttcaca

SEQ ID NO: 7858816 - DNA, 22 bp, Homo sapiens
tgttctcactggatgcttcaca

SEQ ID NO: 7858817 - DNA, 22 bp, Homo sapiens
tgttctcactggatgcttcaca

SEQ ID NO: 7858818 - DNA, 22 bp, Homo sapiens
tgttctcactggatgcttcaca

SEQ ID NO: 7858819 - DNA, 19 bp, Homo sapiens
tgttctagcggcaccaggc

SEQ ID NO: 7858820 - DNA, 19 bp, Homo sapiens
tgttctagcggcaccaggc

SEQ ID NO: 7858821 - DNA, 22 bp, Homo sapiens
tgttctaagctgccaaaatgct

SEQ ID NO: 7858822 - DNA, 22 bp, Homo sapiens
tgttctaggcaaaagctgattt

SEQ ID NO: 7858823 - DNA, 22 bp, Homo sapiens
tgttctaagtgttttgttcatg

SEQ ID NO: 7858824 - DNA, 22 bp, Homo sapiens
tgttcgattagatcatgatgac

SEQ ID NO: 7858825 - DNA, 22 bp, Homo sapiens
tgttccttttactgcatgcgta

SEQ ID NO: 7858826 - DNA, 22 bp, Homo sapiens
tgttccttctggcttttacatc

SEQ ID NO: 7858827 - DNA, 23 bp, Homo sapiens
tgttcctgtcaaattttcttccc

SEQ ID NO: 7858828 - DNA, 21 bp, Homo sapiens
tgttcctgttctctaggatcc

SEQ ID NO: 7858829 - DNA, 21 bp, Homo sapiens
tgttcctgttctctaggatcc

SEQ ID NO: 7858830 - DNA, 21 bp, Homo sapiens
tgttcctgttctctaggatcc

SEQ ID NO: 7858831 - DNA, 22 bp, Homo sapiens
tgttccttcacagcagtggaca

SEQ ID NO: 7858832 - DNA, 22 bp, Homo sapiens
tgttcagaacaaaggtaaatga

SEQ ID NO: 7858833 - DNA, 22 bp, Homo sapiens
tgttcctaaatatgaatggaga

SEQ ID NO: 7858834 - DNA, 22 bp, Homo sapiens
tgttcctgaatgcctggctggc

SEQ ID NO: 7858835 - DNA, 22 bp, Homo sapiens
tgttccctggtaaactgactcc

SEQ ID NO: 7858836 - DNA, 22 bp, Homo sapiens
tgttcccatggatatctgcata

SEQ ID NO: 7858837 - DNA, 22 bp, Homo sapiens
tgttcactggaacacagctgta

SEQ ID NO: 7858838 - DNA, 22 bp, Homo sapiens
tgttcagaaaacagataactaa

SEQ ID NO: 7858839 - DNA, 22 bp, Homo sapiens
tgttcactggaacacagctgta

SEQ ID NO: 7858840 - DNA, 22 bp, Homo sapiens
tgttcactccatgggaattgtg

SEQ ID NO: 7858841 - DNA, 22 bp, Homo sapiens
tgttcacttatgttctcccatt

SEQ ID NO: 7858842 - DNA, 22 bp, Homo sapiens
tgttcactggaacacagctgta

SEQ ID NO: 7858843 - DNA, 20 bp, Homo sapiens
tgttcagaaatgcagagagg

SEQ ID NO: 7858844 - DNA, 22 bp, Homo sapiens
tgttcagaacaaaggtaaatga

SEQ ID NO: 7858845 - DNA, 22 bp, Homo sapiens
tgttcagaacaaaggtaaatga

SEQ ID NO: 7858846 - DNA, 22 bp, Homo sapiens
tgttcctgaggcatgtgtcaat

SEQ ID NO: 7858847 - DNA, 21 bp, Homo sapiens
tgttcctgccccaatccttgg

SEQ ID NO: 7858848 - DNA, 22 bp, Homo sapiens
tgttcctgaggcatgtgtcaat

SEQ ID NO: 7858849 - DNA, 22 bp, Homo sapiens
tgttcctgacggccaaagaggt

SEQ ID NO: 7858850 - DNA, 22 bp, Homo sapiens
tgttcctgaatgcctggctggc

SEQ ID NO: 7858851 - DNA, 22 bp, Homo sapiens
tgttcctgaatgcctggctggc

SEQ ID NO: 7858852 - DNA, 22 bp, Homo sapiens
tgttcctggttcctgcatgatg

SEQ ID NO: 7858853 - DNA, 22 bp, Homo sapiens
tgttcctgtactgctgtggctt

SEQ ID NO: 7858854 - DNA, 22 bp, Homo sapiens
tgttcctggttcctgcatgatg

SEQ ID NO: 7858855 - DNA, 22 bp, Homo sapiens
tgttcctggtgagccatttttt

SEQ ID NO: 7858856 - DNA, 22 bp, Homo sapiens
tgttcctggttcctgcatgatg

SEQ ID NO: 7858857 - DNA, 22 bp, Homo sapiens
tgttcctgctatggtttgttgc

SEQ ID NO: 7858858 - DNA, 22 bp, Homo sapiens
tgttcctggaaagccaggtggg

SEQ ID NO: 7858859 - DNA, 22 bp, Homo sapiens
tgttcctggttcctgcatgatg

SEQ ID NO: 7858860 - DNA, 22 bp, Homo sapiens
tgttatttgggaaagttgtaca

SEQ ID NO: 7858861 - DNA, 22 bp, Homo sapiens
tgttatttgggaaagttgtaca

SEQ ID NO: 7858862 - DNA, 22 bp, Homo sapiens
tgttatttgggaaagttgtaca

SEQ ID NO: 7858863 - DNA, 22 bp, Homo sapiens
tgttatttgggaaagttgtaca

SEQ ID NO: 7858864 - DNA, 22 bp, Homo sapiens
tgttcaaaaatatcttctgcaa

SEQ ID NO: 7858865 - DNA, 21 bp, Homo sapiens
tgttcaaacgtacacatttct

SEQ ID NO: 7858866 - DNA, 21 bp, Homo sapiens
tgttcaaacgtacacatttct

SEQ ID NO: 7858867 - DNA, 22 bp, Homo sapiens
tgttcaaatcttttgcttattt

SEQ ID NO: 7858868 - DNA, 22 bp, Homo sapiens
tgttcaaatcttttgcttattt

SEQ ID NO: 7858869 - DNA, 22 bp, Homo sapiens
tgttcaagtggatgtggctttt

SEQ ID NO: 7858870 - DNA, 22 bp, Homo sapiens
tgttcaaatcttttgcttattt

SEQ ID NO: 7858871 - DNA, 20 bp, Homo sapiens
tgttcacagtagttgctgct

SEQ ID NO: 7858872 - DNA, 22 bp, Homo sapiens
tgttcacaggggagccatttat

SEQ ID NO: 7858873 - DNA, 22 bp, Homo sapiens
tgttcacatgtacatgaatatt

SEQ ID NO: 7858874 - DNA, 22 bp, Homo sapiens
tgttcacatgtacatgaatatt

SEQ ID NO: 7858875 - DNA, 21 bp, Homo sapiens
tgttcacatggagcagaatgt

SEQ ID NO: 7858876 - DNA, 22 bp, Homo sapiens
tgttcacaagatgtctgtggct

SEQ ID NO: 7858877 - DNA, 22 bp, Homo sapiens
tgttcacaacgtgcaggtttgt

SEQ ID NO: 7858878 - DNA, 22 bp, Homo sapiens
tgttcacacacggaggccacag

SEQ ID NO: 7858879 - DNA, 22 bp, Homo sapiens
tgttcacacacggaggccacag

SEQ ID NO: 7858880 - DNA, 22 bp, Homo sapiens
tgttcacacacggaggccacag

SEQ ID NO: 7858881 - DNA, 22 bp, Homo sapiens
tgttatcctcagctcacctcta

SEQ ID NO: 7858882 - DNA, 22 bp, Homo sapiens
tgttatcctcagctcacctcta

SEQ ID NO: 7858883 - DNA, 22 bp, Homo sapiens
tgttatcagagagaggtgctgt

SEQ ID NO: 7858884 - DNA, 22 bp, Homo sapiens
tgttatcacttgtaaaagcaat

SEQ ID NO: 7858885 - DNA, 22 bp, Homo sapiens
tgttatcacttagacatgctag

SEQ ID NO: 7858886 - DNA, 22 bp, Homo sapiens
tgttatcacttagacatgctag

SEQ ID NO: 7858887 - DNA, 22 bp, Homo sapiens
tgttatactatttagaggtaca

SEQ ID NO: 7858888 - DNA, 22 bp, Homo sapiens
tgttaaaaatgcagattcctat

SEQ ID NO: 7858889 - DNA, 22 bp, Homo sapiens
tgttagttgttcatgttaagag

SEQ ID NO: 7858890 - DNA, 22 bp, Homo sapiens
tgttaaaaatgcagattcctat

SEQ ID NO: 7858891 - DNA, 22 bp, Homo sapiens
tgttaaaaatgcagattcctat

SEQ ID NO: 7858892 - DNA, 22 bp, Homo sapiens
tgttatctggttgtctgattac

SEQ ID NO: 7858893 - DNA, 22 bp, Homo sapiens
tgttatctggttgtctgattac

SEQ ID NO: 7858894 - DNA, 22 bp, Homo sapiens
tgttatgaacttctagaaaaca

SEQ ID NO: 7858895 - DNA, 22 bp, Homo sapiens
tgttattaaataattctctctt

SEQ ID NO: 7858896 - DNA, 22 bp, Homo sapiens
tgttattaaataattctctctt

SEQ ID NO: 7858897 - DNA, 22 bp, Homo sapiens
tgttatgagtcctcatatacta

SEQ ID NO: 7858898 - DNA, 22 bp, Homo sapiens
tgttatgagtcctcatatacta

SEQ ID NO: 7858899 - DNA, 22 bp, Homo sapiens
tgttatgagtcctcatatacta

SEQ ID NO: 7858900 - DNA, 22 bp, Homo sapiens
tgttatttatctgagcatttat

SEQ ID NO: 7858901 - DNA, 22 bp, Homo sapiens
tgttatttatctgagcatttat

SEQ ID NO: 7858902 - DNA, 22 bp, Homo sapiens
tgttatttatttcacctccaga

SEQ ID NO: 7858903 - DNA, 22 bp, Homo sapiens
tgttatttatttcacctccaga

SEQ ID NO: 7858904 - DNA, 22 bp, Homo sapiens
tgttatttatctgagcatttat

SEQ ID NO: 7858905 - DNA, 22 bp, Homo sapiens
tgttatttatctgagcatttat

SEQ ID NO: 7858906 - DNA, 22 bp, Homo sapiens
tgttatttatctgagcatttat

SEQ ID NO: 7858907 - DNA, 22 bp, Homo sapiens
tgttatttatctgagcatttat

SEQ ID NO: 7858908 - DNA, 22 bp, Homo sapiens
tgttatttatctgagcatttat

SEQ ID NO: 7858909 - DNA, 22 bp, Homo sapiens
tgttatttctttgccatatctt

SEQ ID NO: 7858910 - DNA, 22 bp, Homo sapiens
tgttatttctttgccatatctt

SEQ ID NO: 7858911 - DNA, 22 bp, Homo sapiens
tgttatttctttgccatatctt

SEQ ID NO: 7858912 - DNA, 22 bp, Homo sapiens
tgttatttctttgccatatctt

SEQ ID NO: 7858913 - DNA, 22 bp, Homo sapiens
tgttatttgggaaagttgtaca

SEQ ID NO: 7858914 - DNA, 22 bp, Homo sapiens
tgttatttgggaaagttgtaca

SEQ ID NO: 7858915 - DNA, 22 bp, Homo sapiens
tgttatttgggaaagttgtaca

SEQ ID NO: 7858916 - DNA, 20 bp, Homo sapiens
tgttattagcaagcttcttt

SEQ ID NO: 7858917 - DNA, 22 bp, Homo sapiens
tgttattatctgttaggtgttc

SEQ ID NO: 7858918 - DNA, 23 bp, Homo sapiens
tgttattccaggttaatgtactt

SEQ ID NO: 7858919 - DNA, 23 bp, Homo sapiens
tgttattccaggttaatgtactt

SEQ ID NO: 7858920 - DNA, 23 bp, Homo sapiens
tgttattccaggttaatgtactt

SEQ ID NO: 7858921 - DNA, 22 bp, Homo sapiens
tgttattgaggttacttataag

SEQ ID NO: 7858922 - DNA, 22 bp, Homo sapiens
tgttattgggtcccaactaggt

SEQ ID NO: 7858923 - DNA, 22 bp, Homo sapiens
tgttattgtcgctgcactggga

SEQ ID NO: 7858924 - DNA, 22 bp, Homo sapiens
tgttattgtcgctgcactggga

SEQ ID NO: 7858925 - DNA, 22 bp, Homo sapiens
tgttatttatctgagcatttat

SEQ ID NO: 7858926 - DNA, 22 bp, Homo sapiens
tgttatttatctgagcatttat

SEQ ID NO: 7858927 - DNA, 22 bp, Homo sapiens
tgttattgtcgctgcactggga

SEQ ID NO: 7858928 - DNA, 22 bp, Homo sapiens
tgtgttttaaatggaaatttga

SEQ ID NO: 7858929 - DNA, 22 bp, Homo sapiens
tgtgtttgggggagatgcattt

SEQ ID NO: 7858930 - DNA, 22 bp, Homo sapiens
tgtgtttgcaatgggaatgaga

SEQ ID NO: 7858931 - DNA, 22 bp, Homo sapiens
tgtgtttgcaatgggaatgaga

SEQ ID NO: 7858932 - DNA, 22 bp, Homo sapiens
tgtgtttgggggagatgcattt

SEQ ID NO: 7858933 - DNA, 22 bp, Homo sapiens
tgtgttttacaaattctcttaa

SEQ ID NO: 7858934 - DNA, 22 bp, Homo sapiens
tgtgttttacaaattctcttaa

SEQ ID NO: 7858935 - DNA, 22 bp, Homo sapiens
tgtgttttaaatggaaatttga

SEQ ID NO: 7858936 - DNA, 21 bp, Homo sapiens
tgtgttttaatgatattctgt

SEQ ID NO: 7858937 - DNA, 21 bp, Homo sapiens
tgtgttttaatgatattctgt

SEQ ID NO: 7858938 - DNA, 20 bp, Homo sapiens
tgtgttttgcagggcattta

SEQ ID NO: 7858939 - DNA, 22 bp, Homo sapiens
tgtgttttgaactcatctactg

SEQ ID NO: 7858940 - DNA, 22 bp, Homo sapiens
tgtgttttggaaggaacatgca

SEQ ID NO: 7858941 - DNA, 22 bp, Homo sapiens
tgtgttttgtgtgacccagctc

SEQ ID NO: 7858942 - DNA, 22 bp, Homo sapiens
tgtgttttggaaggaacatgca

SEQ ID NO: 7858943 - DNA, 22 bp, Homo sapiens
tgtgttttggaaggaacatgca

SEQ ID NO: 7858944 - DNA, 22 bp, Homo sapiens
tgtgttttggaaggaacatgca

SEQ ID NO: 7858945 - DNA, 22 bp, Homo sapiens
tgtgttttatctattgtatctt

SEQ ID NO: 7858946 - DNA, 22 bp, Homo sapiens
tgtgttttatctattgtatctt

SEQ ID NO: 7858947 - DNA, 22 bp, Homo sapiens
tgtgttttccagaatggtgttt

SEQ ID NO: 7858948 - DNA, 22 bp, Homo sapiens
tgtgttttccagaatggtgttt

SEQ ID NO: 7858949 - DNA, 22 bp, Homo sapiens
tgtgttttccagaatggtgttt

SEQ ID NO: 7858950 - DNA, 21 bp, Homo sapiens
tgtgttttctctctgggaggt

SEQ ID NO: 7858951 - DNA, 22 bp, Homo sapiens
tgtgttttcctccctggcgttt

SEQ ID NO: 7858952 - DNA, 22 bp, Homo sapiens
tgtgtttagagagcacattcag

SEQ ID NO: 7858953 - DNA, 22 bp, Homo sapiens
tgtgtttacttctatgcagttt

SEQ ID NO: 7858954 - DNA, 23 bp, Homo sapiens
tgtgtttacctgaggatcttgtt

SEQ ID NO: 7858955 - DNA, 22 bp, Homo sapiens
tgtgtttaaagaggaagtgaga

SEQ ID NO: 7858956 - DNA, 22 bp, Homo sapiens
tgtgtttacttctatgcagttt

SEQ ID NO: 7858957 - DNA, 22 bp, Homo sapiens
tgtgttgttttaagctgctgca

SEQ ID NO: 7858958 - DNA, 22 bp, Homo sapiens
tgtgttgtgacattcttggatg

SEQ ID NO: 7858959 - DNA, 22 bp, Homo sapiens
tgtgtttaaagaggaagtgaga

SEQ ID NO: 7858960 - DNA, 22 bp, Homo sapiens
tgtgtttgagtcctcacagtgc

SEQ ID NO: 7858961 - DNA, 22 bp, Homo sapiens
tgtgtttgaggcatgttgcaga

SEQ ID NO: 7858962 - DNA, 22 bp, Homo sapiens
tgtgtttgaggcatgttgcaga

SEQ ID NO: 7858963 - DNA, 21 bp, Homo sapiens
tgtgtttgagactatgtttcc

SEQ ID NO: 7858964 - DNA, 22 bp, Homo sapiens
tgtgtttctgagaatcccacct

SEQ ID NO: 7858965 - DNA, 21 bp, Homo sapiens
tgtgtttgagactatgtttcc

SEQ ID NO: 7858966 - DNA, 22 bp, Homo sapiens
tgtgtttctctgaggggtccct

SEQ ID NO: 7858967 - DNA, 22 bp, Homo sapiens
tgtgtttcagaaccttctttca

SEQ ID NO: 7858968 - DNA, 22 bp, Homo sapiens
tgtgttcaatcaccaaaggtat

SEQ ID NO: 7858969 - DNA, 22 bp, Homo sapiens
tgtgttcaatcaccaaaggtat

SEQ ID NO: 7858970 - DNA, 22 bp, Homo sapiens
tgtgttcaatcaccaaaggtat

SEQ ID NO: 7858971 - DNA, 22 bp, Homo sapiens
tgtgttcaagattagttctagt

SEQ ID NO: 7858972 - DNA, 22 bp, Homo sapiens
tgtgttctgaaggagaagagtg

SEQ ID NO: 7858973 - DNA, 22 bp, Homo sapiens
tgtgttctggaaagctcactga

SEQ ID NO: 7858974 - DNA, 22 bp, Homo sapiens
tgtgttctggaaagctcactga

SEQ ID NO: 7858975 - DNA, 22 bp, Homo sapiens
tgtgttaatttattgcctcaga

SEQ ID NO: 7858976 - DNA, 22 bp, Homo sapiens
tgtgttaattttccctttctct

SEQ ID NO: 7858977 - DNA, 22 bp, Homo sapiens
tgtgttattgccactgaagacc

SEQ ID NO: 7858978 - DNA, 22 bp, Homo sapiens
tgtgttatgtgggccagggcaa

SEQ ID NO: 7858979 - DNA, 22 bp, Homo sapiens
tgtgttaattttccctttctct

SEQ ID NO: 7858980 - DNA, 21 bp, Homo sapiens
tgtgttcttctaggtcagcta

SEQ ID NO: 7858981 - DNA, 22 bp, Homo sapiens
tgtgttcttaaaagcagtgata

SEQ ID NO: 7858982 - DNA, 22 bp, Homo sapiens
tgtgttcttaaaagcagtgata

SEQ ID NO: 7858983 - DNA, 22 bp, Homo sapiens
tgtgttcttaaaagcagtgata

SEQ ID NO: 7858984 - DNA, 22 bp, Homo sapiens
tgtgttctggctgtgacagctg

SEQ ID NO: 7858985 - DNA, 22 bp, Homo sapiens
tgtgttctggctgtgacagctg

SEQ ID NO: 7858986 - DNA, 22 bp, Homo sapiens
tgtgttctggaaagctcactga

SEQ ID NO: 7858987 - DNA, 21 bp, Homo sapiens
tgtgttcttctaggtcagcta

SEQ ID NO: 7858988 - DNA, 22 bp, Homo sapiens
tgtgttggctgccggcacagga

SEQ ID NO: 7858989 - DNA, 22 bp, Homo sapiens
tgtgttggcttgcctgttaggc

SEQ ID NO: 7858990 - DNA, 22 bp, Homo sapiens
tgtgttggtagatctgaggtct

SEQ ID NO: 7858991 - DNA, 22 bp, Homo sapiens
tgtgttgtgacattcttggatg

SEQ ID NO: 7858992 - DNA, 22 bp, Homo sapiens
tgtgttgtgacattcttggatg

SEQ ID NO: 7858993 - DNA, 22 bp, Homo sapiens
tgtgtgcacaggagtgtttgaa

SEQ ID NO: 7858994 - DNA, 22 bp, Homo sapiens
tgtgtgcaattcttaacataca

SEQ ID NO: 7858995 - DNA, 22 bp, Homo sapiens
tgtgtgcacaaagagtacatgg

SEQ ID NO: 7858996 - DNA, 22 bp, Homo sapiens
tgtgtgcacaaagagtacatgg

SEQ ID NO: 7858997 - DNA, 20 bp, Homo sapiens
tgtgtgcacacatgacattc

SEQ ID NO: 7858998 - DNA, 20 bp, Homo sapiens
tgtgtgcacacatgacattc

SEQ ID NO: 7858999 - DNA, 20 bp, Homo sapiens
tgtgtgcacacatgacattc

SEQ ID NO: 7859000 - DNA, 22 bp, Homo sapiens
tgtgtgcacttaatgcaatcat

SEQ ID NO: 7859001 - DNA, 22 bp, Homo sapiens
tgtgtgcactgccttttgtgga

SEQ ID NO: 7859002 - DNA, 22 bp, Homo sapiens
tgtgtgcacgctgggagctgga

SEQ ID NO: 7859003 - DNA, 22 bp, Homo sapiens
tgtgtgcacatgatttgaaatg

SEQ ID NO: 7859004 - DNA, 21 bp, Homo sapiens
tgtgtgcatatgcatgtacat

SEQ ID NO: 7859005 - DNA, 20 bp, Homo sapiens
tgtgtgcatctgtatgtatt

SEQ ID NO: 7859006 - DNA, 20 bp, Homo sapiens
tgtgtgcatctgtatgtatt

SEQ ID NO: 7859007 - DNA, 22 bp, Homo sapiens
tgtgtgcaggcactgtgccaga

SEQ ID NO: 7859008 - DNA, 22 bp, Homo sapiens
tgtgtgcagcctctgtctttgg

SEQ ID NO: 7859009 - DNA, 22 bp, Homo sapiens
tgtgtgcagacagatattactt

SEQ ID NO: 7859010 - DNA, 22 bp, Homo sapiens
tgtgtgcaggcactgtgccaga

SEQ ID NO: 7859011 - DNA, 22 bp, Homo sapiens
tgtgtgcagcggcaggtgaagt

SEQ ID NO: 7859012 - DNA, 20 bp, Homo sapiens
ttagaaagagcgtgataaga

SEQ ID NO: 7859013 - DNA, 21 bp, Homo sapiens
ttagaaagctcactacagtta

SEQ ID NO: 7859014 - DNA, 22 bp, Homo sapiens
ttagaaagagtataccagaaac

SEQ ID NO: 7859015 - DNA, 21 bp, Homo sapiens
ttagaaagctcactacagtta

SEQ ID NO: 7859016 - DNA, 22 bp, Homo sapiens
ttagaaagaactttagatatca

SEQ ID NO: 7859017 - DNA, 22 bp, Homo sapiens
ttagaaagaactttagatatca

SEQ ID NO: 7859018 - DNA, 22 bp, Homo sapiens
ttagaaagaactttagatatca

SEQ ID NO: 7859019 - DNA, 22 bp, Homo sapiens
ttagaaagaactttagatatca

SEQ ID NO: 7859020 - DNA, 22 bp, Homo sapiens
ttagaaactttggaggatagat

SEQ ID NO: 7859021 - DNA, 22 bp, Homo sapiens
ttagaaactttggaggatagat

SEQ ID NO: 7859022 - DNA, 22 bp, Homo sapiens
ttagaaaatttgcttctttgga

SEQ ID NO: 7859023 - DNA, 22 bp, Homo sapiens
ttactttgtttgcacttcacct

SEQ ID NO: 7859024 - DNA, 22 bp, Homo sapiens
ttactttgtttgcacttcacct

SEQ ID NO: 7859025 - DNA, 22 bp, Homo sapiens
ttacttttctattcgatatgtg

SEQ ID NO: 7859026 - DNA, 19 bp, Homo sapiens
ttagaaactgttgacactg

SEQ ID NO: 7859027 - DNA, 22 bp, Homo sapiens
ttagaaactttggaggatagat

SEQ ID NO: 7859028 - DNA, 22 bp, Homo sapiens
ttagaaactcaactctgggaat

SEQ ID NO: 7859029 - DNA, 22 bp, Homo sapiens
ttagaaactcaactctgggaat

SEQ ID NO: 7859030 - DNA, 19 bp, Homo sapiens
ttagaaactgttgacactg

SEQ ID NO: 7859031 - DNA, 19 bp, Homo sapiens
ttagaaactgttgacactg

SEQ ID NO: 7859032 - DNA, 22 bp, Homo sapiens
ttagaaacaaaatagttatttg

SEQ ID NO: 7859033 - DNA, 22 bp, Homo sapiens
ttagaaacaaaatagttatttg

SEQ ID NO: 7859034 - DNA, 22 bp, Homo sapiens
ttagaaacaaaatagttatttg

SEQ ID NO: 7859035 - DNA, 22 bp, Homo sapiens
ttagaaacccagactcttaggt

SEQ ID NO: 7859036 - DNA, 22 bp, Homo sapiens
ttagaaacccagactcttaggt

SEQ ID NO: 7859037 - DNA, 22 bp, Homo sapiens
ttactttggatggtcaagaaag

SEQ ID NO: 7859038 - DNA, 22 bp, Homo sapiens
ttactttgctttctcattacag

SEQ ID NO: 7859039 - DNA, 22 bp, Homo sapiens
ttactttggcaaactcctgccc

SEQ ID NO: 7859040 - DNA, 22 bp, Homo sapiens
ttactttgcatttgtggtagtc

SEQ ID NO: 7859041 - DNA, 22 bp, Homo sapiens
ttactttgcagatgtgtatgtc

SEQ ID NO: 7859042 - DNA, 22 bp, Homo sapiens
ttactttgaatgtcacaagcaa

SEQ ID NO: 7859043 - DNA, 22 bp, Homo sapiens
ttactttgccttttagtgtagg

SEQ ID NO: 7859044 - DNA, 18 bp, Homo sapiens
ttactttgtatagcctag

SEQ ID NO: 7859045 - DNA, 18 bp, Homo sapiens
ttactttgtatagcctag

SEQ ID NO: 7859046 - DNA, 22 bp, Homo sapiens
ttactttgttctcaagatatgt

SEQ ID NO: 7859047 - DNA, 22 bp, Homo sapiens
ttactttgggtcctgcttataa

SEQ ID NO: 7859048 - DNA, 22 bp, Homo sapiens
ttactttgggtcctgcttataa

SEQ ID NO: 7859049 - DNA, 22 bp, Homo sapiens
ttactttgggtcctgcttataa

SEQ ID NO: 7859050 - DNA, 22 bp, Homo sapiens
ttactttgggtcctgcttataa

SEQ ID NO: 7859051 - DNA, 22 bp, Homo sapiens
ttactttcaaaaactacgtggg

SEQ ID NO: 7859052 - DNA, 22 bp, Homo sapiens
ttactttatgtgatggattagt

SEQ ID NO: 7859053 - DNA, 22 bp, Homo sapiens
ttactttccagctctagcttca

SEQ ID NO: 7859054 - DNA, 22 bp, Homo sapiens
ttactttccagctctagcttca

SEQ ID NO: 7859055 - DNA, 22 bp, Homo sapiens
ttactttgatgatcaatgagcg

SEQ ID NO: 7859056 - DNA, 22 bp, Homo sapiens
ttactttgatgatcaatgagcg

SEQ ID NO: 7859057 - DNA, 22 bp, Homo sapiens
ttactttgatgatcaatgagcg

SEQ ID NO: 7859058 - DNA, 22 bp, Homo sapiens
ttactttatgtgatggattagt

SEQ ID NO: 7859059 - DNA, 22 bp, Homo sapiens
ttactttatagaacactggggg

SEQ ID NO: 7859060 - DNA, 22 bp, Homo sapiens
ttactttatctcctagattcca

SEQ ID NO: 7859061 - DNA, 22 bp, Homo sapiens
ttagagaagctgtaattattca

SEQ ID NO: 7859062 - DNA, 22 bp, Homo sapiens
ttagagaaagggtttgattccg

SEQ ID NO: 7859063 - DNA, 22 bp, Homo sapiens
ttagagaaatgggtactgcata

SEQ ID NO: 7859064 - DNA, 22 bp, Homo sapiens
ttagagaaatgggtactgcata

SEQ ID NO: 7859065 - DNA, 22 bp, Homo sapiens
ttagagaaccaatgaatagtct

SEQ ID NO: 7859066 - DNA, 22 bp, Homo sapiens
ttagagaaccaatgaatagtct

SEQ ID NO: 7859067 - DNA, 22 bp, Homo sapiens
ttagacatgtttgctaaaatga

SEQ ID NO: 7859068 - DNA, 22 bp, Homo sapiens
ttagacatgtttgctaaaatga

SEQ ID NO: 7859069 - DNA, 22 bp, Homo sapiens
ttagacatgatggtgcagagag

SEQ ID NO: 7859070 - DNA, 22 bp, Homo sapiens
ttagacatcagtgcttctcagc

SEQ ID NO: 7859071 - DNA, 22 bp, Homo sapiens
ttagacatcagtgcttctcagc

SEQ ID NO: 7859072 - DNA, 22 bp, Homo sapiens
ttagagaaaagcttgcttgctt

SEQ ID NO: 7859073 - DNA, 22 bp, Homo sapiens
ttagactttaagctgggtgcag

SEQ ID NO: 7859074 - DNA, 22 bp, Homo sapiens
ttagacatgtttgctaaaatga

SEQ ID NO: 7859075 - DNA, 22 bp, Homo sapiens
ttagaaagctttccatagtcaa

SEQ ID NO: 7859076 - DNA, 22 bp, Homo sapiens
ttagaaagctttccatagtcaa

SEQ ID NO: 7859077 - DNA, 22 bp, Homo sapiens
ttagaaagctttccatagtcaa

SEQ ID NO: 7859078 - DNA, 22 bp, Homo sapiens
ttagaaagctttccatagtcaa

SEQ ID NO: 7859079 - DNA, 22 bp, Homo sapiens
ttagaagccaggatggagcagg

SEQ ID NO: 7859080 - DNA, 22 bp, Homo sapiens
ttagaagccaggatggagcagg

SEQ ID NO: 7859081 - DNA, 21 bp, Homo sapiens
ttagaagctaatgcagctggt

SEQ ID NO: 7859082 - DNA, 21 bp, Homo sapiens
ttagaagctaatgcagctggt

SEQ ID NO: 7859083 - DNA, 19 bp, Homo sapiens
ttagaagccataggtacag

SEQ ID NO: 7859084 - DNA, 21 bp, Homo sapiens
ttagaagctaatgcagctggt

SEQ ID NO: 7859085 - DNA, 20 bp, Homo sapiens
ttagaagggccagatgaagg

SEQ ID NO: 7859086 - DNA, 22 bp, Homo sapiens
ttagacatagaatattgtctag

SEQ ID NO: 7859087 - DNA, 22 bp, Homo sapiens
ttagagaagctgtaattattca

SEQ ID NO: 7859088 - DNA, 22 bp, Homo sapiens
ttagagaagttttacttaagaa

SEQ ID NO: 7859089 - DNA, 22 bp, Homo sapiens
ttagagacaggcttcccaagga

SEQ ID NO: 7859090 - DNA, 22 bp, Homo sapiens
ttagagattgtctagtattgtg

SEQ ID NO: 7859091 - DNA, 22 bp, Homo sapiens
ttagagatgtcccaaaatgaag

SEQ ID NO: 7859092 - DNA, 22 bp, Homo sapiens
ttagagatgtcccaaaatgaag

SEQ ID NO: 7859093 - DNA, 22 bp, Homo sapiens
ttagagagaaccatcaggatct

SEQ ID NO: 7859094 - DNA, 22 bp, Homo sapiens
ttagagatacatttgtagcttg

SEQ ID NO: 7859095 - DNA, 23 bp, Homo sapiens
ttagagatgattaaaaaatcttg

SEQ ID NO: 7859096 - DNA, 23 bp, Homo sapiens
ttagagatgattaaaaaatcttg

SEQ ID NO: 7859097 - DNA, 22 bp, Homo sapiens
ttagaggactgtaggtgggaat

SEQ ID NO: 7859098 - DNA, 22 bp, Homo sapiens
ttagaggatatcatcagcctac

SEQ ID NO: 7859099 - DNA, 22 bp, Homo sapiens
ttagaggaattattttctgctg

SEQ ID NO: 7859100 - DNA, 22 bp, Homo sapiens
ttagaggggctgctgaatggga

SEQ ID NO: 7859101 - DNA, 22 bp, Homo sapiens
ttagaggcatgattcagtaaag

SEQ ID NO: 7859102 - DNA, 22 bp, Homo sapiens
ttagaggggctgctgaatggga

SEQ ID NO: 7859103 - DNA, 22 bp, Homo sapiens
ttagaggacaagaggcctggct

SEQ ID NO: 7859104 - DNA, 22 bp, Homo sapiens
ttagaggaaagactgggactaa

SEQ ID NO: 7859105 - DNA, 22 bp, Homo sapiens
ttagaggaaagtgactccgatg

SEQ ID NO: 7859106 - DNA, 22 bp, Homo sapiens
ttagagcttcccaattaaaacg

SEQ ID NO: 7859107 - DNA, 22 bp, Homo sapiens
ttagagctgggatggattttcc

SEQ ID NO: 7859108 - DNA, 22 bp, Homo sapiens
ttagagccagttacaaggtcaa

SEQ ID NO: 7859109 - DNA, 22 bp, Homo sapiens
ttagagccccagaaaacagtgg

SEQ ID NO: 7859110 - DNA, 22 bp, Homo sapiens
ttagagctagatgaggtcatga

SEQ ID NO: 7859111 - DNA, 17 bp, Homo sapiens
ttagagctacatgttga

SEQ ID NO: 7859112 - DNA, 22 bp, Homo sapiens
ttagagctgatagtacactggt

SEQ ID NO: 7859113 - DNA, 22 bp, Homo sapiens
ttagagccccagaaaacagtgg

SEQ ID NO: 7859114 - DNA, 17 bp, Homo sapiens
ttagagctacatgttga

SEQ ID NO: 7859115 - DNA, 17 bp, Homo sapiens
ttagagctacatgttga

SEQ ID NO: 7859116 - DNA, 22 bp, Homo sapiens
ttactttaagggtgtcttatta

SEQ ID NO: 7859117 - DNA, 22 bp, Homo sapiens
ttactttaagggtgtcttatta

SEQ ID NO: 7859118 - DNA, 19 bp, Homo sapiens
ttacttggcaaagtcagtc

SEQ ID NO: 7859119 - DNA, 19 bp, Homo sapiens
ttacttggcaaagtcagtc

SEQ ID NO: 7859120 - DNA, 19 bp, Homo sapiens
ttacttggcaaagtcagtc

SEQ ID NO: 7859121 - DNA, 22 bp, Homo sapiens
ttactttaagggtgtcttatta

SEQ ID NO: 7859122 - DNA, 22 bp, Homo sapiens
ttacttgtgcaccaccctaata

SEQ ID NO: 7859123 - DNA, 20 bp, Homo sapiens
ttacttgtctcagcatggag

SEQ ID NO: 7859124 - DNA, 22 bp, Homo sapiens
ttactttagatcatactgtgtg

SEQ ID NO: 7859125 - DNA, 22 bp, Homo sapiens
ttactttagatcatactgtgtg

SEQ ID NO: 7859126 - DNA, 22 bp, Homo sapiens
ttactttagatcatactgtgtg

SEQ ID NO: 7859127 - DNA, 22 bp, Homo sapiens
ttacttgattgtggagtctgag

SEQ ID NO: 7859128 - DNA, 22 bp, Homo sapiens
ttacttgattgtggagtctgag

SEQ ID NO: 7859129 - DNA, 22 bp, Homo sapiens
ttacttgatgtatgatgagtag

SEQ ID NO: 7859130 - DNA, 22 bp, Homo sapiens
ttacttgacataaatgagttta

SEQ ID NO: 7859131 - DNA, 22 bp, Homo sapiens
ttacttgacataaatgagttta

SEQ ID NO: 7859132 - DNA, 22 bp, Homo sapiens
ttacttacagacagtagactct

SEQ ID NO: 7859133 - DNA, 22 bp, Homo sapiens
ttactgttttggtacctcattg

SEQ ID NO: 7859134 - DNA, 22 bp, Homo sapiens
ttactgtttttaactaattgtg

SEQ ID NO: 7859135 - DNA, 22 bp, Homo sapiens
ttactgttttggtacctcattg

SEQ ID NO: 7859136 - DNA, 22 bp, Homo sapiens
ttactgtttttaactaattgtg

SEQ ID NO: 7859137 - DNA, 22 bp, Homo sapiens
ttacttacagacagtagactct

SEQ ID NO: 7859138 - DNA, 22 bp, Homo sapiens
ttacttaaacagaaatgcagaa

SEQ ID NO: 7859139 - DNA, 22 bp, Homo sapiens
ttacttaaacagaaatgcagaa

SEQ ID NO: 7859140 - DNA, 18 bp, Homo sapiens
ttactgttatcaaaacag

SEQ ID NO: 7859141 - DNA, 22 bp, Homo sapiens
ttactgttcatgttgtacactt

SEQ ID NO: 7859142 - DNA, 22 bp, Homo sapiens
ttactgttcatgttgtacactt

SEQ ID NO: 7859143 - DNA, 22 bp, Homo sapiens
ttactgttcatgttgtacactt

SEQ ID NO: 7859144 - DNA, 22 bp, Homo sapiens
ttactgttggtgtatccatagc

SEQ ID NO: 7859145 - DNA, 22 bp, Homo sapiens
ttactgtttgaaaaatgaatgt

SEQ ID NO: 7859146 - DNA, 22 bp, Homo sapiens
ttactgttggtgtatccatagc

SEQ ID NO: 7859147 - DNA, 22 bp, Homo sapiens
ttactgtagcttgacatatgtc

SEQ ID NO: 7859148 - DNA, 22 bp, Homo sapiens
ttactgtagcttgacatatgtc

SEQ ID NO: 7859149 - DNA, 22 bp, Homo sapiens
ttactgggcggggagtggaagc

SEQ ID NO: 7859150 - DNA, 22 bp, Homo sapiens
ttactgggcggggagtggaagc

SEQ ID NO: 7859151 - DNA, 20 bp, Homo sapiens
ttactgtagtactacatttt

SEQ ID NO: 7859152 - DNA, 20 bp, Homo sapiens
ttactgtagtactacatttt

SEQ ID NO: 7859153 - DNA, 20 bp, Homo sapiens
ttactgtagtactacatttt

SEQ ID NO: 7859154 - DNA, 22 bp, Homo sapiens
ttactgtagcttgacatatgtc

SEQ ID NO: 7859155 - DNA, 22 bp, Homo sapiens
ttactgggaatgttatggagaa

SEQ ID NO: 7859156 - DNA, 22 bp, Homo sapiens
ttactgggaatgttatggagaa

SEQ ID NO: 7859157 - DNA, 22 bp, Homo sapiens
ttactgggaatgttatggagaa

SEQ ID NO: 7859158 - DNA, 22 bp, Homo sapiens
ttactggctgggcctgagggct

SEQ ID NO: 7859159 - DNA, 22 bp, Homo sapiens
ttactgctgttaggatattttt

SEQ ID NO: 7859160 - DNA, 22 bp, Homo sapiens
ttactgcacgtgggacatatat

SEQ ID NO: 7859161 - DNA, 22 bp, Homo sapiens
ttactgctaattctgtaggttt

SEQ ID NO: 7859162 - DNA, 22 bp, Homo sapiens
ttactgcaacataatgtagtct

SEQ ID NO: 7859163 - DNA, 22 bp, Homo sapiens
ttactgatacacataagaattt

SEQ ID NO: 7859164 - DNA, 22 bp, Homo sapiens
ttactgaattgcactccagcgt

SEQ ID NO: 7859165 - DNA, 22 bp, Homo sapiens
ttactgaaggtggatagtgagt

SEQ ID NO: 7859166 - DNA, 22 bp, Homo sapiens
ttactgaaggtggatagtgagt

SEQ ID NO: 7859167 - DNA, 22 bp, Homo sapiens
ttactgaaggtggatagtgagt

SEQ ID NO: 7859168 - DNA, 22 bp, Homo sapiens
ttactgaaggtggatagtgagt

SEQ ID NO: 7859169 - DNA, 22 bp, Homo sapiens
ttactgaaccctacttttacag

SEQ ID NO: 7859170 - DNA, 22 bp, Homo sapiens
ttactgaaataatgaaacacat

SEQ ID NO: 7859171 - DNA, 22 bp, Homo sapiens
ttactgaaagtatacatttctg

SEQ ID NO: 7859172 - DNA, 22 bp, Homo sapiens
ttacattttggggtaaggataa

SEQ ID NO: 7859173 - DNA, 22 bp, Homo sapiens
ttaccaaatgaaatagagattt

SEQ ID NO: 7859174 - DNA, 22 bp, Homo sapiens
ttaccaaatcccgtgcacattc

SEQ ID NO: 7859175 - DNA, 23 bp, Homo sapiens
ttactacacaagtaacgattccc

SEQ ID NO: 7859176 - DNA, 23 bp, Homo sapiens
ttactacacaagtaacgattccc

SEQ ID NO: 7859177 - DNA, 22 bp, Homo sapiens
ttaccaaatgaaatagagattt

SEQ ID NO: 7859178 - DNA, 22 bp, Homo sapiens
ttactacagagagagctccagt

SEQ ID NO: 7859179 - DNA, 22 bp, Homo sapiens
ttactacattgtaacacagtac

SEQ ID NO: 7859180 - DNA, 22 bp, Homo sapiens
ttactacattgtaacacagtac

SEQ ID NO: 7859181 - DNA, 22 bp, Homo sapiens
ttactagttgcttcactttgct

SEQ ID NO: 7859182 - DNA, 22 bp, Homo sapiens
ttactcttaatggcaacaactg

SEQ ID NO: 7859183 - DNA, 22 bp, Homo sapiens
ttactgaaaattcttcaggatt

SEQ ID NO: 7859184 - DNA, 22 bp, Homo sapiens
ttactgaaaattcttcaggatt

SEQ ID NO: 7859185 - DNA, 22 bp, Homo sapiens
ttactcgtgacaatgtccttga

SEQ ID NO: 7859186 - DNA, 19 bp, Homo sapiens
ttactcgagaatgactaca

SEQ ID NO: 7859187 - DNA, 20 bp, Homo sapiens
ttactcataggaccacaagc

SEQ ID NO: 7859188 - DNA, 22 bp, Homo sapiens
ttactcattgctggatctagaa

SEQ ID NO: 7859189 - DNA, 22 bp, Homo sapiens
ttacatattgtctattgttcaa

SEQ ID NO: 7859190 - DNA, 22 bp, Homo sapiens
ttacatattgtctattgttcaa

SEQ ID NO: 7859191 - DNA, 22 bp, Homo sapiens
ttacatattgtctattgttcaa

SEQ ID NO: 7859192 - DNA, 22 bp, Homo sapiens
ttacatattgtctattgttcaa

SEQ ID NO: 7859193 - DNA, 22 bp, Homo sapiens
ttacatattatccaaaactgct

SEQ ID NO: 7859194 - DNA, 22 bp, Homo sapiens
ttacatattatccaaaactgct

SEQ ID NO: 7859195 - DNA, 22 bp, Homo sapiens
ttacatcactttacttaataat

SEQ ID NO: 7859196 - DNA, 22 bp, Homo sapiens
ttacatcagaatcacccaggaa

SEQ ID NO: 7859197 - DNA, 22 bp, Homo sapiens
ttacatcatgcttatccctttc

SEQ ID NO: 7859198 - DNA, 22 bp, Homo sapiens
ttacatcagcaagagtgtatgt

SEQ ID NO: 7859199 - DNA, 19 bp, Homo sapiens
ttacatctgcaacactggt

SEQ ID NO: 7859200 - DNA, 19 bp, Homo sapiens
ttacatctgcaacactggt

SEQ ID NO: 7859201 - DNA, 22 bp, Homo sapiens
ttacatgaatacataaccattc

SEQ ID NO: 7859202 - DNA, 22 bp, Homo sapiens
ttacattttggggtaaggataa

SEQ ID NO: 7859203 - DNA, 22 bp, Homo sapiens
ttacattttggggtaaggataa

SEQ ID NO: 7859204 - DNA, 22 bp, Homo sapiens
ttacatcatgtaactggatata

SEQ ID NO: 7859205 - DNA, 22 bp, Homo sapiens
ttacatcattgagacatacata

SEQ ID NO: 7859206 - DNA, 22 bp, Homo sapiens
ttacatctaaactgtgaacaat

SEQ ID NO: 7859207 - DNA, 17 bp, Homo sapiens
ttacatccttctgaatt

SEQ ID NO: 7859208 - DNA, 22 bp, Homo sapiens
ttacatcattgagacatacata

SEQ ID NO: 7859209 - DNA, 22 bp, Homo sapiens
ttacatccaggaaggtgggagc

SEQ ID NO: 7859210 - DNA, 22 bp, Homo sapiens
ttacatccttcaaagtcactca

SEQ ID NO: 7859211 - DNA, 22 bp, Homo sapiens
ttacatcattgagacatacata

SEQ ID NO: 7859212 - DNA, 22 bp, Homo sapiens
ttacatattatccaaaactgct

SEQ ID NO: 7859213 - DNA, 22 bp, Homo sapiens
ttacatattatccaaaactgct

SEQ ID NO: 7859214 - DNA, 22 bp, Homo sapiens
ttacatattatccaaaactgct

SEQ ID NO: 7859215 - DNA, 20 bp, Homo sapiens
ttacagtgggaccttcctga

SEQ ID NO: 7859216 - DNA, 22 bp, Homo sapiens
ttacatagttaaatagtacagc

SEQ ID NO: 7859217 - DNA, 22 bp, Homo sapiens
ttacatattatccaaaactgct

SEQ ID NO: 7859218 - DNA, 22 bp, Homo sapiens
ttacagtgactcacattaacaa

SEQ ID NO: 7859219 - DNA, 22 bp, Homo sapiens
ttacagtgactcacattaacaa

SEQ ID NO: 7859220 - DNA, 22 bp, Homo sapiens
ttacagtgacagttgctatgat

SEQ ID NO: 7859221 - DNA, 22 bp, Homo sapiens
ttacagtgagggtgacatttac

SEQ ID NO: 7859222 - DNA, 22 bp, Homo sapiens
ttacagtgaagtaccattaaaa

SEQ ID NO: 7859223 - DNA, 22 bp, Homo sapiens
ttacagtgaagtaccattaaaa

SEQ ID NO: 7859224 - DNA, 22 bp, Homo sapiens
ttacagtgacagttgctatgat

SEQ ID NO: 7859225 - DNA, 22 bp, Homo sapiens
ttacagtggcagagttgggtag

SEQ ID NO: 7859226 - DNA, 22 bp, Homo sapiens
ttacagtgctcttcaagacttc

SEQ ID NO: 7859227 - DNA, 20 bp, Homo sapiens
ttacagtgggaccttcctga

SEQ ID NO: 7859228 - DNA, 22 bp, Homo sapiens
ttacagtgctcttcaagacttc

SEQ ID NO: 7859229 - DNA, 22 bp, Homo sapiens
ttacagtggcagagttgggtag

SEQ ID NO: 7859230 - DNA, 22 bp, Homo sapiens
ttacagtgagggtgacatttac

SEQ ID NO: 7859231 - DNA, 22 bp, Homo sapiens
ttacagtgctcttcaagacttc

SEQ ID NO: 7859232 - DNA, 22 bp, Homo sapiens
ttacagtgctcttcaagacttc

SEQ ID NO: 7859233 - DNA, 22 bp, Homo sapiens
ttacagtcagcttacattagtt

SEQ ID NO: 7859234 - DNA, 22 bp, Homo sapiens
ttacagtcaggcatgaattcag

SEQ ID NO: 7859235 - DNA, 22 bp, Homo sapiens
ttacagtcagcttacattagtt

SEQ ID NO: 7859236 - DNA, 22 bp, Homo sapiens
ttacagtcagtgaatggaaggg

SEQ ID NO: 7859237 - DNA, 22 bp, Homo sapiens
ttacagtctggattaggaaaca

SEQ ID NO: 7859238 - DNA, 22 bp, Homo sapiens
ttacagtcctttgtattgttta

SEQ ID NO: 7859239 - DNA, 22 bp, Homo sapiens
ttacagtcagtgaatggaaggg

SEQ ID NO: 7859240 - DNA, 22 bp, Homo sapiens
ttacagtcttaaactcctgggc

SEQ ID NO: 7859241 - DNA, 22 bp, Homo sapiens
ttacagtgaagattcaggttcc

SEQ ID NO: 7859242 - DNA, 22 bp, Homo sapiens
ttacagtgaagattcaggttcc

SEQ ID NO: 7859243 - DNA, 22 bp, Homo sapiens
ttacagtattgttaaactcttt

SEQ ID NO: 7859244 - DNA, 22 bp, Homo sapiens
ttacagtattggtcacgtttgt

SEQ ID NO: 7859245 - DNA, 22 bp, Homo sapiens
ttacagtatgatcaacttttca

SEQ ID NO: 7859246 - DNA, 22 bp, Homo sapiens
ttacagtatgatcaacttttca

SEQ ID NO: 7859247 - DNA, 22 bp, Homo sapiens
ttacacttgtaattatataacg

SEQ ID NO: 7859248 - DNA, 22 bp, Homo sapiens
ttacacttgtaaatggcatgta

SEQ ID NO: 7859249 - DNA, 19 bp, Homo sapiens
ttacacttctgctttgtga

SEQ ID NO: 7859250 - DNA, 22 bp, Homo sapiens
ttacacttctgaaagcctaggt

SEQ ID NO: 7859251 - DNA, 22 bp, Homo sapiens
ttacacttagggtttgtcagag

SEQ ID NO: 7859252 - DNA, 22 bp, Homo sapiens
ttacacttacctgtccattgaa

SEQ ID NO: 7859253 - DNA, 22 bp, Homo sapiens
ttacacttagggtttgtcagag

SEQ ID NO: 7859254 - DNA, 22 bp, Homo sapiens
ttacacttctaaaaaaagcagg

SEQ ID NO: 7859255 - DNA, 22 bp, Homo sapiens
ttacaggaggtgctaggtgttt

SEQ ID NO: 7859256 - DNA, 22 bp, Homo sapiens
ttacagcttacattttaccttg

SEQ ID NO: 7859257 - DNA, 22 bp, Homo sapiens
ttacagtaatgtattatttaac

SEQ ID NO: 7859258 - DNA, 22 bp, Homo sapiens
ttacagtacagaaaataacaga

SEQ ID NO: 7859259 - DNA, 22 bp, Homo sapiens
ttacagtagctttatttggagt

SEQ ID NO: 7859260 - DNA, 22 bp, Homo sapiens
ttacagtagatacaatgagtaa

SEQ ID NO: 7859261 - DNA, 22 bp, Homo sapiens
ttacagtagatacaatgagtaa

SEQ ID NO: 7859262 - DNA, 21 bp, Homo sapiens
ttacaggtcatccaagtcacc

SEQ ID NO: 7859263 - DNA, 22 bp, Homo sapiens
ttacaggtgagaaaactgaggc

SEQ ID NO: 7859264 - DNA, 22 bp, Homo sapiens
ttacaggtcagtttgactgaat

SEQ ID NO: 7859265 - DNA, 22 bp, Homo sapiens
ttacaggtgggaaaactaagct

SEQ ID NO: 7859266 - DNA, 22 bp, Homo sapiens
ttacaggtgagaaaactgaggc

SEQ ID NO: 7859267 - DNA, 22 bp, Homo sapiens
ttacaggtgagaaaactgaggc

SEQ ID NO: 7859268 - DNA, 22 bp, Homo sapiens
ttacaggtggagaagtaaggct

SEQ ID NO: 7859269 - DNA, 22 bp, Homo sapiens
ttacaggtggagaagtaaggct

SEQ ID NO: 7859270 - DNA, 22 bp, Homo sapiens
ttacaggtgggaaaactaagct

SEQ ID NO: 7859271 - DNA, 22 bp, Homo sapiens
ttacaggtgtggaaattgagta

SEQ ID NO: 7859272 - DNA, 22 bp, Homo sapiens
ttacaggtgtggaaattgagta

SEQ ID NO: 7859273 - DNA, 19 bp, Homo sapiens
ttacaggttgacatcaatt

SEQ ID NO: 7859274 - DNA, 22 bp, Homo sapiens
ttacaggttgtgtattcagtga

SEQ ID NO: 7859275 - DNA, 22 bp, Homo sapiens
ttacagtaacattttcagtctg

SEQ ID NO: 7859276 - DNA, 22 bp, Homo sapiens
ttacacattgcagatcaaaatg

SEQ ID NO: 7859277 - DNA, 22 bp, Homo sapiens
ttacacattgcagatcaaaatg

SEQ ID NO: 7859278 - DNA, 22 bp, Homo sapiens
ttacacattgcagatcaaaatg

SEQ ID NO: 7859279 - DNA, 22 bp, Homo sapiens
ttacacattgcagatcaaaatg

SEQ ID NO: 7859280 - DNA, 22 bp, Homo sapiens
ttacacatgtctcagtggaaat

SEQ ID NO: 7859281 - DNA, 22 bp, Homo sapiens
ttacacatgctttgtgtgtatg

SEQ ID NO: 7859282 - DNA, 22 bp, Homo sapiens
ttacacattaacaggcagctaa

SEQ ID NO: 7859283 - DNA, 22 bp, Homo sapiens
ttacacattgcagatcaaaatg

SEQ ID NO: 7859284 - DNA, 22 bp, Homo sapiens
ttacactgacagctgaaaagca

SEQ ID NO: 7859285 - DNA, 18 bp, Homo sapiens
ttacactagccttggttc

SEQ ID NO: 7859286 - DNA, 22 bp, Homo sapiens
ttacactaagctacttctatat

SEQ ID NO: 7859287 - DNA, 22 bp, Homo sapiens
ttacacatgaaggtccaatgtt

SEQ ID NO: 7859288 - DNA, 22 bp, Homo sapiens
ttacacatctagacccattttt

SEQ ID NO: 7859289 - DNA, 22 bp, Homo sapiens
ttacacatgctttgtgtgtatg

SEQ ID NO: 7859290 - DNA, 22 bp, Homo sapiens
ttacacatgctttgtgtgtatg

SEQ ID NO: 7859291 - DNA, 22 bp, Homo sapiens
ttacacagtgcacaagcagagt

SEQ ID NO: 7859292 - DNA, 22 bp, Homo sapiens
ttacacagtgcacaagcagagt

SEQ ID NO: 7859293 - DNA, 22 bp, Homo sapiens
ttacacagtgcacaagcagagt

SEQ ID NO: 7859294 - DNA, 22 bp, Homo sapiens
ttacacagtgcacaagcagagt

SEQ ID NO: 7859295 - DNA, 22 bp, Homo sapiens
ttacacagtggttaagtctggg

SEQ ID NO: 7859296 - DNA, 22 bp, Homo sapiens
ttacacagttggtaggggcaga

SEQ ID NO: 7859297 - DNA, 22 bp, Homo sapiens
ttacacagaaacactgttcaga

SEQ ID NO: 7859298 - DNA, 22 bp, Homo sapiens
ttacacagaaacactgttcaga

SEQ ID NO: 7859299 - DNA, 22 bp, Homo sapiens
ttacacagaaacactgttcaga

SEQ ID NO: 7859300 - DNA, 22 bp, Homo sapiens
ttacacaattttattgacctaa

SEQ ID NO: 7859301 - DNA, 22 bp, Homo sapiens
ttacacagatggttagtagagg

SEQ ID NO: 7859302 - DNA, 22 bp, Homo sapiens
ttacacagatggttagtagagg

SEQ ID NO: 7859303 - DNA, 22 bp, Homo sapiens
ttacacagatggttagtagagg

SEQ ID NO: 7859304 - DNA, 22 bp, Homo sapiens
ttacacagatggttagtagagg

SEQ ID NO: 7859305 - DNA, 17 bp, Homo sapiens
ttacacaggagagctct

SEQ ID NO: 7859306 - DNA, 17 bp, Homo sapiens
ttacacaggagagctct

SEQ ID NO: 7859307 - DNA, 17 bp, Homo sapiens
ttacacaggagagctct

SEQ ID NO: 7859308 - DNA, 22 bp, Homo sapiens
ttacacaggcacttaaaatgca

SEQ ID NO: 7859309 - DNA, 22 bp, Homo sapiens
ttaattttctcatctgtgaaat

SEQ ID NO: 7859310 - DNA, 22 bp, Homo sapiens
ttaattttgatgaggttcagtt

SEQ ID NO: 7859311 - DNA, 22 bp, Homo sapiens
ttaatttttatgtatagtgtgt

SEQ ID NO: 7859312 - DNA, 22 bp, Homo sapiens
ttaatttttatgtatagtgtgt

SEQ ID NO: 7859313 - DNA, 22 bp, Homo sapiens
ttaatttttatgtatagtgtgt

SEQ ID NO: 7859314 - DNA, 22 bp, Homo sapiens
ttaatttttatgtatagtgtgt

SEQ ID NO: 7859315 - DNA, 22 bp, Homo sapiens
ttaatttttatgtatagtgtgt

SEQ ID NO: 7859316 - DNA, 22 bp, Homo sapiens
ttacaaacaacagacatttatt

SEQ ID NO: 7859317 - DNA, 22 bp, Homo sapiens
ttacaaacaacagacatttatt

SEQ ID NO: 7859318 - DNA, 22 bp, Homo sapiens
ttacaaacaacagacatttatt

SEQ ID NO: 7859319 - DNA, 22 bp, Homo sapiens
ttacaaacaacagacatttatt

SEQ ID NO: 7859320 - DNA, 22 bp, Homo sapiens
ttacaaacaacagacatttatt

SEQ ID NO: 7859321 - DNA, 22 bp, Homo sapiens
ttaattttctcatctgtgaaat

SEQ ID NO: 7859322 - DNA, 22 bp, Homo sapiens
ttaattttctcatctgtgaaat

SEQ ID NO: 7859323 - DNA, 22 bp, Homo sapiens
ttaattttctcatctgtgaaat

SEQ ID NO: 7859324 - DNA, 22 bp, Homo sapiens
ttaattttctcatctgtgaaat

SEQ ID NO: 7859325 - DNA, 22 bp, Homo sapiens
ttaattttaacctgtttgtgtc

SEQ ID NO: 7859326 - DNA, 22 bp, Homo sapiens
ttaattttaacctgtttgtgtc

SEQ ID NO: 7859327 - DNA, 22 bp, Homo sapiens
ttaattttaacctgtttgtgtc

SEQ ID NO: 7859328 - DNA, 22 bp, Homo sapiens
ttaattttaacctgtttgtgtc

SEQ ID NO: 7859329 - DNA, 22 bp, Homo sapiens
ttaatttgaccataaatatctt

SEQ ID NO: 7859330 - DNA, 21 bp, Homo sapiens
ttaatttattcatgatagcta

SEQ ID NO: 7859331 - DNA, 22 bp, Homo sapiens
ttacacaacatctgtattatta

SEQ ID NO: 7859332 - DNA, 22 bp, Homo sapiens
ttacacaagttctttaacctat

SEQ ID NO: 7859333 - DNA, 22 bp, Homo sapiens
ttacacaacatctgtattatta

SEQ ID NO: 7859334 - DNA, 22 bp, Homo sapiens
ttacacaacatctgtattatta

SEQ ID NO: 7859335 - DNA, 22 bp, Homo sapiens
ttacacaacatctgtattatta

SEQ ID NO: 7859336 - DNA, 22 bp, Homo sapiens
ttacacaacagtgcatcagcag

SEQ ID NO: 7859337 - DNA, 22 bp, Homo sapiens
ttacacaaagttagctcttgca

SEQ ID NO: 7859338 - DNA, 22 bp, Homo sapiens
ttacacaacagtgcatcagcag

SEQ ID NO: 7859339 - DNA, 22 bp, Homo sapiens
ttacacaaacacattccagata

SEQ ID NO: 7859340 - DNA, 22 bp, Homo sapiens
ttacacaaagctccccaaatag

SEQ ID NO: 7859341 - DNA, 22 bp, Homo sapiens
ttacacaaagttagctcttgca

SEQ ID NO: 7859342 - DNA, 22 bp, Homo sapiens
ttacaaacaagatcttattctt

SEQ ID NO: 7859343 - DNA, 22 bp, Homo sapiens
ttacaaacaagatcttattctt

SEQ ID NO: 7859344 - DNA, 22 bp, Homo sapiens
ttacaaacaagatcttattctt

SEQ ID NO: 7859345 - DNA, 22 bp, Homo sapiens
ttacaaactccagtgagtgagc

SEQ ID NO: 7859346 - DNA, 22 bp, Homo sapiens
ttacaaactccagtgagtgagc

SEQ ID NO: 7859347 - DNA, 22 bp, Homo sapiens
ttacaaactccagtgagtgagc

SEQ ID NO: 7859348 - DNA, 22 bp, Homo sapiens
ttacaaactccagtgagtgagc

SEQ ID NO: 7859349 - DNA, 22 bp, Homo sapiens
ttacaaactgtcatatagtatt

SEQ ID NO: 7859350 - DNA, 22 bp, Homo sapiens
ttacaaactgtcatatagtatt

SEQ ID NO: 7859351 - DNA, 22 bp, Homo sapiens
ttacaaagaaaattaggcattt

SEQ ID NO: 7859352 - DNA, 22 bp, Homo sapiens
ttacaaagaaaattaggcattt

SEQ ID NO: 7859353 - DNA, 22 bp, Homo sapiens
ttacaaagaaaattaggcattt

SEQ ID NO: 7859354 - DNA, 22 bp, Homo sapiens
ttacaaactgtcatatagtatt

SEQ ID NO: 7859355 - DNA, 22 bp, Homo sapiens
ttacaaactgtcatatagtatt

SEQ ID NO: 7859356 - DNA, 22 bp, Homo sapiens
ttacaaactgtcatatagtatt

SEQ ID NO: 7859357 - DNA, 22 bp, Homo sapiens
ttacaaactgtcatatagtatt

SEQ ID NO: 7859358 - DNA, 22 bp, Homo sapiens
ttaaatgtgcctaaacctgtaa

SEQ ID NO: 7859359 - DNA, 22 bp, Homo sapiens
ttaaatgtgatttcatttatgt

SEQ ID NO: 7859360 - DNA, 22 bp, Homo sapiens
ttaaatgtgatttcatttatgt

SEQ ID NO: 7859361 - DNA, 22 bp, Homo sapiens
ttaaatgtttaatctaacttga

SEQ ID NO: 7859362 - DNA, 22 bp, Homo sapiens
ttaaatgtttaatctaacttga

SEQ ID NO: 7859363 - DNA, 22 bp, Homo sapiens
ttaaatgtttaatctaacttga

SEQ ID NO: 7859364 - DNA, 22 bp, Homo sapiens
ttaaatgtgatcctggtatgca

SEQ ID NO: 7859365 - DNA, 22 bp, Homo sapiens
ttaaatgtgatttcatttatgt

SEQ ID NO: 7859366 - DNA, 22 bp, Homo sapiens
ttaaatgtcaatagattgcttg

SEQ ID NO: 7859367 - DNA, 22 bp, Homo sapiens
ttaaatgtctgtagatgtgctg

SEQ ID NO: 7859368 - DNA, 22 bp, Homo sapiens
ttaacaaaaatatcaggcatca

SEQ ID NO: 7859369 - DNA, 22 bp, Homo sapiens
ttaaattaggactctagttctg

SEQ ID NO: 7859370 - DNA, 22 bp, Homo sapiens
ttaacaaaaatatcaggcatca

SEQ ID NO: 7859371 - DNA, 22 bp, Homo sapiens
ttaacaaaaatatcaggcatca

SEQ ID NO: 7859372 - DNA, 22 bp, Homo sapiens
ttaacaaaaatatcaggcatca

SEQ ID NO: 7859373 - DNA, 22 bp, Homo sapiens
ttaacaaaaatatcaggcatca

SEQ ID NO: 7859374 - DNA, 22 bp, Homo sapiens
ttaacaaaaatatcaggcatca

SEQ ID NO: 7859375 - DNA, 22 bp, Homo sapiens
ttaaattaggactctagttctg

SEQ ID NO: 7859376 - DNA, 22 bp, Homo sapiens
ttaaattaggactctagttctg

SEQ ID NO: 7859377 - DNA, 22 bp, Homo sapiens
ttaaattaggactctagttctg

SEQ ID NO: 7859378 - DNA, 22 bp, Homo sapiens
ttaaattaggactctagttctg

SEQ ID NO: 7859379 - DNA, 22 bp, Homo sapiens
ttaacaatagagtttcttcagg

SEQ ID NO: 7859380 - DNA, 22 bp, Homo sapiens
ttaacaaatatttcccatgccc

SEQ ID NO: 7859381 - DNA, 22 bp, Homo sapiens
ttaacaaagtaacgggaaaaga

SEQ ID NO: 7859382 - DNA, 22 bp, Homo sapiens
ttaacaaagtaacgggaaaaga

SEQ ID NO: 7859383 - DNA, 22 bp, Homo sapiens
ttaacaaagtaacgggaaaaga

SEQ ID NO: 7859384 - DNA, 22 bp, Homo sapiens
ttaacaaagtaacgggaaaaga

SEQ ID NO: 7859385 - DNA, 22 bp, Homo sapiens
ttaacaaagtaacgggaaaaga

SEQ ID NO: 7859386 - DNA, 22 bp, Homo sapiens
ttaacaaagctctgttcctttt

SEQ ID NO: 7859387 - DNA, 22 bp, Homo sapiens
ttaacacatatttatcaattgc

SEQ ID NO: 7859388 - DNA, 22 bp, Homo sapiens
ttaacacatatttatcaattgc

SEQ ID NO: 7859389 - DNA, 22 bp, Homo sapiens
ttaacacatatttatcaattgc

SEQ ID NO: 7859390 - DNA, 22 bp, Homo sapiens
ttaacacatatttatcaattgc

SEQ ID NO: 7859391 - DNA, 22 bp, Homo sapiens
ttaacacagggggagacaaagt

SEQ ID NO: 7859392 - DNA, 22 bp, Homo sapiens
ttaacacagggggagacaaagt

SEQ ID NO: 7859393 - DNA, 22 bp, Homo sapiens
ttaacacagggggagacaaagt

SEQ ID NO: 7859394 - DNA, 22 bp, Homo sapiens
ttaacacagggggagacaaagt

SEQ ID NO: 7859395 - DNA, 22 bp, Homo sapiens
ttaacacagggggagacaaagt

SEQ ID NO: 7859396 - DNA, 22 bp, Homo sapiens
ttaacacagggggagacaaagt

SEQ ID NO: 7859397 - DNA, 22 bp, Homo sapiens
ttaacacagggggagacaaagt

SEQ ID NO: 7859398 - DNA, 22 bp, Homo sapiens
ttaacacagggggagacaaagt

SEQ ID NO: 7859399 - DNA, 22 bp, Homo sapiens
ttaacaatagagtttcttcagg

SEQ ID NO: 7859400 - DNA, 22 bp, Homo sapiens
ttaacaatagagtttcttcagg

SEQ ID NO: 7859401 - DNA, 22 bp, Homo sapiens
ttaacaatagagtttcttcagg

SEQ ID NO: 7859402 - DNA, 22 bp, Homo sapiens
ttaacaatagagtttcttcagg

SEQ ID NO: 7859403 - DNA, 22 bp, Homo sapiens
ttaaatggggatgagtagatgg

SEQ ID NO: 7859404 - DNA, 22 bp, Homo sapiens
ttaaatgctcacataaaggtag

SEQ ID NO: 7859405 - DNA, 22 bp, Homo sapiens
ttaaatgctcacataaaggtag

SEQ ID NO: 7859406 - DNA, 22 bp, Homo sapiens
ttaaatggagggggaaatacgt

SEQ ID NO: 7859407 - DNA, 22 bp, Homo sapiens
ttaaatggagggggaaatacgt

SEQ ID NO: 7859408 - DNA, 22 bp, Homo sapiens
ttaaatgatgcatatcatttag

SEQ ID NO: 7859409 - DNA, 22 bp, Homo sapiens
ttaaatgatgcatatcatttag

SEQ ID NO: 7859410 - DNA, 22 bp, Homo sapiens
ttaaatgatgcatatcatttag

SEQ ID NO: 7859411 - DNA, 22 bp, Homo sapiens
ttaaatgatgcatatcatttag

SEQ ID NO: 7859412 - DNA, 22 bp, Homo sapiens
ttaaatgatgcatatcatttag

SEQ ID NO: 7859413 - DNA, 22 bp, Homo sapiens
ttaaatgaggctgatgtagatt

SEQ ID NO: 7859414 - DNA, 22 bp, Homo sapiens
ttaaatgaggctgatgtagatt

SEQ ID NO: 7859415 - DNA, 22 bp, Homo sapiens
ttaaatgagatgttcagatatt

SEQ ID NO: 7859416 - DNA, 22 bp, Homo sapiens
ttaaatgagatgttcagatatt

SEQ ID NO: 7859417 - DNA, 22 bp, Homo sapiens
ttaaatgagatgttcagatatt

SEQ ID NO: 7859418 - DNA, 22 bp, Homo sapiens
ttaaatgagatgttcagatatt

SEQ ID NO: 7859419 - DNA, 22 bp, Homo sapiens
ttaaatgagatgttcagatatt

SEQ ID NO: 7859420 - DNA, 22 bp, Homo sapiens
ttaaatgaggctgatgtagatt

SEQ ID NO: 7859421 - DNA, 22 bp, Homo sapiens
ttaaatgaggctgatgtagatt

SEQ ID NO: 7859422 - DNA, 22 bp, Homo sapiens
ttaaatgaggctgatgtagatt

SEQ ID NO: 7859423 - DNA, 22 bp, Homo sapiens
ttaaatgaggctgatgtagatt

SEQ ID NO: 7859424 - DNA, 22 bp, Homo sapiens
ttaaatgaggctgatgtagatt

SEQ ID NO: 7859425 - DNA, 22 bp, Homo sapiens
ttaaatgaggctgatgtagatt

SEQ ID NO: 7859426 - DNA, 22 bp, Homo sapiens
ttaaatgaggctgatgtagatt

SEQ ID NO: 7859427 - DNA, 22 bp, Homo sapiens
ttaaatgagatgttcagatatt

SEQ ID NO: 7859428 - DNA, 22 bp, Homo sapiens
ttaaatgagatgttcagatatt

SEQ ID NO: 7859429 - DNA, 22 bp, Homo sapiens
ttaaatgagatgttcagatatt

SEQ ID NO: 7859430 - DNA, 22 bp, Homo sapiens
ttaaatgacttttattattctc

SEQ ID NO: 7859431 - DNA, 22 bp, Homo sapiens
ttaaatgacttttattattctc

SEQ ID NO: 7859432 - DNA, 22 bp, Homo sapiens
ttaaatgacttttattattctc

SEQ ID NO: 7859433 - DNA, 22 bp, Homo sapiens
ttaaatgacgggactgggtttt

SEQ ID NO: 7859434 - DNA, 22 bp, Homo sapiens
ttaaatgaacgagatatgcaac

SEQ ID NO: 7859435 - DNA, 22 bp, Homo sapiens
ttaaatgaacgagatatgcaac

SEQ ID NO: 7859436 - DNA, 22 bp, Homo sapiens
ttaaatgaacgagatatgcaac

SEQ ID NO: 7859437 - DNA, 22 bp, Homo sapiens
ttaaatattttcagcagggtca

SEQ ID NO: 7859438 - DNA, 22 bp, Homo sapiens
ttaaatattttcagcagggtca

SEQ ID NO: 7859439 - DNA, 22 bp, Homo sapiens
ttaaatattttcagcagggtca

SEQ ID NO: 7859440 - DNA, 22 bp, Homo sapiens
ttaaatattttcagcagggtca

SEQ ID NO: 7859441 - DNA, 22 bp, Homo sapiens
ttaaatattttcagcagggtca

SEQ ID NO: 7859442 - DNA, 22 bp, Homo sapiens
ttaaatcaggcatcatttcagt

SEQ ID NO: 7859443 - DNA, 22 bp, Homo sapiens
ttaaatcaggcatcatttcagt

SEQ ID NO: 7859444 - DNA, 22 bp, Homo sapiens
tgttttggtagattgattatgg

SEQ ID NO: 7859445 - DNA, 23 bp, Homo sapiens
tgttttcttgtcctggtataatt

SEQ ID NO: 7859446 - DNA, 23 bp, Homo sapiens
tgttttcttgtcctggtataatt

SEQ ID NO: 7859447 - DNA, 22 bp, Homo sapiens
tgttttgcttctctgtttccca

SEQ ID NO: 7859448 - DNA, 22 bp, Homo sapiens
tgttttggtagattgattatgg

SEQ ID NO: 7859449 - DNA, 22 bp, Homo sapiens
tgttttggttttcaccgagtcc

SEQ ID NO: 7859450 - DNA, 22 bp, Homo sapiens
tgttttggttttcaccgagtcc

SEQ ID NO: 7859451 - DNA, 22 bp, Homo sapiens
tgttttgtagctaatagctatt

SEQ ID NO: 7859452 - DNA, 22 bp, Homo sapiens
tgttttgtccttttctatatac

SEQ ID NO: 7859453 - DNA, 22 bp, Homo sapiens
tgttttgtagctaatagctatt

SEQ ID NO: 7859454 - DNA, 22 bp, Homo sapiens
tgttttgtagctaatagctatt

SEQ ID NO: 7859455 - DNA, 19 bp, Homo sapiens
tgttttgttaaagcagtcc

SEQ ID NO: 7859456 - DNA, 19 bp, Homo sapiens
tgttttgttaaagcagtcc

SEQ ID NO: 7859457 - DNA, 22 bp, Homo sapiens
tgttttgtgcatttacaacatg

SEQ ID NO: 7859458 - DNA, 22 bp, Homo sapiens
tgttttgtgcatttacaacatg

SEQ ID NO: 7859459 - DNA, 19 bp, Homo sapiens
tgttttgttaaagcagtcc

SEQ ID NO: 7859460 - DNA, 22 bp, Homo sapiens
tgttttgttagcactctgggaa

SEQ ID NO: 7859461 - DNA, 22 bp, Homo sapiens
tgttttgtctaatctaaattct

SEQ ID NO: 7859462 - DNA, 22 bp, Homo sapiens
tgttttgtgcacttctatagca

SEQ ID NO: 7859463 - DNA, 22 bp, Homo sapiens
tgttttgtccttttctatatac

SEQ ID NO: 7859464 - DNA, 22 bp, Homo sapiens
tgttttgtctaatagggcaggt

SEQ ID NO: 7859465 - DNA, 22 bp, Homo sapiens
tgttttgtgcatttacaacatg

SEQ ID NO: 7859466 - DNA, 22 bp, Homo sapiens
tgttttgtgcatttacaacatg

SEQ ID NO: 7859467 - DNA, 22 bp, Homo sapiens
tgttttgtgcacttctatagca

SEQ ID NO: 7859468 - DNA, 22 bp, Homo sapiens
tgttttgtgcacttctatagca

SEQ ID NO: 7859469 - DNA, 22 bp, Homo sapiens
tgttttctgggtggaaggtact

SEQ ID NO: 7859470 - DNA, 22 bp, Homo sapiens
tgttttctgtgtagagatcaca

SEQ ID NO: 7859471 - DNA, 22 bp, Homo sapiens
tgttttctgtgtagagatcaca

SEQ ID NO: 7859472 - DNA, 22 bp, Homo sapiens
tgttttctgtgtagagatcaca

SEQ ID NO: 7859473 - DNA, 22 bp, Homo sapiens
tgttttctgtgtagagatcaca

SEQ ID NO: 7859474 - DNA, 22 bp, Homo sapiens
tgttttcttcctaattgctcat

SEQ ID NO: 7859475 - DNA, 22 bp, Homo sapiens
tgttttcttcctaattgctcat

SEQ ID NO: 7859476 - DNA, 22 bp, Homo sapiens
tgttttctgtgtagagatcaca

SEQ ID NO: 7859477 - DNA, 22 bp, Homo sapiens
tgttttcttctgtaccgtgcca

SEQ ID NO: 7859478 - DNA, 23 bp, Homo sapiens
tgttttcttgtcctggtataatt

SEQ ID NO: 7859479 - DNA, 22 bp, Homo sapiens
tgttttcttcctaattgctcat

SEQ ID NO: 7859480 - DNA, 22 bp, Homo sapiens
tgttttctgatggttaatgagt

SEQ ID NO: 7859481 - DNA, 22 bp, Homo sapiens
tgttttctgatggttaatgagt

SEQ ID NO: 7859482 - DNA, 22 bp, Homo sapiens
tgttttctgatggttaatgagt

SEQ ID NO: 7859483 - DNA, 22 bp, Homo sapiens
tgttttctgatggttaatgagt

SEQ ID NO: 7859484 - DNA, 17 bp, Homo sapiens
tgttttctgctaccttt

SEQ ID NO: 7859485 - DNA, 22 bp, Homo sapiens
tgttttctgggtggaaggtact

SEQ ID NO: 7859486 - DNA, 22 bp, Homo sapiens
tgttttctgggtggaaggtact

SEQ ID NO: 7859487 - DNA, 17 bp, Homo sapiens
tgttttctgctaccttt

SEQ ID NO: 7859488 - DNA, 17 bp, Homo sapiens
tgttttctgctaccttt

SEQ ID NO: 7859489 - DNA, 17 bp, Homo sapiens
tgttttctgctaccttt

SEQ ID NO: 7859490 - DNA, 17 bp, Homo sapiens
tgttttctgctaccttt

SEQ ID NO: 7859491 - DNA, 17 bp, Homo sapiens
tgttttctgctaccttt

SEQ ID NO: 7859492 - DNA, 22 bp, Homo sapiens
tgttttctgattctcgtgtggt

SEQ ID NO: 7859493 - DNA, 22 bp, Homo sapiens
tgttttctgattctcgtgtggt

SEQ ID NO: 7859494 - DNA, 21 bp, Homo sapiens
ttaaagcctccctcataagga

SEQ ID NO: 7859495 - DNA, 22 bp, Homo sapiens
ttaaatagtcaaatcagtggca

SEQ ID NO: 7859496 - DNA, 22 bp, Homo sapiens
ttaaatagtaggtctattttgg

SEQ ID NO: 7859497 - DNA, 22 bp, Homo sapiens
ttaaatagtaggtctattttgg

SEQ ID NO: 7859498 - DNA, 22 bp, Homo sapiens
ttaaatagtaggtctattttgg

SEQ ID NO: 7859499 - DNA, 22 bp, Homo sapiens
ttaaatattatgttgtctgcaa

SEQ ID NO: 7859500 - DNA, 22 bp, Homo sapiens
ttaaatattatgttgtctgcaa

SEQ ID NO: 7859501 - DNA, 22 bp, Homo sapiens
ttaaatattatgttgtctgcaa

SEQ ID NO: 7859502 - DNA, 22 bp, Homo sapiens
ttaaatattatgttgtctgcaa

SEQ ID NO: 7859503 - DNA, 22 bp, Homo sapiens
ttaaatattatgttgtctgcaa

SEQ ID NO: 7859504 - DNA, 22 bp, Homo sapiens
ttaaatagtcaaatcagtggca

SEQ ID NO: 7859505 - DNA, 22 bp, Homo sapiens
ttaaatagtcaaatcagtggca

SEQ ID NO: 7859506 - DNA, 22 bp, Homo sapiens
ttaaatagtcaaatcagtggca

SEQ ID NO: 7859507 - DNA, 22 bp, Homo sapiens
ttaaatagtcaaatcagtggca

SEQ ID NO: 7859508 - DNA, 22 bp, Homo sapiens
ttaaatattatgttgtctgcaa

SEQ ID NO: 7859509 - DNA, 22 bp, Homo sapiens
ttaaatattatgttgtctgcaa

SEQ ID NO: 7859510 - DNA, 22 bp, Homo sapiens
ttaaatattatgttgtctgcaa

SEQ ID NO: 7859511 - DNA, 22 bp, Homo sapiens
ttaaatattatgttgtctgcaa

SEQ ID NO: 7859512 - DNA, 22 bp, Homo sapiens
ttaaatattatgttgtctgcaa

SEQ ID NO: 7859513 - DNA, 22 bp, Homo sapiens
ttaaatattttcagcagggtca

SEQ ID NO: 7859514 - DNA, 22 bp, Homo sapiens
ttaaatattatgttgtctgcaa

SEQ ID NO: 7859515 - DNA, 22 bp, Homo sapiens
ttaaatattatgttgtctgcaa

SEQ ID NO: 7859516 - DNA, 23 bp, Homo sapiens
tgtttttcattcacatgggctgt

SEQ ID NO: 7859517 - DNA, 23 bp, Homo sapiens
tgtttttcattcacatgggctgt

SEQ ID NO: 7859518 - DNA, 22 bp, Homo sapiens
ttaaagcatcacactattaatt

SEQ ID NO: 7859519 - DNA, 22 bp, Homo sapiens
tgtttttatctctgtgtacaac

SEQ ID NO: 7859520 - DNA, 22 bp, Homo sapiens
tgtttttatctctgtgtacaac

SEQ ID NO: 7859521 - DNA, 22 bp, Homo sapiens
ttaaagcatgttgcttaacagg

SEQ ID NO: 7859522 - DNA, 22 bp, Homo sapiens
ttaaagccatctagattttgag

SEQ ID NO: 7859523 - DNA, 22 bp, Homo sapiens
ttaaagcatcctgtcagtctgt

SEQ ID NO: 7859524 - DNA, 22 bp, Homo sapiens
ttaaagcatcctgtcagtctgt

SEQ ID NO: 7859525 - DNA, 22 bp, Homo sapiens
ttaaagcatgctgcttttccat

SEQ ID NO: 7859526 - DNA, 22 bp, Homo sapiens
tgttttgtttatgagagcacag

SEQ ID NO: 7859527 - DNA, 22 bp, Homo sapiens
tgttttgtttatgagagcacag

SEQ ID NO: 7859528 - DNA, 22 bp, Homo sapiens
tgttttgttcactgcattgtcc

SEQ ID NO: 7859529 - DNA, 22 bp, Homo sapiens
tgttttgtttatgagagcacag

SEQ ID NO: 7859530 - DNA, 22 bp, Homo sapiens
tgtttttaaaatgtcctggtta

SEQ ID NO: 7859531 - DNA, 22 bp, Homo sapiens
tgtttttaaaatgtcctggtta

SEQ ID NO: 7859532 - DNA, 22 bp, Homo sapiens
tgtttttaaataatgatagaaa

SEQ ID NO: 7859533 - DNA, 22 bp, Homo sapiens
tgtttttaaataatgatagaaa

SEQ ID NO: 7859534 - DNA, 22 bp, Homo sapiens
tgtttttaaataatgatagaaa

SEQ ID NO: 7859535 - DNA, 22 bp, Homo sapiens
tgtttttaaataatgatagaaa

SEQ ID NO: 7859536 - DNA, 22 bp, Homo sapiens
tgtttttaaataatgatagaaa

SEQ ID NO: 7859537 - DNA, 22 bp, Homo sapiens
tgtttttaaataatgatagaaa

SEQ ID NO: 7859538 - DNA, 22 bp, Homo sapiens
tgtttttaaataatgatagaaa

SEQ ID NO: 7859539 - DNA, 22 bp, Homo sapiens
tgtttttaaataatgatagaaa

SEQ ID NO: 7859540 - DNA, 22 bp, Homo sapiens
tgtttttactgtgatccagaaa

SEQ ID NO: 7859541 - DNA, 22 bp, Homo sapiens
tgtttttatctctgtgtacaac

SEQ ID NO: 7859542 - DNA, 22 bp, Homo sapiens
ttaactattattagcatctttg

SEQ ID NO: 7859543 - DNA, 22 bp, Homo sapiens
ttaacgaattgtgcataattcc

SEQ ID NO: 7859544 - DNA, 22 bp, Homo sapiens
ttaactctccctccttacatcc

SEQ ID NO: 7859545 - DNA, 22 bp, Homo sapiens
ttaactgctaccattattttcc

SEQ ID NO: 7859546 - DNA, 22 bp, Homo sapiens
ttaacatttgtgaagcatttag

SEQ ID NO: 7859547 - DNA, 22 bp, Homo sapiens
ttaacatttgtgaagcatttag

SEQ ID NO: 7859548 - DNA, 22 bp, Homo sapiens
ttaacctaactcatggaaaaca

SEQ ID NO: 7859549 - DNA, 22 bp, Homo sapiens
ttaaccaggtcctttgaaaaca

SEQ ID NO: 7859550 - DNA, 22 bp, Homo sapiens
ttaaccagtacttattgagcac

SEQ ID NO: 7859551 - DNA, 22 bp, Homo sapiens
ttaaccaaataaaagcagactc

SEQ ID NO: 7859552 - DNA, 22 bp, Homo sapiens
ttaacattgtccttagcagatt

SEQ ID NO: 7859553 - DNA, 22 bp, Homo sapiens
ttaacattgtccttagcagatt

SEQ ID NO: 7859554 - DNA, 22 bp, Homo sapiens
ttaacattgtccttagcagatt

SEQ ID NO: 7859555 - DNA, 22 bp, Homo sapiens
ttaacattgtccttagcagatt

SEQ ID NO: 7859556 - DNA, 22 bp, Homo sapiens
ttaacattgtccttagcagatt

SEQ ID NO: 7859557 - DNA, 22 bp, Homo sapiens
ttaacattgtccttagcagatt

SEQ ID NO: 7859558 - DNA, 22 bp, Homo sapiens
ttaacattaaaagcagcatttt

SEQ ID NO: 7859559 - DNA, 22 bp, Homo sapiens
ttaacattaaaagcagcatttt

SEQ ID NO: 7859560 - DNA, 22 bp, Homo sapiens
ttaacatgtcttgacttcatct

SEQ ID NO: 7859561 - DNA, 22 bp, Homo sapiens
ttaacatgtcttgacttcatct

SEQ ID NO: 7859562 - DNA, 22 bp, Homo sapiens
ttaacatgtcttgacttcatct

SEQ ID NO: 7859563 - DNA, 22 bp, Homo sapiens
ttaacatacatcatgaacaatg

SEQ ID NO: 7859564 - DNA, 22 bp, Homo sapiens
ttaacatacatcatgaacaatg

SEQ ID NO: 7859565 - DNA, 22 bp, Homo sapiens
ttaacatacatcatgaacaatg

SEQ ID NO: 7859566 - DNA, 22 bp, Homo sapiens
ttaacagtggctaagactgagg

SEQ ID NO: 7859567 - DNA, 22 bp, Homo sapiens
ttaacagtggctaagactgagg

SEQ ID NO: 7859568 - DNA, 22 bp, Homo sapiens
ttaacatacatcatgaacaatg

SEQ ID NO: 7859569 - DNA, 22 bp, Homo sapiens
ttaacagcttgtaatagaaggg

SEQ ID NO: 7859570 - DNA, 22 bp, Homo sapiens
ttaacagctttgggtctgatat

SEQ ID NO: 7859571 - DNA, 22 bp, Homo sapiens
ttaacagctgttgcttctcttc

SEQ ID NO: 7859572 - DNA, 22 bp, Homo sapiens
ttaacagctttgggtctgatat

SEQ ID NO: 7859573 - DNA, 19 bp, Homo sapiens
ttaacagtcaccaaggaga

SEQ ID NO: 7859574 - DNA, 22 bp, Homo sapiens
ttaacagacttgggattttcta

SEQ ID NO: 7859575 - DNA, 22 bp, Homo sapiens
ttaacagacatatatatttgta

SEQ ID NO: 7859576 - DNA, 22 bp, Homo sapiens
ttaacagacatatatatttgta

SEQ ID NO: 7859577 - DNA, 22 bp, Homo sapiens
ttaacagaggacacatcaaact

SEQ ID NO: 7859578 - DNA, 22 bp, Homo sapiens
ttaacagagtgcctggcatgta

SEQ ID NO: 7859579 - DNA, 22 bp, Homo sapiens
ttaacagaggacacatcaaact

SEQ ID NO: 7859580 - DNA, 22 bp, Homo sapiens
ttaacactatctgtcataatta

SEQ ID NO: 7859581 - DNA, 22 bp, Homo sapiens
ttaacacatccctgctctaccc

SEQ ID NO: 7859582 - DNA, 22 bp, Homo sapiens
ttaagaaggtactcaaagatct

SEQ ID NO: 7859583 - DNA, 22 bp, Homo sapiens
ttaagaaggtactcaaagatct

SEQ ID NO: 7859584 - DNA, 22 bp, Homo sapiens
ttaagaatggaatgaggaattt

SEQ ID NO: 7859585 - DNA, 22 bp, Homo sapiens
ttaagaatggaatgaggaattt

SEQ ID NO: 7859586 - DNA, 22 bp, Homo sapiens
ttaagacacatttctcagacgg

SEQ ID NO: 7859587 - DNA, 21 bp, Homo sapiens
ttaagacacacagattaagga

SEQ ID NO: 7859588 - DNA, 20 bp, Homo sapiens
ttaagaaaagcacatcctgc

SEQ ID NO: 7859589 - DNA, 20 bp, Homo sapiens
ttaagaaaagcacatcctgc

SEQ ID NO: 7859590 - DNA, 20 bp, Homo sapiens
ttaagaaaagcacatcctgc

SEQ ID NO: 7859591 - DNA, 20 bp, Homo sapiens
ttaagaaaagcacatcctgc

SEQ ID NO: 7859592 - DNA, 21 bp, Homo sapiens
ttaagaagcactgctctaaga

SEQ ID NO: 7859593 - DNA, 20 bp, Homo sapiens
ttaagaaaagcacatcctgc

SEQ ID NO: 7859594 - DNA, 20 bp, Homo sapiens
ttaagaaaagcacatcctgc

SEQ ID NO: 7859595 - DNA, 20 bp, Homo sapiens
ttaagaaaagcacatcctgc

SEQ ID NO: 7859596 - DNA, 22 bp, Homo sapiens
ttaaggaaagccaaaatgaatt

SEQ ID NO: 7859597 - DNA, 22 bp, Homo sapiens
ttaaggaaagccaaaatgaatt

SEQ ID NO: 7859598 - DNA, 22 bp, Homo sapiens
ttaaggaaagattagcatttgt

SEQ ID NO: 7859599 - DNA, 22 bp, Homo sapiens
ttaagagcaacatatggtgaca

SEQ ID NO: 7859600 - DNA, 22 bp, Homo sapiens
ttaagagatttaggaacattat

SEQ ID NO: 7859601 - DNA, 22 bp, Homo sapiens
ttaaggaacaattctacacacc

SEQ ID NO: 7859602 - DNA, 22 bp, Homo sapiens
ttaaggaacaattctacacacc

SEQ ID NO: 7859603 - DNA, 22 bp, Homo sapiens
ttaaggaaccacagcatgttag

SEQ ID NO: 7859604 - DNA, 22 bp, Homo sapiens
ttaaggaacaattctacacacc

SEQ ID NO: 7859605 - DNA, 22 bp, Homo sapiens
ttaaggaaatcttggtgtcaca

SEQ ID NO: 7859606 - DNA, 22 bp, Homo sapiens
ttaaggaaagccaaaatgaatt

SEQ ID NO: 7859607 - DNA, 22 bp, Homo sapiens
ttaaggaaagccaaaatgaatt

SEQ ID NO: 7859608 - DNA, 22 bp, Homo sapiens
ttaaggaaggtgaatttcttgg

SEQ ID NO: 7859609 - DNA, 22 bp, Homo sapiens
ttaaggaaggtgaatttcttgg

SEQ ID NO: 7859610 - DNA, 22 bp, Homo sapiens
ttaaggaaggcacagcagttga

SEQ ID NO: 7859611 - DNA, 22 bp, Homo sapiens
ttaaggaaggcacagcagttga

SEQ ID NO: 7859612 - DNA, 22 bp, Homo sapiens
ttaaggaatattcatgaagttt

SEQ ID NO: 7859613 - DNA, 22 bp, Homo sapiens
ttaaggaatggttggaatggat

SEQ ID NO: 7859614 - DNA, 22 bp, Homo sapiens
ttaaggaacttgtctttctctt

SEQ ID NO: 7859615 - DNA, 22 bp, Homo sapiens
ttaaggaagaattgcaatggca

SEQ ID NO: 7859616 - DNA, 22 bp, Homo sapiens
ttaaggaagacagggcaaggtg

SEQ ID NO: 7859617 - DNA, 22 bp, Homo sapiens
ttaaggaagacagggcaaggtg

SEQ ID NO: 7859618 - DNA, 20 bp, Homo sapiens
ttaaggaagccaccggtcag

SEQ ID NO: 7859619 - DNA, 22 bp, Homo sapiens
ttaaggaagagacttttgcgtt

SEQ ID NO: 7859620 - DNA, 22 bp, Homo sapiens
ttaaggaagcctatgggaatag

SEQ ID NO: 7859621 - DNA, 22 bp, Homo sapiens
ttaaggaaggagtcttaaatgg

SEQ ID NO: 7859622 - DNA, 22 bp, Homo sapiens
ttaagagaaggaatgacctagc

SEQ ID NO: 7859623 - DNA, 22 bp, Homo sapiens
ttaagagaagagtatctagaac

SEQ ID NO: 7859624 - DNA, 22 bp, Homo sapiens
ttaagagaagagtatctagaac

SEQ ID NO: 7859625 - DNA, 22 bp, Homo sapiens
ttaagagatttaggaacattat

SEQ ID NO: 7859626 - DNA, 22 bp, Homo sapiens
ttaagagatttaggaacattat

SEQ ID NO: 7859627 - DNA, 22 bp, Homo sapiens
ttaagagacaggagaatgatgt

SEQ ID NO: 7859628 - DNA, 22 bp, Homo sapiens
ttaagagacaggagaatgatgt

SEQ ID NO: 7859629 - DNA, 22 bp, Homo sapiens
ttaagagacaggagaatgatgt

SEQ ID NO: 7859630 - DNA, 22 bp, Homo sapiens
ttaagacatgtgagcataactt

SEQ ID NO: 7859631 - DNA, 22 bp, Homo sapiens
ttaagacattcagatatttcta

SEQ ID NO: 7859632 - DNA, 22 bp, Homo sapiens
ttaattctagtttaacacttag

SEQ ID NO: 7859633 - DNA, 22 bp, Homo sapiens
ttaattctagtttaacacttag

SEQ ID NO: 7859634 - DNA, 22 bp, Homo sapiens
ttaattctagtttaacacttag

SEQ ID NO: 7859635 - DNA, 22 bp, Homo sapiens
ttaattctgcctttcatgtaac

SEQ ID NO: 7859636 - DNA, 22 bp, Homo sapiens
ttaattcttccggactgtgaaa

SEQ ID NO: 7859637 - DNA, 22 bp, Homo sapiens
ttaattctgcctttcatgtaac

SEQ ID NO: 7859638 - DNA, 22 bp, Homo sapiens
ttaattctgcctttcatgtaac

SEQ ID NO: 7859639 - DNA, 22 bp, Homo sapiens
ttaattgtctgtgagtacctga

SEQ ID NO: 7859640 - DNA, 22 bp, Homo sapiens
ttaattgttggaaatagattat

SEQ ID NO: 7859641 - DNA, 22 bp, Homo sapiens
ttaattgttggaaatagattat

SEQ ID NO: 7859642 - DNA, 22 bp, Homo sapiens
ttaattgagccagaaagtatct

SEQ ID NO: 7859643 - DNA, 22 bp, Homo sapiens
ttaattgatataaagaacttca

SEQ ID NO: 7859644 - DNA, 22 bp, Homo sapiens
ttaatttatacataatcacagg

SEQ ID NO: 7859645 - DNA, 22 bp, Homo sapiens
ttaatttatacataatcacagg

SEQ ID NO: 7859646 - DNA, 22 bp, Homo sapiens
ttaatttatacataatcacagg

SEQ ID NO: 7859647 - DNA, 22 bp, Homo sapiens
ttaatttatgtccaaaccagat

SEQ ID NO: 7859648 - DNA, 22 bp, Homo sapiens
ttaatttatacataatcacagg

SEQ ID NO: 7859649 - DNA, 22 bp, Homo sapiens
ttaatttatacataatcacagg

SEQ ID NO: 7859650 - DNA, 22 bp, Homo sapiens
ttaattagtagaggcatttagt

SEQ ID NO: 7859651 - DNA, 22 bp, Homo sapiens
ttaattatgagaaagggaaaag

SEQ ID NO: 7859652 - DNA, 22 bp, Homo sapiens
ttaattatgagaaagggaaaag

SEQ ID NO: 7859653 - DNA, 22 bp, Homo sapiens
ttaattatgcaaaaggccccat

SEQ ID NO: 7859654 - DNA, 22 bp, Homo sapiens
ttaattcagtcaaagaaaccat

SEQ ID NO: 7859655 - DNA, 22 bp, Homo sapiens
ttaattactaagcacaatgcaa

SEQ ID NO: 7859656 - DNA, 22 bp, Homo sapiens
ttaattactaagcacaatgcaa

SEQ ID NO: 7859657 - DNA, 22 bp, Homo sapiens
ttaattagagctgatgttcata

SEQ ID NO: 7859658 - DNA, 22 bp, Homo sapiens
ttaattacaaaacacataggtt

SEQ ID NO: 7859659 - DNA, 22 bp, Homo sapiens
ttaattaattagttaagcatgt

SEQ ID NO: 7859660 - DNA, 22 bp, Homo sapiens
ttaattacaaaacacataggtt

SEQ ID NO: 7859661 - DNA, 22 bp, Homo sapiens
ttaattactaagcacaatgcaa

SEQ ID NO: 7859662 - DNA, 22 bp, Homo sapiens
ttaagttttaaagctagagtct

SEQ ID NO: 7859663 - DNA, 22 bp, Homo sapiens
ttaataaacaggtgcagctgaa

SEQ ID NO: 7859664 - DNA, 22 bp, Homo sapiens
ttaagtaacttgtccaaatgag

SEQ ID NO: 7859665 - DNA, 22 bp, Homo sapiens
ttaataaacaggtgcagctgaa

SEQ ID NO: 7859666 - DNA, 22 bp, Homo sapiens
ttaataaacaggtgcagctgaa

SEQ ID NO: 7859667 - DNA, 22 bp, Homo sapiens
ttaataaacaggtgcagctgaa

SEQ ID NO: 7859668 - DNA, 22 bp, Homo sapiens
ttaataaacaggtgcagctgaa

SEQ ID NO: 7859669 - DNA, 22 bp, Homo sapiens
ttaataaacaggtgcagctgaa

SEQ ID NO: 7859670 - DNA, 22 bp, Homo sapiens
ttaataaagtatgaattggaaa

SEQ ID NO: 7859671 - DNA, 22 bp, Homo sapiens
ttaataaagtatgaattggaaa

SEQ ID NO: 7859672 - DNA, 22 bp, Homo sapiens
ttaataaacaggtgcagctgaa

SEQ ID NO: 7859673 - DNA, 22 bp, Homo sapiens
ttaataaacaggtgcagctgaa

SEQ ID NO: 7859674 - DNA, 22 bp, Homo sapiens
ttaataaacaggtgcagctgaa

SEQ ID NO: 7859675 - DNA, 22 bp, Homo sapiens
ttaagttttaaagctagagtct

SEQ ID NO: 7859676 - DNA, 22 bp, Homo sapiens
ttaagtgtttagtaagagatgt

SEQ ID NO: 7859677 - DNA, 22 bp, Homo sapiens
ttaagtgcttcaagggaagctc

SEQ ID NO: 7859678 - DNA, 22 bp, Homo sapiens
ttaagtgtagtgctaagggcag

SEQ ID NO: 7859679 - DNA, 22 bp, Homo sapiens
ttaagtgagcttgaataatctt

SEQ ID NO: 7859680 - DNA, 22 bp, Homo sapiens
ttaagtgcaaaaatgaaagtat

SEQ ID NO: 7859681 - DNA, 22 bp, Homo sapiens
ttaagtgcacaatgaggtcaca

SEQ ID NO: 7859682 - DNA, 22 bp, Homo sapiens
ttaagtgcacaatgaggtcaca

SEQ ID NO: 7859683 - DNA, 22 bp, Homo sapiens
ttaagtgccagtgctccctcag

SEQ ID NO: 7859684 - DNA, 22 bp, Homo sapiens
ttaagtgcaaaaatgaaagtat

SEQ ID NO: 7859685 - DNA, 23 bp, Homo sapiens
ttaagtggtcagttttagacaac

SEQ ID NO: 7859686 - DNA, 18 bp, Homo sapiens
ttaagtgctatgcaattg

SEQ ID NO: 7859687 - DNA, 18 bp, Homo sapiens
ttaagtgctatgcaattg

SEQ ID NO: 7859688 - DNA, 22 bp, Homo sapiens
ttaagtgcctctaaaacaagcc

SEQ ID NO: 7859689 - DNA, 22 bp, Homo sapiens
ttaagtgcctctaaaacaagcc

SEQ ID NO: 7859690 - DNA, 22 bp, Homo sapiens
ttaagtgcctacttgtgagtta

SEQ ID NO: 7859691 - DNA, 22 bp, Homo sapiens
ttaagtatatccatttgactgg

SEQ ID NO: 7859692 - DNA, 22 bp, Homo sapiens
ttaagtaacttgtccaaatgag

SEQ ID NO: 7859693 - DNA, 22 bp, Homo sapiens
ttaagtacagggttagtgacgg

SEQ ID NO: 7859694 - DNA, 22 bp, Homo sapiens
ttaagtcacttatctaaagaca

SEQ ID NO: 7859695 - DNA, 22 bp, Homo sapiens
ttaagtgagcttgaataatctt

SEQ ID NO: 7859696 - DNA, 22 bp, Homo sapiens
ttaagtcatttctgattataga

SEQ ID NO: 7859697 - DNA, 17 bp, Homo sapiens
ttaaggtggatcagcac

SEQ ID NO: 7859698 - DNA, 22 bp, Homo sapiens
ttaaggtccacagtataaagat

SEQ ID NO: 7859699 - DNA, 22 bp, Homo sapiens
ttaaggtccacagtataaagat

SEQ ID NO: 7859700 - DNA, 22 bp, Homo sapiens
ttaaggtgctttatttagctct

SEQ ID NO: 7859701 - DNA, 22 bp, Homo sapiens
ttaaggttgagctcacttttat

SEQ ID NO: 7859702 - DNA, 22 bp, Homo sapiens
ttaaggttgagctcacttttat

SEQ ID NO: 7859703 - DNA, 22 bp, Homo sapiens
ttaaggctgtaagatacattca

SEQ ID NO: 7859704 - DNA, 22 bp, Homo sapiens
ttaaggctgagatctattacgc

SEQ ID NO: 7859705 - DNA, 22 bp, Homo sapiens
ttaaggctgttggtatttcaga

SEQ ID NO: 7859706 - DNA, 22 bp, Homo sapiens
ttaaggctgtggggattactgc

SEQ ID NO: 7859707 - DNA, 22 bp, Homo sapiens
ttaaggctgtaagatacattca

SEQ ID NO: 7859708 - DNA, 22 bp, Homo sapiens
ttaagggccattatggatgggt

SEQ ID NO: 7859709 - DNA, 22 bp, Homo sapiens
ttaaggctgtggggattactgc

SEQ ID NO: 7859710 - DNA, 22 bp, Homo sapiens
ttaaggctgttggtatttcaga

SEQ ID NO: 7859711 - DNA, 22 bp, Homo sapiens
ttaaggtagctcactaaatatg

SEQ ID NO: 7859712 - DNA, 23 bp, Homo sapiens
ttaaggagcttgcactctgggtg

SEQ ID NO: 7859713 - DNA, 22 bp, Homo sapiens
ttaaggaggacgttcctggtgg

SEQ ID NO: 7859714 - DNA, 22 bp, Homo sapiens
ttaaggaattacgaaaatattt

SEQ ID NO: 7859715 - DNA, 22 bp, Homo sapiens
ttaaggaattacgaaaatattt

SEQ ID NO: 7859716 - DNA, 22 bp, Homo sapiens
ttaaggaattacgaaaatattt

SEQ ID NO: 7859717 - DNA, 22 bp, Homo sapiens
ttaaggaatgtgcagtttatat

SEQ ID NO: 7859718 - DNA, 22 bp, Homo sapiens
ttaaggaatttatagttgtact

SEQ ID NO: 7859719 - DNA, 22 bp, Homo sapiens
ttaaggaattacgaaaatattt

SEQ ID NO: 7859720 - DNA, 22 bp, Homo sapiens
ttaaggcattctcctactaata

SEQ ID NO: 7859721 - DNA, 22 bp, Homo sapiens
ttaaggctgagatctattacgc

SEQ ID NO: 7859722 - DNA, 22 bp, Homo sapiens
ttaaggcattctcctactaata

SEQ ID NO: 7859723 - DNA, 22 bp, Homo sapiens
ttaaggcacctgggggtgaact

SEQ ID NO: 7859724 - DNA, 22 bp, Homo sapiens
ttcagtcttgttgaaaacttgg

SEQ ID NO: 7859725 - DNA, 22 bp, Homo sapiens
ttcagtctctccctatgtttct

SEQ ID NO: 7859726 - DNA, 20 bp, Homo sapiens
ttcagtctcctgcttccttc

SEQ ID NO: 7859727 - DNA, 22 bp, Homo sapiens
ttcagtctcatggatgtgaaat

SEQ ID NO: 7859728 - DNA, 22 bp, Homo sapiens
ttcagtctcaagtgctgctcac

SEQ ID NO: 7859729 - DNA, 22 bp, Homo sapiens
ttcagtctcaagtgctgctcac

SEQ ID NO: 7859730 - DNA, 22 bp, Homo sapiens
ttcagtatttgaaaccataggc

SEQ ID NO: 7859731 - DNA, 22 bp, Homo sapiens
ttcagtccatcaggcgtggcat

SEQ ID NO: 7859732 - DNA, 22 bp, Homo sapiens
ttcagtccatcaggcgtggcat

SEQ ID NO: 7859733 - DNA, 22 bp, Homo sapiens
ttcagtcctcacaacctcacta

SEQ ID NO: 7859734 - DNA, 22 bp, Homo sapiens
ttcagtcccttgcttaaattta

SEQ ID NO: 7859735 - DNA, 22 bp, Homo sapiens
ttcagtcagtgactaagcagtt

SEQ ID NO: 7859736 - DNA, 22 bp, Homo sapiens
ttcagtatgattcctccagtag

SEQ ID NO: 7859737 - DNA, 22 bp, Homo sapiens
ttcagtatgacagacgcattgg

SEQ ID NO: 7859738 - DNA, 22 bp, Homo sapiens
ttcagtatgtgtaaactacttt

SEQ ID NO: 7859739 - DNA, 22 bp, Homo sapiens
ttcagtatacttcataacattt

SEQ ID NO: 7859740 - DNA, 22 bp, Homo sapiens
ttcagtagggccctcacacagt

SEQ ID NO: 7859741 - DNA, 22 bp, Homo sapiens
ttcagtaaggataataaacaga

SEQ ID NO: 7859742 - DNA, 22 bp, Homo sapiens
ttcaggtgtcaaggataggctg

SEQ ID NO: 7859743 - DNA, 22 bp, Homo sapiens
ttcaggtgggccttttgagcat

SEQ ID NO: 7859744 - DNA, 22 bp, Homo sapiens
ttcagggttacagttggctctg

SEQ ID NO: 7859745 - DNA, 22 bp, Homo sapiens
ttcaggtgtggccagaggagaa

SEQ ID NO: 7859746 - DNA, 22 bp, Homo sapiens
ttcaggtgtggccagaggagaa

SEQ ID NO: 7859747 - DNA, 22 bp, Homo sapiens
ttcagtaaaacactgcaatgtc

SEQ ID NO: 7859748 - DNA, 22 bp, Homo sapiens
ttcagtaagcacttctagagct

SEQ ID NO: 7859749 - DNA, 20 bp, Homo sapiens
ttcagggctttggggacacc

SEQ ID NO: 7859750 - DNA, 20 bp, Homo sapiens
ttcagggctttggggacacc

SEQ ID NO: 7859751 - DNA, 22 bp, Homo sapiens
ttcaggaggtgagcaagaaggg

SEQ ID NO: 7859752 - DNA, 20 bp, Homo sapiens
ttcagggtgagagttctagg

SEQ ID NO: 7859753 - DNA, 22 bp, Homo sapiens
ttcagggtctagagtatctacc

SEQ ID NO: 7859754 - DNA, 22 bp, Homo sapiens
ttcaggaggtgagcaagaaggg

SEQ ID NO: 7859755 - DNA, 22 bp, Homo sapiens
ttcaggaggtgagcaagaaggg

SEQ ID NO: 7859756 - DNA, 22 bp, Homo sapiens
ttcaggagaattccaagaagta

SEQ ID NO: 7859757 - DNA, 22 bp, Homo sapiens
ttcaggagaattccaagaagta

SEQ ID NO: 7859758 - DNA, 22 bp, Homo sapiens
ttcaggagaaagttcagtactt

SEQ ID NO: 7859759 - DNA, 22 bp, Homo sapiens
ttcaggagaattccaagaagta

SEQ ID NO: 7859760 - DNA, 22 bp, Homo sapiens
ttcacagtggctaagttctgca

SEQ ID NO: 7859761 - DNA, 22 bp, Homo sapiens
ttcacagtggctaagttctgca

SEQ ID NO: 7859762 - DNA, 22 bp, Homo sapiens
ttcacagtggccctctctgagt

SEQ ID NO: 7859763 - DNA, 22 bp, Homo sapiens
ttcacagtggccctctctgagt

SEQ ID NO: 7859764 - DNA, 22 bp, Homo sapiens
ttcacagtggctaagttctgca

SEQ ID NO: 7859765 - DNA, 22 bp, Homo sapiens
ttcacagtggctaagttctgca

SEQ ID NO: 7859766 - DNA, 22 bp, Homo sapiens
ttcacagtggctaagttctgca

SEQ ID NO: 7859767 - DNA, 22 bp, Homo sapiens
ttcacagtggccctctctgagt

SEQ ID NO: 7859768 - DNA, 22 bp, Homo sapiens
ttcacagtggccctctctgagt

SEQ ID NO: 7859769 - DNA, 22 bp, Homo sapiens
ttcacagtggccctctctgagt

SEQ ID NO: 7859770 - DNA, 22 bp, Homo sapiens
ttcacagtggccctctctgagt

SEQ ID NO: 7859771 - DNA, 21 bp, Homo sapiens
ttcacagtggataactttctg

SEQ ID NO: 7859772 - DNA, 22 bp, Homo sapiens
ttcacagtgctgcacctggctt

SEQ ID NO: 7859773 - DNA, 22 bp, Homo sapiens
ttcacagtgctgcacctggctt

SEQ ID NO: 7859774 - DNA, 22 bp, Homo sapiens
ttcacagtgctgcacctggctt

SEQ ID NO: 7859775 - DNA, 21 bp, Homo sapiens
ttcacagtggataactttctg

SEQ ID NO: 7859776 - DNA, 21 bp, Homo sapiens
ttcacagtggataactttctg

SEQ ID NO: 7859777 - DNA, 22 bp, Homo sapiens
ttcacagtggctgtgccatttg

SEQ ID NO: 7859778 - DNA, 22 bp, Homo sapiens
ttcacagtggctgtgccatttg

SEQ ID NO: 7859779 - DNA, 22 bp, Homo sapiens
ttcacagtggctgacaggctgg

SEQ ID NO: 7859780 - DNA, 22 bp, Homo sapiens
ttcacagtggctgacaggctgg

SEQ ID NO: 7859781 - DNA, 22 bp, Homo sapiens
ttcacagtggctgacaggctgg

SEQ ID NO: 7859782 - DNA, 22 bp, Homo sapiens
ttcacagtggctgacaggctgg

SEQ ID NO: 7859783 - DNA, 22 bp, Homo sapiens
ttcacagtggctaagttctgca

SEQ ID NO: 7859784 - DNA, 22 bp, Homo sapiens
ttcacattacaaggccatattt

SEQ ID NO: 7859785 - DNA, 22 bp, Homo sapiens
ttcacattacaaggccatattt

SEQ ID NO: 7859786 - DNA, 22 bp, Homo sapiens
ttcacagtggcttaggctatgg

SEQ ID NO: 7859787 - DNA, 22 bp, Homo sapiens
ttcacattagccaagagatgga

SEQ ID NO: 7859788 - DNA, 22 bp, Homo sapiens
ttcacattagccaagagatgga

SEQ ID NO: 7859789 - DNA, 22 bp, Homo sapiens
ttcacattagtggttctatata

SEQ ID NO: 7859790 - DNA, 22 bp, Homo sapiens
ttcacattagtggttctatata

SEQ ID NO: 7859791 - DNA, 22 bp, Homo sapiens
ttcacattagtggttctatata

SEQ ID NO: 7859792 - DNA, 22 bp, Homo sapiens
ttcaggactaggggcttcaagg

SEQ ID NO: 7859793 - DNA, 19 bp, Homo sapiens
ttcacattggaagaagtag

SEQ ID NO: 7859794 - DNA, 22 bp, Homo sapiens
ttcacattgaaggtgctttctt

SEQ ID NO: 7859795 - DNA, 19 bp, Homo sapiens
ttcacattggaagaagtag

SEQ ID NO: 7859796 - DNA, 19 bp, Homo sapiens
ttcacattggaagaagtag

SEQ ID NO: 7859797 - DNA, 22 bp, Homo sapiens
ttcacattgaaggtgctttctt

SEQ ID NO: 7859798 - DNA, 22 bp, Homo sapiens
ttcacattgaaggtgctttctt

SEQ ID NO: 7859799 - DNA, 22 bp, Homo sapiens
ttcacattctcacaagaggaaa

SEQ ID NO: 7859800 - DNA, 22 bp, Homo sapiens
ttcacattctcacaagaggaaa

SEQ ID NO: 7859801 - DNA, 22 bp, Homo sapiens
ttcacattccgcggctattttc

SEQ ID NO: 7859802 - DNA, 22 bp, Homo sapiens
ttcacattcagaaaaagcccgt

SEQ ID NO: 7859803 - DNA, 22 bp, Homo sapiens
ttcacattcagaaaaagcccgt

SEQ ID NO: 7859804 - DNA, 22 bp, Homo sapiens
ttcacattccgcggctattttc

SEQ ID NO: 7859805 - DNA, 22 bp, Homo sapiens
ttcacattatcaggattgtttc

SEQ ID NO: 7859806 - DNA, 22 bp, Homo sapiens
ttcacattatcaggattgtttc

SEQ ID NO: 7859807 - DNA, 22 bp, Homo sapiens
ttcacattagtggttctatata

SEQ ID NO: 7859808 - DNA, 22 bp, Homo sapiens
ttcacattagtggttctatata

SEQ ID NO: 7859809 - DNA, 22 bp, Homo sapiens
ttcacattataatcagttctgc

SEQ ID NO: 7859810 - DNA, 22 bp, Homo sapiens
ttcacattataatcagttctgc

SEQ ID NO: 7859811 - DNA, 22 bp, Homo sapiens
ttcacattataatcagttctgc

SEQ ID NO: 7859812 - DNA, 22 bp, Homo sapiens
ttcacattataatcagttctgc

SEQ ID NO: 7859813 - DNA, 22 bp, Homo sapiens
ttcatgtattgcattgtgtcct

SEQ ID NO: 7859814 - DNA, 22 bp, Homo sapiens
ttcatgtccagaggaagttgag

SEQ ID NO: 7859815 - DNA, 22 bp, Homo sapiens
ttcatgtgaatatatttgtctt

SEQ ID NO: 7859816 - DNA, 22 bp, Homo sapiens
ttcatgtgaatatatttgtctt

SEQ ID NO: 7859817 - DNA, 22 bp, Homo sapiens
ttcatgtctgccttttcaagtg

SEQ ID NO: 7859818 - DNA, 22 bp, Homo sapiens
ttcatgtctgccttttcaagtg

SEQ ID NO: 7859819 - DNA, 22 bp, Homo sapiens
ttcatgtagtgtaatgtcttca

SEQ ID NO: 7859820 - DNA, 22 bp, Homo sapiens
ttcatgtatgaggccaatcttt

SEQ ID NO: 7859821 - DNA, 22 bp, Homo sapiens
ttcatgtagtgtaatgtcttca

SEQ ID NO: 7859822 - DNA, 22 bp, Homo sapiens
ttcatgtaggctgcaatgcaca

SEQ ID NO: 7859823 - DNA, 22 bp, Homo sapiens
ttcatgtaccgtgtaccaggca

SEQ ID NO: 7859824 - DNA, 22 bp, Homo sapiens
ttcatgtaacttttcttctcca

SEQ ID NO: 7859825 - DNA, 22 bp, Homo sapiens
ttcatgtaacttttcttctcca

SEQ ID NO: 7859826 - DNA, 22 bp, Homo sapiens
ttcatgggtccagagccctggg

SEQ ID NO: 7859827 - DNA, 20 bp, Homo sapiens
ttcatggtgtatttctttct

SEQ ID NO: 7859828 - DNA, 22 bp, Homo sapiens
ttcatgtaataggatgtgttaa

SEQ ID NO: 7859829 - DNA, 20 bp, Homo sapiens
ttcatgggagcaaagaggcc

SEQ ID NO: 7859830 - DNA, 20 bp, Homo sapiens
ttcatgggagcaaagaggcc

SEQ ID NO: 7859831 - DNA, 20 bp, Homo sapiens
ttcatgggagcaaagaggcc

SEQ ID NO: 7859832 - DNA, 20 bp, Homo sapiens
ttcatgggagcaaagaggcc

SEQ ID NO: 7859833 - DNA, 20 bp, Homo sapiens
ttcatgggagcaaagaggcc

SEQ ID NO: 7859834 - DNA, 18 bp, Homo sapiens
ttcatgttggcttaggga

SEQ ID NO: 7859835 - DNA, 22 bp, Homo sapiens
ttcatgttgtagtatgtatcag

SEQ ID NO: 7859836 - DNA, 22 bp, Homo sapiens
ttcatgtttcatttgttactat

SEQ ID NO: 7859837 - DNA, 22 bp, Homo sapiens
ttcatgttgtagtatgtatcag

SEQ ID NO: 7859838 - DNA, 22 bp, Homo sapiens
ttcatgttgtagtatgtatcag

SEQ ID NO: 7859839 - DNA, 22 bp, Homo sapiens
ttcatgttcatgcttaggaaaa

SEQ ID NO: 7859840 - DNA, 22 bp, Homo sapiens
ttcatgtgtttgttgtcaaggg

SEQ ID NO: 7859841 - DNA, 22 bp, Homo sapiens
ttcatgttcatatgtgtatatc

SEQ ID NO: 7859842 - DNA, 22 bp, Homo sapiens
ttcatgtgtctgtagcacatat

SEQ ID NO: 7859843 - DNA, 22 bp, Homo sapiens
ttcatgtgtctgtagcacatat

SEQ ID NO: 7859844 - DNA, 22 bp, Homo sapiens
ttcatgttcatgcttaggaaaa

SEQ ID NO: 7859845 - DNA, 22 bp, Homo sapiens
ttcatgttggattcactgtgag

SEQ ID NO: 7859846 - DNA, 22 bp, Homo sapiens
ttcatgtgccagagctgaaaat

SEQ ID NO: 7859847 - DNA, 22 bp, Homo sapiens
ttcatgtgataaatgtgtgact

SEQ ID NO: 7859848 - DNA, 22 bp, Homo sapiens
ttcatgtgatcacagattgtaa

SEQ ID NO: 7859849 - DNA, 22 bp, Homo sapiens
ttcatgtgtatggaacattttt

SEQ ID NO: 7859850 - DNA, 22 bp, Homo sapiens
ttcatgtgtatggaacattttt

SEQ ID NO: 7859851 - DNA, 22 bp, Homo sapiens
ttcatgtgtatggaacattttt

SEQ ID NO: 7859852 - DNA, 23 bp, Homo sapiens
ttcatgtggacctagaggcctgt

SEQ ID NO: 7859853 - DNA, 22 bp, Homo sapiens
ttcatgtggaaaagggctttca

SEQ ID NO: 7859854 - DNA, 23 bp, Homo sapiens
ttcatgtggacctagaggcctgt

SEQ ID NO: 7859855 - DNA, 22 bp, Homo sapiens
ttcatcatcagaactgttcact

SEQ ID NO: 7859856 - DNA, 22 bp, Homo sapiens
ttcatcatcagaactgttcact

SEQ ID NO: 7859857 - DNA, 18 bp, Homo sapiens
ttcatcatgactctgtgg

SEQ ID NO: 7859858 - DNA, 22 bp, Homo sapiens
ttcagtgtcacaagagcaagcc

SEQ ID NO: 7859859 - DNA, 22 bp, Homo sapiens
ttcagtgtcacaagagcaagcc

SEQ ID NO: 7859860 - DNA, 22 bp, Homo sapiens
ttcagtgtcaatttttaaatat

SEQ ID NO: 7859861 - DNA, 23 bp, Homo sapiens
ttcatcagttgctgttgcagaac

SEQ ID NO: 7859862 - DNA, 22 bp, Homo sapiens
ttcagtgtatattttttgagta

SEQ ID NO: 7859863 - DNA, 22 bp, Homo sapiens
ttcagtgtatattttttgagta

SEQ ID NO: 7859864 - DNA, 22 bp, Homo sapiens
ttcagtgtacagtgaagggatt

SEQ ID NO: 7859865 - DNA, 22 bp, Homo sapiens
ttcagtgtacagtgaagggatt

SEQ ID NO: 7859866 - DNA, 22 bp, Homo sapiens
ttcagtgtacagtgaagggatt

SEQ ID NO: 7859867 - DNA, 22 bp, Homo sapiens
ttcagtgtatcttgtcagggag

SEQ ID NO: 7859868 - DNA, 22 bp, Homo sapiens
ttcagtgtcaatttttaaatat

SEQ ID NO: 7859869 - DNA, 22 bp, Homo sapiens
ttcagtgtatcttgtcagggag

SEQ ID NO: 7859870 - DNA, 22 bp, Homo sapiens
ttcagtggtttgatgatgtata

SEQ ID NO: 7859871 - DNA, 22 bp, Homo sapiens
ttcagtgacttacctggagcca

SEQ ID NO: 7859872 - DNA, 22 bp, Homo sapiens
ttcagtgacatcatactggtat

SEQ ID NO: 7859873 - DNA, 22 bp, Homo sapiens
ttcagtgacatcatactggtat

SEQ ID NO: 7859874 - DNA, 22 bp, Homo sapiens
ttcagtgacttacctggagcca

SEQ ID NO: 7859875 - DNA, 22 bp, Homo sapiens
ttcagtgagtgaatgaatgaat

SEQ ID NO: 7859876 - DNA, 22 bp, Homo sapiens
ttcagtgagtgaatgaatgaat

SEQ ID NO: 7859877 - DNA, 22 bp, Homo sapiens
ttcagtgcagtcggaactactg

SEQ ID NO: 7859878 - DNA, 22 bp, Homo sapiens
ttcagtgcacagtactgagact

SEQ ID NO: 7859879 - DNA, 22 bp, Homo sapiens
ttcagtgcagacgccgaagccc

SEQ ID NO: 7859880 - DNA, 22 bp, Homo sapiens
ttcagtgcacagtactgagact

SEQ ID NO: 7859881 - DNA, 22 bp, Homo sapiens
ttcagtgcagacgccgaagccc

SEQ ID NO: 7859882 - DNA, 22 bp, Homo sapiens
ttcagtgccgtgctgggtcgct

SEQ ID NO: 7859883 - DNA, 22 bp, Homo sapiens
ttcagtgccgtgctgggtcgct

SEQ ID NO: 7859884 - DNA, 22 bp, Homo sapiens
ttcagtgcctgtccacagcttc

SEQ ID NO: 7859885 - DNA, 22 bp, Homo sapiens
ttcagtgcctgtccacagcttc

SEQ ID NO: 7859886 - DNA, 22 bp, Homo sapiens
ttcagtgcttacaggtttcttt

SEQ ID NO: 7859887 - DNA, 22 bp, Homo sapiens
ttcagtggtttgatgatgtata

SEQ ID NO: 7859888 - DNA, 22 bp, Homo sapiens
ttcagtgcttacaggtttcttt

SEQ ID NO: 7859889 - DNA, 22 bp, Homo sapiens
ttcagtgctaaaaagtctcaag

SEQ ID NO: 7859890 - DNA, 22 bp, Homo sapiens
ttcagtgctaaaaagtctcaag

SEQ ID NO: 7859891 - DNA, 22 bp, Homo sapiens
ttcatcattacagtcatgttat

SEQ ID NO: 7859892 - DNA, 21 bp, Homo sapiens
ttcatcattggtaaaaagtgg

SEQ ID NO: 7859893 - DNA, 21 bp, Homo sapiens
ttcatcattggtaaaaagtgg

SEQ ID NO: 7859894 - DNA, 21 bp, Homo sapiens
ttcatcattggtaaaaagtgg

SEQ ID NO: 7859895 - DNA, 22 bp, Homo sapiens
ttcatcattgccagtctttaaa

SEQ ID NO: 7859896 - DNA, 22 bp, Homo sapiens
ttcatcattgccagtctttaaa

SEQ ID NO: 7859897 - DNA, 23 bp, Homo sapiens
ttcatgatgattaatcagctaca

SEQ ID NO: 7859898 - DNA, 22 bp, Homo sapiens
ttcatgatagtattttttgtga

SEQ ID NO: 7859899 - DNA, 22 bp, Homo sapiens
ttcatgatggcagcatttatag

SEQ ID NO: 7859900 - DNA, 22 bp, Homo sapiens
ttcatgcatggccttactccct

SEQ ID NO: 7859901 - DNA, 22 bp, Homo sapiens
ttcatgattgactatcaagagc

SEQ ID NO: 7859902 - DNA, 22 bp, Homo sapiens
ttcatggagttgagaaggctaa

SEQ ID NO: 7859903 - DNA, 22 bp, Homo sapiens
ttcatggagttgagaaggctaa

SEQ ID NO: 7859904 - DNA, 22 bp, Homo sapiens
ttcatgcttttaccgctgttaa

SEQ ID NO: 7859905 - DNA, 22 bp, Homo sapiens
ttcatggcctactttgcttcaa

SEQ ID NO: 7859906 - DNA, 22 bp, Homo sapiens
ttcatggcatacatgtttccca

SEQ ID NO: 7859907 - DNA, 22 bp, Homo sapiens
ttcatggcaggagtcagaagct

SEQ ID NO: 7859908 - DNA, 22 bp, Homo sapiens
ttcatgccaccccttgaggagt

SEQ ID NO: 7859909 - DNA, 22 bp, Homo sapiens
ttcatgctagtatgtgctgttc

SEQ ID NO: 7859910 - DNA, 22 bp, Homo sapiens
ttcatgctagtatgtgctgttc

SEQ ID NO: 7859911 - DNA, 22 bp, Homo sapiens
ttcatgctcctgccctttttgg

SEQ ID NO: 7859912 - DNA, 22 bp, Homo sapiens
ttcatgctgtgtctacaactta

SEQ ID NO: 7859913 - DNA, 22 bp, Homo sapiens
ttcatgcttgttcctccacctg

SEQ ID NO: 7859914 - DNA, 22 bp, Homo sapiens
ttcatgctgtgtctacaactta

SEQ ID NO: 7859915 - DNA, 22 bp, Homo sapiens
ttcaactttaggcaaagaaaac

SEQ ID NO: 7859916 - DNA, 22 bp, Homo sapiens
ttcaactgggcggatctgagaa

SEQ ID NO: 7859917 - DNA, 22 bp, Homo sapiens
ttcaactttatgcatatgtatt

SEQ ID NO: 7859918 - DNA, 22 bp, Homo sapiens
ttcaactttaggcaaagaaaac

SEQ ID NO: 7859919 - DNA, 22 bp, Homo sapiens
ttcaactttatgcatatgtatt

SEQ ID NO: 7859920 - DNA, 22 bp, Homo sapiens
ttcaactttggagatttaataa

SEQ ID NO: 7859921 - DNA, 22 bp, Homo sapiens
ttcaactcttcaagatcacatc

SEQ ID NO: 7859922 - DNA, 22 bp, Homo sapiens
ttcaactgcaacatcctgcctc

SEQ ID NO: 7859923 - DNA, 22 bp, Homo sapiens
ttcaactattatgaataaaatt

SEQ ID NO: 7859924 - DNA, 22 bp, Homo sapiens
ttcaactcttcaagatcacatc

SEQ ID NO: 7859925 - DNA, 22 bp, Homo sapiens
ttcaactagatttatacaattc

SEQ ID NO: 7859926 - DNA, 22 bp, Homo sapiens
ttcaactattatgaataaaatt

SEQ ID NO: 7859927 - DNA, 22 bp, Homo sapiens
ttcaactagatttatacaattc

SEQ ID NO: 7859928 - DNA, 22 bp, Homo sapiens
ttcaactattatgaataaaatt

SEQ ID NO: 7859929 - DNA, 22 bp, Homo sapiens
ttcaactagatttatacaattc

SEQ ID NO: 7859930 - DNA, 22 bp, Homo sapiens
ttcaactagaggtgattttgcc

SEQ ID NO: 7859931 - DNA, 22 bp, Homo sapiens
ttcaactaatgtttattttatg

SEQ ID NO: 7859932 - DNA, 22 bp, Homo sapiens
ttcaaccaggttaattcactac

SEQ ID NO: 7859933 - DNA, 22 bp, Homo sapiens
ttcaaccattgtgtaagacagt

SEQ ID NO: 7859934 - DNA, 22 bp, Homo sapiens
ttcaacatttttgagtttaggt

SEQ ID NO: 7859935 - DNA, 22 bp, Homo sapiens
ttcaactaatgtttattttatg

SEQ ID NO: 7859936 - DNA, 22 bp, Homo sapiens
ttcaaccattgtgtaagacagt

SEQ ID NO: 7859937 - DNA, 22 bp, Homo sapiens
ttcaacatttatcagtttatca

SEQ ID NO: 7859938 - DNA, 22 bp, Homo sapiens
ttcaacaattaagtatcagcct

SEQ ID NO: 7859939 - DNA, 22 bp, Homo sapiens
ttcaacacaggaacatgatata

SEQ ID NO: 7859940 - DNA, 22 bp, Homo sapiens
ttcaacagcttccaaagtgtgt

SEQ ID NO: 7859941 - DNA, 21 bp, Homo sapiens
ttcaacagcataatgtaggaa

SEQ ID NO: 7859942 - DNA, 22 bp, Homo sapiens
ttcaacagcttccaaagtgtgt

SEQ ID NO: 7859943 - DNA, 22 bp, Homo sapiens
ttcaacaggaaagcactttaca

SEQ ID NO: 7859944 - DNA, 22 bp, Homo sapiens
ttcaacagatatttattgagca

SEQ ID NO: 7859945 - DNA, 21 bp, Homo sapiens
ttcaacagcataatgtaggaa

SEQ ID NO: 7859946 - DNA, 22 bp, Homo sapiens
ttcaacatgctttatttctaaa

SEQ ID NO: 7859947 - DNA, 22 bp, Homo sapiens
ttcaacatgctttatttctaaa

SEQ ID NO: 7859948 - DNA, 22 bp, Homo sapiens
ttcaacatgttctacataaggg

SEQ ID NO: 7859949 - DNA, 22 bp, Homo sapiens
ttcaacatcattgtaagcctct

SEQ ID NO: 7859950 - DNA, 22 bp, Homo sapiens
ttcaacatgcaaacatgtttgt

SEQ ID NO: 7859951 - DNA, 22 bp, Homo sapiens
ttcaacagggcatgatgagacg

SEQ ID NO: 7859952 - DNA, 22 bp, Homo sapiens
ttcaacagtgatggcctttgta

SEQ ID NO: 7859953 - DNA, 22 bp, Homo sapiens
ttcaacaatgcacttgagtata

SEQ ID NO: 7859954 - DNA, 22 bp, Homo sapiens
ttcaacaatgaaagctaaggaa

SEQ ID NO: 7859955 - DNA, 22 bp, Homo sapiens
ttcaacaagtcttttttcactg

SEQ ID NO: 7859956 - DNA, 22 bp, Homo sapiens
ttcaacaagtagtacacacagt

SEQ ID NO: 7859957 - DNA, 22 bp, Homo sapiens
ttcaacaaggctgtcaaaagtt

SEQ ID NO: 7859958 - DNA, 22 bp, Homo sapiens
ttcaacaacttggttcaaatgg

SEQ ID NO: 7859959 - DNA, 22 bp, Homo sapiens
ttcaacaagtagtacacacagt

SEQ ID NO: 7859960 - DNA, 22 bp, Homo sapiens
ttcaacaaggctgtcaaaagtt

SEQ ID NO: 7859961 - DNA, 22 bp, Homo sapiens
ttcaacaaggctgtcaaaagtt

SEQ ID NO: 7859962 - DNA, 22 bp, Homo sapiens
ttcaacaaggctgtcaaaagtt

SEQ ID NO: 7859963 - DNA, 21 bp, Homo sapiens
ttcaacaaagggaataagttt

SEQ ID NO: 7859964 - DNA, 21 bp, Homo sapiens
ttcaacaaagggaataagttt

SEQ ID NO: 7859965 - DNA, 21 bp, Homo sapiens
ttcaacaaagggaataagttt

SEQ ID NO: 7859966 - DNA, 22 bp, Homo sapiens
ttcaacaaactgttcacgaatg

SEQ ID NO: 7859967 - DNA, 21 bp, Homo sapiens
ttcaacaaagggaataagttt

SEQ ID NO: 7859968 - DNA, 22 bp, Homo sapiens
ttcaacaaactgttcacgaatg

SEQ ID NO: 7859969 - DNA, 22 bp, Homo sapiens
ttcaaagtaccgtacttaatgg

SEQ ID NO: 7859970 - DNA, 17 bp, Homo sapiens
ttcaaagcttatcaagg

SEQ ID NO: 7859971 - DNA, 17 bp, Homo sapiens
ttcaaagcttatcaagg

SEQ ID NO: 7859972 - DNA, 22 bp, Homo sapiens
ttcaaaggagacagagggaagg

SEQ ID NO: 7859973 - DNA, 22 bp, Homo sapiens
ttcaaaggaggtgctgggtctt

SEQ ID NO: 7859974 - DNA, 23 bp, Homo sapiens
ttcaaaggcaatatgctgagaaa

SEQ ID NO: 7859975 - DNA, 22 bp, Homo sapiens
ttcaaagtaaaaatgtgttcac

SEQ ID NO: 7859976 - DNA, 17 bp, Homo sapiens
ttcaaagcttatcaagg

SEQ ID NO: 7859977 - DNA, 22 bp, Homo sapiens
ttagataaattaagactttaca

SEQ ID NO: 7859978 - DNA, 22 bp, Homo sapiens
ttagataaaagtgttcaataaa

SEQ ID NO: 7859979 - DNA, 22 bp, Homo sapiens
ttagataaaagtgttcaataaa

SEQ ID NO: 7859980 - DNA, 22 bp, Homo sapiens
ttagataaaagtgttcaataaa

SEQ ID NO: 7859981 - DNA, 22 bp, Homo sapiens
ttagagtttttgtaagtacaat

SEQ ID NO: 7859982 - DNA, 22 bp, Homo sapiens
ttagagtttttgtaagtacaat

SEQ ID NO: 7859983 - DNA, 22 bp, Homo sapiens
ttagagtttttgtaagtacaat

SEQ ID NO: 7859984 - DNA, 22 bp, Homo sapiens
ttagagtttttgtaagtacaat

SEQ ID NO: 7859985 - DNA, 22 bp, Homo sapiens
ttagataaagtgatgtaggcta

SEQ ID NO: 7859986 - DNA, 22 bp, Homo sapiens
ttagataaagtgatgtaggcta

SEQ ID NO: 7859987 - DNA, 22 bp, Homo sapiens
ttagataaagtgatgtaggcta

SEQ ID NO: 7859988 - DNA, 22 bp, Homo sapiens
ttagagtcaaaatggcatgtta

SEQ ID NO: 7859989 - DNA, 22 bp, Homo sapiens
ttagagtgtagcaggaagaggc

SEQ ID NO: 7859990 - DNA, 22 bp, Homo sapiens
ttagagtcaagctgcatgttct

SEQ ID NO: 7859991 - DNA, 21 bp, Homo sapiens
ttagagtagagaacatgatcc

SEQ ID NO: 7859992 - DNA, 21 bp, Homo sapiens
ttagagtagagaacatgatcc

SEQ ID NO: 7859993 - DNA, 22 bp, Homo sapiens
ttagagttaggatttgtcttta

SEQ ID NO: 7859994 - DNA, 20 bp, Homo sapiens
ttagagttagctgttatgca

SEQ ID NO: 7859995 - DNA, 20 bp, Homo sapiens
ttagagttagctgttatgca

SEQ ID NO: 7859996 - DNA, 22 bp, Homo sapiens
ttagagttttatcattgcctta

SEQ ID NO: 7859997 - DNA, 22 bp, Homo sapiens
ttagagttttatcattgcctta

SEQ ID NO: 7859998 - DNA, 22 bp, Homo sapiens
ttagagttttctgttcctctaa

SEQ ID NO: 7859999 - DNA, 21 bp, Homo sapiens
ttagagttgccattatatgta

SEQ ID NO: 7860000 - DNA, 22 bp, Homo sapiens
ttagagttgagtttctatgaga

SEQ ID NO: 7860001 - DNA, 22 bp, Homo sapiens
ttagagttcagcatgactttga

SEQ ID NO: 7860002 - DNA, 21 bp, Homo sapiens
ttagagttgccattatatgta

SEQ ID NO: 7860003 - DNA, 22 bp, Homo sapiens
ttagagttgagtttctatgaga

SEQ ID NO: 7860004 - DNA, 22 bp, Homo sapiens
ttcaatttcataatatctagct

SEQ ID NO: 7860005 - DNA, 22 bp, Homo sapiens
ttcaatttcataatatctagct

SEQ ID NO: 7860006 - DNA, 22 bp, Homo sapiens
ttcaatttagtgatgttgttgg

SEQ ID NO: 7860007 - DNA, 22 bp, Homo sapiens
ttcaatttcataatatctagct

SEQ ID NO: 7860008 - DNA, 22 bp, Homo sapiens
ttcaatttgtgctaaggcaccg

SEQ ID NO: 7860009 - DNA, 22 bp, Homo sapiens
ttcacaaaaatgctgaacagtt

SEQ ID NO: 7860010 - DNA, 22 bp, Homo sapiens
ttcacaaaaatgctgaacagtt

SEQ ID NO: 7860011 - DNA, 22 bp, Homo sapiens
ttcacaaaatggtttgttgatg

SEQ ID NO: 7860012 - DNA, 22 bp, Homo sapiens
ttcacaaacaccagaatggcta

SEQ ID NO: 7860013 - DNA, 22 bp, Homo sapiens
ttcacaaaacactattttctgg

SEQ ID NO: 7860014 - DNA, 22 bp, Homo sapiens
ttcacaaaaatgctgaacagtt

SEQ ID NO: 7860015 - DNA, 22 bp, Homo sapiens
ttcacaaaacactattttctgg

SEQ ID NO: 7860016 - DNA, 22 bp, Homo sapiens
ttcacaaaacactattttctgg

SEQ ID NO: 7860017 - DNA, 22 bp, Homo sapiens
ttcaatttagtgatgttgttgg

SEQ ID NO: 7860018 - DNA, 22 bp, Homo sapiens
ttcaattcaattctaaatatat

SEQ ID NO: 7860019 - DNA, 22 bp, Homo sapiens
ttcaatgttaagaagaatatgt

SEQ ID NO: 7860020 - DNA, 22 bp, Homo sapiens
ttcaatgtggttataataacta

SEQ ID NO: 7860021 - DNA, 22 bp, Homo sapiens
ttcaatgttaagaagaatatgt

SEQ ID NO: 7860022 - DNA, 22 bp, Homo sapiens
ttcaatgtggttataataacta

SEQ ID NO: 7860023 - DNA, 22 bp, Homo sapiens
ttcaatgtggttataataacta

SEQ ID NO: 7860024 - DNA, 22 bp, Homo sapiens
ttcaatgcatatagatatagaa

SEQ ID NO: 7860025 - DNA, 22 bp, Homo sapiens
ttcaatgcctttctctaagctc

SEQ ID NO: 7860026 - DNA, 22 bp, Homo sapiens
ttcaagaagcccaaagactagc

SEQ ID NO: 7860027 - DNA, 22 bp, Homo sapiens
ttcaagaagcccaaagactagc

SEQ ID NO: 7860028 - DNA, 22 bp, Homo sapiens
ttcaagaaagagtggctattcc

SEQ ID NO: 7860029 - DNA, 22 bp, Homo sapiens
ttcaagaaagagtggctattcc

SEQ ID NO: 7860030 - DNA, 22 bp, Homo sapiens
ttcaagaaagagtggctattcc

SEQ ID NO: 7860031 - DNA, 22 bp, Homo sapiens
ttcaagaaagagtggctattcc

SEQ ID NO: 7860032 - DNA, 22 bp, Homo sapiens
ttcacaaagctggagcatttcc

SEQ ID NO: 7860033 - DNA, 22 bp, Homo sapiens
ttcacaaacttcatgatggcac

SEQ ID NO: 7860034 - DNA, 22 bp, Homo sapiens
ttcacaactgccatagccagtg

SEQ ID NO: 7860035 - DNA, 22 bp, Homo sapiens
ttcacaaagctggttccttctg

SEQ ID NO: 7860036 - DNA, 22 bp, Homo sapiens
ttcacaataatgtccatcctct

SEQ ID NO: 7860037 - DNA, 22 bp, Homo sapiens
ttcacaataatgtccatcctct

SEQ ID NO: 7860038 - DNA, 22 bp, Homo sapiens
ttcacaagtgtgaaggcagagc

SEQ ID NO: 7860039 - DNA, 22 bp, Homo sapiens
ttcacaatagctggcatcatct

SEQ ID NO: 7860040 - DNA, 18 bp, Homo sapiens
ttcacaagggcttggttt

SEQ ID NO: 7860041 - DNA, 22 bp, Homo sapiens
ttcacaagtcattagctgcata

SEQ ID NO: 7860042 - DNA, 22 bp, Homo sapiens
ttcacagtgagctatgtcttgt

SEQ ID NO: 7860043 - DNA, 22 bp, Homo sapiens
ttcacagtctatcttggttttt

SEQ ID NO: 7860044 - DNA, 22 bp, Homo sapiens
ttcacagtgagctatgtcttgt

SEQ ID NO: 7860045 - DNA, 22 bp, Homo sapiens
ttcacagtcacccttctccatg

SEQ ID NO: 7860046 - DNA, 22 bp, Homo sapiens
ttcacagtgagctatgtcttgt

SEQ ID NO: 7860047 - DNA, 22 bp, Homo sapiens
ttcacagtgagctatgtcttgt

SEQ ID NO: 7860048 - DNA, 22 bp, Homo sapiens
ttcacagtgagctatgtcttgt

SEQ ID NO: 7860049 - DNA, 22 bp, Homo sapiens
ttcacagtgctgcacctggctt

SEQ ID NO: 7860050 - DNA, 22 bp, Homo sapiens
ttcacagtgctgcacctggctt

SEQ ID NO: 7860051 - DNA, 22 bp, Homo sapiens
ttcacagtgctgcacctggctt

SEQ ID NO: 7860052 - DNA, 22 bp, Homo sapiens
ttcacagtgctcacagttcagt

SEQ ID NO: 7860053 - DNA, 22 bp, Homo sapiens
ttcacagtgccagggggcaggc

SEQ ID NO: 7860054 - DNA, 22 bp, Homo sapiens
ttcacagtgccagggggcaggc

SEQ ID NO: 7860055 - DNA, 22 bp, Homo sapiens
ttcacagtcacccttctccatg

SEQ ID NO: 7860056 - DNA, 22 bp, Homo sapiens
ttcacagtcacccttctccatg

SEQ ID NO: 7860057 - DNA, 22 bp, Homo sapiens
ttcacagtaatgtgcccaggta

SEQ ID NO: 7860058 - DNA, 22 bp, Homo sapiens
ttcacagtataggtttccagcg

SEQ ID NO: 7860059 - DNA, 22 bp, Homo sapiens
ttcacagtataggtttccagcg

SEQ ID NO: 7860060 - DNA, 22 bp, Homo sapiens
ttcacagtataggtttccagcg

SEQ ID NO: 7860061 - DNA, 22 bp, Homo sapiens
ttcacagtaatgtgcccaggta

SEQ ID NO: 7860062 - DNA, 22 bp, Homo sapiens
ttcacagtaatgtgcccaggta

SEQ ID NO: 7860063 - DNA, 22 bp, Homo sapiens
ttcacagtaagtaggatagttg

SEQ ID NO: 7860064 - DNA, 22 bp, Homo sapiens
ttcacagtaagtaggatagttg

SEQ ID NO: 7860065 - DNA, 22 bp, Homo sapiens
ttcacagtaacagggggatatg

SEQ ID NO: 7860066 - DNA, 22 bp, Homo sapiens
ttcctagaatggttagaaaata

SEQ ID NO: 7860067 - DNA, 22 bp, Homo sapiens
ttcctagaatggttagaaaata

SEQ ID NO: 7860068 - DNA, 22 bp, Homo sapiens
ttcctacatttgtacaataaga

SEQ ID NO: 7860069 - DNA, 22 bp, Homo sapiens
ttcctacaattagagcctcttt

SEQ ID NO: 7860070 - DNA, 22 bp, Homo sapiens
ttcctacagccctgaatctcta

SEQ ID NO: 7860071 - DNA, 22 bp, Homo sapiens
ttcctacatcaccagggggagt

SEQ ID NO: 7860072 - DNA, 22 bp, Homo sapiens
ttcctaggatggtgaagcagga

SEQ ID NO: 7860073 - DNA, 22 bp, Homo sapiens
ttcctagacagttcttcccaaa

SEQ ID NO: 7860074 - DNA, 22 bp, Homo sapiens
ttcctaggatggtgaagcagga

SEQ ID NO: 7860075 - DNA, 22 bp, Homo sapiens
ttcctagggcagagccgctggg

SEQ ID NO: 7860076 - DNA, 22 bp, Homo sapiens
ttcctagggcagagccgctggg

SEQ ID NO: 7860077 - DNA, 22 bp, Homo sapiens
ttcctagggcagagccgctggg

SEQ ID NO: 7860078 - DNA, 22 bp, Homo sapiens
ttcctagggcagagccgctggg

SEQ ID NO: 7860079 - DNA, 22 bp, Homo sapiens
ttcctagggcagagccgctggg

SEQ ID NO: 7860080 - DNA, 22 bp, Homo sapiens
ttcctatagaaagctgtgtaga

SEQ ID NO: 7860081 - DNA, 22 bp, Homo sapiens
ttcctaggtgtttacattcaac

SEQ ID NO: 7860082 - DNA, 22 bp, Homo sapiens
ttcctcacactcccccattcga

SEQ ID NO: 7860083 - DNA, 22 bp, Homo sapiens
ttcctcacctaattgggagggg

SEQ ID NO: 7860084 - DNA, 22 bp, Homo sapiens
ttcctatggctcagttgcattt

SEQ ID NO: 7860085 - DNA, 22 bp, Homo sapiens
ttcctcagagagacagaaacta

SEQ ID NO: 7860086 - DNA, 22 bp, Homo sapiens
ttcctcagagggcgctggggaa

SEQ ID NO: 7860087 - DNA, 22 bp, Homo sapiens
ttcctcagagagacagaaacta

SEQ ID NO: 7860088 - DNA, 22 bp, Homo sapiens
ttcctcagagagacagaaacta

SEQ ID NO: 7860089 - DNA, 22 bp, Homo sapiens
ttcctcagaccctcattgtgag

SEQ ID NO: 7860090 - DNA, 22 bp, Homo sapiens
ttcctcagaccctcattgtgag

SEQ ID NO: 7860091 - DNA, 22 bp, Homo sapiens
ttcctcagaaaatactgtccaa

SEQ ID NO: 7860092 - DNA, 22 bp, Homo sapiens
ttcctcagaaaatactgtccaa

SEQ ID NO: 7860093 - DNA, 22 bp, Homo sapiens
ttcctcagctcagcgagagaga

SEQ ID NO: 7860094 - DNA, 22 bp, Homo sapiens
ttcctcagctggcctgattggg

SEQ ID NO: 7860095 - DNA, 22 bp, Homo sapiens
ttcctcagctggcctgattggg

SEQ ID NO: 7860096 - DNA, 22 bp, Homo sapiens
ttcctcagctcagcgagagaga

SEQ ID NO: 7860097 - DNA, 22 bp, Homo sapiens
ttcctcagccagcacttagggg

SEQ ID NO: 7860098 - DNA, 22 bp, Homo sapiens
ttcctcagcacaaagccaagat

SEQ ID NO: 7860099 - DNA, 22 bp, Homo sapiens
ttcctcagcacaaagccaagat

SEQ ID NO: 7860100 - DNA, 22 bp, Homo sapiens
ttcctcagagggcgctggggaa

SEQ ID NO: 7860101 - DNA, 22 bp, Homo sapiens
ttcctcagagggcgctggggaa

SEQ ID NO: 7860102 - DNA, 22 bp, Homo sapiens
ttcctcagcacaaagccaagat

SEQ ID NO: 7860103 - DNA, 22 bp, Homo sapiens
ttcctcagccaaggctgggatc

SEQ ID NO: 7860104 - DNA, 22 bp, Homo sapiens
ttcctcagccaaggctgggatc

SEQ ID NO: 7860105 - DNA, 22 bp, Homo sapiens
ttcctcagggaggctagcagta

SEQ ID NO: 7860106 - DNA, 22 bp, Homo sapiens
ttcctcagggaggctagcagta

SEQ ID NO: 7860107 - DNA, 22 bp, Homo sapiens
ttcctcagggaggctagcagta

SEQ ID NO: 7860108 - DNA, 22 bp, Homo sapiens
ttcctcagggcggatgggcagg

SEQ ID NO: 7860109 - DNA, 22 bp, Homo sapiens
ttcctcagtgcccccatacggt

SEQ ID NO: 7860110 - DNA, 22 bp, Homo sapiens
ttcctcagtgatggattcaacg

SEQ ID NO: 7860111 - DNA, 22 bp, Homo sapiens
ttcctcaggtgctacaaagcag

SEQ ID NO: 7860112 - DNA, 22 bp, Homo sapiens
ttcctcagtgcccccatacggt

SEQ ID NO: 7860113 - DNA, 22 bp, Homo sapiens
ttcctcagttagtgcctgaggc

SEQ ID NO: 7860114 - DNA, 22 bp, Homo sapiens
ttcctcagttagtgcctgaggc

SEQ ID NO: 7860115 - DNA, 22 bp, Homo sapiens
ttcctcagctgtttgggctcat

SEQ ID NO: 7860116 - DNA, 22 bp, Homo sapiens
ttcctcagctttagactatgaa

SEQ ID NO: 7860117 - DNA, 22 bp, Homo sapiens
ttcctcagctgtgtcctggcga

SEQ ID NO: 7860118 - DNA, 22 bp, Homo sapiens
ttcctcagctggcctgattggg

SEQ ID NO: 7860119 - DNA, 22 bp, Homo sapiens
ttcctcagctgtgtcctggcga

SEQ ID NO: 7860120 - DNA, 22 bp, Homo sapiens
ttcctcaggcttccctttgtcc

SEQ ID NO: 7860121 - DNA, 22 bp, Homo sapiens
ttcctcaggctgctttcacata

SEQ ID NO: 7860122 - DNA, 22 bp, Homo sapiens
ttcctcaggctgctttcacata

SEQ ID NO: 7860123 - DNA, 20 bp, Homo sapiens
ttcctcaggagaggatgtta

SEQ ID NO: 7860124 - DNA, 22 bp, Homo sapiens
ttcctcagctttagactatgaa

SEQ ID NO: 7860125 - DNA, 20 bp, Homo sapiens
ttcctcaggagaggatgtta

SEQ ID NO: 7860126 - DNA, 22 bp, Homo sapiens
ttcctcaggactgttgacttcc

SEQ ID NO: 7860127 - DNA, 22 bp, Homo sapiens
ttcctcatggggttccttcaga

SEQ ID NO: 7860128 - DNA, 22 bp, Homo sapiens
ttcctcatggggttccttcaga

SEQ ID NO: 7860129 - DNA, 22 bp, Homo sapiens
ttcctcatctgtgcacctcact

SEQ ID NO: 7860130 - DNA, 22 bp, Homo sapiens
ttcctcagttagtgcctgaggc

SEQ ID NO: 7860131 - DNA, 22 bp, Homo sapiens
ttcctcatggggttccttcaga

SEQ ID NO: 7860132 - DNA, 18 bp, Homo sapiens
ttcctccacagagcgctg

SEQ ID NO: 7860133 - DNA, 22 bp, Homo sapiens
ttcctccacgtgacaggagcca

SEQ ID NO: 7860134 - DNA, 22 bp, Homo sapiens
ttcctctgtagttgctgatgaa

SEQ ID NO: 7860135 - DNA, 22 bp, Homo sapiens
ttcctctgtagttgctgatgaa

SEQ ID NO: 7860136 - DNA, 22 bp, Homo sapiens
ttcctctgtatgctttgctgct

SEQ ID NO: 7860137 - DNA, 22 bp, Homo sapiens
ttcctcttattttcccagtgat

SEQ ID NO: 7860138 - DNA, 22 bp, Homo sapiens
ttcctctgtatgctttgctgct

SEQ ID NO: 7860139 - DNA, 22 bp, Homo sapiens
ttcctctggggccaggccaaca

SEQ ID NO: 7860140 - DNA, 22 bp, Homo sapiens
ttcctctgtagttgctgatgaa

SEQ ID NO: 7860141 - DNA, 22 bp, Homo sapiens
ttcctccagccatgattgtaaa

SEQ ID NO: 7860142 - DNA, 22 bp, Homo sapiens
ttcctccagaagctgtagggga

SEQ ID NO: 7860143 - DNA, 22 bp, Homo sapiens
ttcctccagcctggagcacttc

SEQ ID NO: 7860144 - DNA, 22 bp, Homo sapiens
ttcctctggaggctctaggaga

SEQ ID NO: 7860145 - DNA, 22 bp, Homo sapiens
ttcctccagcctggagcacttc

SEQ ID NO: 7860146 - DNA, 22 bp, Homo sapiens
ttccagaaccttcctgctggaa

SEQ ID NO: 7860147 - DNA, 22 bp, Homo sapiens
ttccagaaccttcctgctggaa

SEQ ID NO: 7860148 - DNA, 22 bp, Homo sapiens
ttccagaactcaagaaatgccc

SEQ ID NO: 7860149 - DNA, 22 bp, Homo sapiens
ttccagaactcaagaaatgccc

SEQ ID NO: 7860150 - DNA, 22 bp, Homo sapiens
ttccacattccttacattcata

SEQ ID NO: 7860151 - DNA, 22 bp, Homo sapiens
ttccagaacaatgtggacgtat

SEQ ID NO: 7860152 - DNA, 22 bp, Homo sapiens
ttccagaacaatgtggacgtat

SEQ ID NO: 7860153 - DNA, 22 bp, Homo sapiens
ttccacattccttacattcata

SEQ ID NO: 7860154 - DNA, 20 bp, Homo sapiens
ttccacatctttgcacatgc

SEQ ID NO: 7860155 - DNA, 22 bp, Homo sapiens
ttccacagtggctgtagttctg

SEQ ID NO: 7860156 - DNA, 22 bp, Homo sapiens
ttccacagtcatcctgggaatt

SEQ ID NO: 7860157 - DNA, 22 bp, Homo sapiens
ttccacagtcatcctgggaatt

SEQ ID NO: 7860158 - DNA, 22 bp, Homo sapiens
ttccacagtcatcctgggaatt

SEQ ID NO: 7860159 - DNA, 16 bp, Homo sapiens
ttccacagtcgaggtg

SEQ ID NO: 7860160 - DNA, 21 bp, Homo sapiens
ttccacagtcctgaggattca

SEQ ID NO: 7860161 - DNA, 21 bp, Homo sapiens
ttccacagtgagaactgcaag

SEQ ID NO: 7860162 - DNA, 21 bp, Homo sapiens
ttccacagtgagaactgcaag

SEQ ID NO: 7860163 - DNA, 22 bp, Homo sapiens
ttccacagatgtatgaagtggt

SEQ ID NO: 7860164 - DNA, 22 bp, Homo sapiens
ttccacagccatcactgttgct

SEQ ID NO: 7860165 - DNA, 22 bp, Homo sapiens
ttccacagcccaagctggtggc

SEQ ID NO: 7860166 - DNA, 22 bp, Homo sapiens
ttccacagcccaagctggtggc

SEQ ID NO: 7860167 - DNA, 22 bp, Homo sapiens
ttccacagatgtatgaagtggt

SEQ ID NO: 7860168 - DNA, 22 bp, Homo sapiens
ttccacagcccaagctggtggc

SEQ ID NO: 7860169 - DNA, 22 bp, Homo sapiens
ttccacaaatacactccacatt

SEQ ID NO: 7860170 - DNA, 22 bp, Homo sapiens
ttccacaaatacactccacatt

SEQ ID NO: 7860171 - DNA, 22 bp, Homo sapiens
ttccacaaacacatcctgagca

SEQ ID NO: 7860172 - DNA, 22 bp, Homo sapiens
ttccacaaacacatcctgagca

SEQ ID NO: 7860173 - DNA, 22 bp, Homo sapiens
ttccacaaacacatcctgagca

SEQ ID NO: 7860174 - DNA, 22 bp, Homo sapiens
ttccacaaatcaattctgctga

SEQ ID NO: 7860175 - DNA, 22 bp, Homo sapiens
ttccacaaatcaattctgctga

SEQ ID NO: 7860176 - DNA, 22 bp, Homo sapiens
ttccacaaatcaattctgctga

SEQ ID NO: 7860177 - DNA, 22 bp, Homo sapiens
ttccacaacaaccaagcatata

SEQ ID NO: 7860178 - DNA, 22 bp, Homo sapiens
ttccacaacaaccaagcatata

SEQ ID NO: 7860179 - DNA, 22 bp, Homo sapiens
ttccacaagacttgggttaaga

SEQ ID NO: 7860180 - DNA, 22 bp, Homo sapiens
ttccacaagatgtttcttagaa

SEQ ID NO: 7860181 - DNA, 22 bp, Homo sapiens
ttccacaagatgtttcttagaa

SEQ ID NO: 7860182 - DNA, 22 bp, Homo sapiens
ttccacaaggccttgtcctgct

SEQ ID NO: 7860183 - DNA, 22 bp, Homo sapiens
ttccacaagtgatatctagctg

SEQ ID NO: 7860184 - DNA, 22 bp, Homo sapiens
ttccacaaggccttgtcctgct

SEQ ID NO: 7860185 - DNA, 22 bp, Homo sapiens
ttccacaagtgatatctagctg

SEQ ID NO: 7860186 - DNA, 22 bp, Homo sapiens
ttccacaagtgatatctagctg

SEQ ID NO: 7860187 - DNA, 17 bp, Homo sapiens
ttccacaatagtttgtc

SEQ ID NO: 7860188 - DNA, 23 bp, Homo sapiens
ttccacaatgaaaataaagcagg

SEQ ID NO: 7860189 - DNA, 23 bp, Homo sapiens
ttccacaatgaaaataaagcagg

SEQ ID NO: 7860190 - DNA, 22 bp, Homo sapiens
ttccacaatgccaggggcatca

SEQ ID NO: 7860191 - DNA, 22 bp, Homo sapiens
ttccacaatgccaggggcatca

SEQ ID NO: 7860192 - DNA, 22 bp, Homo sapiens
ttccacaatgtatgaataagat

SEQ ID NO: 7860193 - DNA, 22 bp, Homo sapiens
ttccacaattcagattgttgcc

SEQ ID NO: 7860194 - DNA, 22 bp, Homo sapiens
ttccacaatggttaagctcgtt

SEQ ID NO: 7860195 - DNA, 22 bp, Homo sapiens
ttccacaattcagattgttgcc

SEQ ID NO: 7860196 - DNA, 22 bp, Homo sapiens
ttccacaattcagattgttgcc

SEQ ID NO: 7860197 - DNA, 22 bp, Homo sapiens
ttccacacttaaggaatatgat

SEQ ID NO: 7860198 - DNA, 22 bp, Homo sapiens
ttccagaaggaagccggggagc

SEQ ID NO: 7860199 - DNA, 22 bp, Homo sapiens
ttccagaattgggagccttgag

SEQ ID NO: 7860200 - DNA, 22 bp, Homo sapiens
ttccagaattgggagccttgag

SEQ ID NO: 7860201 - DNA, 22 bp, Homo sapiens
ttccagaatagatggagctcta

SEQ ID NO: 7860202 - DNA, 22 bp, Homo sapiens
ttccagaatagatggagctcta

SEQ ID NO: 7860203 - DNA, 22 bp, Homo sapiens
ttccagaagatggcagcaaagg

SEQ ID NO: 7860204 - DNA, 22 bp, Homo sapiens
ttccagaagcctccatattact

SEQ ID NO: 7860205 - DNA, 22 bp, Homo sapiens
ttccagaagcctccatattact

SEQ ID NO: 7860206 - DNA, 22 bp, Homo sapiens
ttccagaagatggcagcaaagg

SEQ ID NO: 7860207 - DNA, 22 bp, Homo sapiens
ttccagaacttttgttaatttc

SEQ ID NO: 7860208 - DNA, 22 bp, Homo sapiens
ttccagaacttttgttaatttc

SEQ ID NO: 7860209 - DNA, 22 bp, Homo sapiens
ttccagaccattccacgggaga

SEQ ID NO: 7860210 - DNA, 22 bp, Homo sapiens
ttccagagagagaaaatttgat

SEQ ID NO: 7860211 - DNA, 22 bp, Homo sapiens
ttccagagagagaaaatttgat

SEQ ID NO: 7860212 - DNA, 22 bp, Homo sapiens
ttccagagagagaaaatttgat

SEQ ID NO: 7860213 - DNA, 22 bp, Homo sapiens
ttccagaattttgttctgcttg

SEQ ID NO: 7860214 - DNA, 22 bp, Homo sapiens
ttccagaattgggagccttgag

SEQ ID NO: 7860215 - DNA, 22 bp, Homo sapiens
ttccagaattttgttctgcttg

SEQ ID NO: 7860216 - DNA, 22 bp, Homo sapiens
ttccagagagttattcccctgg

SEQ ID NO: 7860217 - DNA, 22 bp, Homo sapiens
ttccagagagttattcccctgg

SEQ ID NO: 7860218 - DNA, 22 bp, Homo sapiens
ttccagagagttattcccctgg

SEQ ID NO: 7860219 - DNA, 20 bp, Homo sapiens
ttccagagatctgcatttta

SEQ ID NO: 7860220 - DNA, 22 bp, Homo sapiens
ttccagagaggctcatgttccc

SEQ ID NO: 7860221 - DNA, 22 bp, Homo sapiens
ttccagagaggctcatgttccc

SEQ ID NO: 7860222 - DNA, 22 bp, Homo sapiens
ttccagagaggctcatgttccc

SEQ ID NO: 7860223 - DNA, 22 bp, Homo sapiens
ttccagagcagttttcagatca

SEQ ID NO: 7860224 - DNA, 21 bp, Homo sapiens
ttccagagattgtttcacctg

SEQ ID NO: 7860225 - DNA, 22 bp, Homo sapiens
ttccagagcccatgctctaggc

SEQ ID NO: 7860226 - DNA, 22 bp, Homo sapiens
ttccagagcccatgctctaggc

SEQ ID NO: 7860227 - DNA, 22 bp, Homo sapiens
ttccagagctttgcgcttggaa

SEQ ID NO: 7860228 - DNA, 22 bp, Homo sapiens
ttccagagcctagaatcttgat

SEQ ID NO: 7860229 - DNA, 22 bp, Homo sapiens
ttccagagcctagaatcttgat

SEQ ID NO: 7860230 - DNA, 22 bp, Homo sapiens
ttccagagcctagaatcttgat

SEQ ID NO: 7860231 - DNA, 22 bp, Homo sapiens
ttcctaagtcctgccagcagtc

SEQ ID NO: 7860232 - DNA, 22 bp, Homo sapiens
ttcctaactggcctttatggat

SEQ ID NO: 7860233 - DNA, 22 bp, Homo sapiens
ttcctaatgtctactttagttc

SEQ ID NO: 7860234 - DNA, 22 bp, Homo sapiens
ttcctaatggcaaaacatgttt

SEQ ID NO: 7860235 - DNA, 22 bp, Homo sapiens
ttcctaatcacgaacattattt

SEQ ID NO: 7860236 - DNA, 22 bp, Homo sapiens
ttcctaacaagtctatctttga

SEQ ID NO: 7860237 - DNA, 22 bp, Homo sapiens
ttcctaacacagtgtaagcaag

SEQ ID NO: 7860238 - DNA, 22 bp, Homo sapiens
ttcctaacctctagctgcatat

SEQ ID NO: 7860239 - DNA, 22 bp, Homo sapiens
ttcctaacgccagtattttcat

SEQ ID NO: 7860240 - DNA, 22 bp, Homo sapiens
ttcctaactctggcacctagtc

SEQ ID NO: 7860241 - DNA, 22 bp, Homo sapiens
ttcctaactctggcacctagtc

SEQ ID NO: 7860242 - DNA, 22 bp, Homo sapiens
ttccctggccctggcacgctct

SEQ ID NO: 7860243 - DNA, 22 bp, Homo sapiens
ttccctggccctggcacgctct

SEQ ID NO: 7860244 - DNA, 22 bp, Homo sapiens
ttccctggccctggcacgctct

SEQ ID NO: 7860245 - DNA, 22 bp, Homo sapiens
ttccctggctcttctacatcgt

SEQ ID NO: 7860246 - DNA, 22 bp, Homo sapiens
ttccctggggaaggtgaccttt

SEQ ID NO: 7860247 - DNA, 22 bp, Homo sapiens
ttcctaacaaggggtattcatc

SEQ ID NO: 7860248 - DNA, 22 bp, Homo sapiens
ttccctggaaagccatgcagtc

SEQ ID NO: 7860249 - DNA, 22 bp, Homo sapiens
ttccctggaaagccatgcagtc

SEQ ID NO: 7860250 - DNA, 20 bp, Homo sapiens
ttccctggaaggagaagcag

SEQ ID NO: 7860251 - DNA, 20 bp, Homo sapiens
ttccctggaaggagaagcag

SEQ ID NO: 7860252 - DNA, 22 bp, Homo sapiens
ttccctggaacatcatggtcta

SEQ ID NO: 7860253 - DNA, 20 bp, Homo sapiens
ttccctggaaggagaagcag

SEQ ID NO: 7860254 - DNA, 22 bp, Homo sapiens
ttccctggcatgagtgtaagat

SEQ ID NO: 7860255 - DNA, 22 bp, Homo sapiens
ttccctggaggagtagtgaaat

SEQ ID NO: 7860256 - DNA, 22 bp, Homo sapiens
ttctaggaagggaagcatggca

SEQ ID NO: 7860257 - DNA, 22 bp, Homo sapiens
ttctaggaagggaagcatggca

SEQ ID NO: 7860258 - DNA, 22 bp, Homo sapiens
ttctagctttttgcaccaaggt

SEQ ID NO: 7860259 - DNA, 22 bp, Homo sapiens
ttctaggatgctgatgagaccc

SEQ ID NO: 7860260 - DNA, 22 bp, Homo sapiens
ttctaggatgctgatgagaccc

SEQ ID NO: 7860261 - DNA, 20 bp, Homo sapiens
ttctagcatacttacaagga

SEQ ID NO: 7860262 - DNA, 22 bp, Homo sapiens
ttctagctgttgctgtttatag

SEQ ID NO: 7860263 - DNA, 22 bp, Homo sapiens
ttctagcatgccttttagcaca

SEQ ID NO: 7860264 - DNA, 22 bp, Homo sapiens
ttctagcacaagatatgaaagt

SEQ ID NO: 7860265 - DNA, 22 bp, Homo sapiens
ttctagggaggagaacttgtga

SEQ ID NO: 7860266 - DNA, 22 bp, Homo sapiens
ttctagggatctgctgctgttt

SEQ ID NO: 7860267 - DNA, 22 bp, Homo sapiens
ttctagggatggtaggtacaaa

SEQ ID NO: 7860268 - DNA, 19 bp, Homo sapiens
ttctaggctatgaagcagt

SEQ ID NO: 7860269 - DNA, 22 bp, Homo sapiens
ttctaggcagattgtctaaagc

SEQ ID NO: 7860270 - DNA, 22 bp, Homo sapiens
ttctagggaatgggatgaggat

SEQ ID NO: 7860271 - DNA, 22 bp, Homo sapiens
ttctagggttacagtttcttcc

SEQ ID NO: 7860272 - DNA, 22 bp, Homo sapiens
ttctaggggtttacattatcca

SEQ ID NO: 7860273 - DNA, 22 bp, Homo sapiens
ttctagggttcgagtataatcc

SEQ ID NO: 7860274 - DNA, 20 bp, Homo sapiens
ttctagggggagccacaaag

SEQ ID NO: 7860275 - DNA, 22 bp, Homo sapiens
ttctaggggggatcttggtcca

SEQ ID NO: 7860276 - DNA, 22 bp, Homo sapiens
ttctaggggagaggaagaagtg

SEQ ID NO: 7860277 - DNA, 22 bp, Homo sapiens
ttctaggggagaggaagaagtg

SEQ ID NO: 7860278 - DNA, 22 bp, Homo sapiens
ttctaggggacataatatgaaa

SEQ ID NO: 7860279 - DNA, 22 bp, Homo sapiens
ttctagagaactcgagtgcctt

SEQ ID NO: 7860280 - DNA, 22 bp, Homo sapiens
ttctagacttcaggcattctcc

SEQ ID NO: 7860281 - DNA, 22 bp, Homo sapiens
ttctagacttcaggcattctcc

SEQ ID NO: 7860282 - DNA, 22 bp, Homo sapiens
ttctagagccagggcagctgca

SEQ ID NO: 7860283 - DNA, 22 bp, Homo sapiens
ttctagagaactcgagtgcctt

SEQ ID NO: 7860284 - DNA, 22 bp, Homo sapiens
ttctagagccagggcagctgca

SEQ ID NO: 7860285 - DNA, 22 bp, Homo sapiens
ttctagagccagggcagctgca

SEQ ID NO: 7860286 - DNA, 22 bp, Homo sapiens
ttctagaatgttttgaaaggga

SEQ ID NO: 7860287 - DNA, 22 bp, Homo sapiens
ttctagacaaatgtgttcattc

SEQ ID NO: 7860288 - DNA, 22 bp, Homo sapiens
ttctagatagcacttttgagct

SEQ ID NO: 7860289 - DNA, 22 bp, Homo sapiens
ttctagatagagtgcaaattat

SEQ ID NO: 7860290 - DNA, 22 bp, Homo sapiens
ttctagatagagtgcaaattat

SEQ ID NO: 7860291 - DNA, 22 bp, Homo sapiens
ttctagaggggagatactagta

SEQ ID NO: 7860292 - DNA, 22 bp, Homo sapiens
ttctagaggggagatactagta

SEQ ID NO: 7860293 - DNA, 22 bp, Homo sapiens
ttctagaggggagatactagta

SEQ ID NO: 7860294 - DNA, 22 bp, Homo sapiens
ttctagattgcctgtaagtaaa

SEQ ID NO: 7860295 - DNA, 22 bp, Homo sapiens
ttctagcacaagatatgaaagt

SEQ ID NO: 7860296 - DNA, 22 bp, Homo sapiens
ttctagcacaagatatgaaagt

SEQ ID NO: 7860297 - DNA, 22 bp, Homo sapiens
ttctagcagagggcatctgctg

SEQ ID NO: 7860298 - DNA, 22 bp, Homo sapiens
ttctagcactgcctggaagaca

SEQ ID NO: 7860299 - DNA, 22 bp, Homo sapiens
ttctagcactgcctggaagaca

SEQ ID NO: 7860300 - DNA, 22 bp, Homo sapiens
ttctagatgcttataggcatat

SEQ ID NO: 7860301 - DNA, 22 bp, Homo sapiens
ttctagatatctagtgtataac

SEQ ID NO: 7860302 - DNA, 22 bp, Homo sapiens
ttctagatgataaaccagcagc

SEQ ID NO: 7860303 - DNA, 22 bp, Homo sapiens
ttctagatagcacttttgagct

SEQ ID NO: 7860304 - DNA, 22 bp, Homo sapiens
ttctagatgcttataggcatat

SEQ ID NO: 7860305 - DNA, 22 bp, Homo sapiens
ttctagattgcctgtaagtaaa

SEQ ID NO: 7860306 - DNA, 22 bp, Homo sapiens
ttctagattgacagagagcaca

SEQ ID NO: 7860307 - DNA, 22 bp, Homo sapiens
ttctagaaactggagcaaacag

SEQ ID NO: 7860308 - DNA, 22 bp, Homo sapiens
ttctagaaactggagcaaacag

SEQ ID NO: 7860309 - DNA, 22 bp, Homo sapiens
ttctagaaactggagcaaacag

SEQ ID NO: 7860310 - DNA, 22 bp, Homo sapiens
ttctagaaatccgtaagtgaat

SEQ ID NO: 7860311 - DNA, 22 bp, Homo sapiens
ttctagaaatccgtaagtgaat

SEQ ID NO: 7860312 - DNA, 22 bp, Homo sapiens
ttctagaaatccgtaagtgaat

SEQ ID NO: 7860313 - DNA, 22 bp, Homo sapiens
ttctagaacaggcaaaaccaat

SEQ ID NO: 7860314 - DNA, 22 bp, Homo sapiens
ttctagaacaggcaaaaccaat

SEQ ID NO: 7860315 - DNA, 22 bp, Homo sapiens
ttctagaacaggcaaaaccaat

SEQ ID NO: 7860316 - DNA, 22 bp, Homo sapiens
ttctagaaccatgacttcaggg

SEQ ID NO: 7860317 - DNA, 22 bp, Homo sapiens
ttctagaaccatgacttcaggg

SEQ ID NO: 7860318 - DNA, 22 bp, Homo sapiens
ttctagaaccatgacttcaggg

SEQ ID NO: 7860319 - DNA, 21 bp, Homo sapiens
ttctagaaccgtgggcggttc

SEQ ID NO: 7860320 - DNA, 21 bp, Homo sapiens
ttctagaaccgtgggcggttc

SEQ ID NO: 7860321 - DNA, 19 bp, Homo sapiens
ttctagaactgttctctca

SEQ ID NO: 7860322 - DNA, 21 bp, Homo sapiens
ttctagaaccgtgggcggttc

SEQ ID NO: 7860323 - DNA, 22 bp, Homo sapiens
ttctagaagaactagccaggaa

SEQ ID NO: 7860324 - DNA, 22 bp, Homo sapiens
ttctagaagaactagccaggaa

SEQ ID NO: 7860325 - DNA, 22 bp, Homo sapiens
ttctagaagctctaggggagaa

SEQ ID NO: 7860326 - DNA, 22 bp, Homo sapiens
ttctagaagctctaggggagaa

SEQ ID NO: 7860327 - DNA, 19 bp, Homo sapiens
ttctagaactgttctctca

SEQ ID NO: 7860328 - DNA, 19 bp, Homo sapiens
ttctagaactgttctctca

SEQ ID NO: 7860329 - DNA, 22 bp, Homo sapiens
ttctagaagaactagccaggaa

SEQ ID NO: 7860330 - DNA, 22 bp, Homo sapiens
ttctagaagaactagccaggaa

SEQ ID NO: 7860331 - DNA, 22 bp, Homo sapiens
ttctagaatgatatgaggtact

SEQ ID NO: 7860332 - DNA, 22 bp, Homo sapiens
ttctagaatgatatgaggtact

SEQ ID NO: 7860333 - DNA, 22 bp, Homo sapiens
ttctagaatccttgtctacttt

SEQ ID NO: 7860334 - DNA, 22 bp, Homo sapiens
ttctagaatccttgtctacttt

SEQ ID NO: 7860335 - DNA, 22 bp, Homo sapiens
ttctagaatccttgtctacttt

SEQ ID NO: 7860336 - DNA, 22 bp, Homo sapiens
ttctagaatgatatgaggtact

SEQ ID NO: 7860337 - DNA, 22 bp, Homo sapiens
ttctagaatgatatgaggtact

SEQ ID NO: 7860338 - DNA, 20 bp, Homo sapiens
ttctagaatgcccagggaca

SEQ ID NO: 7860339 - DNA, 20 bp, Homo sapiens
ttctagaatgcccagggaca

SEQ ID NO: 7860340 - DNA, 20 bp, Homo sapiens
ttctagaatgcccagggaca

SEQ ID NO: 7860341 - DNA, 22 bp, Homo sapiens
ttctagaatgttttgaaaggga

SEQ ID NO: 7860342 - DNA, 22 bp, Homo sapiens
ttctagaatgttttgaaaggga

SEQ ID NO: 7860343 - DNA, 22 bp, Homo sapiens
ttctagaagctctaggggagaa

SEQ ID NO: 7860344 - DNA, 22 bp, Homo sapiens
ttctagaagctgaaaaggggga

SEQ ID NO: 7860345 - DNA, 22 bp, Homo sapiens
ttctagaagctgaaaaggggga

SEQ ID NO: 7860346 - DNA, 22 bp, Homo sapiens
ttctagaagctgaaaaggggga

SEQ ID NO: 7860347 - DNA, 22 bp, Homo sapiens
ttctagaaggcaggctgggcca

SEQ ID NO: 7860348 - DNA, 22 bp, Homo sapiens
ttctagaagtgtctatgtctgt

SEQ ID NO: 7860349 - DNA, 22 bp, Homo sapiens
ttctagaaggcaggctgggcca

SEQ ID NO: 7860350 - DNA, 22 bp, Homo sapiens
ttctagaaggcaggctgggcca

SEQ ID NO: 7860351 - DNA, 20 bp, Homo sapiens
ttctagaagtttgctaccca

SEQ ID NO: 7860352 - DNA, 20 bp, Homo sapiens
ttctagaagtttgctaccca

SEQ ID NO: 7860353 - DNA, 22 bp, Homo sapiens
ttctagaagtgtctatgtctgt

SEQ ID NO: 7860354 - DNA, 20 bp, Homo sapiens
ttctagaagtttgctaccca

SEQ ID NO: 7860355 - DNA, 22 bp, Homo sapiens
ttctagaagtgtctatgtctgt

SEQ ID NO: 7860356 - DNA, 22 bp, Homo sapiens
ttctagaagtgtctatgtctgt

SEQ ID NO: 7860357 - DNA, 22 bp, Homo sapiens
ttctacaaatatttactgttcc

SEQ ID NO: 7860358 - DNA, 22 bp, Homo sapiens
ttctacaaatatttactgttcc

SEQ ID NO: 7860359 - DNA, 20 bp, Homo sapiens
ttctacaaaactgattctga

SEQ ID NO: 7860360 - DNA, 20 bp, Homo sapiens
ttctacaaaactgattctga

SEQ ID NO: 7860361 - DNA, 20 bp, Homo sapiens
ttctacaaaactgattctga

SEQ ID NO: 7860362 - DNA, 22 bp, Homo sapiens
ttctacaaatatttactgttcc

SEQ ID NO: 7860363 - DNA, 22 bp, Homo sapiens
ttctacaaatatttactgttcc

SEQ ID NO: 7860364 - DNA, 22 bp, Homo sapiens
ttctacaaatatttactgttcc

SEQ ID NO: 7860365 - DNA, 22 bp, Homo sapiens
ttctacaatatgaataatgaag

SEQ ID NO: 7860366 - DNA, 22 bp, Homo sapiens
ttctacaatatgaataatgaag

SEQ ID NO: 7860367 - DNA, 22 bp, Homo sapiens
ttctacaatatgaataatgaag

SEQ ID NO: 7860368 - DNA, 22 bp, Homo sapiens
ttctacaatatgaataatgaag

SEQ ID NO: 7860369 - DNA, 22 bp, Homo sapiens
ttctacacacctctgaggacat

SEQ ID NO: 7860370 - DNA, 22 bp, Homo sapiens
ttctactaggatgtcttgaaca

SEQ ID NO: 7860371 - DNA, 22 bp, Homo sapiens
ttctacttgccaaatgacacat

SEQ ID NO: 7860372 - DNA, 22 bp, Homo sapiens
ttctacttgccaaatgacacat

SEQ ID NO: 7860373 - DNA, 22 bp, Homo sapiens
ttctacttctgacactgtttgt

SEQ ID NO: 7860374 - DNA, 22 bp, Homo sapiens
ttctactttagcatgctcattc

SEQ ID NO: 7860375 - DNA, 22 bp, Homo sapiens
ttctactttctctgtcattaaa

SEQ ID NO: 7860376 - DNA, 22 bp, Homo sapiens
ttctactttctctgtcattaaa

SEQ ID NO: 7860377 - DNA, 22 bp, Homo sapiens
ttctactttggacataaaggac

SEQ ID NO: 7860378 - DNA, 16 bp, Homo sapiens
ttctagaaaagaaggt

SEQ ID NO: 7860379 - DNA, 16 bp, Homo sapiens
ttctagaaaagaaggt

SEQ ID NO: 7860380 - DNA, 16 bp, Homo sapiens
ttctagaaaagaaggt

SEQ ID NO: 7860381 - DNA, 16 bp, Homo sapiens
ttctagaaaagaaggt

SEQ ID NO: 7860382 - DNA, 21 bp, Homo sapiens
ttctagaaaagtatgggactg

SEQ ID NO: 7860383 - DNA, 21 bp, Homo sapiens
ttctagaaaagtatgggactg

SEQ ID NO: 7860384 - DNA, 21 bp, Homo sapiens
ttctagaaaagtatgggactg

SEQ ID NO: 7860385 - DNA, 22 bp, Homo sapiens
ttctagaaacacatgcaaacag

SEQ ID NO: 7860386 - DNA, 22 bp, Homo sapiens
ttctagaaactggagcaaacag

SEQ ID NO: 7860387 - DNA, 22 bp, Homo sapiens
ttctagaaacacatgcaaacag

SEQ ID NO: 7860388 - DNA, 22 bp, Homo sapiens
ttctagaaacacatgcaaacag

SEQ ID NO: 7860389 - DNA, 19 bp, Homo sapiens
ttctaagttttgcttgctg

SEQ ID NO: 7860390 - DNA, 19 bp, Homo sapiens
ttctaagttttgcttgctg

SEQ ID NO: 7860391 - DNA, 22 bp, Homo sapiens
ttctaagtctgctgtcttcatc

SEQ ID NO: 7860392 - DNA, 22 bp, Homo sapiens
ttctaagtcctacctgaaagca

SEQ ID NO: 7860393 - DNA, 22 bp, Homo sapiens
ttctaatgaaagtggaccatgg

SEQ ID NO: 7860394 - DNA, 22 bp, Homo sapiens
ttctaatacacggtatgacttt

SEQ ID NO: 7860395 - DNA, 22 bp, Homo sapiens
ttctaatctgggcttctgcagt

SEQ ID NO: 7860396 - DNA, 22 bp, Homo sapiens
ttctaatgaaatctgtacagta

SEQ ID NO: 7860397 - DNA, 22 bp, Homo sapiens
ttctaatacacggtatgacttt

SEQ ID NO: 7860398 - DNA, 22 bp, Homo sapiens
ttctaatagctgcctatgtatt

SEQ ID NO: 7860399 - DNA, 20 bp, Homo sapiens
ttctaatttgatggagtagc

SEQ ID NO: 7860400 - DNA, 22 bp, Homo sapiens
ttctaattgtgtttgcatatct

SEQ ID NO: 7860401 - DNA, 22 bp, Homo sapiens
ttctaattgtgtttgcatatct

SEQ ID NO: 7860402 - DNA, 22 bp, Homo sapiens
ttctaattgtgtttgcatatct

SEQ ID NO: 7860403 - DNA, 22 bp, Homo sapiens
ttctaattgtgtttgcatatct

SEQ ID NO: 7860404 - DNA, 19 bp, Homo sapiens
ttctaatgttacattttgg

SEQ ID NO: 7860405 - DNA, 22 bp, Homo sapiens
ttctaatgatttcattcaaagc

SEQ ID NO: 7860406 - DNA, 22 bp, Homo sapiens
ttctaattaaatctacgctagg

SEQ ID NO: 7860407 - DNA, 19 bp, Homo sapiens
ttctaatgttacattttgg

SEQ ID NO: 7860408 - DNA, 22 bp, Homo sapiens
ttctaattattcccttgtccca

SEQ ID NO: 7860409 - DNA, 22 bp, Homo sapiens
ttctaattgaccttaggctgtg

SEQ ID NO: 7860410 - DNA, 22 bp, Homo sapiens
ttctaattgcaagttttagtat

SEQ ID NO: 7860411 - DNA, 22 bp, Homo sapiens
ttctaattgaccttaggctgtg

SEQ ID NO: 7860412 - DNA, 22 bp, Homo sapiens
ttctaagattcatgaggacagg

SEQ ID NO: 7860413 - DNA, 22 bp, Homo sapiens
ttctaagattcatgaggacagg

SEQ ID NO: 7860414 - DNA, 22 bp, Homo sapiens
ttctaagaatgctttgcaaaat

SEQ ID NO: 7860415 - DNA, 22 bp, Homo sapiens
ttctaagaggctaatgaagaat

SEQ ID NO: 7860416 - DNA, 22 bp, Homo sapiens
ttctaagaggctaatgaagaat

SEQ ID NO: 7860417 - DNA, 22 bp, Homo sapiens
ttctaagctctgaaataaatct

SEQ ID NO: 7860418 - DNA, 22 bp, Homo sapiens
ttctaagctctgaaataaatct

SEQ ID NO: 7860419 - DNA, 22 bp, Homo sapiens
ttctaagtcactcagattttgg

SEQ ID NO: 7860420 - DNA, 22 bp, Homo sapiens
ttctaagagagtacaagcaatt

SEQ ID NO: 7860421 - DNA, 18 bp, Homo sapiens
ttccttctgatgtatatg

SEQ ID NO: 7860422 - DNA, 22 bp, Homo sapiens
ttccttctgaagcctttgtgtt

SEQ ID NO: 7860423 - DNA, 22 bp, Homo sapiens
ttccttctgaagcctttgtgtt

SEQ ID NO: 7860424 - DNA, 22 bp, Homo sapiens
ttccttctccagaacttctagg

SEQ ID NO: 7860425 - DNA, 22 bp, Homo sapiens
ttccttctccagaacttctagg

SEQ ID NO: 7860426 - DNA, 22 bp, Homo sapiens
ttccttctctgtggggaaggca

SEQ ID NO: 7860427 - DNA, 22 bp, Homo sapiens
ttccttctccagaacttctagg

SEQ ID NO: 7860428 - DNA, 22 bp, Homo sapiens
ttccttctccagaacttctagg

SEQ ID NO: 7860429 - DNA, 22 bp, Homo sapiens
ttccttctccagaacttctagg

SEQ ID NO: 7860430 - DNA, 22 bp, Homo sapiens
ttccttctagcccaagtattgg

SEQ ID NO: 7860431 - DNA, 22 bp, Homo sapiens
ttccttctattcagctccaaga

SEQ ID NO: 7860432 - DNA, 22 bp, Homo sapiens
ttccttctattcagctccaaga

SEQ ID NO: 7860433 - DNA, 22 bp, Homo sapiens
ttccttctcagccctcgaggat

SEQ ID NO: 7860434 - DNA, 22 bp, Homo sapiens
ttccttctcagccctcgaggat

SEQ ID NO: 7860435 - DNA, 22 bp, Homo sapiens
ttccttctagcccaagtattgg

SEQ ID NO: 7860436 - DNA, 22 bp, Homo sapiens
ttccttctagagcttgtttagg

SEQ ID NO: 7860437 - DNA, 22 bp, Homo sapiens
ttccttctagagcttgtttagg

SEQ ID NO: 7860438 - DNA, 22 bp, Homo sapiens
ttccttctagagcttgtttagg

SEQ ID NO: 7860439 - DNA, 22 bp, Homo sapiens
ttccttctaattttacacctga

SEQ ID NO: 7860440 - DNA, 22 bp, Homo sapiens
ttccttcaaacgcctcctgcac

SEQ ID NO: 7860441 - DNA, 22 bp, Homo sapiens
ttccttcaaacgcctcctgcac

SEQ ID NO: 7860442 - DNA, 22 bp, Homo sapiens
ttccttcaaacgcctcctgcac

SEQ ID NO: 7860443 - DNA, 22 bp, Homo sapiens
ttccttagttgactgtcttagt

SEQ ID NO: 7860444 - DNA, 22 bp, Homo sapiens
ttccttagtgttagattctgtg

SEQ ID NO: 7860445 - DNA, 22 bp, Homo sapiens
ttcctgttagccattattagct

SEQ ID NO: 7860446 - DNA, 22 bp, Homo sapiens
ttcctgtgtgttggtggcagaa

SEQ ID NO: 7860447 - DNA, 22 bp, Homo sapiens
ttcctgttagccattattagct

SEQ ID NO: 7860448 - DNA, 22 bp, Homo sapiens
ttcctgttcaggaaagttgtgt

SEQ ID NO: 7860449 - DNA, 22 bp, Homo sapiens
ttcctgtttcatagaaaactga

SEQ ID NO: 7860450 - DNA, 22 bp, Homo sapiens
ttcctgttgtgttagagtcaat

SEQ ID NO: 7860451 - DNA, 23 bp, Homo sapiens
ttccttaactgttaagattgtct

SEQ ID NO: 7860452 - DNA, 22 bp, Homo sapiens
ttccttaggctgtttgcagtgc

SEQ ID NO: 7860453 - DNA, 22 bp, Homo sapiens
ttccttacattcatatggcttc

SEQ ID NO: 7860454 - DNA, 22 bp, Homo sapiens
ttccttaatatcccttttggaa

SEQ ID NO: 7860455 - DNA, 22 bp, Homo sapiens
ttccttaatgaatcaggccatt

SEQ ID NO: 7860456 - DNA, 22 bp, Homo sapiens
ttccttaatgaatcaggccatt

SEQ ID NO: 7860457 - DNA, 22 bp, Homo sapiens
ttcctgaagtcaaagatctaaa

SEQ ID NO: 7860458 - DNA, 22 bp, Homo sapiens
ttcctgaaaatacagggagaga

SEQ ID NO: 7860459 - DNA, 22 bp, Homo sapiens
ttcctgaacatttctaagttga

SEQ ID NO: 7860460 - DNA, 22 bp, Homo sapiens
ttcctgaagtcaaagatctaaa

SEQ ID NO: 7860461 - DNA, 22 bp, Homo sapiens
ttcctgaatataaagacactag

SEQ ID NO: 7860462 - DNA, 22 bp, Homo sapiens
ttcctgaagtcaaagatctaaa

SEQ ID NO: 7860463 - DNA, 22 bp, Homo sapiens
ttcctgtgaagatctgggtgct

SEQ ID NO: 7860464 - DNA, 22 bp, Homo sapiens
ttcctgtgaaatataggtccat

SEQ ID NO: 7860465 - DNA, 22 bp, Homo sapiens
ttcctgtgaaatataggtccat

SEQ ID NO: 7860466 - DNA, 22 bp, Homo sapiens
ttcctgtatgtcagtgaagagc

SEQ ID NO: 7860467 - DNA, 22 bp, Homo sapiens
ttcctgtattctaaagggaaag

SEQ ID NO: 7860468 - DNA, 22 bp, Homo sapiens
ttcctgtattttgcgaattttc

SEQ ID NO: 7860469 - DNA, 22 bp, Homo sapiens
ttcctgaaaatacagggagaga

SEQ ID NO: 7860470 - DNA, 22 bp, Homo sapiens
ttcctgaaaatacagggagaga

SEQ ID NO: 7860471 - DNA, 22 bp, Homo sapiens
ttcctgaaaatacagggagacc

SEQ ID NO: 7860472 - DNA, 22 bp, Homo sapiens
ttcctgaaaatacagggagacc

SEQ ID NO: 7860473 - DNA, 22 bp, Homo sapiens
ttcctgaaaatacagggagacc

SEQ ID NO: 7860474 - DNA, 22 bp, Homo sapiens
ttcctctttgcatcctcaactc

SEQ ID NO: 7860475 - DNA, 22 bp, Homo sapiens
ttcctctttgcatcctcaactc

SEQ ID NO: 7860476 - DNA, 22 bp, Homo sapiens
ttcctctttgcatcctcaactc

SEQ ID NO: 7860477 - DNA, 22 bp, Homo sapiens
ttcctcttccatcttcccaggg

SEQ ID NO: 7860478 - DNA, 22 bp, Homo sapiens
ttcctctttagggctggccagg

SEQ ID NO: 7860479 - DNA, 22 bp, Homo sapiens
ttcctctttagggctggccagg

SEQ ID NO: 7860480 - DNA, 22 bp, Homo sapiens
ttcctgtgtgactcaagtggtt

SEQ ID NO: 7860481 - DNA, 22 bp, Homo sapiens
ttcctgtgtgttggtggcagaa

SEQ ID NO: 7860482 - DNA, 22 bp, Homo sapiens
ttcctgtgtgactcaagtggtt

SEQ ID NO: 7860483 - DNA, 22 bp, Homo sapiens
ttcctgtgtgctctcatttagt

SEQ ID NO: 7860484 - DNA, 22 bp, Homo sapiens
ttcctgtgtcctatttcgactt

SEQ ID NO: 7860485 - DNA, 22 bp, Homo sapiens
ttcctgtgtgaccgagacagtg

SEQ ID NO: 7860486 - DNA, 22 bp, Homo sapiens
ttcctgtgtacgtgtttcgctg

SEQ ID NO: 7860487 - DNA, 22 bp, Homo sapiens
ttcctgtgtcccgggcaccctg

SEQ ID NO: 7860488 - DNA, 22 bp, Homo sapiens
ttcctgtgtcctatttcgactt

SEQ ID NO: 7860489 - DNA, 22 bp, Homo sapiens
ttcctgtggctgtcactcctgg

SEQ ID NO: 7860490 - DNA, 22 bp, Homo sapiens
ttcctgtggtccagagtcatcc

SEQ ID NO: 7860491 - DNA, 23 bp, Homo sapiens
ttcctgtggtatattttataggg

SEQ ID NO: 7860492 - DNA, 17 bp, Homo sapiens
ttcctgtggtttgatct

SEQ ID NO: 7860493 - DNA, 17 bp, Homo sapiens
ttcctgtggtttgatct

SEQ ID NO: 7860494 - DNA, 22 bp, Homo sapiens
ttcctgtggtccagagtcatcc

SEQ ID NO: 7860495 - DNA, 22 bp, Homo sapiens
ttcctgtggtgtttcccagaca

SEQ ID NO: 7860496 - DNA, 22 bp, Homo sapiens
ttcctgtggtgtttcccagaca

SEQ ID NO: 7860497 - DNA, 22 bp, Homo sapiens
ttcctgtggccttacatctgtg

SEQ ID NO: 7860498 - DNA, 22 bp, Homo sapiens
ttcctgtggccttacatctgtg

SEQ ID NO: 7860499 - DNA, 22 bp, Homo sapiens
ttcctgtggccttacatctgtg

SEQ ID NO: 7860500 - DNA, 22 bp, Homo sapiens
ttcctgtggccttacatctgtg

SEQ ID NO: 7860501 - DNA, 22 bp, Homo sapiens
ttcctgtgcttattcttctctg

SEQ ID NO: 7860502 - DNA, 22 bp, Homo sapiens
ttcctgtgcttaattctcactg

SEQ ID NO: 7860503 - DNA, 22 bp, Homo sapiens
ttcctgtgcttaattctcactg

SEQ ID NO: 7860504 - DNA, 22 bp, Homo sapiens
ttcctgtgcttattcttctctg

SEQ ID NO: 7860505 - DNA, 19 bp, Homo sapiens
ttcctgtgctgctgtgtcc

SEQ ID NO: 7860506 - DNA, 22 bp, Homo sapiens
ttcctgtgcctcaggtctcagc

SEQ ID NO: 7860507 - DNA, 19 bp, Homo sapiens
ttcctgtgctgctgtgtcc

SEQ ID NO: 7860508 - DNA, 22 bp, Homo sapiens
ttcctgtgcctcaggtctcagc

SEQ ID NO: 7860509 - DNA, 22 bp, Homo sapiens
ttcctgtgatattagccactgt

SEQ ID NO: 7860510 - DNA, 22 bp, Homo sapiens
ttcctgtgcctcaggtctcagc

SEQ ID NO: 7860511 - DNA, 22 bp, Homo sapiens
ttcctgtgaagccggtggtctc

SEQ ID NO: 7860512 - DNA, 22 bp, Homo sapiens
ttctttaaaatagtgagaaaga

SEQ ID NO: 7860513 - DNA, 22 bp, Homo sapiens
ttcttggaaactgattccttgt

SEQ ID NO: 7860514 - DNA, 22 bp, Homo sapiens
ttcttgctcaatgtctgtttaa

SEQ ID NO: 7860515 - DNA, 22 bp, Homo sapiens
ttctttaaaatagtgagaaaga

SEQ ID NO: 7860516 - DNA, 22 bp, Homo sapiens
ttctttaaaatagtgagaaaga

SEQ ID NO: 7860517 - DNA, 22 bp, Homo sapiens
ttctttaaaatagtgagaaaga

SEQ ID NO: 7860518 - DNA, 22 bp, Homo sapiens
ttctttaaatgaattctctgta

SEQ ID NO: 7860519 - DNA, 22 bp, Homo sapiens
ttctttaaaatagtgagaaaga

SEQ ID NO: 7860520 - DNA, 18 bp, Homo sapiens
ttctttaattcagtttga

SEQ ID NO: 7860521 - DNA, 20 bp, Homo sapiens
ttcttgatttgatcctggtt

SEQ ID NO: 7860522 - DNA, 22 bp, Homo sapiens
ttcttgcatcaagacagcctgt

SEQ ID NO: 7860523 - DNA, 22 bp, Homo sapiens
ttcttgcaggtcactcactgag

SEQ ID NO: 7860524 - DNA, 22 bp, Homo sapiens
ttcttgatttcatgcagttaag

SEQ ID NO: 7860525 - DNA, 22 bp, Homo sapiens
ttcttgatttcatgcagttaag

SEQ ID NO: 7860526 - DNA, 22 bp, Homo sapiens
ttcttgcatcactctgctgttc

SEQ ID NO: 7860527 - DNA, 22 bp, Homo sapiens
ttcttgatttcatgcagttaag

SEQ ID NO: 7860528 - DNA, 22 bp, Homo sapiens
ttcttgccatatttcagccctt

SEQ ID NO: 7860529 - DNA, 22 bp, Homo sapiens
ttcttgattcttccttgaagga

SEQ ID NO: 7860530 - DNA, 22 bp, Homo sapiens
ttcttgattcttccttgaagga

SEQ ID NO: 7860531 - DNA, 22 bp, Homo sapiens
ttcttgattagtctcatgccaa

SEQ ID NO: 7860532 - DNA, 22 bp, Homo sapiens
ttcttgatgtaccaacttggga

SEQ ID NO: 7860533 - DNA, 22 bp, Homo sapiens
ttcttgattcttccttgaagga

SEQ ID NO: 7860534 - DNA, 22 bp, Homo sapiens
ttcttgatgaatgctaagaact

SEQ ID NO: 7860535 - DNA, 22 bp, Homo sapiens
ttcttgatgaatgctaagaact

SEQ ID NO: 7860536 - DNA, 22 bp, Homo sapiens
ttcttgatgcttgtttaaaggt

SEQ ID NO: 7860537 - DNA, 22 bp, Homo sapiens
ttctttagcaacttggatttag

SEQ ID NO: 7860538 - DNA, 22 bp, Homo sapiens
ttctttatatctgctagtgggt

SEQ ID NO: 7860539 - DNA, 22 bp, Homo sapiens
ttctttaggtagatccagtttt

SEQ ID NO: 7860540 - DNA, 22 bp, Homo sapiens
ttctttatcagttactcatagg

SEQ ID NO: 7860541 - DNA, 22 bp, Homo sapiens
ttctttatcagttactcatagg

SEQ ID NO: 7860542 - DNA, 22 bp, Homo sapiens
ttctttatcagttactcatagg

SEQ ID NO: 7860543 - DNA, 22 bp, Homo sapiens
ttctttatcagttactcatagg

SEQ ID NO: 7860544 - DNA, 22 bp, Homo sapiens
ttctttatcagttactcatagg

SEQ ID NO: 7860545 - DNA, 22 bp, Homo sapiens
ttctttatcagttactcatagg

SEQ ID NO: 7860546 - DNA, 22 bp, Homo sapiens
ttctttatcagttactcatagg

SEQ ID NO: 7860547 - DNA, 18 bp, Homo sapiens
ttctttaattcagtttga

SEQ ID NO: 7860548 - DNA, 18 bp, Homo sapiens
ttctttaattcagtttga

SEQ ID NO: 7860549 - DNA, 18 bp, Homo sapiens
ttctttaattcagtttga

SEQ ID NO: 7860550 - DNA, 20 bp, Homo sapiens
ttctttacgacctttctgca

SEQ ID NO: 7860551 - DNA, 22 bp, Homo sapiens
ttctttagcaacttggatttag

SEQ ID NO: 7860552 - DNA, 22 bp, Homo sapiens
ttctttaccactactcttccaa

SEQ ID NO: 7860553 - DNA, 22 bp, Homo sapiens
ttctttacagtgggttttgaat

SEQ ID NO: 7860554 - DNA, 22 bp, Homo sapiens
ttctttaccagtgaaatgttat

SEQ ID NO: 7860555 - DNA, 22 bp, Homo sapiens
ttcttacagccctattactaaa

SEQ ID NO: 7860556 - DNA, 22 bp, Homo sapiens
ttcttacagccctattactaaa

SEQ ID NO: 7860557 - DNA, 22 bp, Homo sapiens
ttcttacagccctattactaaa

SEQ ID NO: 7860558 - DNA, 22 bp, Homo sapiens
ttcttacagccctattactaaa

SEQ ID NO: 7860559 - DNA, 22 bp, Homo sapiens
ttcttacatattttcatatggt

SEQ ID NO: 7860560 - DNA, 22 bp, Homo sapiens
ttcttacatattttcatatggt

SEQ ID NO: 7860561 - DNA, 22 bp, Homo sapiens
ttcttacatattttcatatggt

SEQ ID NO: 7860562 - DNA, 22 bp, Homo sapiens
ttcttacagatttggtgaatga

SEQ ID NO: 7860563 - DNA, 22 bp, Homo sapiens
ttcttacagatttggtgaatga

SEQ ID NO: 7860564 - DNA, 22 bp, Homo sapiens
ttcttacagccctattactaaa

SEQ ID NO: 7860565 - DNA, 22 bp, Homo sapiens
ttcttacagagtttacagagcc

SEQ ID NO: 7860566 - DNA, 22 bp, Homo sapiens
ttcttacagatttggtgaatga

SEQ ID NO: 7860567 - DNA, 22 bp, Homo sapiens
ttcttacagagtttacagagcc

SEQ ID NO: 7860568 - DNA, 22 bp, Homo sapiens
ttcttacattactttacatgtg

SEQ ID NO: 7860569 - DNA, 22 bp, Homo sapiens
ttcttacattactttacatgtg

SEQ ID NO: 7860570 - DNA, 21 bp, Homo sapiens
ttcttcttggactgttttggc

SEQ ID NO: 7860571 - DNA, 22 bp, Homo sapiens
ttcttacatcagtttattttgt

SEQ ID NO: 7860572 - DNA, 22 bp, Homo sapiens
ttcttacatcagtttattttgt

SEQ ID NO: 7860573 - DNA, 22 bp, Homo sapiens
ttcttacatctataaagttggg

SEQ ID NO: 7860574 - DNA, 22 bp, Homo sapiens
ttcttacatctataaagttggg

SEQ ID NO: 7860575 - DNA, 22 bp, Homo sapiens
ttcttcttgtctgccctcacat

SEQ ID NO: 7860576 - DNA, 22 bp, Homo sapiens
ttcttctttatctcagtatcct

SEQ ID NO: 7860577 - DNA, 22 bp, Homo sapiens
ttcttcttgtctgccctcacat

SEQ ID NO: 7860578 - DNA, 22 bp, Homo sapiens
ttcttctttatctcagtatcct

SEQ ID NO: 7860579 - DNA, 22 bp, Homo sapiens
ttcttctttatctcagtatcct

SEQ ID NO: 7860580 - DNA, 22 bp, Homo sapiens
ttcttctttccaattacatggt

SEQ ID NO: 7860581 - DNA, 22 bp, Homo sapiens
ttcttctttcctataattaatt

SEQ ID NO: 7860582 - DNA, 22 bp, Homo sapiens
ttcttgaaaatagccatgtaca

SEQ ID NO: 7860583 - DNA, 19 bp, Homo sapiens
ttcttgaacatgtttctca

SEQ ID NO: 7860584 - DNA, 22 bp, Homo sapiens
ttcttctttcctataattaatt

SEQ ID NO: 7860585 - DNA, 22 bp, Homo sapiens
ttcttctttcctataattaatt

SEQ ID NO: 7860586 - DNA, 22 bp, Homo sapiens
ttcttctttccaattacatggt

SEQ ID NO: 7860587 - DNA, 22 bp, Homo sapiens
ttcttctttccaattacatggt

SEQ ID NO: 7860588 - DNA, 22 bp, Homo sapiens
ttcttctttccccctgtggtac

SEQ ID NO: 7860589 - DNA, 22 bp, Homo sapiens
ttcttctttccccctgtggtac

SEQ ID NO: 7860590 - DNA, 22 bp, Homo sapiens
ttcttctttccccctgtggtac

SEQ ID NO: 7860591 - DNA, 22 bp, Homo sapiens
ttcttctttcctataattaatt

SEQ ID NO: 7860592 - DNA, 22 bp, Homo sapiens
ttcttctttcctataattaatt

SEQ ID NO: 7860593 - DNA, 22 bp, Homo sapiens
ttcttctttcctataattaatt

SEQ ID NO: 7860594 - DNA, 22 bp, Homo sapiens
ttcttgaatagggattgataaa

SEQ ID NO: 7860595 - DNA, 22 bp, Homo sapiens
ttcttgaatagggattgataaa

SEQ ID NO: 7860596 - DNA, 22 bp, Homo sapiens
ttcttgaaggggatataaatag

SEQ ID NO: 7860597 - DNA, 22 bp, Homo sapiens
ttcttgaaggggatataaatag

SEQ ID NO: 7860598 - DNA, 19 bp, Homo sapiens
ttcttgaacatgtttctca

SEQ ID NO: 7860599 - DNA, 20 bp, Homo sapiens
ttcttgagccaaaaggcata

SEQ ID NO: 7860600 - DNA, 19 bp, Homo sapiens
ttcttgagacctcagtctg

SEQ ID NO: 7860601 - DNA, 19 bp, Homo sapiens
ttcttgagacctcagtctg

SEQ ID NO: 7860602 - DNA, 22 bp, Homo sapiens
ttcttgagtatctgcacagtgc

SEQ ID NO: 7860603 - DNA, 22 bp, Homo sapiens
ttcttgatgaatgctaagaact

SEQ ID NO: 7860604 - DNA, 22 bp, Homo sapiens
ttcttgaccatgtatgtggtcc

SEQ ID NO: 7860605 - DNA, 22 bp, Homo sapiens
ttcttgaatcactttagagata

SEQ ID NO: 7860606 - DNA, 22 bp, Homo sapiens
ttcttgaatcactttagagata

SEQ ID NO: 7860607 - DNA, 22 bp, Homo sapiens
ttcttgaatcactttagagata

SEQ ID NO: 7860608 - DNA, 22 bp, Homo sapiens
ttctggttacattgttacagct

SEQ ID NO: 7860609 - DNA, 22 bp, Homo sapiens
ttctgttagaattttgaaaata

SEQ ID NO: 7860610 - DNA, 22 bp, Homo sapiens
ttctgttacttgcaaccacagg

SEQ ID NO: 7860611 - DNA, 22 bp, Homo sapiens
ttctgtttataatttgcagttg

SEQ ID NO: 7860612 - DNA, 22 bp, Homo sapiens
ttctgtttataatttgcagttg

SEQ ID NO: 7860613 - DNA, 22 bp, Homo sapiens
ttctgtttactcagaaatacaa

SEQ ID NO: 7860614 - DNA, 22 bp, Homo sapiens
ttctgtttattcctaggagctc

SEQ ID NO: 7860615 - DNA, 22 bp, Homo sapiens
ttctgttctttatttaccatat

SEQ ID NO: 7860616 - DNA, 22 bp, Homo sapiens
ttctgtttactcagaaatacaa

SEQ ID NO: 7860617 - DNA, 22 bp, Homo sapiens
ttctgttctgatacttgtttct

SEQ ID NO: 7860618 - DNA, 22 bp, Homo sapiens
ttctgttctttatttaccatat

SEQ ID NO: 7860619 - DNA, 22 bp, Homo sapiens
ttctgtttctggggtctctgac

SEQ ID NO: 7860620 - DNA, 22 bp, Homo sapiens
ttctgtttctggggtctctgac

SEQ ID NO: 7860621 - DNA, 22 bp, Homo sapiens
ttctgtttgccatatatagtag

SEQ ID NO: 7860622 - DNA, 22 bp, Homo sapiens
ttctgttttagaaataagtagt

SEQ ID NO: 7860623 - DNA, 22 bp, Homo sapiens
ttctgttttagaaataagtagt

SEQ ID NO: 7860624 - DNA, 22 bp, Homo sapiens
ttctgttttagaaataagtagt

SEQ ID NO: 7860625 - DNA, 22 bp, Homo sapiens
ttctgttttagaaataagtagt

SEQ ID NO: 7860626 - DNA, 22 bp, Homo sapiens
ttcttacactcttaaaaatcat

SEQ ID NO: 7860627 - DNA, 22 bp, Homo sapiens
ttcttaaaacttatggacaggt

SEQ ID NO: 7860628 - DNA, 22 bp, Homo sapiens
ttcttacaagtattccaggtcc

SEQ ID NO: 7860629 - DNA, 22 bp, Homo sapiens
ttcttacagagtttacagagcc

SEQ ID NO: 7860630 - DNA, 22 bp, Homo sapiens
ttcttacagagtttacagagcc

SEQ ID NO: 7860631 - DNA, 22 bp, Homo sapiens
ttcttacactcttaaaaatcat

SEQ ID NO: 7860632 - DNA, 22 bp, Homo sapiens
ttcttacactcttaaaaatcat

SEQ ID NO: 7860633 - DNA, 22 bp, Homo sapiens
ttcttaaaacttatggacaggt

SEQ ID NO: 7860634 - DNA, 22 bp, Homo sapiens
ttctgggtggccagtatttaga

SEQ ID NO: 7860635 - DNA, 22 bp, Homo sapiens
ttctgggtgccacctaagacat

SEQ ID NO: 7860636 - DNA, 18 bp, Homo sapiens
ttctgggtgttatgttta

SEQ ID NO: 7860637 - DNA, 21 bp, Homo sapiens
ttctgggttgttaatctgaac

SEQ ID NO: 7860638 - DNA, 23 bp, Homo sapiens
ttctgggttgctgtgcttggaat

SEQ ID NO: 7860639 - DNA, 22 bp, Homo sapiens
ttctgggtttacatctgacttc

SEQ ID NO: 7860640 - DNA, 22 bp, Homo sapiens
ttctggtatgggaaatttcaag

SEQ ID NO: 7860641 - DNA, 22 bp, Homo sapiens
ttctggtcaatggcctgtaagt

SEQ ID NO: 7860642 - DNA, 22 bp, Homo sapiens
ttctggtaccgtgtcagaaacc

SEQ ID NO: 7860643 - DNA, 19 bp, Homo sapiens
ttctggtctggaatcaagg

SEQ ID NO: 7860644 - DNA, 19 bp, Homo sapiens
ttctggtctggaatcaagg

SEQ ID NO: 7860645 - DNA, 22 bp, Homo sapiens
ttctggtctctctgacctagga

SEQ ID NO: 7860646 - DNA, 19 bp, Homo sapiens
ttctggtctggaatcaagg

SEQ ID NO: 7860647 - DNA, 22 bp, Homo sapiens
ttctgggtgactcacgctcccc

SEQ ID NO: 7860648 - DNA, 17 bp, Homo sapiens
ttctgggtcccagggcc

SEQ ID NO: 7860649 - DNA, 22 bp, Homo sapiens
ttctgggtgcaactctgttctg

SEQ ID NO: 7860650 - DNA, 22 bp, Homo sapiens
ttctgggtgccacctaagacat

SEQ ID NO: 7860651 - DNA, 22 bp, Homo sapiens
ttctgggtaacaaggcaagaat

SEQ ID NO: 7860652 - DNA, 22 bp, Homo sapiens
ttctgggtagtatggttagttt

SEQ ID NO: 7860653 - DNA, 22 bp, Homo sapiens
ttctgggtcacccttctgctca

SEQ ID NO: 7860654 - DNA, 22 bp, Homo sapiens
ttctggggctaatacagaggtc

SEQ ID NO: 7860655 - DNA, 22 bp, Homo sapiens
ttctgggggccaggacagtggt

SEQ ID NO: 7860656 - DNA, 22 bp, Homo sapiens
ttctgggggaatacagctatga

SEQ ID NO: 7860657 - DNA, 22 bp, Homo sapiens
ttctgggctgtccagagggtga

SEQ ID NO: 7860658 - DNA, 23 bp, Homo sapiens
ttctgggctgtggaagcctcggg

SEQ ID NO: 7860659 - DNA, 22 bp, Homo sapiens
ttctgggctgtccagagggtga

SEQ ID NO: 7860660 - DNA, 22 bp, Homo sapiens
ttctgggctctctttctgtgtg

SEQ ID NO: 7860661 - DNA, 22 bp, Homo sapiens
ttctgggctcccacatatttca

SEQ ID NO: 7860662 - DNA, 22 bp, Homo sapiens
ttctgggctcccacatatttca

SEQ ID NO: 7860663 - DNA, 22 bp, Homo sapiens
ttctgggctcacagagcagcag

SEQ ID NO: 7860664 - DNA, 22 bp, Homo sapiens
ttctgggcttggctgtttccat

SEQ ID NO: 7860665 - DNA, 22 bp, Homo sapiens
ttctggggacataacagtaagc

SEQ ID NO: 7860666 - DNA, 22 bp, Homo sapiens
ttctgggcttgaaagtttaata

SEQ ID NO: 7860667 - DNA, 21 bp, Homo sapiens
ttctgggccggagaaggggcg

SEQ ID NO: 7860668 - DNA, 22 bp, Homo sapiens
ttctgggcctcctaggacaggc

SEQ ID NO: 7860669 - DNA, 22 bp, Homo sapiens
ttctgggctaccttcccggcag

SEQ ID NO: 7860670 - DNA, 22 bp, Homo sapiens
ttctgggctcacagagcagcag

SEQ ID NO: 7860671 - DNA, 22 bp, Homo sapiens
ttctgggcccaaccctagagtg

SEQ ID NO: 7860672 - DNA, 22 bp, Homo sapiens
ttctgggcccactgtagcatcc

SEQ ID NO: 7860673 - DNA, 22 bp, Homo sapiens
ttctgggcccactgtagcatcc

SEQ ID NO: 7860674 - DNA, 22 bp, Homo sapiens
ttctgggcccactgtagcatcc

SEQ ID NO: 7860675 - DNA, 21 bp, Homo sapiens
ttctgggccggagaaggggcg

SEQ ID NO: 7860676 - DNA, 21 bp, Homo sapiens
ttctgggccatgctgcttctc

SEQ ID NO: 7860677 - DNA, 22 bp, Homo sapiens
ttctgggcccaaccctagagtg

SEQ ID NO: 7860678 - DNA, 22 bp, Homo sapiens
ttctgagaaatgggttcacata

SEQ ID NO: 7860679 - DNA, 22 bp, Homo sapiens
ttctgacctcaggtgatccgtc

SEQ ID NO: 7860680 - DNA, 22 bp, Homo sapiens
ttctgagaaggctgtggacaca

SEQ ID NO: 7860681 - DNA, 22 bp, Homo sapiens
ttctgagaaggctgtggacaca

SEQ ID NO: 7860682 - DNA, 22 bp, Homo sapiens
ttctgagaagggtgggtctggc

SEQ ID NO: 7860683 - DNA, 22 bp, Homo sapiens
ttctgagaaggctgtggacaca

SEQ ID NO: 7860684 - DNA, 22 bp, Homo sapiens
ttctgagaagggtgggtctggc

SEQ ID NO: 7860685 - DNA, 22 bp, Homo sapiens
ttctgagaatgcttctggaatc

SEQ ID NO: 7860686 - DNA, 22 bp, Homo sapiens
ttctgagaatgcttctggaatc

SEQ ID NO: 7860687 - DNA, 22 bp, Homo sapiens
ttctgagaagtaaaatggcgtt

SEQ ID NO: 7860688 - DNA, 22 bp, Homo sapiens
ttctgacagtaatcagtttgct

SEQ ID NO: 7860689 - DNA, 22 bp, Homo sapiens
ttctgacatatccagtctcagt

SEQ ID NO: 7860690 - DNA, 22 bp, Homo sapiens
ttctgacagcaaaactcagcct

SEQ ID NO: 7860691 - DNA, 22 bp, Homo sapiens
ttctgacagcaaaactcagcct

SEQ ID NO: 7860692 - DNA, 22 bp, Homo sapiens
ttctgacatttgtcaaaatgat

SEQ ID NO: 7860693 - DNA, 22 bp, Homo sapiens
ttctgaattcatgagatttggg

SEQ ID NO: 7860694 - DNA, 22 bp, Homo sapiens
ttctgaatgatagtcttgaact

SEQ ID NO: 7860695 - DNA, 22 bp, Homo sapiens
ttctgaatggcaagcattaggc

SEQ ID NO: 7860696 - DNA, 22 bp, Homo sapiens
ttctgaatgatagtcttgaact

SEQ ID NO: 7860697 - DNA, 22 bp, Homo sapiens
ttctgaatcctcgaaacatagc

SEQ ID NO: 7860698 - DNA, 22 bp, Homo sapiens
ttctgacacattactacatgga

SEQ ID NO: 7860699 - DNA, 22 bp, Homo sapiens
ttctgacaattcagtaacagca

SEQ ID NO: 7860700 - DNA, 22 bp, Homo sapiens
ttctgacaattcagtaacagca

SEQ ID NO: 7860701 - DNA, 22 bp, Homo sapiens
ttctgacaattcagtaacagca

SEQ ID NO: 7860702 - DNA, 22 bp, Homo sapiens
ttctgaatttctgtgtatctta

SEQ ID NO: 7860703 - DNA, 22 bp, Homo sapiens
ttctgagagctgaagaaatgtt

SEQ ID NO: 7860704 - DNA, 22 bp, Homo sapiens
ttctgagagctgaagaaatgtt

SEQ ID NO: 7860705 - DNA, 22 bp, Homo sapiens
ttctgagagctgaagaaatgtt

SEQ ID NO: 7860706 - DNA, 22 bp, Homo sapiens
ttctgagaggcagagcttgtga

SEQ ID NO: 7860707 - DNA, 22 bp, Homo sapiens
ttctgagagagcctctcatgtt

SEQ ID NO: 7860708 - DNA, 22 bp, Homo sapiens
ttctgagagctgaagaaatgtt

SEQ ID NO: 7860709 - DNA, 22 bp, Homo sapiens
ttctgagagagcctctcatgtt

SEQ ID NO: 7860710 - DNA, 22 bp, Homo sapiens
ttctgagagtaaacatagcctg

SEQ ID NO: 7860711 - DNA, 22 bp, Homo sapiens
ttctgagagtaaacatagcctg

SEQ ID NO: 7860712 - DNA, 22 bp, Homo sapiens
ttctgagagtaaacatagcctg

SEQ ID NO: 7860713 - DNA, 22 bp, Homo sapiens
ttctgagaggtttgcattttca

SEQ ID NO: 7860714 - DNA, 22 bp, Homo sapiens
ttctgagacagcaaagattctt

SEQ ID NO: 7860715 - DNA, 22 bp, Homo sapiens
ttctgagacagcaaagattctt

SEQ ID NO: 7860716 - DNA, 22 bp, Homo sapiens
ttctgagacaattgagagtcta

SEQ ID NO: 7860717 - DNA, 22 bp, Homo sapiens
ttctgagaatgcttctggaatc

SEQ ID NO: 7860718 - DNA, 22 bp, Homo sapiens
ttctgagacaattgagagtcta

SEQ ID NO: 7860719 - DNA, 21 bp, Homo sapiens
ttctgagactcatttgaactc

SEQ ID NO: 7860720 - DNA, 22 bp, Homo sapiens
ttctgagacttgagattaattt

SEQ ID NO: 7860721 - DNA, 21 bp, Homo sapiens
ttctgagactcatttgaactc

SEQ ID NO: 7860722 - DNA, 22 bp, Homo sapiens
ttctgagacatcatacttttag

SEQ ID NO: 7860723 - DNA, 22 bp, Homo sapiens
ttctgagagagcctctcatgtt

SEQ ID NO: 7860724 - DNA, 22 bp, Homo sapiens
ttctgagacttgagattaattt

SEQ ID NO: 7860725 - DNA, 22 bp, Homo sapiens
ttctgagagagcctctcatgtt

SEQ ID NO: 7860726 - DNA, 22 bp, Homo sapiens
ttctgagagtgccagaagttct

SEQ ID NO: 7860727 - DNA, 20 bp, Homo sapiens
ttctgagagttcacagcccc

SEQ ID NO: 7860728 - DNA, 20 bp, Homo sapiens
ttctgagagttcacagcccc

SEQ ID NO: 7860729 - DNA, 20 bp, Homo sapiens
ttctgagagttcacagcccc

SEQ ID NO: 7860730 - DNA, 22 bp, Homo sapiens
ttctgagagtgccagaagttct

SEQ ID NO: 7860731 - DNA, 22 bp, Homo sapiens
ttctgagagtgccagaagttct

SEQ ID NO: 7860732 - DNA, 22 bp, Homo sapiens
ttctgagagttgtagtgtatcc

SEQ ID NO: 7860733 - DNA, 22 bp, Homo sapiens
ttctgagagttgtagtgtatcc

SEQ ID NO: 7860734 - DNA, 22 bp, Homo sapiens
ttctgagatacttttggcacca

SEQ ID NO: 7860735 - DNA, 22 bp, Homo sapiens
ttctgagatacttttggcacca

SEQ ID NO: 7860736 - DNA, 22 bp, Homo sapiens
ttctgagatacaaaatttactt

SEQ ID NO: 7860737 - DNA, 22 bp, Homo sapiens
ttctgagatacaaaatttactt

SEQ ID NO: 7860738 - DNA, 22 bp, Homo sapiens
ttctgagatacaaaatttactt

SEQ ID NO: 7860739 - DNA, 22 bp, Homo sapiens
ttctgagatgaggaggaaaaag

SEQ ID NO: 7860740 - DNA, 22 bp, Homo sapiens
ttctgagatgaggaggaaaaag

SEQ ID NO: 7860741 - DNA, 22 bp, Homo sapiens
ttctgagatgaggaggaaaaag

SEQ ID NO: 7860742 - DNA, 22 bp, Homo sapiens
ttctgagatacttttggcacca

SEQ ID NO: 7860743 - DNA, 22 bp, Homo sapiens
ttctgagatgcgttagaaattt

SEQ ID NO: 7860744 - DNA, 22 bp, Homo sapiens
ttctgagatgaggaggaaaaag

SEQ ID NO: 7860745 - DNA, 22 bp, Homo sapiens
ttctgagatgcgttagaaattt

SEQ ID NO: 7860746 - DNA, 22 bp, Homo sapiens
ttctgagatgcgttagaaattt

SEQ ID NO: 7860747 - DNA, 22 bp, Homo sapiens
ttctgagattatcatacaacat

SEQ ID NO: 7860748 - DNA, 22 bp, Homo sapiens
ttctgagatgtgaatctgtcaa

SEQ ID NO: 7860749 - DNA, 22 bp, Homo sapiens
ttctgagatgtgaatctgtcaa

SEQ ID NO: 7860750 - DNA, 22 bp, Homo sapiens
ttctgagatgtgaatctgtcaa

SEQ ID NO: 7860751 - DNA, 22 bp, Homo sapiens
ttctgagatgcgttagaaattt

SEQ ID NO: 7860752 - DNA, 22 bp, Homo sapiens
ttctagttaatgtagcatcttg

SEQ ID NO: 7860753 - DNA, 22 bp, Homo sapiens
ttctagttaatgtagcatcttg

SEQ ID NO: 7860754 - DNA, 22 bp, Homo sapiens
ttctagttaatgtagcatcttg

SEQ ID NO: 7860755 - DNA, 22 bp, Homo sapiens
ttctagttaatgtagcatcttg

SEQ ID NO: 7860756 - DNA, 22 bp, Homo sapiens
ttctagttaatgtagcatcttg

SEQ ID NO: 7860757 - DNA, 22 bp, Homo sapiens
ttctagttacagaagccttgct

SEQ ID NO: 7860758 - DNA, 22 bp, Homo sapiens
ttctagttactcttaaatgctg

SEQ ID NO: 7860759 - DNA, 22 bp, Homo sapiens
ttctagttactcttaaatgctg

SEQ ID NO: 7860760 - DNA, 22 bp, Homo sapiens
ttctagttactcttaaatgctg

SEQ ID NO: 7860761 - DNA, 22 bp, Homo sapiens
ttctagggaatgggatgaggat

SEQ ID NO: 7860762 - DNA, 22 bp, Homo sapiens
ttctagttaaagtatgtattag

SEQ ID NO: 7860763 - DNA, 22 bp, Homo sapiens
ttctagttaaagtatgtattag

SEQ ID NO: 7860764 - DNA, 22 bp, Homo sapiens
ttctagtgtccttggacttgct

SEQ ID NO: 7860765 - DNA, 22 bp, Homo sapiens
ttctagtgtccttggacttgct

SEQ ID NO: 7860766 - DNA, 22 bp, Homo sapiens
ttctagtgtccttggacttgct

SEQ ID NO: 7860767 - DNA, 22 bp, Homo sapiens
ttctagggttgtagcccccagt

SEQ ID NO: 7860768 - DNA, 22 bp, Homo sapiens
ttctagtgtccttggacttgct

SEQ ID NO: 7860769 - DNA, 20 bp, Homo sapiens
ttctagtttggagttattaa

SEQ ID NO: 7860770 - DNA, 20 bp, Homo sapiens
ttctagtttggagttattaa

SEQ ID NO: 7860771 - DNA, 22 bp, Homo sapiens
ttctagttttcagtccaccagg

SEQ ID NO: 7860772 - DNA, 22 bp, Homo sapiens
ttctagttttcagtccaccagg

SEQ ID NO: 7860773 - DNA, 20 bp, Homo sapiens
ttctagtttggagttattaa

SEQ ID NO: 7860774 - DNA, 20 bp, Homo sapiens
ttctagtttggagttattaa

SEQ ID NO: 7860775 - DNA, 22 bp, Homo sapiens
ttctagtttccattttaagaca

SEQ ID NO: 7860776 - DNA, 22 bp, Homo sapiens
ttctagtttccattttaagaca

SEQ ID NO: 7860777 - DNA, 22 bp, Homo sapiens
ttctagtttccattttaagaca

SEQ ID NO: 7860778 - DNA, 22 bp, Homo sapiens
ttctagttgagggagacaaata

SEQ ID NO: 7860779 - DNA, 22 bp, Homo sapiens
ttctagttcttagagaattggt

SEQ ID NO: 7860780 - DNA, 22 bp, Homo sapiens
ttctagttcttagagaattggt

SEQ ID NO: 7860781 - DNA, 22 bp, Homo sapiens
ttctagttgagggagacaaata

SEQ ID NO: 7860782 - DNA, 22 bp, Homo sapiens
ttctagttcttaggaacagaca

SEQ ID NO: 7860783 - DNA, 22 bp, Homo sapiens
ttctagttccctctggaatgta

SEQ ID NO: 7860784 - DNA, 22 bp, Homo sapiens
ttctagttctgaaagcctgaca

SEQ ID NO: 7860785 - DNA, 22 bp, Homo sapiens
ttctagttcccacatagttgcc

SEQ ID NO: 7860786 - DNA, 22 bp, Homo sapiens
ttctagttcatattctcaaaga

SEQ ID NO: 7860787 - DNA, 22 bp, Homo sapiens
ttctagttcatattctcaaaga

SEQ ID NO: 7860788 - DNA, 22 bp, Homo sapiens
ttctagttatagaaaaagcatt

SEQ ID NO: 7860789 - DNA, 22 bp, Homo sapiens
ttctcttttagaggctccatga

SEQ ID NO: 7860790 - DNA, 22 bp, Homo sapiens
ttctcttttcaccagttgctaa

SEQ ID NO: 7860791 - DNA, 22 bp, Homo sapiens
ttctcttttagaggctccatga

SEQ ID NO: 7860792 - DNA, 22 bp, Homo sapiens
ttctatatgacttctaggcagg

SEQ ID NO: 7860793 - DNA, 22 bp, Homo sapiens
ttctcttttagaggctccatga

SEQ ID NO: 7860794 - DNA, 22 bp, Homo sapiens
ttctcttttcaccagttgctaa

SEQ ID NO: 7860795 - DNA, 22 bp, Homo sapiens
ttctcttttcaccagttgctaa

SEQ ID NO: 7860796 - DNA, 22 bp, Homo sapiens
ttctgaaggtcagcagcttggt

SEQ ID NO: 7860797 - DNA, 22 bp, Homo sapiens
ttctgaatcctcgaaacatagc

SEQ ID NO: 7860798 - DNA, 22 bp, Homo sapiens
ttctgaatcctcgaaacatagc

SEQ ID NO: 7860799 - DNA, 22 bp, Homo sapiens
ttctgaatcctcgaaacatagc

SEQ ID NO: 7860800 - DNA, 22 bp, Homo sapiens
ttctgaagggctaagtgtctat

SEQ ID NO: 7860801 - DNA, 22 bp, Homo sapiens
ttctgaagggctaagtgtctat

SEQ ID NO: 7860802 - DNA, 22 bp, Homo sapiens
ttctgaagggctaagtgtctat

SEQ ID NO: 7860803 - DNA, 22 bp, Homo sapiens
ttctcttttgtgatgtgagatg

SEQ ID NO: 7860804 - DNA, 22 bp, Homo sapiens
ttctcttttagaggctccatga

SEQ ID NO: 7860805 - DNA, 22 bp, Homo sapiens
ttctataagactcatatttctt

SEQ ID NO: 7860806 - DNA, 22 bp, Homo sapiens
ttctatacaaagatttctcaca

SEQ ID NO: 7860807 - DNA, 22 bp, Homo sapiens
ttctatacaaagatttctcaca

SEQ ID NO: 7860808 - DNA, 22 bp, Homo sapiens
ttctataatgcaagccactgca

SEQ ID NO: 7860809 - DNA, 22 bp, Homo sapiens
ttctataatgcaagccactgca

SEQ ID NO: 7860810 - DNA, 22 bp, Homo sapiens
ttctataaatgaatgtgtatat

SEQ ID NO: 7860811 - DNA, 22 bp, Homo sapiens
ttctagttttgccttatcaaca

SEQ ID NO: 7860812 - DNA, 22 bp, Homo sapiens
ttctagttttgccttatcaaca

SEQ ID NO: 7860813 - DNA, 22 bp, Homo sapiens
ttctagttttgccttatcaaca

SEQ ID NO: 7860814 - DNA, 22 bp, Homo sapiens
ttctagttttgccttatcaaca

SEQ ID NO: 7860815 - DNA, 22 bp, Homo sapiens
ttctagttttgccacaggatac

SEQ ID NO: 7860816 - DNA, 22 bp, Homo sapiens
ttctgcctgccccagagaggcc

SEQ ID NO: 7860817 - DNA, 22 bp, Homo sapiens
ttctgagctacatagtactggg

SEQ ID NO: 7860818 - DNA, 22 bp, Homo sapiens
ttctgagattatcatacaacat

SEQ ID NO: 7860819 - DNA, 22 bp, Homo sapiens
ttctgagattgttaggcactaa

SEQ ID NO: 7860820 - DNA, 22 bp, Homo sapiens
ttctgagattgttaggcactaa

SEQ ID NO: 7860821 - DNA, 22 bp, Homo sapiens
ttctgagattgttaggcactaa

SEQ ID NO: 7860822 - DNA, 22 bp, Homo sapiens
ttctgagattatcatacaacat

SEQ ID NO: 7860823 - DNA, 22 bp, Homo sapiens
ttctgagcctcattcatgaggc

SEQ ID NO: 7860824 - DNA, 21 bp, Homo sapiens
ttctgccttcccctagctggg

SEQ ID NO: 7860825 - DNA, 21 bp, Homo sapiens
ttctgccttcccctagctggg

SEQ ID NO: 7860826 - DNA, 21 bp, Homo sapiens
ttctgccttcccctagctggg

SEQ ID NO: 7860827 - DNA, 22 bp, Homo sapiens
ttctgccttcagtcctctgact

SEQ ID NO: 7860828 - DNA, 21 bp, Homo sapiens
ttctgccttcccctagctggg

SEQ ID NO: 7860829 - DNA, 22 bp, Homo sapiens
ttctgccttcagtcctctgact

SEQ ID NO: 7860830 - DNA, 22 bp, Homo sapiens
ttctgccttcagtcctctgact

SEQ ID NO: 7860831 - DNA, 22 bp, Homo sapiens
ttctgcctgccccagagaggcc

SEQ ID NO: 7860832 - DNA, 22 bp, Homo sapiens
ttctgccttcagtcctctgact

SEQ ID NO: 7860833 - DNA, 21 bp, Homo sapiens
ttctgccttcgaggtctcagg

SEQ ID NO: 7860834 - DNA, 22 bp, Homo sapiens
ttctgctatacttatgaataca

SEQ ID NO: 7860835 - DNA, 22 bp, Homo sapiens
ttctgctacctttctgtacctt

SEQ ID NO: 7860836 - DNA, 22 bp, Homo sapiens
ttctgctccaccacttccagca

SEQ ID NO: 7860837 - DNA, 17 bp, Homo sapiens
ttctgctgtcgtcctct

SEQ ID NO: 7860838 - DNA, 22 bp, Homo sapiens
ttctgctgcgacccaggagtta

SEQ ID NO: 7860839 - DNA, 22 bp, Homo sapiens
ttctgctgcgacccaggagtta

SEQ ID NO: 7860840 - DNA, 17 bp, Homo sapiens
ttctgctgtttcccctt

SEQ ID NO: 7860841 - DNA, 22 bp, Homo sapiens
ttctgctgtttgtagtaatgta

SEQ ID NO: 7860842 - DNA, 19 bp, Homo sapiens
ttctgctgttcctaggctg

SEQ ID NO: 7860843 - DNA, 19 bp, Homo sapiens
ttctgctgttcctaggctg

SEQ ID NO: 7860844 - DNA, 21 bp, Homo sapiens
ttctgctgtgccatgcctctg

SEQ ID NO: 7860845 - DNA, 21 bp, Homo sapiens
ttctgctgtgccatgcctctg

SEQ ID NO: 7860846 - DNA, 21 bp, Homo sapiens
ttctgctgtgccatgcctctg

SEQ ID NO: 7860847 - DNA, 22 bp, Homo sapiens
ttctgctgaaaacagccatgta

SEQ ID NO: 7860848 - DNA, 22 bp, Homo sapiens
ttctgctgaaaacagccatgta

SEQ ID NO: 7860849 - DNA, 22 bp, Homo sapiens
ttctgctgaaaacagccatgta

SEQ ID NO: 7860850 - DNA, 22 bp, Homo sapiens
ttctgctgaagccagggagcaa

SEQ ID NO: 7860851 - DNA, 22 bp, Homo sapiens
ttctgctgaaaacagccatgta

SEQ ID NO: 7860852 - DNA, 22 bp, Homo sapiens
ttctgctgcctactcctgggga

SEQ ID NO: 7860853 - DNA, 22 bp, Homo sapiens
ttctgctgagtgggcaggtgca

SEQ ID NO: 7860854 - DNA, 22 bp, Homo sapiens
ttctgctgaagtcactgggagc

SEQ ID NO: 7860855 - DNA, 21 bp, Homo sapiens
ttctgctccagctcctctggg

SEQ ID NO: 7860856 - DNA, 22 bp, Homo sapiens
ttctgctccaccacttccagca

SEQ ID NO: 7860857 - DNA, 22 bp, Homo sapiens
ttctgctccaccacttccagca

SEQ ID NO: 7860858 - DNA, 22 bp, Homo sapiens
ttctgcttttagctaaactata

SEQ ID NO: 7860859 - DNA, 22 bp, Homo sapiens
ttctgcttttattgccagagtt

SEQ ID NO: 7860860 - DNA, 22 bp, Homo sapiens
ttctgcttttagctaaactata

SEQ ID NO: 7860861 - DNA, 22 bp, Homo sapiens
ttctgcttttagctaaactata

SEQ ID NO: 7860862 - DNA, 22 bp, Homo sapiens
ttctgcttttattgccagagtt

SEQ ID NO: 7860863 - DNA, 22 bp, Homo sapiens
ttctgcttttctctgtctgagt

SEQ ID NO: 7860864 - DNA, 22 bp, Homo sapiens
ttctgctttcagttcttctggg

SEQ ID NO: 7860865 - DNA, 22 bp, Homo sapiens
ttctgctttcagttcttctggg

SEQ ID NO: 7860866 - DNA, 22 bp, Homo sapiens
ttctgctttcagttcttctggg

SEQ ID NO: 7860867 - DNA, 22 bp, Homo sapiens
ttctgctttggttccatggatg

SEQ ID NO: 7860868 - DNA, 22 bp, Homo sapiens
ttctgcttttagctaaactata

SEQ ID NO: 7860869 - DNA, 22 bp, Homo sapiens
ttctgcttttagctaaactata

SEQ ID NO: 7860870 - DNA, 22 bp, Homo sapiens
ttctgctttggttccatggatg

SEQ ID NO: 7860871 - DNA, 20 bp, Homo sapiens
ttctgcttgcaaatatcaag

SEQ ID NO: 7860872 - DNA, 20 bp, Homo sapiens
ttctgcttgcaaatatcaag

SEQ ID NO: 7860873 - DNA, 20 bp, Homo sapiens
ttctgcttgcaaatatcaag

SEQ ID NO: 7860874 - DNA, 20 bp, Homo sapiens
ttctgcttgcaaatatcaag

SEQ ID NO: 7860875 - DNA, 22 bp, Homo sapiens
ttctgcttctgtgtgtcccagg

SEQ ID NO: 7860876 - DNA, 22 bp, Homo sapiens
ttctgcttattctgtagccttt

SEQ ID NO: 7860877 - DNA, 22 bp, Homo sapiens
ttctgcttattctgtagccttt

SEQ ID NO: 7860878 - DNA, 22 bp, Homo sapiens
ttctgcttcactggcctggagg

SEQ ID NO: 7860879 - DNA, 22 bp, Homo sapiens
ttctgcttattcaaatgatctt

SEQ ID NO: 7860880 - DNA, 22 bp, Homo sapiens
ttctgcttattcaaatgatctt

SEQ ID NO: 7860881 - DNA, 22 bp, Homo sapiens
ttctggaaagcatttgaggccc

SEQ ID NO: 7860882 - DNA, 22 bp, Homo sapiens
ttctggaaagatttgcgtgtaa

SEQ ID NO: 7860883 - DNA, 22 bp, Homo sapiens
ttctgggcaccaccacagactt

SEQ ID NO: 7860884 - DNA, 22 bp, Homo sapiens
ttctggaaaagaaagttaagat

SEQ ID NO: 7860885 - DNA, 22 bp, Homo sapiens
ttctggaaaagaaagttaagat

SEQ ID NO: 7860886 - DNA, 20 bp, Homo sapiens
ttctgcttttgcttagggac

SEQ ID NO: 7860887 - DNA, 22 bp, Homo sapiens
ttctggaaaagaaagttaagat

SEQ ID NO: 7860888 - DNA, 19 bp, Homo sapiens
ttctggaaacccaggtaat

SEQ ID NO: 7860889 - DNA, 19 bp, Homo sapiens
ttctggaaacccaggtaat

SEQ ID NO: 7860890 - DNA, 22 bp, Homo sapiens
ttctggaaaccctcagccagtg

SEQ ID NO: 7860891 - DNA, 19 bp, Homo sapiens
ttctgggcagcacatgaat

SEQ ID NO: 7860892 - DNA, 20 bp, Homo sapiens
ttctgggcagccatgtactt

SEQ ID NO: 7860893 - DNA, 22 bp, Homo sapiens
ttctgggcaggactggggaccc

SEQ ID NO: 7860894 - DNA, 22 bp, Homo sapiens
ttctgggcagagctggagctgc

SEQ ID NO: 7860895 - DNA, 19 bp, Homo sapiens
ttctgggcagcacatgaat

SEQ ID NO: 7860896 - DNA, 22 bp, Homo sapiens
ttctgggcagagctggagctgc

SEQ ID NO: 7860897 - DNA, 19 bp, Homo sapiens
ttctgggcattcatattta

SEQ ID NO: 7860898 - DNA, 22 bp, Homo sapiens
ttctgggccaatctcttaatct

SEQ ID NO: 7860899 - DNA, 21 bp, Homo sapiens
ttctgggccatgctgcttctc

SEQ ID NO: 7860900 - DNA, 22 bp, Homo sapiens
ttctgggcagttggaaatttca

SEQ ID NO: 7860901 - DNA, 22 bp, Homo sapiens
ttctgggcaggactggggaccc

SEQ ID NO: 7860902 - DNA, 22 bp, Homo sapiens
ttctgggcatgttacattctgt

SEQ ID NO: 7860903 - DNA, 22 bp, Homo sapiens
ttctttatgcttctgtttaggc

SEQ ID NO: 7860904 - DNA, 22 bp, Homo sapiens
ttctttatgcttctgtttaggc

SEQ ID NO: 7860905 - DNA, 22 bp, Homo sapiens
ttctttatgcttctgtttaggc

SEQ ID NO: 7860906 - DNA, 22 bp, Homo sapiens
ttctttatcctatttgtaggtg

SEQ ID NO: 7860907 - DNA, 22 bp, Homo sapiens
ttctttatggaatggtgatagt

SEQ ID NO: 7860908 - DNA, 22 bp, Homo sapiens
ttctttatgcttctgtttaggc

SEQ ID NO: 7860909 - DNA, 22 bp, Homo sapiens
ttctttatgttaatgaatctat

SEQ ID NO: 7860910 - DNA, 22 bp, Homo sapiens
ttctttatgttaatgaatctat

SEQ ID NO: 7860911 - DNA, 22 bp, Homo sapiens
ttctttatgttaatgaatctat

SEQ ID NO: 7860912 - DNA, 22 bp, Homo sapiens
ttctttatgttaatgaatctat

SEQ ID NO: 7860913 - DNA, 22 bp, Homo sapiens
ttctttatgttaatgaatctat

SEQ ID NO: 7860914 - DNA, 22 bp, Homo sapiens
ttctttatgttaatgaatctat

SEQ ID NO: 7860915 - DNA, 22 bp, Homo sapiens
ttctttattagtttagtgagct

SEQ ID NO: 7860916 - DNA, 22 bp, Homo sapiens
ttctttattagtttagtgagct

SEQ ID NO: 7860917 - DNA, 22 bp, Homo sapiens
ttctttattagtttagtgagct

SEQ ID NO: 7860918 - DNA, 22 bp, Homo sapiens
ttctttattgagacttcattgt

SEQ ID NO: 7860919 - DNA, 22 bp, Homo sapiens
ttctttattgagacttcattgt

SEQ ID NO: 7860920 - DNA, 22 bp, Homo sapiens
ttctttattgagacttcattgt

SEQ ID NO: 7860921 - DNA, 22 bp, Homo sapiens
ttctttcaatagctggcatatg

SEQ ID NO: 7860922 - DNA, 22 bp, Homo sapiens
ttctttcaatagctggcatatg

SEQ ID NO: 7860923 - DNA, 22 bp, Homo sapiens
ttctttcaatagctggcatatg

SEQ ID NO: 7860924 - DNA, 22 bp, Homo sapiens
ttctttcagaacacaagtgatt

SEQ ID NO: 7860925 - DNA, 22 bp, Homo sapiens
ttctttcagaacacaagtgatt

SEQ ID NO: 7860926 - DNA, 23 bp, Homo sapiens
ttctttcaagaagttcacagtgc

SEQ ID NO: 7860927 - DNA, 23 bp, Homo sapiens
ttctttcaagaagttcacagtgc

SEQ ID NO: 7860928 - DNA, 23 bp, Homo sapiens
ttctttcaagaagttcacagtgc

SEQ ID NO: 7860929 - DNA, 22 bp, Homo sapiens
ttctttccaaccagatattggt

SEQ ID NO: 7860930 - DNA, 22 bp, Homo sapiens
ttctttccaaccagatattggt

SEQ ID NO: 7860931 - DNA, 20 bp, Homo sapiens
ttctttcatctacacgttgt

SEQ ID NO: 7860932 - DNA, 20 bp, Homo sapiens
ttctttcatctacacgttgt

SEQ ID NO: 7860933 - DNA, 19 bp, Homo sapiens
ttctttccacatcttctct

SEQ ID NO: 7860934 - DNA, 19 bp, Homo sapiens
ttctttccacatcttctct

SEQ ID NO: 7860935 - DNA, 19 bp, Homo sapiens
ttctttccacatcttctct

SEQ ID NO: 7860936 - DNA, 19 bp, Homo sapiens
ttctttccacatcttctct

SEQ ID NO: 7860937 - DNA, 22 bp, Homo sapiens
ttctttccttgcctcagtgaag

SEQ ID NO: 7860938 - DNA, 22 bp, Homo sapiens
ttctttccttgcctcagtgaag

SEQ ID NO: 7860939 - DNA, 22 bp, Homo sapiens
ttctttcctcccagcctttgga

SEQ ID NO: 7860940 - DNA, 22 bp, Homo sapiens
ttctttcctcccagcctttgga

SEQ ID NO: 7860941 - DNA, 22 bp, Homo sapiens
ttctttccttgcctcagtgaag

SEQ ID NO: 7860942 - DNA, 22 bp, Homo sapiens
ttctttccttgcctcagtgaag

SEQ ID NO: 7860943 - DNA, 22 bp, Homo sapiens
ttctttccttgcctcagtgaag

SEQ ID NO: 7860944 - DNA, 22 bp, Homo sapiens
ttctttcccttccagcagctcc

SEQ ID NO: 7860945 - DNA, 22 bp, Homo sapiens
ttctttcccagtagatgtgaaa

SEQ ID NO: 7860946 - DNA, 21 bp, Homo sapiens
ttctttccccagaggactaaa

SEQ ID NO: 7860947 - DNA, 22 bp, Homo sapiens
ttgaagaacataatagctactt

SEQ ID NO: 7860948 - DNA, 22 bp, Homo sapiens
ttgaagaagtaattttaagtct

SEQ ID NO: 7860949 - DNA, 22 bp, Homo sapiens
ttgaagaaccatctgtgccact

SEQ ID NO: 7860950 - DNA, 22 bp, Homo sapiens
ttgaagaagtaattttaagtct

SEQ ID NO: 7860951 - DNA, 22 bp, Homo sapiens
ttgaagaattaacagctgtgga

SEQ ID NO: 7860952 - DNA, 22 bp, Homo sapiens
ttgaagaattaggacgtgagta

SEQ ID NO: 7860953 - DNA, 22 bp, Homo sapiens
ttgaagaattaacagctgtgga

SEQ ID NO: 7860954 - DNA, 22 bp, Homo sapiens
ttgaagagaaccgcggcttatt

SEQ ID NO: 7860955 - DNA, 22 bp, Homo sapiens
ttgaagagtttgatagagttga

SEQ ID NO: 7860956 - DNA, 22 bp, Homo sapiens
ttgaagagttttatgccaacct

SEQ ID NO: 7860957 - DNA, 22 bp, Homo sapiens
ttgaagagtgtccttgtaaaaa

SEQ ID NO: 7860958 - DNA, 22 bp, Homo sapiens
ttgaagagtgccttccagacat

SEQ ID NO: 7860959 - DNA, 22 bp, Homo sapiens
ttgaagagtgtccttgtaaaaa

SEQ ID NO: 7860960 - DNA, 22 bp, Homo sapiens
ttgaagagtgcattagcatatt

SEQ ID NO: 7860961 - DNA, 22 bp, Homo sapiens
ttgaagagtgcattagcatatt

SEQ ID NO: 7860962 - DNA, 22 bp, Homo sapiens
ttgaagagtgccttccagacat

SEQ ID NO: 7860963 - DNA, 22 bp, Homo sapiens
ttgaagagtctagattggttat

SEQ ID NO: 7860964 - DNA, 22 bp, Homo sapiens
ttgaagagtctagattggttat

SEQ ID NO: 7860965 - DNA, 22 bp, Homo sapiens
ttgaagagtctttctttccccc

SEQ ID NO: 7860966 - DNA, 22 bp, Homo sapiens
ttgaagagtctttctttccccc

SEQ ID NO: 7860967 - DNA, 22 bp, Homo sapiens
ttgaagagtctttctttccccc

SEQ ID NO: 7860968 - DNA, 22 bp, Homo sapiens
ttgaagatctttgcattgcagg

SEQ ID NO: 7860969 - DNA, 22 bp, Homo sapiens
ttgaagagtttgatagagttga

SEQ ID NO: 7860970 - DNA, 22 bp, Homo sapiens
ttgaagagttttatgccaacct

SEQ ID NO: 7860971 - DNA, 22 bp, Homo sapiens
ttgaagatggtagcaatttcct

SEQ ID NO: 7860972 - DNA, 22 bp, Homo sapiens
ttgaagatctttgcattgcagg

SEQ ID NO: 7860973 - DNA, 22 bp, Homo sapiens
ttgaagattattctattaaaag

SEQ ID NO: 7860974 - DNA, 22 bp, Homo sapiens
ttgaagattctttttgttagta

SEQ ID NO: 7860975 - DNA, 22 bp, Homo sapiens
ttgaagagaatcagaaggttga

SEQ ID NO: 7860976 - DNA, 22 bp, Homo sapiens
ttgaagagaaccgcggcttatt

SEQ ID NO: 7860977 - DNA, 22 bp, Homo sapiens
ttgaagagaatcagaaggttga

SEQ ID NO: 7860978 - DNA, 22 bp, Homo sapiens
ttgaagagacaatttggaaagc

SEQ ID NO: 7860979 - DNA, 22 bp, Homo sapiens
ttgaagagcaccagcattttga

SEQ ID NO: 7860980 - DNA, 22 bp, Homo sapiens
ttgaagagacgatttttccacc

SEQ ID NO: 7860981 - DNA, 22 bp, Homo sapiens
ttgaagagacaatttggaaagc

SEQ ID NO: 7860982 - DNA, 22 bp, Homo sapiens
ttgaagagacgatttttccacc

SEQ ID NO: 7860983 - DNA, 22 bp, Homo sapiens
ttgaagagcaccagcattttga

SEQ ID NO: 7860984 - DNA, 22 bp, Homo sapiens
ttgaagagcaccagcattttga

SEQ ID NO: 7860985 - DNA, 22 bp, Homo sapiens
ttgaagagctgcttgataccct

SEQ ID NO: 7860986 - DNA, 22 bp, Homo sapiens
ttgaagagctgcttgataccct

SEQ ID NO: 7860987 - DNA, 22 bp, Homo sapiens
ttgaagaggactttgcagctgt

SEQ ID NO: 7860988 - DNA, 22 bp, Homo sapiens
ttgaagaggactttgcagctgt

SEQ ID NO: 7860989 - DNA, 20 bp, Homo sapiens
ttgaagaggatatatcgctc

SEQ ID NO: 7860990 - DNA, 22 bp, Homo sapiens
ttgaagagcaccagcattttga

SEQ ID NO: 7860991 - DNA, 20 bp, Homo sapiens
ttgaagaggatatatcgctc

SEQ ID NO: 7860992 - DNA, 22 bp, Homo sapiens
ttgaagagtaaagtgttttctc

SEQ ID NO: 7860993 - DNA, 20 bp, Homo sapiens
ttgaagaggatatatcgctc

SEQ ID NO: 7860994 - DNA, 22 bp, Homo sapiens
ttgaagagtaaagtgttttctc

SEQ ID NO: 7860995 - DNA, 20 bp, Homo sapiens
ttgaagagtcaggtagggcc

SEQ ID NO: 7860996 - DNA, 20 bp, Homo sapiens
ttgaagagtcaggtagggcc

SEQ ID NO: 7860997 - DNA, 22 bp, Homo sapiens
ttgaagagtagaaaatgcaaat

SEQ ID NO: 7860998 - DNA, 22 bp, Homo sapiens
ttgaagagtagaaaatgcaaat

SEQ ID NO: 7860999 - DNA, 20 bp, Homo sapiens
ttgaagagtcaggtagggcc

SEQ ID NO: 7861000 - DNA, 22 bp, Homo sapiens
ttgaagagtcgcttaacctgtg

SEQ ID NO: 7861001 - DNA, 22 bp, Homo sapiens
ttgaagagtcgcttaacctgtg

SEQ ID NO: 7861002 - DNA, 22 bp, Homo sapiens
ttgaattagactttgctacagg

SEQ ID NO: 7861003 - DNA, 22 bp, Homo sapiens
ttgaatgcttacaatatgttag

SEQ ID NO: 7861004 - DNA, 22 bp, Homo sapiens
ttgaattagactttgctacagg

SEQ ID NO: 7861005 - DNA, 22 bp, Homo sapiens
ttgaattagactttgctacagg

SEQ ID NO: 7861006 - DNA, 22 bp, Homo sapiens
ttgaattataagtgtgtctact

SEQ ID NO: 7861007 - DNA, 22 bp, Homo sapiens
ttgaattataagtgtgtctact

SEQ ID NO: 7861008 - DNA, 22 bp, Homo sapiens
ttgaattataagtgtgtctact

SEQ ID NO: 7861009 - DNA, 22 bp, Homo sapiens
ttgaattatttgtttgcaagct

SEQ ID NO: 7861010 - DNA, 22 bp, Homo sapiens
ttgaattatatgtatgtccttt

SEQ ID NO: 7861011 - DNA, 22 bp, Homo sapiens
ttgaattataagtgtgtctact

SEQ ID NO: 7861012 - DNA, 22 bp, Homo sapiens
ttgaatgagaagttattgccat

SEQ ID NO: 7861013 - DNA, 22 bp, Homo sapiens
ttgaatgaggaagagcactggc

SEQ ID NO: 7861014 - DNA, 22 bp, Homo sapiens
ttgaatgagtgttttactcatg

SEQ ID NO: 7861015 - DNA, 22 bp, Homo sapiens
ttgaatgagtgttttactcatg

SEQ ID NO: 7861016 - DNA, 22 bp, Homo sapiens
ttgaatgatcctatctagcaca

SEQ ID NO: 7861017 - DNA, 22 bp, Homo sapiens
ttgaatgagtgttttactcatg

SEQ ID NO: 7861018 - DNA, 22 bp, Homo sapiens
ttgaatgcatctttgagctcct

SEQ ID NO: 7861019 - DNA, 22 bp, Homo sapiens
ttgaaggacatcctatttctag

SEQ ID NO: 7861020 - DNA, 22 bp, Homo sapiens
ttgaagctgtgctttttgtagg

SEQ ID NO: 7861021 - DNA, 22 bp, Homo sapiens
ttgaagctgtgctttttgtagg

SEQ ID NO: 7861022 - DNA, 22 bp, Homo sapiens
ttgaagctgtctttcagaatca

SEQ ID NO: 7861023 - DNA, 22 bp, Homo sapiens
ttgaagctgtctttcagaatca

SEQ ID NO: 7861024 - DNA, 22 bp, Homo sapiens
ttgaagctaggctgtgcatatg

SEQ ID NO: 7861025 - DNA, 22 bp, Homo sapiens
ttgaagctccggtgtataggaa

SEQ ID NO: 7861026 - DNA, 22 bp, Homo sapiens
ttgaagctctaacttccaatac

SEQ ID NO: 7861027 - DNA, 22 bp, Homo sapiens
ttgaagctgccgtttttctcca

SEQ ID NO: 7861028 - DNA, 22 bp, Homo sapiens
ttgaagctctaacttccaatac

SEQ ID NO: 7861029 - DNA, 22 bp, Homo sapiens
ttgaatgaatggtccatataga

SEQ ID NO: 7861030 - DNA, 22 bp, Homo sapiens
ttgaatgaataaaagagtaagg

SEQ ID NO: 7861031 - DNA, 22 bp, Homo sapiens
ttgaagcaggaaaatttctatt

SEQ ID NO: 7861032 - DNA, 22 bp, Homo sapiens
ttgaagcaaggcgaatcttgtg

SEQ ID NO: 7861033 - DNA, 22 bp, Homo sapiens
ttgaggagtgtgaggtctccca

SEQ ID NO: 7861034 - DNA, 22 bp, Homo sapiens
ttgagctcagtgactcgacttt

SEQ ID NO: 7861035 - DNA, 22 bp, Homo sapiens
ttgagcccaggaggcctgggtg

SEQ ID NO: 7861036 - DNA, 22 bp, Homo sapiens
ttgagcccaggaggcctgggtg

SEQ ID NO: 7861037 - DNA, 22 bp, Homo sapiens
ttgagcccaggaggcctgggtg

SEQ ID NO: 7861038 - DNA, 22 bp, Homo sapiens
ttgagcccaggaggcctgggtg

SEQ ID NO: 7861039 - DNA, 22 bp, Homo sapiens
ttgagcatttgttttgaaagag

SEQ ID NO: 7861040 - DNA, 22 bp, Homo sapiens
ttgagcccaggaggcctgggtg

SEQ ID NO: 7861041 - DNA, 22 bp, Homo sapiens
ttgagcccaggaggcctgggtg

SEQ ID NO: 7861042 - DNA, 22 bp, Homo sapiens
ttgagcccaggaggcctgggtg

SEQ ID NO: 7861043 - DNA, 23 bp, Homo sapiens
ttgagcatttgtggatactgaaa

SEQ ID NO: 7861044 - DNA, 22 bp, Homo sapiens
ttgagcatgtaactacacaggg

SEQ ID NO: 7861045 - DNA, 22 bp, Homo sapiens
ttgaggattcatgtcagaattc

SEQ ID NO: 7861046 - DNA, 22 bp, Homo sapiens
ttgaggcaaaatcaacgggaag

SEQ ID NO: 7861047 - DNA, 23 bp, Homo sapiens
ttgaggcaaacatgtaagtagga

SEQ ID NO: 7861048 - DNA, 23 bp, Homo sapiens
ttgaggcaaacatgtaagtagga

SEQ ID NO: 7861049 - DNA, 23 bp, Homo sapiens
ttgaggcaaactcttttctgaaa

SEQ ID NO: 7861050 - DNA, 22 bp, Homo sapiens
ttgaggattcatgtcagaattc

SEQ ID NO: 7861051 - DNA, 22 bp, Homo sapiens
ttgaggcacacacaggttgcat

SEQ ID NO: 7861052 - DNA, 22 bp, Homo sapiens
ttgaggcacacacaggttgcat

SEQ ID NO: 7861053 - DNA, 22 bp, Homo sapiens
ttgaggcacagattttagtggc

SEQ ID NO: 7861054 - DNA, 22 bp, Homo sapiens
ttgaggcacagattttagtggc

SEQ ID NO: 7861055 - DNA, 22 bp, Homo sapiens
ttgagcaggatggctatgcaca

SEQ ID NO: 7861056 - DNA, 20 bp, Homo sapiens
ttgagcagcagtgctgtgtc

SEQ ID NO: 7861057 - DNA, 22 bp, Homo sapiens
ttgagcaggaactagaagatag

SEQ ID NO: 7861058 - DNA, 22 bp, Homo sapiens
ttgagcagatcgggctgtgggg

SEQ ID NO: 7861059 - DNA, 19 bp, Homo sapiens
ttgagcagtgcttagcacc

SEQ ID NO: 7861060 - DNA, 22 bp, Homo sapiens
ttgagcatctgaggattttcct

SEQ ID NO: 7861061 - DNA, 22 bp, Homo sapiens
ttgagcaattaggaaataaaga

SEQ ID NO: 7861062 - DNA, 22 bp, Homo sapiens
ttgagcaattaggaaataaaga

SEQ ID NO: 7861063 - DNA, 22 bp, Homo sapiens
ttgagcacttattggtgttagg

SEQ ID NO: 7861064 - DNA, 22 bp, Homo sapiens
ttgagcacattccctttcatgg

SEQ ID NO: 7861065 - DNA, 22 bp, Homo sapiens
ttgagcacattccctttcatgg

SEQ ID NO: 7861066 - DNA, 22 bp, Homo sapiens
ttgagcaagtgtacgagcaggc

SEQ ID NO: 7861067 - DNA, 20 bp, Homo sapiens
ttgagcaatcagtaaaggat

SEQ ID NO: 7861068 - DNA, 22 bp, Homo sapiens
ttgagcaagagtaggaactgaa

SEQ ID NO: 7861069 - DNA, 22 bp, Homo sapiens
ttgagcaatgctgcaaagagat

SEQ ID NO: 7861070 - DNA, 22 bp, Homo sapiens
ttgagcaatgtcactgaggctt

SEQ ID NO: 7861071 - DNA, 20 bp, Homo sapiens
ttgagcaatcagtaaaggat

SEQ ID NO: 7861072 - DNA, 22 bp, Homo sapiens
ttgagcaatgctgcaaagagat

SEQ ID NO: 7861073 - DNA, 22 bp, Homo sapiens
ttgagcaaatcagaagtttaga

SEQ ID NO: 7861074 - DNA, 22 bp, Homo sapiens
ttgagcaaatcagattgtaatt

SEQ ID NO: 7861075 - DNA, 22 bp, Homo sapiens
ttgagcaaaggagtaaaatgca

SEQ ID NO: 7861076 - DNA, 22 bp, Homo sapiens
ttgagcaaaggagtaaaatgca

SEQ ID NO: 7861077 - DNA, 22 bp, Homo sapiens
ttgcaaagagtcatgtaagtca

SEQ ID NO: 7861078 - DNA, 22 bp, Homo sapiens
ttgcaaagactggcttaacagt

SEQ ID NO: 7861079 - DNA, 22 bp, Homo sapiens
ttgatttttccagcttctagag

SEQ ID NO: 7861080 - DNA, 20 bp, Homo sapiens
ttgcaaagtgaatagcaatt

SEQ ID NO: 7861081 - DNA, 22 bp, Homo sapiens
ttgcaaaggggaataaagcaat

SEQ ID NO: 7861082 - DNA, 22 bp, Homo sapiens
ttgcaaagttccctacacatgt

SEQ ID NO: 7861083 - DNA, 21 bp, Homo sapiens
ttgattttaggaagtttgtca

SEQ ID NO: 7861084 - DNA, 21 bp, Homo sapiens
ttgattttaggaagtttgtca

SEQ ID NO: 7861085 - DNA, 21 bp, Homo sapiens
ttgattttaggaagtttgtca

SEQ ID NO: 7861086 - DNA, 21 bp, Homo sapiens
ttgattttaggaagtttgtca

SEQ ID NO: 7861087 - DNA, 21 bp, Homo sapiens
ttgattttaggaagtttgtca

SEQ ID NO: 7861088 - DNA, 22 bp, Homo sapiens
ttgattttaaaatagtgacact

SEQ ID NO: 7861089 - DNA, 21 bp, Homo sapiens
ttgattttaggaagtttgtca

SEQ ID NO: 7861090 - DNA, 22 bp, Homo sapiens
ttgatttttccagcttctagag

SEQ ID NO: 7861091 - DNA, 22 bp, Homo sapiens
ttgattttgcctgatctgagag

SEQ ID NO: 7861092 - DNA, 22 bp, Homo sapiens
ttgattttgcctgatctgagag

SEQ ID NO: 7861093 - DNA, 22 bp, Homo sapiens
ttgattttgcctgatctgagag

SEQ ID NO: 7861094 - DNA, 21 bp, Homo sapiens
ttgattttaggaagtttgtca

SEQ ID NO: 7861095 - DNA, 22 bp, Homo sapiens
ttgattttcaattcattgacaa

SEQ ID NO: 7861096 - DNA, 22 bp, Homo sapiens
ttgattttcaattcattgacaa

SEQ ID NO: 7861097 - DNA, 22 bp, Homo sapiens
ttgattttcaattcattgacaa

SEQ ID NO: 7861098 - DNA, 22 bp, Homo sapiens
ttgatttatagaatgttcaagc

SEQ ID NO: 7861099 - DNA, 22 bp, Homo sapiens
ttgatttatagaatgttcaagc

SEQ ID NO: 7861100 - DNA, 23 bp, Homo sapiens
ttgatttagctgggattgcatgc

SEQ ID NO: 7861101 - DNA, 23 bp, Homo sapiens
ttgatttagctgggattgcatgc

SEQ ID NO: 7861102 - DNA, 23 bp, Homo sapiens
ttgatttagctgggattgcatgc

SEQ ID NO: 7861103 - DNA, 22 bp, Homo sapiens
ttgattgaattttgaaaatcta

SEQ ID NO: 7861104 - DNA, 22 bp, Homo sapiens
ttgattggcagatggcttgaca

SEQ ID NO: 7861105 - DNA, 22 bp, Homo sapiens
ttgattgtactccaagtacctg

SEQ ID NO: 7861106 - DNA, 22 bp, Homo sapiens
ttgattttaaaatagtgacact

SEQ ID NO: 7861107 - DNA, 22 bp, Homo sapiens
ttgatttgtattgcaggcccct

SEQ ID NO: 7861108 - DNA, 22 bp, Homo sapiens
ttgattttaaaatagtgacact

SEQ ID NO: 7861109 - DNA, 22 bp, Homo sapiens
ttgatttgtaggaatggagacc

SEQ ID NO: 7861110 - DNA, 22 bp, Homo sapiens
ttgattttaaaatagtgacact

SEQ ID NO: 7861111 - DNA, 22 bp, Homo sapiens
ttgatttctattgagttcctgt

SEQ ID NO: 7861112 - DNA, 22 bp, Homo sapiens
ttgatttctattcagatgtaga

SEQ ID NO: 7861113 - DNA, 22 bp, Homo sapiens
ttgatttcactctctgtccaat

SEQ ID NO: 7861114 - DNA, 22 bp, Homo sapiens
ttgatttcttactcttccaagg

SEQ ID NO: 7861115 - DNA, 22 bp, Homo sapiens
ttgatttcttactcttccaagg

SEQ ID NO: 7861116 - DNA, 22 bp, Homo sapiens
ttgatttcttactcttccaagg

SEQ ID NO: 7861117 - DNA, 22 bp, Homo sapiens
ttgcaaatgtttcataacagta

SEQ ID NO: 7861118 - DNA, 22 bp, Homo sapiens
ttgcaaattaaagaggatagca

SEQ ID NO: 7861119 - DNA, 22 bp, Homo sapiens
ttgcaaatgggcaaagcagatc

SEQ ID NO: 7861120 - DNA, 22 bp, Homo sapiens
ttgcaaatgtgagtttagactg

SEQ ID NO: 7861121 - DNA, 22 bp, Homo sapiens
ttgcaaatgtgaataattacac

SEQ ID NO: 7861122 - DNA, 20 bp, Homo sapiens
ttgcaaatatctattgattg

SEQ ID NO: 7861123 - DNA, 22 bp, Homo sapiens
ttgcaaatgaccattgccacat

SEQ ID NO: 7861124 - DNA, 22 bp, Homo sapiens
ttgcaaatcacaagagcagagc

SEQ ID NO: 7861125 - DNA, 22 bp, Homo sapiens
ttgatctttataatagttttga

SEQ ID NO: 7861126 - DNA, 22 bp, Homo sapiens
ttgatcttggactttccagcct

SEQ ID NO: 7861127 - DNA, 22 bp, Homo sapiens
ttgatgaacacagataatcagt

SEQ ID NO: 7861128 - DNA, 22 bp, Homo sapiens
ttgatgaattgctagattgcta

SEQ ID NO: 7861129 - DNA, 22 bp, Homo sapiens
ttgatgagaccattgccgcgtc

SEQ ID NO: 7861130 - DNA, 22 bp, Homo sapiens
ttgatcttcatcgaaatattgt

SEQ ID NO: 7861131 - DNA, 22 bp, Homo sapiens
ttgatcaggttgctgtggtgta

SEQ ID NO: 7861132 - DNA, 22 bp, Homo sapiens
ttgatcttcatcgaaatattgt

SEQ ID NO: 7861133 - DNA, 22 bp, Homo sapiens
ttgatctctgttgctgtctttg

SEQ ID NO: 7861134 - DNA, 22 bp, Homo sapiens
ttgatctctgttgctgtctttg

SEQ ID NO: 7861135 - DNA, 22 bp, Homo sapiens
ttgatcttacagtgttcttcca

SEQ ID NO: 7861136 - DNA, 22 bp, Homo sapiens
ttgatctgcctcattcttgttc

SEQ ID NO: 7861137 - DNA, 22 bp, Homo sapiens
ttgatgagaccattgccgcgtc

SEQ ID NO: 7861138 - DNA, 22 bp, Homo sapiens
ttgatgatcttacggcagagga

SEQ ID NO: 7861139 - DNA, 22 bp, Homo sapiens
ttgatgatgtttctgccttgcc

SEQ ID NO: 7861140 - DNA, 22 bp, Homo sapiens
ttgatgatgcacatttataatt

SEQ ID NO: 7861141 - DNA, 22 bp, Homo sapiens
ttgatggaaaatttcatggtga

SEQ ID NO: 7861142 - DNA, 22 bp, Homo sapiens
ttgatgcttaaggtaaaacaga

SEQ ID NO: 7861143 - DNA, 22 bp, Homo sapiens
ttgatgcttaaggtaaaacaga

SEQ ID NO: 7861144 - DNA, 22 bp, Homo sapiens
ttgatgctgtctttcagaatca

SEQ ID NO: 7861145 - DNA, 22 bp, Homo sapiens
ttgatgctagaagtaaaccaag

SEQ ID NO: 7861146 - DNA, 22 bp, Homo sapiens
ttgatgctagaagtaaaccaag

SEQ ID NO: 7861147 - DNA, 21 bp, Homo sapiens
ttgatggtgggtgatgctctg

SEQ ID NO: 7861148 - DNA, 22 bp, Homo sapiens
ttgatgtaaaagccttggtggc

SEQ ID NO: 7861149 - DNA, 22 bp, Homo sapiens
ttgatgtaaactttgatttcat

SEQ ID NO: 7861150 - DNA, 22 bp, Homo sapiens
ttgatgtaaactttgatttcat

SEQ ID NO: 7861151 - DNA, 22 bp, Homo sapiens
ttgatgtaaagtgattcatggg

SEQ ID NO: 7861152 - DNA, 22 bp, Homo sapiens
ttgatgtaatactttgcaacca

SEQ ID NO: 7861153 - DNA, 22 bp, Homo sapiens
ttgatgtaaagtgattcatggg

SEQ ID NO: 7861154 - DNA, 22 bp, Homo sapiens
ttgatgtaaagatagtttctgt

SEQ ID NO: 7861155 - DNA, 22 bp, Homo sapiens
ttgatgtaaagatagtttctgt

SEQ ID NO: 7861156 - DNA, 22 bp, Homo sapiens
ttgatgtaaagatagtttctgt

SEQ ID NO: 7861157 - DNA, 22 bp, Homo sapiens
ttgatcaagtgggaaatagtaa

SEQ ID NO: 7861158 - DNA, 22 bp, Homo sapiens
ttgatcaagtgggaaatagtaa

SEQ ID NO: 7861159 - DNA, 22 bp, Homo sapiens
ttgatcaagtgggaaatagtaa

SEQ ID NO: 7861160 - DNA, 22 bp, Homo sapiens
ttgatcatctaagagtaatagt

SEQ ID NO: 7861161 - DNA, 22 bp, Homo sapiens
ttgatccagttgaaagtgatga

SEQ ID NO: 7861162 - DNA, 22 bp, Homo sapiens
ttgatcatctaagagtaatagt

SEQ ID NO: 7861163 - DNA, 22 bp, Homo sapiens
ttgatctctgttgctgtctttg

SEQ ID NO: 7861164 - DNA, 22 bp, Homo sapiens
ttgagtctgcccaaattaagaa

SEQ ID NO: 7861165 - DNA, 22 bp, Homo sapiens
ttgagtctgcaatacataacac

SEQ ID NO: 7861166 - DNA, 22 bp, Homo sapiens
ttgagtctgtgccctatgctgt

SEQ ID NO: 7861167 - DNA, 22 bp, Homo sapiens
ttgagtctgtgccctatgctgt

SEQ ID NO: 7861168 - DNA, 22 bp, Homo sapiens
ttgagtgtactttagtcatctg

SEQ ID NO: 7861169 - DNA, 22 bp, Homo sapiens
ttgagtgtaaggaatgtggggc

SEQ ID NO: 7861170 - DNA, 22 bp, Homo sapiens
ttgagtgagaattacatcagct

SEQ ID NO: 7861171 - DNA, 22 bp, Homo sapiens
ttgagtggttcctcagttgact

SEQ ID NO: 7861172 - DNA, 22 bp, Homo sapiens
ttgagtctctgccaaaacacaa

SEQ ID NO: 7861173 - DNA, 22 bp, Homo sapiens
ttgaggcattactgtaatgaga

SEQ ID NO: 7861174 - DNA, 22 bp, Homo sapiens
ttgaggccaaaaagtcctatga

SEQ ID NO: 7861175 - DNA, 20 bp, Homo sapiens
ttgaggcatgtctagaagta

SEQ ID NO: 7861176 - DNA, 20 bp, Homo sapiens
ttgaggcatgtctagaagta

SEQ ID NO: 7861177 - DNA, 22 bp, Homo sapiens
ttgaggcaggtccgggtccttc

SEQ ID NO: 7861178 - DNA, 22 bp, Homo sapiens
ttgaggcaggtccgggtccttc

SEQ ID NO: 7861179 - DNA, 22 bp, Homo sapiens
ttgaggcagggcatggtggccc

SEQ ID NO: 7861180 - DNA, 22 bp, Homo sapiens
ttgaggcagggcatggtggccc

SEQ ID NO: 7861181 - DNA, 22 bp, Homo sapiens
ttgaggcagcccttaattggga

SEQ ID NO: 7861182 - DNA, 22 bp, Homo sapiens
ttgattcagtaaagctaaattt

SEQ ID NO: 7861183 - DNA, 22 bp, Homo sapiens
ttgattctacttaaaacatatg

SEQ ID NO: 7861184 - DNA, 22 bp, Homo sapiens
ttgattctaaaataggaggaaa

SEQ ID NO: 7861185 - DNA, 22 bp, Homo sapiens
ttgattctgatcctttgctagc

SEQ ID NO: 7861186 - DNA, 22 bp, Homo sapiens
ttgattctgatcctttgctagc

SEQ ID NO: 7861187 - DNA, 22 bp, Homo sapiens
ttgattctgatcctgtctggag

SEQ ID NO: 7861188 - DNA, 22 bp, Homo sapiens
ttgattctatggctccgggagt

SEQ ID NO: 7861189 - DNA, 22 bp, Homo sapiens
ttgattctatgttgttgtctca

SEQ ID NO: 7861190 - DNA, 22 bp, Homo sapiens
ttgattctgggctcatttcttt

SEQ ID NO: 7861191 - DNA, 22 bp, Homo sapiens
ttgattcttctgaatttgcaga

SEQ ID NO: 7861192 - DNA, 23 bp, Homo sapiens
ttgattctttcagggacctagat

SEQ ID NO: 7861193 - DNA, 22 bp, Homo sapiens
ttgattcttagctggtgataat

SEQ ID NO: 7861194 - DNA, 22 bp, Homo sapiens
ttgattctggtgactgatggaa

SEQ ID NO: 7861195 - DNA, 22 bp, Homo sapiens
ttgatgttgctcttaacagtat

SEQ ID NO: 7861196 - DNA, 22 bp, Homo sapiens
ttgattaaaatgagacatcatt

SEQ ID NO: 7861197 - DNA, 22 bp, Homo sapiens
ttgattaaaatgagacatcatt

SEQ ID NO: 7861198 - DNA, 22 bp, Homo sapiens
ttgattaaaatgagacatcatt

SEQ ID NO: 7861199 - DNA, 22 bp, Homo sapiens
ttgatgttcataaatgatacag

SEQ ID NO: 7861200 - DNA, 22 bp, Homo sapiens
ttgatgtctaagtcattggcct

SEQ ID NO: 7861201 - DNA, 22 bp, Homo sapiens
ttgatgtcagtattatgagttt

SEQ ID NO: 7861202 - DNA, 22 bp, Homo sapiens
ttgatgttcataaatgatacag

SEQ ID NO: 7861203 - DNA, 22 bp, Homo sapiens
ttgatgtagaaccaagatcttt

SEQ ID NO: 7861204 - DNA, 22 bp, Homo sapiens
ttgatgtacagaattgttcaca

SEQ ID NO: 7861205 - DNA, 22 bp, Homo sapiens
ttgatgtacagaattgttcaca

SEQ ID NO: 7861206 - DNA, 22 bp, Homo sapiens
ttgatgtacagaattgttcaca

SEQ ID NO: 7861207 - DNA, 22 bp, Homo sapiens
ttgatgtacagaattgttcaca

SEQ ID NO: 7861208 - DNA, 22 bp, Homo sapiens
ttgatgtaggtttatctattgt

SEQ ID NO: 7861209 - DNA, 22 bp, Homo sapiens
ttgatgtagggattcctgtaaa

SEQ ID NO: 7861210 - DNA, 22 bp, Homo sapiens
ttgatgtaggtttatctattgt

SEQ ID NO: 7861211 - DNA, 22 bp, Homo sapiens
ttgatgtaggtttatctattgt

SEQ ID NO: 7861212 - DNA, 22 bp, Homo sapiens
ttgatgtaggtttatctattgt

SEQ ID NO: 7861213 - DNA, 22 bp, Homo sapiens
ttgatgtcagtattatgagttt

SEQ ID NO: 7861214 - DNA, 22 bp, Homo sapiens
ttgattcaaccacttaataatc

SEQ ID NO: 7861215 - DNA, 20 bp, Homo sapiens
ttgattcaagggctgatgga

SEQ ID NO: 7861216 - DNA, 22 bp, Homo sapiens
ttgattatagaatcttggcttt

SEQ ID NO: 7861217 - DNA, 22 bp, Homo sapiens
ttgattatagactcactaatct

SEQ ID NO: 7861218 - DNA, 22 bp, Homo sapiens
ttgattaaaatgagacatcatt

SEQ ID NO: 7861219 - DNA, 22 bp, Homo sapiens
ttgattaaaatgagacatcatt

SEQ ID NO: 7861220 - DNA, 22 bp, Homo sapiens
ttgattaaacaggcatattcaa

SEQ ID NO: 7861221 - DNA, 22 bp, Homo sapiens
ttgattaatcccatgtgagtag

SEQ ID NO: 7861222 - DNA, 22 bp, Homo sapiens
ttgattaatcccatgtgagtag

SEQ ID NO: 7861223 - DNA, 22 bp, Homo sapiens
ttgattaatcccatgtgagtag

SEQ ID NO: 7861224 - DNA, 22 bp, Homo sapiens
ttgattactatgtgttgaaagc

SEQ ID NO: 7861225 - DNA, 22 bp, Homo sapiens
tttctgctttcagagtgagaca

SEQ ID NO: 7861226 - DNA, 22 bp, Homo sapiens
tttctggaaacgggttcaagct

SEQ ID NO: 7861227 - DNA, 22 bp, Homo sapiens
tttctgctttcagagtgagaca

SEQ ID NO: 7861228 - DNA, 22 bp, Homo sapiens
tttctgcttgagagaattgctg

SEQ ID NO: 7861229 - DNA, 22 bp, Homo sapiens
tttctgcttgagagaattgctg

SEQ ID NO: 7861230 - DNA, 22 bp, Homo sapiens
tttctgcttccttgagaaggag

SEQ ID NO: 7861231 - DNA, 22 bp, Homo sapiens
tttctgcttaggactctgtgga

SEQ ID NO: 7861232 - DNA, 22 bp, Homo sapiens
tttctgctgtgctttcttgcgt

SEQ ID NO: 7861233 - DNA, 22 bp, Homo sapiens
tttctgctgtgctttcttgcgt

SEQ ID NO: 7861234 - DNA, 22 bp, Homo sapiens
tttctgctgtgctttcttgcgt

SEQ ID NO: 7861235 - DNA, 22 bp, Homo sapiens
tttctgcttaggactctgtgga

SEQ ID NO: 7861236 - DNA, 22 bp, Homo sapiens
tttctgctgtgtaaaatgaggg

SEQ ID NO: 7861237 - DNA, 17 bp, Homo sapiens
tttctggaatgggcaaa

SEQ ID NO: 7861238 - DNA, 22 bp, Homo sapiens
tttctggacagcaagatcagtt

SEQ ID NO: 7861239 - DNA, 17 bp, Homo sapiens
tttctggaatgggcaaa

SEQ ID NO: 7861240 - DNA, 22 bp, Homo sapiens
tttctggacccttctgtgagtg

SEQ ID NO: 7861241 - DNA, 22 bp, Homo sapiens
tttctggaaccacaaaagtatg

SEQ ID NO: 7861242 - DNA, 22 bp, Homo sapiens
tttctggaacagtaattgaaga

SEQ ID NO: 7861243 - DNA, 22 bp, Homo sapiens
tttctggaaagcaagatacatt

SEQ ID NO: 7861244 - DNA, 20 bp, Homo sapiens
tttctgtagctcagtattca

SEQ ID NO: 7861245 - DNA, 22 bp, Homo sapiens
tttctgtagggatttcacagtt

SEQ ID NO: 7861246 - DNA, 22 bp, Homo sapiens
tttctgtagggatttcacagtt

SEQ ID NO: 7861247 - DNA, 22 bp, Homo sapiens
tttctgtacctcctcttgcccc

SEQ ID NO: 7861248 - DNA, 22 bp, Homo sapiens
tttctgtacacccactattcat

SEQ ID NO: 7861249 - DNA, 22 bp, Homo sapiens
tttctgtaagtggcaaataatg

SEQ ID NO: 7861250 - DNA, 22 bp, Homo sapiens
tttctgtaagtggcaaataatg

SEQ ID NO: 7861251 - DNA, 22 bp, Homo sapiens
tttctgtaagttcaggctttcc

SEQ ID NO: 7861252 - DNA, 21 bp, Homo sapiens
tttctgggtggctgcatagtg

SEQ ID NO: 7861253 - DNA, 21 bp, Homo sapiens
tttctgggtggctgcatagtg

SEQ ID NO: 7861254 - DNA, 22 bp, Homo sapiens
tttctgggtttatgtcacagct

SEQ ID NO: 7861255 - DNA, 22 bp, Homo sapiens
tttctgggactggggagattct

SEQ ID NO: 7861256 - DNA, 22 bp, Homo sapiens
tttctggcagcgggacaggggt

SEQ ID NO: 7861257 - DNA, 22 bp, Homo sapiens
tttctggcagcgggacaggggt

SEQ ID NO: 7861258 - DNA, 22 bp, Homo sapiens
tttctggcagcgggacaggggt

SEQ ID NO: 7861259 - DNA, 22 bp, Homo sapiens
tttctggcagcgggacaggggt

SEQ ID NO: 7861260 - DNA, 22 bp, Homo sapiens
tttctggaggcccaagggcaga

SEQ ID NO: 7861261 - DNA, 22 bp, Homo sapiens
tttctggcagcgggacaggggt

SEQ ID NO: 7861262 - DNA, 22 bp, Homo sapiens
tttctgaagtcttctaacagat

SEQ ID NO: 7861263 - DNA, 23 bp, Homo sapiens
tttctgaagttgagatggacttt

SEQ ID NO: 7861264 - DNA, 23 bp, Homo sapiens
tttctgaagttgagatggacttt

SEQ ID NO: 7861265 - DNA, 23 bp, Homo sapiens
tttctgaagttgagatggacttt

SEQ ID NO: 7861266 - DNA, 22 bp, Homo sapiens
tttctgaataactctatgatat

SEQ ID NO: 7861267 - DNA, 22 bp, Homo sapiens
tttctgaataactctatgatat

SEQ ID NO: 7861268 - DNA, 22 bp, Homo sapiens
tttctgaagtcttctaacagat

SEQ ID NO: 7861269 - DNA, 22 bp, Homo sapiens
tttctgaataactctatgatat

SEQ ID NO: 7861270 - DNA, 22 bp, Homo sapiens
tttctgaataactctatgatat

SEQ ID NO: 7861271 - DNA, 22 bp, Homo sapiens
tttctgaaggttaaggaattag

SEQ ID NO: 7861272 - DNA, 22 bp, Homo sapiens
tttctgaaggttaaggaattag

SEQ ID NO: 7861273 - DNA, 22 bp, Homo sapiens
tttctgaaggttaaggaattag

SEQ ID NO: 7861274 - DNA, 22 bp, Homo sapiens
tttctgaagtcttctaacagat

SEQ ID NO: 7861275 - DNA, 22 bp, Homo sapiens
tttctgaaggttaaggaattag

SEQ ID NO: 7861276 - DNA, 22 bp, Homo sapiens
tttctgaagtcttctaacagat

SEQ ID NO: 7861277 - DNA, 22 bp, Homo sapiens
tttctgaagggcagcagactct

SEQ ID NO: 7861278 - DNA, 22 bp, Homo sapiens
tttctgaagggcagcagactct

SEQ ID NO: 7861279 - DNA, 22 bp, Homo sapiens
tttctgaataactctatgatat

SEQ ID NO: 7861280 - DNA, 22 bp, Homo sapiens
tttctgaataactctatgatat

SEQ ID NO: 7861281 - DNA, 22 bp, Homo sapiens
tttctgaataactctatgatat

SEQ ID NO: 7861282 - DNA, 18 bp, Homo sapiens
tttctgaatgtctatttc

SEQ ID NO: 7861283 - DNA, 18 bp, Homo sapiens
tttctgaatgtctatttc

SEQ ID NO: 7861284 - DNA, 18 bp, Homo sapiens
tttctgaatgtctatttc

SEQ ID NO: 7861285 - DNA, 18 bp, Homo sapiens
tttctgaatgtctatttc

SEQ ID NO: 7861286 - DNA, 18 bp, Homo sapiens
tttctgaatgtctatttc

SEQ ID NO: 7861287 - DNA, 22 bp, Homo sapiens
tttctgaattcctaggatgttg

SEQ ID NO: 7861288 - DNA, 22 bp, Homo sapiens
tttctgaattcctaggatgttg

SEQ ID NO: 7861289 - DNA, 22 bp, Homo sapiens
tttctgactccagagaggaata

SEQ ID NO: 7861290 - DNA, 22 bp, Homo sapiens
tttctgacctgcaacagtttac

SEQ ID NO: 7861291 - DNA, 22 bp, Homo sapiens
tttctgacctgcaacagtttac

SEQ ID NO: 7861292 - DNA, 22 bp, Homo sapiens
tttctgaattcctaggatgttg

SEQ ID NO: 7861293 - DNA, 22 bp, Homo sapiens
tttctgaatttactcaaggtca

SEQ ID NO: 7861294 - DNA, 22 bp, Homo sapiens
tttctgacacatcagttgtaaa

SEQ ID NO: 7861295 - DNA, 22 bp, Homo sapiens
tttctgacacatcagttgtaaa

SEQ ID NO: 7861296 - DNA, 22 bp, Homo sapiens
tttctgcatgcatttaattaaa

SEQ ID NO: 7861297 - DNA, 22 bp, Homo sapiens
tttctgataattttgtgaaatc

SEQ ID NO: 7861298 - DNA, 22 bp, Homo sapiens
tttctgcatctctacagttgtt

SEQ ID NO: 7861299 - DNA, 17 bp, Homo sapiens
tttctgcatgattggac

SEQ ID NO: 7861300 - DNA, 22 bp, Homo sapiens
tttctgcatcttgaaacagagc

SEQ ID NO: 7861301 - DNA, 22 bp, Homo sapiens
tttctgcatcttgaaacagagc

SEQ ID NO: 7861302 - DNA, 22 bp, Homo sapiens
tttctgagaaattaaacacttt

SEQ ID NO: 7861303 - DNA, 22 bp, Homo sapiens
tttctgagaaattaaacacttt

SEQ ID NO: 7861304 - DNA, 22 bp, Homo sapiens
tttctgactggtgtataatagg

SEQ ID NO: 7861305 - DNA, 22 bp, Homo sapiens
tttctgactccagagaggaata

SEQ ID NO: 7861306 - DNA, 22 bp, Homo sapiens
tttctgacttttatatgcatat

SEQ ID NO: 7861307 - DNA, 22 bp, Homo sapiens
tttctgaggaattaatacagaa

SEQ ID NO: 7861308 - DNA, 22 bp, Homo sapiens
tttctgaggaattaatacagaa

SEQ ID NO: 7861309 - DNA, 22 bp, Homo sapiens
tttctgataattttgtgaaatc

SEQ ID NO: 7861310 - DNA, 22 bp, Homo sapiens
tttctgagaaattaaacacttt

SEQ ID NO: 7861311 - DNA, 22 bp, Homo sapiens
tttctgcatttacaaaatgagg

SEQ ID NO: 7861312 - DNA, 22 bp, Homo sapiens
tttctgcattgtcctcttggtt

SEQ ID NO: 7861313 - DNA, 22 bp, Homo sapiens
tttctgccaaccatttaaactc

SEQ ID NO: 7861314 - DNA, 22 bp, Homo sapiens
tttctgccaggtttctggatga

SEQ ID NO: 7861315 - DNA, 22 bp, Homo sapiens
tttctgccaggtttctggatga

SEQ ID NO: 7861316 - DNA, 22 bp, Homo sapiens
tttctgccagtcactgctctag

SEQ ID NO: 7861317 - DNA, 22 bp, Homo sapiens
tttctgccgttccctgctctgt

SEQ ID NO: 7861318 - DNA, 22 bp, Homo sapiens
tttctgctaatcttttactgag

SEQ ID NO: 7861319 - DNA, 22 bp, Homo sapiens
tttctgctcgctctcaatcagg

SEQ ID NO: 7861320 - DNA, 22 bp, Homo sapiens
tttctgctcgctctcaatcagg

SEQ ID NO: 7861321 - DNA, 22 bp, Homo sapiens
tttctgaacaaagccattatca

SEQ ID NO: 7861322 - DNA, 22 bp, Homo sapiens
tttctgaacaaagccattatca

SEQ ID NO: 7861323 - DNA, 22 bp, Homo sapiens
tttctgaacaaagccattatca

SEQ ID NO: 7861324 - DNA, 22 bp, Homo sapiens
tttctgaaatgctggctttgga

SEQ ID NO: 7861325 - DNA, 22 bp, Homo sapiens
tttctgaaatgctggctttgga

SEQ ID NO: 7861326 - DNA, 22 bp, Homo sapiens
tttctgaaatgctggctttgga

SEQ ID NO: 7861327 - DNA, 22 bp, Homo sapiens
tttctgaaatctcttttgagga

SEQ ID NO: 7861328 - DNA, 22 bp, Homo sapiens
tttctgaaatctcttttgagga

SEQ ID NO: 7861329 - DNA, 22 bp, Homo sapiens
tttctgaaatctcttttgagga

SEQ ID NO: 7861330 - DNA, 22 bp, Homo sapiens
tttctgaaacatggtctttgta

SEQ ID NO: 7861331 - DNA, 22 bp, Homo sapiens
tttctgaaacatggtctttgta

SEQ ID NO: 7861332 - DNA, 22 bp, Homo sapiens
tttctgaaatctcttttgagga

SEQ ID NO: 7861333 - DNA, 22 bp, Homo sapiens
tttctgaaatctcttttgagga

SEQ ID NO: 7861334 - DNA, 22 bp, Homo sapiens
tttctgaaatctcttttgagga

SEQ ID NO: 7861335 - DNA, 22 bp, Homo sapiens
tttctgaaaactgaagtagtgc

SEQ ID NO: 7861336 - DNA, 22 bp, Homo sapiens
tttctgaaacatggtctttgta

SEQ ID NO: 7861337 - DNA, 22 bp, Homo sapiens
tttctgaaacatggtctttgta

SEQ ID NO: 7861338 - DNA, 22 bp, Homo sapiens
tttctgaaacatggtctttgta

SEQ ID NO: 7861339 - DNA, 21 bp, Homo sapiens
tttctgaaggcaacatctatc

SEQ ID NO: 7861340 - DNA, 21 bp, Homo sapiens
tttctgaaggcaacatctatc

SEQ ID NO: 7861341 - DNA, 21 bp, Homo sapiens
tttctgaaggcaacatctatc

SEQ ID NO: 7861342 - DNA, 22 bp, Homo sapiens
tttctgaagggcagcagactct

SEQ ID NO: 7861343 - DNA, 21 bp, Homo sapiens
tttctgaaggcaacatctatc

SEQ ID NO: 7861344 - DNA, 21 bp, Homo sapiens
tttctgaaggcaacatctatc

SEQ ID NO: 7861345 - DNA, 21 bp, Homo sapiens
tttctgaaggcaacatctatc

SEQ ID NO: 7861346 - DNA, 21 bp, Homo sapiens
tttctgaaggcaacatctatc

SEQ ID NO: 7861347 - DNA, 22 bp, Homo sapiens
tttctgaacttggtactggagc

SEQ ID NO: 7861348 - DNA, 22 bp, Homo sapiens
tttctgaacaaagccattatca

SEQ ID NO: 7861349 - DNA, 22 bp, Homo sapiens
tttctgaacttggtactggagc

SEQ ID NO: 7861350 - DNA, 22 bp, Homo sapiens
tttctgaacttggtactggagc

SEQ ID NO: 7861351 - DNA, 22 bp, Homo sapiens
tttctgaagatacagctttgct

SEQ ID NO: 7861352 - DNA, 22 bp, Homo sapiens
tttctgaagatacagctttgct

SEQ ID NO: 7861353 - DNA, 22 bp, Homo sapiens
tttctgaagatacagctttgct

SEQ ID NO: 7861354 - DNA, 22 bp, Homo sapiens
tttctgaagatacagctttgct

SEQ ID NO: 7861355 - DNA, 22 bp, Homo sapiens
tttctgaagatacagctttgct

SEQ ID NO: 7861356 - DNA, 22 bp, Homo sapiens
tttctgaagatacagctttgct

SEQ ID NO: 7861357 - DNA, 22 bp, Homo sapiens
tttctcttcactgtgtgcctca

SEQ ID NO: 7861358 - DNA, 22 bp, Homo sapiens
tttctcttcactgtgtgcctca

SEQ ID NO: 7861359 - DNA, 22 bp, Homo sapiens
tttctcttcactgtgtgcctca

SEQ ID NO: 7861360 - DNA, 22 bp, Homo sapiens
tttctcttcactgtgtgcctca

SEQ ID NO: 7861361 - DNA, 22 bp, Homo sapiens
tttctcttgcgatatgctacac

SEQ ID NO: 7861362 - DNA, 22 bp, Homo sapiens
tttctctttcaatctgcagtac

SEQ ID NO: 7861363 - DNA, 22 bp, Homo sapiens
tttctctttcaatctgcagtac

SEQ ID NO: 7861364 - DNA, 22 bp, Homo sapiens
tttctcttgcgatatgctacac

SEQ ID NO: 7861365 - DNA, 22 bp, Homo sapiens
tttctcttgcgatatgctacac

SEQ ID NO: 7861366 - DNA, 22 bp, Homo sapiens
tttctctttggaggggctgaat

SEQ ID NO: 7861367 - DNA, 22 bp, Homo sapiens
tttctgaaaactgaagtagtgc

SEQ ID NO: 7861368 - DNA, 22 bp, Homo sapiens
tttctgaaaactgaagtagtgc

SEQ ID NO: 7861369 - DNA, 22 bp, Homo sapiens
tttctgaaaactgaagtagtgc

SEQ ID NO: 7861370 - DNA, 22 bp, Homo sapiens
tttctctttgacaggaatcaga

SEQ ID NO: 7861371 - DNA, 22 bp, Homo sapiens
tttctctttgacaggaatcaga

SEQ ID NO: 7861372 - DNA, 22 bp, Homo sapiens
tttctctttgacaggaatcaga

SEQ ID NO: 7861373 - DNA, 22 bp, Homo sapiens
tttctctttgacaggaatcaga

SEQ ID NO: 7861374 - DNA, 22 bp, Homo sapiens
tttctctttgacaggaatcaga

SEQ ID NO: 7861375 - DNA, 22 bp, Homo sapiens
tttctctttcaatctgcagtac

SEQ ID NO: 7861376 - DNA, 22 bp, Homo sapiens
tttctctttcaatctgcagtac

SEQ ID NO: 7861377 - DNA, 22 bp, Homo sapiens
tttctctttcaatctgcagtac

SEQ ID NO: 7861378 - DNA, 22 bp, Homo sapiens
tttctctttcaatctgcagtac

SEQ ID NO: 7861379 - DNA, 22 bp, Homo sapiens
tttctctttcaatctgcagtac

SEQ ID NO: 7861380 - DNA, 22 bp, Homo sapiens
tttctctgtgccatttccataa

SEQ ID NO: 7861381 - DNA, 19 bp, Homo sapiens
tttctctgtgcaccttttc

SEQ ID NO: 7861382 - DNA, 18 bp, Homo sapiens
tttctctgtcgtcttctg

SEQ ID NO: 7861383 - DNA, 18 bp, Homo sapiens
tttctctgtcgtcttctg

SEQ ID NO: 7861384 - DNA, 22 bp, Homo sapiens
tttctctgggctgttggcagcc

SEQ ID NO: 7861385 - DNA, 22 bp, Homo sapiens
tttctctgggcactctccaaac

SEQ ID NO: 7861386 - DNA, 22 bp, Homo sapiens
tttctcggcagagatgatgggc

SEQ ID NO: 7861387 - DNA, 22 bp, Homo sapiens
tttctccttgtgtctcctttga

SEQ ID NO: 7861388 - DNA, 22 bp, Homo sapiens
tttctctagctattcattaaat

SEQ ID NO: 7861389 - DNA, 22 bp, Homo sapiens
tttctctaaatagggaggctta

SEQ ID NO: 7861390 - DNA, 22 bp, Homo sapiens
tttctctagctattcattaaat

SEQ ID NO: 7861391 - DNA, 22 bp, Homo sapiens
tttctcttaatgtctctgtgct

SEQ ID NO: 7861392 - DNA, 22 bp, Homo sapiens
tttctcttaatgtctctgtgct

SEQ ID NO: 7861393 - DNA, 22 bp, Homo sapiens
tttctcttaatgtctctgtgct

SEQ ID NO: 7861394 - DNA, 22 bp, Homo sapiens
tttctcttcactgtgtgcctca

SEQ ID NO: 7861395 - DNA, 22 bp, Homo sapiens
tttctctgtgccatttccataa

SEQ ID NO: 7861396 - DNA, 22 bp, Homo sapiens
tttctcttaatgtctctgtgct

SEQ ID NO: 7861397 - DNA, 22 bp, Homo sapiens
tttctcttaatgtctctgtgct

SEQ ID NO: 7861398 - DNA, 22 bp, Homo sapiens
tttctctgttctctaactgtaa

SEQ ID NO: 7861399 - DNA, 22 bp, Homo sapiens
tttctctgttctctaactgtaa

SEQ ID NO: 7861400 - DNA, 22 bp, Homo sapiens
tttctcttaatgtctctgtgct

SEQ ID NO: 7861401 - DNA, 22 bp, Homo sapiens
tttctctgttctctaactgtaa

SEQ ID NO: 7861402 - DNA, 22 bp, Homo sapiens
tttctctgttctctaactgtaa

SEQ ID NO: 7861403 - DNA, 22 bp, Homo sapiens
tttctctgttctctaactgtaa

SEQ ID NO: 7861404 - DNA, 22 bp, Homo sapiens
tttctctgtgggctttatgcat

SEQ ID NO: 7861405 - DNA, 22 bp, Homo sapiens
tttctctgtgccatttccataa

SEQ ID NO: 7861406 - DNA, 17 bp, Homo sapiens
tttctccttccatctca

SEQ ID NO: 7861407 - DNA, 17 bp, Homo sapiens
tttctccttccatctca

SEQ ID NO: 7861408 - DNA, 17 bp, Homo sapiens
tttctccttccatctca

SEQ ID NO: 7861409 - DNA, 22 bp, Homo sapiens
tttctccttgtgtctcctttga

SEQ ID NO: 7861410 - DNA, 22 bp, Homo sapiens
tttctccttgtgtctcctttga

SEQ ID NO: 7861411 - DNA, 17 bp, Homo sapiens
tttctccttccatctca

SEQ ID NO: 7861412 - DNA, 17 bp, Homo sapiens
tttctccttccatctca

SEQ ID NO: 7861413 - DNA, 17 bp, Homo sapiens
tttctccttccatctca

SEQ ID NO: 7861414 - DNA, 22 bp, Homo sapiens
tttctcctgtgtaagccgccca

SEQ ID NO: 7861415 - DNA, 22 bp, Homo sapiens
tttctcctgtgtaagccgccca

SEQ ID NO: 7861416 - DNA, 22 bp, Homo sapiens
tttctcctgtgaggtcagaagt

SEQ ID NO: 7861417 - DNA, 22 bp, Homo sapiens
tttctcctgtgaggtcagaagt

SEQ ID NO: 7861418 - DNA, 22 bp, Homo sapiens
tttctcctgtgaggtcagaagt

SEQ ID NO: 7861419 - DNA, 22 bp, Homo sapiens
tttctcctgtgaggtcagaagt

SEQ ID NO: 7861420 - DNA, 22 bp, Homo sapiens
tttctcctgctagaacaaggag

SEQ ID NO: 7861421 - DNA, 22 bp, Homo sapiens
tttctcctgtgaggtcagaagt

SEQ ID NO: 7861422 - DNA, 22 bp, Homo sapiens
tttctcctgagttccacgctac

SEQ ID NO: 7861423 - DNA, 22 bp, Homo sapiens
tttctcctctccagagtgcagt

SEQ ID NO: 7861424 - DNA, 22 bp, Homo sapiens
tttctcctctccagagtgcagt

SEQ ID NO: 7861425 - DNA, 22 bp, Homo sapiens
tttctcctctccagagtgcagt

SEQ ID NO: 7861426 - DNA, 22 bp, Homo sapiens
tttctcctgagttccacgctac

SEQ ID NO: 7861427 - DNA, 22 bp, Homo sapiens
tttctcctgagttccacgctac

SEQ ID NO: 7861428 - DNA, 22 bp, Homo sapiens
tttctcctgagttccacgctac

SEQ ID NO: 7861429 - DNA, 22 bp, Homo sapiens
tttctcctgagttccacgctac

SEQ ID NO: 7861430 - DNA, 22 bp, Homo sapiens
tttctcctgtgaggtcagaagt

SEQ ID NO: 7861431 - DNA, 22 bp, Homo sapiens
tttctcctgctagaacaaggag

SEQ ID NO: 7861432 - DNA, 22 bp, Homo sapiens
tttctcctgctagaacaaggag

SEQ ID NO: 7861433 - DNA, 22 bp, Homo sapiens
tttctcctgcccagatgcctgg

SEQ ID NO: 7861434 - DNA, 22 bp, Homo sapiens
tttctcctgcccagatgcctgg

SEQ ID NO: 7861435 - DNA, 22 bp, Homo sapiens
tttctcctgagttccacgctac

SEQ ID NO: 7861436 - DNA, 22 bp, Homo sapiens
tttctcctgcccagatgcctgg

SEQ ID NO: 7861437 - DNA, 22 bp, Homo sapiens
tttctcctgcccagatgcctgg

SEQ ID NO: 7861438 - DNA, 22 bp, Homo sapiens
tttctttatcatagcatctttg

SEQ ID NO: 7861439 - DNA, 22 bp, Homo sapiens
tttctttatcctcctttgcaca

SEQ ID NO: 7861440 - DNA, 22 bp, Homo sapiens
tttctttatcctcctttgcaca

SEQ ID NO: 7861441 - DNA, 22 bp, Homo sapiens
tttctttatcatagcatctttg

SEQ ID NO: 7861442 - DNA, 22 bp, Homo sapiens
tttctttatcatagcatctttg

SEQ ID NO: 7861443 - DNA, 22 bp, Homo sapiens
tttcttgtttcatggtgtctca

SEQ ID NO: 7861444 - DNA, 22 bp, Homo sapiens
tttcttgtttcatggtgtctca

SEQ ID NO: 7861445 - DNA, 22 bp, Homo sapiens
tttcttgtttcatggtgtctca

SEQ ID NO: 7861446 - DNA, 22 bp, Homo sapiens
tttcttgtttcatggtgtctca

SEQ ID NO: 7861447 - DNA, 22 bp, Homo sapiens
tttcttgtctttagtatctggc

SEQ ID NO: 7861448 - DNA, 22 bp, Homo sapiens
tttcttgtctttagtatctggc

SEQ ID NO: 7861449 - DNA, 22 bp, Homo sapiens
tttcttgtgcctaattttgggc

SEQ ID NO: 7861450 - DNA, 20 bp, Homo sapiens
tttcttgtacttggagaagg

SEQ ID NO: 7861451 - DNA, 22 bp, Homo sapiens
tttcttgtgcctaattttgggc

SEQ ID NO: 7861452 - DNA, 22 bp, Homo sapiens
tttcttgtctttagtatctggc

SEQ ID NO: 7861453 - DNA, 22 bp, Homo sapiens
tttctttaattctcacagcaat

SEQ ID NO: 7861454 - DNA, 22 bp, Homo sapiens
tttctttaaaggaactctgttt

SEQ ID NO: 7861455 - DNA, 20 bp, Homo sapiens
tttcttgtcggctgttgctg

SEQ ID NO: 7861456 - DNA, 20 bp, Homo sapiens
tttcttgtacttggagaagg

SEQ ID NO: 7861457 - DNA, 20 bp, Homo sapiens
tttcttgtcggctgttgctg

SEQ ID NO: 7861458 - DNA, 20 bp, Homo sapiens
tttcttgtcggctgttgctg

SEQ ID NO: 7861459 - DNA, 20 bp, Homo sapiens
tttcttgtcggctgttgctg

SEQ ID NO: 7861460 - DNA, 20 bp, Homo sapiens
tttcttgtcggctgttgctg

SEQ ID NO: 7861461 - DNA, 20 bp, Homo sapiens
tttcttgtcggctgttgctg

SEQ ID NO: 7861462 - DNA, 20 bp, Homo sapiens
tttcttgtacttggagaagg

SEQ ID NO: 7861463 - DNA, 20 bp, Homo sapiens
tttcttgtacttggagaagg

SEQ ID NO: 7861464 - DNA, 22 bp, Homo sapiens
tttcttgtaagatgtttattaa

SEQ ID NO: 7861465 - DNA, 22 bp, Homo sapiens
tttcttctctaatctcaatgat

SEQ ID NO: 7861466 - DNA, 22 bp, Homo sapiens
tttcttctctaatctcaatgat

SEQ ID NO: 7861467 - DNA, 22 bp, Homo sapiens
tttcttctgagatcagggagaa

SEQ ID NO: 7861468 - DNA, 22 bp, Homo sapiens
tttcttctgagatcagggagaa

SEQ ID NO: 7861469 - DNA, 22 bp, Homo sapiens
tttcttctgagatcagggagaa

SEQ ID NO: 7861470 - DNA, 22 bp, Homo sapiens
tttcttctgagatcagggagaa

SEQ ID NO: 7861471 - DNA, 22 bp, Homo sapiens
tttcttctgagatcagggagaa

SEQ ID NO: 7861472 - DNA, 22 bp, Homo sapiens
tttcttctctgattaaggctca

SEQ ID NO: 7861473 - DNA, 22 bp, Homo sapiens
tttcttctctgattaaggctca

SEQ ID NO: 7861474 - DNA, 22 bp, Homo sapiens
tttcttctctgattaaggctca

SEQ ID NO: 7861475 - DNA, 22 bp, Homo sapiens
tttcttctctgattaaggctca

SEQ ID NO: 7861476 - DNA, 22 bp, Homo sapiens
tttcttctctgattaaggctca

SEQ ID NO: 7861477 - DNA, 22 bp, Homo sapiens
tttcttcctgctttgtcccatg

SEQ ID NO: 7861478 - DNA, 22 bp, Homo sapiens
tttcttcctgctttgtcccatg

SEQ ID NO: 7861479 - DNA, 22 bp, Homo sapiens
tttcttcctgctttgtcccatg

SEQ ID NO: 7861480 - DNA, 22 bp, Homo sapiens
tttcttcctggattcctacttc

SEQ ID NO: 7861481 - DNA, 22 bp, Homo sapiens
tttcttcctggattcctacttc

SEQ ID NO: 7861482 - DNA, 22 bp, Homo sapiens
tttcttcctggattcctacttc

SEQ ID NO: 7861483 - DNA, 22 bp, Homo sapiens
tttcttcctggattcctacttc

SEQ ID NO: 7861484 - DNA, 22 bp, Homo sapiens
tttcttccttaccttactagag

SEQ ID NO: 7861485 - DNA, 22 bp, Homo sapiens
tttcttcctaaatatgatttcc

SEQ ID NO: 7861486 - DNA, 22 bp, Homo sapiens
tttcttcctaaatatgatttcc

SEQ ID NO: 7861487 - DNA, 22 bp, Homo sapiens
tttcttcctgctttgtcccatg

SEQ ID NO: 7861488 - DNA, 22 bp, Homo sapiens
tttcttcctgctttgtcccatg

SEQ ID NO: 7861489 - DNA, 22 bp, Homo sapiens
tttcttcctatgtatcttgctg

SEQ ID NO: 7861490 - DNA, 22 bp, Homo sapiens
tttcttctaagatttcaaacta

SEQ ID NO: 7861491 - DNA, 22 bp, Homo sapiens
tttcttctaagatttcaaacta

SEQ ID NO: 7861492 - DNA, 22 bp, Homo sapiens
tttcttctaagatttcaaacta

SEQ ID NO: 7861493 - DNA, 22 bp, Homo sapiens
tttcttctaagatttcaaacta

SEQ ID NO: 7861494 - DNA, 22 bp, Homo sapiens
tttcttctaagatttcaaacta

SEQ ID NO: 7861495 - DNA, 22 bp, Homo sapiens
tttcttctaagatttcaaacta

SEQ ID NO: 7861496 - DNA, 22 bp, Homo sapiens
tttcttccttaccttactagag

SEQ ID NO: 7861497 - DNA, 22 bp, Homo sapiens
tttcttctaggactaataagag

SEQ ID NO: 7861498 - DNA, 22 bp, Homo sapiens
tttcttctaggactaataagag

SEQ ID NO: 7861499 - DNA, 22 bp, Homo sapiens
tttcttctaggactaataagag

SEQ ID NO: 7861500 - DNA, 22 bp, Homo sapiens
tttcttctaggactaataagag

SEQ ID NO: 7861501 - DNA, 22 bp, Homo sapiens
tttcttctaggactaataagag

SEQ ID NO: 7861502 - DNA, 22 bp, Homo sapiens
tttcttctaggactaataagag

SEQ ID NO: 7861503 - DNA, 22 bp, Homo sapiens
tttcttctcacccaggacagag

SEQ ID NO: 7861504 - DNA, 22 bp, Homo sapiens
tttcttctcacccaggacagag

SEQ ID NO: 7861505 - DNA, 22 bp, Homo sapiens
tttcttctcacccaggacagag

SEQ ID NO: 7861506 - DNA, 22 bp, Homo sapiens
tttcttctcacccaggacagag

SEQ ID NO: 7861507 - DNA, 22 bp, Homo sapiens
tttcttctcacccaggacagag

SEQ ID NO: 7861508 - DNA, 22 bp, Homo sapiens
tttcttctcacccaggacagag

SEQ ID NO: 7861509 - DNA, 22 bp, Homo sapiens
tttcttctcacccaggacagag

SEQ ID NO: 7861510 - DNA, 22 bp, Homo sapiens
tttcttctcatccctgaaatca

SEQ ID NO: 7861511 - DNA, 22 bp, Homo sapiens
tttcttctcatccctgaaatca

SEQ ID NO: 7861512 - DNA, 22 bp, Homo sapiens
tttcttctatgtgtgatatttt

SEQ ID NO: 7861513 - DNA, 22 bp, Homo sapiens
tttcttctatgtgtgatatttt

SEQ ID NO: 7861514 - DNA, 22 bp, Homo sapiens
tttcttctatgtgtgatatttt

SEQ ID NO: 7861515 - DNA, 22 bp, Homo sapiens
tttcttctcgacaccttatccc

SEQ ID NO: 7861516 - DNA, 23 bp, Homo sapiens
tttcttctcgaagagggagctta

SEQ ID NO: 7861517 - DNA, 23 bp, Homo sapiens
tttcttctcgaagagggagctta

SEQ ID NO: 7861518 - DNA, 22 bp, Homo sapiens
tttcttctcgacaccttatccc

SEQ ID NO: 7861519 - DNA, 22 bp, Homo sapiens
tttcttctcgacaccttatccc

SEQ ID NO: 7861520 - DNA, 22 bp, Homo sapiens
tttcttctcatccctgaaatca

SEQ ID NO: 7861521 - DNA, 22 bp, Homo sapiens
tttcttctcatccctgaaatca

SEQ ID NO: 7861522 - DNA, 22 bp, Homo sapiens
tttcttctcatccctgaaatca

SEQ ID NO: 7861523 - DNA, 22 bp, Homo sapiens
tttcttctcatccctgaaatca

SEQ ID NO: 7861524 - DNA, 22 bp, Homo sapiens
tttcttcatagaccttgtcttg

SEQ ID NO: 7861525 - DNA, 22 bp, Homo sapiens
tttcttcattcaccttcacccc

SEQ ID NO: 7861526 - DNA, 22 bp, Homo sapiens
tttcttcattgacaaggaaaaa

SEQ ID NO: 7861527 - DNA, 22 bp, Homo sapiens
tttcttcagccactccaaactg

SEQ ID NO: 7861528 - DNA, 22 bp, Homo sapiens
tttcttcagccactccaaactg

SEQ ID NO: 7861529 - DNA, 22 bp, Homo sapiens
tttcttcagtaacacaaaccat

SEQ ID NO: 7861530 - DNA, 22 bp, Homo sapiens
tttcttcatagaccttgtcttg

SEQ ID NO: 7861531 - DNA, 22 bp, Homo sapiens
tttcttcccaagcagtttcaga

SEQ ID NO: 7861532 - DNA, 22 bp, Homo sapiens
tttcttcccaagcagtttcaga

SEQ ID NO: 7861533 - DNA, 22 bp, Homo sapiens
tttcttcccaagcagtttcaga

SEQ ID NO: 7861534 - DNA, 22 bp, Homo sapiens
tttcttccccactgcaggctct

SEQ ID NO: 7861535 - DNA, 22 bp, Homo sapiens
tttcttccccactgcaggctct

SEQ ID NO: 7861536 - DNA, 21 bp, Homo sapiens
tttcttcccttggcttctgag

SEQ ID NO: 7861537 - DNA, 21 bp, Homo sapiens
tttcttcccttggcttctgag

SEQ ID NO: 7861538 - DNA, 22 bp, Homo sapiens
tttcttcctaaatatgatttcc

SEQ ID NO: 7861539 - DNA, 19 bp, Homo sapiens
tttcttccaaagactatgg

SEQ ID NO: 7861540 - DNA, 22 bp, Homo sapiens
tttcttcattgatgtcaggtgg

SEQ ID NO: 7861541 - DNA, 22 bp, Homo sapiens
tttcttccaaaggcacgttctc

SEQ ID NO: 7861542 - DNA, 22 bp, Homo sapiens
tttcttccaaaggcacgttctc

SEQ ID NO: 7861543 - DNA, 22 bp, Homo sapiens
tttcttatggggtagtccttta

SEQ ID NO: 7861544 - DNA, 22 bp, Homo sapiens
tttcttatgtgcagagtgagta

SEQ ID NO: 7861545 - DNA, 22 bp, Homo sapiens
tttcttatgtgcagagtgagta

SEQ ID NO: 7861546 - DNA, 22 bp, Homo sapiens
tttcttcaattgctaacaagga

SEQ ID NO: 7861547 - DNA, 22 bp, Homo sapiens
tttcttatgagcaagactctat

SEQ ID NO: 7861548 - DNA, 22 bp, Homo sapiens
tttcttatggggtagtccttta

SEQ ID NO: 7861549 - DNA, 22 bp, Homo sapiens
tttcttatggggtagtccttta

SEQ ID NO: 7861550 - DNA, 22 bp, Homo sapiens
tttcttatgagcaagactctat

SEQ ID NO: 7861551 - DNA, 22 bp, Homo sapiens
tttcttatggggtagtccttta

SEQ ID NO: 7861552 - DNA, 22 bp, Homo sapiens
tttcttcagcaggtttgtgaga

SEQ ID NO: 7861553 - DNA, 22 bp, Homo sapiens
tttcttcagcaggtttgtgaga

SEQ ID NO: 7861554 - DNA, 22 bp, Homo sapiens
tttcttcagagagagctttccc

SEQ ID NO: 7861555 - DNA, 22 bp, Homo sapiens
tttcttcagagagagctttccc

SEQ ID NO: 7861556 - DNA, 22 bp, Homo sapiens
tttcttcagagagagctttccc

SEQ ID NO: 7861557 - DNA, 22 bp, Homo sapiens
tttcttcacagggtattgggtg

SEQ ID NO: 7861558 - DNA, 23 bp, Homo sapiens
tttctgttcctctagctttgcat

SEQ ID NO: 7861559 - DNA, 22 bp, Homo sapiens
tttctgttaggcatcattttaa

SEQ ID NO: 7861560 - DNA, 22 bp, Homo sapiens
tttctgttaggcatcattttaa

SEQ ID NO: 7861561 - DNA, 22 bp, Homo sapiens
tttctgttaggcatcattttaa

SEQ ID NO: 7861562 - DNA, 22 bp, Homo sapiens
tttctgtggtgggtagttcaga

SEQ ID NO: 7861563 - DNA, 22 bp, Homo sapiens
tttctgtggattttccattcaa

SEQ ID NO: 7861564 - DNA, 22 bp, Homo sapiens
tttctgtggattttccattcaa

SEQ ID NO: 7861565 - DNA, 22 bp, Homo sapiens
tttctgtggtgggtagttcaga

SEQ ID NO: 7861566 - DNA, 22 bp, Homo sapiens
tttctgtggtgggtagttcaga

SEQ ID NO: 7861567 - DNA, 22 bp, Homo sapiens
tttctgttaggcatcattttaa

SEQ ID NO: 7861568 - DNA, 19 bp, Homo sapiens
tttctgttagaaggataca

SEQ ID NO: 7861569 - DNA, 23 bp, Homo sapiens
tttctgttgggtatatatccaag

SEQ ID NO: 7861570 - DNA, 22 bp, Homo sapiens
tttctgttgtacttaaactagg

SEQ ID NO: 7861571 - DNA, 23 bp, Homo sapiens
tttctgttgggtatatatccaag

SEQ ID NO: 7861572 - DNA, 22 bp, Homo sapiens
tttctgttgtacttaaactagg

SEQ ID NO: 7861573 - DNA, 22 bp, Homo sapiens
tttctgttgtacttaaactagg

SEQ ID NO: 7861574 - DNA, 22 bp, Homo sapiens
tttctgttgtacttaaactagg

SEQ ID NO: 7861575 - DNA, 21 bp, Homo sapiens
tttcttatctgtaaagtggga

SEQ ID NO: 7861576 - DNA, 21 bp, Homo sapiens
tttcttatctgtaaagtggga

SEQ ID NO: 7861577 - DNA, 21 bp, Homo sapiens
tttcttatctgtaaagtggga

SEQ ID NO: 7861578 - DNA, 21 bp, Homo sapiens
tttctgtctctgccactagtt

SEQ ID NO: 7861579 - DNA, 21 bp, Homo sapiens
tttctgtctctgccactagtt

SEQ ID NO: 7861580 - DNA, 22 bp, Homo sapiens
tttctgtgaattataaaatttg

SEQ ID NO: 7861581 - DNA, 20 bp, Homo sapiens
tttctgtgagaaacactgtt

SEQ ID NO: 7861582 - DNA, 19 bp, Homo sapiens
tttctgtctgtgttttgcc

SEQ ID NO: 7861583 - DNA, 22 bp, Homo sapiens
tttctgtgaattataaaatttg

SEQ ID NO: 7861584 - DNA, 20 bp, Homo sapiens
tttctgtgatagagaggtgt

SEQ ID NO: 7861585 - DNA, 20 bp, Homo sapiens
tttctgtgcccaggtctgtt

SEQ ID NO: 7861586 - DNA, 22 bp, Homo sapiens
tttctgtggattttccattcaa

SEQ ID NO: 7861587 - DNA, 20 bp, Homo sapiens
tttctgtgcccaggtctgtt

SEQ ID NO: 7861588 - DNA, 21 bp, Homo sapiens
tttctgtcctttccatcagct

SEQ ID NO: 7861589 - DNA, 21 bp, Homo sapiens
tttctgtcctttccatcagct

SEQ ID NO: 7861590 - DNA, 22 bp, Homo sapiens
tttctgtcatagttatctttgt

SEQ ID NO: 7861591 - DNA, 22 bp, Homo sapiens
tttctgtatttaaaagatctgg

SEQ ID NO: 7861592 - DNA, 22 bp, Homo sapiens
tttctgtagtgtggtatgtagg

SEQ ID NO: 7861593 - DNA, 22 bp, Homo sapiens
tttctgtagggatttcacagtt

SEQ ID NO: 7861594 - DNA, 22 bp, Homo sapiens
tttctacatttgtaaccagatt

SEQ ID NO: 7861595 - DNA, 22 bp, Homo sapiens
tttctacatttgtaaccagatt

SEQ ID NO: 7861596 - DNA, 22 bp, Homo sapiens
tttctacatttgtaaccagatt

SEQ ID NO: 7861597 - DNA, 22 bp, Homo sapiens
tttctacattcaaaaactacca

SEQ ID NO: 7861598 - DNA, 22 bp, Homo sapiens
tttctacattcaaaaactacca

SEQ ID NO: 7861599 - DNA, 22 bp, Homo sapiens
tttctactcaactgagagttgt

SEQ ID NO: 7861600 - DNA, 22 bp, Homo sapiens
tttctactaagaaagttgatta

SEQ ID NO: 7861601 - DNA, 22 bp, Homo sapiens
tttctactaagaaagttgatta

SEQ ID NO: 7861602 - DNA, 22 bp, Homo sapiens
tttctactcaactgagagttgt

SEQ ID NO: 7861603 - DNA, 22 bp, Homo sapiens
tttctactaagaaagttgatta

SEQ ID NO: 7861604 - DNA, 22 bp, Homo sapiens
tttctaatctgattctcctacc

SEQ ID NO: 7861605 - DNA, 22 bp, Homo sapiens
tttctaatctgattctcctacc

SEQ ID NO: 7861606 - DNA, 22 bp, Homo sapiens
tttctaatctttagttacaaaa

SEQ ID NO: 7861607 - DNA, 22 bp, Homo sapiens
tttctaatctttagttacaaaa

SEQ ID NO: 7861608 - DNA, 22 bp, Homo sapiens
tttctaatctttagttacaaaa

SEQ ID NO: 7861609 - DNA, 22 bp, Homo sapiens
tttctaatctttagttacaaaa

SEQ ID NO: 7861610 - DNA, 22 bp, Homo sapiens
tttctacatgttttctattgaa

SEQ ID NO: 7861611 - DNA, 22 bp, Homo sapiens
tttctacatgttttctattgaa

SEQ ID NO: 7861612 - DNA, 22 bp, Homo sapiens
tttctaagtgtgtttcatagga

SEQ ID NO: 7861613 - DNA, 22 bp, Homo sapiens
tttctaagtgtattgagcttgg

SEQ ID NO: 7861614 - DNA, 22 bp, Homo sapiens
tttctaagtgtgtttcatagga

SEQ ID NO: 7861615 - DNA, 22 bp, Homo sapiens
tttctaatctgattctcctacc

SEQ ID NO: 7861616 - DNA, 21 bp, Homo sapiens
tttctaagtgcttggtttggg

SEQ ID NO: 7861617 - DNA, 21 bp, Homo sapiens
tttctaagtgcttggtttggg

SEQ ID NO: 7861618 - DNA, 22 bp, Homo sapiens
tttctaagtgtgattttagatt

SEQ ID NO: 7861619 - DNA, 22 bp, Homo sapiens
tttctaagtgtattgagcttgg

SEQ ID NO: 7861620 - DNA, 22 bp, Homo sapiens
tttctaagtgtgattttagatt

SEQ ID NO: 7861621 - DNA, 22 bp, Homo sapiens
tttctaagtgtgattttagatt

SEQ ID NO: 7861622 - DNA, 22 bp, Homo sapiens
tttctaagtatcttgcagtttt

SEQ ID NO: 7861623 - DNA, 22 bp, Homo sapiens
tttctaagtatcttgcagtttt

SEQ ID NO: 7861624 - DNA, 22 bp, Homo sapiens
tttctaagtatcttgcagtttt

SEQ ID NO: 7861625 - DNA, 22 bp, Homo sapiens
tttctaagtctgagggagtata

SEQ ID NO: 7861626 - DNA, 22 bp, Homo sapiens
tttctaagtgaacattcaagtt

SEQ ID NO: 7861627 - DNA, 22 bp, Homo sapiens
tttctaagtaaacacagcatac

SEQ ID NO: 7861628 - DNA, 22 bp, Homo sapiens
tttctaagtaaacacagcatac

SEQ ID NO: 7861629 - DNA, 22 bp, Homo sapiens
tttctaaggtgatcctttctta

SEQ ID NO: 7861630 - DNA, 21 bp, Homo sapiens
tttctaagtaactggcagcat

SEQ ID NO: 7861631 - DNA, 21 bp, Homo sapiens
tttctaagtaactggcagcat

SEQ ID NO: 7861632 - DNA, 22 bp, Homo sapiens
tttctaagtaagattaacttct

SEQ ID NO: 7861633 - DNA, 22 bp, Homo sapiens
tttctaagtaagattaacttct

SEQ ID NO: 7861634 - DNA, 22 bp, Homo sapiens
tttcctgttgccatcaagaatg

SEQ ID NO: 7861635 - DNA, 22 bp, Homo sapiens
tttcctgtgcttaacaaatatt

SEQ ID NO: 7861636 - DNA, 22 bp, Homo sapiens
tttcctgtgcttaacaaatatt

SEQ ID NO: 7861637 - DNA, 22 bp, Homo sapiens
tttcctgttctagttgttgcca

SEQ ID NO: 7861638 - DNA, 22 bp, Homo sapiens
tttcctgtcttttgtgaaggat

SEQ ID NO: 7861639 - DNA, 22 bp, Homo sapiens
tttcctgtcctggtacttggca

SEQ ID NO: 7861640 - DNA, 22 bp, Homo sapiens
tttcctggtttgaagcagcagc

SEQ ID NO: 7861641 - DNA, 22 bp, Homo sapiens
tttcctggaccaactgagattg

SEQ ID NO: 7861642 - DNA, 22 bp, Homo sapiens
tttcctggaagttattcctcat

SEQ ID NO: 7861643 - DNA, 22 bp, Homo sapiens
tttcctgcacccgctgatgcca

SEQ ID NO: 7861644 - DNA, 22 bp, Homo sapiens
tttcctgcacccgctgatgcca

SEQ ID NO: 7861645 - DNA, 22 bp, Homo sapiens
tttcctgcctggacctctgctt

SEQ ID NO: 7861646 - DNA, 21 bp, Homo sapiens
tttcctgccctttgtcatcac

SEQ ID NO: 7861647 - DNA, 22 bp, Homo sapiens
tttcctctttgtaccttgacta

SEQ ID NO: 7861648 - DNA, 22 bp, Homo sapiens
tttcctctttgtaccttgacta

SEQ ID NO: 7861649 - DNA, 22 bp, Homo sapiens
tttcctctttgtaccttgacta

SEQ ID NO: 7861650 - DNA, 22 bp, Homo sapiens
tttcctctttgtaccttgacta

SEQ ID NO: 7861651 - DNA, 22 bp, Homo sapiens
tttcctctttgtgacacagctg

SEQ ID NO: 7861652 - DNA, 22 bp, Homo sapiens
tttcctgagccagagtttcatt

SEQ ID NO: 7861653 - DNA, 22 bp, Homo sapiens
tttccttctcagggagcttcaa

SEQ ID NO: 7861654 - DNA, 22 bp, Homo sapiens
tttccttctcagggagcttcaa

SEQ ID NO: 7861655 - DNA, 22 bp, Homo sapiens
tttccttctcagggagcttcaa

SEQ ID NO: 7861656 - DNA, 22 bp, Homo sapiens
tttctaaggtgatcctttctta

SEQ ID NO: 7861657 - DNA, 23 bp, Homo sapiens
tttctaaggtttttatctgctac

SEQ ID NO: 7861658 - DNA, 22 bp, Homo sapiens
tttccttcttagcggtgttctt

SEQ ID NO: 7861659 - DNA, 22 bp, Homo sapiens
tttccttctcagggagcttcaa

SEQ ID NO: 7861660 - DNA, 22 bp, Homo sapiens
tttccttctcagggagcttcaa

SEQ ID NO: 7861661 - DNA, 22 bp, Homo sapiens
tttccttccttgctagcctgag

SEQ ID NO: 7861662 - DNA, 22 bp, Homo sapiens
tttccttccctggatgagaagt

SEQ ID NO: 7861663 - DNA, 22 bp, Homo sapiens
tttccttccttgctagcctgag

SEQ ID NO: 7861664 - DNA, 22 bp, Homo sapiens
tttccttccttgctagcctgag

SEQ ID NO: 7861665 - DNA, 22 bp, Homo sapiens
tttccttcctaaggtgaagcaa

SEQ ID NO: 7861666 - DNA, 22 bp, Homo sapiens
tttccttcctaaggtgaagcaa

SEQ ID NO: 7861667 - DNA, 22 bp, Homo sapiens
tttccttcctaaggtgaagcaa

SEQ ID NO: 7861668 - DNA, 22 bp, Homo sapiens
tttccttccaaatgcccgggag

SEQ ID NO: 7861669 - DNA, 22 bp, Homo sapiens
tttccttcatcatctgagagct

SEQ ID NO: 7861670 - DNA, 22 bp, Homo sapiens
tttccttcatcatctgagagct

SEQ ID NO: 7861671 - DNA, 22 bp, Homo sapiens
tttccttcatcatctgagagct

SEQ ID NO: 7861672 - DNA, 22 bp, Homo sapiens
tttccttcatcatctgagagct

SEQ ID NO: 7861673 - DNA, 22 bp, Homo sapiens
tttccttaaatctgtttctagt

SEQ ID NO: 7861674 - DNA, 22 bp, Homo sapiens
tttccttaaatctgtttctagt

SEQ ID NO: 7861675 - DNA, 22 bp, Homo sapiens
tttcctgttgccatcaagaatg

SEQ ID NO: 7861676 - DNA, 22 bp, Homo sapiens
tttccttccaggttcctaaggc

SEQ ID NO: 7861677 - DNA, 22 bp, Homo sapiens
tttccttccaggttcctaaggc

SEQ ID NO: 7861678 - DNA, 22 bp, Homo sapiens
tttccttccaggttcctaaggc

SEQ ID NO: 7861679 - DNA, 22 bp, Homo sapiens
tttccttccaggttcctaaggc

SEQ ID NO: 7861680 - DNA, 22 bp, Homo sapiens
tttccttccaggttcctaaggc

SEQ ID NO: 7861681 - DNA, 22 bp, Homo sapiens
tttccttccatgttgggcaaaa

SEQ ID NO: 7861682 - DNA, 22 bp, Homo sapiens
tttccttccatgttgggcaaaa

SEQ ID NO: 7861683 - DNA, 22 bp, Homo sapiens
tttccttcatcatctgagagct

SEQ ID NO: 7861684 - DNA, 22 bp, Homo sapiens
tttccttccctggatgagaagt

SEQ ID NO: 7861685 - DNA, 22 bp, Homo sapiens
tttccttccctggatgagaagt

SEQ ID NO: 7861686 - DNA, 22 bp, Homo sapiens
tttctattgtaagtctcctata

SEQ ID NO: 7861687 - DNA, 22 bp, Homo sapiens
tttctatttacagtgctaggta

SEQ ID NO: 7861688 - DNA, 22 bp, Homo sapiens
tttctatttacagtgctaggta

SEQ ID NO: 7861689 - DNA, 22 bp, Homo sapiens
tttctattggcgtcactgttgt

SEQ ID NO: 7861690 - DNA, 22 bp, Homo sapiens
tttctagacatttctatgtaca

SEQ ID NO: 7861691 - DNA, 21 bp, Homo sapiens
tttctagaatgactggttctt

SEQ ID NO: 7861692 - DNA, 22 bp, Homo sapiens
tttctagaatgactcatctgag

SEQ ID NO: 7861693 - DNA, 22 bp, Homo sapiens
tttctagacatttctatgtaca

SEQ ID NO: 7861694 - DNA, 22 bp, Homo sapiens
tttctattggcgtcactgttgt

SEQ ID NO: 7861695 - DNA, 22 bp, Homo sapiens
tttctattgtaagtctcctata

SEQ ID NO: 7861696 - DNA, 22 bp, Homo sapiens
tttctattgtaagtctcctata

SEQ ID NO: 7861697 - DNA, 22 bp, Homo sapiens
tttctattgtaagtctcctata

SEQ ID NO: 7861698 - DNA, 22 bp, Homo sapiens
tttctagaagtggctgggcgtt

SEQ ID NO: 7861699 - DNA, 22 bp, Homo sapiens
tttctagaaacattatctctat

SEQ ID NO: 7861700 - DNA, 22 bp, Homo sapiens
tttctagaaacattatctctat

SEQ ID NO: 7861701 - DNA, 22 bp, Homo sapiens
tttctacttctcctgaatgtct

SEQ ID NO: 7861702 - DNA, 22 bp, Homo sapiens
tttctacttctcctgaatgtct

SEQ ID NO: 7861703 - DNA, 22 bp, Homo sapiens
tttctagaatgactcatctgag

SEQ ID NO: 7861704 - DNA, 21 bp, Homo sapiens
tttctagaaggaggcatgagg

SEQ ID NO: 7861705 - DNA, 22 bp, Homo sapiens
tttctagaaatagagatagagt

SEQ ID NO: 7861706 - DNA, 22 bp, Homo sapiens
tttctagaagatggctaataag

SEQ ID NO: 7861707 - DNA, 22 bp, Homo sapiens
tttctagaaaccaagatattgt

SEQ ID NO: 7861708 - DNA, 22 bp, Homo sapiens
tttctagaaagttcatgtgttt

SEQ ID NO: 7861709 - DNA, 22 bp, Homo sapiens
tttctagaaaccaagatattgt

SEQ ID NO: 7861710 - DNA, 22 bp, Homo sapiens
tttctcagctcagcatctgggt

SEQ ID NO: 7861711 - DNA, 22 bp, Homo sapiens
tttctcagctcagcatctgggt

SEQ ID NO: 7861712 - DNA, 22 bp, Homo sapiens
tttctcagcctccttgctggag

SEQ ID NO: 7861713 - DNA, 22 bp, Homo sapiens
tttctcagcgttcttagggctc

SEQ ID NO: 7861714 - DNA, 22 bp, Homo sapiens
tttctcagcgttcttagggctc

SEQ ID NO: 7861715 - DNA, 19 bp, Homo sapiens
tttctcaggaagtttgtgt

SEQ ID NO: 7861716 - DNA, 22 bp, Homo sapiens
tttctcagtaatgtcctggaat

SEQ ID NO: 7861717 - DNA, 22 bp, Homo sapiens
tttctcagtagtaatggcagtc

SEQ ID NO: 7861718 - DNA, 22 bp, Homo sapiens
tttctcagtagtaatggcagtc

SEQ ID NO: 7861719 - DNA, 22 bp, Homo sapiens
tttctcagggaggagtcaagcc

SEQ ID NO: 7861720 - DNA, 22 bp, Homo sapiens
tttctcagggaggagtcaagcc

SEQ ID NO: 7861721 - DNA, 22 bp, Homo sapiens
tttctcagtaatgtcctggaat

SEQ ID NO: 7861722 - DNA, 21 bp, Homo sapiens
tttctcataaaatactcatta

SEQ ID NO: 7861723 - DNA, 21 bp, Homo sapiens
tttctcataaaatactcatta

SEQ ID NO: 7861724 - DNA, 21 bp, Homo sapiens
tttctcagttgtgtgagcagc

SEQ ID NO: 7861725 - DNA, 21 bp, Homo sapiens
tttctcagttgtgtgagcagc

SEQ ID NO: 7861726 - DNA, 22 bp, Homo sapiens
tttctcagttctctgcaaggag

SEQ ID NO: 7861727 - DNA, 22 bp, Homo sapiens
tttctcagtgtagcttttcaag

SEQ ID NO: 7861728 - DNA, 22 bp, Homo sapiens
tttctcagttactagctgtggt

SEQ ID NO: 7861729 - DNA, 22 bp, Homo sapiens
tttctcagttactagctgtggt

SEQ ID NO: 7861730 - DNA, 22 bp, Homo sapiens
tttctcagtgtagcttttcaag

SEQ ID NO: 7861731 - DNA, 22 bp, Homo sapiens
tttctcagttctctgcaaggag

SEQ ID NO: 7861732 - DNA, 22 bp, Homo sapiens
tttctcagttctctgcaaggag

SEQ ID NO: 7861733 - DNA, 22 bp, Homo sapiens
tttctcagttactagctgtggt

SEQ ID NO: 7861734 - DNA, 23 bp, Homo sapiens
tttctcatccagagagtcagtcc

SEQ ID NO: 7861735 - DNA, 22 bp, Homo sapiens
tttctcatagtcatgcctctta

SEQ ID NO: 7861736 - DNA, 22 bp, Homo sapiens
tttctcatagtcatgcctctta

SEQ ID NO: 7861737 - DNA, 22 bp, Homo sapiens
tttctcatagtcatgcctctta

SEQ ID NO: 7861738 - DNA, 23 bp, Homo sapiens
tttctcatccagagagtcagtcc

SEQ ID NO: 7861739 - DNA, 22 bp, Homo sapiens
tttctcatctggaaacagtgct

SEQ ID NO: 7861740 - DNA, 22 bp, Homo sapiens
tttctcatggaacatagctcct

SEQ ID NO: 7861741 - DNA, 22 bp, Homo sapiens
tttctcatggaacatagctcct

SEQ ID NO: 7861742 - DNA, 23 bp, Homo sapiens
tttctcatccagagagtcagtcc

SEQ ID NO: 7861743 - DNA, 22 bp, Homo sapiens
tttctcatggaacatagctcct

SEQ ID NO: 7861744 - DNA, 22 bp, Homo sapiens
tttctcatggaacatcgtttag

SEQ ID NO: 7861745 - DNA, 22 bp, Homo sapiens
tttctcatggacccttcatgat

SEQ ID NO: 7861746 - DNA, 22 bp, Homo sapiens
tttctcatggacccttcatgat

SEQ ID NO: 7861747 - DNA, 22 bp, Homo sapiens
tttctcatggcccttggctttt

SEQ ID NO: 7861748 - DNA, 22 bp, Homo sapiens
tttctccacgccagcttgctta

SEQ ID NO: 7861749 - DNA, 22 bp, Homo sapiens
tttctccaatgtatcagcacac

SEQ ID NO: 7861750 - DNA, 22 bp, Homo sapiens
tttctccacgccagcttgctta

SEQ ID NO: 7861751 - DNA, 22 bp, Homo sapiens
tttctccacgccagcttgctta

SEQ ID NO: 7861752 - DNA, 22 bp, Homo sapiens
tttctccacttctcttgccaac

SEQ ID NO: 7861753 - DNA, 22 bp, Homo sapiens
tttctccacttctcttgccaac

SEQ ID NO: 7861754 - DNA, 22 bp, Homo sapiens
tttctccacttctcttgccaac

SEQ ID NO: 7861755 - DNA, 21 bp, Homo sapiens
tttctccaagtgactgattcc

SEQ ID NO: 7861756 - DNA, 21 bp, Homo sapiens
tttctccaagtgactgattcc

SEQ ID NO: 7861757 - DNA, 22 bp, Homo sapiens
tttctccaatgtatcagcacac

SEQ ID NO: 7861758 - DNA, 22 bp, Homo sapiens
tttctccaatgtatcagcacac

SEQ ID NO: 7861759 - DNA, 22 bp, Homo sapiens
tttctcctcatgactggttgtg

SEQ ID NO: 7861760 - DNA, 22 bp, Homo sapiens
tttctcctcatgactggttgtg

SEQ ID NO: 7861761 - DNA, 22 bp, Homo sapiens
tttctcctaactcaaatttaag

SEQ ID NO: 7861762 - DNA, 22 bp, Homo sapiens
tttctcctaactcaaatttaag

SEQ ID NO: 7861763 - DNA, 22 bp, Homo sapiens
tttctcctaactcaaatttaag

SEQ ID NO: 7861764 - DNA, 20 bp, Homo sapiens
tttctccggtcttgagatcc

SEQ ID NO: 7861765 - DNA, 22 bp, Homo sapiens
tttctccctttataagactgta

SEQ ID NO: 7861766 - DNA, 22 bp, Homo sapiens
tttctcctaactcaaatttaag

SEQ ID NO: 7861767 - DNA, 22 bp, Homo sapiens
tttctcctccagagagacacag

SEQ ID NO: 7861768 - DNA, 22 bp, Homo sapiens
tttctcctctccagagtgcagt

SEQ ID NO: 7861769 - DNA, 22 bp, Homo sapiens
tttctcctctccagagtgcagt

SEQ ID NO: 7861770 - DNA, 22 bp, Homo sapiens
tttctcctctccagagtgcagt

SEQ ID NO: 7861771 - DNA, 22 bp, Homo sapiens
tttctcctccagagagacacag

SEQ ID NO: 7861772 - DNA, 22 bp, Homo sapiens
tttctcctccagagagacacag

SEQ ID NO: 7861773 - DNA, 22 bp, Homo sapiens
tttctcctcatgactggttgtg

SEQ ID NO: 7861774 - DNA, 22 bp, Homo sapiens
tttctcctccagagagacacag

SEQ ID NO: 7861775 - DNA, 22 bp, Homo sapiens
tttctcccccatgataatttct

SEQ ID NO: 7861776 - DNA, 22 bp, Homo sapiens
tttctcccccatgataatttct

SEQ ID NO: 7861777 - DNA, 22 bp, Homo sapiens
tttctccccagtctaatctgga

SEQ ID NO: 7861778 - DNA, 22 bp, Homo sapiens
tttctccccagtctaatctgga

SEQ ID NO: 7861779 - DNA, 22 bp, Homo sapiens
tttctccctttataagactgta

SEQ ID NO: 7861780 - DNA, 22 bp, Homo sapiens
tttctccctttataagactgta

SEQ ID NO: 7861781 - DNA, 22 bp, Homo sapiens
tttctccctccactacaggctc

SEQ ID NO: 7861782 - DNA, 22 bp, Homo sapiens
tttctccctccactacaggctc

SEQ ID NO: 7861783 - DNA, 22 bp, Homo sapiens
tttctcccagtctcctgagaca

SEQ ID NO: 7861784 - DNA, 22 bp, Homo sapiens
tttctcccagtctcctgagaca

SEQ ID NO: 7861785 - DNA, 20 bp, Homo sapiens
tttctcccaagtgcaagggt

SEQ ID NO: 7861786 - DNA, 20 bp, Homo sapiens
tttctcccaagtgcaagggt

SEQ ID NO: 7861787 - DNA, 20 bp, Homo sapiens
tttctcccaagtgcaagggt

SEQ ID NO: 7861788 - DNA, 22 bp, Homo sapiens
tttctcccaactctggaagcca

SEQ ID NO: 7861789 - DNA, 22 bp, Homo sapiens
tttctcccaactctggaagcca

SEQ ID NO: 7861790 - DNA, 22 bp, Homo sapiens
tttctcccaactctggaagcca

SEQ ID NO: 7861791 - DNA, 22 bp, Homo sapiens
tttctccatcaccccctcggtg

SEQ ID NO: 7861792 - DNA, 22 bp, Homo sapiens
tttctcccaaagtgcaaccaca

SEQ ID NO: 7861793 - DNA, 22 bp, Homo sapiens
tttctcccaaagtgcaaccaca

SEQ ID NO: 7861794 - DNA, 22 bp, Homo sapiens
tttctccatcaccccctcggtg

SEQ ID NO: 7861795 - DNA, 22 bp, Homo sapiens
tttctccatcaccccctcggtg

SEQ ID NO: 7861796 - DNA, 22 bp, Homo sapiens
tttctccagaagaggaagcgga

SEQ ID NO: 7861797 - DNA, 22 bp, Homo sapiens
tttcatttcatagaattgtgtt

SEQ ID NO: 7861798 - DNA, 22 bp, Homo sapiens
tttcatttcatagaattgtgtt

SEQ ID NO: 7861799 - DNA, 22 bp, Homo sapiens
tttcatttcatagaattgtgtt

SEQ ID NO: 7861800 - DNA, 22 bp, Homo sapiens
tttcatttcatagaattgtgtt

SEQ ID NO: 7861801 - DNA, 22 bp, Homo sapiens
tttcatttcatagaattgtgtt

SEQ ID NO: 7861802 - DNA, 22 bp, Homo sapiens
tttcatttcatagaattgtgtt

SEQ ID NO: 7861803 - DNA, 22 bp, Homo sapiens
tttcattttggttatgccataa

SEQ ID NO: 7861804 - DNA, 22 bp, Homo sapiens
tttcattttggttatgccataa

SEQ ID NO: 7861805 - DNA, 22 bp, Homo sapiens
tttcattttggttatgccataa

SEQ ID NO: 7861806 - DNA, 22 bp, Homo sapiens
tttcattttggttatgccataa

SEQ ID NO: 7861807 - DNA, 22 bp, Homo sapiens
tttcattttggttatgccataa

SEQ ID NO: 7861808 - DNA, 22 bp, Homo sapiens
tttcattttggttatgccataa

SEQ ID NO: 7861809 - DNA, 22 bp, Homo sapiens
tttccaaaatgaatctaatgca

SEQ ID NO: 7861810 - DNA, 22 bp, Homo sapiens
tttccaaacccagcgagctaca

SEQ ID NO: 7861811 - DNA, 22 bp, Homo sapiens
tttccaaaatgaatctaatgca

SEQ ID NO: 7861812 - DNA, 22 bp, Homo sapiens
tttccaaaatgaatctaatgca

SEQ ID NO: 7861813 - DNA, 22 bp, Homo sapiens
tttccaaagctgagttgagcaa

SEQ ID NO: 7861814 - DNA, 22 bp, Homo sapiens
tttccaaacccagcgagctaca

SEQ ID NO: 7861815 - DNA, 22 bp, Homo sapiens
tttccaaaatgaatctaatgca

SEQ ID NO: 7861816 - DNA, 22 bp, Homo sapiens
tttccaaaagtttgttctgtgc

SEQ ID NO: 7861817 - DNA, 22 bp, Homo sapiens
tttccaaaatgaatctaatgca

SEQ ID NO: 7861818 - DNA, 22 bp, Homo sapiens
tttccaaaagtttgttctgtgc

SEQ ID NO: 7861819 - DNA, 22 bp, Homo sapiens
tttccaaaagtttgttctgtgc

SEQ ID NO: 7861820 - DNA, 22 bp, Homo sapiens
tttcattttggttatgccataa

SEQ ID NO: 7861821 - DNA, 22 bp, Homo sapiens
tttccaaaagtttgttctgtgc

SEQ ID NO: 7861822 - DNA, 22 bp, Homo sapiens
tttcattgtcatctatcttaga

SEQ ID NO: 7861823 - DNA, 22 bp, Homo sapiens
tttcattgtcaataaactgtat

SEQ ID NO: 7861824 - DNA, 20 bp, Homo sapiens
tttcattgtcagaatcttat

SEQ ID NO: 7861825 - DNA, 22 bp, Homo sapiens
tttcattgtctacatatgacat

SEQ ID NO: 7861826 - DNA, 22 bp, Homo sapiens
tttcattgtccccaggcaagac

SEQ ID NO: 7861827 - DNA, 22 bp, Homo sapiens
tttcattgtccccaggcaagac

SEQ ID NO: 7861828 - DNA, 22 bp, Homo sapiens
tttcattgtccccaggcaagac

SEQ ID NO: 7861829 - DNA, 22 bp, Homo sapiens
tttcattgtctacatatgacat

SEQ ID NO: 7861830 - DNA, 22 bp, Homo sapiens
tttcattgtctacatatgacat

SEQ ID NO: 7861831 - DNA, 22 bp, Homo sapiens
tttcattggctccctgatgaat

SEQ ID NO: 7861832 - DNA, 22 bp, Homo sapiens
tttcattgcctttggaaggtct

SEQ ID NO: 7861833 - DNA, 22 bp, Homo sapiens
tttcattgcctttggaaggtct

SEQ ID NO: 7861834 - DNA, 22 bp, Homo sapiens
tttcattggcagagcctgtttt

SEQ ID NO: 7861835 - DNA, 22 bp, Homo sapiens
tttcattgtcaataaactgtat

SEQ ID NO: 7861836 - DNA, 22 bp, Homo sapiens
tttcattgtcaataaactgtat

SEQ ID NO: 7861837 - DNA, 22 bp, Homo sapiens
tttcattgtcaataaactgtat

SEQ ID NO: 7861838 - DNA, 22 bp, Homo sapiens
tttcattggctccctgatgaat

SEQ ID NO: 7861839 - DNA, 22 bp, Homo sapiens
tttcattgccataaggtgggat

SEQ ID NO: 7861840 - DNA, 22 bp, Homo sapiens
tttcattgccataaggtgggat

SEQ ID NO: 7861841 - DNA, 22 bp, Homo sapiens
tttcattgccataaggtgggat

SEQ ID NO: 7861842 - DNA, 22 bp, Homo sapiens
tttcagtggcatcgattaccct

SEQ ID NO: 7861843 - DNA, 22 bp, Homo sapiens
tttcagtggagtgacatgatct

SEQ ID NO: 7861844 - DNA, 22 bp, Homo sapiens
tttcagtggagtgacatgatct

SEQ ID NO: 7861845 - DNA, 22 bp, Homo sapiens
tttcagtggaccacagtttgat

SEQ ID NO: 7861846 - DNA, 22 bp, Homo sapiens
tttcagtgcttctgtttaccgg

SEQ ID NO: 7861847 - DNA, 22 bp, Homo sapiens
tttcagtgaaagctactgttag

SEQ ID NO: 7861848 - DNA, 22 bp, Homo sapiens
tttcagtgcttctgtttaccgg

SEQ ID NO: 7861849 - DNA, 22 bp, Homo sapiens
tttccaaagttgccataagctt

SEQ ID NO: 7861850 - DNA, 22 bp, Homo sapiens
tttccaaagttgccataagctt

SEQ ID NO: 7861851 - DNA, 22 bp, Homo sapiens
tttccaaagttgccataagctt

SEQ ID NO: 7861852 - DNA, 22 bp, Homo sapiens
tttccaaataaggtcacactca

SEQ ID NO: 7861853 - DNA, 22 bp, Homo sapiens
tttccaaataaggtcacactca

SEQ ID NO: 7861854 - DNA, 22 bp, Homo sapiens
tttccaaaggtggcaggaacaa

SEQ ID NO: 7861855 - DNA, 22 bp, Homo sapiens
tttccaaagttgccataagctt

SEQ ID NO: 7861856 - DNA, 22 bp, Homo sapiens
tttccaaaggtggcaggaacaa

SEQ ID NO: 7861857 - DNA, 22 bp, Homo sapiens
tttccaaaggtggcaggaacaa

SEQ ID NO: 7861858 - DNA, 22 bp, Homo sapiens
tttccaaaggtggcaggaacaa

SEQ ID NO: 7861859 - DNA, 16 bp, Homo sapiens
tttccaaagggcagct

SEQ ID NO: 7861860 - DNA, 22 bp, Homo sapiens
tttccaaaggtggcaggaacaa

SEQ ID NO: 7861861 - DNA, 22 bp, Homo sapiens
tttccaaaggaggaaccagttt

SEQ ID NO: 7861862 - DNA, 22 bp, Homo sapiens
tttccaaagctgagttgagcaa

SEQ ID NO: 7861863 - DNA, 22 bp, Homo sapiens
tttccaaacccagcgagctaca

SEQ ID NO: 7861864 - DNA, 22 bp, Homo sapiens
tttccaaagctgagttgagcaa

SEQ ID NO: 7861865 - DNA, 22 bp, Homo sapiens
tttccaaaggaggaaccagttt

SEQ ID NO: 7861866 - DNA, 22 bp, Homo sapiens
tttccaaaggagtaccacgcat

SEQ ID NO: 7861867 - DNA, 22 bp, Homo sapiens
tttccaaaggagtaccacgcat

SEQ ID NO: 7861868 - DNA, 22 bp, Homo sapiens
tttccaaaggaggaaccagttt

SEQ ID NO: 7861869 - DNA, 22 bp, Homo sapiens
tttccaaaggctaaactcagtt

SEQ ID NO: 7861870 - DNA, 22 bp, Homo sapiens
tttccaaaggaggaaccagttt

SEQ ID NO: 7861871 - DNA, 22 bp, Homo sapiens
tttccaaaggctaaactcagtt

SEQ ID NO: 7861872 - DNA, 22 bp, Homo sapiens
tttccaaaggagtaccacgcat

SEQ ID NO: 7861873 - DNA, 22 bp, Homo sapiens
tttccaaaggctaaactcagtt

SEQ ID NO: 7861874 - DNA, 22 bp, Homo sapiens
tttccaaaggctaaactcagtt

SEQ ID NO: 7861875 - DNA, 16 bp, Homo sapiens
tttccaaagggcagct

SEQ ID NO: 7861876 - DNA, 16 bp, Homo sapiens
tttccaaagggcagct

SEQ ID NO: 7861877 - DNA, 22 bp, Homo sapiens
tttccaaaggctaaactcagtt

SEQ ID NO: 7861878 - DNA, 22 bp, Homo sapiens
tttccaaaggctaaactcagtt

SEQ ID NO: 7861879 - DNA, 22 bp, Homo sapiens
tttcctcttatacagtgtttat

SEQ ID NO: 7861880 - DNA, 22 bp, Homo sapiens
tttcctcttccgagggggaggc

SEQ ID NO: 7861881 - DNA, 22 bp, Homo sapiens
tttcctcttcgattaagtttgg

SEQ ID NO: 7861882 - DNA, 22 bp, Homo sapiens
tttcctcttcgattaagtttgg

SEQ ID NO: 7861883 - DNA, 22 bp, Homo sapiens
tttcctcttcgattaagtttgg

SEQ ID NO: 7861884 - DNA, 22 bp, Homo sapiens
tttcctcttcgattaagtttgg

SEQ ID NO: 7861885 - DNA, 22 bp, Homo sapiens
tttcctcttctggcaggcaggg

SEQ ID NO: 7861886 - DNA, 22 bp, Homo sapiens
tttcctcttcttcccatgtcat

SEQ ID NO: 7861887 - DNA, 22 bp, Homo sapiens
tttcctcttcttcccatgtcat

SEQ ID NO: 7861888 - DNA, 22 bp, Homo sapiens
tttcctcttcttcccatgtcat

SEQ ID NO: 7861889 - DNA, 22 bp, Homo sapiens
tttcctcttcttcccatgtcat

SEQ ID NO: 7861890 - DNA, 22 bp, Homo sapiens
tttcctcttcttcccatgtcat

SEQ ID NO: 7861891 - DNA, 22 bp, Homo sapiens
tttcctcttcttcccatgtcat

SEQ ID NO: 7861892 - DNA, 22 bp, Homo sapiens
tttcctcttcttcccatgtcat

SEQ ID NO: 7861893 - DNA, 22 bp, Homo sapiens
tttcctcttatacagtgtttat

SEQ ID NO: 7861894 - DNA, 22 bp, Homo sapiens
tttcctcttatacagtgtttat

SEQ ID NO: 7861895 - DNA, 22 bp, Homo sapiens
tttcctctgtcatgacagctga

SEQ ID NO: 7861896 - DNA, 22 bp, Homo sapiens
tttcctctgtcatgacagctga

SEQ ID NO: 7861897 - DNA, 22 bp, Homo sapiens
tttcctctgggccctgccaccc

SEQ ID NO: 7861898 - DNA, 22 bp, Homo sapiens
tttcctctgatgctgacttgga

SEQ ID NO: 7861899 - DNA, 22 bp, Homo sapiens
tttcctctgctgccattgcccc

SEQ ID NO: 7861900 - DNA, 22 bp, Homo sapiens
tttcctctgctgccattgcccc

SEQ ID NO: 7861901 - DNA, 20 bp, Homo sapiens
tttcagagtgtctttccatt

SEQ ID NO: 7861902 - DNA, 20 bp, Homo sapiens
tttcagagtgtctttccatt

SEQ ID NO: 7861903 - DNA, 22 bp, Homo sapiens
tttcagagttagtagagcatgt

SEQ ID NO: 7861904 - DNA, 22 bp, Homo sapiens
tttcagagttagtagagcatgt

SEQ ID NO: 7861905 - DNA, 22 bp, Homo sapiens
tttcagagttatgtaagaaaat

SEQ ID NO: 7861906 - DNA, 22 bp, Homo sapiens
tttcagagttatgtaagaaaat

SEQ ID NO: 7861907 - DNA, 22 bp, Homo sapiens
tttcagagttatgtaagaaaat

SEQ ID NO: 7861908 - DNA, 22 bp, Homo sapiens
tttcagagtcagctcctctcta

SEQ ID NO: 7861909 - DNA, 22 bp, Homo sapiens
tttcagagtctggctgcagcct

SEQ ID NO: 7861910 - DNA, 22 bp, Homo sapiens
tttcagagtctggctgcagcct

SEQ ID NO: 7861911 - DNA, 22 bp, Homo sapiens
tttcagagtcagctcctctcta

SEQ ID NO: 7861912 - DNA, 22 bp, Homo sapiens
tttcagaggtatgctgcttatc

SEQ ID NO: 7861913 - DNA, 22 bp, Homo sapiens
tttcagaggtgcttggaatgct

SEQ ID NO: 7861914 - DNA, 22 bp, Homo sapiens
tttcagaggtgcttggaatgct

SEQ ID NO: 7861915 - DNA, 22 bp, Homo sapiens
tttcagaggtgcttggaatgct

SEQ ID NO: 7861916 - DNA, 22 bp, Homo sapiens
tttcagaggaaatctcattgag

SEQ ID NO: 7861917 - DNA, 22 bp, Homo sapiens
tttcagaggagagctggaccaa

SEQ ID NO: 7861918 - DNA, 22 bp, Homo sapiens
tttcagaggaggaaggcagtta

SEQ ID NO: 7861919 - DNA, 22 bp, Homo sapiens
tttcagaggaggaaggcagtta

SEQ ID NO: 7861920 - DNA, 22 bp, Homo sapiens
tttcagaggagagctggaccaa

SEQ ID NO: 7861921 - DNA, 22 bp, Homo sapiens
tttcagaggtatgctgcttatc

SEQ ID NO: 7861922 - DNA, 22 bp, Homo sapiens
tttcagaggtatgctgcttatc

SEQ ID NO: 7861923 - DNA, 22 bp, Homo sapiens
tttcagagggcagatctggggc

SEQ ID NO: 7861924 - DNA, 22 bp, Homo sapiens
tttcagaggaggaaggcagtta

SEQ ID NO: 7861925 - DNA, 22 bp, Homo sapiens
tttcagagctgagatgccacag

SEQ ID NO: 7861926 - DNA, 22 bp, Homo sapiens
tttcaaagggaagttatgaagt

SEQ ID NO: 7861927 - DNA, 22 bp, Homo sapiens
tttcagaggaaatctcattgag

SEQ ID NO: 7861928 - DNA, 22 bp, Homo sapiens
tttcagaggaaatctcattgag

SEQ ID NO: 7861929 - DNA, 22 bp, Homo sapiens
tttcaaagggaagttatgaagt

SEQ ID NO: 7861930 - DNA, 20 bp, Homo sapiens
tttcaaaggcacctatgaag

SEQ ID NO: 7861931 - DNA, 22 bp, Homo sapiens
tttcaaactttactcttgaatc

SEQ ID NO: 7861932 - DNA, 22 bp, Homo sapiens
tttcaaactttactcttgaatc

SEQ ID NO: 7861933 - DNA, 22 bp, Homo sapiens
tttcaaactttactcttgaatc

SEQ ID NO: 7861934 - DNA, 22 bp, Homo sapiens
tttcaaagacagccatatttgt

SEQ ID NO: 7861935 - DNA, 22 bp, Homo sapiens
tttcaaagacagccatatttgt

SEQ ID NO: 7861936 - DNA, 22 bp, Homo sapiens
tttcaaagacagccatatttgt

SEQ ID NO: 7861937 - DNA, 22 bp, Homo sapiens
tttcaaagacagccatatttgt

SEQ ID NO: 7861938 - DNA, 22 bp, Homo sapiens
tttcaaagaccattaactatca

SEQ ID NO: 7861939 - DNA, 22 bp, Homo sapiens
tttcaaagaccattaactatca

SEQ ID NO: 7861940 - DNA, 22 bp, Homo sapiens
tttcaaagaccattaactatca

SEQ ID NO: 7861941 - DNA, 22 bp, Homo sapiens
tttcaaagaccattaactatca

SEQ ID NO: 7861942 - DNA, 22 bp, Homo sapiens
tttcaaagaccattaactatca

SEQ ID NO: 7861943 - DNA, 17 bp, Homo sapiens
tttcaaagcagtcagga

SEQ ID NO: 7861944 - DNA, 20 bp, Homo sapiens
tttcaaaggcacctatgaag

SEQ ID NO: 7861945 - DNA, 22 bp, Homo sapiens
tttcaaaggaggctgagaggat

SEQ ID NO: 7861946 - DNA, 22 bp, Homo sapiens
tttcaaagagaggcagaaggaa

SEQ ID NO: 7861947 - DNA, 22 bp, Homo sapiens
tttcaaagagttgtaaattact

SEQ ID NO: 7861948 - DNA, 22 bp, Homo sapiens
tttcaaagcaactgaaaaggaa

SEQ ID NO: 7861949 - DNA, 22 bp, Homo sapiens
tttcagagttggggaaaagcag

SEQ ID NO: 7861950 - DNA, 22 bp, Homo sapiens
tttcagagttatgtaagaaaat

SEQ ID NO: 7861951 - DNA, 22 bp, Homo sapiens
tttcagagttgtcttcttgacc

SEQ ID NO: 7861952 - DNA, 22 bp, Homo sapiens
tttcagagttggggaaaagcag

SEQ ID NO: 7861953 - DNA, 22 bp, Homo sapiens
tttcagagttgtcttcttgacc

SEQ ID NO: 7861954 - DNA, 22 bp, Homo sapiens
tttcagatcactttcaggaaag

SEQ ID NO: 7861955 - DNA, 22 bp, Homo sapiens
tttcagatcactttcaggaaag

SEQ ID NO: 7861956 - DNA, 22 bp, Homo sapiens
tttcagatgcaattaattttca

SEQ ID NO: 7861957 - DNA, 22 bp, Homo sapiens
tttcagattatctcaactttgg

SEQ ID NO: 7861958 - DNA, 22 bp, Homo sapiens
tttcagatggtatatacagtag

SEQ ID NO: 7861959 - DNA, 22 bp, Homo sapiens
tttcagatggtatatacagtag

SEQ ID NO: 7861960 - DNA, 22 bp, Homo sapiens
tttcagatggtatatacagtag

SEQ ID NO: 7861961 - DNA, 22 bp, Homo sapiens
tttcagcactttaggcagcagg

SEQ ID NO: 7861962 - DNA, 23 bp, Homo sapiens
tttcagcattctagttcaggttc

SEQ ID NO: 7861963 - DNA, 22 bp, Homo sapiens
tttcagctgctgactagttgta

SEQ ID NO: 7861964 - DNA, 22 bp, Homo sapiens
tttcagcactttaggcagcagg

SEQ ID NO: 7861965 - DNA, 22 bp, Homo sapiens
tttcagcactttaggcagcagg

SEQ ID NO: 7861966 - DNA, 20 bp, Homo sapiens
tttcagatttacagaaatgt

SEQ ID NO: 7861967 - DNA, 20 bp, Homo sapiens
tttcagatttacagaaatgt

SEQ ID NO: 7861968 - DNA, 22 bp, Homo sapiens
tttcaggattttatgagatagt

SEQ ID NO: 7861969 - DNA, 22 bp, Homo sapiens
tttcaggcaggtggaatgagta

SEQ ID NO: 7861970 - DNA, 22 bp, Homo sapiens
tttcaggattagtttaagcagg

SEQ ID NO: 7861971 - DNA, 22 bp, Homo sapiens
tttcaggattttatgagatagt

SEQ ID NO: 7861972 - DNA, 19 bp, Homo sapiens
tttcaggagctatgcaggg

SEQ ID NO: 7861973 - DNA, 22 bp, Homo sapiens
tttcaggatcaaatgaaatcgt

SEQ ID NO: 7861974 - DNA, 22 bp, Homo sapiens
tttcaggagagaccagaaatga

SEQ ID NO: 7861975 - DNA, 22 bp, Homo sapiens
tttcaggaaggtgaggcacatg

SEQ ID NO: 7861976 - DNA, 22 bp, Homo sapiens
tttcaggaaacatttaatggca

SEQ ID NO: 7861977 - DNA, 22 bp, Homo sapiens
tttcagctggtaaaggagtagc

SEQ ID NO: 7861978 - DNA, 22 bp, Homo sapiens
tttcagctggtaaaggagtagc

SEQ ID NO: 7861979 - DNA, 22 bp, Homo sapiens
tttcaggacacctttaaaaacg

SEQ ID NO: 7861980 - DNA, 22 bp, Homo sapiens
tttcaggacacctttaaaaacg

SEQ ID NO: 7861981 - DNA, 22 bp, Homo sapiens
tttcaggactcaaaacgataat

SEQ ID NO: 7861982 - DNA, 22 bp, Homo sapiens
tttcaggagagaccagaaatga

SEQ ID NO: 7861983 - DNA, 22 bp, Homo sapiens
tttcaggccatagcacagggaa

SEQ ID NO: 7861984 - DNA, 20 bp, Homo sapiens
tttcaggctggctatctttg

SEQ ID NO: 7861985 - DNA, 22 bp, Homo sapiens
tttcaggcaggtggaatgagta

SEQ ID NO: 7861986 - DNA, 22 bp, Homo sapiens
tttcagggaagtgttgaaaagg

SEQ ID NO: 7861987 - DNA, 22 bp, Homo sapiens
tttcagggagcctagaagagct

SEQ ID NO: 7861988 - DNA, 22 bp, Homo sapiens
tttcagggtgctccagacaccc

SEQ ID NO: 7861989 - DNA, 22 bp, Homo sapiens
tttcaggtaagaaaactaagaa

SEQ ID NO: 7861990 - DNA, 22 bp, Homo sapiens
tttcagggtcagcctgtatgtg

SEQ ID NO: 7861991 - DNA, 22 bp, Homo sapiens
tttcagtcatgagttgttttca

SEQ ID NO: 7861992 - DNA, 22 bp, Homo sapiens
tttcagtcatgagttgttttca

SEQ ID NO: 7861993 - DNA, 22 bp, Homo sapiens
tttcagtcatggattcactgag

SEQ ID NO: 7861994 - DNA, 22 bp, Homo sapiens
tttcagtgcccagagctttgca

SEQ ID NO: 7861995 - DNA, 22 bp, Homo sapiens
tttcagtgcacgtagtttattt

SEQ ID NO: 7861996 - DNA, 22 bp, Homo sapiens
tttcagtgaaagctactgttag

SEQ ID NO: 7861997 - DNA, 22 bp, Homo sapiens
tttcagtgaaagctactgttag

SEQ ID NO: 7861998 - DNA, 22 bp, Homo sapiens
ttgtgtgtgagccttcaccaca

SEQ ID NO: 7861999 - DNA, 22 bp, Homo sapiens
ttgtgtgtgagccttcaccaca

SEQ ID NO: 7862000 - DNA, 22 bp, Homo sapiens
ttgtgtgtgagccttcaccaca

SEQ ID NO: 7862001 - DNA, 22 bp, Homo sapiens
ttgtgtgtcttcttcactgccc

SEQ ID NO: 7862002 - DNA, 22 bp, Homo sapiens
ttgtgtgtgagccttcaccaca

SEQ ID NO: 7862003 - DNA, 22 bp, Homo sapiens
ttgtgtgtgagccttcaccaca

SEQ ID NO: 7862004 - DNA, 22 bp, Homo sapiens
ttgtgtgtcttcttcactgccc

SEQ ID NO: 7862005 - DNA, 22 bp, Homo sapiens
ttgtgtgtcttcttcactgccc

SEQ ID NO: 7862006 - DNA, 22 bp, Homo sapiens
ttgtgtgtcttcttcactgccc

SEQ ID NO: 7862007 - DNA, 22 bp, Homo sapiens
ttgtgtgtcttcttcactgccc

SEQ ID NO: 7862008 - DNA, 22 bp, Homo sapiens
ttgtgtgtcttcttcactgccc

SEQ ID NO: 7862009 - DNA, 22 bp, Homo sapiens
ttgtgacattgattaaactatg

SEQ ID NO: 7862010 - DNA, 19 bp, Homo sapiens
ttgtgtgtcagtcagagtt

SEQ ID NO: 7862011 - DNA, 19 bp, Homo sapiens
ttgtgtgtcagtcagagtt

SEQ ID NO: 7862012 - DNA, 19 bp, Homo sapiens
ttgtgtgtcagtcagagtt

SEQ ID NO: 7862013 - DNA, 22 bp, Homo sapiens
ttgtgagaaatcttaatcccaa

SEQ ID NO: 7862014 - DNA, 19 bp, Homo sapiens
ttgtgtgtcagtcagagtt

SEQ ID NO: 7862015 - DNA, 22 bp, Homo sapiens
ttgtgacattgattaaactatg

SEQ ID NO: 7862016 - DNA, 19 bp, Homo sapiens
ttgtgactggctctgcata

SEQ ID NO: 7862017 - DNA, 22 bp, Homo sapiens
ttgtgacacatgccgtcctgag

SEQ ID NO: 7862018 - DNA, 22 bp, Homo sapiens
ttgtgaatggtgccgcaataaa

SEQ ID NO: 7862019 - DNA, 22 bp, Homo sapiens
ttgtgaatggtgccgcaataaa

SEQ ID NO: 7862020 - DNA, 22 bp, Homo sapiens
ttgtgaatggtgccgcaataaa

SEQ ID NO: 7862021 - DNA, 22 bp, Homo sapiens
ttgtgaatgcttaatatgtttc

SEQ ID NO: 7862022 - DNA, 22 bp, Homo sapiens
ttgtgtgtgtaactttatgaga

SEQ ID NO: 7862023 - DNA, 22 bp, Homo sapiens
ttgtgtgtgtaactttatgaga

SEQ ID NO: 7862024 - DNA, 22 bp, Homo sapiens
ttgtgtgtgtaactttatgaga

SEQ ID NO: 7862025 - DNA, 22 bp, Homo sapiens
ttgtgtgtgtaactttatgaga

SEQ ID NO: 7862026 - DNA, 22 bp, Homo sapiens
ttgtgtgtttgtagaaaatcca

SEQ ID NO: 7862027 - DNA, 22 bp, Homo sapiens
ttgtgtgtgtaactttatgaga

SEQ ID NO: 7862028 - DNA, 22 bp, Homo sapiens
ttgtgtgtttgtagaaaatcca

SEQ ID NO: 7862029 - DNA, 22 bp, Homo sapiens
ttgtgtgtttgtagaaaatcca

SEQ ID NO: 7862030 - DNA, 22 bp, Homo sapiens
ttgtgttaaggtgcatctagtg

SEQ ID NO: 7862031 - DNA, 22 bp, Homo sapiens
ttgtgttaaggtgcatctagtg

SEQ ID NO: 7862032 - DNA, 22 bp, Homo sapiens
ttgtgttaaggtgcatctagtg

SEQ ID NO: 7862033 - DNA, 22 bp, Homo sapiens
ttgtgtgtttgtagaaaatcca

SEQ ID NO: 7862034 - DNA, 22 bp, Homo sapiens
ttgtgtttctgtgatatgtaaa

SEQ ID NO: 7862035 - DNA, 22 bp, Homo sapiens
ttgtgtttctggccaagatgga

SEQ ID NO: 7862036 - DNA, 22 bp, Homo sapiens
ttgtgtttctggccaagatgga

SEQ ID NO: 7862037 - DNA, 22 bp, Homo sapiens
ttgtgtttctggccaagatgga

SEQ ID NO: 7862038 - DNA, 22 bp, Homo sapiens
ttgtgttaaggtgcatctagtg

SEQ ID NO: 7862039 - DNA, 22 bp, Homo sapiens
ttgtgttaaggtgcatctagtg

SEQ ID NO: 7862040 - DNA, 22 bp, Homo sapiens
ttgtgtttcccttgcatattcc

SEQ ID NO: 7862041 - DNA, 20 bp, Homo sapiens
ttgtttaaaggtgaagaggc

SEQ ID NO: 7862042 - DNA, 20 bp, Homo sapiens
ttgtttaaaggtgaagaggc

SEQ ID NO: 7862043 - DNA, 22 bp, Homo sapiens
ttgtttaagccacccaatctgt

SEQ ID NO: 7862044 - DNA, 22 bp, Homo sapiens
ttgtttaagccacccaatctgt

SEQ ID NO: 7862045 - DNA, 22 bp, Homo sapiens
ttgtttaagccacccaatctgt

SEQ ID NO: 7862046 - DNA, 22 bp, Homo sapiens
ttgtttcatggggatgtttatt

SEQ ID NO: 7862047 - DNA, 22 bp, Homo sapiens
ttgtttccattgcagactgtgt

SEQ ID NO: 7862048 - DNA, 21 bp, Homo sapiens
ttgtttcccagagctcgctcc

SEQ ID NO: 7862049 - DNA, 21 bp, Homo sapiens
ttgtttcccagagctcgctcc

SEQ ID NO: 7862050 - DNA, 22 bp, Homo sapiens
ttgtttccataattaagtgtga

SEQ ID NO: 7862051 - DNA, 22 bp, Homo sapiens
ttgtttccagcaaatagtccat

SEQ ID NO: 7862052 - DNA, 22 bp, Homo sapiens
ttgtttaaaatgtagcaagaaa

SEQ ID NO: 7862053 - DNA, 22 bp, Homo sapiens
ttgtttaaagaacttctgactt

SEQ ID NO: 7862054 - DNA, 22 bp, Homo sapiens
ttgtttaaagaacttctgactt

SEQ ID NO: 7862055 - DNA, 22 bp, Homo sapiens
ttgttattattactaagtcttc

SEQ ID NO: 7862056 - DNA, 22 bp, Homo sapiens
ttgttattattactaagtcttc

SEQ ID NO: 7862057 - DNA, 22 bp, Homo sapiens
ttgttattattactaagtcttc

SEQ ID NO: 7862058 - DNA, 22 bp, Homo sapiens
ttgttattattactaagtcttc

SEQ ID NO: 7862059 - DNA, 22 bp, Homo sapiens
ttgttagtaagtgacaaaaatc

SEQ ID NO: 7862060 - DNA, 22 bp, Homo sapiens
ttgttagctgatcttgagtgca

SEQ ID NO: 7862061 - DNA, 22 bp, Homo sapiens
ttgttagctgatcttgagtgca

SEQ ID NO: 7862062 - DNA, 22 bp, Homo sapiens
ttgttataaagactaaatatgt

SEQ ID NO: 7862063 - DNA, 22 bp, Homo sapiens
ttgttataaagactaaatatgt

SEQ ID NO: 7862064 - DNA, 22 bp, Homo sapiens
ttgttatctgcgtgaagaaaat

SEQ ID NO: 7862065 - DNA, 22 bp, Homo sapiens
ttgtgttttcttatggcataaa

SEQ ID NO: 7862066 - DNA, 22 bp, Homo sapiens
ttgttaaaaatagatttccagg

SEQ ID NO: 7862067 - DNA, 22 bp, Homo sapiens
ttgttaaaaatagatttccagg

SEQ ID NO: 7862068 - DNA, 22 bp, Homo sapiens
ttgttaaaaatagatttccagg

SEQ ID NO: 7862069 - DNA, 22 bp, Homo sapiens
ttgttaaaaatagatttccagg

SEQ ID NO: 7862070 - DNA, 22 bp, Homo sapiens
ttgttacagcagtgatttcaga

SEQ ID NO: 7862071 - DNA, 22 bp, Homo sapiens
ttgttacagcagtgatttcaga

SEQ ID NO: 7862072 - DNA, 22 bp, Homo sapiens
ttgttacagcagtgatttcaga

SEQ ID NO: 7862073 - DNA, 22 bp, Homo sapiens
ttgttacagcagcaatagaaaa

SEQ ID NO: 7862074 - DNA, 22 bp, Homo sapiens
ttgttacatcttatgtaagtgg

SEQ ID NO: 7862075 - DNA, 22 bp, Homo sapiens
ttgttacatcttatgtaagtgg

SEQ ID NO: 7862076 - DNA, 22 bp, Homo sapiens
ttgttacatacagcagaacata

SEQ ID NO: 7862077 - DNA, 22 bp, Homo sapiens
ttgttacatacagcagaacata

SEQ ID NO: 7862078 - DNA, 22 bp, Homo sapiens
ttgttacatacagcagaacata

SEQ ID NO: 7862079 - DNA, 22 bp, Homo sapiens
ttgttacaggtcctagtggctg

SEQ ID NO: 7862080 - DNA, 22 bp, Homo sapiens
ttgttacagcagtgatttcaga

SEQ ID NO: 7862081 - DNA, 22 bp, Homo sapiens
ttgttacatggacaactgtatg

SEQ ID NO: 7862082 - DNA, 22 bp, Homo sapiens
ttgttacatggacaactgtatg

SEQ ID NO: 7862083 - DNA, 21 bp, Homo sapiens
ttgttacattcttatggcata

SEQ ID NO: 7862084 - DNA, 22 bp, Homo sapiens
ttgttacatggacaactgtatg

SEQ ID NO: 7862085 - DNA, 22 bp, Homo sapiens
ttgttacatggacaactgtatg

SEQ ID NO: 7862086 - DNA, 22 bp, Homo sapiens
ttgttacatcttatgtaagtgg

SEQ ID NO: 7862087 - DNA, 22 bp, Homo sapiens
ttgttacatcttatgtaagtgg

SEQ ID NO: 7862088 - DNA, 22 bp, Homo sapiens
ttgttacttgcatgtagactaa

SEQ ID NO: 7862089 - DNA, 22 bp, Homo sapiens
ttgttactgttctacatacagt

SEQ ID NO: 7862090 - DNA, 22 bp, Homo sapiens
ttgttactaagcctttaaatag

SEQ ID NO: 7862091 - DNA, 22 bp, Homo sapiens
ttgttactaagcctttaaatag

SEQ ID NO: 7862092 - DNA, 21 bp, Homo sapiens
ttgttacattcttatggcata

SEQ ID NO: 7862093 - DNA, 21 bp, Homo sapiens
ttgttacattcttatggcata

SEQ ID NO: 7862094 - DNA, 20 bp, Homo sapiens
ttgttagaggaatgccatag

SEQ ID NO: 7862095 - DNA, 22 bp, Homo sapiens
ttgttagcatgcttaatggata

SEQ ID NO: 7862096 - DNA, 22 bp, Homo sapiens
ttgttagatatttcttagaaga

SEQ ID NO: 7862097 - DNA, 20 bp, Homo sapiens
ttgttagaggaatgccatag

SEQ ID NO: 7862098 - DNA, 20 bp, Homo sapiens
ttgttagaggaatgccatag

SEQ ID NO: 7862099 - DNA, 20 bp, Homo sapiens
ttgttagaggaatgccatag

SEQ ID NO: 7862100 - DNA, 20 bp, Homo sapiens
ttgtttctgctattttctaa

SEQ ID NO: 7862101 - DNA, 20 bp, Homo sapiens
ttgtttctgctattttctaa

SEQ ID NO: 7862102 - DNA, 20 bp, Homo sapiens
ttgtttctgctattttctaa

SEQ ID NO: 7862103 - DNA, 20 bp, Homo sapiens
ttgtttctgctattttctaa

SEQ ID NO: 7862104 - DNA, 20 bp, Homo sapiens
ttgtttctgctattttctaa

SEQ ID NO: 7862105 - DNA, 22 bp, Homo sapiens
ttgtttcttcaggcttttagga

SEQ ID NO: 7862106 - DNA, 22 bp, Homo sapiens
ttgtttcttcaggcttttagga

SEQ ID NO: 7862107 - DNA, 22 bp, Homo sapiens
ttgtttctggaaaaggcgagaa

SEQ ID NO: 7862108 - DNA, 20 bp, Homo sapiens
ttgtttctgctattttctaa

SEQ ID NO: 7862109 - DNA, 22 bp, Homo sapiens
ttgtttctggaaaaggcgagaa

SEQ ID NO: 7862110 - DNA, 22 bp, Homo sapiens
ttgtttctctggtcttgagtga

SEQ ID NO: 7862111 - DNA, 22 bp, Homo sapiens
ttgtttctgagttttcatgtat

SEQ ID NO: 7862112 - DNA, 22 bp, Homo sapiens
ttgtttctcctggtgcctgata

SEQ ID NO: 7862113 - DNA, 22 bp, Homo sapiens
ttgtttctcctggtgcctgata

SEQ ID NO: 7862114 - DNA, 22 bp, Homo sapiens
ttgtttctccagtctaggaaaa

SEQ ID NO: 7862115 - DNA, 22 bp, Homo sapiens
ttgtttctccagtctaggaaaa

SEQ ID NO: 7862116 - DNA, 22 bp, Homo sapiens
ttgtttccctggatctagagct

SEQ ID NO: 7862117 - DNA, 21 bp, Homo sapiens
ttgtttcctcccaaaatgcca

SEQ ID NO: 7862118 - DNA, 22 bp, Homo sapiens
ttgtttccctggatctagagct

SEQ ID NO: 7862119 - DNA, 21 bp, Homo sapiens
ttgtttcccagagctcgctcc

SEQ ID NO: 7862120 - DNA, 21 bp, Homo sapiens
ttgtttcccagagctcgctcc

SEQ ID NO: 7862121 - DNA, 22 bp, Homo sapiens
ttgtttcctttctatacaggat

SEQ ID NO: 7862122 - DNA, 22 bp, Homo sapiens
ttgtttcctttctatacaggat

SEQ ID NO: 7862123 - DNA, 20 bp, Homo sapiens
ttgtttcctggctgttctgc

SEQ ID NO: 7862124 - DNA, 22 bp, Homo sapiens
ttgtttgtcataatatcattac

SEQ ID NO: 7862125 - DNA, 22 bp, Homo sapiens
ttgtttgtatgctgagaagaat

SEQ ID NO: 7862126 - DNA, 22 bp, Homo sapiens
ttgtttgtaaggctcttagaat

SEQ ID NO: 7862127 - DNA, 22 bp, Homo sapiens
ttgtttgtaaggctcttagaat

SEQ ID NO: 7862128 - DNA, 22 bp, Homo sapiens
ttgtttgtaaggctcttagaat

SEQ ID NO: 7862129 - DNA, 22 bp, Homo sapiens
ttgtttgtaaggctcttagaat

SEQ ID NO: 7862130 - DNA, 22 bp, Homo sapiens
ttgtttgaataacagacaaatt

SEQ ID NO: 7862131 - DNA, 23 bp, Homo sapiens
ttgtttctttgtattgtctctat

SEQ ID NO: 7862132 - DNA, 22 bp, Homo sapiens
ttgtttgaggtcactgatattt

SEQ ID NO: 7862133 - DNA, 22 bp, Homo sapiens
ttgtttgcccacaactattaag

SEQ ID NO: 7862134 - DNA, 22 bp, Homo sapiens
ttgtttgaggtcactgatattt

SEQ ID NO: 7862135 - DNA, 22 bp, Homo sapiens
ttgtttctttgaagtttctaga

SEQ ID NO: 7862136 - DNA, 22 bp, Homo sapiens
ttgtttctttgaagtttctaga

SEQ ID NO: 7862137 - DNA, 17 bp, Homo sapiens
ttgtttcttctctgtgg

SEQ ID NO: 7862138 - DNA, 22 bp, Homo sapiens
ttgtttctttgaagtttctaga

SEQ ID NO: 7862139 - DNA, 22 bp, Homo sapiens
ttgtttctttgaagtttctaga

SEQ ID NO: 7862140 - DNA, 22 bp, Homo sapiens
ttgtttcttcaggcttttagga

SEQ ID NO: 7862141 - DNA, 22 bp, Homo sapiens
ttgtttcttcaggcttttagga

SEQ ID NO: 7862142 - DNA, 22 bp, Homo sapiens
ttgtttcttcaggcttttagga

SEQ ID NO: 7862143 - DNA, 22 bp, Homo sapiens
ttgtttcttcatttagaagctt

SEQ ID NO: 7862144 - DNA, 22 bp, Homo sapiens
ttgtttcttcatttagaagctt

SEQ ID NO: 7862145 - DNA, 22 bp, Homo sapiens
ttgtttcttcatttagaagctt

SEQ ID NO: 7862146 - DNA, 22 bp, Homo sapiens
ttgtttcttcatttagaagctt

SEQ ID NO: 7862147 - DNA, 17 bp, Homo sapiens
ttgtttcttctctgtgg

SEQ ID NO: 7862148 - DNA, 22 bp, Homo sapiens
ttgttttggagatgagctaaaa

SEQ ID NO: 7862149 - DNA, 22 bp, Homo sapiens
ttgtttttaaacatgtgactga

SEQ ID NO: 7862150 - DNA, 22 bp, Homo sapiens
ttgttttggaagaacttactct

SEQ ID NO: 7862151 - DNA, 22 bp, Homo sapiens
ttgtttttaaacatgtgactga

SEQ ID NO: 7862152 - DNA, 22 bp, Homo sapiens
ttgtttttaaacatgtgactga

SEQ ID NO: 7862153 - DNA, 22 bp, Homo sapiens
ttgtttttaaacatgtgactga

SEQ ID NO: 7862154 - DNA, 22 bp, Homo sapiens
ttgtttttaaacatgtgactga

SEQ ID NO: 7862155 - DNA, 22 bp, Homo sapiens
ttgttttggaagaacttactct

SEQ ID NO: 7862156 - DNA, 22 bp, Homo sapiens
ttgttttggaagaacttactct

SEQ ID NO: 7862157 - DNA, 22 bp, Homo sapiens
ttgttttgctaaagggtcatca

SEQ ID NO: 7862158 - DNA, 22 bp, Homo sapiens
ttgttttgagccctggacttgc

SEQ ID NO: 7862159 - DNA, 22 bp, Homo sapiens
ttgttttcttgtatatagcctc

SEQ ID NO: 7862160 - DNA, 22 bp, Homo sapiens
ttgttttctccactgcatctta

SEQ ID NO: 7862161 - DNA, 22 bp, Homo sapiens
ttgttttcttgtatatagcctc

SEQ ID NO: 7862162 - DNA, 22 bp, Homo sapiens
ttgttttcagggtgtcattcac

SEQ ID NO: 7862163 - DNA, 22 bp, Homo sapiens
ttgttttcctgggataccaacc

SEQ ID NO: 7862164 - DNA, 22 bp, Homo sapiens
ttgttttctccactgcatctta

SEQ ID NO: 7862165 - DNA, 22 bp, Homo sapiens
ttgttttatctttctacagact

SEQ ID NO: 7862166 - DNA, 22 bp, Homo sapiens
ttgttttattctgcaatttccc

SEQ ID NO: 7862167 - DNA, 22 bp, Homo sapiens
ttgttttattctgcaatttccc

SEQ ID NO: 7862168 - DNA, 22 bp, Homo sapiens
ttgttttattctgcaatttccc

SEQ ID NO: 7862169 - DNA, 22 bp, Homo sapiens
ttgttttatctttctacagact

SEQ ID NO: 7862170 - DNA, 22 bp, Homo sapiens
ttgttttattctgcaatttccc

SEQ ID NO: 7862171 - DNA, 22 bp, Homo sapiens
ttgttttatctttctacagact

SEQ ID NO: 7862172 - DNA, 22 bp, Homo sapiens
ttgttttattctgcaatttccc

SEQ ID NO: 7862173 - DNA, 22 bp, Homo sapiens
ttgttttaatgagggaggttga

SEQ ID NO: 7862174 - DNA, 22 bp, Homo sapiens
ttgttttagtaggtacactgag

SEQ ID NO: 7862175 - DNA, 22 bp, Homo sapiens
ttgttttagtaggtacactgag

SEQ ID NO: 7862176 - DNA, 22 bp, Homo sapiens
ttgttttagtaggtacactgag

SEQ ID NO: 7862177 - DNA, 22 bp, Homo sapiens
ttgttttagtaggtacactgag

SEQ ID NO: 7862178 - DNA, 22 bp, Homo sapiens
ttgttttagtaggtacactgag

SEQ ID NO: 7862179 - DNA, 22 bp, Homo sapiens
ttgttttatctttctacagact

SEQ ID NO: 7862180 - DNA, 22 bp, Homo sapiens
ttgttttagtaggtacactgag

SEQ ID NO: 7862181 - DNA, 22 bp, Homo sapiens
ttgttttaacgactcagcttgt

SEQ ID NO: 7862182 - DNA, 22 bp, Homo sapiens
ttgttttaacgactcagcttgt

SEQ ID NO: 7862183 - DNA, 18 bp, Homo sapiens
ttgttttaagactctgtc

SEQ ID NO: 7862184 - DNA, 18 bp, Homo sapiens
ttgttttaagactctgtc

SEQ ID NO: 7862185 - DNA, 18 bp, Homo sapiens
ttgttttaagactctgtc

SEQ ID NO: 7862186 - DNA, 22 bp, Homo sapiens
ttgttttaagccagtctgccta

SEQ ID NO: 7862187 - DNA, 20 bp, Homo sapiens
ttgttttaaatcctggatga

SEQ ID NO: 7862188 - DNA, 22 bp, Homo sapiens
ttgtttgtgctatttaatgtag

SEQ ID NO: 7862189 - DNA, 22 bp, Homo sapiens
ttgtttgtcataatatcattac

SEQ ID NO: 7862190 - DNA, 22 bp, Homo sapiens
ttgttttaacctagtgtttatg

SEQ ID NO: 7862191 - DNA, 22 bp, Homo sapiens
ttgttttaacctagtgtttatg

SEQ ID NO: 7862192 - DNA, 20 bp, Homo sapiens
ttgttttaaatcctggatga

SEQ ID NO: 7862193 - DNA, 22 bp, Homo sapiens
ttgttttaacctagtgtttatg

SEQ ID NO: 7862194 - DNA, 22 bp, Homo sapiens
ttgttttaacctagtgtttatg

SEQ ID NO: 7862195 - DNA, 22 bp, Homo sapiens
ttgttttaacgactcagcttgt

SEQ ID NO: 7862196 - DNA, 22 bp, Homo sapiens
ttgttttaacgactcagcttgt

SEQ ID NO: 7862197 - DNA, 22 bp, Homo sapiens
ttgttttaacctagtgtttatg

SEQ ID NO: 7862198 - DNA, 22 bp, Homo sapiens
ttggtgggagagatgagggttg

SEQ ID NO: 7862199 - DNA, 22 bp, Homo sapiens
ttggtgggagagatgagggttg

SEQ ID NO: 7862200 - DNA, 22 bp, Homo sapiens
ttggtgggagagatgagggttg

SEQ ID NO: 7862201 - DNA, 22 bp, Homo sapiens
ttggtgggcacaggggagaagt

SEQ ID NO: 7862202 - DNA, 22 bp, Homo sapiens
ttggtgggcacaggggagaagt

SEQ ID NO: 7862203 - DNA, 22 bp, Homo sapiens
ttggtgtacatctccccttcat

SEQ ID NO: 7862204 - DNA, 23 bp, Homo sapiens
ttggtgtcagggaactttggaat

SEQ ID NO: 7862205 - DNA, 22 bp, Homo sapiens
ttggtgtgactaaggcagtgtg

SEQ ID NO: 7862206 - DNA, 22 bp, Homo sapiens
ttggttacaagtttgctctgcc

SEQ ID NO: 7862207 - DNA, 22 bp, Homo sapiens
ttggttacacttaatttttcca

SEQ ID NO: 7862208 - DNA, 19 bp, Homo sapiens
ttggtgcacacatgggccc

SEQ ID NO: 7862209 - DNA, 22 bp, Homo sapiens
ttggtgccgaggatctgcaggt

SEQ ID NO: 7862210 - DNA, 22 bp, Homo sapiens
ttggtgctctctatgacatgaa

SEQ ID NO: 7862211 - DNA, 22 bp, Homo sapiens
ttggtgaacacatacacatttt

SEQ ID NO: 7862212 - DNA, 22 bp, Homo sapiens
ttggtgacttgcagaaacagct

SEQ ID NO: 7862213 - DNA, 22 bp, Homo sapiens
ttggtcttgagtggcttgttaa

SEQ ID NO: 7862214 - DNA, 22 bp, Homo sapiens
ttggtctgtgttacatcattta

SEQ ID NO: 7862215 - DNA, 22 bp, Homo sapiens
ttggtctggagtatgatgataa

SEQ ID NO: 7862216 - DNA, 22 bp, Homo sapiens
ttggtctgcagggagggctgga

SEQ ID NO: 7862217 - DNA, 22 bp, Homo sapiens
ttggtctgcagggagggctgga

SEQ ID NO: 7862218 - DNA, 22 bp, Homo sapiens
ttggtctgtagttttcttatgt

SEQ ID NO: 7862219 - DNA, 18 bp, Homo sapiens
ttggtctgggtggaaacc

SEQ ID NO: 7862220 - DNA, 22 bp, Homo sapiens
ttggtccctcatggacacatga

SEQ ID NO: 7862221 - DNA, 22 bp, Homo sapiens
ttggtcctcagtttccctatct

SEQ ID NO: 7862222 - DNA, 22 bp, Homo sapiens
ttggtcctgccccctccaggtc

SEQ ID NO: 7862223 - DNA, 22 bp, Homo sapiens
ttggtcctggtctaggcagagt

SEQ ID NO: 7862224 - DNA, 22 bp, Homo sapiens
ttggtcctttatcctttaggca

SEQ ID NO: 7862225 - DNA, 22 bp, Homo sapiens
ttggtctgcagggagggctgga

SEQ ID NO: 7862226 - DNA, 22 bp, Homo sapiens
ttggggtggaagtgaggatcat

SEQ ID NO: 7862227 - DNA, 22 bp, Homo sapiens
ttggggtggaagtgaggatcat

SEQ ID NO: 7862228 - DNA, 18 bp, Homo sapiens
ttggggtgaggccaggaa

SEQ ID NO: 7862229 - DNA, 22 bp, Homo sapiens
ttggggtggaagtgaggatcat

SEQ ID NO: 7862230 - DNA, 22 bp, Homo sapiens
ttggggtgttggatggagcaag

SEQ ID NO: 7862231 - DNA, 22 bp, Homo sapiens
ttggggtgttggatggagcaag

SEQ ID NO: 7862232 - DNA, 22 bp, Homo sapiens
ttggtcatcttccgtttcctca

SEQ ID NO: 7862233 - DNA, 22 bp, Homo sapiens
ttggtcagtcagagaatggagt

SEQ ID NO: 7862234 - DNA, 22 bp, Homo sapiens
ttggtcagctcaatggagaggg

SEQ ID NO: 7862235 - DNA, 22 bp, Homo sapiens
ttggtcagtcagagaatggagt

SEQ ID NO: 7862236 - DNA, 22 bp, Homo sapiens
ttggtcagctcaatggagaggg

SEQ ID NO: 7862237 - DNA, 22 bp, Homo sapiens
ttggggtgttggatggagcaag

SEQ ID NO: 7862238 - DNA, 22 bp, Homo sapiens
ttggggtgttggatggagcaag

SEQ ID NO: 7862239 - DNA, 22 bp, Homo sapiens
ttgcaagaaattaggaagtgaa

SEQ ID NO: 7862240 - DNA, 22 bp, Homo sapiens
ttgcaaggagccactctgcctg

SEQ ID NO: 7862241 - DNA, 20 bp, Homo sapiens
ttgcaagctttcaagatagc

SEQ ID NO: 7862242 - DNA, 22 bp, Homo sapiens
ttgcaagatgttaccattgtta

SEQ ID NO: 7862243 - DNA, 22 bp, Homo sapiens
ttgcaaggtcatcatgcattgg

SEQ ID NO: 7862244 - DNA, 22 bp, Homo sapiens
ttgcaagttaaaaattattagt

SEQ ID NO: 7862245 - DNA, 22 bp, Homo sapiens
ttgcaaggtttctctctgccta

SEQ ID NO: 7862246 - DNA, 22 bp, Homo sapiens
ttgcaagttccttatgagaatc

SEQ ID NO: 7862247 - DNA, 20 bp, Homo sapiens
ttgcaataaatgaaagacca

SEQ ID NO: 7862248 - DNA, 22 bp, Homo sapiens
ttgcaatcaaaaagaagtacag

SEQ ID NO: 7862249 - DNA, 22 bp, Homo sapiens
ttgcaatagccttatttccaaa

SEQ ID NO: 7862250 - DNA, 18 bp, Homo sapiens
ttggggtgaggccaggaa

SEQ ID NO: 7862251 - DNA, 18 bp, Homo sapiens
ttggggtgaggccaggaa

SEQ ID NO: 7862252 - DNA, 22 bp, Homo sapiens
ttgcaaattcgtcactgttaaa

SEQ ID NO: 7862253 - DNA, 18 bp, Homo sapiens
ttgcaaattcttccctgt

SEQ ID NO: 7862254 - DNA, 22 bp, Homo sapiens
ttgcaaattcatggatctgaat

SEQ ID NO: 7862255 - DNA, 22 bp, Homo sapiens
ttgcaacaggtgtgttttggtg

SEQ ID NO: 7862256 - DNA, 22 bp, Homo sapiens
ttgcaacattgtaagtttatat

SEQ ID NO: 7862257 - DNA, 22 bp, Homo sapiens
ttgcaactaaaagaacttgaca

SEQ ID NO: 7862258 - DNA, 23 bp, Homo sapiens
ttgcaaatttcagttagttcatg

SEQ ID NO: 7862259 - DNA, 23 bp, Homo sapiens
ttgcaaatttcagttagttcatg

SEQ ID NO: 7862260 - DNA, 21 bp, Homo sapiens
ttgcaacaacctatatatttt

SEQ ID NO: 7862261 - DNA, 22 bp, Homo sapiens
ttgtctctcattcctgcaactc

SEQ ID NO: 7862262 - DNA, 22 bp, Homo sapiens
ttgtctctcattcctgcaactc

SEQ ID NO: 7862263 - DNA, 22 bp, Homo sapiens
ttgtctatacatcaataatgat

SEQ ID NO: 7862264 - DNA, 22 bp, Homo sapiens
ttgtctctaagtgtgatcttca

SEQ ID NO: 7862265 - DNA, 22 bp, Homo sapiens
ttgtctctaagtgtgatcttca

SEQ ID NO: 7862266 - DNA, 22 bp, Homo sapiens
ttgtctgaagtcacacagatgc

SEQ ID NO: 7862267 - DNA, 22 bp, Homo sapiens
ttgtctgaaccatctccctggc

SEQ ID NO: 7862268 - DNA, 22 bp, Homo sapiens
ttgtctgaaagatcattacatt

SEQ ID NO: 7862269 - DNA, 22 bp, Homo sapiens
ttgtctgaaaaggtaaatattt

SEQ ID NO: 7862270 - DNA, 22 bp, Homo sapiens
ttgtctctgggacatggtatta

SEQ ID NO: 7862271 - DNA, 22 bp, Homo sapiens
ttgtctctcattcctgcaactc

SEQ ID NO: 7862272 - DNA, 22 bp, Homo sapiens
ttgtctgagggtttgagagaat

SEQ ID NO: 7862273 - DNA, 22 bp, Homo sapiens
ttgtctgagagatggcagaggt

SEQ ID NO: 7862274 - DNA, 22 bp, Homo sapiens
ttgtctgagaaagtgagttgct

SEQ ID NO: 7862275 - DNA, 22 bp, Homo sapiens
ttgtctgagaaagtgagttgct

SEQ ID NO: 7862276 - DNA, 22 bp, Homo sapiens
ttgtctgagagatggcagaggt

SEQ ID NO: 7862277 - DNA, 22 bp, Homo sapiens
ttgtctgagggtttgagagaat

SEQ ID NO: 7862278 - DNA, 22 bp, Homo sapiens
ttgtctgatgttccctcatgat

SEQ ID NO: 7862279 - DNA, 22 bp, Homo sapiens
ttgtctgatgttccctcatgat

SEQ ID NO: 7862280 - DNA, 22 bp, Homo sapiens
ttgtctgattgctggattagca

SEQ ID NO: 7862281 - DNA, 22 bp, Homo sapiens
ttgtctgcatgattctaggcag

SEQ ID NO: 7862282 - DNA, 22 bp, Homo sapiens
ttgtctgaatctggagctctct

SEQ ID NO: 7862283 - DNA, 22 bp, Homo sapiens
ttgtctgaatatgtatgtatcc

SEQ ID NO: 7862284 - DNA, 22 bp, Homo sapiens
ttgtctgaatctggagctctct

SEQ ID NO: 7862285 - DNA, 22 bp, Homo sapiens
ttgtctgaatatgtatgtatcc

SEQ ID NO: 7862286 - DNA, 22 bp, Homo sapiens
ttgtctgaaccatctccctggc

SEQ ID NO: 7862287 - DNA, 22 bp, Homo sapiens
ttgtctgaagtcacacagatgc

SEQ ID NO: 7862288 - DNA, 22 bp, Homo sapiens
ttgtctgaagtcacacagatgc

SEQ ID NO: 7862289 - DNA, 22 bp, Homo sapiens
ttgtctgacttctttagttact

SEQ ID NO: 7862290 - DNA, 22 bp, Homo sapiens
ttgtctgacttctttagttact

SEQ ID NO: 7862291 - DNA, 22 bp, Homo sapiens
ttgtctgaattcttctaggcag

SEQ ID NO: 7862292 - DNA, 22 bp, Homo sapiens
ttgtctgaattcttctaggcag

SEQ ID NO: 7862293 - DNA, 22 bp, Homo sapiens
ttgtgaatagtgccacaataaa

SEQ ID NO: 7862294 - DNA, 22 bp, Homo sapiens
ttgtgaatagtgccgcaataaa

SEQ ID NO: 7862295 - DNA, 22 bp, Homo sapiens
ttgtgaaatgtttcaaaatagt

SEQ ID NO: 7862296 - DNA, 22 bp, Homo sapiens
ttgtgaaatgtttcaaaatagt

SEQ ID NO: 7862297 - DNA, 22 bp, Homo sapiens
ttgtgaaatgtttcaaaatagt

SEQ ID NO: 7862298 - DNA, 22 bp, Homo sapiens
ttgtgaaatgtttcaaaatagt

SEQ ID NO: 7862299 - DNA, 22 bp, Homo sapiens
ttgtgaaatcgtgtttggaagc

SEQ ID NO: 7862300 - DNA, 22 bp, Homo sapiens
ttgtctgtaaagacggccacca

SEQ ID NO: 7862301 - DNA, 22 bp, Homo sapiens
ttgtctgtaaagacggccacca

SEQ ID NO: 7862302 - DNA, 22 bp, Homo sapiens
ttgtctgcttgttcagatggaa

SEQ ID NO: 7862303 - DNA, 22 bp, Homo sapiens
ttgtctggtcaaatcacttgta

SEQ ID NO: 7862304 - DNA, 22 bp, Homo sapiens
ttgtctgcattgtttctatggg

SEQ ID NO: 7862305 - DNA, 22 bp, Homo sapiens
ttgtctgcatgattctaggcag

SEQ ID NO: 7862306 - DNA, 22 bp, Homo sapiens
ttgtctgcattgtttctatggg

SEQ ID NO: 7862307 - DNA, 22 bp, Homo sapiens
ttgtctgcttgatgccaagcat

SEQ ID NO: 7862308 - DNA, 22 bp, Homo sapiens
ttgtgaatagtgccgctataaa

SEQ ID NO: 7862309 - DNA, 22 bp, Homo sapiens
ttgtgaatagtgccgctataaa

SEQ ID NO: 7862310 - DNA, 22 bp, Homo sapiens
ttgtgaatagtgccgcaatgaa

SEQ ID NO: 7862311 - DNA, 22 bp, Homo sapiens
ttgtgaatagtgccgctataaa

SEQ ID NO: 7862312 - DNA, 22 bp, Homo sapiens
ttgtgaatagtgccgctataaa

SEQ ID NO: 7862313 - DNA, 22 bp, Homo sapiens
ttgtgaatagtgccgcaataaa

SEQ ID NO: 7862314 - DNA, 22 bp, Homo sapiens
ttgtgaatagtgccgcaataaa

SEQ ID NO: 7862315 - DNA, 22 bp, Homo sapiens
ttgtgaatagtgccgcaataaa

SEQ ID NO: 7862316 - DNA, 22 bp, Homo sapiens
ttgtgaatggtgccgcaataaa

SEQ ID NO: 7862317 - DNA, 22 bp, Homo sapiens
ttgtgaatagtgctgcagtaaa

SEQ ID NO: 7862318 - DNA, 22 bp, Homo sapiens
ttgtgaatgcttaatatgtttc

SEQ ID NO: 7862319 - DNA, 22 bp, Homo sapiens
ttgtgaatagtgctgcaataaa

SEQ ID NO: 7862320 - DNA, 22 bp, Homo sapiens
ttgtgaatagtgccgctataaa

SEQ ID NO: 7862321 - DNA, 22 bp, Homo sapiens
ttgtcctttaatgtttagtatt

SEQ ID NO: 7862322 - DNA, 22 bp, Homo sapiens
ttgtccttgttcctaacccctc

SEQ ID NO: 7862323 - DNA, 22 bp, Homo sapiens
ttgtcctttaatgtttagtatt

SEQ ID NO: 7862324 - DNA, 22 bp, Homo sapiens
ttgtccttgtgcaagacccagc

SEQ ID NO: 7862325 - DNA, 22 bp, Homo sapiens
ttgtccttggctctagaggtga

SEQ ID NO: 7862326 - DNA, 17 bp, Homo sapiens
ttgtctacctagcagaa

SEQ ID NO: 7862327 - DNA, 22 bp, Homo sapiens
ttgtctactaagaaagacaatt

SEQ ID NO: 7862328 - DNA, 22 bp, Homo sapiens
ttgtctatacatcaataatgat

SEQ ID NO: 7862329 - DNA, 22 bp, Homo sapiens
ttgtctatacatcaataatgat

SEQ ID NO: 7862330 - DNA, 22 bp, Homo sapiens
ttgtctaatgagctccacttca

SEQ ID NO: 7862331 - DNA, 22 bp, Homo sapiens
ttggttttgggatgtacaaagg

SEQ ID NO: 7862332 - DNA, 22 bp, Homo sapiens
ttggttttgggatgtacaaagg

SEQ ID NO: 7862333 - DNA, 22 bp, Homo sapiens
ttggttttgaaatagcttattg

SEQ ID NO: 7862334 - DNA, 22 bp, Homo sapiens
ttgtccttcatgttggatttat

SEQ ID NO: 7862335 - DNA, 22 bp, Homo sapiens
ttgtccttcatgttggatttat

SEQ ID NO: 7862336 - DNA, 22 bp, Homo sapiens
ttgtccttcatgttggatttat

SEQ ID NO: 7862337 - DNA, 23 bp, Homo sapiens
ttgtccttctgaaatatatctgg

SEQ ID NO: 7862338 - DNA, 23 bp, Homo sapiens
ttgtccttctgaaatatatctgg

SEQ ID NO: 7862339 - DNA, 23 bp, Homo sapiens
ttgtccttctgaaatatatctgg

SEQ ID NO: 7862340 - DNA, 22 bp, Homo sapiens
ttgtccttcttcattcagtccc

SEQ ID NO: 7862341 - DNA, 20 bp, Homo sapiens
ttggttgagccagggcctgg

SEQ ID NO: 7862342 - DNA, 22 bp, Homo sapiens
ttggttcattttctcatctaga

SEQ ID NO: 7862343 - DNA, 23 bp, Homo sapiens
ttggtttacaggaataagcaggg

SEQ ID NO: 7862344 - DNA, 22 bp, Homo sapiens
ttggttacttttaaacttgtct

SEQ ID NO: 7862345 - DNA, 22 bp, Homo sapiens
ttggttactaaaaactgtttgg

SEQ ID NO: 7862346 - DNA, 22 bp, Homo sapiens
ttggttcaaagggattcaattt

SEQ ID NO: 7862347 - DNA, 22 bp, Homo sapiens
ttggttttatcttaagattctt

SEQ ID NO: 7862348 - DNA, 22 bp, Homo sapiens
ttggtttgttcaccatcaagca

SEQ ID NO: 7862349 - DNA, 22 bp, Homo sapiens
ttggttttcaggggcaggataa

SEQ ID NO: 7862350 - DNA, 22 bp, Homo sapiens
ttggttttctaatgtattaagg

SEQ ID NO: 7862351 - DNA, 22 bp, Homo sapiens
ttggtttagagagtgtggttac

SEQ ID NO: 7862352 - DNA, 22 bp, Homo sapiens
ttggtttactctggggatatct

SEQ ID NO: 7862353 - DNA, 22 bp, Homo sapiens
ttggtttagagagtgtggttac

SEQ ID NO: 7862354 - DNA, 22 bp, Homo sapiens
ttggtttccttaacagcctaaa

SEQ ID NO: 7862355 - DNA, 22 bp, Homo sapiens
ttggtttaggaactggcttgga

SEQ ID NO: 7862356 - DNA, 22 bp, Homo sapiens
tttatataacagagactgctat

SEQ ID NO: 7862357 - DNA, 22 bp, Homo sapiens
tttatataacagagactgctat

SEQ ID NO: 7862358 - DNA, 22 bp, Homo sapiens
tttatataacagagactgctat

SEQ ID NO: 7862359 - DNA, 20 bp, Homo sapiens
tttatagtgatcaatttata

SEQ ID NO: 7862360 - DNA, 22 bp, Homo sapiens
tttatagtcgtctcagtaataa

SEQ ID NO: 7862361 - DNA, 22 bp, Homo sapiens
tttatagttatatacagatgtt

SEQ ID NO: 7862362 - DNA, 22 bp, Homo sapiens
tttatagttatatacagatgtt

SEQ ID NO: 7862363 - DNA, 22 bp, Homo sapiens
tttatagttatatacagatgtt

SEQ ID NO: 7862364 - DNA, 23 bp, Homo sapiens
tttatagcagcatgatttatagt

SEQ ID NO: 7862365 - DNA, 23 bp, Homo sapiens
tttatagcagcatgatttatagt

SEQ ID NO: 7862366 - DNA, 22 bp, Homo sapiens
tttatagcagcatgatttatag

SEQ ID NO: 7862367 - DNA, 23 bp, Homo sapiens
tttatagcagcatgatttatagt

SEQ ID NO: 7862368 - DNA, 23 bp, Homo sapiens
tttatagcagcatgatttatagt

SEQ ID NO: 7862369 - DNA, 23 bp, Homo sapiens
tttatagcagcatgatttataat

SEQ ID NO: 7862370 - DNA, 23 bp, Homo sapiens
tttatagcagcatgatttataat

SEQ ID NO: 7862371 - DNA, 23 bp, Homo sapiens
tttatagcagcatgatttataat

SEQ ID NO: 7862372 - DNA, 22 bp, Homo sapiens
tttatagcagcatgatttataa

SEQ ID NO: 7862373 - DNA, 23 bp, Homo sapiens
tttatagcagcatgatttataat

SEQ ID NO: 7862374 - DNA, 22 bp, Homo sapiens
tttatagtagcatgatttatag

SEQ ID NO: 7862375 - DNA, 22 bp, Homo sapiens
tttatagtagcatgatttataa

SEQ ID NO: 7862376 - DNA, 22 bp, Homo sapiens
tttataggatatgggggaagga

SEQ ID NO: 7862377 - DNA, 22 bp, Homo sapiens
tttattaatgtagcatccatgg

SEQ ID NO: 7862378 - DNA, 22 bp, Homo sapiens
tttattaatgtagcatccatgg

SEQ ID NO: 7862379 - DNA, 22 bp, Homo sapiens
tttattaatgtagcatccatgg

SEQ ID NO: 7862380 - DNA, 22 bp, Homo sapiens
tttattaatgtagcatccatgg

SEQ ID NO: 7862381 - DNA, 22 bp, Homo sapiens
tttattaatgtagcatccatgg

SEQ ID NO: 7862382 - DNA, 22 bp, Homo sapiens
tttattaatgtagcatccatgg

SEQ ID NO: 7862383 - DNA, 22 bp, Homo sapiens
tttattaatgtagcatccatgg

SEQ ID NO: 7862384 - DNA, 22 bp, Homo sapiens
tttattaagatgcgaatgctga

SEQ ID NO: 7862385 - DNA, 22 bp, Homo sapiens
tttattaagatgcgaatgctga

SEQ ID NO: 7862386 - DNA, 22 bp, Homo sapiens
tttattaagatgcgaatgctga

SEQ ID NO: 7862387 - DNA, 22 bp, Homo sapiens
tttattaagatgcgaatgctga

SEQ ID NO: 7862388 - DNA, 22 bp, Homo sapiens
tttattaagatgcgaatgctga

SEQ ID NO: 7862389 - DNA, 22 bp, Homo sapiens
tttattaagatgcgaatgctga

SEQ ID NO: 7862390 - DNA, 22 bp, Homo sapiens
tttattaagatgcgaatgctga

SEQ ID NO: 7862391 - DNA, 22 bp, Homo sapiens
tttattaagatgcgaatgctga

SEQ ID NO: 7862392 - DNA, 22 bp, Homo sapiens
tttattaagatgcgaatgctga

SEQ ID NO: 7862393 - DNA, 21 bp, Homo sapiens
tttattaacaactgtggacgt

SEQ ID NO: 7862394 - DNA, 21 bp, Homo sapiens
tttattaacaactgtggacgt

SEQ ID NO: 7862395 - DNA, 21 bp, Homo sapiens
tttattaacaactgtggacgt

SEQ ID NO: 7862396 - DNA, 21 bp, Homo sapiens
tttattaacaactgtggacgt

SEQ ID NO: 7862397 - DNA, 21 bp, Homo sapiens
tttattaacaactgtggacgt

SEQ ID NO: 7862398 - DNA, 21 bp, Homo sapiens
tttattaacaactgtggacgt

SEQ ID NO: 7862399 - DNA, 21 bp, Homo sapiens
tttattaacaactgtggacgt

SEQ ID NO: 7862400 - DNA, 21 bp, Homo sapiens
tttattaacaactgtggacgt

SEQ ID NO: 7862401 - DNA, 22 bp, Homo sapiens
tttattaaaactgttggctctg

SEQ ID NO: 7862402 - DNA, 22 bp, Homo sapiens
tttattaaaactgttggctctg

SEQ ID NO: 7862403 - DNA, 22 bp, Homo sapiens
tttattaaaactgttggctctg

SEQ ID NO: 7862404 - DNA, 22 bp, Homo sapiens
tttattaaaactgttggctctg

SEQ ID NO: 7862405 - DNA, 22 bp, Homo sapiens
tttattaaaactgttggctctg

SEQ ID NO: 7862406 - DNA, 22 bp, Homo sapiens
tttattaaaactgttggctctg

SEQ ID NO: 7862407 - DNA, 22 bp, Homo sapiens
tttatgtttgcattttcaaaga

SEQ ID NO: 7862408 - DNA, 22 bp, Homo sapiens
tttatgtttgcattttcaaaga

SEQ ID NO: 7862409 - DNA, 22 bp, Homo sapiens
tttattaaaactgttggctctg

SEQ ID NO: 7862410 - DNA, 22 bp, Homo sapiens
tttatgtttgcattttcaaaga

SEQ ID NO: 7862411 - DNA, 22 bp, Homo sapiens
tttataaaatagactgggtcta

SEQ ID NO: 7862412 - DNA, 22 bp, Homo sapiens
tttataaaatagactgggtcta

SEQ ID NO: 7862413 - DNA, 22 bp, Homo sapiens
tttataaaatagactgggtcta

SEQ ID NO: 7862414 - DNA, 22 bp, Homo sapiens
tttataaaatagactgggtcta

SEQ ID NO: 7862415 - DNA, 22 bp, Homo sapiens
tttataaaatagactgggtcta

SEQ ID NO: 7862416 - DNA, 22 bp, Homo sapiens
tttataaaatagactgggtcta

SEQ ID NO: 7862417 - DNA, 22 bp, Homo sapiens
tttataaacagtaccacggtgc

SEQ ID NO: 7862418 - DNA, 22 bp, Homo sapiens
tttataaacagtaccacggtgc

SEQ ID NO: 7862419 - DNA, 22 bp, Homo sapiens
tttataaacagtaccacggtgc

SEQ ID NO: 7862420 - DNA, 22 bp, Homo sapiens
tttataaacagtaccacggtgc

SEQ ID NO: 7862421 - DNA, 22 bp, Homo sapiens
tttataaccaagttctgcttgt

SEQ ID NO: 7862422 - DNA, 22 bp, Homo sapiens
tttataaacagtaccacggtgc

SEQ ID NO: 7862423 - DNA, 22 bp, Homo sapiens
tttataacatttcttacctgtg

SEQ ID NO: 7862424 - DNA, 22 bp, Homo sapiens
tttagttcataaaaccagggtg

SEQ ID NO: 7862425 - DNA, 22 bp, Homo sapiens
tttagttctcccagtcttgatt

SEQ ID NO: 7862426 - DNA, 22 bp, Homo sapiens
tttagttcacaccagggtagca

SEQ ID NO: 7862427 - DNA, 22 bp, Homo sapiens
tttagttattgttacagtatga

SEQ ID NO: 7862428 - DNA, 22 bp, Homo sapiens
tttagttcacaccagggtagca

SEQ ID NO: 7862429 - DNA, 22 bp, Homo sapiens
tttagtttgatgttctactcct

SEQ ID NO: 7862430 - DNA, 22 bp, Homo sapiens
tttagttttaactgaaagctat

SEQ ID NO: 7862431 - DNA, 22 bp, Homo sapiens
tttagttttgatgaaaatgcca

SEQ ID NO: 7862432 - DNA, 22 bp, Homo sapiens
tttagttttgatgaaaatgcca

SEQ ID NO: 7862433 - DNA, 22 bp, Homo sapiens
tttagttttgatgaaaatgcca

SEQ ID NO: 7862434 - DNA, 22 bp, Homo sapiens
tttatacatggagaatttttgc

SEQ ID NO: 7862435 - DNA, 22 bp, Homo sapiens
tttatacctcattcttagcaaa

SEQ ID NO: 7862436 - DNA, 22 bp, Homo sapiens
tttatacctcattcttagcaaa

SEQ ID NO: 7862437 - DNA, 22 bp, Homo sapiens
tttatactccactctgcaagcg

SEQ ID NO: 7862438 - DNA, 22 bp, Homo sapiens
tttatagatgtctgtattataa

SEQ ID NO: 7862439 - DNA, 22 bp, Homo sapiens
tttatagatgtctgtattataa

SEQ ID NO: 7862440 - DNA, 22 bp, Homo sapiens
tttatagacaaactcagaggct

SEQ ID NO: 7862441 - DNA, 22 bp, Homo sapiens
tttatacttcataatgtctatt

SEQ ID NO: 7862442 - DNA, 22 bp, Homo sapiens
tttatagatgtctgtattataa

SEQ ID NO: 7862443 - DNA, 22 bp, Homo sapiens
tttatagatgtctgtattataa

SEQ ID NO: 7862444 - DNA, 22 bp, Homo sapiens
tttataattatctctactctta

SEQ ID NO: 7862445 - DNA, 17 bp, Homo sapiens
tttataattggcctctt

SEQ ID NO: 7862446 - DNA, 22 bp, Homo sapiens
tttataattatctctactctta

SEQ ID NO: 7862447 - DNA, 23 bp, Homo sapiens
tttatacaagaaaccgctggcct

SEQ ID NO: 7862448 - DNA, 23 bp, Homo sapiens
tttatacaagaaaccgctggcct

SEQ ID NO: 7862449 - DNA, 22 bp, Homo sapiens
tttatacatggagaatttttgc

SEQ ID NO: 7862450 - DNA, 22 bp, Homo sapiens
tttatacatggagaatttttgc

SEQ ID NO: 7862451 - DNA, 22 bp, Homo sapiens
tttatacatggagaatttttgc

SEQ ID NO: 7862452 - DNA, 22 bp, Homo sapiens
tttatacatggagaatttttgc

SEQ ID NO: 7862453 - DNA, 22 bp, Homo sapiens
tttattattctgttctctctac

SEQ ID NO: 7862454 - DNA, 22 bp, Homo sapiens
tttattattctgttctctctac

SEQ ID NO: 7862455 - DNA, 22 bp, Homo sapiens
tttattattctctggagaatgt

SEQ ID NO: 7862456 - DNA, 22 bp, Homo sapiens
tttattattctctggagaatgt

SEQ ID NO: 7862457 - DNA, 22 bp, Homo sapiens
tttattatgatggacaccttcg

SEQ ID NO: 7862458 - DNA, 22 bp, Homo sapiens
tttattatgtacaggcactata

SEQ ID NO: 7862459 - DNA, 22 bp, Homo sapiens
tttattatgtacaggcactata

SEQ ID NO: 7862460 - DNA, 22 bp, Homo sapiens
tttattatccagtgttgtcatg

SEQ ID NO: 7862461 - DNA, 22 bp, Homo sapiens
tttattatgatggacaccttcg

SEQ ID NO: 7862462 - DNA, 22 bp, Homo sapiens
tttattatgatggacaccttcg

SEQ ID NO: 7862463 - DNA, 22 bp, Homo sapiens
tttattatgatggacaccttcg

SEQ ID NO: 7862464 - DNA, 22 bp, Homo sapiens
tttattagattatcaaagaggt

SEQ ID NO: 7862465 - DNA, 22 bp, Homo sapiens
tttattagattatcaaagaggt

SEQ ID NO: 7862466 - DNA, 22 bp, Homo sapiens
tttattagattatcaaagaggt

SEQ ID NO: 7862467 - DNA, 22 bp, Homo sapiens
tttattagattatcaaagaggt

SEQ ID NO: 7862468 - DNA, 22 bp, Homo sapiens
tttattacaccaggttaactca

SEQ ID NO: 7862469 - DNA, 22 bp, Homo sapiens
tttattacaccaggttaactca

SEQ ID NO: 7862470 - DNA, 22 bp, Homo sapiens
tttattaattagtgacccaatg

SEQ ID NO: 7862471 - DNA, 22 bp, Homo sapiens
tttattaattagtgacccaatg

SEQ ID NO: 7862472 - DNA, 22 bp, Homo sapiens
tttattaattagtgacccaatg

SEQ ID NO: 7862473 - DNA, 22 bp, Homo sapiens
tttattaattagtgacccaatg

SEQ ID NO: 7862474 - DNA, 22 bp, Homo sapiens
tttattaattagtgacccaatg

SEQ ID NO: 7862475 - DNA, 22 bp, Homo sapiens
tttattaattagtgacccaatg

SEQ ID NO: 7862476 - DNA, 22 bp, Homo sapiens
tttattagtgcttgtatcactg

SEQ ID NO: 7862477 - DNA, 22 bp, Homo sapiens
tttattagtgcttgtatcactg

SEQ ID NO: 7862478 - DNA, 22 bp, Homo sapiens
tttattatagtggtggggactg

SEQ ID NO: 7862479 - DNA, 22 bp, Homo sapiens
tttattatagtggtggggactg

SEQ ID NO: 7862480 - DNA, 22 bp, Homo sapiens
tttattatagtggtggggactg

SEQ ID NO: 7862481 - DNA, 22 bp, Homo sapiens
tttattatccagtgttgtcatg

SEQ ID NO: 7862482 - DNA, 22 bp, Homo sapiens
tttattatccagtgttgtcatg

SEQ ID NO: 7862483 - DNA, 22 bp, Homo sapiens
tttattatccagtgttgtcatg

SEQ ID NO: 7862484 - DNA, 22 bp, Homo sapiens
tttattatccagtgttgtcatg

SEQ ID NO: 7862485 - DNA, 22 bp, Homo sapiens
tttattatccagtgttgtcatg

SEQ ID NO: 7862486 - DNA, 22 bp, Homo sapiens
tttattatccagtgttgtcatg

SEQ ID NO: 7862487 - DNA, 22 bp, Homo sapiens
tttatttgtcttgccatttagt

SEQ ID NO: 7862488 - DNA, 22 bp, Homo sapiens
tttcaaaattttgcagtggtaa

SEQ ID NO: 7862489 - DNA, 22 bp, Homo sapiens
tttcaaaattttgcagtggtaa

SEQ ID NO: 7862490 - DNA, 22 bp, Homo sapiens
tttcaaaattttgcagtggtaa

SEQ ID NO: 7862491 - DNA, 22 bp, Homo sapiens
tttcaaaagcgtacgtagtgaa

SEQ ID NO: 7862492 - DNA, 22 bp, Homo sapiens
tttatttgtcttgccatttagt

SEQ ID NO: 7862493 - DNA, 22 bp, Homo sapiens
tttcaaaattttgcagtggtaa

SEQ ID NO: 7862494 - DNA, 22 bp, Homo sapiens
tttcaaaattttgcagtggtaa

SEQ ID NO: 7862495 - DNA, 22 bp, Homo sapiens
tttcaaacatatcttcattact

SEQ ID NO: 7862496 - DNA, 22 bp, Homo sapiens
tttcaaacatagatctgaatat

SEQ ID NO: 7862497 - DNA, 22 bp, Homo sapiens
tttcaaacatagatctgaatat

SEQ ID NO: 7862498 - DNA, 22 bp, Homo sapiens
tttcaaacatagatctgaatat

SEQ ID NO: 7862499 - DNA, 22 bp, Homo sapiens
tttcaaacatatcttcattact

SEQ ID NO: 7862500 - DNA, 22 bp, Homo sapiens
tttcaaacatagatctgaatat

SEQ ID NO: 7862501 - DNA, 22 bp, Homo sapiens
tttcaaacttaaatacctttcc

SEQ ID NO: 7862502 - DNA, 22 bp, Homo sapiens
tttcaaactgtactttccccta

SEQ ID NO: 7862503 - DNA, 22 bp, Homo sapiens
tttcaaactgcccagcacacct

SEQ ID NO: 7862504 - DNA, 22 bp, Homo sapiens
tttcaaactccagctcaccaat

SEQ ID NO: 7862505 - DNA, 22 bp, Homo sapiens
tttcaaactgggagtgagggga

SEQ ID NO: 7862506 - DNA, 22 bp, Homo sapiens
tttcaaactgcccagcacacct

SEQ ID NO: 7862507 - DNA, 22 bp, Homo sapiens
tttcaaacctacttgtatgttt

SEQ ID NO: 7862508 - DNA, 22 bp, Homo sapiens
tttcaaactatgtgtcaggcag

SEQ ID NO: 7862509 - DNA, 22 bp, Homo sapiens
tttcaaacctacttgtatgttt

SEQ ID NO: 7862510 - DNA, 20 bp, Homo sapiens
tttcaaactgcacctttgct

SEQ ID NO: 7862511 - DNA, 22 bp, Homo sapiens
tttcaaaccactgaggttctga

SEQ ID NO: 7862512 - DNA, 22 bp, Homo sapiens
tttcaaaccactgaggttctga

SEQ ID NO: 7862513 - DNA, 22 bp, Homo sapiens
tttcaaacattcctgggagact

SEQ ID NO: 7862514 - DNA, 22 bp, Homo sapiens
tttcaaacattcctgggagact

SEQ ID NO: 7862515 - DNA, 22 bp, Homo sapiens
tttatttggcatctctgccaag

SEQ ID NO: 7862516 - DNA, 22 bp, Homo sapiens
tttatttggcatccagggagaa

SEQ ID NO: 7862517 - DNA, 22 bp, Homo sapiens
tttatttggcatccagggagaa

SEQ ID NO: 7862518 - DNA, 22 bp, Homo sapiens
tttatttggcatccagggagaa

SEQ ID NO: 7862519 - DNA, 22 bp, Homo sapiens
tttatttggcatctctgccaag

SEQ ID NO: 7862520 - DNA, 22 bp, Homo sapiens
tttatttggcatctctgccaag

SEQ ID NO: 7862521 - DNA, 22 bp, Homo sapiens
tttatttgtcttgccatttagt

SEQ ID NO: 7862522 - DNA, 22 bp, Homo sapiens
tttatttgtcttgccatttagt

SEQ ID NO: 7862523 - DNA, 22 bp, Homo sapiens
tttatttgtcttgccatttagt

SEQ ID NO: 7862524 - DNA, 22 bp, Homo sapiens
tttatttgtcttgccatttagt

SEQ ID NO: 7862525 - DNA, 22 bp, Homo sapiens
tttatttcactctccggatact

SEQ ID NO: 7862526 - DNA, 22 bp, Homo sapiens
tttatttcactctccggatact

SEQ ID NO: 7862527 - DNA, 22 bp, Homo sapiens
tttatttcttagtttgccacag

SEQ ID NO: 7862528 - DNA, 22 bp, Homo sapiens
tttattattctgttctctctac

SEQ ID NO: 7862529 - DNA, 23 bp, Homo sapiens
tttatttatttaggctgagggat

SEQ ID NO: 7862530 - DNA, 23 bp, Homo sapiens
tttatttatttaggctgagggat

SEQ ID NO: 7862531 - DNA, 22 bp, Homo sapiens
tttatttgaatcaggggagaat

SEQ ID NO: 7862532 - DNA, 22 bp, Homo sapiens
tttatttcttagtttgccacag

SEQ ID NO: 7862533 - DNA, 22 bp, Homo sapiens
tttatttgaatcaggggagaat

SEQ ID NO: 7862534 - DNA, 19 bp, Homo sapiens
tttatttgagacatgcctt

SEQ ID NO: 7862535 - DNA, 22 bp, Homo sapiens
tttaattttcctcttcctggag

SEQ ID NO: 7862536 - DNA, 22 bp, Homo sapiens
tttaattttcctggtaggcctg

SEQ ID NO: 7862537 - DNA, 22 bp, Homo sapiens
tttaattttcctggtaggcctg

SEQ ID NO: 7862538 - DNA, 22 bp, Homo sapiens
tttaattttcctggtaggcctg

SEQ ID NO: 7862539 - DNA, 22 bp, Homo sapiens
tttaattttcctcttcctggag

SEQ ID NO: 7862540 - DNA, 22 bp, Homo sapiens
tttaattttctgggcccagcag

SEQ ID NO: 7862541 - DNA, 22 bp, Homo sapiens
tttacaacctcatattctgatg

SEQ ID NO: 7862542 - DNA, 22 bp, Homo sapiens
tttaattttctgggcccagcag

SEQ ID NO: 7862543 - DNA, 22 bp, Homo sapiens
tttaatttgtatttctagaggg

SEQ ID NO: 7862544 - DNA, 22 bp, Homo sapiens
tttaatttgtatttctagaggg

SEQ ID NO: 7862545 - DNA, 22 bp, Homo sapiens
tttaatttgtatttctagaggg

SEQ ID NO: 7862546 - DNA, 22 bp, Homo sapiens
tttaattttcctcttcctggag

SEQ ID NO: 7862547 - DNA, 22 bp, Homo sapiens
tttaattttcctcttcctggag

SEQ ID NO: 7862548 - DNA, 22 bp, Homo sapiens
tttaattttcctcttcctggag

SEQ ID NO: 7862549 - DNA, 21 bp, Homo sapiens
tttaatttgcatgtatgacgc

SEQ ID NO: 7862550 - DNA, 21 bp, Homo sapiens
tttaatttgcatgtatgacgc

SEQ ID NO: 7862551 - DNA, 21 bp, Homo sapiens
tttaatttgcatgtatgacgc

SEQ ID NO: 7862552 - DNA, 21 bp, Homo sapiens
tttaatttgcatgtatgacgc

SEQ ID NO: 7862553 - DNA, 22 bp, Homo sapiens
tttaatttgtatttctagaggg

SEQ ID NO: 7862554 - DNA, 22 bp, Homo sapiens
tttaattgattcacagtctgta

SEQ ID NO: 7862555 - DNA, 22 bp, Homo sapiens
tttaattgattcacagtctgta

SEQ ID NO: 7862556 - DNA, 22 bp, Homo sapiens
tttaatgtttgagtcagtatat

SEQ ID NO: 7862557 - DNA, 22 bp, Homo sapiens
tttaattgcatttaaagatgga

SEQ ID NO: 7862558 - DNA, 22 bp, Homo sapiens
tttaattgcatttaaagatgga

SEQ ID NO: 7862559 - DNA, 22 bp, Homo sapiens
tttaattgcatttaaagatgga

SEQ ID NO: 7862560 - DNA, 22 bp, Homo sapiens
tttaattgcatttaaagatgga

SEQ ID NO: 7862561 - DNA, 22 bp, Homo sapiens
tttaatttgaaatgagtaaccc

SEQ ID NO: 7862562 - DNA, 22 bp, Homo sapiens
tttaatttgaaatgagtaaccc

SEQ ID NO: 7862563 - DNA, 22 bp, Homo sapiens
tttaatttgaaatgagtaaccc

SEQ ID NO: 7862564 - DNA, 22 bp, Homo sapiens
tttaatttgaaatgagtaaccc

SEQ ID NO: 7862565 - DNA, 22 bp, Homo sapiens
tttaattgttgtgggtacatag

SEQ ID NO: 7862566 - DNA, 22 bp, Homo sapiens
tttaattgttgtgggtacatag

SEQ ID NO: 7862567 - DNA, 22 bp, Homo sapiens
tttaaaatcagatgggagttgg

SEQ ID NO: 7862568 - DNA, 22 bp, Homo sapiens
tttaaaatcagatgggagttgg

SEQ ID NO: 7862569 - DNA, 22 bp, Homo sapiens
tttaaaatcagatgggagttgg

SEQ ID NO: 7862570 - DNA, 23 bp, Homo sapiens
tttaaaagttgtaatgtaggctt

SEQ ID NO: 7862571 - DNA, 23 bp, Homo sapiens
tttaaaagttgtaatgtaggctt

SEQ ID NO: 7862572 - DNA, 23 bp, Homo sapiens
tttaaaagttgtaatgtaggctt

SEQ ID NO: 7862573 - DNA, 22 bp, Homo sapiens
tttaaaaaactagtctgagtct

SEQ ID NO: 7862574 - DNA, 22 bp, Homo sapiens
tttaaaagttatcatctgtcca

SEQ ID NO: 7862575 - DNA, 22 bp, Homo sapiens
ttgtttttaaacatgtgactga

SEQ ID NO: 7862576 - DNA, 22 bp, Homo sapiens
ttgtttttagagaagccctgaa

SEQ ID NO: 7862577 - DNA, 22 bp, Homo sapiens
ttgtttttagagaagccctgaa

SEQ ID NO: 7862578 - DNA, 22 bp, Homo sapiens
ttgtttttagagaagccctgaa

SEQ ID NO: 7862579 - DNA, 22 bp, Homo sapiens
ttgtttttagagaagccctgaa

SEQ ID NO: 7862580 - DNA, 22 bp, Homo sapiens
ttgtttttagagaagccctgaa

SEQ ID NO: 7862581 - DNA, 23 bp, Homo sapiens
ttgtttttagaggtggcatgaga

SEQ ID NO: 7862582 - DNA, 22 bp, Homo sapiens
ttgtttttatgaacatccagga

SEQ ID NO: 7862583 - DNA, 23 bp, Homo sapiens
ttgtttttagaggtggcatgaga

SEQ ID NO: 7862584 - DNA, 22 bp, Homo sapiens
ttgtttttatgaacatccagga

SEQ ID NO: 7862585 - DNA, 22 bp, Homo sapiens
ttgtttttgtgaggcagcccat

SEQ ID NO: 7862586 - DNA, 22 bp, Homo sapiens
tttaaaatttagacctctccac

SEQ ID NO: 7862587 - DNA, 22 bp, Homo sapiens
tttaaaatttagacctctccac

SEQ ID NO: 7862588 - DNA, 22 bp, Homo sapiens
tttaaaatttagacctctccac

SEQ ID NO: 7862589 - DNA, 22 bp, Homo sapiens
tttaaaatttagacctctccac

SEQ ID NO: 7862590 - DNA, 22 bp, Homo sapiens
tttaaaatttagacctctccac

SEQ ID NO: 7862591 - DNA, 22 bp, Homo sapiens
tttaaaatcagatgggagttgg

SEQ ID NO: 7862592 - DNA, 22 bp, Homo sapiens
tttaaaatttagacctctccac

SEQ ID NO: 7862593 - DNA, 22 bp, Homo sapiens
tttaaaatcagatgggagttgg

SEQ ID NO: 7862594 - DNA, 22 bp, Homo sapiens
tttaaaatcagatgggagttgg

SEQ ID NO: 7862595 - DNA, 22 bp, Homo sapiens
tttaaacaaataggattgccta

SEQ ID NO: 7862596 - DNA, 22 bp, Homo sapiens
tttaaacaaataggattgccta

SEQ ID NO: 7862597 - DNA, 22 bp, Homo sapiens
tttaaacaaataggattgccta

SEQ ID NO: 7862598 - DNA, 22 bp, Homo sapiens
tttaaacatatctgttgaggga

SEQ ID NO: 7862599 - DNA, 22 bp, Homo sapiens
tttaatgtttgagtcagtatat

SEQ ID NO: 7862600 - DNA, 22 bp, Homo sapiens
tttaatgtttgagtcagtatat

SEQ ID NO: 7862601 - DNA, 22 bp, Homo sapiens
tttaatgttcatctcaaaggat

SEQ ID NO: 7862602 - DNA, 19 bp, Homo sapiens
tttaatgtgtgctgcaatc

SEQ ID NO: 7862603 - DNA, 22 bp, Homo sapiens
tttaatgttaaatttgtagatg

SEQ ID NO: 7862604 - DNA, 22 bp, Homo sapiens
tttaatgttaaatttgtagatg

SEQ ID NO: 7862605 - DNA, 22 bp, Homo sapiens
tttaatgttaaatttgtagatg

SEQ ID NO: 7862606 - DNA, 22 bp, Homo sapiens
tttacaacctcatattctgatg

SEQ ID NO: 7862607 - DNA, 22 bp, Homo sapiens
tttacaacctcatattctgatg

SEQ ID NO: 7862608 - DNA, 22 bp, Homo sapiens
tttacaactttctgttctgtat

SEQ ID NO: 7862609 - DNA, 22 bp, Homo sapiens
tttacaacgttcctggtgctaa

SEQ ID NO: 7862610 - DNA, 22 bp, Homo sapiens
tttacaaggatcaagggatctc

SEQ ID NO: 7862611 - DNA, 22 bp, Homo sapiens
tttacaaggatcaagggatctc

SEQ ID NO: 7862612 - DNA, 22 bp, Homo sapiens
tttacaaggcagaactgattaa

SEQ ID NO: 7862613 - DNA, 22 bp, Homo sapiens
tttacaagaaatcatgatgcta

SEQ ID NO: 7862614 - DNA, 22 bp, Homo sapiens
tttacaagaaatcatgatgcta

SEQ ID NO: 7862615 - DNA, 22 bp, Homo sapiens
tttacaaggcagaactgattaa

SEQ ID NO: 7862616 - DNA, 22 bp, Homo sapiens
tttacaaggcagaactgattaa

SEQ ID NO: 7862617 - DNA, 22 bp, Homo sapiens
tttacaaggcagaactgattaa

SEQ ID NO: 7862618 - DNA, 22 bp, Homo sapiens
tttacaaggcagttattttcct

SEQ ID NO: 7862619 - DNA, 22 bp, Homo sapiens
tttacaaggcagttattttcct

SEQ ID NO: 7862620 - DNA, 22 bp, Homo sapiens
tttacaaggcagttattttcct

SEQ ID NO: 7862621 - DNA, 22 bp, Homo sapiens
tttacaaggcagttattttcct

SEQ ID NO: 7862622 - DNA, 22 bp, Homo sapiens
tttacaagtacacctaacagct

SEQ ID NO: 7862623 - DNA, 22 bp, Homo sapiens
tttaccaggagtcagaaggact

SEQ ID NO: 7862624 - DNA, 22 bp, Homo sapiens
tttaccagtgttaaacaccagc

SEQ ID NO: 7862625 - DNA, 22 bp, Homo sapiens
tttaccagtgttaaacaccagc

SEQ ID NO: 7862626 - DNA, 22 bp, Homo sapiens
tttaccagtgaggaaaatgagg

SEQ ID NO: 7862627 - DNA, 22 bp, Homo sapiens
tttaccagtgaggaaaatgagg

SEQ ID NO: 7862628 - DNA, 22 bp, Homo sapiens
tttaccagtgaggaaaatgagg

SEQ ID NO: 7862629 - DNA, 22 bp, Homo sapiens
tttaccagtgaggaaaatgagg

SEQ ID NO: 7862630 - DNA, 22 bp, Homo sapiens
tttaccatacatcaaaatattt

SEQ ID NO: 7862631 - DNA, 22 bp, Homo sapiens
tttactaagcccagttatatgc

SEQ ID NO: 7862632 - DNA, 22 bp, Homo sapiens
tttactaagtacttgtatccct

SEQ ID NO: 7862633 - DNA, 22 bp, Homo sapiens
tttactaagtacttgtatccct

SEQ ID NO: 7862634 - DNA, 22 bp, Homo sapiens
tttactcaagtatgcatttatg

SEQ ID NO: 7862635 - DNA, 22 bp, Homo sapiens
tttactacttcattgacttacg

SEQ ID NO: 7862636 - DNA, 22 bp, Homo sapiens
tttactaacaccatacatgctg

SEQ ID NO: 7862637 - DNA, 22 bp, Homo sapiens
tttactaacaccatacatgctg

SEQ ID NO: 7862638 - DNA, 22 bp, Homo sapiens
tttactaacaccatacatgctg

SEQ ID NO: 7862639 - DNA, 22 bp, Homo sapiens
tttactaacaccatacatgctg

SEQ ID NO: 7862640 - DNA, 22 bp, Homo sapiens
tttactaagcccagttatatgc

SEQ ID NO: 7862641 - DNA, 22 bp, Homo sapiens
tttacctggattcttacttcct

SEQ ID NO: 7862642 - DNA, 22 bp, Homo sapiens
tttacccattcagactcacttg

SEQ ID NO: 7862643 - DNA, 22 bp, Homo sapiens
tttaccttcttttaactacagt

SEQ ID NO: 7862644 - DNA, 22 bp, Homo sapiens
tttaccttcttttaactacagt

SEQ ID NO: 7862645 - DNA, 22 bp, Homo sapiens
tttacctggattcttacttcct

SEQ ID NO: 7862646 - DNA, 19 bp, Homo sapiens
tttaccttcttgagagcag

SEQ ID NO: 7862647 - DNA, 19 bp, Homo sapiens
tttaccttcttgagagcag

SEQ ID NO: 7862648 - DNA, 22 bp, Homo sapiens
tttaccttcttttaactacagt

SEQ ID NO: 7862649 - DNA, 22 bp, Homo sapiens
tttacctttgtgggtctccctc

SEQ ID NO: 7862650 - DNA, 22 bp, Homo sapiens
tttaccttttgctatggtggaa

SEQ ID NO: 7862651 - DNA, 22 bp, Homo sapiens
tttaccttttgctatggtggaa

SEQ ID NO: 7862652 - DNA, 22 bp, Homo sapiens
tttacccatattagcatcaagt

SEQ ID NO: 7862653 - DNA, 22 bp, Homo sapiens
tttaccatcctcttttagaatt

SEQ ID NO: 7862654 - DNA, 22 bp, Homo sapiens
tttaccatcctcttttagaatt

SEQ ID NO: 7862655 - DNA, 19 bp, Homo sapiens
tttactctccaaggtgagt

SEQ ID NO: 7862656 - DNA, 18 bp, Homo sapiens
tttactcataggcctgac

SEQ ID NO: 7862657 - DNA, 22 bp, Homo sapiens
tttactgaatttggtatattcc

SEQ ID NO: 7862658 - DNA, 22 bp, Homo sapiens
tttactgaactgctagtacagg

SEQ ID NO: 7862659 - DNA, 22 bp, Homo sapiens
tttactgaactgctagtacagg

SEQ ID NO: 7862660 - DNA, 21 bp, Homo sapiens
tttactgagcacttactatgt

SEQ ID NO: 7862661 - DNA, 22 bp, Homo sapiens
tttactgacctccaatcccact

SEQ ID NO: 7862662 - DNA, 22 bp, Homo sapiens
tttactgaatttggtatattcc

SEQ ID NO: 7862663 - DNA, 22 bp, Homo sapiens
tttactgagtgacctagaataa

SEQ ID NO: 7862664 - DNA, 22 bp, Homo sapiens
tttactgagtgacctagaataa

SEQ ID NO: 7862665 - DNA, 21 bp, Homo sapiens
tttactgagcacttactatgt

SEQ ID NO: 7862666 - DNA, 21 bp, Homo sapiens
tttactgagcacttactatgt

SEQ ID NO: 7862667 - DNA, 22 bp, Homo sapiens
tttacttctgcatttcccctag

SEQ ID NO: 7862668 - DNA, 22 bp, Homo sapiens
tttacttgatatggagctgagg

SEQ ID NO: 7862669 - DNA, 22 bp, Homo sapiens
tttacttgatatggagctgagg

SEQ ID NO: 7862670 - DNA, 22 bp, Homo sapiens
tttacttgatatggagctgagg

SEQ ID NO: 7862671 - DNA, 22 bp, Homo sapiens
tttactttctcaagtatatagg

SEQ ID NO: 7862672 - DNA, 22 bp, Homo sapiens
tttacttgttctgctgaattct

SEQ ID NO: 7862673 - DNA, 22 bp, Homo sapiens
tttacttgttctgctgaattct

SEQ ID NO: 7862674 - DNA, 22 bp, Homo sapiens
tttactgttcaacttgcaagta

SEQ ID NO: 7862675 - DNA, 22 bp, Homo sapiens
tttactgttttatattgtccag

SEQ ID NO: 7862676 - DNA, 22 bp, Homo sapiens
tttacttcatttccagtgagga

SEQ ID NO: 7862677 - DNA, 22 bp, Homo sapiens
tttactgtgtccatctgtgact

SEQ ID NO: 7862678 - DNA, 22 bp, Homo sapiens
tttactgttacacctaccttct

SEQ ID NO: 7862679 - DNA, 22 bp, Homo sapiens
tttactgttacacctaccttct

SEQ ID NO: 7862680 - DNA, 22 bp, Homo sapiens
tttactgtctcagagagacaaa

SEQ ID NO: 7862681 - DNA, 22 bp, Homo sapiens
tttactgagtgacctagaataa

SEQ ID NO: 7862682 - DNA, 22 bp, Homo sapiens
tttactgtctcagagagacaaa

SEQ ID NO: 7862683 - DNA, 22 bp, Homo sapiens
tttactgtgcattagaatcacc

SEQ ID NO: 7862684 - DNA, 22 bp, Homo sapiens
tttactgtgcattagaatcacc

SEQ ID NO: 7862685 - DNA, 22 bp, Homo sapiens
tttagttattgttacagtatga

SEQ ID NO: 7862686 - DNA, 20 bp, Homo sapiens
tttagaagaatgagcacttt

SEQ ID NO: 7862687 - DNA, 22 bp, Homo sapiens
tttagttattgttacagtatga

SEQ ID NO: 7862688 - DNA, 22 bp, Homo sapiens
tttagaacagatattgtaactt

SEQ ID NO: 7862689 - DNA, 22 bp, Homo sapiens
tttagaacagatattgtaactt

SEQ ID NO: 7862690 - DNA, 22 bp, Homo sapiens
tttagaacaatgtgtagaaaaa

SEQ ID NO: 7862691 - DNA, 22 bp, Homo sapiens
tttagaaattgcagagtgggtg

SEQ ID NO: 7862692 - DNA, 22 bp, Homo sapiens
tttagaaattcatctatggcct

SEQ ID NO: 7862693 - DNA, 22 bp, Homo sapiens
tttacttttggtaaggtcattt

SEQ ID NO: 7862694 - DNA, 22 bp, Homo sapiens
tttagaaattcatctatggcct

SEQ ID NO: 7862695 - DNA, 22 bp, Homo sapiens
tttagaaattcatctatggcct

SEQ ID NO: 7862696 - DNA, 22 bp, Homo sapiens
tttagaaattcatctatggcct

SEQ ID NO: 7862697 - DNA, 22 bp, Homo sapiens
tttactttctcaagtatatagg

SEQ ID NO: 7862698 - DNA, 22 bp, Homo sapiens
tttactttctcaagtatatagg

SEQ ID NO: 7862699 - DNA, 22 bp, Homo sapiens
tttactttctcaagtatatagg

SEQ ID NO: 7862700 - DNA, 22 bp, Homo sapiens
tttactttctcaagtatatagg

SEQ ID NO: 7862701 - DNA, 22 bp, Homo sapiens
tttactttgtgtcaagtcaaga

SEQ ID NO: 7862702 - DNA, 22 bp, Homo sapiens
tttactttgtgtcaagtcaaga

SEQ ID NO: 7862703 - DNA, 22 bp, Homo sapiens
tttactttgtgtcaagtcaaga

SEQ ID NO: 7862704 - DNA, 22 bp, Homo sapiens
tttactttgtgtcaagtcaaga

SEQ ID NO: 7862705 - DNA, 22 bp, Homo sapiens
tttactttgtgtcaagtcaaga

SEQ ID NO: 7862706 - DNA, 22 bp, Homo sapiens
tttactttgtgtcaagtcaaga

SEQ ID NO: 7862707 - DNA, 22 bp, Homo sapiens
tttggcaagtgggaaattagta

SEQ ID NO: 7862708 - DNA, 22 bp, Homo sapiens
tttggcaatatctgaattatag

SEQ ID NO: 7862709 - DNA, 22 bp, Homo sapiens
tttggcaatttgactgtatagg

SEQ ID NO: 7862710 - DNA, 22 bp, Homo sapiens
tttggcaagaaaatgtgattga

SEQ ID NO: 7862711 - DNA, 22 bp, Homo sapiens
tttggcacattctgtcacattc

SEQ ID NO: 7862712 - DNA, 22 bp, Homo sapiens
tttggcaccaaaggagaagatc

SEQ ID NO: 7862713 - DNA, 22 bp, Homo sapiens
tttggcacctccaaggactcgc

SEQ ID NO: 7862714 - DNA, 22 bp, Homo sapiens
tttggcagagtcatttcagaaa

SEQ ID NO: 7862715 - DNA, 22 bp, Homo sapiens
tttggcagagtaaggcctgctt

SEQ ID NO: 7862716 - DNA, 22 bp, Homo sapiens
tttggcagagtcatttcagaaa

SEQ ID NO: 7862717 - DNA, 22 bp, Homo sapiens
tttggcagaggttgtcaggcca

SEQ ID NO: 7862718 - DNA, 23 bp, Homo sapiens
tttggcagaagcacattattgtg

SEQ ID NO: 7862719 - DNA, 22 bp, Homo sapiens
tttggcagaaataagtggggca

SEQ ID NO: 7862720 - DNA, 22 bp, Homo sapiens
tttggcagaattgatggtcctt

SEQ ID NO: 7862721 - DNA, 22 bp, Homo sapiens
tttggcagaggaagaaggcaca

SEQ ID NO: 7862722 - DNA, 22 bp, Homo sapiens
tttggcacttggcagttgagtt

SEQ ID NO: 7862723 - DNA, 22 bp, Homo sapiens
tttggcagaaataagtggggca

SEQ ID NO: 7862724 - DNA, 19 bp, Homo sapiens
tttggcactctgaagtgtt

SEQ ID NO: 7862725 - DNA, 22 bp, Homo sapiens
tttggcactgttctaggtgcaa

SEQ ID NO: 7862726 - DNA, 22 bp, Homo sapiens
tttgtacaattagcagaggcta

SEQ ID NO: 7862727 - DNA, 22 bp, Homo sapiens
tttgtacaattagcagaggcta

SEQ ID NO: 7862728 - DNA, 22 bp, Homo sapiens
tttgtacaattagcagaggcta

SEQ ID NO: 7862729 - DNA, 22 bp, Homo sapiens
tttgtacaattagcagaggcta

SEQ ID NO: 7862730 - DNA, 17 bp, Homo sapiens
tttgtacaacattttaa

SEQ ID NO: 7862731 - DNA, 22 bp, Homo sapiens
tttgtacacaacctgtggtagt

SEQ ID NO: 7862732 - DNA, 22 bp, Homo sapiens
tttgtacacaacctgtggtagt

SEQ ID NO: 7862733 - DNA, 22 bp, Homo sapiens
tttgtacacaggatgttataat

SEQ ID NO: 7862734 - DNA, 22 bp, Homo sapiens
tttgtacaattagcagaggcta

SEQ ID NO: 7862735 - DNA, 22 bp, Homo sapiens
tttgtacacaacctgtggtagt

SEQ ID NO: 7862736 - DNA, 22 bp, Homo sapiens
tttgtacacaggatgttataat

SEQ ID NO: 7862737 - DNA, 23 bp, Homo sapiens
tttgtacattgaggaggcagaat

SEQ ID NO: 7862738 - DNA, 23 bp, Homo sapiens
tttgtacattgaggaggcagaat

SEQ ID NO: 7862739 - DNA, 23 bp, Homo sapiens
tttgtacattgaggaggcagaat

SEQ ID NO: 7862740 - DNA, 23 bp, Homo sapiens
tttgtacattgaggaggcagaat

SEQ ID NO: 7862741 - DNA, 22 bp, Homo sapiens
tttgtacattcaaatgtcccat

SEQ ID NO: 7862742 - DNA, 22 bp, Homo sapiens
tttgtacatgtaagattgcatc

SEQ ID NO: 7862743 - DNA, 22 bp, Homo sapiens
tttgtacatgtaagattgcatc

SEQ ID NO: 7862744 - DNA, 22 bp, Homo sapiens
tttgtacatgaatgtgcaccca

SEQ ID NO: 7862745 - DNA, 22 bp, Homo sapiens
tttggcagcacccgccatctat

SEQ ID NO: 7862746 - DNA, 22 bp, Homo sapiens
tttggcagatgaccctcaagtt

SEQ ID NO: 7862747 - DNA, 22 bp, Homo sapiens
tttggcagagtgtgggcatttg

SEQ ID NO: 7862748 - DNA, 19 bp, Homo sapiens
tttggcagcattaatatca

SEQ ID NO: 7862749 - DNA, 22 bp, Homo sapiens
tttggcagcacccgccatctat

SEQ ID NO: 7862750 - DNA, 22 bp, Homo sapiens
tttggcagctcttgactgttct

SEQ ID NO: 7862751 - DNA, 22 bp, Homo sapiens
tttggcagctctacctttttat

SEQ ID NO: 7862752 - DNA, 22 bp, Homo sapiens
tttggcagctaaggcagctcgc

SEQ ID NO: 7862753 - DNA, 22 bp, Homo sapiens
tttggcaggtggcagctctggg

SEQ ID NO: 7862754 - DNA, 22 bp, Homo sapiens
tttggcaggtagtcccaaaggg

SEQ ID NO: 7862755 - DNA, 19 bp, Homo sapiens
tttggcaggagataggatg

SEQ ID NO: 7862756 - DNA, 22 bp, Homo sapiens
tttggcaggtagtcccaaaggg

SEQ ID NO: 7862757 - DNA, 19 bp, Homo sapiens
tttggcaggagataggatg

SEQ ID NO: 7862758 - DNA, 22 bp, Homo sapiens
tttggcagcttccatattcact

SEQ ID NO: 7862759 - DNA, 17 bp, Homo sapiens
tttgtacaacattttaa

SEQ ID NO: 7862760 - DNA, 17 bp, Homo sapiens
tttgtacaacattttaa

SEQ ID NO: 7862761 - DNA, 22 bp, Homo sapiens
tttgtaatgataatgttaaatt

SEQ ID NO: 7862762 - DNA, 22 bp, Homo sapiens
tttggatttggggatggagtat

SEQ ID NO: 7862763 - DNA, 22 bp, Homo sapiens
tttggcaaacataagcctttct

SEQ ID NO: 7862764 - DNA, 22 bp, Homo sapiens
tttggcaaacataagcctttct

SEQ ID NO: 7862765 - DNA, 22 bp, Homo sapiens
tttggcaaaactgtgtctatct

SEQ ID NO: 7862766 - DNA, 22 bp, Homo sapiens
tttggagtttaacaacttgaag

SEQ ID NO: 7862767 - DNA, 22 bp, Homo sapiens
tttggatatgtttctgtcttct

SEQ ID NO: 7862768 - DNA, 22 bp, Homo sapiens
tttggcaaaggtcagagactcc

SEQ ID NO: 7862769 - DNA, 22 bp, Homo sapiens
tttggcaaaggtcagagactcc

SEQ ID NO: 7862770 - DNA, 22 bp, Homo sapiens
tttggcaaattcttggtagtat

SEQ ID NO: 7862771 - DNA, 22 bp, Homo sapiens
tttggcaacctcaatggctcta

SEQ ID NO: 7862772 - DNA, 22 bp, Homo sapiens
tttggcaaagatggctagctgt

SEQ ID NO: 7862773 - DNA, 22 bp, Homo sapiens
tttggcaaagatcaacatgtta

SEQ ID NO: 7862774 - DNA, 22 bp, Homo sapiens
tttggcaaacttttaggacttt

SEQ ID NO: 7862775 - DNA, 22 bp, Homo sapiens
tttggcaaacttttaggacttt

SEQ ID NO: 7862776 - DNA, 22 bp, Homo sapiens
tttggagaagttgctaaagtgt

SEQ ID NO: 7862777 - DNA, 22 bp, Homo sapiens
tttggagagagttaaatatgtt

SEQ ID NO: 7862778 - DNA, 20 bp, Homo sapiens
tttggagagaaagaagtagt

SEQ ID NO: 7862779 - DNA, 22 bp, Homo sapiens
tttggagaaaagttgagaccat

SEQ ID NO: 7862780 - DNA, 22 bp, Homo sapiens
tttggagaaatggctgatcaaa

SEQ ID NO: 7862781 - DNA, 22 bp, Homo sapiens
tttggagaaatggctgatcaaa

SEQ ID NO: 7862782 - DNA, 22 bp, Homo sapiens
tttggagaaatggctgatcaaa

SEQ ID NO: 7862783 - DNA, 22 bp, Homo sapiens
tttggagagcagctaggccctt

SEQ ID NO: 7862784 - DNA, 22 bp, Homo sapiens
tttggagagatgaagttctgtg

SEQ ID NO: 7862785 - DNA, 22 bp, Homo sapiens
tttggagatagggcctagcaat

SEQ ID NO: 7862786 - DNA, 22 bp, Homo sapiens
tttggagatagggcctagcaat

SEQ ID NO: 7862787 - DNA, 22 bp, Homo sapiens
tttggagagcagctaggccctt

SEQ ID NO: 7862788 - DNA, 22 bp, Homo sapiens
tttggaggggaagaccttggag

SEQ ID NO: 7862789 - DNA, 22 bp, Homo sapiens
tttggagatggagagagggcat

SEQ ID NO: 7862790 - DNA, 22 bp, Homo sapiens
tttggacaaatgtctgactttc

SEQ ID NO: 7862791 - DNA, 22 bp, Homo sapiens
tttggacaagttactggtttcc

SEQ ID NO: 7862792 - DNA, 19 bp, Homo sapiens
tttggacagagtgtccagg

SEQ ID NO: 7862793 - DNA, 22 bp, Homo sapiens
tttggacacattatttatcttc

SEQ ID NO: 7862794 - DNA, 22 bp, Homo sapiens
tttggacatgagtctttaatct

SEQ ID NO: 7862795 - DNA, 22 bp, Homo sapiens
tttggacatgagtctttaatct

SEQ ID NO: 7862796 - DNA, 22 bp, Homo sapiens
tttggacatgttgagtctgata

SEQ ID NO: 7862797 - DNA, 22 bp, Homo sapiens
tttggacatgttgagtctgata

SEQ ID NO: 7862798 - DNA, 22 bp, Homo sapiens
tttggacatgttgagtctgata

SEQ ID NO: 7862799 - DNA, 22 bp, Homo sapiens
tttggactactgggaccttgtg

SEQ ID NO: 7862800 - DNA, 22 bp, Homo sapiens
tttggacaaatgtctgactttc

SEQ ID NO: 7862801 - DNA, 22 bp, Homo sapiens
tttggacttagcctgcagaatt

SEQ ID NO: 7862802 - DNA, 22 bp, Homo sapiens
tttggaaggtgaggcatgaagg

SEQ ID NO: 7862803 - DNA, 22 bp, Homo sapiens
tttggaaggtgaggcatgaagg

SEQ ID NO: 7862804 - DNA, 22 bp, Homo sapiens
tttggaagggaaccaaaacatg

SEQ ID NO: 7862805 - DNA, 22 bp, Homo sapiens
tttggaagggaaccaaaacatg

SEQ ID NO: 7862806 - DNA, 22 bp, Homo sapiens
tttggaagggaaccaaaacatg

SEQ ID NO: 7862807 - DNA, 22 bp, Homo sapiens
tttggaagggaaagaaagtact

SEQ ID NO: 7862808 - DNA, 22 bp, Homo sapiens
tttggaagggaaccaaaacatg

SEQ ID NO: 7862809 - DNA, 22 bp, Homo sapiens
tttggaagggaaccaaaacatg

SEQ ID NO: 7862810 - DNA, 22 bp, Homo sapiens
tttggaagggaaagaaagtact

SEQ ID NO: 7862811 - DNA, 22 bp, Homo sapiens
tttgcagtgattcttgcagtga

SEQ ID NO: 7862812 - DNA, 22 bp, Homo sapiens
tttggaagacagggcaggaaag

SEQ ID NO: 7862813 - DNA, 22 bp, Homo sapiens
tttggaagacagggcaggaaag

SEQ ID NO: 7862814 - DNA, 22 bp, Homo sapiens
tttggaagacagggcaggaaag

SEQ ID NO: 7862815 - DNA, 22 bp, Homo sapiens
tttgcagtctggcctgctttgg

SEQ ID NO: 7862816 - DNA, 22 bp, Homo sapiens
tttgcagtcaaatttgctaaat

SEQ ID NO: 7862817 - DNA, 22 bp, Homo sapiens
tttgcagtctggcctgctttgg

SEQ ID NO: 7862818 - DNA, 22 bp, Homo sapiens
tttgcacacacaataacaaatg

SEQ ID NO: 7862819 - DNA, 22 bp, Homo sapiens
tttgcacacacaataacaaatg

SEQ ID NO: 7862820 - DNA, 22 bp, Homo sapiens
tttgcactagcatttgtccatg

SEQ ID NO: 7862821 - DNA, 22 bp, Homo sapiens
tttgcacagcctttctggctgc

SEQ ID NO: 7862822 - DNA, 22 bp, Homo sapiens
tttgcacacattcttagaaatg

SEQ ID NO: 7862823 - DNA, 22 bp, Homo sapiens
tttgcagaagaaaacatgaaca

SEQ ID NO: 7862824 - DNA, 22 bp, Homo sapiens
tttgcagaagaaaacatgaaca

SEQ ID NO: 7862825 - DNA, 22 bp, Homo sapiens
tttgcactctaagtagtttgga

SEQ ID NO: 7862826 - DNA, 22 bp, Homo sapiens
tttgcacttaacttatttgaaa

SEQ ID NO: 7862827 - DNA, 22 bp, Homo sapiens
tttgcacttaacttatttgaaa

SEQ ID NO: 7862828 - DNA, 22 bp, Homo sapiens
tttgcagcaaggagagagcatt

SEQ ID NO: 7862829 - DNA, 22 bp, Homo sapiens
tttgcagcaaggagagagcatt

SEQ ID NO: 7862830 - DNA, 22 bp, Homo sapiens
tttgcagagtgcagaagcatct

SEQ ID NO: 7862831 - DNA, 22 bp, Homo sapiens
tttgcagagtgcagaagcatct

SEQ ID NO: 7862832 - DNA, 22 bp, Homo sapiens
tttgcagatgagaaaactgtgg

SEQ ID NO: 7862833 - DNA, 22 bp, Homo sapiens
tttgcagagtgcagaagcatct

SEQ ID NO: 7862834 - DNA, 22 bp, Homo sapiens
tttgcagcttctggtggcctct

SEQ ID NO: 7862835 - DNA, 20 bp, Homo sapiens
tttgcaggaaggaaataggt

SEQ ID NO: 7862836 - DNA, 22 bp, Homo sapiens
tttgcagcctccctggcagaag

SEQ ID NO: 7862837 - DNA, 22 bp, Homo sapiens
tttgcagtagacatcttatttt

SEQ ID NO: 7862838 - DNA, 22 bp, Homo sapiens
tttgcagtagacatcttatttt

SEQ ID NO: 7862839 - DNA, 22 bp, Homo sapiens
tttgcagtcaaatttgctaaat

SEQ ID NO: 7862840 - DNA, 22 bp, Homo sapiens
tttgcaatagtcctggcctgta

SEQ ID NO: 7862841 - DNA, 22 bp, Homo sapiens
tttgcaatagtcctggcctgta

SEQ ID NO: 7862842 - DNA, 22 bp, Homo sapiens
tttgcaatagtcctggcctgta

SEQ ID NO: 7862843 - DNA, 22 bp, Homo sapiens
tttgcaagtatcaaacatgtca

SEQ ID NO: 7862844 - DNA, 22 bp, Homo sapiens
tttgcaaggcagcaggtgcagt

SEQ ID NO: 7862845 - DNA, 22 bp, Homo sapiens
tttgcaaggcagcaggtgcagt

SEQ ID NO: 7862846 - DNA, 22 bp, Homo sapiens
tttgcaatgtgaaattaaagaa

SEQ ID NO: 7862847 - DNA, 22 bp, Homo sapiens
tttgcaatttgtgctgcaaatg

SEQ ID NO: 7862848 - DNA, 22 bp, Homo sapiens
tttgcaatttgtgctgcaaatg

SEQ ID NO: 7862849 - DNA, 22 bp, Homo sapiens
tttgcaaatttcgtctcctcag

SEQ ID NO: 7862850 - DNA, 22 bp, Homo sapiens
tttgcaaatttcgtctcctcag

SEQ ID NO: 7862851 - DNA, 22 bp, Homo sapiens
tttgcaaatttcgtctcctcag

SEQ ID NO: 7862852 - DNA, 23 bp, Homo sapiens
tttgcaaattttcctgactactc

SEQ ID NO: 7862853 - DNA, 23 bp, Homo sapiens
tttgcaaattttcctgactactc

SEQ ID NO: 7862854 - DNA, 22 bp, Homo sapiens
tttgcaaggattttctggctca

SEQ ID NO: 7862855 - DNA, 22 bp, Homo sapiens
tttgcaagatgaaaaagttcta

SEQ ID NO: 7862856 - DNA, 22 bp, Homo sapiens
tttgcaacagactcatcattga

SEQ ID NO: 7862857 - DNA, 23 bp, Homo sapiens
tttgcaaattttcctgactactc

SEQ ID NO: 7862858 - DNA, 22 bp, Homo sapiens
tttgcaaattcttgtctagcct

SEQ ID NO: 7862859 - DNA, 22 bp, Homo sapiens
tttgcaaattcttgtctagcct

SEQ ID NO: 7862860 - DNA, 22 bp, Homo sapiens
tttgcaaattcttgtctagcct

SEQ ID NO: 7862861 - DNA, 22 bp, Homo sapiens
tttgcaaattcttgtctagcct

SEQ ID NO: 7862862 - DNA, 23 bp, Homo sapiens
tttgcaaattggacacaaccaca

SEQ ID NO: 7862863 - DNA, 22 bp, Homo sapiens
tttgcaaatttcgtctcctcag

SEQ ID NO: 7862864 - DNA, 22 bp, Homo sapiens
tttgcaaatgctctgcagagct

SEQ ID NO: 7862865 - DNA, 22 bp, Homo sapiens
tttgcaaatgctctgcagagct

SEQ ID NO: 7862866 - DNA, 22 bp, Homo sapiens
tttgcaaatgctctgcagagct

SEQ ID NO: 7862867 - DNA, 22 bp, Homo sapiens
tttgcaaatgctctgcagagct

SEQ ID NO: 7862868 - DNA, 22 bp, Homo sapiens
tttgcaaatgaagctctgagga

SEQ ID NO: 7862869 - DNA, 22 bp, Homo sapiens
tttgcaaattagccaccctgtt

SEQ ID NO: 7862870 - DNA, 22 bp, Homo sapiens
tttgcaaatgctctgcagagct

SEQ ID NO: 7862871 - DNA, 22 bp, Homo sapiens
tttgatttactggatattctca

SEQ ID NO: 7862872 - DNA, 20 bp, Homo sapiens
tttgatttcacaaggccagt

SEQ ID NO: 7862873 - DNA, 22 bp, Homo sapiens
tttgatttactggatattctca

SEQ ID NO: 7862874 - DNA, 22 bp, Homo sapiens
tttgattttcagcaatagtggc

SEQ ID NO: 7862875 - DNA, 22 bp, Homo sapiens
tttgcaaaatgaggtgaagagt

SEQ ID NO: 7862876 - DNA, 22 bp, Homo sapiens
tttgcaaaatgaggtgaagagt

SEQ ID NO: 7862877 - DNA, 22 bp, Homo sapiens
tttgattttcagcaatagtggc

SEQ ID NO: 7862878 - DNA, 22 bp, Homo sapiens
tttgattttcagcaatagtggc

SEQ ID NO: 7862879 - DNA, 22 bp, Homo sapiens
tttgattttcagcaatagtggc

SEQ ID NO: 7862880 - DNA, 22 bp, Homo sapiens
tttgcaaataaataagtgctcg

SEQ ID NO: 7862881 - DNA, 22 bp, Homo sapiens
tttgcaaataaataagtgctcg

SEQ ID NO: 7862882 - DNA, 22 bp, Homo sapiens
tttgcaaatatgtgtttctatt

SEQ ID NO: 7862883 - DNA, 22 bp, Homo sapiens
tttgcaaataccatgaaacttg

SEQ ID NO: 7862884 - DNA, 22 bp, Homo sapiens
tttgcaaatgaagctctgagga

SEQ ID NO: 7862885 - DNA, 22 bp, Homo sapiens
tttgcaaatgaagctctgagga

SEQ ID NO: 7862886 - DNA, 22 bp, Homo sapiens
tttgcaaatacagaggtcttgc

SEQ ID NO: 7862887 - DNA, 22 bp, Homo sapiens
tttgcaaatacagaggtcttgc

SEQ ID NO: 7862888 - DNA, 22 bp, Homo sapiens
tttgcaaataccatgaaacttg

SEQ ID NO: 7862889 - DNA, 22 bp, Homo sapiens
tttgcaaataccatgaaacttg

SEQ ID NO: 7862890 - DNA, 22 bp, Homo sapiens
tttgcaaataccatgaaacttg

SEQ ID NO: 7862891 - DNA, 22 bp, Homo sapiens
tttctttccatacatattgcta

SEQ ID NO: 7862892 - DNA, 22 bp, Homo sapiens
tttctttccatacatattgcta

SEQ ID NO: 7862893 - DNA, 22 bp, Homo sapiens
tttctttccatacatattgcta

SEQ ID NO: 7862894 - DNA, 22 bp, Homo sapiens
tttctttccatgagcctatgta

SEQ ID NO: 7862895 - DNA, 22 bp, Homo sapiens
tttctttccatgagcctatgta

SEQ ID NO: 7862896 - DNA, 22 bp, Homo sapiens
tttctttccatacatattgcta

SEQ ID NO: 7862897 - DNA, 22 bp, Homo sapiens
tttctttctcgtaaacttagtt

SEQ ID NO: 7862898 - DNA, 22 bp, Homo sapiens
tttctttccatgagcctatgta

SEQ ID NO: 7862899 - DNA, 18 bp, Homo sapiens
tttctttctgcctggggc

SEQ ID NO: 7862900 - DNA, 22 bp, Homo sapiens
tttgatttactggatattctca

SEQ ID NO: 7862901 - DNA, 22 bp, Homo sapiens
tttctttctcgtaaacttagtt

SEQ ID NO: 7862902 - DNA, 22 bp, Homo sapiens
tttctttcaattctcctaatgc

SEQ ID NO: 7862903 - DNA, 22 bp, Homo sapiens
tttctttccagagtgattggca

SEQ ID NO: 7862904 - DNA, 22 bp, Homo sapiens
tttctttcaattctcctaatgc

SEQ ID NO: 7862905 - DNA, 22 bp, Homo sapiens
tttctttccagagtgattggca

SEQ ID NO: 7862906 - DNA, 22 bp, Homo sapiens
tttctttccagagtgattggca

SEQ ID NO: 7862907 - DNA, 22 bp, Homo sapiens
tttctttatcctcctttgcaca

SEQ ID NO: 7862908 - DNA, 22 bp, Homo sapiens
tttctttatcctcctttgcaca

SEQ ID NO: 7862909 - DNA, 22 bp, Homo sapiens
tttctttatcctcctttgcaca

SEQ ID NO: 7862910 - DNA, 22 bp, Homo sapiens
tttctttatcctcctttgcaca

SEQ ID NO: 7862911 - DNA, 22 bp, Homo sapiens
tttgtagagaatgttaagcact

SEQ ID NO: 7862912 - DNA, 22 bp, Homo sapiens
tttgtagagaataaaacaaatt

SEQ ID NO: 7862913 - DNA, 22 bp, Homo sapiens
tttgtagagaataaaacaaatt

SEQ ID NO: 7862914 - DNA, 22 bp, Homo sapiens
tttgtagatagaaaaatgatta

SEQ ID NO: 7862915 - DNA, 22 bp, Homo sapiens
tttgtagagggtaattgacaga

SEQ ID NO: 7862916 - DNA, 22 bp, Homo sapiens
tttgtagagaatgttaagcact

SEQ ID NO: 7862917 - DNA, 22 bp, Homo sapiens
tttgtagagggtaattgacaga

SEQ ID NO: 7862918 - DNA, 22 bp, Homo sapiens
tttgtagaactgtagaacaatg

SEQ ID NO: 7862919 - DNA, 22 bp, Homo sapiens
tttgtagaactgtagaacaatg

SEQ ID NO: 7862920 - DNA, 22 bp, Homo sapiens
tttgtagaataatatctttctg

SEQ ID NO: 7862921 - DNA, 22 bp, Homo sapiens
tttgtaccagccacatatgaaa

SEQ ID NO: 7862922 - DNA, 22 bp, Homo sapiens
tttgtacatttcactccattgt

SEQ ID NO: 7862923 - DNA, 22 bp, Homo sapiens
tttgtacatttcactccattgt

SEQ ID NO: 7862924 - DNA, 23 bp, Homo sapiens
tttgtacattgaggaggcagaat

SEQ ID NO: 7862925 - DNA, 18 bp, Homo sapiens
tttgtacccttttcctag

SEQ ID NO: 7862926 - DNA, 22 bp, Homo sapiens
tttgtatgtgataagactattc

SEQ ID NO: 7862927 - DNA, 22 bp, Homo sapiens
tttgtatgtgataagactattc

SEQ ID NO: 7862928 - DNA, 22 bp, Homo sapiens
tttgtatgtgataagactattc

SEQ ID NO: 7862929 - DNA, 22 bp, Homo sapiens
tttgtattacaaagtcacagta

SEQ ID NO: 7862930 - DNA, 22 bp, Homo sapiens
tttgtatgtgataagactattc

SEQ ID NO: 7862931 - DNA, 22 bp, Homo sapiens
tttgtatgaactggtatgtagg

SEQ ID NO: 7862932 - DNA, 22 bp, Homo sapiens
tttgtataagaacattctagca

SEQ ID NO: 7862933 - DNA, 22 bp, Homo sapiens
tttgtatgaactggtatgtagg

SEQ ID NO: 7862934 - DNA, 22 bp, Homo sapiens
tttgtatgaatgcatattttca

SEQ ID NO: 7862935 - DNA, 22 bp, Homo sapiens
tttgtatgaatgcatattttca

SEQ ID NO: 7862936 - DNA, 22 bp, Homo sapiens
tttgtatgggcagaaattagat

SEQ ID NO: 7862937 - DNA, 22 bp, Homo sapiens
tttgtatgggcagaaattagat

SEQ ID NO: 7862938 - DNA, 22 bp, Homo sapiens
tttgtatgggcagaaattagat

SEQ ID NO: 7862939 - DNA, 22 bp, Homo sapiens
tttgtagcagcatgatttataa

SEQ ID NO: 7862940 - DNA, 22 bp, Homo sapiens
tttgtagcagcatgatttataa

SEQ ID NO: 7862941 - DNA, 22 bp, Homo sapiens
tttgtagcagcatgatttataa

SEQ ID NO: 7862942 - DNA, 22 bp, Homo sapiens
tttgtagttgtggatgctgaag

SEQ ID NO: 7862943 - DNA, 22 bp, Homo sapiens
tttgtagcagcatgatttataa

SEQ ID NO: 7862944 - DNA, 22 bp, Homo sapiens
tttgtagcagcatgatttataa

SEQ ID NO: 7862945 - DNA, 22 bp, Homo sapiens
tttgtataagaacattctagca

SEQ ID NO: 7862946 - DNA, 22 bp, Homo sapiens
tttgtataagaacattctagca

SEQ ID NO: 7862947 - DNA, 22 bp, Homo sapiens
tttgtataaatgaagatgctgg

SEQ ID NO: 7862948 - DNA, 22 bp, Homo sapiens
tttgttcttgcaacagttatta

SEQ ID NO: 7862949 - DNA, 22 bp, Homo sapiens
tttgttcttgcaacagttatta

SEQ ID NO: 7862950 - DNA, 22 bp, Homo sapiens
tttgttgagttacagagatgaa

SEQ ID NO: 7862951 - DNA, 22 bp, Homo sapiens
tttgttgacatccctgtacttt

SEQ ID NO: 7862952 - DNA, 22 bp, Homo sapiens
tttgttggttgcactggtgggt

SEQ ID NO: 7862953 - DNA, 22 bp, Homo sapiens
tttgttctgcatcacagaaaaa

SEQ ID NO: 7862954 - DNA, 22 bp, Homo sapiens
tttgttctgaagcaagtaggga

SEQ ID NO: 7862955 - DNA, 22 bp, Homo sapiens
tttgttctgaagcaagtaggga

SEQ ID NO: 7862956 - DNA, 22 bp, Homo sapiens
tttgttcttgcaacagttatta

SEQ ID NO: 7862957 - DNA, 22 bp, Homo sapiens
tttgttcttagtatctgtgtgc

SEQ ID NO: 7862958 - DNA, 22 bp, Homo sapiens
tttgttcttagtatctgtgtgc

SEQ ID NO: 7862959 - DNA, 22 bp, Homo sapiens
tttgtttacaaaaataagcagt

SEQ ID NO: 7862960 - DNA, 22 bp, Homo sapiens
tttgtttacaaaaataagcagt

SEQ ID NO: 7862961 - DNA, 22 bp, Homo sapiens
tttgtttacaaaaataagcagt

SEQ ID NO: 7862962 - DNA, 22 bp, Homo sapiens
tttgtttacaaaaataagcagt

SEQ ID NO: 7862963 - DNA, 22 bp, Homo sapiens
tttgtttactcattcattgatg

SEQ ID NO: 7862964 - DNA, 22 bp, Homo sapiens
tttgtttactcattcattgatg

SEQ ID NO: 7862965 - DNA, 22 bp, Homo sapiens
tttgtttactcattcattgatg

SEQ ID NO: 7862966 - DNA, 22 bp, Homo sapiens
tttgttgtctagcatgaggtgc

SEQ ID NO: 7862967 - DNA, 22 bp, Homo sapiens
tttgttgtgaacagaataatat

SEQ ID NO: 7862968 - DNA, 22 bp, Homo sapiens
tttgttgtactgggattagact

SEQ ID NO: 7862969 - DNA, 22 bp, Homo sapiens
tttgttgtcatcagtgatgagt

SEQ ID NO: 7862970 - DNA, 22 bp, Homo sapiens
tttgttgtgataatggtctgca

SEQ ID NO: 7862971 - DNA, 22 bp, Homo sapiens
tttgttgtgaacagaataatat

SEQ ID NO: 7862972 - DNA, 22 bp, Homo sapiens
tttgtcaaagatcagatgcttt

SEQ ID NO: 7862973 - DNA, 20 bp, Homo sapiens
tttgtcaactgcatccagca

SEQ ID NO: 7862974 - DNA, 22 bp, Homo sapiens
tttgtcaaatcaaaccacattc

SEQ ID NO: 7862975 - DNA, 22 bp, Homo sapiens
tttgtcaataactaccaacagg

SEQ ID NO: 7862976 - DNA, 22 bp, Homo sapiens
tttgtcaatcccttgaaaacct

SEQ ID NO: 7862977 - DNA, 22 bp, Homo sapiens
tttgtcaataactaccaacagg

SEQ ID NO: 7862978 - DNA, 22 bp, Homo sapiens
tttgtcaccagtggctttggta

SEQ ID NO: 7862979 - DNA, 22 bp, Homo sapiens
tttgtcagggatcagatcggta

SEQ ID NO: 7862980 - DNA, 22 bp, Homo sapiens
tttgttcacctagcaaactttt

SEQ ID NO: 7862981 - DNA, 22 bp, Homo sapiens
tttgttcacctcaaggatggga

SEQ ID NO: 7862982 - DNA, 22 bp, Homo sapiens
tttgtcagtcatgtctgctttt

SEQ ID NO: 7862983 - DNA, 22 bp, Homo sapiens
tttgtcagtcatgtctgctttt

SEQ ID NO: 7862984 - DNA, 22 bp, Homo sapiens
tttgttcacatgtcatgtacaa

SEQ ID NO: 7862985 - DNA, 22 bp, Homo sapiens
tttgtcagtcatgtctgctttt

SEQ ID NO: 7862986 - DNA, 22 bp, Homo sapiens
tttgttcacatttaggactctc

SEQ ID NO: 7862987 - DNA, 22 bp, Homo sapiens
tttgttcacatgtcatgtacaa

SEQ ID NO: 7862988 - DNA, 22 bp, Homo sapiens
tttgttcacatttaggactctc

SEQ ID NO: 7862989 - DNA, 22 bp, Homo sapiens
tttgttcactatatccctcagt

SEQ ID NO: 7862990 - DNA, 23 bp, Homo sapiens
tttgttcactcctgggaaagaca

SEQ ID NO: 7862991 - DNA, 22 bp, Homo sapiens
tttgttcactgagcaatgatta

SEQ ID NO: 7862992 - DNA, 22 bp, Homo sapiens
tttgttcactgatgtatcccaa

SEQ ID NO: 7862993 - DNA, 22 bp, Homo sapiens
tttgttcagagatgttcaagct

SEQ ID NO: 7862994 - DNA, 22 bp, Homo sapiens
tttgttcagctctcattgatta

SEQ ID NO: 7862995 - DNA, 22 bp, Homo sapiens
tttgttttcaatgtgtcattca

SEQ ID NO: 7862996 - DNA, 22 bp, Homo sapiens
tttgttttcaatgtgtcattca

SEQ ID NO: 7862997 - DNA, 22 bp, Homo sapiens
tttgttttcaatgtgtcattca

SEQ ID NO: 7862998 - DNA, 22 bp, Homo sapiens
tttgttttcaatgtgtcattca

SEQ ID NO: 7862999 - DNA, 22 bp, Homo sapiens
tttgttttcaatgtgtcattca

SEQ ID NO: 7863000 - DNA, 22 bp, Homo sapiens
tttgttttcaatgtgtcattca

SEQ ID NO: 7863001 - DNA, 22 bp, Homo sapiens
tttgttttcaatgtgtcattca

SEQ ID NO: 7863002 - DNA, 22 bp, Homo sapiens
tttgttttcaatgtgtcattca

SEQ ID NO: 7863003 - DNA, 22 bp, Homo sapiens
tttgtttgaaagtctctacagc

SEQ ID NO: 7863004 - DNA, 22 bp, Homo sapiens
tttgtttgaaagtctctacagc

SEQ ID NO: 7863005 - DNA, 22 bp, Homo sapiens
tttgtttgccacacaaaacagt

SEQ ID NO: 7863006 - DNA, 22 bp, Homo sapiens
tttgtttgcggcacatagtttg

SEQ ID NO: 7863007 - DNA, 22 bp, Homo sapiens
tttgtttgcggcacatagtttg

SEQ ID NO: 7863008 - DNA, 22 bp, Homo sapiens
tttgtttagatggtaaatcagt

SEQ ID NO: 7863009 - DNA, 22 bp, Homo sapiens
tttgtttagatggtaaatcagt

SEQ ID NO: 7863010 - DNA, 22 bp, Homo sapiens
tttgtttagatggtaaatcagt

SEQ ID NO: 7863011 - DNA, 22 bp, Homo sapiens
tttgtttagagaattgaagcag

SEQ ID NO: 7863012 - DNA, 22 bp, Homo sapiens
tttgtttagatggtaaatcagt

SEQ ID NO: 7863013 - DNA, 22 bp, Homo sapiens
tttgtttactcattcattgatg

SEQ ID NO: 7863014 - DNA, 22 bp, Homo sapiens
tttgtttactcattcattgatg

SEQ ID NO: 7863015 - DNA, 22 bp, Homo sapiens
tttgtttactcattcattgatg

SEQ ID NO: 7863016 - DNA, 22 bp, Homo sapiens
tttgtttagagaattgaagcag

SEQ ID NO: 7863017 - DNA, 22 bp, Homo sapiens
tttgtttagatggtaaatcagt

SEQ ID NO: 7863018 - DNA, 22 bp, Homo sapiens
tttgtttagatggtaaatcagt

SEQ ID NO: 7863019 - DNA, 22 bp, Homo sapiens
tttgtttctgcaatacctatag

SEQ ID NO: 7863020 - DNA, 22 bp, Homo sapiens
tttgtttcgcagcctctctctg

SEQ ID NO: 7863021 - DNA, 22 bp, Homo sapiens
tttgtttcgcagcctctctctg

SEQ ID NO: 7863022 - DNA, 22 bp, Homo sapiens
tttgtttattaggggagagttg

SEQ ID NO: 7863023 - DNA, 22 bp, Homo sapiens
tttgtttcgcagcctctctctg

SEQ ID NO: 7863024 - DNA, 22 bp, Homo sapiens
tttgtttatcaaggtctagcat

SEQ ID NO: 7863025 - DNA, 22 bp, Homo sapiens
tttgtttagatggtaaatcagt

SEQ ID NO: 7863026 - DNA, 22 bp, Homo sapiens
tttgtttattaggggagagttg

SEQ ID NO: 7863027 - DNA, 22 bp, Homo sapiens
tttgttttcaatgtgtcattca

SEQ ID NO: 7863028 - DNA, 21 bp, Homo sapiens
tttgtttgtatcagaatggcc

SEQ ID NO: 7863029 - DNA, 22 bp, Homo sapiens
tttgttttcaatgtgtcattca

SEQ ID NO: 7863030 - DNA, 22 bp, Homo sapiens
tttgttttcaatgtgtcattca

SEQ ID NO: 7863031 - DNA, 22 bp, Homo sapiens
tttgttttcaatgtgtcattca

SEQ ID NO: 7863032 - DNA, 22 bp, Homo sapiens
tttgttttctgtaggcctttcc

SEQ ID NO: 7863033 - DNA, 22 bp, Homo sapiens
tttgttttctgtaggcctttcc

SEQ ID NO: 7863034 - DNA, 22 bp, Homo sapiens
tttgttttctgtaggcctttcc

SEQ ID NO: 7863035 - DNA, 22 bp, Homo sapiens
tttgttttctgtaggcctttcc

SEQ ID NO: 7863036 - DNA, 22 bp, Homo sapiens
tttgttttcaatgtgtcattca

SEQ ID NO: 7863037 - DNA, 22 bp, Homo sapiens
tttgttttctgtaggcctttcc

SEQ ID NO: 7863038 - DNA, 22 bp, Homo sapiens
tttgttttgaactagctcagaa

SEQ ID NO: 7863039 - DNA, 22 bp, Homo sapiens
tttgttttctgtaggcctttcc

SEQ ID NO: 7863040 - DNA, 22 bp, Homo sapiens
tttgttttctgtaggcctttcc

SEQ ID NO: 7863041 - DNA, 22 bp, Homo sapiens
ttttaaactatagctggatgct

SEQ ID NO: 7863042 - DNA, 22 bp, Homo sapiens
ttttaaactatagctggatgct

SEQ ID NO: 7863043 - DNA, 22 bp, Homo sapiens
tttgttttgaactagctcagaa

SEQ ID NO: 7863044 - DNA, 22 bp, Homo sapiens
tttgttttgaactagctcagaa

SEQ ID NO: 7863045 - DNA, 22 bp, Homo sapiens
tttgttttgaactagctcagaa

SEQ ID NO: 7863046 - DNA, 22 bp, Homo sapiens
tttgttttgaactagctcagaa

SEQ ID NO: 7863047 - DNA, 22 bp, Homo sapiens
tttgttttgaactagctcagaa

SEQ ID NO: 7863048 - DNA, 22 bp, Homo sapiens
tttgttttgaactagctcagaa

SEQ ID NO: 7863049 - DNA, 22 bp, Homo sapiens
ttttagaagttcacttgggttt

SEQ ID NO: 7863050 - DNA, 22 bp, Homo sapiens
ttttagaagttcacttgggttt

SEQ ID NO: 7863051 - DNA, 22 bp, Homo sapiens
ttttagaagttcatgtgggatt

SEQ ID NO: 7863052 - DNA, 22 bp, Homo sapiens
ttttagaagttcacttgggttt

SEQ ID NO: 7863053 - DNA, 22 bp, Homo sapiens
ttttagaagttcacttgggttt

SEQ ID NO: 7863054 - DNA, 22 bp, Homo sapiens
ttttaaactcccctagttggtg

SEQ ID NO: 7863055 - DNA, 22 bp, Homo sapiens
ttttaaactatagctggatgct

SEQ ID NO: 7863056 - DNA, 22 bp, Homo sapiens
ttttagaagtgcctatcctatg

SEQ ID NO: 7863057 - DNA, 22 bp, Homo sapiens
ttttagaagtgcctatcctatg

SEQ ID NO: 7863058 - DNA, 22 bp, Homo sapiens
ttttataagcaagaaagggaaa

SEQ ID NO: 7863059 - DNA, 22 bp, Homo sapiens
ttttataagcaagaaagggaaa

SEQ ID NO: 7863060 - DNA, 22 bp, Homo sapiens
ttttataagcaagaaagggaaa

SEQ ID NO: 7863061 - DNA, 22 bp, Homo sapiens
ttttataagcaagaaagggaaa

SEQ ID NO: 7863062 - DNA, 22 bp, Homo sapiens
ttttatacacatgaacatgcag

SEQ ID NO: 7863063 - DNA, 22 bp, Homo sapiens
ttttatacttaagacagagttt

SEQ ID NO: 7863064 - DNA, 22 bp, Homo sapiens
ttttatacacatgaacatgcag

SEQ ID NO: 7863065 - DNA, 22 bp, Homo sapiens
ttttatacacatgaacatgcag

SEQ ID NO: 7863066 - DNA, 22 bp, Homo sapiens
ttttatacttaagacagagttt

SEQ ID NO: 7863067 - DNA, 22 bp, Homo sapiens
ttttatacttaagacagagttt

SEQ ID NO: 7863068 - DNA, 22 bp, Homo sapiens
ttttatacttaagacagagttt

SEQ ID NO: 7863069 - DNA, 22 bp, Homo sapiens
ttttatagctgaatagtattcc

SEQ ID NO: 7863070 - DNA, 22 bp, Homo sapiens
ttttagaatcaggttgtctggg

SEQ ID NO: 7863071 - DNA, 22 bp, Homo sapiens
ttttagaagttcatgtgggatt

SEQ ID NO: 7863072 - DNA, 22 bp, Homo sapiens
ttttagaagttcatgtgggatt

SEQ ID NO: 7863073 - DNA, 22 bp, Homo sapiens
ttttagaagttcatgtgggatt

SEQ ID NO: 7863074 - DNA, 22 bp, Homo sapiens
ttttagaatcaggttgtctggg

SEQ ID NO: 7863075 - DNA, 22 bp, Homo sapiens
ttttagaagttcatgtgggatt

SEQ ID NO: 7863076 - DNA, 22 bp, Homo sapiens
ttttagaatcaggttgtctggg

SEQ ID NO: 7863077 - DNA, 22 bp, Homo sapiens
ttttataaagagagtcagttgg

SEQ ID NO: 7863078 - DNA, 22 bp, Homo sapiens
ttttataaagagagtcagttgg

SEQ ID NO: 7863079 - DNA, 22 bp, Homo sapiens
ttttataaagagagtcagttgg

SEQ ID NO: 7863080 - DNA, 22 bp, Homo sapiens
ttttataaagagagtcagttgg

SEQ ID NO: 7863081 - DNA, 22 bp, Homo sapiens
ttttataagcaagaaagggaaa

SEQ ID NO: 7863082 - DNA, 22 bp, Homo sapiens
ttttataaagagagtcagttgg

SEQ ID NO: 7863083 - DNA, 22 bp, Homo sapiens
ttttatcaatcattaagacatt

SEQ ID NO: 7863084 - DNA, 22 bp, Homo sapiens
ttttatcaatcattaagacatt

SEQ ID NO: 7863085 - DNA, 22 bp, Homo sapiens
ttttatcaatcattaagacatt

SEQ ID NO: 7863086 - DNA, 22 bp, Homo sapiens
ttttatcaatcattaagacatt

SEQ ID NO: 7863087 - DNA, 22 bp, Homo sapiens
ttttatcaatcattaagacatt

SEQ ID NO: 7863088 - DNA, 22 bp, Homo sapiens
ttttatcaatcattaagacatt

SEQ ID NO: 7863089 - DNA, 22 bp, Homo sapiens
ttttatcaatcattaagacatt

SEQ ID NO: 7863090 - DNA, 22 bp, Homo sapiens
ttttatcagcagggataacaag

SEQ ID NO: 7863091 - DNA, 22 bp, Homo sapiens
ttttatcagcagggataacaag

SEQ ID NO: 7863092 - DNA, 22 bp, Homo sapiens
ttttatcagcagggataacaag

SEQ ID NO: 7863093 - DNA, 22 bp, Homo sapiens
ttttatcagcagggataacaag

SEQ ID NO: 7863094 - DNA, 22 bp, Homo sapiens
ttttatcagcagggataacaag

SEQ ID NO: 7863095 - DNA, 22 bp, Homo sapiens
ttttatattgagtgagagttcc

SEQ ID NO: 7863096 - DNA, 22 bp, Homo sapiens
ttttatattgagtgagagttcc

SEQ ID NO: 7863097 - DNA, 22 bp, Homo sapiens
ttttatattgagtgagagttcc

SEQ ID NO: 7863098 - DNA, 22 bp, Homo sapiens
ttttgatatcatgatgaacaga

SEQ ID NO: 7863099 - DNA, 22 bp, Homo sapiens
ttttgcaaagtacattatcagg

SEQ ID NO: 7863100 - DNA, 22 bp, Homo sapiens
ttttgatatcatgatgaacaga

SEQ ID NO: 7863101 - DNA, 22 bp, Homo sapiens
ttttgcaaagtacattatcagg

SEQ ID NO: 7863102 - DNA, 22 bp, Homo sapiens
ttttgcaaagtacattatcagg

SEQ ID NO: 7863103 - DNA, 23 bp, Homo sapiens
ttttgcaataagtcactggaata

SEQ ID NO: 7863104 - DNA, 22 bp, Homo sapiens
ttttgcaatgagatgcttgtca

SEQ ID NO: 7863105 - DNA, 22 bp, Homo sapiens
ttttgcaatatgttcctgaata

SEQ ID NO: 7863106 - DNA, 22 bp, Homo sapiens
ttttgcagaatgggaaggtagt

SEQ ID NO: 7863107 - DNA, 22 bp, Homo sapiens
ttttgccgaaggtatctgagat

SEQ ID NO: 7863108 - DNA, 22 bp, Homo sapiens
ttttggaatttatacagtaatg

SEQ ID NO: 7863109 - DNA, 22 bp, Homo sapiens
ttttggaatttatacagtaatg

SEQ ID NO: 7863110 - DNA, 22 bp, Homo sapiens
ttttggaatttatacagtaatg

SEQ ID NO: 7863111 - DNA, 22 bp, Homo sapiens
ttttgcctaagaatctctctga

SEQ ID NO: 7863112 - DNA, 22 bp, Homo sapiens
ttttggaatctgggaaaacagt

SEQ ID NO: 7863113 - DNA, 22 bp, Homo sapiens
ttttggaatctgggaaaacagt

SEQ ID NO: 7863114 - DNA, 22 bp, Homo sapiens
ttttggaatgaggaacatccag

SEQ ID NO: 7863115 - DNA, 21 bp, Homo sapiens
ttttggcaaggtgcatgtttc

SEQ ID NO: 7863116 - DNA, 22 bp, Homo sapiens
ttttggcaagctgggagatatt

SEQ ID NO: 7863117 - DNA, 22 bp, Homo sapiens
ttttggcaagctgggagatatt

SEQ ID NO: 7863118 - DNA, 22 bp, Homo sapiens
ttttggcaaagagatagcatga

SEQ ID NO: 7863119 - DNA, 22 bp, Homo sapiens
ttttggcaaaggcattctcttt

SEQ ID NO: 7863120 - DNA, 22 bp, Homo sapiens
ttttgaaagggtgatttggctt

SEQ ID NO: 7863121 - DNA, 22 bp, Homo sapiens
ttttgaaagggtgatttggctt

SEQ ID NO: 7863122 - DNA, 22 bp, Homo sapiens
ttttgaaagggtgatttggctt

SEQ ID NO: 7863123 - DNA, 22 bp, Homo sapiens
ttttgaaagggtgatttggctt

SEQ ID NO: 7863124 - DNA, 22 bp, Homo sapiens
ttttgaaagccaggtttgtatg

SEQ ID NO: 7863125 - DNA, 22 bp, Homo sapiens
ttttgaaagccaggtttgtatg

SEQ ID NO: 7863126 - DNA, 22 bp, Homo sapiens
ttttgaaagagtcctgctacag

SEQ ID NO: 7863127 - DNA, 22 bp, Homo sapiens
ttttgaaagccaggtttgtatg

SEQ ID NO: 7863128 - DNA, 22 bp, Homo sapiens
ttttgaccaaataatttagcag

SEQ ID NO: 7863129 - DNA, 22 bp, Homo sapiens
ttttgatatcatgatgaacaga

SEQ ID NO: 7863130 - DNA, 22 bp, Homo sapiens
ttttgagatggagtcttgctct

SEQ ID NO: 7863131 - DNA, 22 bp, Homo sapiens
ttttgaataattcagaaacagc

SEQ ID NO: 7863132 - DNA, 19 bp, Homo sapiens
ttttgaagtatgagacagg

SEQ ID NO: 7863133 - DNA, 19 bp, Homo sapiens
ttttgaagtatgagacagg

SEQ ID NO: 7863134 - DNA, 22 bp, Homo sapiens
ttttgaataattcagaaacagc

SEQ ID NO: 7863135 - DNA, 22 bp, Homo sapiens
ttttgaataattcagaaacagc

SEQ ID NO: 7863136 - DNA, 22 bp, Homo sapiens
ttttggctccagtggtttgtgc

SEQ ID NO: 7863137 - DNA, 22 bp, Homo sapiens
ttttggccacatccttttgagt

SEQ ID NO: 7863138 - DNA, 22 bp, Homo sapiens
ttttggctctgcaggtttgcac

SEQ ID NO: 7863139 - DNA, 22 bp, Homo sapiens
ttttggctacaaagagcctagt

SEQ ID NO: 7863140 - DNA, 22 bp, Homo sapiens
ttttggctccagtggtttgtgc

SEQ ID NO: 7863141 - DNA, 22 bp, Homo sapiens
ttttggctctgcaggtttgcac

SEQ ID NO: 7863142 - DNA, 22 bp, Homo sapiens
ttttggctctgtctgtatcttt

SEQ ID NO: 7863143 - DNA, 22 bp, Homo sapiens
tttttcatctgattgataactc

SEQ ID NO: 7863144 - DNA, 22 bp, Homo sapiens
tttttcatgagactagaagtca

SEQ ID NO: 7863145 - DNA, 22 bp, Homo sapiens
tttttcatgagactagaagtca

SEQ ID NO: 7863146 - DNA, 22 bp, Homo sapiens
tttttcatgagactagaagtca

SEQ ID NO: 7863147 - DNA, 22 bp, Homo sapiens
tttttcatgagactagaagtca

SEQ ID NO: 7863148 - DNA, 22 bp, Homo sapiens
tttttcatgagactagaagtca

SEQ ID NO: 7863149 - DNA, 22 bp, Homo sapiens
ttttggcactgcgtctacatgg

SEQ ID NO: 7863150 - DNA, 22 bp, Homo sapiens
ttttggcagattacttaatatg

SEQ ID NO: 7863151 - DNA, 22 bp, Homo sapiens
ttttggcactttgtctgattct

SEQ ID NO: 7863152 - DNA, 22 bp, Homo sapiens
ttttggcaggatatgcaccagc

SEQ ID NO: 7863153 - DNA, 22 bp, Homo sapiens
ttttggcaggatatgcaccagc

SEQ ID NO: 7863154 - DNA, 22 bp, Homo sapiens
ttttggcagccacatgcacttg

SEQ ID NO: 7863155 - DNA, 22 bp, Homo sapiens
ttttggcagcaggtatggggca

SEQ ID NO: 7863156 - DNA, 22 bp, Homo sapiens
ttttggcagcaggtatggggca

SEQ ID NO: 7863157 - DNA, 22 bp, Homo sapiens
ttttggcagccacatgcacttg

SEQ ID NO: 7863158 - DNA, 22 bp, Homo sapiens
ttttggcatcacttgccatcta

SEQ ID NO: 7863159 - DNA, 22 bp, Homo sapiens
ttttggcatcacttgccatcta

SEQ ID NO: 7863160 - DNA, 22 bp, Homo sapiens
tttttcccatatagaaagccaa

SEQ ID NO: 7863161 - DNA, 22 bp, Homo sapiens
tttttcctaagcagtggagctg

SEQ ID NO: 7863162 - DNA, 22 bp, Homo sapiens
tttttccagggttagatgttta

SEQ ID NO: 7863163 - DNA, 22 bp, Homo sapiens
tttttcattgcagcctctctcc

SEQ ID NO: 7863164 - DNA, 22 bp, Homo sapiens
tttttcattgcagcctctctcc

SEQ ID NO: 7863165 - DNA, 22 bp, Homo sapiens
tttttcattgcagcctctctcc

SEQ ID NO: 7863166 - DNA, 22 bp, Homo sapiens
tttttccacataccctaggcca

SEQ ID NO: 7863167 - DNA, 22 bp, Homo sapiens
tttttccaccgtacttcctgag

SEQ ID NO: 7863168 - DNA, 22 bp, Homo sapiens
tttttcctagcgatttgtcagc

SEQ ID NO: 7863169 - DNA, 22 bp, Homo sapiens
tttttcctagcgatttgtcagc

SEQ ID NO: 7863170 - DNA, 22 bp, Homo sapiens
tttttcctaagcagtggagctg

SEQ ID NO: 7863171 - DNA, 22 bp, Homo sapiens
tttttcctaagcagtggagctg

SEQ ID NO: 7863172 - DNA, 22 bp, Homo sapiens
tttttcctagtgctttctggta

SEQ ID NO: 7863173 - DNA, 22 bp, Homo sapiens
tttttcctagtgctttctggta

SEQ ID NO: 7863174 - DNA, 22 bp, Homo sapiens
tttttcctagcgatttgtcagc

SEQ ID NO: 7863175 - DNA, 22 bp, Homo sapiens
tttttcctagcgatttgtcagc

SEQ ID NO: 7863176 - DNA, 22 bp, Homo sapiens
tttttcctagcgatttgtcagc

SEQ ID NO: 7863177 - DNA, 22 bp, Homo sapiens
tttttcctagcgatttgtcagc

SEQ ID NO: 7863178 - DNA, 22 bp, Homo sapiens
tttttccttaggggttactcac

SEQ ID NO: 7863179 - DNA, 22 bp, Homo sapiens
tttttccttaggggttactcac

SEQ ID NO: 7863180 - DNA, 22 bp, Homo sapiens
tttttcctagtgctttctggta

SEQ ID NO: 7863181 - DNA, 22 bp, Homo sapiens
tttttcctagtgctttctggta

SEQ ID NO: 7863182 - DNA, 22 bp, Homo sapiens
tttttcctagtgctttctggta

SEQ ID NO: 7863183 - DNA, 22 bp, Homo sapiens
tttttccttaggggttactcac

SEQ ID NO: 7863184 - DNA, 22 bp, Homo sapiens
tttttccttaggggttactcac

SEQ ID NO: 7863185 - DNA, 22 bp, Homo sapiens
tttttccttaggggttactcac

SEQ ID NO: 7863186 - DNA, 20 bp, Homo sapiens
tttttccttctctacaggca

SEQ ID NO: 7863187 - DNA, 20 bp, Homo sapiens
tttttccttctctacaggca

SEQ ID NO: 7863188 - DNA, 20 bp, Homo sapiens
ttttccttctgagtatgttg

SEQ ID NO: 7863189 - DNA, 20 bp, Homo sapiens
ttttccttctgagtatgttg

SEQ ID NO: 7863190 - DNA, 20 bp, Homo sapiens
ttttccttctgagtatgttg

SEQ ID NO: 7863191 - DNA, 20 bp, Homo sapiens
ttttccttctgagtatgttg

SEQ ID NO: 7863192 - DNA, 20 bp, Homo sapiens
ttttccttctgagtatgttg

SEQ ID NO: 7863193 - DNA, 20 bp, Homo sapiens
ttttccttctgagtatgttg

SEQ ID NO: 7863194 - DNA, 20 bp, Homo sapiens
ttttccttctgagtatgttg

SEQ ID NO: 7863195 - DNA, 20 bp, Homo sapiens
ttttccttctgagtatgttg

SEQ ID NO: 7863196 - DNA, 20 bp, Homo sapiens
ttttccttctgagtatgttg

SEQ ID NO: 7863197 - DNA, 22 bp, Homo sapiens
ttttccttctgatactccattt

SEQ ID NO: 7863198 - DNA, 22 bp, Homo sapiens
ttttccttctgatactccattt

SEQ ID NO: 7863199 - DNA, 22 bp, Homo sapiens
ttttccttctgatactccattt

SEQ ID NO: 7863200 - DNA, 22 bp, Homo sapiens
ttttccttctgatactccattt

SEQ ID NO: 7863201 - DNA, 22 bp, Homo sapiens
ttttccttctgatactccattt

SEQ ID NO: 7863202 - DNA, 22 bp, Homo sapiens
ttttccttctgatactccattt

SEQ ID NO: 7863203 - DNA, 22 bp, Homo sapiens
ttttccttctgatactccattt

SEQ ID NO: 7863204 - DNA, 22 bp, Homo sapiens
ttttccttctgatactccattt

SEQ ID NO: 7863205 - DNA, 22 bp, Homo sapiens
ttttccttctgatactccattt

SEQ ID NO: 7863206 - DNA, 20 bp, Homo sapiens
ttttccttgttgccgctgct

SEQ ID NO: 7863207 - DNA, 20 bp, Homo sapiens
ttttccttgttgccgctgct

SEQ ID NO: 7863208 - DNA, 22 bp, Homo sapiens
ttttcctttcatcaggacaaag

SEQ ID NO: 7863209 - DNA, 22 bp, Homo sapiens
ttttcctttcatcaggacaaag

SEQ ID NO: 7863210 - DNA, 20 bp, Homo sapiens
ttttccttgttgccgctgct

SEQ ID NO: 7863211 - DNA, 22 bp, Homo sapiens
ttttcctttcatcaggacaaag

SEQ ID NO: 7863212 - DNA, 22 bp, Homo sapiens
ttttcctttcatcaggacaaag

SEQ ID NO: 7863213 - DNA, 22 bp, Homo sapiens
ttttcctttcatcaggacaaag

SEQ ID NO: 7863214 - DNA, 22 bp, Homo sapiens
ttttcctttcatcaggacaaag

SEQ ID NO: 7863215 - DNA, 22 bp, Homo sapiens
ttttcctttgaaaggtgagggc

SEQ ID NO: 7863216 - DNA, 22 bp, Homo sapiens
ttttcctttgaaaggtgagggc

SEQ ID NO: 7863217 - DNA, 22 bp, Homo sapiens
ttttcctttgaaaggtgagggc

SEQ ID NO: 7863218 - DNA, 22 bp, Homo sapiens
ttttcctttgattcccagatgt

SEQ ID NO: 7863219 - DNA, 22 bp, Homo sapiens
ttttcctttgattcccagatgt

SEQ ID NO: 7863220 - DNA, 22 bp, Homo sapiens
ttttcctttgattcccagatgt

SEQ ID NO: 7863221 - DNA, 22 bp, Homo sapiens
ttttcctttgattcccagatgt

SEQ ID NO: 7863222 - DNA, 22 bp, Homo sapiens
ttttcctttgattcccagatgt

SEQ ID NO: 7863223 - DNA, 22 bp, Homo sapiens
ttttcctttgattcccagatgt

SEQ ID NO: 7863224 - DNA, 22 bp, Homo sapiens
ttttcctttggaagatgcatat

SEQ ID NO: 7863225 - DNA, 22 bp, Homo sapiens
ttttatgaagataattttctga

SEQ ID NO: 7863226 - DNA, 22 bp, Homo sapiens
ttttatgaagataattttctga

SEQ ID NO: 7863227 - DNA, 22 bp, Homo sapiens
ttttatgaagataattttctga

SEQ ID NO: 7863228 - DNA, 22 bp, Homo sapiens
ttttatctgtgacatctggcag

SEQ ID NO: 7863229 - DNA, 22 bp, Homo sapiens
ttttatcttcattcctatctac

SEQ ID NO: 7863230 - DNA, 22 bp, Homo sapiens
ttttatcttcattcctatctac

SEQ ID NO: 7863231 - DNA, 22 bp, Homo sapiens
ttttatcttcattcctatctac

SEQ ID NO: 7863232 - DNA, 22 bp, Homo sapiens
ttttatgaagataattttctga

SEQ ID NO: 7863233 - DNA, 19 bp, Homo sapiens
ttttccttctcctcttaat

SEQ ID NO: 7863234 - DNA, 19 bp, Homo sapiens
ttttccttctcctcttaat

SEQ ID NO: 7863235 - DNA, 22 bp, Homo sapiens
ttttatgagaatgcgccacttg

SEQ ID NO: 7863236 - DNA, 19 bp, Homo sapiens
ttttccttctcctcttaat

SEQ ID NO: 7863237 - DNA, 19 bp, Homo sapiens
ttttccttctcctcttaat

SEQ ID NO: 7863238 - DNA, 19 bp, Homo sapiens
ttttccttctcctcttaat

SEQ ID NO: 7863239 - DNA, 20 bp, Homo sapiens
ttttccttctgagtatgttg

SEQ ID NO: 7863240 - DNA, 22 bp, Homo sapiens
ttttatctgcttcattagttga

SEQ ID NO: 7863241 - DNA, 22 bp, Homo sapiens
ttttatctgcttcattagttga

SEQ ID NO: 7863242 - DNA, 22 bp, Homo sapiens
ttttatctgcttcattagttga

SEQ ID NO: 7863243 - DNA, 22 bp, Homo sapiens
ttttatctgcttcattagttga

SEQ ID NO: 7863244 - DNA, 22 bp, Homo sapiens
ttttatctgcttcattagttga

SEQ ID NO: 7863245 - DNA, 22 bp, Homo sapiens
ttttatctgtgacatctggcag

SEQ ID NO: 7863246 - DNA, 22 bp, Homo sapiens
ttttatctgtgacatctggcag

SEQ ID NO: 7863247 - DNA, 22 bp, Homo sapiens
ttttatcattacccagctgaaa

SEQ ID NO: 7863248 - DNA, 22 bp, Homo sapiens
ttttatcattacccagctgaaa

SEQ ID NO: 7863249 - DNA, 22 bp, Homo sapiens
ttttatctacctatgctcattt

SEQ ID NO: 7863250 - DNA, 22 bp, Homo sapiens
ttttatctacctatgctcattt

SEQ ID NO: 7863251 - DNA, 22 bp, Homo sapiens
ttttatctacctatgctcattt

SEQ ID NO: 7863252 - DNA, 22 bp, Homo sapiens
ttttctaacatctagtaatttg

SEQ ID NO: 7863253 - DNA, 22 bp, Homo sapiens
ttttctaacatctagtaatttg

SEQ ID NO: 7863254 - DNA, 22 bp, Homo sapiens
ttttctaacatctagtaatttg

SEQ ID NO: 7863255 - DNA, 22 bp, Homo sapiens
ttttctaacatctagtaatttg

SEQ ID NO: 7863256 - DNA, 22 bp, Homo sapiens
ttttctaacatctagtaatttg

SEQ ID NO: 7863257 - DNA, 22 bp, Homo sapiens
ttttctaaaatatccaggacag

SEQ ID NO: 7863258 - DNA, 22 bp, Homo sapiens
ttttctaacatctagtaatttg

SEQ ID NO: 7863259 - DNA, 23 bp, Homo sapiens
ttttcctttggacaggctgtatt

SEQ ID NO: 7863260 - DNA, 23 bp, Homo sapiens
ttttcctttggacaggctgtatt

SEQ ID NO: 7863261 - DNA, 23 bp, Homo sapiens
ttttcctttggacaggctgtatt

SEQ ID NO: 7863262 - DNA, 23 bp, Homo sapiens
ttttcctttggacaggctgtatt

SEQ ID NO: 7863263 - DNA, 22 bp, Homo sapiens
ttttcgtttatttgacatgtaa

SEQ ID NO: 7863264 - DNA, 23 bp, Homo sapiens
ttttcctttggacaggctgtatt

SEQ ID NO: 7863265 - DNA, 22 bp, Homo sapiens
ttttcctttggaagatgcatat

SEQ ID NO: 7863266 - DNA, 22 bp, Homo sapiens
ttttcctttggaagatgcatat

SEQ ID NO: 7863267 - DNA, 22 bp, Homo sapiens
ttttcctttggaagatgcatat

SEQ ID NO: 7863268 - DNA, 22 bp, Homo sapiens
ttttcctttggaagatgcatat

SEQ ID NO: 7863269 - DNA, 22 bp, Homo sapiens
ttttcctttggaagatgcatat

SEQ ID NO: 7863270 - DNA, 22 bp, Homo sapiens
ttttcctttggaagatgcatat

SEQ ID NO: 7863271 - DNA, 23 bp, Homo sapiens
ttttcctttggacaggctgtatt

SEQ ID NO: 7863272 - DNA, 22 bp, Homo sapiens
ttttcctttggaagatgcatat

SEQ ID NO: 7863273 - DNA, 22 bp, Homo sapiens
ttttcttctacctgctgtccaa

SEQ ID NO: 7863274 - DNA, 22 bp, Homo sapiens
ttttcttctacctgctgtccaa

SEQ ID NO: 7863275 - DNA, 22 bp, Homo sapiens
ttttcttcggtgctgggttgat

SEQ ID NO: 7863276 - DNA, 22 bp, Homo sapiens
ttttctattaactcattttgca

SEQ ID NO: 7863277 - DNA, 22 bp, Homo sapiens
ttttctattaactcattttgca

SEQ ID NO: 7863278 - DNA, 22 bp, Homo sapiens
ttttctttaatctggtggggtg

SEQ ID NO: 7863279 - DNA, 22 bp, Homo sapiens
ttttgaaagagtcctgctacag

SEQ ID NO: 7863280 - DNA, 22 bp, Homo sapiens
ttttgaaagagtcctgctacag

SEQ ID NO: 7863281 - DNA, 22 bp, Homo sapiens
ttttctttaatctggtggggtg

SEQ ID NO: 7863282 - DNA, 22 bp, Homo sapiens
ttttctattaactcattttgca

SEQ ID NO: 7863283 - DNA, 22 bp, Homo sapiens
ttttctattaactcattttgca

SEQ ID NO: 7863284 - DNA, 22 bp, Homo sapiens
ttttctattaactcattttgca

SEQ ID NO: 7863285 - DNA, 22 bp, Homo sapiens
ttttctattaactcattttgca

SEQ ID NO: 7863286 - DNA, 22 bp, Homo sapiens
ttttctattaactcattttgca

SEQ ID NO: 7863287 - DNA, 22 bp, Homo sapiens
ttttctatctcctagaactgcc

SEQ ID NO: 7863288 - DNA, 22 bp, Homo sapiens
ttttctatctcctagaactgcc

SEQ ID NO: 7863289 - DNA, 22 bp, Homo sapiens
ttttctatctcctagaactgcc

SEQ ID NO: 7863290 - DNA, 22 bp, Homo sapiens
ttttctaagggaaacgtcctcc

SEQ ID NO: 7863291 - DNA, 22 bp, Homo sapiens
ttttctagggtgctaaatgaac

SEQ ID NO: 7863292 - DNA, 22 bp, Homo sapiens
ttttctatctcctagaactgcc

SEQ ID NO: 7863293 - DNA, 22 bp, Homo sapiens
ttttttgtcccagagagcctgg

SEQ ID NO: 7863294 - DNA, 22 bp, Homo sapiens
ttttttgtcccagagagcctgg

SEQ ID NO: 7863295 - DNA, 22 bp, Homo sapiens
tttttgtagtcattagaagagg

SEQ ID NO: 7863296 - DNA, 22 bp, Homo sapiens
tttttgtagtcattagaagagg

SEQ ID NO: 7863297 - DNA, 22 bp, Homo sapiens
ttttttgtagcaagcgcagata

SEQ ID NO: 7863298 - DNA, 22 bp, Homo sapiens
tttttgggtccaggctgtatct

SEQ ID NO: 7863299 - DNA, 22 bp, Homo sapiens
tttttgggtccaggctgtatct

SEQ ID NO: 7863300 - DNA, 22 bp, Homo sapiens
tttttgtagtcattagaagagg

SEQ ID NO: 7863301 - DNA, 22 bp, Homo sapiens
tttttgggtccaggctgtatct

SEQ ID NO: 7863302 - DNA, 22 bp, Homo sapiens
ttttttgtcttgaagaaatggt

SEQ ID NO: 7863303 - DNA, 22 bp, Homo sapiens
ttttttgtcttgaagaaatggt

SEQ ID NO: 7863304 - DNA, 22 bp, Homo sapiens
ttttttgtcttgaagaaatggt

SEQ ID NO: 7863305 - DNA, 22 bp, Homo sapiens
ttttttgtcttgaagaaatggt

SEQ ID NO: 7863306 - DNA, 22 bp, Homo sapiens
ttttttgtcttgaagaaatggt

SEQ ID NO: 7863307 - DNA, 22 bp, Homo sapiens
ttttttgtcttgaagaaatggt

SEQ ID NO: 7863308 - DNA, 22 bp, Homo sapiens
tttttgctccacaactttgaag

SEQ ID NO: 7863309 - DNA, 22 bp, Homo sapiens
tttttgctaatccccagccact

SEQ ID NO: 7863310 - DNA, 22 bp, Homo sapiens
tttttgcaccaacctaatagaa

SEQ ID NO: 7863311 - DNA, 22 bp, Homo sapiens
tttttgcaccaacctaatagaa

SEQ ID NO: 7863312 - DNA, 22 bp, Homo sapiens
tttttgctgataagcagaattc

SEQ ID NO: 7863313 - DNA, 22 bp, Homo sapiens
tttttggaaggagatccacact

SEQ ID NO: 7863314 - DNA, 22 bp, Homo sapiens
tttttgggtccaggctgtatct

SEQ ID NO: 7863315 - DNA, 22 bp, Homo sapiens
tttttgaaggctgatgtgatta

SEQ ID NO: 7863316 - DNA, 22 bp, Homo sapiens
tttttgaaggctgatgtgatta

SEQ ID NO: 7863317 - DNA, 22 bp, Homo sapiens
tttttcttgtgctggatctaat

SEQ ID NO: 7863318 - DNA, 22 bp, Homo sapiens
tttttctactggtgttggtgta

SEQ ID NO: 7863319 - DNA, 22 bp, Homo sapiens
tttttgattcctagtctaggca

SEQ ID NO: 7863320 - DNA, 22 bp, Homo sapiens
tttttgatactcaagaggggta

SEQ ID NO: 7863321 - DNA, 22 bp, Homo sapiens
tttttgaaggctgatgtgatta

SEQ ID NO: 7863322 - DNA, 22 bp, Homo sapiens
tttttctactgcccacattgta

SEQ ID NO: 7863323 - DNA, 22 bp, Homo sapiens
tttttctactgcccacattgta

SEQ ID NO: 7863324 - DNA, 22 bp, Homo sapiens
tttttctactgcccacattgta

SEQ ID NO: 7863325 - DNA, 22 bp, Homo sapiens
tttttctactgcccacattgta

SEQ ID NO: 7863326 - DNA, 22 bp, Homo sapiens
tttttctaatggcttaggatgt

SEQ ID NO: 7863327 - DNA, 22 bp, Homo sapiens
tttttctaatggcttaggatgt

SEQ ID NO: 7863328 - DNA, 22 bp, Homo sapiens
tttttctaatggcttaggatgt

SEQ ID NO: 7863329 - DNA, 22 bp, Homo sapiens
tttttctactgcccacattgta

SEQ ID NO: 7863330 - DNA, 20 bp, Homo sapiens
tttttccttctctacaggca

SEQ ID NO: 7863331 - DNA, 20 bp, Homo sapiens
tttttccttctctacaggca

SEQ ID NO: 7863332 - DNA, 22 bp, Homo sapiens
tttttccttggatgtgtctctc

SEQ ID NO: 7863333 - DNA, 22 bp, Homo sapiens
tttttccttggatgtgtctctc

SEQ ID NO: 7863334 - DNA, 22 bp, Homo sapiens
tttttccttggatgtgtctctc

SEQ ID NO: 7863335 - DNA, 22 bp, Homo sapiens
tttttccttggatgtgtctctc

SEQ ID NO: 7863336 - DNA, 23 bp, Homo sapiens
ttttttgtcttgctaggctgccc

SEQ ID NO: 7863337 - DNA, 22 bp, Homo sapiens
ttttttgtcttgaagaaatggt

SEQ ID NO: 7863338 - DNA, 22 bp, Homo sapiens
cacctggcagctgttggccacg

SEQ ID NO: 7863339 - DNA, 22 bp, Homo sapiens
cacctggcagctgttggccacg

SEQ ID NO: 7863340 - DNA, 22 bp, Homo sapiens
cacctggcccagctccagtgct

SEQ ID NO: 7863341 - DNA, 22 bp, Homo sapiens
cacctggcagctgttggccacg

SEQ ID NO: 7863342 - DNA, 22 bp, Homo sapiens
cacctggcccagctccagtgct

SEQ ID NO: 7863343 - DNA, 22 bp, Homo sapiens
cacctggatatgtttcagcttg

SEQ ID NO: 7863344 - DNA, 22 bp, Homo sapiens
cacctggagtagcaaggtaatt

SEQ ID NO: 7863345 - DNA, 20 bp, Homo sapiens
cacctggatatgacccagct

SEQ ID NO: 7863346 - DNA, 20 bp, Homo sapiens
cacctggatatgacccagct

SEQ ID NO: 7863347 - DNA, 22 bp, Homo sapiens
cacctgctgagctgctgggggt

SEQ ID NO: 7863348 - DNA, 22 bp, Homo sapiens
cacctggaccctgggaggaggg

SEQ ID NO: 7863349 - DNA, 22 bp, Homo sapiens
cacctgctccctcagttccagc

SEQ ID NO: 7863350 - DNA, 22 bp, Homo sapiens
cacctggaccctgggaggaggg

SEQ ID NO: 7863351 - DNA, 22 bp, Homo sapiens
cacctgcctggtccttagggct

SEQ ID NO: 7863352 - DNA, 22 bp, Homo sapiens
cacctgcctggtccttagggct

SEQ ID NO: 7863353 - DNA, 22 bp, Homo sapiens
cacctgcctggtccttagggct

SEQ ID NO: 7863354 - DNA, 23 bp, Homo sapiens
cacctggcttgagttggtgggtc

SEQ ID NO: 7863355 - DNA, 23 bp, Homo sapiens
cacctggcttgagttggtgggtc

SEQ ID NO: 7863356 - DNA, 22 bp, Homo sapiens
cacctggctgtgaagcctgggt

SEQ ID NO: 7863357 - DNA, 22 bp, Homo sapiens
cacctggctgtgaagcctgggt

SEQ ID NO: 7863358 - DNA, 22 bp, Homo sapiens
cacctgggctaaactatgcagg

SEQ ID NO: 7863359 - DNA, 22 bp, Homo sapiens
cacctgggctaaactatgcagg

SEQ ID NO: 7863360 - DNA, 22 bp, Homo sapiens
cacctggctggaagtgctccgg

SEQ ID NO: 7863361 - DNA, 22 bp, Homo sapiens
cacctggctggaagtgctccgg

SEQ ID NO: 7863362 - DNA, 22 bp, Homo sapiens
cacctggctgtgaagcctgggt

SEQ ID NO: 7863363 - DNA, 22 bp, Homo sapiens
cacctggctggaagtgctccgg

SEQ ID NO: 7863364 - DNA, 22 bp, Homo sapiens
cacctggctggaagtgctccgg

SEQ ID NO: 7863365 - DNA, 20 bp, Homo sapiens
cacctggctgactgtctcca

SEQ ID NO: 7863366 - DNA, 22 bp, Homo sapiens
cacctggcctacagggaccagc

SEQ ID NO: 7863367 - DNA, 22 bp, Homo sapiens
cacctggcccagctccagtgct

SEQ ID NO: 7863368 - DNA, 20 bp, Homo sapiens
cacctggctgactgtctcca

SEQ ID NO: 7863369 - DNA, 20 bp, Homo sapiens
cacctggctgactgtctcca

SEQ ID NO: 7863370 - DNA, 22 bp, Homo sapiens
ggccaggctgccctgggagcag

SEQ ID NO: 7863371 - DNA, 22 bp, Homo sapiens
ggccaggctgccctgggagcag

SEQ ID NO: 7863372 - DNA, 22 bp, Homo sapiens
ggccaggctgccctgggagcag

SEQ ID NO: 7863373 - DNA, 22 bp, Homo sapiens
ggccaggctgccctgggagcag

SEQ ID NO: 7863374 - DNA, 22 bp, Homo sapiens
ggccaggctgccctgggagcag

SEQ ID NO: 7863375 - DNA, 22 bp, Homo sapiens
ggccaggctgctgggaccccgc

SEQ ID NO: 7863376 - DNA, 22 bp, Homo sapiens
ggccaggctgctgggaccccgc

SEQ ID NO: 7863377 - DNA, 22 bp, Homo sapiens
ggccaggctgctgggaccccgc

SEQ ID NO: 7863378 - DNA, 22 bp, Homo sapiens
ggccaggctggtctcagacttc

SEQ ID NO: 7863379 - DNA, 22 bp, Homo sapiens
ggccaggctgctgggaccccgc

SEQ ID NO: 7863380 - DNA, 22 bp, Homo sapiens
ggccaggctgccctgggagcag

SEQ ID NO: 7863381 - DNA, 22 bp, Homo sapiens
ggccaggctggtctcagacttc

SEQ ID NO: 7863382 - DNA, 22 bp, Homo sapiens
ggccaggctggtctcagacttc

SEQ ID NO: 7863383 - DNA, 22 bp, Homo sapiens
ggccaggctggtctcagacttc

SEQ ID NO: 7863384 - DNA, 22 bp, Homo sapiens
ggccaggctggtctcagacttc

SEQ ID NO: 7863385 - DNA, 22 bp, Homo sapiens
ggccagggaggagaggcccctg

SEQ ID NO: 7863386 - DNA, 22 bp, Homo sapiens
ggccagggaggagaggcccctg

SEQ ID NO: 7863387 - DNA, 22 bp, Homo sapiens
ggccagggaggagaggcccctg

SEQ ID NO: 7863388 - DNA, 22 bp, Homo sapiens
ggccagggaggagaggcccctg

SEQ ID NO: 7863389 - DNA, 22 bp, Homo sapiens
ggccagggaggagaggcccctg

SEQ ID NO: 7863390 - DNA, 22 bp, Homo sapiens
ggccaggctggttccttgacct

SEQ ID NO: 7863391 - DNA, 22 bp, Homo sapiens
ggccaggctggttccttgacct

SEQ ID NO: 7863392 - DNA, 22 bp, Homo sapiens
ggccaggctggttccttgacct

SEQ ID NO: 7863393 - DNA, 22 bp, Homo sapiens
ggccaggctggttccttgacct

SEQ ID NO: 7863394 - DNA, 22 bp, Homo sapiens
caccaggctggagtgcagaggt

SEQ ID NO: 7863395 - DNA, 22 bp, Homo sapiens
caccaggctggagtgcagaggt

SEQ ID NO: 7863396 - DNA, 22 bp, Homo sapiens
caccaggctggagtgcagaggt

SEQ ID NO: 7863397 - DNA, 22 bp, Homo sapiens
caccctgggagtggaagtcagt

SEQ ID NO: 7863398 - DNA, 22 bp, Homo sapiens
caccaggctggagtgcagaggt

SEQ ID NO: 7863399 - DNA, 22 bp, Homo sapiens
caccaggctggagtgcagaggt

SEQ ID NO: 7863400 - DNA, 22 bp, Homo sapiens
caccaggctggagtgcagaggt

SEQ ID NO: 7863401 - DNA, 22 bp, Homo sapiens
cacctgcccagcacctgggatc

SEQ ID NO: 7863402 - DNA, 22 bp, Homo sapiens
cacctgcccagcacctgggatc

SEQ ID NO: 7863403 - DNA, 22 bp, Homo sapiens
cacctgcccagcacctgggatc

SEQ ID NO: 7863404 - DNA, 22 bp, Homo sapiens
caccctgtacaaatggacatct

SEQ ID NO: 7863405 - DNA, 22 bp, Homo sapiens
cacctgccaaatggggatgctg

SEQ ID NO: 7863406 - DNA, 22 bp, Homo sapiens
caccctgggctgggcctgttaa

SEQ ID NO: 7863407 - DNA, 22 bp, Homo sapiens
caccctgggctgggcctgttaa

SEQ ID NO: 7863408 - DNA, 22 bp, Homo sapiens
caccctgggctgggcctgttaa

SEQ ID NO: 7863409 - DNA, 22 bp, Homo sapiens
caccctgggctgggcctgttaa

SEQ ID NO: 7863410 - DNA, 22 bp, Homo sapiens
caccctgggctgggcctgttaa

SEQ ID NO: 7863411 - DNA, 22 bp, Homo sapiens
cacctgccccagtcttggagct

SEQ ID NO: 7863412 - DNA, 22 bp, Homo sapiens
cacctgccccagtcttggagct

SEQ ID NO: 7863413 - DNA, 22 bp, Homo sapiens
cacctgccccagtcttggagct

SEQ ID NO: 7863414 - DNA, 22 bp, Homo sapiens
cacctgccccagtcttggagct

SEQ ID NO: 7863415 - DNA, 22 bp, Homo sapiens
cacctgccccagtcttggagct

SEQ ID NO: 7863416 - DNA, 22 bp, Homo sapiens
cacctgccctttcttgctccac

SEQ ID NO: 7863417 - DNA, 22 bp, Homo sapiens
cacctgccctttcttgctccac

SEQ ID NO: 7863418 - DNA, 22 bp, Homo sapiens
cacctgcctcatttgtccctgc

SEQ ID NO: 7863419 - DNA, 22 bp, Homo sapiens
cacctgcctcatttgtccctgc

SEQ ID NO: 7863420 - DNA, 22 bp, Homo sapiens
cacctgcctgcaggggctccac

SEQ ID NO: 7863421 - DNA, 22 bp, Homo sapiens
cacctgcctgcaggggctccac

SEQ ID NO: 7863422 - DNA, 22 bp, Homo sapiens
cacctgcctgcaggggctccac

SEQ ID NO: 7863423 - DNA, 22 bp, Homo sapiens
cacctgcctgctagagcctgac

SEQ ID NO: 7863424 - DNA, 22 bp, Homo sapiens
cacctgcctgctagagcctgac

SEQ ID NO: 7863425 - DNA, 22 bp, Homo sapiens
caccaggctgcccaggacaggg

SEQ ID NO: 7863426 - DNA, 22 bp, Homo sapiens
caccaggctgcccaggacaggg

SEQ ID NO: 7863427 - DNA, 22 bp, Homo sapiens
caccaggctgcccaggacaggg

SEQ ID NO: 7863428 - DNA, 22 bp, Homo sapiens
caccaggctgcccaggacaggg

SEQ ID NO: 7863429 - DNA, 22 bp, Homo sapiens
caccaggctgcccaggacaggg

SEQ ID NO: 7863430 - DNA, 22 bp, Homo sapiens
caccaggctgcccaggacaggg

SEQ ID NO: 7863431 - DNA, 22 bp, Homo sapiens
caccaggctgaaccagagggga

SEQ ID NO: 7863432 - DNA, 22 bp, Homo sapiens
caccaggctgaaccagagggga

SEQ ID NO: 7863433 - DNA, 22 bp, Homo sapiens
caccaggctgagcctctcatct

SEQ ID NO: 7863434 - DNA, 22 bp, Homo sapiens
caccaggcacatagtaggcact

SEQ ID NO: 7863435 - DNA, 20 bp, Homo sapiens
caccaggcgctctgagaaca

SEQ ID NO: 7863436 - DNA, 22 bp, Homo sapiens
caccaggctgaaccagagggga

SEQ ID NO: 7863437 - DNA, 22 bp, Homo sapiens
caccaggcacatagtaggcact

SEQ ID NO: 7863438 - DNA, 22 bp, Homo sapiens
caccaggcacagctctcctgct

SEQ ID NO: 7863439 - DNA, 22 bp, Homo sapiens
caccaggatgggcaggtaggtc

SEQ ID NO: 7863440 - DNA, 22 bp, Homo sapiens
caccaggagtgagaatgaaggg

SEQ ID NO: 7863441 - DNA, 22 bp, Homo sapiens
caccaggaggacaggcccctac

SEQ ID NO: 7863442 - DNA, 22 bp, Homo sapiens
caccaggagtgagaatgaaggg

SEQ ID NO: 7863443 - DNA, 22 bp, Homo sapiens
caccaggagtgagaatgaaggg

SEQ ID NO: 7863444 - DNA, 22 bp, Homo sapiens
caccaggatgggcaggtaggtc

SEQ ID NO: 7863445 - DNA, 22 bp, Homo sapiens
caccaggatgggcaggtaggtc

SEQ ID NO: 7863446 - DNA, 22 bp, Homo sapiens
cactctgacacatgaacttgat

SEQ ID NO: 7863447 - DNA, 22 bp, Homo sapiens
cactctgaactattaacttggg

SEQ ID NO: 7863448 - DNA, 22 bp, Homo sapiens
cactgcaacctccacctcctgg

SEQ ID NO: 7863449 - DNA, 22 bp, Homo sapiens
cactgcaacctccacctcctgg

SEQ ID NO: 7863450 - DNA, 22 bp, Homo sapiens
cactgcactccagcctggcgac

SEQ ID NO: 7863451 - DNA, 22 bp, Homo sapiens
cactgcactccagcctgggaga

SEQ ID NO: 7863452 - DNA, 22 bp, Homo sapiens
cactgcactccagcctgggaga

SEQ ID NO: 7863453 - DNA, 22 bp, Homo sapiens
cactgcactccagcctgggaga

SEQ ID NO: 7863454 - DNA, 22 bp, Homo sapiens
cactgcactccagcctgggaga

SEQ ID NO: 7863455 - DNA, 22 bp, Homo sapiens
cactgcactccagcctgggaga

SEQ ID NO: 7863456 - DNA, 22 bp, Homo sapiens
cactgcactccagcctgggaga

SEQ ID NO: 7863457 - DNA, 22 bp, Homo sapiens
cactgcactccagcctgggaga

SEQ ID NO: 7863458 - DNA, 22 bp, Homo sapiens
cactgcactccagcctgggaga

SEQ ID NO: 7863459 - DNA, 22 bp, Homo sapiens
cactgcactccagcctgggaga

SEQ ID NO: 7863460 - DNA, 22 bp, Homo sapiens
cactgcactccagcctgggaga

SEQ ID NO: 7863461 - DNA, 22 bp, Homo sapiens
cactgcactccagcctgggaga

SEQ ID NO: 7863462 - DNA, 22 bp, Homo sapiens
cactgcactccagcctgggaga

SEQ ID NO: 7863463 - DNA, 22 bp, Homo sapiens
cactgcactccagcctgggaga

SEQ ID NO: 7863464 - DNA, 22 bp, Homo sapiens
cactgcactccagcctgggaga

SEQ ID NO: 7863465 - DNA, 22 bp, Homo sapiens
cactcccttcaggagcctagga

SEQ ID NO: 7863466 - DNA, 23 bp, Homo sapiens
cactcctgtttctaagccagcat

SEQ ID NO: 7863467 - DNA, 22 bp, Homo sapiens
cactcccttcaggagcctagga

SEQ ID NO: 7863468 - DNA, 22 bp, Homo sapiens
cactctcactgagctcatgcca

SEQ ID NO: 7863469 - DNA, 22 bp, Homo sapiens
cactctcactgagctcatgcca

SEQ ID NO: 7863470 - DNA, 21 bp, Homo sapiens
cactctcccaatccttgctga

SEQ ID NO: 7863471 - DNA, 22 bp, Homo sapiens
cactctccagcacaccccattt

SEQ ID NO: 7863472 - DNA, 22 bp, Homo sapiens
cactccagcctcagtgacagag

SEQ ID NO: 7863473 - DNA, 22 bp, Homo sapiens
cactccagccatttgtccccag

SEQ ID NO: 7863474 - DNA, 22 bp, Homo sapiens
cactccagcctcagtgacagag

SEQ ID NO: 7863475 - DNA, 22 bp, Homo sapiens
cactccaggtcccagttcctgg

SEQ ID NO: 7863476 - DNA, 22 bp, Homo sapiens
cactcccttcaggagcctagga

SEQ ID NO: 7863477 - DNA, 22 bp, Homo sapiens
cactcctataattaaagatgca

SEQ ID NO: 7863478 - DNA, 22 bp, Homo sapiens
cactccctctagttgcattctg

SEQ ID NO: 7863479 - DNA, 22 bp, Homo sapiens
cactccctctagttgcattctg

SEQ ID NO: 7863480 - DNA, 21 bp, Homo sapiens
cactcaataaatgtcatatgc

SEQ ID NO: 7863481 - DNA, 22 bp, Homo sapiens
cactatttttcacttaggctta

SEQ ID NO: 7863482 - DNA, 22 bp, Homo sapiens
cactcaatacaatggttggcac

SEQ ID NO: 7863483 - DNA, 22 bp, Homo sapiens
cactattttctcttcagatggc

SEQ ID NO: 7863484 - DNA, 22 bp, Homo sapiens
cactatttgctttgggctagag

SEQ ID NO: 7863485 - DNA, 22 bp, Homo sapiens
cactcacttatttctaacagaa

SEQ ID NO: 7863486 - DNA, 22 bp, Homo sapiens
cactcagaggtttgattgctca

SEQ ID NO: 7863487 - DNA, 22 bp, Homo sapiens
cactcaggctgtgtcaggagga

SEQ ID NO: 7863488 - DNA, 22 bp, Homo sapiens
cactcaggctgtgtcaggagga

SEQ ID NO: 7863489 - DNA, 22 bp, Homo sapiens
cactcaggctgtgtcaggagga

SEQ ID NO: 7863490 - DNA, 22 bp, Homo sapiens
cactcagctgagccctcagccc

SEQ ID NO: 7863491 - DNA, 22 bp, Homo sapiens
cactcagctgagccctcagccc

SEQ ID NO: 7863492 - DNA, 21 bp, Homo sapiens
cactccacttagaacagggtt

SEQ ID NO: 7863493 - DNA, 21 bp, Homo sapiens
cactccacttagaacagggtt

SEQ ID NO: 7863494 - DNA, 21 bp, Homo sapiens
cactccacttagaacagggtt

SEQ ID NO: 7863495 - DNA, 21 bp, Homo sapiens
cactccacttagaacagggtt

SEQ ID NO: 7863496 - DNA, 21 bp, Homo sapiens
cactccacttagaacagggtt

SEQ ID NO: 7863497 - DNA, 21 bp, Homo sapiens
cactccacttagaacagggtt

SEQ ID NO: 7863498 - DNA, 22 bp, Homo sapiens
cactcagggtacaatggagggc

SEQ ID NO: 7863499 - DNA, 22 bp, Homo sapiens
cactcagggatcaggtaaattc

SEQ ID NO: 7863500 - DNA, 21 bp, Homo sapiens
cactcagggtatgtgccaggc

SEQ ID NO: 7863501 - DNA, 21 bp, Homo sapiens
cactcagggtatgtgccaggc

SEQ ID NO: 7863502 - DNA, 22 bp, Homo sapiens
cactccaagacctactttctct

SEQ ID NO: 7863503 - DNA, 22 bp, Homo sapiens
cactccaagacctactttctct

SEQ ID NO: 7863504 - DNA, 22 bp, Homo sapiens
cactcatattggaacaagcttg

SEQ ID NO: 7863505 - DNA, 22 bp, Homo sapiens
cactccaagacctactttctct

SEQ ID NO: 7863506 - DNA, 21 bp, Homo sapiens
cactcagggtatgtgccaggc

SEQ ID NO: 7863507 - DNA, 21 bp, Homo sapiens
cactcagggtatgtgccaggc

SEQ ID NO: 7863508 - DNA, 17 bp, Homo sapiens
cactagtagtctctggc

SEQ ID NO: 7863509 - DNA, 17 bp, Homo sapiens
cactagtagtctctggc

SEQ ID NO: 7863510 - DNA, 19 bp, Homo sapiens
cactagtctagatgggatg

SEQ ID NO: 7863511 - DNA, 22 bp, Homo sapiens
cactagtcctggtttcatgcta

SEQ ID NO: 7863512 - DNA, 22 bp, Homo sapiens
cactagtggccccatgtggttg

SEQ ID NO: 7863513 - DNA, 22 bp, Homo sapiens
cactagttcacaaaataggaaa

SEQ ID NO: 7863514 - DNA, 22 bp, Homo sapiens
cacgccagccggacactgggcc

SEQ ID NO: 7863515 - DNA, 22 bp, Homo sapiens
ggccagggccaaggctttccca

SEQ ID NO: 7863516 - DNA, 22 bp, Homo sapiens
ggccagggaggagaggcccctg

SEQ ID NO: 7863517 - DNA, 22 bp, Homo sapiens
ggccagggccaaggctttccca

SEQ ID NO: 7863518 - DNA, 23 bp, Homo sapiens
cacggcagcctccgagggtgctg

SEQ ID NO: 7863519 - DNA, 23 bp, Homo sapiens
cacggcagcctccgagggtgctg

SEQ ID NO: 7863520 - DNA, 23 bp, Homo sapiens
cacggcagcctccgagggtgctg

SEQ ID NO: 7863521 - DNA, 22 bp, Homo sapiens
cacgcgcacactcaggtcaagt

SEQ ID NO: 7863522 - DNA, 22 bp, Homo sapiens
cactatgcagtgagaaaatggc

SEQ ID NO: 7863523 - DNA, 22 bp, Homo sapiens
cactatatgcctttgaaataca

SEQ ID NO: 7863524 - DNA, 22 bp, Homo sapiens
cactatatgcctttgaaataca

SEQ ID NO: 7863525 - DNA, 22 bp, Homo sapiens
cactatatgcctttgaaataca

SEQ ID NO: 7863526 - DNA, 22 bp, Homo sapiens
cactatatctctttcatctttt

SEQ ID NO: 7863527 - DNA, 22 bp, Homo sapiens
cactatatctgttcttgtttat

SEQ ID NO: 7863528 - DNA, 22 bp, Homo sapiens
cactatatctgttcttgtttat

SEQ ID NO: 7863529 - DNA, 22 bp, Homo sapiens
cactatttcctggattttgacg

SEQ ID NO: 7863530 - DNA, 22 bp, Homo sapiens
cactatttcctggattttgacg

SEQ ID NO: 7863531 - DNA, 22 bp, Homo sapiens
cactatgcttacatgcttatat

SEQ ID NO: 7863532 - DNA, 22 bp, Homo sapiens
cactatgtgcattgttttctcc

SEQ ID NO: 7863533 - DNA, 22 bp, Homo sapiens
cactatttatacttcctgatcc

SEQ ID NO: 7863534 - DNA, 21 bp, Homo sapiens
cactatttatatatgccagct

SEQ ID NO: 7863535 - DNA, 22 bp, Homo sapiens
cactgtccaatagatacataat

SEQ ID NO: 7863536 - DNA, 22 bp, Homo sapiens
ggctctgctggattgaggccag

SEQ ID NO: 7863537 - DNA, 22 bp, Homo sapiens
ggctctgctggattgaggccag

SEQ ID NO: 7863538 - DNA, 22 bp, Homo sapiens
cactgtattattaggaatgaca

SEQ ID NO: 7863539 - DNA, 22 bp, Homo sapiens
cactgtattattaggaatgaca

SEQ ID NO: 7863540 - DNA, 22 bp, Homo sapiens
cactgtcacgttctgaaactgt

SEQ ID NO: 7863541 - DNA, 22 bp, Homo sapiens
cactgtattattaggaatgaca

SEQ ID NO: 7863542 - DNA, 21 bp, Homo sapiens
cactgtatagcaggagaaaac

SEQ ID NO: 7863543 - DNA, 22 bp, Homo sapiens
cactgtactgtgaataaggagg

SEQ ID NO: 7863544 - DNA, 22 bp, Homo sapiens
cactgtactgtgaataaggagg

SEQ ID NO: 7863545 - DNA, 22 bp, Homo sapiens
cactgtactgggttgaaggacg

SEQ ID NO: 7863546 - DNA, 22 bp, Homo sapiens
cactgtactgtgaataaggagg

SEQ ID NO: 7863547 - DNA, 22 bp, Homo sapiens
ggctctgcttcagaaggctcat

SEQ ID NO: 7863548 - DNA, 22 bp, Homo sapiens
ggctctgcttcagaaggctcat

SEQ ID NO: 7863549 - DNA, 22 bp, Homo sapiens
ggctctgctggtaagatgcctc

SEQ ID NO: 7863550 - DNA, 22 bp, Homo sapiens
ggctctgcttgaggccagcctg

SEQ ID NO: 7863551 - DNA, 22 bp, Homo sapiens
ggctctgcttctcacctgttcc

SEQ ID NO: 7863552 - DNA, 22 bp, Homo sapiens
ggctctgcttcagaaggctcat

SEQ ID NO: 7863553 - DNA, 22 bp, Homo sapiens
cactggtgtattagagctagaa

SEQ ID NO: 7863554 - DNA, 22 bp, Homo sapiens
cactggtgtattagagctagaa

SEQ ID NO: 7863555 - DNA, 22 bp, Homo sapiens
cactggtgtctgagcagggtga

SEQ ID NO: 7863556 - DNA, 22 bp, Homo sapiens
cactggtgtctgagcagggtga

SEQ ID NO: 7863557 - DNA, 22 bp, Homo sapiens
cactggtgtctgagcagggtga

SEQ ID NO: 7863558 - DNA, 22 bp, Homo sapiens
cactggttccccaggtgcctag

SEQ ID NO: 7863559 - DNA, 21 bp, Homo sapiens
cactggttcctgaatgccttc

SEQ ID NO: 7863560 - DNA, 22 bp, Homo sapiens
cactggtgccagagaacagaat

SEQ ID NO: 7863561 - DNA, 22 bp, Homo sapiens
cactggtgccagagaacagaat

SEQ ID NO: 7863562 - DNA, 22 bp, Homo sapiens
cactggtgtacaggaggtaaaa

SEQ ID NO: 7863563 - DNA, 23 bp, Homo sapiens
cactggtggggtttaaaagaagc

SEQ ID NO: 7863564 - DNA, 22 bp, Homo sapiens
cactggtgtattagagctagaa

SEQ ID NO: 7863565 - DNA, 22 bp, Homo sapiens
cactggtgtacaggaggtaaaa

SEQ ID NO: 7863566 - DNA, 22 bp, Homo sapiens
cactgggcaattctgagcctaa

SEQ ID NO: 7863567 - DNA, 22 bp, Homo sapiens
cactggtgatgaggcagttagg

SEQ ID NO: 7863568 - DNA, 22 bp, Homo sapiens
cactggtgatgaggcagttagg

SEQ ID NO: 7863569 - DNA, 22 bp, Homo sapiens
cactggtgccagagaacagaat

SEQ ID NO: 7863570 - DNA, 22 bp, Homo sapiens
cactggtgatgaggcagttagg

SEQ ID NO: 7863571 - DNA, 22 bp, Homo sapiens
cactgggagtcgtaagacacgg

SEQ ID NO: 7863572 - DNA, 22 bp, Homo sapiens
cactgggatttggggtgtctta

SEQ ID NO: 7863573 - DNA, 22 bp, Homo sapiens
cactgtaatggaattttcttta

SEQ ID NO: 7863574 - DNA, 22 bp, Homo sapiens
cactgtaatagcattataagtg

SEQ ID NO: 7863575 - DNA, 22 bp, Homo sapiens
cactgtacagcattaacaaggc

SEQ ID NO: 7863576 - DNA, 22 bp, Homo sapiens
cactgtacagcattaacaaggc

SEQ ID NO: 7863577 - DNA, 22 bp, Homo sapiens
cactgtacccatttaaataaat

SEQ ID NO: 7863578 - DNA, 22 bp, Homo sapiens
cactggttgaagttctgtatgg

SEQ ID NO: 7863579 - DNA, 22 bp, Homo sapiens
cactggttgcctctttctgttc

SEQ ID NO: 7863580 - DNA, 20 bp, Homo sapiens
cactggttggcacttaggga

SEQ ID NO: 7863581 - DNA, 22 bp, Homo sapiens
cactggttggctgagatccata

SEQ ID NO: 7863582 - DNA, 22 bp, Homo sapiens
cactggttgggaaaggcagagg

SEQ ID NO: 7863583 - DNA, 22 bp, Homo sapiens
cactggttgggaaaggcagagg

SEQ ID NO: 7863584 - DNA, 22 bp, Homo sapiens
cactggttttgagagtagtcat

SEQ ID NO: 7863585 - DNA, 22 bp, Homo sapiens
cactggttttgctgataaggca

SEQ ID NO: 7863586 - DNA, 22 bp, Homo sapiens
cactggttttgctgataaggca

SEQ ID NO: 7863587 - DNA, 18 bp, Homo sapiens
cactggtttctgatgttt

SEQ ID NO: 7863588 - DNA, 22 bp, Homo sapiens
cactggttttaatttccatttc

SEQ ID NO: 7863589 - DNA, 22 bp, Homo sapiens
cactggttttcaaaccctgggt

SEQ ID NO: 7863590 - DNA, 22 bp, Homo sapiens
cactggttttcttcctcgtagc

SEQ ID NO: 7863591 - DNA, 22 bp, Homo sapiens
cactgtaatagcattataagtg

SEQ ID NO: 7863592 - DNA, 22 bp, Homo sapiens
cactgcactccagcctgggtca

SEQ ID NO: 7863593 - DNA, 22 bp, Homo sapiens
cactgcactccagcctgggtca

SEQ ID NO: 7863594 - DNA, 22 bp, Homo sapiens
cactgcactccagcctgggtca

SEQ ID NO: 7863595 - DNA, 22 bp, Homo sapiens
cactgcactccagcctgggtca

SEQ ID NO: 7863596 - DNA, 22 bp, Homo sapiens
cactgcactccagcctgggtca

SEQ ID NO: 7863597 - DNA, 22 bp, Homo sapiens
cactgcactccagcctgggcaa

SEQ ID NO: 7863598 - DNA, 22 bp, Homo sapiens
cactgcactccagcctgggaga

SEQ ID NO: 7863599 - DNA, 22 bp, Homo sapiens
cactgcactccagcctgggtca

SEQ ID NO: 7863600 - DNA, 22 bp, Homo sapiens
cactgcactccagcctgggcaa

SEQ ID NO: 7863601 - DNA, 22 bp, Homo sapiens
cactgcactccagcctgggtca

SEQ ID NO: 7863602 - DNA, 22 bp, Homo sapiens
cactgcactccagcctgggtca

SEQ ID NO: 7863603 - DNA, 22 bp, Homo sapiens
cactgcactccagcctgggtca

SEQ ID NO: 7863604 - DNA, 22 bp, Homo sapiens
cactgcactccagcctgggtca

SEQ ID NO: 7863605 - DNA, 22 bp, Homo sapiens
cactgcactccagcctgggtca

SEQ ID NO: 7863606 - DNA, 22 bp, Homo sapiens
cactgcactccagcctgggtga

SEQ ID NO: 7863607 - DNA, 22 bp, Homo sapiens
cactgcactccagcctgggtca

SEQ ID NO: 7863608 - DNA, 22 bp, Homo sapiens
cactgcactccagcctgggtca

SEQ ID NO: 7863609 - DNA, 22 bp, Homo sapiens
cactgcactccagcctgggtca

SEQ ID NO: 7863610 - DNA, 22 bp, Homo sapiens
cactgcactccagcctgggtga

SEQ ID NO: 7863611 - DNA, 22 bp, Homo sapiens
cactgcactccagcctgggtga

SEQ ID NO: 7863612 - DNA, 22 bp, Homo sapiens
cactgcactccagcctgggtga

SEQ ID NO: 7863613 - DNA, 22 bp, Homo sapiens
cactgcactccagcctgggtga

SEQ ID NO: 7863614 - DNA, 22 bp, Homo sapiens
cactgcactccagcctgggtga

SEQ ID NO: 7863615 - DNA, 22 bp, Homo sapiens
cactgcactccagcctgggtga

SEQ ID NO: 7863616 - DNA, 22 bp, Homo sapiens
cactgcactccagcctgggtga

SEQ ID NO: 7863617 - DNA, 22 bp, Homo sapiens
cactgcactccagcctgggtga

SEQ ID NO: 7863618 - DNA, 22 bp, Homo sapiens
cactgcactccagcctgggtga

SEQ ID NO: 7863619 - DNA, 22 bp, Homo sapiens
cactgcactccagcctgggtga

SEQ ID NO: 7863620 - DNA, 22 bp, Homo sapiens
cactgcactccagcctgggtga

SEQ ID NO: 7863621 - DNA, 22 bp, Homo sapiens
cactgcactccagcttgggtga

SEQ ID NO: 7863622 - DNA, 22 bp, Homo sapiens
cactgcactccagcttgggtga

SEQ ID NO: 7863623 - DNA, 22 bp, Homo sapiens
cactgcactccagcttgggtga

SEQ ID NO: 7863624 - DNA, 22 bp, Homo sapiens
cactgcactccagcttgggtga

SEQ ID NO: 7863625 - DNA, 22 bp, Homo sapiens
cactgcactccagcttgggtga

SEQ ID NO: 7863626 - DNA, 22 bp, Homo sapiens
cactgcactccagcttgggtga

SEQ ID NO: 7863627 - DNA, 22 bp, Homo sapiens
cactgcactccagcttgggtga

SEQ ID NO: 7863628 - DNA, 22 bp, Homo sapiens
cactgcactccagcttgggtga

SEQ ID NO: 7863629 - DNA, 22 bp, Homo sapiens
cactgcactccagcttgggcaa

SEQ ID NO: 7863630 - DNA, 22 bp, Homo sapiens
cactgcactccagcctgggtga

SEQ ID NO: 7863631 - DNA, 22 bp, Homo sapiens
cactgcactccagcctgggtga

SEQ ID NO: 7863632 - DNA, 22 bp, Homo sapiens
cacttatttatgcagaaaagtt

SEQ ID NO: 7863633 - DNA, 22 bp, Homo sapiens
cacttcaacctctgagtcctgg

SEQ ID NO: 7863634 - DNA, 22 bp, Homo sapiens
cacttattatgggctaggaact

SEQ ID NO: 7863635 - DNA, 22 bp, Homo sapiens
cacttatactttggatgtggat

SEQ ID NO: 7863636 - DNA, 22 bp, Homo sapiens
cacttagagccagatgcatagt

SEQ ID NO: 7863637 - DNA, 22 bp, Homo sapiens
cacttagagccagatgcatagt

SEQ ID NO: 7863638 - DNA, 22 bp, Homo sapiens
cacttagaaaacttgagcaagt

SEQ ID NO: 7863639 - DNA, 22 bp, Homo sapiens
cacttagaaaacttgagcaagt

SEQ ID NO: 7863640 - DNA, 22 bp, Homo sapiens
cacttagatactagatcacaaa

SEQ ID NO: 7863641 - DNA, 22 bp, Homo sapiens
cacttaactgtgtgccaagtac

SEQ ID NO: 7863642 - DNA, 22 bp, Homo sapiens
cacttcaaggaatatctagaaa

SEQ ID NO: 7863643 - DNA, 19 bp, Homo sapiens
cacttcacatggtgaaagc

SEQ ID NO: 7863644 - DNA, 22 bp, Homo sapiens
cacttcaggttctggcagggcg

SEQ ID NO: 7863645 - DNA, 22 bp, Homo sapiens
cacttcattgggaccagggctg

SEQ ID NO: 7863646 - DNA, 22 bp, Homo sapiens
cacttcaggttctggcagggcg

SEQ ID NO: 7863647 - DNA, 22 bp, Homo sapiens
cacttcaccactaggctatact

SEQ ID NO: 7863648 - DNA, 22 bp, Homo sapiens
cacttccagagtctgggctggg

SEQ ID NO: 7863649 - DNA, 22 bp, Homo sapiens
cacttccagagtctgggctggg

SEQ ID NO: 7863650 - DNA, 22 bp, Homo sapiens
cacttcattgggaccagggctg

SEQ ID NO: 7863651 - DNA, 20 bp, Homo sapiens
ggctctggaatctggtgggc

SEQ ID NO: 7863652 - DNA, 20 bp, Homo sapiens
ggctctggaatctggtgggc

SEQ ID NO: 7863653 - DNA, 22 bp, Homo sapiens
cacttaaatctgttgagaaaaa

SEQ ID NO: 7863654 - DNA, 22 bp, Homo sapiens
cactgtggcttaccaaagctaa

SEQ ID NO: 7863655 - DNA, 22 bp, Homo sapiens
cactgtggcaacctgtgcccaa

SEQ ID NO: 7863656 - DNA, 22 bp, Homo sapiens
cactgtggcaacctgtgcccaa

SEQ ID NO: 7863657 - DNA, 20 bp, Homo sapiens
ggctctggaatctggtgggc

SEQ ID NO: 7863658 - DNA, 20 bp, Homo sapiens
ggctctggaatctggtgggc

SEQ ID NO: 7863659 - DNA, 20 bp, Homo sapiens
ggctctggaatctggtgggc

SEQ ID NO: 7863660 - DNA, 20 bp, Homo sapiens
ggctctggaatctggtgggc

SEQ ID NO: 7863661 - DNA, 20 bp, Homo sapiens
ggctctggaatctggtgggc

SEQ ID NO: 7863662 - DNA, 22 bp, Homo sapiens
ggctctggaaagtgtccttgat

SEQ ID NO: 7863663 - DNA, 20 bp, Homo sapiens
ggctctggaatctggtgggc

SEQ ID NO: 7863664 - DNA, 20 bp, Homo sapiens
ggctctggaatctggtgggc

SEQ ID NO: 7863665 - DNA, 22 bp, Homo sapiens
ggctctggaaagtgtccttgat

SEQ ID NO: 7863666 - DNA, 22 bp, Homo sapiens
ggctctggaaagtgtccttgat

SEQ ID NO: 7863667 - DNA, 20 bp, Homo sapiens
ggctctgcttgtgagcagcc

SEQ ID NO: 7863668 - DNA, 22 bp, Homo sapiens
ggctctggaaagtgtccttgat

SEQ ID NO: 7863669 - DNA, 22 bp, Homo sapiens
ggctctggaaagtgtccttgat

SEQ ID NO: 7863670 - DNA, 22 bp, Homo sapiens
ggctctggaaagtgtccttgat

SEQ ID NO: 7863671 - DNA, 22 bp, Homo sapiens
ggctctggaaagtgtccttgat

SEQ ID NO: 7863672 - DNA, 22 bp, Homo sapiens
ggctctggaaagtgtccttgat

SEQ ID NO: 7863673 - DNA, 22 bp, Homo sapiens
cacttgttggtggtgaaatcac

SEQ ID NO: 7863674 - DNA, 22 bp, Homo sapiens
cacttgttggtggtgaaatcac

SEQ ID NO: 7863675 - DNA, 22 bp, Homo sapiens
cacttgttggtggtgaaatcac

SEQ ID NO: 7863676 - DNA, 22 bp, Homo sapiens
cacttgttggtggtgaaatcac

SEQ ID NO: 7863677 - DNA, 21 bp, Homo sapiens
cactttaaaaatatctttata

SEQ ID NO: 7863678 - DNA, 21 bp, Homo sapiens
cactttaaaaatatctttata

SEQ ID NO: 7863679 - DNA, 22 bp, Homo sapiens
cacttgggattaggggctaggt

SEQ ID NO: 7863680 - DNA, 22 bp, Homo sapiens
cacttgttggtggtgaaatcac

SEQ ID NO: 7863681 - DNA, 22 bp, Homo sapiens
cacttgttggtggtgaaatcac

SEQ ID NO: 7863682 - DNA, 22 bp, Homo sapiens
cacttgtagaggcattattcca

SEQ ID NO: 7863683 - DNA, 22 bp, Homo sapiens
cacttgttggtggtgaaatcac

SEQ ID NO: 7863684 - DNA, 17 bp, Homo sapiens
ggctgctgtgctggtgc

SEQ ID NO: 7863685 - DNA, 22 bp, Homo sapiens
cactttaactcacatttcagct

SEQ ID NO: 7863686 - DNA, 17 bp, Homo sapiens
ggctgctgtgctggtgc

SEQ ID NO: 7863687 - DNA, 17 bp, Homo sapiens
ggctgctgtgctggtgc

SEQ ID NO: 7863688 - DNA, 17 bp, Homo sapiens
ggctgctgtgctggtgc

SEQ ID NO: 7863689 - DNA, 22 bp, Homo sapiens
cactttaactcacatttcagct

SEQ ID NO: 7863690 - DNA, 22 bp, Homo sapiens
ggctggcaagtcagtgctgatg

SEQ ID NO: 7863691 - DNA, 22 bp, Homo sapiens
ggctggcaaaaaccttctctga

SEQ ID NO: 7863692 - DNA, 22 bp, Homo sapiens
ggctggatttttggaaggagag

SEQ ID NO: 7863693 - DNA, 22 bp, Homo sapiens
ggctggcaaaaaccttctctga

SEQ ID NO: 7863694 - DNA, 20 bp, Homo sapiens
ggctgctgtgggcagagagg

SEQ ID NO: 7863695 - DNA, 17 bp, Homo sapiens
ggctgctgtgctggtgc

SEQ ID NO: 7863696 - DNA, 17 bp, Homo sapiens
cacttgctggtctacct

SEQ ID NO: 7863697 - DNA, 22 bp, Homo sapiens
cacttggaggaaggcctattca

SEQ ID NO: 7863698 - DNA, 22 bp, Homo sapiens
cacttggaggaaggcctattca

SEQ ID NO: 7863699 - DNA, 22 bp, Homo sapiens
cacttggaggccccctgtgccc

SEQ ID NO: 7863700 - DNA, 22 bp, Homo sapiens
cacttgatggaagagcagaaga

SEQ ID NO: 7863701 - DNA, 22 bp, Homo sapiens
cacttgatggaagagcagaaga

SEQ ID NO: 7863702 - DNA, 22 bp, Homo sapiens
cacttgcctacccttagaacgt

SEQ ID NO: 7863703 - DNA, 22 bp, Homo sapiens
cacttgaatgaaagagactcct

SEQ ID NO: 7863704 - DNA, 22 bp, Homo sapiens
cacttgaagtgaattgctcacc

SEQ ID NO: 7863705 - DNA, 22 bp, Homo sapiens
cacttgaatgagaatttcctgg

SEQ ID NO: 7863706 - DNA, 22 bp, Homo sapiens
cacttgaatggcattgttcctt

SEQ ID NO: 7863707 - DNA, 21 bp, Homo sapiens
cacttgaatggtgttttacaa

SEQ ID NO: 7863708 - DNA, 22 bp, Homo sapiens
cacttgagttcttaatagtcag

SEQ ID NO: 7863709 - DNA, 22 bp, Homo sapiens
cacttgaaaatcagaggaaatt

SEQ ID NO: 7863710 - DNA, 22 bp, Homo sapiens
cacttctgttgccttgtgcaat

SEQ ID NO: 7863711 - DNA, 22 bp, Homo sapiens
cacttctctgataatctcagtt

SEQ ID NO: 7863712 - DNA, 22 bp, Homo sapiens
cacttctctgataatctcagtt

SEQ ID NO: 7863713 - DNA, 23 bp, Homo sapiens
cacttcccctgtggcgagcctgc

SEQ ID NO: 7863714 - DNA, 23 bp, Homo sapiens
cacttcccctgtggcgagcctgc

SEQ ID NO: 7863715 - DNA, 22 bp, Homo sapiens
cacttgaacccgggaggctgag

SEQ ID NO: 7863716 - DNA, 22 bp, Homo sapiens
cacttgaacccgggaggctgag

SEQ ID NO: 7863717 - DNA, 22 bp, Homo sapiens
cacttgaaatattaggggtgat

SEQ ID NO: 7863718 - DNA, 22 bp, Homo sapiens
cacttgaaagtaatggttgtgc

SEQ ID NO: 7863719 - DNA, 22 bp, Homo sapiens
cacttgaagtgaattgctcacc

SEQ ID NO: 7863720 - DNA, 22 bp, Homo sapiens
cacttgaagtttgggggactct

SEQ ID NO: 7863721 - DNA, 22 bp, Homo sapiens
cacttgaactgtttgaatgaga

SEQ ID NO: 7863722 - DNA, 22 bp, Homo sapiens
cacttgaactgtttgaatgaga

SEQ ID NO: 7863723 - DNA, 22 bp, Homo sapiens
cacatatatgaaatgaggaatt

SEQ ID NO: 7863724 - DNA, 22 bp, Homo sapiens
cacatgaagattcaactggatg

SEQ ID NO: 7863725 - DNA, 22 bp, Homo sapiens
cacatgaagagagtctagtaat

SEQ ID NO: 7863726 - DNA, 16 bp, Homo sapiens
cacatatatttatatg

SEQ ID NO: 7863727 - DNA, 22 bp, Homo sapiens
ggcaatgtttcgatgggagctg

SEQ ID NO: 7863728 - DNA, 22 bp, Homo sapiens
ggcaatagttgtgggttcttta

SEQ ID NO: 7863729 - DNA, 22 bp, Homo sapiens
ggcaataatgacattttaaaaa

SEQ ID NO: 7863730 - DNA, 23 bp, Homo sapiens
ggcaataacgagcttgtctctga

SEQ ID NO: 7863731 - DNA, 22 bp, Homo sapiens
ggcaagtgtgagaagggactgg

SEQ ID NO: 7863732 - DNA, 22 bp, Homo sapiens
ggcaataatctactctgccact

SEQ ID NO: 7863733 - DNA, 20 bp, Homo sapiens
ggcaatgccagatgacagga

SEQ ID NO: 7863734 - DNA, 22 bp, Homo sapiens
ggcaatgaagtgaagagattaa

SEQ ID NO: 7863735 - DNA, 22 bp, Homo sapiens
ggcaatgtctcttgcttccagg

SEQ ID NO: 7863736 - DNA, 22 bp, Homo sapiens
ggcaatcattggcattctctgg

SEQ ID NO: 7863737 - DNA, 22 bp, Homo sapiens
cacatgagacaattaaagactt

SEQ ID NO: 7863738 - DNA, 22 bp, Homo sapiens
cacatgagagcccccaagagca

SEQ ID NO: 7863739 - DNA, 22 bp, Homo sapiens
cacatgagagcccccaagagca

SEQ ID NO: 7863740 - DNA, 22 bp, Homo sapiens
cacatgagacaattaaagactt

SEQ ID NO: 7863741 - DNA, 22 bp, Homo sapiens
cacatgactctggctacccaga

SEQ ID NO: 7863742 - DNA, 22 bp, Homo sapiens
cacatgactctggctacccaga

SEQ ID NO: 7863743 - DNA, 22 bp, Homo sapiens
cacatgaccactctttacttct

SEQ ID NO: 7863744 - DNA, 23 bp, Homo sapiens
cacatgacctgacctaggctagg

SEQ ID NO: 7863745 - DNA, 22 bp, Homo sapiens
cacatgaccactctttacttct

SEQ ID NO: 7863746 - DNA, 22 bp, Homo sapiens
cacatgacactattttgttcta

SEQ ID NO: 7863747 - DNA, 22 bp, Homo sapiens
cacatgagagcccccaagagca

SEQ ID NO: 7863748 - DNA, 19 bp, Homo sapiens
cacatgagggctgagggac

SEQ ID NO: 7863749 - DNA, 19 bp, Homo sapiens
cacatgagggctgagggac

SEQ ID NO: 7863750 - DNA, 19 bp, Homo sapiens
cacatgagggctgagggac

SEQ ID NO: 7863751 - DNA, 22 bp, Homo sapiens
cacatgaggtgacttccaagct

SEQ ID NO: 7863752 - DNA, 22 bp, Homo sapiens
cacatgaggtggagatgaatga

SEQ ID NO: 7863753 - DNA, 22 bp, Homo sapiens
cacatgaggtggagatgaatga

SEQ ID NO: 7863754 - DNA, 22 bp, Homo sapiens
cacatgaaggctggggtcgtga

SEQ ID NO: 7863755 - DNA, 22 bp, Homo sapiens
cacatgaaggctggggtcgtga

SEQ ID NO: 7863756 - DNA, 22 bp, Homo sapiens
cacatgaaggctggggtcgtga

SEQ ID NO: 7863757 - DNA, 22 bp, Homo sapiens
cacatgaaggctggggtcgtga

SEQ ID NO: 7863758 - DNA, 22 bp, Homo sapiens
cacatgaaggctggggtcgtga

SEQ ID NO: 7863759 - DNA, 22 bp, Homo sapiens
cacatgaataaggctttattgt

SEQ ID NO: 7863760 - DNA, 22 bp, Homo sapiens
cacatgaattcacatgtatttt

SEQ ID NO: 7863761 - DNA, 22 bp, Homo sapiens
cacatgacactattttgttcta

SEQ ID NO: 7863762 - DNA, 22 bp, Homo sapiens
cacatgaattcacatgtatttt

SEQ ID NO: 7863763 - DNA, 22 bp, Homo sapiens
ggcagatgacagaccagtatgt

SEQ ID NO: 7863764 - DNA, 22 bp, Homo sapiens
ggcagatgacagaccagtatgt

SEQ ID NO: 7863765 - DNA, 22 bp, Homo sapiens
ggcagatatattcgtgaaatag

SEQ ID NO: 7863766 - DNA, 22 bp, Homo sapiens
ggcagagttggtggagtcagtt

SEQ ID NO: 7863767 - DNA, 22 bp, Homo sapiens
ggcagagttggtggagtcagtt

SEQ ID NO: 7863768 - DNA, 22 bp, Homo sapiens
ggcagagtggagtgcggcctcc

SEQ ID NO: 7863769 - DNA, 22 bp, Homo sapiens
ggcagagtggagtgcggcctcc

SEQ ID NO: 7863770 - DNA, 22 bp, Homo sapiens
ggcagagttggtggagtcagtt

SEQ ID NO: 7863771 - DNA, 22 bp, Homo sapiens
ggcagagtggagtgcggcctcc

SEQ ID NO: 7863772 - DNA, 22 bp, Homo sapiens
ggcagagtgctctgggcagggg

SEQ ID NO: 7863773 - DNA, 22 bp, Homo sapiens
ggcagatggaagaggctgggtc

SEQ ID NO: 7863774 - DNA, 22 bp, Homo sapiens
ggcagatggaagaggctgggtc

SEQ ID NO: 7863775 - DNA, 22 bp, Homo sapiens
ggcagatgctggcttctgctgt

SEQ ID NO: 7863776 - DNA, 22 bp, Homo sapiens
ggcagatggaagaggctgggtc

SEQ ID NO: 7863777 - DNA, 22 bp, Homo sapiens
cacatgctccatacagaatggg

SEQ ID NO: 7863778 - DNA, 22 bp, Homo sapiens
cacatgctccatacagaatggg

SEQ ID NO: 7863779 - DNA, 20 bp, Homo sapiens
cacatgctgtgtgtttctct

SEQ ID NO: 7863780 - DNA, 18 bp, Homo sapiens
ggcagatgacaggagaga

SEQ ID NO: 7863781 - DNA, 18 bp, Homo sapiens
ggcagatgacaggagaga

SEQ ID NO: 7863782 - DNA, 18 bp, Homo sapiens
ggcagatgacaggagaga

SEQ ID NO: 7863783 - DNA, 18 bp, Homo sapiens
ggcagatgacaggagaga

SEQ ID NO: 7863784 - DNA, 18 bp, Homo sapiens
ggcagatgacaggagaga

SEQ ID NO: 7863785 - DNA, 20 bp, Homo sapiens
ggcagatgcagagctatgca

SEQ ID NO: 7863786 - DNA, 20 bp, Homo sapiens
ggcagatgcagagctatgca

SEQ ID NO: 7863787 - DNA, 22 bp, Homo sapiens
cacatgagtgagaacatgcagt

SEQ ID NO: 7863788 - DNA, 22 bp, Homo sapiens
cacatgagtgagaacatgcagt

SEQ ID NO: 7863789 - DNA, 22 bp, Homo sapiens
cacatgagtgtaggaagaggga

SEQ ID NO: 7863790 - DNA, 22 bp, Homo sapiens
cacatgagtgagaacatgcagt

SEQ ID NO: 7863791 - DNA, 22 bp, Homo sapiens
cacatgagtcctgccaggtatg

SEQ ID NO: 7863792 - DNA, 22 bp, Homo sapiens
cacatgagtgtaggaagaggga

SEQ ID NO: 7863793 - DNA, 22 bp, Homo sapiens
cacatgatcacttcttgaaaat

SEQ ID NO: 7863794 - DNA, 22 bp, Homo sapiens
cacatgatggtggaagccatag

SEQ ID NO: 7863795 - DNA, 22 bp, Homo sapiens
cacatgatggtggaagccatag

SEQ ID NO: 7863796 - DNA, 22 bp, Homo sapiens
cacatgatcgtcatgtgaaagt

SEQ ID NO: 7863797 - DNA, 22 bp, Homo sapiens
cacatgcaccagaaatcaacat

SEQ ID NO: 7863798 - DNA, 22 bp, Homo sapiens
cacatgcaccagaaatcaacat

SEQ ID NO: 7863799 - DNA, 22 bp, Homo sapiens
cacatgcaccagaaatcaacat

SEQ ID NO: 7863800 - DNA, 22 bp, Homo sapiens
cacatgcaagtcctcagttcta

SEQ ID NO: 7863801 - DNA, 22 bp, Homo sapiens
cacatgcaagtcctcagttcta

SEQ ID NO: 7863802 - DNA, 22 bp, Homo sapiens
cacatgcaggagccaatgtaca

SEQ ID NO: 7863803 - DNA, 22 bp, Homo sapiens
cacatgcaggagccaatgtaca

SEQ ID NO: 7863804 - DNA, 22 bp, Homo sapiens
cacatgcaggagccaatgtaca

SEQ ID NO: 7863805 - DNA, 22 bp, Homo sapiens
ggcagaggtgacagtgtctttt

SEQ ID NO: 7863806 - DNA, 22 bp, Homo sapiens
ggcagaggtgacagtgtctttt

SEQ ID NO: 7863807 - DNA, 22 bp, Homo sapiens
ggcagagtcagaggtggttctg

SEQ ID NO: 7863808 - DNA, 22 bp, Homo sapiens
ggcagagtgctctgggcagggg

SEQ ID NO: 7863809 - DNA, 22 bp, Homo sapiens
ggcagagtgctctgggcagggg

SEQ ID NO: 7863810 - DNA, 22 bp, Homo sapiens
ggcagagtgctctgggcagggg

SEQ ID NO: 7863811 - DNA, 22 bp, Homo sapiens
ggcagagtcagaggtggttctg

SEQ ID NO: 7863812 - DNA, 22 bp, Homo sapiens
cacattaagaataatgagacta

SEQ ID NO: 7863813 - DNA, 22 bp, Homo sapiens
cacattaaatagtagggatgct

SEQ ID NO: 7863814 - DNA, 22 bp, Homo sapiens
cacattaaaatcctaacttcca

SEQ ID NO: 7863815 - DNA, 20 bp, Homo sapiens
cacattaaggaaaacaactg

SEQ ID NO: 7863816 - DNA, 20 bp, Homo sapiens
cacattaaggaaaacaactg

SEQ ID NO: 7863817 - DNA, 22 bp, Homo sapiens
cacattaagaataatgagacta

SEQ ID NO: 7863818 - DNA, 22 bp, Homo sapiens
cacattaaaatcctaacttcca

SEQ ID NO: 7863819 - DNA, 22 bp, Homo sapiens
cacattaaaatcctaacttcca

SEQ ID NO: 7863820 - DNA, 22 bp, Homo sapiens
cacatgtttttggccatcatgg

SEQ ID NO: 7863821 - DNA, 22 bp, Homo sapiens
cacatgtttgctacatttttct

SEQ ID NO: 7863822 - DNA, 22 bp, Homo sapiens
cacatgtttggcatgtcaccaa

SEQ ID NO: 7863823 - DNA, 22 bp, Homo sapiens
cacatgtttttggccatcatgg

SEQ ID NO: 7863824 - DNA, 22 bp, Homo sapiens
cacatgtttggcatgtcaccaa

SEQ ID NO: 7863825 - DNA, 22 bp, Homo sapiens
cacatgtttttggccatcatgg

SEQ ID NO: 7863826 - DNA, 22 bp, Homo sapiens
cacattcaattacacagatagg

SEQ ID NO: 7863827 - DNA, 22 bp, Homo sapiens
cacattcaattacacagatagg

SEQ ID NO: 7863828 - DNA, 22 bp, Homo sapiens
cacattattctaaagaggtact

SEQ ID NO: 7863829 - DNA, 22 bp, Homo sapiens
cacattatgctactaccaaatg

SEQ ID NO: 7863830 - DNA, 22 bp, Homo sapiens
cacattatgctactaccaaatg

SEQ ID NO: 7863831 - DNA, 22 bp, Homo sapiens
cacattcacttctctgtccacc

SEQ ID NO: 7863832 - DNA, 22 bp, Homo sapiens
cacattcacttctctgtccacc

SEQ ID NO: 7863833 - DNA, 22 bp, Homo sapiens
cacattcacatttttccctcta

SEQ ID NO: 7863834 - DNA, 22 bp, Homo sapiens
cacattcagggaacattggagg

SEQ ID NO: 7863835 - DNA, 22 bp, Homo sapiens
cacatgtgtgctgaggactgtg

SEQ ID NO: 7863836 - DNA, 22 bp, Homo sapiens
cacatgttaatgaaaggttttt

SEQ ID NO: 7863837 - DNA, 22 bp, Homo sapiens
cacatgttaacttcctacagtg

SEQ ID NO: 7863838 - DNA, 22 bp, Homo sapiens
cacatgtgtgctgaggactgtg

SEQ ID NO: 7863839 - DNA, 22 bp, Homo sapiens
cacatgtgtgctgaggactgtg

SEQ ID NO: 7863840 - DNA, 22 bp, Homo sapiens
cacatgtgtgctgaggactgtg

SEQ ID NO: 7863841 - DNA, 22 bp, Homo sapiens
cacatgtgtatatgtgaggggg

SEQ ID NO: 7863842 - DNA, 17 bp, Homo sapiens
cacatgttcttagagcc

SEQ ID NO: 7863843 - DNA, 22 bp, Homo sapiens
cacatgttcttaacttctgttt

SEQ ID NO: 7863844 - DNA, 17 bp, Homo sapiens
cacatgttcttagagcc

SEQ ID NO: 7863845 - DNA, 22 bp, Homo sapiens
cacatgtttcaggccatatttg

SEQ ID NO: 7863846 - DNA, 22 bp, Homo sapiens
cacatgtttcaggccatatttg

SEQ ID NO: 7863847 - DNA, 22 bp, Homo sapiens
cacatgtttgctacatttttct

SEQ ID NO: 7863848 - DNA, 22 bp, Homo sapiens
cacatgtgcaaatactgaggct

SEQ ID NO: 7863849 - DNA, 22 bp, Homo sapiens
cacatgtgcaaatactgaggct

SEQ ID NO: 7863850 - DNA, 20 bp, Homo sapiens
cacatgctgtgtgtttctct

SEQ ID NO: 7863851 - DNA, 22 bp, Homo sapiens
cacatgcttagatttcagtgga

SEQ ID NO: 7863852 - DNA, 21 bp, Homo sapiens
cacatgtgaattactgaactg

SEQ ID NO: 7863853 - DNA, 22 bp, Homo sapiens
cacatgtgggaaatggtgctta

SEQ ID NO: 7863854 - DNA, 22 bp, Homo sapiens
cacatgtgggaaatggtgctta

SEQ ID NO: 7863855 - DNA, 22 bp, Homo sapiens
cacatgtgtatatgtgaggggg

SEQ ID NO: 7863856 - DNA, 22 bp, Homo sapiens
cacatgtgcagttacatgaatt

SEQ ID NO: 7863857 - DNA, 22 bp, Homo sapiens
cacatgtgcaaatactgaggct

SEQ ID NO: 7863858 - DNA, 22 bp, Homo sapiens
cacatgtgcagttacatgaatt

SEQ ID NO: 7863859 - DNA, 22 bp, Homo sapiens
cacatgtgcagttacatgaatt

SEQ ID NO: 7863860 - DNA, 22 bp, Homo sapiens
caccagctccaccagggcaggt

SEQ ID NO: 7863861 - DNA, 22 bp, Homo sapiens
caccagctctccaccaggtttc

SEQ ID NO: 7863862 - DNA, 22 bp, Homo sapiens
caccagcttacagtctcacccc

SEQ ID NO: 7863863 - DNA, 22 bp, Homo sapiens
caccagcttgcagtcttaaccc

SEQ ID NO: 7863864 - DNA, 22 bp, Homo sapiens
caccagcttacagtctcacccc

SEQ ID NO: 7863865 - DNA, 22 bp, Homo sapiens
caccaggagccatcaggagtcc

SEQ ID NO: 7863866 - DNA, 22 bp, Homo sapiens
caccaggagccatcaggagtcc

SEQ ID NO: 7863867 - DNA, 22 bp, Homo sapiens
caccaggagccatcaggagtcc

SEQ ID NO: 7863868 - DNA, 22 bp, Homo sapiens
caccaggacttaacacattccc

SEQ ID NO: 7863869 - DNA, 22 bp, Homo sapiens
caccaggagcatctaggaggcg

SEQ ID NO: 7863870 - DNA, 22 bp, Homo sapiens
caccaggagcatctaggaggcg

SEQ ID NO: 7863871 - DNA, 22 bp, Homo sapiens
caccaggagcatctaggaggcg

SEQ ID NO: 7863872 - DNA, 22 bp, Homo sapiens
caccaggagccatcaggagtcc

SEQ ID NO: 7863873 - DNA, 20 bp, Homo sapiens
caccaggaccattggctatg

SEQ ID NO: 7863874 - DNA, 22 bp, Homo sapiens
caccaggaagtggtggcctggg

SEQ ID NO: 7863875 - DNA, 22 bp, Homo sapiens
caccaggacttaacacattccc

SEQ ID NO: 7863876 - DNA, 22 bp, Homo sapiens
caccaggaccccacggtgggtt

SEQ ID NO: 7863877 - DNA, 22 bp, Homo sapiens
caccaggaagctgcaatttgag

SEQ ID NO: 7863878 - DNA, 22 bp, Homo sapiens
caccactgtatccctagcactt

SEQ ID NO: 7863879 - DNA, 22 bp, Homo sapiens
caccactggaggtcttggcttt

SEQ ID NO: 7863880 - DNA, 22 bp, Homo sapiens
caccactggaggtcttggcttt

SEQ ID NO: 7863881 - DNA, 22 bp, Homo sapiens
caccactgcttcctgccatctg

SEQ ID NO: 7863882 - DNA, 22 bp, Homo sapiens
caccactggaggtcttggcttt

SEQ ID NO: 7863883 - DNA, 22 bp, Homo sapiens
caccactgcttcctgccatctg

SEQ ID NO: 7863884 - DNA, 22 bp, Homo sapiens
caccactgcttcctgccatctg

SEQ ID NO: 7863885 - DNA, 22 bp, Homo sapiens
cacattcctggtgctcagcagc

SEQ ID NO: 7863886 - DNA, 22 bp, Homo sapiens
cacattccttacattcatagag

SEQ ID NO: 7863887 - DNA, 22 bp, Homo sapiens
cacattcctgagcttcgacctg

SEQ ID NO: 7863888 - DNA, 22 bp, Homo sapiens
cacattcctggtgctcagcagc

SEQ ID NO: 7863889 - DNA, 21 bp, Homo sapiens
cacattccatgggtctattta

SEQ ID NO: 7863890 - DNA, 22 bp, Homo sapiens
cacattccccagagctggggct

SEQ ID NO: 7863891 - DNA, 22 bp, Homo sapiens
cacattcatcagtgttgtactg

SEQ ID NO: 7863892 - DNA, 22 bp, Homo sapiens
cacattcatggagtttgcctgt

SEQ ID NO: 7863893 - DNA, 22 bp, Homo sapiens
cacattcaggtggcatgttaga

SEQ ID NO: 7863894 - DNA, 22 bp, Homo sapiens
cacattcaggtggcatgttaga

SEQ ID NO: 7863895 - DNA, 22 bp, Homo sapiens
ggcaagtggaggtgttcatcag

SEQ ID NO: 7863896 - DNA, 22 bp, Homo sapiens
ggcaagtggtagaacatctgag

SEQ ID NO: 7863897 - DNA, 22 bp, Homo sapiens
ggcaagtcaggaagttgacatt

SEQ ID NO: 7863898 - DNA, 22 bp, Homo sapiens
ggcaagggttgaagataaggta

SEQ ID NO: 7863899 - DNA, 22 bp, Homo sapiens
ggcaagggttgaagataaggta

SEQ ID NO: 7863900 - DNA, 22 bp, Homo sapiens
ggcaagggttgaagataaggta

SEQ ID NO: 7863901 - DNA, 22 bp, Homo sapiens
ggcaaggtactctagagcacat

SEQ ID NO: 7863902 - DNA, 22 bp, Homo sapiens
ggcaaggtactctagagcacat

SEQ ID NO: 7863903 - DNA, 22 bp, Homo sapiens
ggcaaggggtcaggctgagaca

SEQ ID NO: 7863904 - DNA, 22 bp, Homo sapiens
ggcaaggggtcaggctgagaca

SEQ ID NO: 7863905 - DNA, 22 bp, Homo sapiens
ggcaaggggtcaggctgagaca

SEQ ID NO: 7863906 - DNA, 22 bp, Homo sapiens
ggcaaggggtcaggctgagaca

SEQ ID NO: 7863907 - DNA, 22 bp, Homo sapiens
ggcaaggggtcaggctgagaca

SEQ ID NO: 7863908 - DNA, 22 bp, Homo sapiens
ggcaaggggtcaggctgagaca

SEQ ID NO: 7863909 - DNA, 22 bp, Homo sapiens
ggcaaggggtcaggctgagaca

SEQ ID NO: 7863910 - DNA, 22 bp, Homo sapiens
cacagtgcgaaagaaacccagc

SEQ ID NO: 7863911 - DNA, 22 bp, Homo sapiens
ggcaaggggtcaggctgagaca

SEQ ID NO: 7863912 - DNA, 22 bp, Homo sapiens
cacagtgcatgatgggcagaag

SEQ ID NO: 7863913 - DNA, 22 bp, Homo sapiens
cacagtgcatgatgggcagaag

SEQ ID NO: 7863914 - DNA, 22 bp, Homo sapiens
cacagtgcatgatgggcagaag

SEQ ID NO: 7863915 - DNA, 22 bp, Homo sapiens
cacagtgcatgatgggcagaag

SEQ ID NO: 7863916 - DNA, 19 bp, Homo sapiens
cacagtgcagccatttctc

SEQ ID NO: 7863917 - DNA, 19 bp, Homo sapiens
cacagtgcagccatttctc

SEQ ID NO: 7863918 - DNA, 22 bp, Homo sapiens
cacagtgcactaagctccgggg

SEQ ID NO: 7863919 - DNA, 22 bp, Homo sapiens
cacagtgcaatcggccacaaat

SEQ ID NO: 7863920 - DNA, 22 bp, Homo sapiens
cacagtgcactaagctccgggg

SEQ ID NO: 7863921 - DNA, 22 bp, Homo sapiens
cacagtgcactaagctccgggg

SEQ ID NO: 7863922 - DNA, 22 bp, Homo sapiens
cacagtgcaatcggccacaaat

SEQ ID NO: 7863923 - DNA, 22 bp, Homo sapiens
cacagtgagctgggcatcagtt

SEQ ID NO: 7863924 - DNA, 18 bp, Homo sapiens
cacagtgacttctgatac

SEQ ID NO: 7863925 - DNA, 22 bp, Homo sapiens
cacagtgactggcacctagtat

SEQ ID NO: 7863926 - DNA, 22 bp, Homo sapiens
cacagtgattgatttttacttt

SEQ ID NO: 7863927 - DNA, 22 bp, Homo sapiens
cacagtgagtatttagtaccta

SEQ ID NO: 7863928 - DNA, 22 bp, Homo sapiens
cacagtgagctgggcatcagtt

SEQ ID NO: 7863929 - DNA, 22 bp, Homo sapiens
cacagtgaatttcaagtgttgt

SEQ ID NO: 7863930 - DNA, 22 bp, Homo sapiens
cacagtgaatttcaagtgttgt

SEQ ID NO: 7863931 - DNA, 22 bp, Homo sapiens
cacagtgaatttcaagtgttgt

SEQ ID NO: 7863932 - DNA, 22 bp, Homo sapiens
cacagtgacagctatacagaga

SEQ ID NO: 7863933 - DNA, 22 bp, Homo sapiens
cacagtgacagctatacagaga

SEQ ID NO: 7863934 - DNA, 22 bp, Homo sapiens
cacagtgacattagtgagaaaa

SEQ ID NO: 7863935 - DNA, 22 bp, Homo sapiens
cacagtgacattagtgagaaaa

SEQ ID NO: 7863936 - DNA, 22 bp, Homo sapiens
cacagtgactggcacatagtaa

SEQ ID NO: 7863937 - DNA, 22 bp, Homo sapiens
cacagtgactggcacatagtaa

SEQ ID NO: 7863938 - DNA, 22 bp, Homo sapiens
cacagtgacctctttaaaaggg

SEQ ID NO: 7863939 - DNA, 22 bp, Homo sapiens
cacagtgactggcacatagtaa

SEQ ID NO: 7863940 - DNA, 22 bp, Homo sapiens
cacagtgactggcacatagtaa

SEQ ID NO: 7863941 - DNA, 22 bp, Homo sapiens
cacaggttcacctcaggtaggt

SEQ ID NO: 7863942 - DNA, 22 bp, Homo sapiens
cacaggttgggggagttgataa

SEQ ID NO: 7863943 - DNA, 22 bp, Homo sapiens
cacaggtttcaaggataagatg

SEQ ID NO: 7863944 - DNA, 22 bp, Homo sapiens
cacaggttaggtattatactat

SEQ ID NO: 7863945 - DNA, 22 bp, Homo sapiens
cacaggttagcagcttgaaact

SEQ ID NO: 7863946 - DNA, 22 bp, Homo sapiens
cacaggttaggtattatactat

SEQ ID NO: 7863947 - DNA, 22 bp, Homo sapiens
cacaggtttgacaaggataaaa

SEQ ID NO: 7863948 - DNA, 22 bp, Homo sapiens
cacagtaaccccaggactggga

SEQ ID NO: 7863949 - DNA, 22 bp, Homo sapiens
cacagtaactcctgacccctcg

SEQ ID NO: 7863950 - DNA, 22 bp, Homo sapiens
cacagtaaccccaggactggga

SEQ ID NO: 7863951 - DNA, 22 bp, Homo sapiens
cacagtaagaaatgaagaggta

SEQ ID NO: 7863952 - DNA, 22 bp, Homo sapiens
cacagtaagaaatgaagaggta

SEQ ID NO: 7863953 - DNA, 22 bp, Homo sapiens
cacagtaaggtatcccagtgaa

SEQ ID NO: 7863954 - DNA, 22 bp, Homo sapiens
cacagtaactggcgtgtagtaa

SEQ ID NO: 7863955 - DNA, 22 bp, Homo sapiens
cacagtaactcctgacccctcg

SEQ ID NO: 7863956 - DNA, 22 bp, Homo sapiens
cacagtaactggcgtgtagtaa

SEQ ID NO: 7863957 - DNA, 22 bp, Homo sapiens
cacagtgaagcatgcagacatc

SEQ ID NO: 7863958 - DNA, 22 bp, Homo sapiens
cacagtgaagcatgcagacatc

SEQ ID NO: 7863959 - DNA, 22 bp, Homo sapiens
cacagtgaatttcaagtgttgt

SEQ ID NO: 7863960 - DNA, 22 bp, Homo sapiens
cacagtgaattacatagacgtg

SEQ ID NO: 7863961 - DNA, 22 bp, Homo sapiens
cacagtgaattacatagacgtg

SEQ ID NO: 7863962 - DNA, 22 bp, Homo sapiens
cacagtcttatcccaaccacca

SEQ ID NO: 7863963 - DNA, 22 bp, Homo sapiens
cacagtgaacattctgtcaggg

SEQ ID NO: 7863964 - DNA, 22 bp, Homo sapiens
cacagtgaacattctgtcaggg

SEQ ID NO: 7863965 - DNA, 22 bp, Homo sapiens
cacagtgaacattctgtcaggg

SEQ ID NO: 7863966 - DNA, 22 bp, Homo sapiens
cacagtaaggtatcccagtgaa

SEQ ID NO: 7863967 - DNA, 22 bp, Homo sapiens
cacagtacccagcactactgag

SEQ ID NO: 7863968 - DNA, 22 bp, Homo sapiens
cacagtaaggtatcccagtgaa

SEQ ID NO: 7863969 - DNA, 22 bp, Homo sapiens
cacagtcctgccagagggcctt

SEQ ID NO: 7863970 - DNA, 22 bp, Homo sapiens
cacagtcctgccagagggcctt

SEQ ID NO: 7863971 - DNA, 22 bp, Homo sapiens
cacagtctcctctcttagcctg

SEQ ID NO: 7863972 - DNA, 22 bp, Homo sapiens
cacagtcctgccagagggcctt

SEQ ID NO: 7863973 - DNA, 22 bp, Homo sapiens
cacagtctctgttgctgggacc

SEQ ID NO: 7863974 - DNA, 22 bp, Homo sapiens
cacaggtgtgtcctggtcttgt

SEQ ID NO: 7863975 - DNA, 22 bp, Homo sapiens
cacaggtgtgtcctggtcttgt

SEQ ID NO: 7863976 - DNA, 22 bp, Homo sapiens
cacaggtgtctctagtagcgtt

SEQ ID NO: 7863977 - DNA, 22 bp, Homo sapiens
cacaggtgtgtgccttatcaaa

SEQ ID NO: 7863978 - DNA, 22 bp, Homo sapiens
cacaggtgtccaatacctgctt

SEQ ID NO: 7863979 - DNA, 22 bp, Homo sapiens
cacaggtgtgtgccttatcaaa

SEQ ID NO: 7863980 - DNA, 22 bp, Homo sapiens
cacaggtgtgtcctggtcttgt

SEQ ID NO: 7863981 - DNA, 22 bp, Homo sapiens
cacaggtgtgtgccttatcaaa

SEQ ID NO: 7863982 - DNA, 22 bp, Homo sapiens
cacaggtgttcttgcagtgaaa

SEQ ID NO: 7863983 - DNA, 22 bp, Homo sapiens
cacaggtgttcttgcagtgaaa

SEQ ID NO: 7863984 - DNA, 22 bp, Homo sapiens
cacaggtgtttgttatactcag

SEQ ID NO: 7863985 - DNA, 22 bp, Homo sapiens
cacaggttagcagcttgaaact

SEQ ID NO: 7863986 - DNA, 23 bp, Homo sapiens
cacaggtgtttcatcttctcagt

SEQ ID NO: 7863987 - DNA, 23 bp, Homo sapiens
cacaggtgtttcatcttctcagt

SEQ ID NO: 7863988 - DNA, 22 bp, Homo sapiens
cacaggtgtttgttatactcag

SEQ ID NO: 7863989 - DNA, 22 bp, Homo sapiens
cacaggtgttcttgcagtgaaa

SEQ ID NO: 7863990 - DNA, 22 bp, Homo sapiens
cacaggtgttcttgcagtgaaa

SEQ ID NO: 7863991 - DNA, 23 bp, Homo sapiens
cacaggtgtttcatcttctcagt

SEQ ID NO: 7863992 - DNA, 23 bp, Homo sapiens
cacaggtgtttcatcttctcagt

SEQ ID NO: 7863993 - DNA, 21 bp, Homo sapiens
cacaggtgggtcagtgaggcc

SEQ ID NO: 7863994 - DNA, 21 bp, Homo sapiens
cacaggtgggtcagtgaggcc

SEQ ID NO: 7863995 - DNA, 22 bp, Homo sapiens
cacaggtgtatgaatatgtcca

SEQ ID NO: 7863996 - DNA, 22 bp, Homo sapiens
cacaggtgccatctcttcatgg

SEQ ID NO: 7863997 - DNA, 22 bp, Homo sapiens
cacaggtggctccaagttagag

SEQ ID NO: 7863998 - DNA, 22 bp, Homo sapiens
cacaggtggcttctttcatctt

SEQ ID NO: 7863999 - DNA, 22 bp, Homo sapiens
cacaggtggcttctttcatctt

SEQ ID NO: 7864000 - DNA, 22 bp, Homo sapiens
cacaggtggcttctttcatctt

SEQ ID NO: 7864001 - DNA, 22 bp, Homo sapiens
cacaggtgtatgaatatgtcca

SEQ ID NO: 7864002 - DNA, 22 bp, Homo sapiens
cacaggtgtatgaatatgtcca

SEQ ID NO: 7864003 - DNA, 22 bp, Homo sapiens
cacaggtgtccaatacctgctt

SEQ ID NO: 7864004 - DNA, 22 bp, Homo sapiens
cacaggtgtctctagtagcgtt

SEQ ID NO: 7864005 - DNA, 17 bp, Homo sapiens
cacaggtgtggtttgag

SEQ ID NO: 7864006 - DNA, 17 bp, Homo sapiens
cacaggtgtggtttgag

SEQ ID NO: 7864007 - DNA, 18 bp, Homo sapiens
cacaggcaggtgataggt

SEQ ID NO: 7864008 - DNA, 18 bp, Homo sapiens
cacaggcaggtgataggt

SEQ ID NO: 7864009 - DNA, 18 bp, Homo sapiens
cacaggcaggtgataggt

SEQ ID NO: 7864010 - DNA, 22 bp, Homo sapiens
cacaggcaggaggttctccagt

SEQ ID NO: 7864011 - DNA, 22 bp, Homo sapiens
cacaggcaggaggttctccagt

SEQ ID NO: 7864012 - DNA, 22 bp, Homo sapiens
cacaggcaggaggttctccagt

SEQ ID NO: 7864013 - DNA, 22 bp, Homo sapiens
cacaggcaggaggttctccagt

SEQ ID NO: 7864014 - DNA, 22 bp, Homo sapiens
cacaggcaggaggttctccagt

SEQ ID NO: 7864015 - DNA, 23 bp, Homo sapiens
cacaggcagaaatcaagacggta

SEQ ID NO: 7864016 - DNA, 22 bp, Homo sapiens
cacaggcagccttgtagaagaa

SEQ ID NO: 7864017 - DNA, 22 bp, Homo sapiens
cacaggcagccttgtagaagaa

SEQ ID NO: 7864018 - DNA, 22 bp, Homo sapiens
cacaggcagccttgtagaagaa

SEQ ID NO: 7864019 - DNA, 22 bp, Homo sapiens
cacaggcaggaggttctccagt

SEQ ID NO: 7864020 - DNA, 22 bp, Homo sapiens
cacaggcagccttgtagaagaa

SEQ ID NO: 7864021 - DNA, 22 bp, Homo sapiens
cacaggcacccctgactgctca

SEQ ID NO: 7864022 - DNA, 22 bp, Homo sapiens
cacaggcacccctgactgctca

SEQ ID NO: 7864023 - DNA, 22 bp, Homo sapiens
cacaggcacgcctctggccagg

SEQ ID NO: 7864024 - DNA, 22 bp, Homo sapiens
cacaggcacgcctctggccagg

SEQ ID NO: 7864025 - DNA, 22 bp, Homo sapiens
cacaggcacccctgactgctca

SEQ ID NO: 7864026 - DNA, 22 bp, Homo sapiens
cacaggcacccctgactgctca

SEQ ID NO: 7864027 - DNA, 22 bp, Homo sapiens
cacaggcacccctgactgctca

SEQ ID NO: 7864028 - DNA, 22 bp, Homo sapiens
cacaggcacgcctctggccagg

SEQ ID NO: 7864029 - DNA, 22 bp, Homo sapiens
cacaggcacgcctctggccagg

SEQ ID NO: 7864030 - DNA, 22 bp, Homo sapiens
cacaggcacgcctctggccagg

SEQ ID NO: 7864031 - DNA, 22 bp, Homo sapiens
cacaggcacgcctctggccagg

SEQ ID NO: 7864032 - DNA, 22 bp, Homo sapiens
cacaggcacgcctctggccagg

SEQ ID NO: 7864033 - DNA, 23 bp, Homo sapiens
cacaggcagaaatcaagacggta

SEQ ID NO: 7864034 - DNA, 23 bp, Homo sapiens
cacaggcagaaatcaagacggta

SEQ ID NO: 7864035 - DNA, 23 bp, Homo sapiens
cacaggcagaaatcaagacggta

SEQ ID NO: 7864036 - DNA, 23 bp, Homo sapiens
cacaggcagaaatcaagacggta

SEQ ID NO: 7864037 - DNA, 22 bp, Homo sapiens
cacaggagtgctgctattgttg

SEQ ID NO: 7864038 - DNA, 22 bp, Homo sapiens
cacaggagtgctgctattgttg

SEQ ID NO: 7864039 - DNA, 22 bp, Homo sapiens
cacaggagttaacataattaag

SEQ ID NO: 7864040 - DNA, 22 bp, Homo sapiens
cacaggagtgctgctattgttg

SEQ ID NO: 7864041 - DNA, 22 bp, Homo sapiens
cacaggaggttaggaagtggtc

SEQ ID NO: 7864042 - DNA, 22 bp, Homo sapiens
cacaggaggttaggaagtggtc

SEQ ID NO: 7864043 - DNA, 22 bp, Homo sapiens
cacaggaggttaggaagtggtc

SEQ ID NO: 7864044 - DNA, 18 bp, Homo sapiens
cacaggagccacactcac

SEQ ID NO: 7864045 - DNA, 18 bp, Homo sapiens
cacaggagccacactcac

SEQ ID NO: 7864046 - DNA, 22 bp, Homo sapiens
ggagagcctccacggcttctgt

SEQ ID NO: 7864047 - DNA, 22 bp, Homo sapiens
ggagagcctgtgcagccgggtt

SEQ ID NO: 7864048 - DNA, 20 bp, Homo sapiens
ggagagccacatagtctccc

SEQ ID NO: 7864049 - DNA, 20 bp, Homo sapiens
ggagagccacatagtctccc

SEQ ID NO: 7864050 - DNA, 22 bp, Homo sapiens
ggagagctagtgcctgccagta

SEQ ID NO: 7864051 - DNA, 22 bp, Homo sapiens
ggagagctagtgcctgccagta

SEQ ID NO: 7864052 - DNA, 22 bp, Homo sapiens
ggagagctagtgcctgccagta

SEQ ID NO: 7864053 - DNA, 22 bp, Homo sapiens
ggagagcctgtgcagccgggtt

SEQ ID NO: 7864054 - DNA, 18 bp, Homo sapiens
cacaggagccacactcac

SEQ ID NO: 7864055 - DNA, 22 bp, Homo sapiens
cacaggagattgatctattggt

SEQ ID NO: 7864056 - DNA, 22 bp, Homo sapiens
ggagagctgaagcatggacagg

SEQ ID NO: 7864057 - DNA, 22 bp, Homo sapiens
ggagagctgaagcatggacagg

SEQ ID NO: 7864058 - DNA, 22 bp, Homo sapiens
ggagagctctgggtctccgaca

SEQ ID NO: 7864059 - DNA, 22 bp, Homo sapiens
ggagagctctgggtctccgaca

SEQ ID NO: 7864060 - DNA, 22 bp, Homo sapiens
ggagagctagtgcctgccagta

SEQ ID NO: 7864061 - DNA, 23 bp, Homo sapiens
ggagagctcctcgtgactcactg

SEQ ID NO: 7864062 - DNA, 22 bp, Homo sapiens
ggagagctagtgcctgccagta

SEQ ID NO: 7864063 - DNA, 22 bp, Homo sapiens
cacagggctttgatggctgagt

SEQ ID NO: 7864064 - DNA, 22 bp, Homo sapiens
cacagggctttgatggctgagt

SEQ ID NO: 7864065 - DNA, 22 bp, Homo sapiens
cacagggctttgatggctgagt

SEQ ID NO: 7864066 - DNA, 22 bp, Homo sapiens
cacaggggcaaactgtagggga

SEQ ID NO: 7864067 - DNA, 22 bp, Homo sapiens
cacaggggcaaactgtagggga

SEQ ID NO: 7864068 - DNA, 22 bp, Homo sapiens
cacagggctttgatggctgagt

SEQ ID NO: 7864069 - DNA, 22 bp, Homo sapiens
cacagggcaggtactctcagag

SEQ ID NO: 7864070 - DNA, 22 bp, Homo sapiens
cacagggctttgatggctgagt

SEQ ID NO: 7864071 - DNA, 22 bp, Homo sapiens
cacaggtaatagcctaggctat

SEQ ID NO: 7864072 - DNA, 22 bp, Homo sapiens
cacaggtaatagcctaggctat

SEQ ID NO: 7864073 - DNA, 22 bp, Homo sapiens
cacagggttgttctgaggattc

SEQ ID NO: 7864074 - DNA, 22 bp, Homo sapiens
cacaggggcaaactgtagggga

SEQ ID NO: 7864075 - DNA, 22 bp, Homo sapiens
cacaggggcaaactgtagggga

SEQ ID NO: 7864076 - DNA, 22 bp, Homo sapiens
cacaggtgcaagaagttgcagt

SEQ ID NO: 7864077 - DNA, 22 bp, Homo sapiens
cacaggtgctcctcggggagct

SEQ ID NO: 7864078 - DNA, 22 bp, Homo sapiens
cacaggtgccatctcttcatgg

SEQ ID NO: 7864079 - DNA, 22 bp, Homo sapiens
cacaggtccttcctgccctggg

SEQ ID NO: 7864080 - DNA, 22 bp, Homo sapiens
cacaggtccttcctgccctggg

SEQ ID NO: 7864081 - DNA, 22 bp, Homo sapiens
cacaggtatatgtgtatatact

SEQ ID NO: 7864082 - DNA, 22 bp, Homo sapiens
cacaggtagaattttagggaaa

SEQ ID NO: 7864083 - DNA, 22 bp, Homo sapiens
cacaggtagatgccatgcagca

SEQ ID NO: 7864084 - DNA, 22 bp, Homo sapiens
cacaggtatatgtgtatatact

SEQ ID NO: 7864085 - DNA, 20 bp, Homo sapiens
cacaggccttgtgagcagac

SEQ ID NO: 7864086 - DNA, 20 bp, Homo sapiens
cacaggccttgtgagcagac

SEQ ID NO: 7864087 - DNA, 20 bp, Homo sapiens
cacaggccttgtgagcagac

SEQ ID NO: 7864088 - DNA, 20 bp, Homo sapiens
cacaggccttgtgagcagac

SEQ ID NO: 7864089 - DNA, 22 bp, Homo sapiens
cacagggcaggtactctcagag

SEQ ID NO: 7864090 - DNA, 22 bp, Homo sapiens
cacagggcaggccccaggcctc

SEQ ID NO: 7864091 - DNA, 22 bp, Homo sapiens
cacagggcaggtactctcagag

SEQ ID NO: 7864092 - DNA, 22 bp, Homo sapiens
cacagggcaggtactctcagag

SEQ ID NO: 7864093 - DNA, 22 bp, Homo sapiens
cacaggcctggggttgagcggg

SEQ ID NO: 7864094 - DNA, 22 bp, Homo sapiens
cacaggcctgtctctttctaac

SEQ ID NO: 7864095 - DNA, 22 bp, Homo sapiens
cacaggcctggggttgagcggg

SEQ ID NO: 7864096 - DNA, 22 bp, Homo sapiens
cacaggcctggggttgagcggg

SEQ ID NO: 7864097 - DNA, 20 bp, Homo sapiens
cacaggccttgtgagcagac

SEQ ID NO: 7864098 - DNA, 20 bp, Homo sapiens
cacaggccttgtgagcagac

SEQ ID NO: 7864099 - DNA, 22 bp, Homo sapiens
cacaggcacgcctctggccagg

SEQ ID NO: 7864100 - DNA, 20 bp, Homo sapiens
cacaggccttgtgagcagac

SEQ ID NO: 7864101 - DNA, 20 bp, Homo sapiens
cacaggccttgtgagcagac

SEQ ID NO: 7864102 - DNA, 22 bp, Homo sapiens
cacaggccagtaagactgtgtt

SEQ ID NO: 7864103 - DNA, 22 bp, Homo sapiens
cacaggccagtaagactgtgtt

SEQ ID NO: 7864104 - DNA, 22 bp, Homo sapiens
cacaggccagtaagactgtgtt

SEQ ID NO: 7864105 - DNA, 22 bp, Homo sapiens
cacaggccagtaagactgtgtt

SEQ ID NO: 7864106 - DNA, 22 bp, Homo sapiens
cacaggccagtaagactgtgtt

SEQ ID NO: 7864107 - DNA, 20 bp, Homo sapiens
cacaggccccaagacctgta

SEQ ID NO: 7864108 - DNA, 20 bp, Homo sapiens
cacaggccccaagacctgta

SEQ ID NO: 7864109 - DNA, 20 bp, Homo sapiens
cacaggccccaagacctgta

SEQ ID NO: 7864110 - DNA, 20 bp, Homo sapiens
cacaggccccaagacctgta

SEQ ID NO: 7864111 - DNA, 20 bp, Homo sapiens
cacaggccccaagacctgta

SEQ ID NO: 7864112 - DNA, 22 bp, Homo sapiens
cacaggccagtaagactgtgtt

SEQ ID NO: 7864113 - DNA, 22 bp, Homo sapiens
cacaggccaataccctctctct

SEQ ID NO: 7864114 - DNA, 22 bp, Homo sapiens
cacaggccagtaagactgtgtt

SEQ ID NO: 7864115 - DNA, 22 bp, Homo sapiens
cacaggccagtaagactgtgtt

SEQ ID NO: 7864116 - DNA, 22 bp, Homo sapiens
cacaggccaataccctctctct

SEQ ID NO: 7864117 - DNA, 22 bp, Homo sapiens
gctggggagctagacctcagca

SEQ ID NO: 7864118 - DNA, 22 bp, Homo sapiens
gctggggaggcagcagagaaca

SEQ ID NO: 7864119 - DNA, 22 bp, Homo sapiens
gctggggaggcagcagagaaca

SEQ ID NO: 7864120 - DNA, 22 bp, Homo sapiens
gctggggaggcagcagagaaca

SEQ ID NO: 7864121 - DNA, 22 bp, Homo sapiens
gctggggagctagacctcagca

SEQ ID NO: 7864122 - DNA, 22 bp, Homo sapiens
gctggggagctagacctcagca

SEQ ID NO: 7864123 - DNA, 22 bp, Homo sapiens
caaggctaagctttggctttct

SEQ ID NO: 7864124 - DNA, 22 bp, Homo sapiens
gctggggaggcagcagagaaca

SEQ ID NO: 7864125 - DNA, 22 bp, Homo sapiens
caaggctataatgttgctggaa

SEQ ID NO: 7864126 - DNA, 22 bp, Homo sapiens
caaggctagcaagcagtagtca

SEQ ID NO: 7864127 - DNA, 22 bp, Homo sapiens
caaggctagaagtccaacatca

SEQ ID NO: 7864128 - DNA, 22 bp, Homo sapiens
caaggctaccctttcaccaaaa

SEQ ID NO: 7864129 - DNA, 22 bp, Homo sapiens
caaggctgcaaaactacatggg

SEQ ID NO: 7864130 - DNA, 22 bp, Homo sapiens
caaggctgcaaaactacatggg

SEQ ID NO: 7864131 - DNA, 22 bp, Homo sapiens
caaggctgcaaaactacatggg

SEQ ID NO: 7864132 - DNA, 22 bp, Homo sapiens
caaggctgagaaattctgccct

SEQ ID NO: 7864133 - DNA, 22 bp, Homo sapiens
caaggctgcaaaactacatggg

SEQ ID NO: 7864134 - DNA, 22 bp, Homo sapiens
caaggctctggaccaaatccca

SEQ ID NO: 7864135 - DNA, 22 bp, Homo sapiens
caaggctctgcttctatcacat

SEQ ID NO: 7864136 - DNA, 22 bp, Homo sapiens
caaggctgctgcgggtcgcacc

SEQ ID NO: 7864137 - DNA, 22 bp, Homo sapiens
caaggctgctgcgggtcgcacc

SEQ ID NO: 7864138 - DNA, 22 bp, Homo sapiens
caaggctgctgcgggtcgcacc

SEQ ID NO: 7864139 - DNA, 22 bp, Homo sapiens
caaggctgctggcttctgagct

SEQ ID NO: 7864140 - DNA, 22 bp, Homo sapiens
caaggctgcttcagactagtga

SEQ ID NO: 7864141 - DNA, 22 bp, Homo sapiens
caaggctgcttcagactagtga

SEQ ID NO: 7864142 - DNA, 22 bp, Homo sapiens
caaggctggctcacaataatga

SEQ ID NO: 7864143 - DNA, 22 bp, Homo sapiens
caaggctgtgcagggtccatat

SEQ ID NO: 7864144 - DNA, 22 bp, Homo sapiens
caaggctgtgcagggtccatat

SEQ ID NO: 7864145 - DNA, 22 bp, Homo sapiens
caaggctgtgcagggtccatat

SEQ ID NO: 7864146 - DNA, 22 bp, Homo sapiens
caaggctgtctccagcttccaa

SEQ ID NO: 7864147 - DNA, 22 bp, Homo sapiens
caaggctgtctccagcttccaa

SEQ ID NO: 7864148 - DNA, 22 bp, Homo sapiens
caaggctgtctccagcttccaa

SEQ ID NO: 7864149 - DNA, 22 bp, Homo sapiens
caaggcttaggtggctccctgt

SEQ ID NO: 7864150 - DNA, 22 bp, Homo sapiens
caataagatgtattgagcagag

SEQ ID NO: 7864151 - DNA, 22 bp, Homo sapiens
caataagatgtattgagcagag

SEQ ID NO: 7864152 - DNA, 22 bp, Homo sapiens
caatactgggcaggagagtaca

SEQ ID NO: 7864153 - DNA, 22 bp, Homo sapiens
caatactgcatctttgcccttt

SEQ ID NO: 7864154 - DNA, 22 bp, Homo sapiens
caatactgcatctttgcccttt

SEQ ID NO: 7864155 - DNA, 22 bp, Homo sapiens
caataaggttttgactattgag

SEQ ID NO: 7864156 - DNA, 22 bp, Homo sapiens
caataaggatttgtggaccaca

SEQ ID NO: 7864157 - DNA, 22 bp, Homo sapiens
caataaggtgaggctcaaggga

SEQ ID NO: 7864158 - DNA, 22 bp, Homo sapiens
caatagaaaactcaatacttaa

SEQ ID NO: 7864159 - DNA, 22 bp, Homo sapiens
caatacttaatgctttttccta

SEQ ID NO: 7864160 - DNA, 22 bp, Homo sapiens
caatacttccttgttagaggca

SEQ ID NO: 7864161 - DNA, 22 bp, Homo sapiens
caatactttagtaaaatggccc

SEQ ID NO: 7864162 - DNA, 22 bp, Homo sapiens
caatagaaaactcaatacttaa

SEQ ID NO: 7864163 - DNA, 22 bp, Homo sapiens
caatagaaaactcaatacttaa

SEQ ID NO: 7864164 - DNA, 22 bp, Homo sapiens
caatactttagtaaaatggccc

SEQ ID NO: 7864165 - DNA, 22 bp, Homo sapiens
caatagaaaactcaatacttaa

SEQ ID NO: 7864166 - DNA, 22 bp, Homo sapiens
caatagaaaactcaatacttaa

SEQ ID NO: 7864167 - DNA, 18 bp, Homo sapiens
caatagaaacagtaggaa

SEQ ID NO: 7864168 - DNA, 18 bp, Homo sapiens
caatagaaacagtaggaa

SEQ ID NO: 7864169 - DNA, 18 bp, Homo sapiens
caatagaaacagtaggaa

SEQ ID NO: 7864170 - DNA, 18 bp, Homo sapiens
caatagaaacagtaggaa

SEQ ID NO: 7864171 - DNA, 22 bp, Homo sapiens
caatagaaggcacagataggta

SEQ ID NO: 7864172 - DNA, 22 bp, Homo sapiens
caatagaaggcacagataggta

SEQ ID NO: 7864173 - DNA, 22 bp, Homo sapiens
caatagcagacctagaaagcaa

SEQ ID NO: 7864174 - DNA, 22 bp, Homo sapiens
caatagataactgagatagact

SEQ ID NO: 7864175 - DNA, 20 bp, Homo sapiens
caatagaatgtggagataag

SEQ ID NO: 7864176 - DNA, 20 bp, Homo sapiens
caatagaatgtggagataag

SEQ ID NO: 7864177 - DNA, 20 bp, Homo sapiens
caatagaatgtggagataag

SEQ ID NO: 7864178 - DNA, 20 bp, Homo sapiens
caatagaatgtggagataag

SEQ ID NO: 7864179 - DNA, 20 bp, Homo sapiens
caatagaatgtggagataag

SEQ ID NO: 7864180 - DNA, 22 bp, Homo sapiens
caatagaaggcacagataggta

SEQ ID NO: 7864181 - DNA, 18 bp, Homo sapiens
caatagaaacagtaggaa

SEQ ID NO: 7864182 - DNA, 22 bp, Homo sapiens
caatagaaggcacagataggta

SEQ ID NO: 7864183 - DNA, 22 bp, Homo sapiens
caatagaaggcacagataggta

SEQ ID NO: 7864184 - DNA, 22 bp, Homo sapiens
caatagaaggcacagataggta

SEQ ID NO: 7864185 - DNA, 22 bp, Homo sapiens
caatatataggaacaacttagg

SEQ ID NO: 7864186 - DNA, 22 bp, Homo sapiens
caatatataggaacaacttagg

SEQ ID NO: 7864187 - DNA, 22 bp, Homo sapiens
caatatataggaacaacttagg

SEQ ID NO: 7864188 - DNA, 22 bp, Homo sapiens
caatatataggaacaacttagg

SEQ ID NO: 7864189 - DNA, 22 bp, Homo sapiens
caatatataatgagtactttcc

SEQ ID NO: 7864190 - DNA, 22 bp, Homo sapiens
caatatataatgagtactttcc

SEQ ID NO: 7864191 - DNA, 19 bp, Homo sapiens
caatatatagtgagtggat

SEQ ID NO: 7864192 - DNA, 22 bp, Homo sapiens
caatatataggaacaacttagg

SEQ ID NO: 7864193 - DNA, 22 bp, Homo sapiens
caatatataggaacaacttagg

SEQ ID NO: 7864194 - DNA, 22 bp, Homo sapiens
caatatataggaacaacttagg

SEQ ID NO: 7864195 - DNA, 22 bp, Homo sapiens
caatagttcggtcctgaaggcc

SEQ ID NO: 7864196 - DNA, 22 bp, Homo sapiens
caatagtgtctgcttgtttcta

SEQ ID NO: 7864197 - DNA, 22 bp, Homo sapiens
caatagtgtctgcttgtttcta

SEQ ID NO: 7864198 - DNA, 22 bp, Homo sapiens
caatagtgtctgcttgtttcta

SEQ ID NO: 7864199 - DNA, 22 bp, Homo sapiens
caatatataatgagtactttcc

SEQ ID NO: 7864200 - DNA, 22 bp, Homo sapiens
caatatataatgagtactttcc

SEQ ID NO: 7864201 - DNA, 22 bp, Homo sapiens
caatagcaggtctacagagaga

SEQ ID NO: 7864202 - DNA, 22 bp, Homo sapiens
caatagcagacctagaaagcaa

SEQ ID NO: 7864203 - DNA, 22 bp, Homo sapiens
caatagcaggtctacagagaga

SEQ ID NO: 7864204 - DNA, 22 bp, Homo sapiens
caatagtaaattacggaggaga

SEQ ID NO: 7864205 - DNA, 22 bp, Homo sapiens
caatagtaaattacggaggaga

SEQ ID NO: 7864206 - DNA, 22 bp, Homo sapiens
caatttcatggataaaagatgt

SEQ ID NO: 7864207 - DNA, 22 bp, Homo sapiens
caatttcattaatagatataga

SEQ ID NO: 7864208 - DNA, 22 bp, Homo sapiens
caatttcattaatagatataga

SEQ ID NO: 7864209 - DNA, 22 bp, Homo sapiens
caatttcattaatagatataga

SEQ ID NO: 7864210 - DNA, 22 bp, Homo sapiens
caatttcattaatagatataga

SEQ ID NO: 7864211 - DNA, 22 bp, Homo sapiens
caatttccttcatagatgactg

SEQ ID NO: 7864212 - DNA, 22 bp, Homo sapiens
caatttctaacattccatggat

SEQ ID NO: 7864213 - DNA, 22 bp, Homo sapiens
ggaagagcctggggtgtcaggc

SEQ ID NO: 7864214 - DNA, 20 bp, Homo sapiens
caatttcatcatttcctgtg

SEQ ID NO: 7864215 - DNA, 20 bp, Homo sapiens
caatttcatcatttcctgtg

SEQ ID NO: 7864216 - DNA, 22 bp, Homo sapiens
caatttcatcttgtgcttcaat

SEQ ID NO: 7864217 - DNA, 22 bp, Homo sapiens
caatttcatcttgtgcttcaat

SEQ ID NO: 7864218 - DNA, 18 bp, Homo sapiens
caatttcatccttaagcc

SEQ ID NO: 7864219 - DNA, 22 bp, Homo sapiens
caatttcatgccatgtattgct

SEQ ID NO: 7864220 - DNA, 22 bp, Homo sapiens
caatttcatggataaaagatgt

SEQ ID NO: 7864221 - DNA, 22 bp, Homo sapiens
caatttcatcttgtgcttcaat

SEQ ID NO: 7864222 - DNA, 22 bp, Homo sapiens
caatttcaatacaaaatacatt

SEQ ID NO: 7864223 - DNA, 22 bp, Homo sapiens
caatttcaatacaaaatacatt

SEQ ID NO: 7864224 - DNA, 22 bp, Homo sapiens
caatttcaatacaaaatacatt

SEQ ID NO: 7864225 - DNA, 22 bp, Homo sapiens
caatttcaatacaaaatacatt

SEQ ID NO: 7864226 - DNA, 22 bp, Homo sapiens
caatttcaatacaaaatacatt

SEQ ID NO: 7864227 - DNA, 22 bp, Homo sapiens
caatttcaatacaaaatacatt

SEQ ID NO: 7864228 - DNA, 22 bp, Homo sapiens
caatttcaatacaaaatacatt

SEQ ID NO: 7864229 - DNA, 22 bp, Homo sapiens
caatttcactaataatatttac

SEQ ID NO: 7864230 - DNA, 22 bp, Homo sapiens
caatttcactaataatatttac

SEQ ID NO: 7864231 - DNA, 22 bp, Homo sapiens
caatttcaatgaggccacaggg

SEQ ID NO: 7864232 - DNA, 22 bp, Homo sapiens
caatttcagacctttccttgga

SEQ ID NO: 7864233 - DNA, 22 bp, Homo sapiens
caatttcactaataatatttac

SEQ ID NO: 7864234 - DNA, 22 bp, Homo sapiens
caatttcaggtggataggtttt

SEQ ID NO: 7864235 - DNA, 22 bp, Homo sapiens
caatttcaggtggataggtttt

SEQ ID NO: 7864236 - DNA, 17 bp, Homo sapiens
caatttcataggttttg

SEQ ID NO: 7864237 - DNA, 22 bp, Homo sapiens
caatttcagtctcagagagttc

SEQ ID NO: 7864238 - DNA, 22 bp, Homo sapiens
caattgacaatgacagtgtcaa

SEQ ID NO: 7864239 - DNA, 22 bp, Homo sapiens
caatttcaagattctgttcttt

SEQ ID NO: 7864240 - DNA, 22 bp, Homo sapiens
caatttcaagattctgttcttt

SEQ ID NO: 7864241 - DNA, 22 bp, Homo sapiens
caattgtattactgagcttata

SEQ ID NO: 7864242 - DNA, 22 bp, Homo sapiens
caattgtcagtgctgtttaaat

SEQ ID NO: 7864243 - DNA, 23 bp, Homo sapiens
caattgtataaagcaaatggttt

SEQ ID NO: 7864244 - DNA, 22 bp, Homo sapiens
caattgtatgtgagaaataaat

SEQ ID NO: 7864245 - DNA, 23 bp, Homo sapiens
caattgtataaagcaaatggttt

SEQ ID NO: 7864246 - DNA, 22 bp, Homo sapiens
caattgtattactgagcttata

SEQ ID NO: 7864247 - DNA, 22 bp, Homo sapiens
caattcttggagaagaagcata

SEQ ID NO: 7864248 - DNA, 19 bp, Homo sapiens
caattctattatcattcca

SEQ ID NO: 7864249 - DNA, 22 bp, Homo sapiens
caattcctctggttgcaaagct

SEQ ID NO: 7864250 - DNA, 19 bp, Homo sapiens
caattctattatcattcca

SEQ ID NO: 7864251 - DNA, 19 bp, Homo sapiens
caattctgcaacactgtcc

SEQ ID NO: 7864252 - DNA, 22 bp, Homo sapiens
caattcccagctgccgggctgc

SEQ ID NO: 7864253 - DNA, 22 bp, Homo sapiens
caattcattacattgcaaagac

SEQ ID NO: 7864254 - DNA, 22 bp, Homo sapiens
caattcccagctgccgggctgc

SEQ ID NO: 7864255 - DNA, 22 bp, Homo sapiens
caattcattacattgcaaagac

SEQ ID NO: 7864256 - DNA, 22 bp, Homo sapiens
caatccatcaattacacaggct

SEQ ID NO: 7864257 - DNA, 22 bp, Homo sapiens
caatccatcaattacacaggct

SEQ ID NO: 7864258 - DNA, 21 bp, Homo sapiens
caatcagttggcatttgagca

SEQ ID NO: 7864259 - DNA, 22 bp, Homo sapiens
caatccagtttctgtcagctac

SEQ ID NO: 7864260 - DNA, 22 bp, Homo sapiens
caatgttttgttgaatgaatag

SEQ ID NO: 7864261 - DNA, 22 bp, Homo sapiens
caatgttttgttgaatgaatag

SEQ ID NO: 7864262 - DNA, 22 bp, Homo sapiens
caatgttttgttgaatgaatag

SEQ ID NO: 7864263 - DNA, 22 bp, Homo sapiens
caattcatgttaaacagaagca

SEQ ID NO: 7864264 - DNA, 22 bp, Homo sapiens
caattcatgtgagcggactctt

SEQ ID NO: 7864265 - DNA, 22 bp, Homo sapiens
caattcatctgggtaggtagcc

SEQ ID NO: 7864266 - DNA, 22 bp, Homo sapiens
caattcatgggctgaggaaggg

SEQ ID NO: 7864267 - DNA, 22 bp, Homo sapiens
caatcacaaagagacaagtgtc

SEQ ID NO: 7864268 - DNA, 22 bp, Homo sapiens
caatcacaaagagacaagtgtc

SEQ ID NO: 7864269 - DNA, 22 bp, Homo sapiens
caatcaatgctgctagttcctt

SEQ ID NO: 7864270 - DNA, 22 bp, Homo sapiens
caatcaggagaaagagcgtgtg

SEQ ID NO: 7864271 - DNA, 22 bp, Homo sapiens
caatcacaaagagacaagtgtc

SEQ ID NO: 7864272 - DNA, 21 bp, Homo sapiens
caatcacttttgcaccaagct

SEQ ID NO: 7864273 - DNA, 22 bp, Homo sapiens
caatcagatatgtgacatattt

SEQ ID NO: 7864274 - DNA, 22 bp, Homo sapiens
caatcactctgcaacattcctg

SEQ ID NO: 7864275 - DNA, 22 bp, Homo sapiens
caatcactccacaatatggttc

SEQ ID NO: 7864276 - DNA, 22 bp, Homo sapiens
caatcacaaagagacaagtgtc

SEQ ID NO: 7864277 - DNA, 22 bp, Homo sapiens
caatcactgacctgcagatgca

SEQ ID NO: 7864278 - DNA, 22 bp, Homo sapiens
caatcactgggatattggtgtg

SEQ ID NO: 7864279 - DNA, 22 bp, Homo sapiens
cacaaatccaatttaattctgg

SEQ ID NO: 7864280 - DNA, 22 bp, Homo sapiens
cacaaatcattccatcattctt

SEQ ID NO: 7864281 - DNA, 22 bp, Homo sapiens
cacaaatgactgaaacgactgt

SEQ ID NO: 7864282 - DNA, 22 bp, Homo sapiens
cacaaatgactgaaacgactgt

SEQ ID NO: 7864283 - DNA, 22 bp, Homo sapiens
cacaaatgactgaaacgactgt

SEQ ID NO: 7864284 - DNA, 19 bp, Homo sapiens
cacaaatgatgaggacctg

SEQ ID NO: 7864285 - DNA, 19 bp, Homo sapiens
cacaaatgatgaggacctg

SEQ ID NO: 7864286 - DNA, 22 bp, Homo sapiens
cacaaataccagtttcctaaca

SEQ ID NO: 7864287 - DNA, 22 bp, Homo sapiens
cacaaataccagtttcctaaca

SEQ ID NO: 7864288 - DNA, 22 bp, Homo sapiens
cacaaataccagtttcctaaca

SEQ ID NO: 7864289 - DNA, 20 bp, Homo sapiens
ggaagctgtgggtccccagg

SEQ ID NO: 7864290 - DNA, 20 bp, Homo sapiens
ggaagctgtgggtccccagg

SEQ ID NO: 7864291 - DNA, 22 bp, Homo sapiens
cacaaataccagtttcctaaca

SEQ ID NO: 7864292 - DNA, 22 bp, Homo sapiens
ggaagctggacaggctttgagt

SEQ ID NO: 7864293 - DNA, 22 bp, Homo sapiens
ggaagctggcatatgtaatcct

SEQ ID NO: 7864294 - DNA, 22 bp, Homo sapiens
ggaagctggacaggctttgagt

SEQ ID NO: 7864295 - DNA, 22 bp, Homo sapiens
ggaagctggacaggctttgagt

SEQ ID NO: 7864296 - DNA, 22 bp, Homo sapiens
ggaagctggcatatgtaatcct

SEQ ID NO: 7864297 - DNA, 22 bp, Homo sapiens
ggaagctggctcttataaatat

SEQ ID NO: 7864298 - DNA, 22 bp, Homo sapiens
ggaagctgggatctctctcccg

SEQ ID NO: 7864299 - DNA, 22 bp, Homo sapiens
ggaagctggtaattgttgggac

SEQ ID NO: 7864300 - DNA, 22 bp, Homo sapiens
ggaagctggggagctttggaga

SEQ ID NO: 7864301 - DNA, 22 bp, Homo sapiens
ggaagctggtaattgttgggac

SEQ ID NO: 7864302 - DNA, 22 bp, Homo sapiens
ggaagctgtgctctcaggcctc

SEQ ID NO: 7864303 - DNA, 22 bp, Homo sapiens
ggaagctccccaagcctgccct

SEQ ID NO: 7864304 - DNA, 22 bp, Homo sapiens
ggaagctgaacttagcaaggaa

SEQ ID NO: 7864305 - DNA, 22 bp, Homo sapiens
ggaagctctgcctagatttcag

SEQ ID NO: 7864306 - DNA, 22 bp, Homo sapiens
ggaagctccccaagcctgccct

SEQ ID NO: 7864307 - DNA, 22 bp, Homo sapiens
ggaagctccccaagcctgccct

SEQ ID NO: 7864308 - DNA, 23 bp, Homo sapiens
ggaagctcacgtagtcctgcact

SEQ ID NO: 7864309 - DNA, 22 bp, Homo sapiens
ggaagctgaacttagcaaggaa

SEQ ID NO: 7864310 - DNA, 22 bp, Homo sapiens
ggaagctgaacttagcaaggaa

SEQ ID NO: 7864311 - DNA, 22 bp, Homo sapiens
ggaagctgaacttagcaaggaa

SEQ ID NO: 7864312 - DNA, 22 bp, Homo sapiens
ggaagcggccctgagcgcaggg

SEQ ID NO: 7864313 - DNA, 22 bp, Homo sapiens
ggaagcggccctgagcgcaggg

SEQ ID NO: 7864314 - DNA, 22 bp, Homo sapiens
ggaagaggaggagccaggcttt

SEQ ID NO: 7864315 - DNA, 22 bp, Homo sapiens
ggaagctaagataatttaagta

SEQ ID NO: 7864316 - DNA, 22 bp, Homo sapiens
ggaagctagttgtgtttcagga

SEQ ID NO: 7864317 - DNA, 23 bp, Homo sapiens
ggaagctcacgtagtcctgcact

SEQ ID NO: 7864318 - DNA, 22 bp, Homo sapiens
ggaagaggaggagccaggcttt

SEQ ID NO: 7864319 - DNA, 22 bp, Homo sapiens
ggaagcctaaagcccaggtctc

SEQ ID NO: 7864320 - DNA, 22 bp, Homo sapiens
ggaagagctgcttagttttgat

SEQ ID NO: 7864321 - DNA, 22 bp, Homo sapiens
ggaagagcctggggtgtcaggc

SEQ ID NO: 7864322 - DNA, 22 bp, Homo sapiens
ggaagctgaggcccagtgaagg

SEQ ID NO: 7864323 - DNA, 22 bp, Homo sapiens
ggaagctgaatccagagacagg

SEQ ID NO: 7864324 - DNA, 22 bp, Homo sapiens
ggaagctgaggcccagtgaagg

SEQ ID NO: 7864325 - DNA, 22 bp, Homo sapiens
ggaagctgaatccagagacagg

SEQ ID NO: 7864326 - DNA, 22 bp, Homo sapiens
ggaagctgaacttagcaaggaa

SEQ ID NO: 7864327 - DNA, 22 bp, Homo sapiens
ggaagctgaatccagagacagg

SEQ ID NO: 7864328 - DNA, 22 bp, Homo sapiens
ggaagctgaatccagagacagg

SEQ ID NO: 7864329 - DNA, 22 bp, Homo sapiens
ggaagctgaatccagagacagg

SEQ ID NO: 7864330 - DNA, 22 bp, Homo sapiens
ggaagctgaatccagagacagg

SEQ ID NO: 7864331 - DNA, 22 bp, Homo sapiens
ggaagctgcataactagcgtgg

SEQ ID NO: 7864332 - DNA, 22 bp, Homo sapiens
ggaagctgccagtccaccagct

SEQ ID NO: 7864333 - DNA, 22 bp, Homo sapiens
ggaagctgccagtccaccagct

SEQ ID NO: 7864334 - DNA, 22 bp, Homo sapiens
ggaagctgcttagctaatgtag

SEQ ID NO: 7864335 - DNA, 22 bp, Homo sapiens
ggaagctggacaggctttgagt

SEQ ID NO: 7864336 - DNA, 22 bp, Homo sapiens
ggacatttttcttcctacaatg

SEQ ID NO: 7864337 - DNA, 22 bp, Homo sapiens
ggacatttagtttcattgggca

SEQ ID NO: 7864338 - DNA, 22 bp, Homo sapiens
ggacatttcataagaccattct

SEQ ID NO: 7864339 - DNA, 19 bp, Homo sapiens
ggacatttgagttgtttat

SEQ ID NO: 7864340 - DNA, 22 bp, Homo sapiens
ggacatggagctccatggaggc

SEQ ID NO: 7864341 - DNA, 22 bp, Homo sapiens
ggacatggagctccatggaggc

SEQ ID NO: 7864342 - DNA, 22 bp, Homo sapiens
ggacatggagctccatggaggc

SEQ ID NO: 7864343 - DNA, 22 bp, Homo sapiens
ggacatggagcatgtagagaaa

SEQ ID NO: 7864344 - DNA, 22 bp, Homo sapiens
ggacatggaagtatggagtgga

SEQ ID NO: 7864345 - DNA, 18 bp, Homo sapiens
ggacaggagacatgggtg

SEQ ID NO: 7864346 - DNA, 22 bp, Homo sapiens
ggacatggagcatgtagagaaa

SEQ ID NO: 7864347 - DNA, 22 bp, Homo sapiens
ggacatggaagtatggagtgga

SEQ ID NO: 7864348 - DNA, 22 bp, Homo sapiens
ggacatttagaacagagtattt

SEQ ID NO: 7864349 - DNA, 22 bp, Homo sapiens
ggacattatagcttccagattg

SEQ ID NO: 7864350 - DNA, 22 bp, Homo sapiens
ggacatgtgcaacttctttgga

SEQ ID NO: 7864351 - DNA, 20 bp, Homo sapiens
ggacaggaagacaacctacc

SEQ ID NO: 7864352 - DNA, 18 bp, Homo sapiens
ggacaggagacatgggtg

SEQ ID NO: 7864353 - DNA, 18 bp, Homo sapiens
ggacaggagacatgggtg

SEQ ID NO: 7864354 - DNA, 22 bp, Homo sapiens
ggacatggaagtatggagtgga

SEQ ID NO: 7864355 - DNA, 18 bp, Homo sapiens
ggacaggagacatgggtg

SEQ ID NO: 7864356 - DNA, 18 bp, Homo sapiens
ggacaggagacatgggtg

SEQ ID NO: 7864357 - DNA, 18 bp, Homo sapiens
ggacaggagacatgggtg

SEQ ID NO: 7864358 - DNA, 18 bp, Homo sapiens
ggacaggagacatgggtg

SEQ ID NO: 7864359 - DNA, 19 bp, Homo sapiens
cacaacttcgcttgattcc

SEQ ID NO: 7864360 - DNA, 22 bp, Homo sapiens
cacaacttagcagcttgaaaca

SEQ ID NO: 7864361 - DNA, 20 bp, Homo sapiens
ggacaggaagacaacctacc

SEQ ID NO: 7864362 - DNA, 20 bp, Homo sapiens
cacaactgtccacatgctcc

SEQ ID NO: 7864363 - DNA, 22 bp, Homo sapiens
cacaacttagcagcttgaaaca

SEQ ID NO: 7864364 - DNA, 20 bp, Homo sapiens
cacaactgtccacatgctcc

SEQ ID NO: 7864365 - DNA, 17 bp, Homo sapiens
cacaactgaaaccacta

SEQ ID NO: 7864366 - DNA, 22 bp, Homo sapiens
cacaactgccatctgagcagca

SEQ ID NO: 7864367 - DNA, 22 bp, Homo sapiens
cacaactgccatctgagcagca

SEQ ID NO: 7864368 - DNA, 22 bp, Homo sapiens
cacaaatggccgtgttcaaaga

SEQ ID NO: 7864369 - DNA, 22 bp, Homo sapiens
cacaaatggccgtgttcaaaga

SEQ ID NO: 7864370 - DNA, 22 bp, Homo sapiens
cacaaatggccgtgttcaaaga

SEQ ID NO: 7864371 - DNA, 19 bp, Homo sapiens
cacaaatgatgaggacctg

SEQ ID NO: 7864372 - DNA, 22 bp, Homo sapiens
cacaaatggttgtagacattaa

SEQ ID NO: 7864373 - DNA, 22 bp, Homo sapiens
cacaaatggttgtagacattaa

SEQ ID NO: 7864374 - DNA, 22 bp, Homo sapiens
cacaaatggttgtagacattaa

SEQ ID NO: 7864375 - DNA, 22 bp, Homo sapiens
cacaaatgtgcagaaatgtgag

SEQ ID NO: 7864376 - DNA, 22 bp, Homo sapiens
cacaaatgtgcagaaatgtgag

SEQ ID NO: 7864377 - DNA, 22 bp, Homo sapiens
cacaaatgtgcagaaatgtgag

SEQ ID NO: 7864378 - DNA, 22 bp, Homo sapiens
cacaaatgtgcagaaatgtgag

SEQ ID NO: 7864379 - DNA, 22 bp, Homo sapiens
cacaaccatgcacagctaattt

SEQ ID NO: 7864380 - DNA, 23 bp, Homo sapiens
cacaactaatcagaatctctagg

SEQ ID NO: 7864381 - DNA, 22 bp, Homo sapiens
cacaaccatgcacagctaattt

SEQ ID NO: 7864382 - DNA, 23 bp, Homo sapiens
cacaactaatcagaatctctagg

SEQ ID NO: 7864383 - DNA, 22 bp, Homo sapiens
cacaaatgtagtagcttaaaac

SEQ ID NO: 7864384 - DNA, 22 bp, Homo sapiens
cacaaatgtagtagcttaaaac

SEQ ID NO: 7864385 - DNA, 22 bp, Homo sapiens
cacaaatggttgtagacattaa

SEQ ID NO: 7864386 - DNA, 22 bp, Homo sapiens
cacaaatgtagtagcttaaaac

SEQ ID NO: 7864387 - DNA, 22 bp, Homo sapiens
cacaaatgtgcagaaatgtgag

SEQ ID NO: 7864388 - DNA, 22 bp, Homo sapiens
ggagaagggacagactcagctt

SEQ ID NO: 7864389 - DNA, 22 bp, Homo sapiens
ggagaagggcatggtagtttta

SEQ ID NO: 7864390 - DNA, 22 bp, Homo sapiens
ggagaagggcatggtagtttta

SEQ ID NO: 7864391 - DNA, 22 bp, Homo sapiens
ggagaagggcatggtagtttta

SEQ ID NO: 7864392 - DNA, 22 bp, Homo sapiens
ggagaagggcatggtagtttta

SEQ ID NO: 7864393 - DNA, 22 bp, Homo sapiens
ggagaagggcatggtagtttta

SEQ ID NO: 7864394 - DNA, 22 bp, Homo sapiens
ggagaagggccaattccatgta

SEQ ID NO: 7864395 - DNA, 22 bp, Homo sapiens
ggagaagggccaattccatgta

SEQ ID NO: 7864396 - DNA, 22 bp, Homo sapiens
ggagaagggccaattccatgta

SEQ ID NO: 7864397 - DNA, 22 bp, Homo sapiens
ggagaagggccaattccatgta

SEQ ID NO: 7864398 - DNA, 22 bp, Homo sapiens
ggagaagggacagactcagctt

SEQ ID NO: 7864399 - DNA, 22 bp, Homo sapiens
ggagaagggacagactcagctt

SEQ ID NO: 7864400 - DNA, 22 bp, Homo sapiens
ggagaagggacagactcagctt

SEQ ID NO: 7864401 - DNA, 22 bp, Homo sapiens
ggagaagggacagactcagctt

SEQ ID NO: 7864402 - DNA, 22 bp, Homo sapiens
ggagaagggacagactcagctt

SEQ ID NO: 7864403 - DNA, 22 bp, Homo sapiens
ggagaagggacagactcagctt

SEQ ID NO: 7864404 - DNA, 22 bp, Homo sapiens
ggagaagggacagactcagctt

SEQ ID NO: 7864405 - DNA, 22 bp, Homo sapiens
ggagaagggacagactcagctt

SEQ ID NO: 7864406 - DNA, 22 bp, Homo sapiens
ggagaagggacagactcagctt

SEQ ID NO: 7864407 - DNA, 22 bp, Homo sapiens
ggagaaggtgctggtcactgtg

SEQ ID NO: 7864408 - DNA, 22 bp, Homo sapiens
ggagaaggtgctggtcactgtg

SEQ ID NO: 7864409 - DNA, 22 bp, Homo sapiens
ggagaagggtatgtgtggcgga

SEQ ID NO: 7864410 - DNA, 22 bp, Homo sapiens
ggagaaggtgctggtcactgtg

SEQ ID NO: 7864411 - DNA, 22 bp, Homo sapiens
ggagaaggtgctggtcactgtg

SEQ ID NO: 7864412 - DNA, 22 bp, Homo sapiens
ggagaaggtgctggtcactgtg

SEQ ID NO: 7864413 - DNA, 22 bp, Homo sapiens
ggagaagggtatgtgtggcgga

SEQ ID NO: 7864414 - DNA, 22 bp, Homo sapiens
ggagaagggtatgtgtggcgga

SEQ ID NO: 7864415 - DNA, 22 bp, Homo sapiens
ggagaagggtatgtgtggcgga

SEQ ID NO: 7864416 - DNA, 22 bp, Homo sapiens
ggagaagggtatgtgtggcgga

SEQ ID NO: 7864417 - DNA, 22 bp, Homo sapiens
ggagaagggtatgtgtggcgga

SEQ ID NO: 7864418 - DNA, 22 bp, Homo sapiens
ggagaagggtatgtgtggcgga

SEQ ID NO: 7864419 - DNA, 22 bp, Homo sapiens
ggagaagggtatgtgtggcgga

SEQ ID NO: 7864420 - DNA, 22 bp, Homo sapiens
ggagaagggtatgtgtggcgga

SEQ ID NO: 7864421 - DNA, 22 bp, Homo sapiens
ggagaagggtatgtgtggcgga

SEQ ID NO: 7864422 - DNA, 22 bp, Homo sapiens
ggagaagggtatgtgtggcgga

SEQ ID NO: 7864423 - DNA, 22 bp, Homo sapiens
ggagagcagggaggctgctctg

SEQ ID NO: 7864424 - DNA, 22 bp, Homo sapiens
ggagagcagggaggctgctctg

SEQ ID NO: 7864425 - DNA, 22 bp, Homo sapiens
ggagagcagggaggctgctctg

SEQ ID NO: 7864426 - DNA, 22 bp, Homo sapiens
ggagagcagggaggctgctctg

SEQ ID NO: 7864427 - DNA, 22 bp, Homo sapiens
ggagagcagggaggctgctctg

SEQ ID NO: 7864428 - DNA, 22 bp, Homo sapiens
ggagagcagggaggctgctctg

SEQ ID NO: 7864429 - DNA, 22 bp, Homo sapiens
ggagagcagggaggctgctctg

SEQ ID NO: 7864430 - DNA, 20 bp, Homo sapiens
ggagagcagggaagacagta

SEQ ID NO: 7864431 - DNA, 22 bp, Homo sapiens
ggagagcattcttagtctgttt

SEQ ID NO: 7864432 - DNA, 22 bp, Homo sapiens
ggagagcattcttagtctgttt

SEQ ID NO: 7864433 - DNA, 22 bp, Homo sapiens
ggagagcattcttagtctgttt

SEQ ID NO: 7864434 - DNA, 22 bp, Homo sapiens
ggagagcattcttagtctgttt

SEQ ID NO: 7864435 - DNA, 22 bp, Homo sapiens
ggagagcagggtcctgagatac

SEQ ID NO: 7864436 - DNA, 22 bp, Homo sapiens
ggagagcagggtcctgagatac

SEQ ID NO: 7864437 - DNA, 22 bp, Homo sapiens
ggagagcagggtcctgagatac

SEQ ID NO: 7864438 - DNA, 22 bp, Homo sapiens
ggagagaggctggccgtgatga

SEQ ID NO: 7864439 - DNA, 20 bp, Homo sapiens
ggagagcagggaagacagta

SEQ ID NO: 7864440 - DNA, 22 bp, Homo sapiens
ggagagatggtaaccctggggc

SEQ ID NO: 7864441 - DNA, 22 bp, Homo sapiens
ggagagaggctggccgtgatga

SEQ ID NO: 7864442 - DNA, 22 bp, Homo sapiens
ggagaaggtggctcagcaaagg

SEQ ID NO: 7864443 - DNA, 22 bp, Homo sapiens
ggagagaggagcccactgctgt

SEQ ID NO: 7864444 - DNA, 22 bp, Homo sapiens
ggagaaggtggctcagcaaagg

SEQ ID NO: 7864445 - DNA, 22 bp, Homo sapiens
ggagaaggtgctggtcactgtg

SEQ ID NO: 7864446 - DNA, 22 bp, Homo sapiens
ggagagaggagcccactgctgt

SEQ ID NO: 7864447 - DNA, 22 bp, Homo sapiens
ggagagaggagcccactgctgt

SEQ ID NO: 7864448 - DNA, 22 bp, Homo sapiens
cacacaggtaagcctctttcaa

SEQ ID NO: 7864449 - DNA, 22 bp, Homo sapiens
cacacaggtatatatatgtaca

SEQ ID NO: 7864450 - DNA, 22 bp, Homo sapiens
cacacaggtaagcctctttcaa

SEQ ID NO: 7864451 - DNA, 22 bp, Homo sapiens
cacacaggtaagcctctttcaa

SEQ ID NO: 7864452 - DNA, 22 bp, Homo sapiens
cacacagggagaaagaaagcct

SEQ ID NO: 7864453 - DNA, 22 bp, Homo sapiens
cacacaggtaagcctctttcaa

SEQ ID NO: 7864454 - DNA, 22 bp, Homo sapiens
cacacagggagaaagaaagcct

SEQ ID NO: 7864455 - DNA, 22 bp, Homo sapiens
cacacaggatgaagcagcagaa

SEQ ID NO: 7864456 - DNA, 22 bp, Homo sapiens
cacacaggatgaagcagcagaa

SEQ ID NO: 7864457 - DNA, 22 bp, Homo sapiens
cacacaggcaggatcccttccc

SEQ ID NO: 7864458 - DNA, 22 bp, Homo sapiens
cacacaggatgaagcagcagaa

SEQ ID NO: 7864459 - DNA, 22 bp, Homo sapiens
cacacagggagaaagaaagcct

SEQ ID NO: 7864460 - DNA, 22 bp, Homo sapiens
cacacaggcaggatcccttccc

SEQ ID NO: 7864461 - DNA, 22 bp, Homo sapiens
ggaccagctatcaatgccaggg

SEQ ID NO: 7864462 - DNA, 22 bp, Homo sapiens
ggaccagctatcaatgccaggg

SEQ ID NO: 7864463 - DNA, 22 bp, Homo sapiens
ggaccagcaatcaagaacctac

SEQ ID NO: 7864464 - DNA, 22 bp, Homo sapiens
ggaccagcaatcaagaacctac

SEQ ID NO: 7864465 - DNA, 22 bp, Homo sapiens
ggaccagagctcgggcttctca

SEQ ID NO: 7864466 - DNA, 22 bp, Homo sapiens
ggaccagagggatgacatttgg

SEQ ID NO: 7864467 - DNA, 22 bp, Homo sapiens
ggaccagagctcgggcttctca

SEQ ID NO: 7864468 - DNA, 22 bp, Homo sapiens
ggaccagagaagtgagcacctg

SEQ ID NO: 7864469 - DNA, 22 bp, Homo sapiens
ggaccagagaagtgagcacctg

SEQ ID NO: 7864470 - DNA, 22 bp, Homo sapiens
cacacaggagagtgctggaggt

SEQ ID NO: 7864471 - DNA, 22 bp, Homo sapiens
cacacaggatgaagcagcagaa

SEQ ID NO: 7864472 - DNA, 22 bp, Homo sapiens
cacacaggatgaagcagcagaa

SEQ ID NO: 7864473 - DNA, 22 bp, Homo sapiens
cacacaggatgaagcagcagaa

SEQ ID NO: 7864474 - DNA, 22 bp, Homo sapiens
ggaccagctatcaatgccaggg

SEQ ID NO: 7864475 - DNA, 20 bp, Homo sapiens
ggaccagctgtctgaggggc

SEQ ID NO: 7864476 - DNA, 20 bp, Homo sapiens
ggaccagctgtctgaggggc

SEQ ID NO: 7864477 - DNA, 22 bp, Homo sapiens
cacacaggagagtgctggaggt

SEQ ID NO: 7864478 - DNA, 22 bp, Homo sapiens
cacacagtggagtattactcag

SEQ ID NO: 7864479 - DNA, 22 bp, Homo sapiens
cacacagtggagtattactcag

SEQ ID NO: 7864480 - DNA, 22 bp, Homo sapiens
cacacagtggagtattactcag

SEQ ID NO: 7864481 - DNA, 21 bp, Homo sapiens
cacacagtgatctatccacat

SEQ ID NO: 7864482 - DNA, 21 bp, Homo sapiens
cacacagtgatctatccacat

SEQ ID NO: 7864483 - DNA, 22 bp, Homo sapiens
cacacagtaggcactcattaat

SEQ ID NO: 7864484 - DNA, 22 bp, Homo sapiens
cacacagtagtatgaggcaaaa

SEQ ID NO: 7864485 - DNA, 22 bp, Homo sapiens
cacacagtagtatgaggcaaaa

SEQ ID NO: 7864486 - DNA, 22 bp, Homo sapiens
cacacagtaggcactcattaat

SEQ ID NO: 7864487 - DNA, 22 bp, Homo sapiens
cacacagtaggcactcattaat

SEQ ID NO: 7864488 - DNA, 22 bp, Homo sapiens
ggagaagggaactgagtttttg

SEQ ID NO: 7864489 - DNA, 22 bp, Homo sapiens
ggagaagggaactgagtttttg

SEQ ID NO: 7864490 - DNA, 22 bp, Homo sapiens
ggagaagggaactgagtttttg

SEQ ID NO: 7864491 - DNA, 22 bp, Homo sapiens
ggagaagggaactgagtttttg

SEQ ID NO: 7864492 - DNA, 22 bp, Homo sapiens
ggagaagggacagactcagctt

SEQ ID NO: 7864493 - DNA, 22 bp, Homo sapiens
ggagaagggacagactcagctt

SEQ ID NO: 7864494 - DNA, 22 bp, Homo sapiens
ggagaaggcgaagtcattcttt

SEQ ID NO: 7864495 - DNA, 22 bp, Homo sapiens
ggagaaggcacacccacctctg

SEQ ID NO: 7864496 - DNA, 22 bp, Homo sapiens
ggagaaggcacacccacctctg

SEQ ID NO: 7864497 - DNA, 22 bp, Homo sapiens
ggagaaggcgaagtcattcttt

SEQ ID NO: 7864498 - DNA, 21 bp, Homo sapiens
cacacagtggagtgcccttgc

SEQ ID NO: 7864499 - DNA, 22 bp, Homo sapiens
ggactgggtaggagcccagggc

SEQ ID NO: 7864500 - DNA, 22 bp, Homo sapiens
cacacagtgggaaaacctgaag

SEQ ID NO: 7864501 - DNA, 22 bp, Homo sapiens
ggactgggtaggagcccagggc

SEQ ID NO: 7864502 - DNA, 22 bp, Homo sapiens
ggagaaggcacacccacctctg

SEQ ID NO: 7864503 - DNA, 22 bp, Homo sapiens
caagcgtggctgctctgatgga

SEQ ID NO: 7864504 - DNA, 22 bp, Homo sapiens
caagcgtggctgctctgatgga

SEQ ID NO: 7864505 - DNA, 22 bp, Homo sapiens
caagctactcaggcaagatgtg

SEQ ID NO: 7864506 - DNA, 22 bp, Homo sapiens
caagccttggaaatccattctg

SEQ ID NO: 7864507 - DNA, 22 bp, Homo sapiens
caagccttggaaatccattctg

SEQ ID NO: 7864508 - DNA, 22 bp, Homo sapiens
caagcctgtctcaccagtgcta

SEQ ID NO: 7864509 - DNA, 22 bp, Homo sapiens
caagctctgcgggctccaagat

SEQ ID NO: 7864510 - DNA, 22 bp, Homo sapiens
caagctctgggatagcagagag

SEQ ID NO: 7864511 - DNA, 22 bp, Homo sapiens
caagctctgggatagcagagag

SEQ ID NO: 7864512 - DNA, 22 bp, Homo sapiens
caagctctgcgggctccaagat

SEQ ID NO: 7864513 - DNA, 22 bp, Homo sapiens
caagctacttagaaagcacagt

SEQ ID NO: 7864514 - DNA, 22 bp, Homo sapiens
caagctccttacatccacaggg

SEQ ID NO: 7864515 - DNA, 22 bp, Homo sapiens
caagctccttacatccacaggg

SEQ ID NO: 7864516 - DNA, 22 bp, Homo sapiens
caagctccttacatccacaggg

SEQ ID NO: 7864517 - DNA, 22 bp, Homo sapiens
gctgggctcaccaggccactag

SEQ ID NO: 7864518 - DNA, 23 bp, Homo sapiens
caagctgcagtttggttggtggg

SEQ ID NO: 7864519 - DNA, 22 bp, Homo sapiens
gctgggctcaccaggccactag

SEQ ID NO: 7864520 - DNA, 22 bp, Homo sapiens
caagctctgggatgcagacatc

SEQ ID NO: 7864521 - DNA, 22 bp, Homo sapiens
caagctctgcgggctccaagat

SEQ ID NO: 7864522 - DNA, 22 bp, Homo sapiens
caagctctttaaacttatgtca

SEQ ID NO: 7864523 - DNA, 22 bp, Homo sapiens
gctgggctcagacctagtgaac

SEQ ID NO: 7864524 - DNA, 22 bp, Homo sapiens
gctgggctcagacctagtgaac

SEQ ID NO: 7864525 - DNA, 22 bp, Homo sapiens
gctgggctcagacctagtgaac

SEQ ID NO: 7864526 - DNA, 22 bp, Homo sapiens
gctgggcttgtggccagctggg

SEQ ID NO: 7864527 - DNA, 22 bp, Homo sapiens
gctgggcttgtggccagctggg

SEQ ID NO: 7864528 - DNA, 22 bp, Homo sapiens
gctgggcttggtttccctgctt

SEQ ID NO: 7864529 - DNA, 22 bp, Homo sapiens
gctgggcttgtggccagctggg

SEQ ID NO: 7864530 - DNA, 22 bp, Homo sapiens
gctgggcttgtggccagctggg

SEQ ID NO: 7864531 - DNA, 22 bp, Homo sapiens
gctggggactccccaccatagc

SEQ ID NO: 7864532 - DNA, 22 bp, Homo sapiens
gctggggaccagctgtctctga

SEQ ID NO: 7864533 - DNA, 22 bp, Homo sapiens
gctggggagaattgggttatct

SEQ ID NO: 7864534 - DNA, 22 bp, Homo sapiens
gctggggagaattgggttatct

SEQ ID NO: 7864535 - DNA, 22 bp, Homo sapiens
gctggggactccccaccatagc

SEQ ID NO: 7864536 - DNA, 22 bp, Homo sapiens
gctggggagcaagagtagtgag

SEQ ID NO: 7864537 - DNA, 22 bp, Homo sapiens
gctggggagaattgggttatct

SEQ ID NO: 7864538 - DNA, 22 bp, Homo sapiens
gctggggagcaagagtagtgag

SEQ ID NO: 7864539 - DNA, 22 bp, Homo sapiens
gctggggagcaagagtagtgag

SEQ ID NO: 7864540 - DNA, 22 bp, Homo sapiens
gctggggagcaagagtagtgag

SEQ ID NO: 7864541 - DNA, 22 bp, Homo sapiens
gctggggagcaagagtagtgag

SEQ ID NO: 7864542 - DNA, 22 bp, Homo sapiens
gctggggagaattgggttatct

SEQ ID NO: 7864543 - DNA, 22 bp, Homo sapiens
gctggggagcaagagtagtgag

SEQ ID NO: 7864544 - DNA, 22 bp, Homo sapiens
gctggggagcaagagtagtgag

SEQ ID NO: 7864545 - DNA, 19 bp, Homo sapiens
gctggggaatggatattga

SEQ ID NO: 7864546 - DNA, 19 bp, Homo sapiens
gctggggaatggatattga

SEQ ID NO: 7864547 - DNA, 19 bp, Homo sapiens
gctggggaatggatattga

SEQ ID NO: 7864548 - DNA, 20 bp, Homo sapiens
gctgggctttgactgacaca

SEQ ID NO: 7864549 - DNA, 22 bp, Homo sapiens
gctggggaccagctgtctctga

SEQ ID NO: 7864550 - DNA, 22 bp, Homo sapiens
gctggggaccagctgtctctga

SEQ ID NO: 7864551 - DNA, 22 bp, Homo sapiens
gctggggaccagctgtctctga

SEQ ID NO: 7864552 - DNA, 22 bp, Homo sapiens
gctggggaccagctgtctctga

SEQ ID NO: 7864553 - DNA, 20 bp, Homo sapiens
gctgggctttgactgacaca

SEQ ID NO: 7864554 - DNA, 20 bp, Homo sapiens
gctgggctttgactgacaca

SEQ ID NO: 7864555 - DNA, 22 bp, Homo sapiens
gctgggcttgtggccagctggg

SEQ ID NO: 7864556 - DNA, 20 bp, Homo sapiens
gctgggctttgactgacaca

SEQ ID NO: 7864557 - DNA, 20 bp, Homo sapiens
gctgggctttgactgacaca

SEQ ID NO: 7864558 - DNA, 22 bp, Homo sapiens
gctgggcttgtggccagctggg

SEQ ID NO: 7864559 - DNA, 22 bp, Homo sapiens
gctgggcttgtggccagctggg

SEQ ID NO: 7864560 - DNA, 22 bp, Homo sapiens
gctgggcttgtggccagctggg

SEQ ID NO: 7864561 - DNA, 22 bp, Homo sapiens
caagccatactgggtgaaatca

SEQ ID NO: 7864562 - DNA, 22 bp, Homo sapiens
gctggctgagttctgtcgtctg

SEQ ID NO: 7864563 - DNA, 22 bp, Homo sapiens
gctggctgagttctgtcgtctg

SEQ ID NO: 7864564 - DNA, 22 bp, Homo sapiens
gctggctgagttctgtcgtctg

SEQ ID NO: 7864565 - DNA, 22 bp, Homo sapiens
gctggctgagttctgtcgtctg

SEQ ID NO: 7864566 - DNA, 22 bp, Homo sapiens
gctggctgagttctgtcgtctg

SEQ ID NO: 7864567 - DNA, 22 bp, Homo sapiens
gctggctgaggtctagctcttt

SEQ ID NO: 7864568 - DNA, 22 bp, Homo sapiens
gctggctgaggtctagctcttt

SEQ ID NO: 7864569 - DNA, 22 bp, Homo sapiens
gctggctgaggtctagctcttt

SEQ ID NO: 7864570 - DNA, 22 bp, Homo sapiens
gctggctgaggtctagctcttt

SEQ ID NO: 7864571 - DNA, 22 bp, Homo sapiens
gctggctgaggtctagctcttt

SEQ ID NO: 7864572 - DNA, 22 bp, Homo sapiens
gctggctgaggtctagctcttt

SEQ ID NO: 7864573 - DNA, 22 bp, Homo sapiens
gctggctgaggtctagctcttt

SEQ ID NO: 7864574 - DNA, 22 bp, Homo sapiens
gctggctgaggtctagctcttt

SEQ ID NO: 7864575 - DNA, 22 bp, Homo sapiens
gctggctgaggtctagctcttt

SEQ ID NO: 7864576 - DNA, 22 bp, Homo sapiens
gctggctgaggtctagctcttt

SEQ ID NO: 7864577 - DNA, 22 bp, Homo sapiens
caagccatattttgaagaatga

SEQ ID NO: 7864578 - DNA, 22 bp, Homo sapiens
gctggctgagttctgtcgtctg

SEQ ID NO: 7864579 - DNA, 22 bp, Homo sapiens
caagcccactgctcagagccaa

SEQ ID NO: 7864580 - DNA, 22 bp, Homo sapiens
caagcccactgctcagagccaa

SEQ ID NO: 7864581 - DNA, 22 bp, Homo sapiens
caagcccactgctcagagccaa

SEQ ID NO: 7864582 - DNA, 22 bp, Homo sapiens
caagcccactgctcagagccaa

SEQ ID NO: 7864583 - DNA, 22 bp, Homo sapiens
caagcccagatcctgcgtgtct

SEQ ID NO: 7864584 - DNA, 22 bp, Homo sapiens
caagcccagatcctgcgtgtct

SEQ ID NO: 7864585 - DNA, 22 bp, Homo sapiens
caagcccaggattccccagtta

SEQ ID NO: 7864586 - DNA, 22 bp, Homo sapiens
caagcccaggattccccagtta

SEQ ID NO: 7864587 - DNA, 22 bp, Homo sapiens
caagccctgttaggggtctcta

SEQ ID NO: 7864588 - DNA, 22 bp, Homo sapiens
caagcctgtctcaccagtgcta

SEQ ID NO: 7864589 - DNA, 22 bp, Homo sapiens
caagcctcagaatcttctccat

SEQ ID NO: 7864590 - DNA, 22 bp, Homo sapiens
gctggctgaatcttctgcaata

SEQ ID NO: 7864591 - DNA, 22 bp, Homo sapiens
gctggctgaatcttctgcaata

SEQ ID NO: 7864592 - DNA, 22 bp, Homo sapiens
gctggctgaatcttctgcaata

SEQ ID NO: 7864593 - DNA, 22 bp, Homo sapiens
gctggctctttttgccgggctc

SEQ ID NO: 7864594 - DNA, 22 bp, Homo sapiens
gctggctctttttgccgggctc

SEQ ID NO: 7864595 - DNA, 20 bp, Homo sapiens
gctggctgaactgaaagcaa

SEQ ID NO: 7864596 - DNA, 20 bp, Homo sapiens
gctggctgaactgaaagcaa

SEQ ID NO: 7864597 - DNA, 22 bp, Homo sapiens
gctggctctttttgccgggctc

SEQ ID NO: 7864598 - DNA, 22 bp, Homo sapiens
gctggctctttttgccgggctc

SEQ ID NO: 7864599 - DNA, 22 bp, Homo sapiens
gctggctctttttgccgggctc

SEQ ID NO: 7864600 - DNA, 22 bp, Homo sapiens
gctggctcttcagtggagatag

SEQ ID NO: 7864601 - DNA, 22 bp, Homo sapiens
gctggctcttcagtggagatag

SEQ ID NO: 7864602 - DNA, 22 bp, Homo sapiens
gctggcccagggtcacctagga

SEQ ID NO: 7864603 - DNA, 22 bp, Homo sapiens
gctggcccagcgtggggccgtg

SEQ ID NO: 7864604 - DNA, 22 bp, Homo sapiens
gctggcccagggtcacctagga

SEQ ID NO: 7864605 - DNA, 22 bp, Homo sapiens
gctggcccagggtcacctagga

SEQ ID NO: 7864606 - DNA, 22 bp, Homo sapiens
gctggcccagggtcacctagga

SEQ ID NO: 7864607 - DNA, 17 bp, Homo sapiens
gctggctgacccatgcc

SEQ ID NO: 7864608 - DNA, 17 bp, Homo sapiens
gctggctgacccatgcc

SEQ ID NO: 7864609 - DNA, 17 bp, Homo sapiens
gctggctgacccatgcc

SEQ ID NO: 7864610 - DNA, 22 bp, Homo sapiens
gctggctgaatcttctgcaata

SEQ ID NO: 7864611 - DNA, 22 bp, Homo sapiens
gctggctgacagagatttaaaa

SEQ ID NO: 7864612 - DNA, 22 bp, Homo sapiens
gctggctgacagatttggggtg

SEQ ID NO: 7864613 - DNA, 22 bp, Homo sapiens
gctggctgacagatttggggtg

SEQ ID NO: 7864614 - DNA, 22 bp, Homo sapiens
gctggctgagcactggtttata

SEQ ID NO: 7864615 - DNA, 22 bp, Homo sapiens
gctggctgagatctgttttcct

SEQ ID NO: 7864616 - DNA, 17 bp, Homo sapiens
gctggctgacccatgcc

SEQ ID NO: 7864617 - DNA, 17 bp, Homo sapiens
gctggctgacccatgcc

SEQ ID NO: 7864618 - DNA, 22 bp, Homo sapiens
gctggctgagatctgttttcct

SEQ ID NO: 7864619 - DNA, 17 bp, Homo sapiens
gctggctgacccatgcc

SEQ ID NO: 7864620 - DNA, 22 bp, Homo sapiens
gctgctggcgctgggcgtccgg

SEQ ID NO: 7864621 - DNA, 22 bp, Homo sapiens
gctgctggcgctgggcgtccgg

SEQ ID NO: 7864622 - DNA, 22 bp, Homo sapiens
gctgctggcgctgggcgtccgg

SEQ ID NO: 7864623 - DNA, 22 bp, Homo sapiens
gctgctggccgcccagcttctc

SEQ ID NO: 7864624 - DNA, 22 bp, Homo sapiens
gctgctggccgcccagcttctc

SEQ ID NO: 7864625 - DNA, 22 bp, Homo sapiens
gctgctggcgctgggcgtccgg

SEQ ID NO: 7864626 - DNA, 22 bp, Homo sapiens
gctgctggccccacatgctcca

SEQ ID NO: 7864627 - DNA, 22 bp, Homo sapiens
gctgctggccgcccagcttctc

SEQ ID NO: 7864628 - DNA, 22 bp, Homo sapiens
gctgctggccgcccagcttctc

SEQ ID NO: 7864629 - DNA, 22 bp, Homo sapiens
gctgcctgccttgcctggagga

SEQ ID NO: 7864630 - DNA, 22 bp, Homo sapiens
gctgcctgccttgcctggagga

SEQ ID NO: 7864631 - DNA, 22 bp, Homo sapiens
gctgcctgccttgcctggagga

SEQ ID NO: 7864632 - DNA, 22 bp, Homo sapiens
gctgcctgcctagttccacagt

SEQ ID NO: 7864633 - DNA, 22 bp, Homo sapiens
gctgcctgccctgggtcatctg

SEQ ID NO: 7864634 - DNA, 22 bp, Homo sapiens
gctgcctgcctagttccacagt

SEQ ID NO: 7864635 - DNA, 22 bp, Homo sapiens
gctgcctgccttgcctggagga

SEQ ID NO: 7864636 - DNA, 22 bp, Homo sapiens
gctgcctgcctagttccacagt

SEQ ID NO: 7864637 - DNA, 22 bp, Homo sapiens
gctgcctgcctagttccacagt

SEQ ID NO: 7864638 - DNA, 22 bp, Homo sapiens
gctgcctgcacagagctgcttt

SEQ ID NO: 7864639 - DNA, 22 bp, Homo sapiens
gctgcctgcacagagctgcttt

SEQ ID NO: 7864640 - DNA, 22 bp, Homo sapiens
gctgcctgcacagagctgcttt

SEQ ID NO: 7864641 - DNA, 21 bp, Homo sapiens
gctgcctgcccctcgggggct

SEQ ID NO: 7864642 - DNA, 21 bp, Homo sapiens
gctgcctgcccctcgggggct

SEQ ID NO: 7864643 - DNA, 18 bp, Homo sapiens
gctgcctgcattcctcac

SEQ ID NO: 7864644 - DNA, 18 bp, Homo sapiens
gctgcctgcattcctcac

SEQ ID NO: 7864645 - DNA, 22 bp, Homo sapiens
gctgcctgccctgggtcatctg

SEQ ID NO: 7864646 - DNA, 22 bp, Homo sapiens
gctgcctgccctgggtcatctg

SEQ ID NO: 7864647 - DNA, 22 bp, Homo sapiens
gctgcctgccctgggtcatctg

SEQ ID NO: 7864648 - DNA, 21 bp, Homo sapiens
gctgcctgcccctcgggggct

SEQ ID NO: 7864649 - DNA, 21 bp, Homo sapiens
gctgcctgcccctcgggggct

SEQ ID NO: 7864650 - DNA, 22 bp, Homo sapiens
gctggaaatgaatggagaggtg

SEQ ID NO: 7864651 - DNA, 22 bp, Homo sapiens
gctggaaatgattaaatggtga

SEQ ID NO: 7864652 - DNA, 20 bp, Homo sapiens
gctggaagggctagagggct

SEQ ID NO: 7864653 - DNA, 22 bp, Homo sapiens
gctggaaatcatattttgttgt

SEQ ID NO: 7864654 - DNA, 22 bp, Homo sapiens
gctggaaatcaaagaagtggat

SEQ ID NO: 7864655 - DNA, 22 bp, Homo sapiens
gctggaaatcaaagaagtggat

SEQ ID NO: 7864656 - DNA, 22 bp, Homo sapiens
gctggaaaaggaggcaaaatat

SEQ ID NO: 7864657 - DNA, 22 bp, Homo sapiens
gctgctttttggatttggcaca

SEQ ID NO: 7864658 - DNA, 22 bp, Homo sapiens
gctggaaaaggaggcaaaatat

SEQ ID NO: 7864659 - DNA, 22 bp, Homo sapiens
gctgcttttcacagagacaaga

SEQ ID NO: 7864660 - DNA, 22 bp, Homo sapiens
gctgctggcgctgggcgtccgg

SEQ ID NO: 7864661 - DNA, 22 bp, Homo sapiens
gctgctttctgttaggaattgg

SEQ ID NO: 7864662 - DNA, 22 bp, Homo sapiens
gctgctttctgaaggtgcactg

SEQ ID NO: 7864663 - DNA, 22 bp, Homo sapiens
gctgctttgacagtgggaacag

SEQ ID NO: 7864664 - DNA, 22 bp, Homo sapiens
gctgctttgacagtgggaacag

SEQ ID NO: 7864665 - DNA, 22 bp, Homo sapiens
gctgctttgtctgtaaaatgga

SEQ ID NO: 7864666 - DNA, 22 bp, Homo sapiens
gctgctttgcagtagagtaata

SEQ ID NO: 7864667 - DNA, 22 bp, Homo sapiens
gctgctttgtctgtaaaatgga

SEQ ID NO: 7864668 - DNA, 22 bp, Homo sapiens
gctgctttgtctgtaaaatgga

SEQ ID NO: 7864669 - DNA, 22 bp, Homo sapiens
caagaatcaacattatttagtg

SEQ ID NO: 7864670 - DNA, 22 bp, Homo sapiens
caagaatatatatggagtggag

SEQ ID NO: 7864671 - DNA, 22 bp, Homo sapiens
caagaatataaatactttcaaa

SEQ ID NO: 7864672 - DNA, 22 bp, Homo sapiens
caagaatataaatactttcaaa

SEQ ID NO: 7864673 - DNA, 22 bp, Homo sapiens
caagaataaccagacaatagca

SEQ ID NO: 7864674 - DNA, 22 bp, Homo sapiens
caagaataaccagacaatagca

SEQ ID NO: 7864675 - DNA, 22 bp, Homo sapiens
caagaataaaatacatgttgat

SEQ ID NO: 7864676 - DNA, 22 bp, Homo sapiens
caagaatagctacctcccatat

SEQ ID NO: 7864677 - DNA, 22 bp, Homo sapiens
caagaataaccagacaatagca

SEQ ID NO: 7864678 - DNA, 22 bp, Homo sapiens
caagaatagctacctcccatat

SEQ ID NO: 7864679 - DNA, 22 bp, Homo sapiens
gctggcccagcgtggggccgtg

SEQ ID NO: 7864680 - DNA, 22 bp, Homo sapiens
gctggcccagcgtggggccgtg

SEQ ID NO: 7864681 - DNA, 22 bp, Homo sapiens
gctggcccagcgtggggccgtg

SEQ ID NO: 7864682 - DNA, 19 bp, Homo sapiens
caagacaaagcccatcttc

SEQ ID NO: 7864683 - DNA, 22 bp, Homo sapiens
caagaattgtacaaactgggtg

SEQ ID NO: 7864684 - DNA, 19 bp, Homo sapiens
caagacaaagcccatcttc

SEQ ID NO: 7864685 - DNA, 19 bp, Homo sapiens
caagacaaagcccatcttc

SEQ ID NO: 7864686 - DNA, 18 bp, Homo sapiens
caagaatctctaaagaag

SEQ ID NO: 7864687 - DNA, 22 bp, Homo sapiens
caagaatcttgcagcttagact

SEQ ID NO: 7864688 - DNA, 22 bp, Homo sapiens
caagaatcctgttcttgaagat

SEQ ID NO: 7864689 - DNA, 22 bp, Homo sapiens
caagaatcagacctgtcagggt

SEQ ID NO: 7864690 - DNA, 22 bp, Homo sapiens
caagaatcttgcagcttagact

SEQ ID NO: 7864691 - DNA, 22 bp, Homo sapiens
caagaatgaattcaatgtgtgg

SEQ ID NO: 7864692 - DNA, 22 bp, Homo sapiens
caagaattaagaattttgatgt

SEQ ID NO: 7864693 - DNA, 22 bp, Homo sapiens
gctggacttagaggtggaaaag

SEQ ID NO: 7864694 - DNA, 22 bp, Homo sapiens
gctggacttagaggtggaaaag

SEQ ID NO: 7864695 - DNA, 22 bp, Homo sapiens
gctggacttcatgcattcctgt

SEQ ID NO: 7864696 - DNA, 22 bp, Homo sapiens
gctggacccggcccctcacctc

SEQ ID NO: 7864697 - DNA, 22 bp, Homo sapiens
gctggacccggcccctcacctc

SEQ ID NO: 7864698 - DNA, 22 bp, Homo sapiens
gctggaccaggtgtgcacaggc

SEQ ID NO: 7864699 - DNA, 22 bp, Homo sapiens
gctggacccggcccctcacctc

SEQ ID NO: 7864700 - DNA, 22 bp, Homo sapiens
gctggaccaggtgtgcacaggc

SEQ ID NO: 7864701 - DNA, 22 bp, Homo sapiens
gctggacaggccacatggagga

SEQ ID NO: 7864702 - DNA, 22 bp, Homo sapiens
gctggacatccatcctgtagaa

SEQ ID NO: 7864703 - DNA, 22 bp, Homo sapiens
gctggacaggccacatggagga

SEQ ID NO: 7864704 - DNA, 22 bp, Homo sapiens
gctggacaggccacatggagga

SEQ ID NO: 7864705 - DNA, 20 bp, Homo sapiens
gctggaagggctagagggct

SEQ ID NO: 7864706 - DNA, 20 bp, Homo sapiens
gctggaagggctagagggct

SEQ ID NO: 7864707 - DNA, 22 bp, Homo sapiens
gctggaattggacccagggctc

SEQ ID NO: 7864708 - DNA, 22 bp, Homo sapiens
gctggaattggacccagggctc

SEQ ID NO: 7864709 - DNA, 22 bp, Homo sapiens
caagaagttgacagccaggtga

SEQ ID NO: 7864710 - DNA, 22 bp, Homo sapiens
caagaagttgacagccaggtga

SEQ ID NO: 7864711 - DNA, 22 bp, Homo sapiens
caagaagtgtcagctttttaaa

SEQ ID NO: 7864712 - DNA, 22 bp, Homo sapiens
gctggagaaacaggaggaggaa

SEQ ID NO: 7864713 - DNA, 22 bp, Homo sapiens
caagaagcccttcctgggtgga

SEQ ID NO: 7864714 - DNA, 22 bp, Homo sapiens
caagaagctttccctgcttgca

SEQ ID NO: 7864715 - DNA, 22 bp, Homo sapiens
caaattttgtgtgttctctagt

SEQ ID NO: 7864716 - DNA, 22 bp, Homo sapiens
caaattttgtgtgttctctagt

SEQ ID NO: 7864717 - DNA, 22 bp, Homo sapiens
caaattttgtgtgttctctagt

SEQ ID NO: 7864718 - DNA, 22 bp, Homo sapiens
caacaagcgctcagagcaaagc

SEQ ID NO: 7864719 - DNA, 22 bp, Homo sapiens
caacaagcgctcagagcaaagc

SEQ ID NO: 7864720 - DNA, 22 bp, Homo sapiens
caacaatatgccagactcaatt

SEQ ID NO: 7864721 - DNA, 22 bp, Homo sapiens
caacaatatgccagactcaatt

SEQ ID NO: 7864722 - DNA, 22 bp, Homo sapiens
caacaatatgctgagtttttca

SEQ ID NO: 7864723 - DNA, 22 bp, Homo sapiens
caacaatatgccagactcaatt

SEQ ID NO: 7864724 - DNA, 22 bp, Homo sapiens
caacaagggacagtgttctaaa

SEQ ID NO: 7864725 - DNA, 22 bp, Homo sapiens
caacaagcgctcagagcaaagc

SEQ ID NO: 7864726 - DNA, 22 bp, Homo sapiens
caacaagcgctcagagcaaagc

SEQ ID NO: 7864727 - DNA, 22 bp, Homo sapiens
caaattttgtgtgttctctagt

SEQ ID NO: 7864728 - DNA, 22 bp, Homo sapiens
caaattttgtgtgttctctagt

SEQ ID NO: 7864729 - DNA, 22 bp, Homo sapiens
gctgccctgtccggctctcctg

SEQ ID NO: 7864730 - DNA, 22 bp, Homo sapiens
gctgccctgtccggctctcctg

SEQ ID NO: 7864731 - DNA, 22 bp, Homo sapiens
gctgccctgtccggctctcctg

SEQ ID NO: 7864732 - DNA, 22 bp, Homo sapiens
gctgccctgtccggctctcctg

SEQ ID NO: 7864733 - DNA, 22 bp, Homo sapiens
gctgccctgtctgcagcaggac

SEQ ID NO: 7864734 - DNA, 22 bp, Homo sapiens
gctgccctgtctgcagcaggac

SEQ ID NO: 7864735 - DNA, 22 bp, Homo sapiens
gctgccctgtctgcagcaggac

SEQ ID NO: 7864736 - DNA, 22 bp, Homo sapiens
gctgccctgtccggctctcctg

SEQ ID NO: 7864737 - DNA, 22 bp, Homo sapiens
caacaatatgctgagtttttca

SEQ ID NO: 7864738 - DNA, 22 bp, Homo sapiens
caacaatatgctgagtttttca

SEQ ID NO: 7864739 - DNA, 22 bp, Homo sapiens
caacacaggggttatgccatgg

SEQ ID NO: 7864740 - DNA, 22 bp, Homo sapiens
caacacaggggttatgccatgg

SEQ ID NO: 7864741 - DNA, 22 bp, Homo sapiens
caacacaggttctgcaaaggaa

SEQ ID NO: 7864742 - DNA, 22 bp, Homo sapiens
caacacattgaagctatgatga

SEQ ID NO: 7864743 - DNA, 22 bp, Homo sapiens
caacacattgaagctatgatga

SEQ ID NO: 7864744 - DNA, 22 bp, Homo sapiens
caacacaggttctgcaaaggaa

SEQ ID NO: 7864745 - DNA, 22 bp, Homo sapiens
caacacaggttctgcaaaggaa

SEQ ID NO: 7864746 - DNA, 22 bp, Homo sapiens
caacaccttgatcttggacttc

SEQ ID NO: 7864747 - DNA, 22 bp, Homo sapiens
caacaccttgatcttggacttc

SEQ ID NO: 7864748 - DNA, 22 bp, Homo sapiens
caacacattgaagctatgatga

SEQ ID NO: 7864749 - DNA, 22 bp, Homo sapiens
caacactgacaatggactgatt

SEQ ID NO: 7864750 - DNA, 22 bp, Homo sapiens
caacactgacaatggactgatt

SEQ ID NO: 7864751 - DNA, 22 bp, Homo sapiens
caactactggtgctcaggaaat

SEQ ID NO: 7864752 - DNA, 22 bp, Homo sapiens
caactagttttaatgttcatgg

SEQ ID NO: 7864753 - DNA, 22 bp, Homo sapiens
caactagttttaatgttcatgg

SEQ ID NO: 7864754 - DNA, 22 bp, Homo sapiens
caactacatccacactttgtta

SEQ ID NO: 7864755 - DNA, 22 bp, Homo sapiens
caactttagcaatgttagtata

SEQ ID NO: 7864756 - DNA, 22 bp, Homo sapiens
caactttagcaatgttagtata

SEQ ID NO: 7864757 - DNA, 22 bp, Homo sapiens
caactatagggagagtggttaa

SEQ ID NO: 7864758 - DNA, 22 bp, Homo sapiens
caactatagatcaaatgagttt

SEQ ID NO: 7864759 - DNA, 22 bp, Homo sapiens
caactatatagaaattgattgt

SEQ ID NO: 7864760 - DNA, 22 bp, Homo sapiens
caactttagaccccaagtagct

SEQ ID NO: 7864761 - DNA, 22 bp, Homo sapiens
caacttttgacacgtgtgctaa

SEQ ID NO: 7864762 - DNA, 22 bp, Homo sapiens
caacttttctgtgaatttaagt

SEQ ID NO: 7864763 - DNA, 22 bp, Homo sapiens
caagaaacaccaatgactgctg

SEQ ID NO: 7864764 - DNA, 23 bp, Homo sapiens
caacttttggctacatgcttagc

SEQ ID NO: 7864765 - DNA, 23 bp, Homo sapiens
caacttttggctacatgcttagc

SEQ ID NO: 7864766 - DNA, 22 bp, Homo sapiens
caactttcacactccacatgct

SEQ ID NO: 7864767 - DNA, 22 bp, Homo sapiens
caactttatgattggtttgtca

SEQ ID NO: 7864768 - DNA, 22 bp, Homo sapiens
caactttctccaagtacaagaa

SEQ ID NO: 7864769 - DNA, 22 bp, Homo sapiens
caactttctccaagtacaagaa

SEQ ID NO: 7864770 - DNA, 22 bp, Homo sapiens
caactttgtgtgacctagatag

SEQ ID NO: 7864771 - DNA, 22 bp, Homo sapiens
caagaaattctgttcagatagc

SEQ ID NO: 7864772 - DNA, 22 bp, Homo sapiens
caagaaacaccaatgactgctg

SEQ ID NO: 7864773 - DNA, 22 bp, Homo sapiens
caagaaatgtttactgagcatc

SEQ ID NO: 7864774 - DNA, 22 bp, Homo sapiens
caagaaatggggaggggagttg

SEQ ID NO: 7864775 - DNA, 22 bp, Homo sapiens
caagaaatgggatttgactgcc

SEQ ID NO: 7864776 - DNA, 22 bp, Homo sapiens
caagaaatgggatttgactgcc

SEQ ID NO: 7864777 - DNA, 22 bp, Homo sapiens
caagaaatgggatttgactgcc

SEQ ID NO: 7864778 - DNA, 22 bp, Homo sapiens
caagaaatgggatttgactgcc

SEQ ID NO: 7864779 - DNA, 22 bp, Homo sapiens
caagaaatctagaagtcagtgg

SEQ ID NO: 7864780 - DNA, 22 bp, Homo sapiens
caagaaatctagaagtcagtgg

SEQ ID NO: 7864781 - DNA, 22 bp, Homo sapiens
caagaaatctagaagtcagtgg

SEQ ID NO: 7864782 - DNA, 22 bp, Homo sapiens
caagaaactttattctgccata

SEQ ID NO: 7864783 - DNA, 22 bp, Homo sapiens
caagaaactttattctgccata

SEQ ID NO: 7864784 - DNA, 22 bp, Homo sapiens
caagaaatctagaagtcagtgg

SEQ ID NO: 7864785 - DNA, 22 bp, Homo sapiens
gctgcctgcacagagctgcttt

SEQ ID NO: 7864786 - DNA, 22 bp, Homo sapiens
gctgcctgcacagagctgcttt

SEQ ID NO: 7864787 - DNA, 22 bp, Homo sapiens
gctgcctgcacagagctgcttt

SEQ ID NO: 7864788 - DNA, 22 bp, Homo sapiens
gctgcctgcacagagctgcttt

SEQ ID NO: 7864789 - DNA, 22 bp, Homo sapiens
gctgcctgcacagagctgcttt

SEQ ID NO: 7864790 - DNA, 17 bp, Homo sapiens
gctgcctgcaactgact

SEQ ID NO: 7864791 - DNA, 17 bp, Homo sapiens
gctgcctgcaactgact

SEQ ID NO: 7864792 - DNA, 22 bp, Homo sapiens
gctgcctgatttacatagtgaa

SEQ ID NO: 7864793 - DNA, 22 bp, Homo sapiens
gctgcctgatttacatagtgaa

SEQ ID NO: 7864794 - DNA, 22 bp, Homo sapiens
gctgcctgatgtccagcaggac

SEQ ID NO: 7864795 - DNA, 22 bp, Homo sapiens
gctgcctgatgtccagcaggac

SEQ ID NO: 7864796 - DNA, 22 bp, Homo sapiens
gctgcctgatgtccagcaggac

SEQ ID NO: 7864797 - DNA, 22 bp, Homo sapiens
gctgcctgatgtccagcaggac

SEQ ID NO: 7864798 - DNA, 22 bp, Homo sapiens
caagaaatttcttaagaactaa

SEQ ID NO: 7864799 - DNA, 22 bp, Homo sapiens
caagaaattctgttcagatagc

SEQ ID NO: 7864800 - DNA, 22 bp, Homo sapiens
caagaaattctgttcagatagc

SEQ ID NO: 7864801 - DNA, 22 bp, Homo sapiens
caagaaattctgttcagatagc

SEQ ID NO: 7864802 - DNA, 22 bp, Homo sapiens
caagaaattctgttcagatagc

SEQ ID NO: 7864803 - DNA, 22 bp, Homo sapiens
caagaacattgtgatcacttca

SEQ ID NO: 7864804 - DNA, 22 bp, Homo sapiens
caagaaccgcaattacttttgc

SEQ ID NO: 7864805 - DNA, 22 bp, Homo sapiens
caagaacagtttgccaaattgg

SEQ ID NO: 7864806 - DNA, 22 bp, Homo sapiens
caagaacagtttgccaaattgg

SEQ ID NO: 7864807 - DNA, 22 bp, Homo sapiens
caagaaatttcttaagaactaa

SEQ ID NO: 7864808 - DNA, 22 bp, Homo sapiens
caaagtatgaaccagtttctct

SEQ ID NO: 7864809 - DNA, 17 bp, Homo sapiens
gctctggcacaggattg

SEQ ID NO: 7864810 - DNA, 22 bp, Homo sapiens
caaagtcagccagctagtaggt

SEQ ID NO: 7864811 - DNA, 17 bp, Homo sapiens
gctctggcacaggattg

SEQ ID NO: 7864812 - DNA, 17 bp, Homo sapiens
gctctggcacaggattg

SEQ ID NO: 7864813 - DNA, 17 bp, Homo sapiens
gctctggcacaggattg

SEQ ID NO: 7864814 - DNA, 23 bp, Homo sapiens
gctctggagctgggcctggcagg

SEQ ID NO: 7864815 - DNA, 23 bp, Homo sapiens
gctctggagctgggcctggcagg

SEQ ID NO: 7864816 - DNA, 22 bp, Homo sapiens
gctctggatccggctgggtctg

SEQ ID NO: 7864817 - DNA, 22 bp, Homo sapiens
gctctggatccggctgggtctg

SEQ ID NO: 7864818 - DNA, 22 bp, Homo sapiens
gctctggatccggctgggtctg

SEQ ID NO: 7864819 - DNA, 18 bp, Homo sapiens
gctctggaggtagcatta

SEQ ID NO: 7864820 - DNA, 22 bp, Homo sapiens
caaagtcataaaacttgtaagt

SEQ ID NO: 7864821 - DNA, 22 bp, Homo sapiens
caaagtcagggaagagtggctg

SEQ ID NO: 7864822 - DNA, 22 bp, Homo sapiens
caaagtcatggggatgcaggtc

SEQ ID NO: 7864823 - DNA, 22 bp, Homo sapiens
caaagtcatggggatgcaggtc

SEQ ID NO: 7864824 - DNA, 22 bp, Homo sapiens
caaagtcttcagttgattctga

SEQ ID NO: 7864825 - DNA, 22 bp, Homo sapiens
caaagtcctagaacagtgcttg

SEQ ID NO: 7864826 - DNA, 22 bp, Homo sapiens
gctctggagcactggaaacact

SEQ ID NO: 7864827 - DNA, 22 bp, Homo sapiens
gctctggagatggagccttgag

SEQ ID NO: 7864828 - DNA, 22 bp, Homo sapiens
gctctggagatggagccttgag

SEQ ID NO: 7864829 - DNA, 22 bp, Homo sapiens
gctctggagatggagccttgag

SEQ ID NO: 7864830 - DNA, 22 bp, Homo sapiens
gctctggagatggagccttgag

SEQ ID NO: 7864831 - DNA, 22 bp, Homo sapiens
gctctggagagccataggccct

SEQ ID NO: 7864832 - DNA, 22 bp, Homo sapiens
gctctggactggggcctgagaa

SEQ ID NO: 7864833 - DNA, 22 bp, Homo sapiens
gctctggaccctggagtggctg

SEQ ID NO: 7864834 - DNA, 22 bp, Homo sapiens
gctctggaccctggagtggctg

SEQ ID NO: 7864835 - DNA, 22 bp, Homo sapiens
gctctggaccctgccagcctta

SEQ ID NO: 7864836 - DNA, 22 bp, Homo sapiens
gctctggactggggcctgagaa

SEQ ID NO: 7864837 - DNA, 22 bp, Homo sapiens
gctctggactggggcctgagaa

SEQ ID NO: 7864838 - DNA, 22 bp, Homo sapiens
gctctggaccctggagtggctg

SEQ ID NO: 7864839 - DNA, 22 bp, Homo sapiens
gctctggactggggcctgagaa

SEQ ID NO: 7864840 - DNA, 22 bp, Homo sapiens
gctctggactggggcctgagaa

SEQ ID NO: 7864841 - DNA, 22 bp, Homo sapiens
gctctgcttgcatcatgactgc

SEQ ID NO: 7864842 - DNA, 22 bp, Homo sapiens
gctctgcttgcatcatgactgc

SEQ ID NO: 7864843 - DNA, 22 bp, Homo sapiens
gctctgcttgcatcatgactgc

SEQ ID NO: 7864844 - DNA, 22 bp, Homo sapiens
gctctgctgtgtttgttcagca

SEQ ID NO: 7864845 - DNA, 22 bp, Homo sapiens
gctctggaagcatctgagagga

SEQ ID NO: 7864846 - DNA, 22 bp, Homo sapiens
gctctggaagcatctgagagga

SEQ ID NO: 7864847 - DNA, 22 bp, Homo sapiens
gctctggaagcatctgagagga

SEQ ID NO: 7864848 - DNA, 22 bp, Homo sapiens
gctctggaacctgccaggatgc

SEQ ID NO: 7864849 - DNA, 22 bp, Homo sapiens
gctctggaacctgccaggatgc

SEQ ID NO: 7864850 - DNA, 22 bp, Homo sapiens
gctctggaagcatctgagagga

SEQ ID NO: 7864851 - DNA, 22 bp, Homo sapiens
gctctggaagcatctgagagga

SEQ ID NO: 7864852 - DNA, 22 bp, Homo sapiens
gctctggaagcatctgagagga

SEQ ID NO: 7864853 - DNA, 22 bp, Homo sapiens
gctctggaagcatctgagagga

SEQ ID NO: 7864854 - DNA, 22 bp, Homo sapiens
gctctggaccctgccagcctta

SEQ ID NO: 7864855 - DNA, 22 bp, Homo sapiens
caaagtgctaggattacaggcc

SEQ ID NO: 7864856 - DNA, 22 bp, Homo sapiens
caaagtgctaggattacaggcg

SEQ ID NO: 7864857 - DNA, 22 bp, Homo sapiens
caaagtgctaggattacaggcc

SEQ ID NO: 7864858 - DNA, 22 bp, Homo sapiens
caaagtgcctgtaccactttgc

SEQ ID NO: 7864859 - DNA, 22 bp, Homo sapiens
caaagtgagagaatggcagaaa

SEQ ID NO: 7864860 - DNA, 22 bp, Homo sapiens
caaagtgagagaatggcagaaa

SEQ ID NO: 7864861 - DNA, 22 bp, Homo sapiens
caaagtgagagaatggcagaaa

SEQ ID NO: 7864862 - DNA, 22 bp, Homo sapiens
caaagtgagagaatggcagaaa

SEQ ID NO: 7864863 - DNA, 22 bp, Homo sapiens
caaagtgagttataaacatctt

SEQ ID NO: 7864864 - DNA, 22 bp, Homo sapiens
caaagtgcagaaggaactgggt

SEQ ID NO: 7864865 - DNA, 22 bp, Homo sapiens
caaagtgagttataaacatctt

SEQ ID NO: 7864866 - DNA, 22 bp, Homo sapiens
caaagtgagttataaacatctt

SEQ ID NO: 7864867 - DNA, 22 bp, Homo sapiens
gctgccacgatctctgctgtag

SEQ ID NO: 7864868 - DNA, 22 bp, Homo sapiens
gctgccacgaggtttccttatc

SEQ ID NO: 7864869 - DNA, 17 bp, Homo sapiens
gctgccacctttggagc

SEQ ID NO: 7864870 - DNA, 22 bp, Homo sapiens
caaagtgctaggattataggtg

SEQ ID NO: 7864871 - DNA, 22 bp, Homo sapiens
caaagtgctaggattacaggcg

SEQ ID NO: 7864872 - DNA, 22 bp, Homo sapiens
gctgccacgatctctgctgtag

SEQ ID NO: 7864873 - DNA, 22 bp, Homo sapiens
gctgccctccagttcccacagt

SEQ ID NO: 7864874 - DNA, 22 bp, Homo sapiens
gctgccctccagttcccacagt

SEQ ID NO: 7864875 - DNA, 18 bp, Homo sapiens
gctgccctagctcccctc

SEQ ID NO: 7864876 - DNA, 22 bp, Homo sapiens
gctgccctccagttcccacagt

SEQ ID NO: 7864877 - DNA, 22 bp, Homo sapiens
gctgccctccagttcccacagt

SEQ ID NO: 7864878 - DNA, 22 bp, Homo sapiens
gctgccctgtccggctctcctg

SEQ ID NO: 7864879 - DNA, 21 bp, Homo sapiens
gctgccctggctcagcattca

SEQ ID NO: 7864880 - DNA, 21 bp, Homo sapiens
gctgccctggctcagcattca

SEQ ID NO: 7864881 - DNA, 21 bp, Homo sapiens
gctgccctggctcagcattca

SEQ ID NO: 7864882 - DNA, 22 bp, Homo sapiens
gctgccctgcctcagactcctc

SEQ ID NO: 7864883 - DNA, 22 bp, Homo sapiens
gctgccctgcctcagactcctc

SEQ ID NO: 7864884 - DNA, 22 bp, Homo sapiens
gctgccctgcctcagactcctc

SEQ ID NO: 7864885 - DNA, 22 bp, Homo sapiens
gctgccctgcatctgtgccttc

SEQ ID NO: 7864886 - DNA, 22 bp, Homo sapiens
gctgccctgcctcagactcctc

SEQ ID NO: 7864887 - DNA, 22 bp, Homo sapiens
gctgccctgcatctgtgccttc

SEQ ID NO: 7864888 - DNA, 22 bp, Homo sapiens
gctgccctgactccagcagcct

SEQ ID NO: 7864889 - DNA, 22 bp, Homo sapiens
gctgccctgactccagcagcct

SEQ ID NO: 7864890 - DNA, 22 bp, Homo sapiens
gctgccctgactccagcagcct

SEQ ID NO: 7864891 - DNA, 22 bp, Homo sapiens
gctgccctgactccagcagcct

SEQ ID NO: 7864892 - DNA, 22 bp, Homo sapiens
gctgccctgactccagcagcct

SEQ ID NO: 7864893 - DNA, 22 bp, Homo sapiens
gctgccctgactccagcagcct

SEQ ID NO: 7864894 - DNA, 22 bp, Homo sapiens
gctgccctgacaagctactccc

SEQ ID NO: 7864895 - DNA, 22 bp, Homo sapiens
gctgccctgacaagctactccc

SEQ ID NO: 7864896 - DNA, 22 bp, Homo sapiens
gctgccctgacaagctactccc

SEQ ID NO: 7864897 - DNA, 22 bp, Homo sapiens
gctgccctctgtgtttgtcctt

SEQ ID NO: 7864898 - DNA, 22 bp, Homo sapiens
gctgccctctgtgtttgtcctt

SEQ ID NO: 7864899 - DNA, 22 bp, Homo sapiens
gctgccctgacaagctactccc

SEQ ID NO: 7864900 - DNA, 22 bp, Homo sapiens
gctgccctgactccagcagcct

SEQ ID NO: 7864901 - DNA, 22 bp, Homo sapiens
gctgccctgacaagctactccc

SEQ ID NO: 7864902 - DNA, 22 bp, Homo sapiens
gctgccctctgtgacccggccc

SEQ ID NO: 7864903 - DNA, 22 bp, Homo sapiens
gctgccctctctggccccacac

SEQ ID NO: 7864904 - DNA, 22 bp, Homo sapiens
gctgccctctgtgacccggccc

SEQ ID NO: 7864905 - DNA, 22 bp, Homo sapiens
gctgccctctctggccccacac

SEQ ID NO: 7864906 - DNA, 22 bp, Homo sapiens
gctgccctcccagggcaagctt

SEQ ID NO: 7864907 - DNA, 22 bp, Homo sapiens
gtacacatatttccaagggtaa

SEQ ID NO: 7864908 - DNA, 22 bp, Homo sapiens
gtacacatatattaaaaattgt

SEQ ID NO: 7864909 - DNA, 22 bp, Homo sapiens
gtacacatatattaaaaattgt

SEQ ID NO: 7864910 - DNA, 23 bp, Homo sapiens
gtacacatagtgtagttatattt

SEQ ID NO: 7864911 - DNA, 23 bp, Homo sapiens
gtacacatagtgtagttatattt

SEQ ID NO: 7864912 - DNA, 20 bp, Homo sapiens
gtacacatatatgtatgtgt

SEQ ID NO: 7864913 - DNA, 20 bp, Homo sapiens
gtacacatatatgtatgtgt

SEQ ID NO: 7864914 - DNA, 22 bp, Homo sapiens
gtacacattgtctgtttacttc

SEQ ID NO: 7864915 - DNA, 22 bp, Homo sapiens
gtacacattgtctgtttacttc

SEQ ID NO: 7864916 - DNA, 22 bp, Homo sapiens
gtacacattgtctgtttacttc

SEQ ID NO: 7864917 - DNA, 22 bp, Homo sapiens
gtacacattatgcttctctaaa

SEQ ID NO: 7864918 - DNA, 22 bp, Homo sapiens
gtacacattatgcttctctaaa

SEQ ID NO: 7864919 - DNA, 22 bp, Homo sapiens
gtacactccccctgtgaagttg

SEQ ID NO: 7864920 - DNA, 22 bp, Homo sapiens
gtacactccccctgtgaagttg

SEQ ID NO: 7864921 - DNA, 22 bp, Homo sapiens
gtacactgggtaagggactcct

SEQ ID NO: 7864922 - DNA, 20 bp, Homo sapiens
gtacacttcatgtttcacct

SEQ ID NO: 7864923 - DNA, 22 bp, Homo sapiens
gtacacttgtcttgaacagcct

SEQ ID NO: 7864924 - DNA, 22 bp, Homo sapiens
gtacacttgactcataggaaat

SEQ ID NO: 7864925 - DNA, 20 bp, Homo sapiens
gtacacttcatgtttcacct

SEQ ID NO: 7864926 - DNA, 22 bp, Homo sapiens
gtactaaacagagaaccaatat

SEQ ID NO: 7864927 - DNA, 22 bp, Homo sapiens
gtactaagtcaggagaagaatt

SEQ ID NO: 7864928 - DNA, 22 bp, Homo sapiens
gtactacaatgttcacaacatt

SEQ ID NO: 7864929 - DNA, 22 bp, Homo sapiens
gtactaaaaaatgatcagtttg

SEQ ID NO: 7864930 - DNA, 22 bp, Homo sapiens
gtactacagtttctcattaaat

SEQ ID NO: 7864931 - DNA, 22 bp, Homo sapiens
gtactagagatgtgtgcgggta

SEQ ID NO: 7864932 - DNA, 22 bp, Homo sapiens
gtactgctgtaaatattcttca

SEQ ID NO: 7864933 - DNA, 22 bp, Homo sapiens
gtactgaataacaaagtctgtc

SEQ ID NO: 7864934 - DNA, 22 bp, Homo sapiens
gtactgaataacaaagtctgtc

SEQ ID NO: 7864935 - DNA, 22 bp, Homo sapiens
gtactgaacttaaaaatcccct

SEQ ID NO: 7864936 - DNA, 22 bp, Homo sapiens
gtactgaaaagttttctaatct

SEQ ID NO: 7864937 - DNA, 22 bp, Homo sapiens
gtactgaaaagttttctaatct

SEQ ID NO: 7864938 - DNA, 22 bp, Homo sapiens
gtacacataggttactgattaa

SEQ ID NO: 7864939 - DNA, 22 bp, Homo sapiens
gtacacatactattcaaagaga

SEQ ID NO: 7864940 - DNA, 22 bp, Homo sapiens
gtacacataggttactgattaa

SEQ ID NO: 7864941 - DNA, 23 bp, Homo sapiens
gtacacatagtgtagttatattt

SEQ ID NO: 7864942 - DNA, 23 bp, Homo sapiens
gtacacatagtgtagttatattt

SEQ ID NO: 7864943 - DNA, 22 bp, Homo sapiens
gtacacaggcagcccagtgctg

SEQ ID NO: 7864944 - DNA, 22 bp, Homo sapiens
gtacacatactattcaaagaga

SEQ ID NO: 7864945 - DNA, 22 bp, Homo sapiens
gtacacatactattcaaagaga

SEQ ID NO: 7864946 - DNA, 22 bp, Homo sapiens
gtacacagatgcttgagaatct

SEQ ID NO: 7864947 - DNA, 22 bp, Homo sapiens
gtacacagatgcttgagaatct

SEQ ID NO: 7864948 - DNA, 22 bp, Homo sapiens
gtacacagatgcttgagaatct

SEQ ID NO: 7864949 - DNA, 22 bp, Homo sapiens
gtacacagatgcttgagaatct

SEQ ID NO: 7864950 - DNA, 22 bp, Homo sapiens
gtacacactgtttgatcatttc

SEQ ID NO: 7864951 - DNA, 22 bp, Homo sapiens
gtacacagagtggtggaagaaa

SEQ ID NO: 7864952 - DNA, 22 bp, Homo sapiens
cagcagcctagaagctctacca

SEQ ID NO: 7864953 - DNA, 22 bp, Homo sapiens
cagcagcctagaagctctacca

SEQ ID NO: 7864954 - DNA, 22 bp, Homo sapiens
cagcagcctagaagctctacca

SEQ ID NO: 7864955 - DNA, 22 bp, Homo sapiens
cagcagcctagaagctctacca

SEQ ID NO: 7864956 - DNA, 22 bp, Homo sapiens
cagcagcctagggttccatcat

SEQ ID NO: 7864957 - DNA, 22 bp, Homo sapiens
cagcagcctagaagctctacca

SEQ ID NO: 7864958 - DNA, 22 bp, Homo sapiens
cagcagcctagggttccatcat

SEQ ID NO: 7864959 - DNA, 22 bp, Homo sapiens
gtacacactgtttgatcatttc

SEQ ID NO: 7864960 - DNA, 22 bp, Homo sapiens
gtacacactgtttgatcatttc

SEQ ID NO: 7864961 - DNA, 22 bp, Homo sapiens
gtacacactatttaaagtgttt

SEQ ID NO: 7864962 - DNA, 22 bp, Homo sapiens
gtacacactgtttgatcatttc

SEQ ID NO: 7864963 - DNA, 22 bp, Homo sapiens
gtacacactatttaaagtgttt

SEQ ID NO: 7864964 - DNA, 22 bp, Homo sapiens
gtacacactatgtattgtacac

SEQ ID NO: 7864965 - DNA, 22 bp, Homo sapiens
gtacacactatttaaagtgttt

SEQ ID NO: 7864966 - DNA, 22 bp, Homo sapiens
gtacacactatgtattgtacac

SEQ ID NO: 7864967 - DNA, 22 bp, Homo sapiens
gtacttctttagtcaatatgta

SEQ ID NO: 7864968 - DNA, 22 bp, Homo sapiens
gtacttcttaaattaggatcaa

SEQ ID NO: 7864969 - DNA, 22 bp, Homo sapiens
gtacttctggccaggctggcca

SEQ ID NO: 7864970 - DNA, 22 bp, Homo sapiens
gtacttctcaaactagaaacta

SEQ ID NO: 7864971 - DNA, 22 bp, Homo sapiens
gtactgttggatgttgcagttt

SEQ ID NO: 7864972 - DNA, 21 bp, Homo sapiens
gtacttaagaaactctatgac

SEQ ID NO: 7864973 - DNA, 22 bp, Homo sapiens
gtactgtgctagttgatgggag

SEQ ID NO: 7864974 - DNA, 22 bp, Homo sapiens
gtactttaaatcaatgtagatt

SEQ ID NO: 7864975 - DNA, 22 bp, Homo sapiens
gtactttaaatcaatgtagatt

SEQ ID NO: 7864976 - DNA, 22 bp, Homo sapiens
gtagaaaattaggatgaggctt

SEQ ID NO: 7864977 - DNA, 22 bp, Homo sapiens
gtagaaaattaggatgaggctt

SEQ ID NO: 7864978 - DNA, 22 bp, Homo sapiens
gtagaaaattaggatgaggctt

SEQ ID NO: 7864979 - DNA, 22 bp, Homo sapiens
gtagaaatagtggttgacagga

SEQ ID NO: 7864980 - DNA, 22 bp, Homo sapiens
gtagaaatagtggttgacagga

SEQ ID NO: 7864981 - DNA, 22 bp, Homo sapiens
gtagaaatagtggttgacagga

SEQ ID NO: 7864982 - DNA, 22 bp, Homo sapiens
gtagaaatatttatctctgaga

SEQ ID NO: 7864983 - DNA, 22 bp, Homo sapiens
gtagaaatagtggttgacagga

SEQ ID NO: 7864984 - DNA, 22 bp, Homo sapiens
gtagaaatagtggttgacagga

SEQ ID NO: 7864985 - DNA, 22 bp, Homo sapiens
gtactttagagtaaaatagacc

SEQ ID NO: 7864986 - DNA, 22 bp, Homo sapiens
gtagaaaaagcagtaagtctca

SEQ ID NO: 7864987 - DNA, 22 bp, Homo sapiens
gtagaaaaagcagtaagtctca

SEQ ID NO: 7864988 - DNA, 22 bp, Homo sapiens
gtagaaaaagcagtaagtctca

SEQ ID NO: 7864989 - DNA, 22 bp, Homo sapiens
gtagaaaaagcagtaagtctca

SEQ ID NO: 7864990 - DNA, 22 bp, Homo sapiens
gtagaaaaagcagtaagtctca

SEQ ID NO: 7864991 - DNA, 22 bp, Homo sapiens
gtaggcagtggttggaagagaa

SEQ ID NO: 7864992 - DNA, 22 bp, Homo sapiens
gtaggcagtggttggaagagaa

SEQ ID NO: 7864993 - DNA, 22 bp, Homo sapiens
gtaggccagtgtgaaacctggt

SEQ ID NO: 7864994 - DNA, 22 bp, Homo sapiens
gtaggccagtgtgaaacctggt

SEQ ID NO: 7864995 - DNA, 22 bp, Homo sapiens
gtaggctgtgtgaggctagaga

SEQ ID NO: 7864996 - DNA, 22 bp, Homo sapiens
gtaggctgtgtgaggctagaga

SEQ ID NO: 7864997 - DNA, 22 bp, Homo sapiens
gtaggccatggtggttgtctct

SEQ ID NO: 7864998 - DNA, 22 bp, Homo sapiens
gtaggcagtggttggaagagaa

SEQ ID NO: 7864999 - DNA, 22 bp, Homo sapiens
gtaggcagtctctcaggtgatc

SEQ ID NO: 7865000 - DNA, 22 bp, Homo sapiens
gtaggcagtgcttgattttcca

SEQ ID NO: 7865001 - DNA, 22 bp, Homo sapiens
gtaggcagtgcttgattttcca

SEQ ID NO: 7865002 - DNA, 22 bp, Homo sapiens
gtaggcaggtggaggagtgaag

SEQ ID NO: 7865003 - DNA, 22 bp, Homo sapiens
gtaggcagtctctcaggtgatc

SEQ ID NO: 7865004 - DNA, 22 bp, Homo sapiens
gtaggcagggctgtggggagaa

SEQ ID NO: 7865005 - DNA, 22 bp, Homo sapiens
gtaggcaggtggaggagtgaag

SEQ ID NO: 7865006 - DNA, 22 bp, Homo sapiens
gtaggcagggctgtggggagaa

SEQ ID NO: 7865007 - DNA, 22 bp, Homo sapiens
gtaggcagggctgtggggagaa

SEQ ID NO: 7865008 - DNA, 22 bp, Homo sapiens
gtagaaatatttatctctgaga

SEQ ID NO: 7865009 - DNA, 22 bp, Homo sapiens
cagcagcctacaatgcacagaa

SEQ ID NO: 7865010 - DNA, 22 bp, Homo sapiens
cagcagcctacaatgcacagaa

SEQ ID NO: 7865011 - DNA, 22 bp, Homo sapiens
cagcagcctagaagctctacca

SEQ ID NO: 7865012 - DNA, 22 bp, Homo sapiens
cagcagcctacaatgcacagaa

SEQ ID NO: 7865013 - DNA, 22 bp, Homo sapiens
cagcagcctacaatgcacagaa

SEQ ID NO: 7865014 - DNA, 22 bp, Homo sapiens
cagcagcctacaatgcacagaa

SEQ ID NO: 7865015 - DNA, 22 bp, Homo sapiens
cagcagccgagagggggctctg

SEQ ID NO: 7865016 - DNA, 22 bp, Homo sapiens
cagcagccgagagggggctctg

SEQ ID NO: 7865017 - DNA, 22 bp, Homo sapiens
cagcagccgagagggggctctg

SEQ ID NO: 7865018 - DNA, 22 bp, Homo sapiens
cagcagccgagagggggctctg

SEQ ID NO: 7865019 - DNA, 22 bp, Homo sapiens
cagcagccctttggctgaactg

SEQ ID NO: 7865020 - DNA, 22 bp, Homo sapiens
cagcagccctttggctgaactg

SEQ ID NO: 7865021 - DNA, 22 bp, Homo sapiens
cagcagccgagagggggctctg

SEQ ID NO: 7865022 - DNA, 22 bp, Homo sapiens
cagcagcccacgcgtgctgtcc

SEQ ID NO: 7865023 - DNA, 22 bp, Homo sapiens
cagcagcccacgcgtgctgtcc

SEQ ID NO: 7865024 - DNA, 22 bp, Homo sapiens
cagcagcccacgcgtgctgtcc

SEQ ID NO: 7865025 - DNA, 20 bp, Homo sapiens
cagcagccattctagtagta

SEQ ID NO: 7865026 - DNA, 20 bp, Homo sapiens
cagcagccattctagtagta

SEQ ID NO: 7865027 - DNA, 20 bp, Homo sapiens
cagcagccattctagtagta

SEQ ID NO: 7865028 - DNA, 22 bp, Homo sapiens
cagcagcccacgcgtgctgtcc

SEQ ID NO: 7865029 - DNA, 22 bp, Homo sapiens
cagcagcccacgcgtgctgtcc

SEQ ID NO: 7865030 - DNA, 20 bp, Homo sapiens
cagcagccattctagtagta

SEQ ID NO: 7865031 - DNA, 22 bp, Homo sapiens
cagcagccatgtaccacactca

SEQ ID NO: 7865032 - DNA, 22 bp, Homo sapiens
cagcagccactagagggctcac

SEQ ID NO: 7865033 - DNA, 22 bp, Homo sapiens
cagcagccactagagggctcac

SEQ ID NO: 7865034 - DNA, 22 bp, Homo sapiens
cagcagccatgtaccacactca

SEQ ID NO: 7865035 - DNA, 19 bp, Homo sapiens
cagcagccagggggcccct

SEQ ID NO: 7865036 - DNA, 19 bp, Homo sapiens
cagcagccagggggcccct

SEQ ID NO: 7865037 - DNA, 19 bp, Homo sapiens
cagcagccagggggcccct

SEQ ID NO: 7865038 - DNA, 22 bp, Homo sapiens
cagcaaaggggatgcgtcctaa

SEQ ID NO: 7865039 - DNA, 22 bp, Homo sapiens
cagcaaaggggatgcgtcctaa

SEQ ID NO: 7865040 - DNA, 22 bp, Homo sapiens
cagcaaaggggatgcgtcctaa

SEQ ID NO: 7865041 - DNA, 22 bp, Homo sapiens
cagcaaaggggatgcgtcctaa

SEQ ID NO: 7865042 - DNA, 22 bp, Homo sapiens
cagcaaagcttaatttatatct

SEQ ID NO: 7865043 - DNA, 22 bp, Homo sapiens
cagcaaagcttgttccttcctg

SEQ ID NO: 7865044 - DNA, 22 bp, Homo sapiens
cagcaaagcttaatttatatct

SEQ ID NO: 7865045 - DNA, 22 bp, Homo sapiens
cagcaaagcttgttccttcctg

SEQ ID NO: 7865046 - DNA, 22 bp, Homo sapiens
cagcaaagcttaatttatatct

SEQ ID NO: 7865047 - DNA, 22 bp, Homo sapiens
cagcaaagcttaatttatatct

SEQ ID NO: 7865048 - DNA, 20 bp, Homo sapiens
cagcaaaatgaaaatggatt

SEQ ID NO: 7865049 - DNA, 22 bp, Homo sapiens
cagcaaaatttgaggattgcct

SEQ ID NO: 7865050 - DNA, 22 bp, Homo sapiens
cagcaaaatttgaggattgcct

SEQ ID NO: 7865051 - DNA, 22 bp, Homo sapiens
cagcaaaatttgaggattgcct

SEQ ID NO: 7865052 - DNA, 22 bp, Homo sapiens
cagcaaaatttgaggattgcct

SEQ ID NO: 7865053 - DNA, 19 bp, Homo sapiens
cagcaaacactgtaaatgg

SEQ ID NO: 7865054 - DNA, 19 bp, Homo sapiens
cagcaaacactgtaaatgg

SEQ ID NO: 7865055 - DNA, 22 bp, Homo sapiens
cagcaaagcaggctcctagaac

SEQ ID NO: 7865056 - DNA, 22 bp, Homo sapiens
cagcaaagcaggctcctagaac

SEQ ID NO: 7865057 - DNA, 22 bp, Homo sapiens
cagcaaagcaggctcctagaac

SEQ ID NO: 7865058 - DNA, 22 bp, Homo sapiens
cagcaaagcaggctcctagaac

SEQ ID NO: 7865059 - DNA, 22 bp, Homo sapiens
cagcaaagcaggctcctagaac

SEQ ID NO: 7865060 - DNA, 22 bp, Homo sapiens
cagcagcagccccaggaaggtt

SEQ ID NO: 7865061 - DNA, 22 bp, Homo sapiens
cagcagcagccccaggaaggtt

SEQ ID NO: 7865062 - DNA, 22 bp, Homo sapiens
cagcagcagccccaggaaggtt

SEQ ID NO: 7865063 - DNA, 22 bp, Homo sapiens
cagcagccactagagggctcac

SEQ ID NO: 7865064 - DNA, 20 bp, Homo sapiens
cagcagccaaacttctattc

SEQ ID NO: 7865065 - DNA, 22 bp, Homo sapiens
cagcagccactagagggctcac

SEQ ID NO: 7865066 - DNA, 22 bp, Homo sapiens
cagcagccactagagggctcac

SEQ ID NO: 7865067 - DNA, 22 bp, Homo sapiens
cagcagccactagagggctcac

SEQ ID NO: 7865068 - DNA, 22 bp, Homo sapiens
cagcaaaggtagaagcacagga

SEQ ID NO: 7865069 - DNA, 22 bp, Homo sapiens
cagcaaaggtagaagcacagga

SEQ ID NO: 7865070 - DNA, 22 bp, Homo sapiens
cagcaaaggtagaagcacagga

SEQ ID NO: 7865071 - DNA, 22 bp, Homo sapiens
cagcaaaggtagaagcacagga

SEQ ID NO: 7865072 - DNA, 22 bp, Homo sapiens
cagcaaaggtagaagcacagga

SEQ ID NO: 7865073 - DNA, 22 bp, Homo sapiens
cagcagcagattcagcgtctgg

SEQ ID NO: 7865074 - DNA, 22 bp, Homo sapiens
cagcagcagattcagcgtctgg

SEQ ID NO: 7865075 - DNA, 22 bp, Homo sapiens
cagcagcagattcagcgtctgg

SEQ ID NO: 7865076 - DNA, 22 bp, Homo sapiens
cagcagcagattcagcgtctgg

SEQ ID NO: 7865077 - DNA, 22 bp, Homo sapiens
cagcagcagccccaggaaggtt

SEQ ID NO: 7865078 - DNA, 22 bp, Homo sapiens
cagatttaagatatttgtattg

SEQ ID NO: 7865079 - DNA, 22 bp, Homo sapiens
cagatttaggtcactagaattt

SEQ ID NO: 7865080 - DNA, 22 bp, Homo sapiens
cagatttaggcttagtccaagc

SEQ ID NO: 7865081 - DNA, 22 bp, Homo sapiens
cagatttaggcttagtccaagc

SEQ ID NO: 7865082 - DNA, 22 bp, Homo sapiens
cagatttaggtcactagaattt

SEQ ID NO: 7865083 - DNA, 22 bp, Homo sapiens
cagatttcagctcatatattat

SEQ ID NO: 7865084 - DNA, 22 bp, Homo sapiens
cagatttatgcaaaaaggaaga

SEQ ID NO: 7865085 - DNA, 22 bp, Homo sapiens
cagatttatgcaaaaaggaaga

SEQ ID NO: 7865086 - DNA, 22 bp, Homo sapiens
cagatttatgcaaaaaggaaga

SEQ ID NO: 7865087 - DNA, 22 bp, Homo sapiens
cagatttatgcaaaaaggaaga

SEQ ID NO: 7865088 - DNA, 22 bp, Homo sapiens
cagatttattttacatccttca

SEQ ID NO: 7865089 - DNA, 22 bp, Homo sapiens
cagatttcaaggaggcactcca

SEQ ID NO: 7865090 - DNA, 20 bp, Homo sapiens
cagcaaaatgaaaatggatt

SEQ ID NO: 7865091 - DNA, 20 bp, Homo sapiens
cagcaaaatgaaaatggatt

SEQ ID NO: 7865092 - DNA, 20 bp, Homo sapiens
cagcaaaatgaaaatggatt

SEQ ID NO: 7865093 - DNA, 20 bp, Homo sapiens
cagcaaaatgaaaatggatt

SEQ ID NO: 7865094 - DNA, 22 bp, Homo sapiens
cagcaaaagccagcataagctc

SEQ ID NO: 7865095 - DNA, 22 bp, Homo sapiens
cagcaaaagccagcataagctc

SEQ ID NO: 7865096 - DNA, 22 bp, Homo sapiens
cagcaaaagccagcataagctc

SEQ ID NO: 7865097 - DNA, 22 bp, Homo sapiens
cagcaaaagccagcataagctc

SEQ ID NO: 7865098 - DNA, 22 bp, Homo sapiens
cagattttgatgaatgtggaaa

SEQ ID NO: 7865099 - DNA, 22 bp, Homo sapiens
cagatttggggtctcctgttag

SEQ ID NO: 7865100 - DNA, 22 bp, Homo sapiens
cagatttctttagcaagctaag

SEQ ID NO: 7865101 - DNA, 22 bp, Homo sapiens
cagatttgccacttactcgttg

SEQ ID NO: 7865102 - DNA, 22 bp, Homo sapiens
cagcaaaacagccgttgcctgg

SEQ ID NO: 7865103 - DNA, 22 bp, Homo sapiens
cagcaaaagccagcataagctc

SEQ ID NO: 7865104 - DNA, 22 bp, Homo sapiens
cagcaaaacagccgttgcctgg

SEQ ID NO: 7865105 - DNA, 22 bp, Homo sapiens
cagcaaaacagccgttgcctgg

SEQ ID NO: 7865106 - DNA, 22 bp, Homo sapiens
cagattcttcattgccccattc

SEQ ID NO: 7865107 - DNA, 22 bp, Homo sapiens
cagattcttcattgccccattc

SEQ ID NO: 7865108 - DNA, 22 bp, Homo sapiens
cagattcttcattcattctaca

SEQ ID NO: 7865109 - DNA, 22 bp, Homo sapiens
cagattcttctgtatttttgct

SEQ ID NO: 7865110 - DNA, 22 bp, Homo sapiens
cagattcttctgtatttttgct

SEQ ID NO: 7865111 - DNA, 22 bp, Homo sapiens
cagatttaagagataaacagtg

SEQ ID NO: 7865112 - DNA, 22 bp, Homo sapiens
cagattggattaaatagctgcc

SEQ ID NO: 7865113 - DNA, 22 bp, Homo sapiens
cagattctccaggggctgcaga

SEQ ID NO: 7865114 - DNA, 22 bp, Homo sapiens
cagattctccaggggctgcaga

SEQ ID NO: 7865115 - DNA, 22 bp, Homo sapiens
cagattctgaagtctagctgct

SEQ ID NO: 7865116 - DNA, 22 bp, Homo sapiens
cagattctgcagtcaacttgct

SEQ ID NO: 7865117 - DNA, 22 bp, Homo sapiens
cagattctgcagtcaacttgct

SEQ ID NO: 7865118 - DNA, 22 bp, Homo sapiens
cagattctgggcccagcttgtc

SEQ ID NO: 7865119 - DNA, 22 bp, Homo sapiens
cagattcttaatttatgggatt

SEQ ID NO: 7865120 - DNA, 22 bp, Homo sapiens
cagattcttcattcattctaca

SEQ ID NO: 7865121 - DNA, 22 bp, Homo sapiens
cagattcttcattcattctaca

SEQ ID NO: 7865122 - DNA, 22 bp, Homo sapiens
cagattctcactgtattcaggt

SEQ ID NO: 7865123 - DNA, 22 bp, Homo sapiens
cagattctcactgtattcaggt

SEQ ID NO: 7865124 - DNA, 22 bp, Homo sapiens
cagattctccaggggctgcaga

SEQ ID NO: 7865125 - DNA, 22 bp, Homo sapiens
cagattctcactgtattcaggt

SEQ ID NO: 7865126 - DNA, 20 bp, Homo sapiens
cagattctccactaacatat

SEQ ID NO: 7865127 - DNA, 22 bp, Homo sapiens
cagattagttgtgctatggcct

SEQ ID NO: 7865128 - DNA, 22 bp, Homo sapiens
cagattactttgtagcagtcag

SEQ ID NO: 7865129 - DNA, 22 bp, Homo sapiens
cagattaagtgctcaacagtgt

SEQ ID NO: 7865130 - DNA, 22 bp, Homo sapiens
cagattaagtgctcaacagtgt

SEQ ID NO: 7865131 - DNA, 22 bp, Homo sapiens
cagcatctcacttcccagaagg

SEQ ID NO: 7865132 - DNA, 22 bp, Homo sapiens
cagcatctcacttcccagaagg

SEQ ID NO: 7865133 - DNA, 20 bp, Homo sapiens
cagcatctagtgagatttgc

SEQ ID NO: 7865134 - DNA, 22 bp, Homo sapiens
cagcatctaatcttcatgccgg

SEQ ID NO: 7865135 - DNA, 22 bp, Homo sapiens
cagcatctcacttcccagaagg

SEQ ID NO: 7865136 - DNA, 22 bp, Homo sapiens
cagcatctcattcattcatgtt

SEQ ID NO: 7865137 - DNA, 22 bp, Homo sapiens
cagcatctcattcattcatgtt

SEQ ID NO: 7865138 - DNA, 22 bp, Homo sapiens
cagcatctcattcattcatgtt

SEQ ID NO: 7865139 - DNA, 22 bp, Homo sapiens
cagcatctcatttgacttctgc

SEQ ID NO: 7865140 - DNA, 22 bp, Homo sapiens
cagcatctcatttgacttctgc

SEQ ID NO: 7865141 - DNA, 22 bp, Homo sapiens
cagcatctcccaggcatttgcc

SEQ ID NO: 7865142 - DNA, 22 bp, Homo sapiens
cagcatctcctgtgcagaggga

SEQ ID NO: 7865143 - DNA, 22 bp, Homo sapiens
cagcatctcctgtgcagaggga

SEQ ID NO: 7865144 - DNA, 22 bp, Homo sapiens
cagcatctccatggctttggag

SEQ ID NO: 7865145 - DNA, 22 bp, Homo sapiens
cagcatctccatggctttggag

SEQ ID NO: 7865146 - DNA, 22 bp, Homo sapiens
cagcatctcccaggcatttgcc

SEQ ID NO: 7865147 - DNA, 22 bp, Homo sapiens
cagcatctccatggctttggag

SEQ ID NO: 7865148 - DNA, 22 bp, Homo sapiens
cagcatcctttgctggtttccc

SEQ ID NO: 7865149 - DNA, 22 bp, Homo sapiens
cagcatctaatcttcatgccgg

SEQ ID NO: 7865150 - DNA, 22 bp, Homo sapiens
cagcatcgtgtggaaagtggta

SEQ ID NO: 7865151 - DNA, 22 bp, Homo sapiens
cagcatctaatcttcatgccgg

SEQ ID NO: 7865152 - DNA, 22 bp, Homo sapiens
cagcatccctcaggggcctctg

SEQ ID NO: 7865153 - DNA, 22 bp, Homo sapiens
cagcatccctcaggggcctctg

SEQ ID NO: 7865154 - DNA, 22 bp, Homo sapiens
cagcatccgttctcaggactga

SEQ ID NO: 7865155 - DNA, 22 bp, Homo sapiens
cagcatccgttctcaggactga

SEQ ID NO: 7865156 - DNA, 22 bp, Homo sapiens
gtcagcatagttcacacacagt

SEQ ID NO: 7865157 - DNA, 22 bp, Homo sapiens
cagcagtgtctccagcatcaca

SEQ ID NO: 7865158 - DNA, 22 bp, Homo sapiens
cagcagtgtctccagcatcaca

SEQ ID NO: 7865159 - DNA, 22 bp, Homo sapiens
cagcatcccagagcccagagct

SEQ ID NO: 7865160 - DNA, 22 bp, Homo sapiens
cagcatccctcaggggcctctg

SEQ ID NO: 7865161 - DNA, 22 bp, Homo sapiens
cagcatcccagagcccagagct

SEQ ID NO: 7865162 - DNA, 22 bp, Homo sapiens
gtcagcaatagttagtttacaa

SEQ ID NO: 7865163 - DNA, 22 bp, Homo sapiens
gtcagatgtttgcgtagggtat

SEQ ID NO: 7865164 - DNA, 22 bp, Homo sapiens
gtcagatgatacactgttgtca

SEQ ID NO: 7865165 - DNA, 22 bp, Homo sapiens
gtcagatgatacactgttgtca

SEQ ID NO: 7865166 - DNA, 22 bp, Homo sapiens
gtcagcaaaaaatttatgtgag

SEQ ID NO: 7865167 - DNA, 22 bp, Homo sapiens
gtcagcaatagttagtttacaa

SEQ ID NO: 7865168 - DNA, 22 bp, Homo sapiens
gtcagcaattcaagagctctta

SEQ ID NO: 7865169 - DNA, 19 bp, Homo sapiens
gtcagcaccatggacaggg

SEQ ID NO: 7865170 - DNA, 22 bp, Homo sapiens
gtcagcacctctttggggagct

SEQ ID NO: 7865171 - DNA, 22 bp, Homo sapiens
gtcagcacttttccgaggcaga

SEQ ID NO: 7865172 - DNA, 22 bp, Homo sapiens
gtcagcagcatgtttaatcaaa

SEQ ID NO: 7865173 - DNA, 21 bp, Homo sapiens
gtcagcagatccagcacttgt

SEQ ID NO: 7865174 - DNA, 21 bp, Homo sapiens
gtcagcagatccagcacttgt

SEQ ID NO: 7865175 - DNA, 17 bp, Homo sapiens
gtcagcagcttgcttgt

SEQ ID NO: 7865176 - DNA, 17 bp, Homo sapiens
gtcagcagcttgcttgt

SEQ ID NO: 7865177 - DNA, 22 bp, Homo sapiens
gtcagcagtggcagctcccggg

SEQ ID NO: 7865178 - DNA, 22 bp, Homo sapiens
gtcagcagggctccctggcagg

SEQ ID NO: 7865179 - DNA, 22 bp, Homo sapiens
gtcagcagtgtcagctctgggg

SEQ ID NO: 7865180 - DNA, 22 bp, Homo sapiens
gtcagcagtgtcagctctgggg

SEQ ID NO: 7865181 - DNA, 22 bp, Homo sapiens
gtcagcagtggcagctcccggg

SEQ ID NO: 7865182 - DNA, 22 bp, Homo sapiens
gtcagcagtggcagctcccggg

SEQ ID NO: 7865183 - DNA, 22 bp, Homo sapiens
gtcagcagtgtcagctctgggg

SEQ ID NO: 7865184 - DNA, 22 bp, Homo sapiens
gtagggacatgccattatctca

SEQ ID NO: 7865185 - DNA, 20 bp, Homo sapiens
gtagggaaggaatctgcagg

SEQ ID NO: 7865186 - DNA, 22 bp, Homo sapiens
gtagggaaggccaacttcatgt

SEQ ID NO: 7865187 - DNA, 22 bp, Homo sapiens
gtagggaagggagcactggaca

SEQ ID NO: 7865188 - DNA, 22 bp, Homo sapiens
gtaggctgtgtgaggctagaga

SEQ ID NO: 7865189 - DNA, 20 bp, Homo sapiens
gtagggaaggaatctgcagg

SEQ ID NO: 7865190 - DNA, 22 bp, Homo sapiens
gtagggagcccagagcccagtg

SEQ ID NO: 7865191 - DNA, 22 bp, Homo sapiens
gtagggagcccagagcccagtg

SEQ ID NO: 7865192 - DNA, 22 bp, Homo sapiens
gtattttacttacgcatgactt

SEQ ID NO: 7865193 - DNA, 22 bp, Homo sapiens
gtagggagcccagagcccagtg

SEQ ID NO: 7865194 - DNA, 22 bp, Homo sapiens
gtattttatggcatgcagtggc

SEQ ID NO: 7865195 - DNA, 22 bp, Homo sapiens
gtattttatggcatgcagtggc

SEQ ID NO: 7865196 - DNA, 22 bp, Homo sapiens
gtattttacttacgcatgactt

SEQ ID NO: 7865197 - DNA, 22 bp, Homo sapiens
gtcacacagggcctccaaatca

SEQ ID NO: 7865198 - DNA, 22 bp, Homo sapiens
gtcacacagggcctccaaatca

SEQ ID NO: 7865199 - DNA, 22 bp, Homo sapiens
gtcacacagggcctccaaatca

SEQ ID NO: 7865200 - DNA, 22 bp, Homo sapiens
gtcacacaggttgaaatgcagt

SEQ ID NO: 7865201 - DNA, 22 bp, Homo sapiens
gtcacacaggttgaaatgcagt

SEQ ID NO: 7865202 - DNA, 22 bp, Homo sapiens
gtcacacagagccctgtgctca

SEQ ID NO: 7865203 - DNA, 22 bp, Homo sapiens
gtcacacagagccctgtgctca

SEQ ID NO: 7865204 - DNA, 21 bp, Homo sapiens
gtcacacaggcctggagctga

SEQ ID NO: 7865205 - DNA, 22 bp, Homo sapiens
gtcacacaatagtaagtggtcc

SEQ ID NO: 7865206 - DNA, 22 bp, Homo sapiens
gtcacaggcctggatgaggggc

SEQ ID NO: 7865207 - DNA, 22 bp, Homo sapiens
gtcacaggcagtaactaggacc

SEQ ID NO: 7865208 - DNA, 22 bp, Homo sapiens
gtcacaggcagtaactaggacc

SEQ ID NO: 7865209 - DNA, 22 bp, Homo sapiens
gtcacaggcagtaactaggacc

SEQ ID NO: 7865210 - DNA, 22 bp, Homo sapiens
gtcacaggaagcagcaggcact

SEQ ID NO: 7865211 - DNA, 22 bp, Homo sapiens
gtcacaggaagcagcaggcact

SEQ ID NO: 7865212 - DNA, 22 bp, Homo sapiens
gtcacaggaagcagcaggcact

SEQ ID NO: 7865213 - DNA, 22 bp, Homo sapiens
gtcacaggaagcagcaggcact

SEQ ID NO: 7865214 - DNA, 22 bp, Homo sapiens
gtcacaggaagcagcaggcact

SEQ ID NO: 7865215 - DNA, 22 bp, Homo sapiens
gtcacagggtccccatatggag

SEQ ID NO: 7865216 - DNA, 22 bp, Homo sapiens
gtcagatctttggggatgctgt

SEQ ID NO: 7865217 - DNA, 22 bp, Homo sapiens
gtcacactcaaaagctaggatg

SEQ ID NO: 7865218 - DNA, 22 bp, Homo sapiens
gtcacagatctcttgagtcaag

SEQ ID NO: 7865219 - DNA, 22 bp, Homo sapiens
gtcacacttctttctgtgtctc

SEQ ID NO: 7865220 - DNA, 22 bp, Homo sapiens
gtcacactcttccctccacatg

SEQ ID NO: 7865221 - DNA, 22 bp, Homo sapiens
gtcacagatctcttgagtcaag

SEQ ID NO: 7865222 - DNA, 22 bp, Homo sapiens
gtcacagatctcttgagtcaag

SEQ ID NO: 7865223 - DNA, 22 bp, Homo sapiens
gtcacagatctcttgagtcaag

SEQ ID NO: 7865224 - DNA, 18 bp, Homo sapiens
gtcacagcagagaactgc

SEQ ID NO: 7865225 - DNA, 18 bp, Homo sapiens
gtcacagcagagaactgc

SEQ ID NO: 7865226 - DNA, 22 bp, Homo sapiens
gtcacaggaaagggtgtaaggg

SEQ ID NO: 7865227 - DNA, 22 bp, Homo sapiens
gtcacagcctcaatcccatctg

SEQ ID NO: 7865228 - DNA, 22 bp, Homo sapiens
gtcacagatggggaaacggagg

SEQ ID NO: 7865229 - DNA, 22 bp, Homo sapiens
cagcatctctgggagaagcatc

SEQ ID NO: 7865230 - DNA, 22 bp, Homo sapiens
cagcatctctgggagaagcatc

SEQ ID NO: 7865231 - DNA, 22 bp, Homo sapiens
cagcatctctgggagaagcatc

SEQ ID NO: 7865232 - DNA, 22 bp, Homo sapiens
cagcatctctttttgcattcct

SEQ ID NO: 7865233 - DNA, 22 bp, Homo sapiens
cagcatctctttttgcattcct

SEQ ID NO: 7865234 - DNA, 22 bp, Homo sapiens
cagcatctgaccaatatctaca

SEQ ID NO: 7865235 - DNA, 22 bp, Homo sapiens
cagcatctgaccaatatctaca

SEQ ID NO: 7865236 - DNA, 19 bp, Homo sapiens
cagcatctgagccgtgtcc

SEQ ID NO: 7865237 - DNA, 22 bp, Homo sapiens
cagcatctctgcctgcctgcaa

SEQ ID NO: 7865238 - DNA, 22 bp, Homo sapiens
cagcatctctgcctgcctgcaa

SEQ ID NO: 7865239 - DNA, 22 bp, Homo sapiens
cagcatctctgcctgcctgcaa

SEQ ID NO: 7865240 - DNA, 22 bp, Homo sapiens
cagcatctcgtggctggataga

SEQ ID NO: 7865241 - DNA, 22 bp, Homo sapiens
cagcatctcctgtgcagaggga

SEQ ID NO: 7865242 - DNA, 22 bp, Homo sapiens
cagcatctctgcaccctccccc

SEQ ID NO: 7865243 - DNA, 22 bp, Homo sapiens
cagcatctgttcccaacgagat

SEQ ID NO: 7865244 - DNA, 22 bp, Homo sapiens
cagcatctgtatcctaggctga

SEQ ID NO: 7865245 - DNA, 22 bp, Homo sapiens
cagcatctgtatcctaggctga

SEQ ID NO: 7865246 - DNA, 22 bp, Homo sapiens
cagcatctgttggatggataag

SEQ ID NO: 7865247 - DNA, 22 bp, Homo sapiens
cagcatctgtttttctgaccca

SEQ ID NO: 7865248 - DNA, 22 bp, Homo sapiens
cagcatctgttggatggataag

SEQ ID NO: 7865249 - DNA, 22 bp, Homo sapiens
cagcatctgtttttctgaccca

SEQ ID NO: 7865250 - DNA, 22 bp, Homo sapiens
cagcatctgtttttctgaccca

SEQ ID NO: 7865251 - DNA, 22 bp, Homo sapiens
gtccagagaggcaggaggctac

SEQ ID NO: 7865252 - DNA, 19 bp, Homo sapiens
cagcatctgagccgtgtcc

SEQ ID NO: 7865253 - DNA, 19 bp, Homo sapiens
cagcatctgagccgtgtcc

SEQ ID NO: 7865254 - DNA, 22 bp, Homo sapiens
cagcatctggatttcctccact

SEQ ID NO: 7865255 - DNA, 22 bp, Homo sapiens
cagcatctggatttcctccact

SEQ ID NO: 7865256 - DNA, 22 bp, Homo sapiens
cagcatctggggaacattcaag

SEQ ID NO: 7865257 - DNA, 22 bp, Homo sapiens
cagcatctgtaggactcctctt

SEQ ID NO: 7865258 - DNA, 22 bp, Homo sapiens
cagcatctgtaggactcctctt

SEQ ID NO: 7865259 - DNA, 22 bp, Homo sapiens
cagcatctgtaggactcctctt

SEQ ID NO: 7865260 - DNA, 22 bp, Homo sapiens
cagcatctgtatcctaggctga

SEQ ID NO: 7865261 - DNA, 22 bp, Homo sapiens
gtccagagccggaagagtgaca

SEQ ID NO: 7865262 - DNA, 22 bp, Homo sapiens
gtccagagccggaagagtgaca

SEQ ID NO: 7865263 - DNA, 22 bp, Homo sapiens
gtccagagaggcaggaggctac

SEQ ID NO: 7865264 - DNA, 22 bp, Homo sapiens
gtccagagaggcaggaggctac

SEQ ID NO: 7865265 - DNA, 22 bp, Homo sapiens
gtccagagaggcaggaggctac

SEQ ID NO: 7865266 - DNA, 22 bp, Homo sapiens
gtccagagggctgcaggatgct

SEQ ID NO: 7865267 - DNA, 22 bp, Homo sapiens
gtccagagggctgcaggatgct

SEQ ID NO: 7865268 - DNA, 22 bp, Homo sapiens
gtccagagggctgcaggatgct

SEQ ID NO: 7865269 - DNA, 22 bp, Homo sapiens
gtccagagctggcacactgtca

SEQ ID NO: 7865270 - DNA, 22 bp, Homo sapiens
gtccagagggctgcaggatgct

SEQ ID NO: 7865271 - DNA, 22 bp, Homo sapiens
gtccagagggctgcaggatgct

SEQ ID NO: 7865272 - DNA, 22 bp, Homo sapiens
gtccagagggctgcaggatgct

SEQ ID NO: 7865273 - DNA, 22 bp, Homo sapiens
gtccagagggctgcaggatgct

SEQ ID NO: 7865274 - DNA, 20 bp, Homo sapiens
gtccagagtaatgtgctgac

SEQ ID NO: 7865275 - DNA, 22 bp, Homo sapiens
gtccagaggtccaggatcaagg

SEQ ID NO: 7865276 - DNA, 22 bp, Homo sapiens
gtccagaggtccaggatcaagg

SEQ ID NO: 7865277 - DNA, 22 bp, Homo sapiens
gtccagaggtccaggatcaagg

SEQ ID NO: 7865278 - DNA, 22 bp, Homo sapiens
gtccagagggtcaagtttcttg

SEQ ID NO: 7865279 - DNA, 22 bp, Homo sapiens
gtccagagggctgcaggatgct

SEQ ID NO: 7865280 - DNA, 22 bp, Homo sapiens
cagccaggatggagaactgttg

SEQ ID NO: 7865281 - DNA, 22 bp, Homo sapiens
cagccaggatggagaactgttg

SEQ ID NO: 7865282 - DNA, 22 bp, Homo sapiens
cagccaggatggagaactgttg

SEQ ID NO: 7865283 - DNA, 22 bp, Homo sapiens
cagccaggatggagaactgttg

SEQ ID NO: 7865284 - DNA, 22 bp, Homo sapiens
cagccaggcccagatcatgctg

SEQ ID NO: 7865285 - DNA, 22 bp, Homo sapiens
cagccaggcccccgagtcgttg

SEQ ID NO: 7865286 - DNA, 22 bp, Homo sapiens
cagccaggcccccgagtcgttg

SEQ ID NO: 7865287 - DNA, 22 bp, Homo sapiens
cagccaggcccccgagtcgttg

SEQ ID NO: 7865288 - DNA, 22 bp, Homo sapiens
cagccaggcccagatcatgctg

SEQ ID NO: 7865289 - DNA, 22 bp, Homo sapiens
cagccaggcccccgagtcgttg

SEQ ID NO: 7865290 - DNA, 22 bp, Homo sapiens
cagccaggcccagatcatgctg

SEQ ID NO: 7865291 - DNA, 22 bp, Homo sapiens
cagccaggcccagatcatgctg

SEQ ID NO: 7865292 - DNA, 22 bp, Homo sapiens
cagccaggcccagatcatgctg

SEQ ID NO: 7865293 - DNA, 22 bp, Homo sapiens
cagccaggcccagatcatgctg

SEQ ID NO: 7865294 - DNA, 22 bp, Homo sapiens
cagccaggactcccatttagga

SEQ ID NO: 7865295 - DNA, 22 bp, Homo sapiens
cagccaggagcctctgcaacta

SEQ ID NO: 7865296 - DNA, 22 bp, Homo sapiens
cagccaggagcctctgcaacta

SEQ ID NO: 7865297 - DNA, 22 bp, Homo sapiens
cagccaggagcctctgcaacta

SEQ ID NO: 7865298 - DNA, 22 bp, Homo sapiens
cagccaggactcccatttagga

SEQ ID NO: 7865299 - DNA, 22 bp, Homo sapiens
cagccaggactcccatttagga

SEQ ID NO: 7865300 - DNA, 22 bp, Homo sapiens
cagccaggagcctctgcaacta

SEQ ID NO: 7865301 - DNA, 22 bp, Homo sapiens
cagccaggagctccccctgctc

SEQ ID NO: 7865302 - DNA, 22 bp, Homo sapiens
cagccaggagctccccctgctc

SEQ ID NO: 7865303 - DNA, 22 bp, Homo sapiens
cagccaggagctccccctgctc

SEQ ID NO: 7865304 - DNA, 22 bp, Homo sapiens
cagccaggagcctctgcaacta

SEQ ID NO: 7865305 - DNA, 22 bp, Homo sapiens
cagccaggagcctctgcaacta

SEQ ID NO: 7865306 - DNA, 22 bp, Homo sapiens
cagccagctggtgcggcagagc

SEQ ID NO: 7865307 - DNA, 22 bp, Homo sapiens
cagccagctggtgcggcagagc

SEQ ID NO: 7865308 - DNA, 22 bp, Homo sapiens
cagccagctggtgcggcagagc

SEQ ID NO: 7865309 - DNA, 22 bp, Homo sapiens
cagccagctgtcccaagtgcct

SEQ ID NO: 7865310 - DNA, 22 bp, Homo sapiens
cagccagctgtcccaagtgcct

SEQ ID NO: 7865311 - DNA, 22 bp, Homo sapiens
cagccagctgtcccaagtgcct

SEQ ID NO: 7865312 - DNA, 22 bp, Homo sapiens
cagccaggacagggaaactagt

SEQ ID NO: 7865313 - DNA, 22 bp, Homo sapiens
cagccagcttcagatccaagcc

SEQ ID NO: 7865314 - DNA, 22 bp, Homo sapiens
cagccagcttcagatccaagcc

SEQ ID NO: 7865315 - DNA, 22 bp, Homo sapiens
cagccagctgtcccaagtgcct

SEQ ID NO: 7865316 - DNA, 22 bp, Homo sapiens
cagccagcttcagatccaagcc

SEQ ID NO: 7865317 - DNA, 22 bp, Homo sapiens
cagccagctgtcccaagtgcct

SEQ ID NO: 7865318 - DNA, 22 bp, Homo sapiens
gtccagagtagtcgagtattct

SEQ ID NO: 7865319 - DNA, 22 bp, Homo sapiens
gtccagagttagaaatgaatat

SEQ ID NO: 7865320 - DNA, 22 bp, Homo sapiens
gtccagagtattcaagtaactt

SEQ ID NO: 7865321 - DNA, 22 bp, Homo sapiens
gtccagcatttaggcttgctga

SEQ ID NO: 7865322 - DNA, 22 bp, Homo sapiens
gtccagcaggatgcaagtgcca

SEQ ID NO: 7865323 - DNA, 22 bp, Homo sapiens
gtccagcaggatgcaagtgcca

SEQ ID NO: 7865324 - DNA, 22 bp, Homo sapiens
gtccagagttagaaatgaatat

SEQ ID NO: 7865325 - DNA, 22 bp, Homo sapiens
gtccagcaggatgcaagtgcca

SEQ ID NO: 7865326 - DNA, 22 bp, Homo sapiens
cagccagaacctaggatgagct

SEQ ID NO: 7865327 - DNA, 22 bp, Homo sapiens
cagccagaacctaggatgagct

SEQ ID NO: 7865328 - DNA, 22 bp, Homo sapiens
cagccagaacctaggatgagct

SEQ ID NO: 7865329 - DNA, 22 bp, Homo sapiens
gtccagcatttaggcttgctga

SEQ ID NO: 7865330 - DNA, 22 bp, Homo sapiens
gtccagccaccctggaggcacg

SEQ ID NO: 7865331 - DNA, 22 bp, Homo sapiens
gtcctgtgcaccgtgggatgtt

SEQ ID NO: 7865332 - DNA, 22 bp, Homo sapiens
gtcctgtgatgagtaccaggtg

SEQ ID NO: 7865333 - DNA, 22 bp, Homo sapiens
gtcctgtgagattcatgctcaa

SEQ ID NO: 7865334 - DNA, 22 bp, Homo sapiens
gtcctgtgagattcatgctcaa

SEQ ID NO: 7865335 - DNA, 22 bp, Homo sapiens
gtcctgtgacctgcatcctgag

SEQ ID NO: 7865336 - DNA, 22 bp, Homo sapiens
gtcctgtgacctgcatcctgag

SEQ ID NO: 7865337 - DNA, 22 bp, Homo sapiens
gtcctgtgacctgcatcctgag

SEQ ID NO: 7865338 - DNA, 22 bp, Homo sapiens
gtcctgtcccccaaggctgtgg

SEQ ID NO: 7865339 - DNA, 22 bp, Homo sapiens
gtcctggtgaggtagtgggagg

SEQ ID NO: 7865340 - DNA, 22 bp, Homo sapiens
gtcctgtcccccaaggctgtgg

SEQ ID NO: 7865341 - DNA, 22 bp, Homo sapiens
gtcctggttttcacagaccttt

SEQ ID NO: 7865342 - DNA, 21 bp, Homo sapiens
gtcctgtagctgtctggtctt

SEQ ID NO: 7865343 - DNA, 22 bp, Homo sapiens
cagccaggcccccgagtcgttg

SEQ ID NO: 7865344 - DNA, 22 bp, Homo sapiens
gtcctggtgaggtagtgggagg

SEQ ID NO: 7865345 - DNA, 22 bp, Homo sapiens
gtcctggtcctgcctccccatg

SEQ ID NO: 7865346 - DNA, 22 bp, Homo sapiens
gtcctggtcctgcctccccatg

SEQ ID NO: 7865347 - DNA, 22 bp, Homo sapiens
gtcctggtataattgtttaaaa

SEQ ID NO: 7865348 - DNA, 22 bp, Homo sapiens
gtcctggtataattgtttaaaa

SEQ ID NO: 7865349 - DNA, 22 bp, Homo sapiens
gtcctggtgctggtcattgtcg

SEQ ID NO: 7865350 - DNA, 22 bp, Homo sapiens
gtcctggtgctggtcattgtcg

SEQ ID NO: 7865351 - DNA, 22 bp, Homo sapiens
gtcctggtgccacctgcgggat

SEQ ID NO: 7865352 - DNA, 17 bp, Homo sapiens
gtcctggtgtgtgagga

SEQ ID NO: 7865353 - DNA, 22 bp, Homo sapiens
gtcctggtgggacaatggacat

SEQ ID NO: 7865354 - DNA, 22 bp, Homo sapiens
gtcctggtggagtctctgggga

SEQ ID NO: 7865355 - DNA, 22 bp, Homo sapiens
gtgaatttctgactaaaagtgc

SEQ ID NO: 7865356 - DNA, 22 bp, Homo sapiens
gtgaatttctgactaaaagtgc

SEQ ID NO: 7865357 - DNA, 22 bp, Homo sapiens
gtgaattaggacaaaagggctt

SEQ ID NO: 7865358 - DNA, 22 bp, Homo sapiens
gtgaattaggacaaaagggctt

SEQ ID NO: 7865359 - DNA, 22 bp, Homo sapiens
gtgaattaggctatggcagagg

SEQ ID NO: 7865360 - DNA, 22 bp, Homo sapiens
gtgaattacatgtatttttaag

SEQ ID NO: 7865361 - DNA, 22 bp, Homo sapiens
gtcctgtgctcagacatggggg

SEQ ID NO: 7865362 - DNA, 22 bp, Homo sapiens
gtcctgtgccctgggtggcgct

SEQ ID NO: 7865363 - DNA, 22 bp, Homo sapiens
gtcctgtgccgaggtgggaagc

SEQ ID NO: 7865364 - DNA, 22 bp, Homo sapiens
gtcctgtgccctgggtggcgct

SEQ ID NO: 7865365 - DNA, 22 bp, Homo sapiens
gtcctgtgccctgggtggcgct

SEQ ID NO: 7865366 - DNA, 22 bp, Homo sapiens
gtcctgtgcccagaccctctgt

SEQ ID NO: 7865367 - DNA, 22 bp, Homo sapiens
gtgaatttctgactaaaagtgc

SEQ ID NO: 7865368 - DNA, 22 bp, Homo sapiens
gtgagagatgctttcttaacgc

SEQ ID NO: 7865369 - DNA, 22 bp, Homo sapiens
gtgagagcctgtctggatgtcg

SEQ ID NO: 7865370 - DNA, 22 bp, Homo sapiens
gtgagagcctgtctggatgtcg

SEQ ID NO: 7865371 - DNA, 22 bp, Homo sapiens
gtgagagctgctagactgttat

SEQ ID NO: 7865372 - DNA, 22 bp, Homo sapiens
gtgagagctcagctgccctggg

SEQ ID NO: 7865373 - DNA, 22 bp, Homo sapiens
gtgagagctgctccagatctct

SEQ ID NO: 7865374 - DNA, 22 bp, Homo sapiens
gtgagagggctgggctcatgat

SEQ ID NO: 7865375 - DNA, 22 bp, Homo sapiens
gtgagagggctgggctcatgat

SEQ ID NO: 7865376 - DNA, 22 bp, Homo sapiens
gtgagagggctgggctcatgat

SEQ ID NO: 7865377 - DNA, 22 bp, Homo sapiens
gtgagagctcagctgccctggg

SEQ ID NO: 7865378 - DNA, 22 bp, Homo sapiens
gtgagaggttcctgttagaact

SEQ ID NO: 7865379 - DNA, 22 bp, Homo sapiens
gtgagagggctgggctcatgat

SEQ ID NO: 7865380 - DNA, 23 bp, Homo sapiens
gtgagcagcaccatgaggctaga

SEQ ID NO: 7865381 - DNA, 23 bp, Homo sapiens
gtgagcagcaccatgaggctaga

SEQ ID NO: 7865382 - DNA, 23 bp, Homo sapiens
gtgagcagcaccatgaggctaga

SEQ ID NO: 7865383 - DNA, 23 bp, Homo sapiens
gtgagcagcaccatgaggctaga

SEQ ID NO: 7865384 - DNA, 22 bp, Homo sapiens
gtgagcagagatcgcgtgattg

SEQ ID NO: 7865385 - DNA, 22 bp, Homo sapiens
gtgagcagagatcgcgtgattg

SEQ ID NO: 7865386 - DNA, 22 bp, Homo sapiens
gtgagcagagatcgcgtgattg

SEQ ID NO: 7865387 - DNA, 18 bp, Homo sapiens
gtgagcagagagcatcac

SEQ ID NO: 7865388 - DNA, 22 bp, Homo sapiens
cagccctcatcccgcctgcgtt

SEQ ID NO: 7865389 - DNA, 23 bp, Homo sapiens
gtgagcagcccactaggaatgcc

SEQ ID NO: 7865390 - DNA, 22 bp, Homo sapiens
cagccctcatcccgcctgcgtt

SEQ ID NO: 7865391 - DNA, 22 bp, Homo sapiens
cagccctcatctcagcttcttt

SEQ ID NO: 7865392 - DNA, 22 bp, Homo sapiens
cagccctcatctcagcttcttt

SEQ ID NO: 7865393 - DNA, 22 bp, Homo sapiens
cagccctcatctcagcttcttt

SEQ ID NO: 7865394 - DNA, 18 bp, Homo sapiens
gtgagcagagagcatcac

SEQ ID NO: 7865395 - DNA, 18 bp, Homo sapiens
gtgagcagagagcatcac

SEQ ID NO: 7865396 - DNA, 18 bp, Homo sapiens
gtgagcagagagcatcac

SEQ ID NO: 7865397 - DNA, 22 bp, Homo sapiens
gtgagcagaacaggtggcttct

SEQ ID NO: 7865398 - DNA, 22 bp, Homo sapiens
gtgagcagacatcaaaggctgc

SEQ ID NO: 7865399 - DNA, 22 bp, Homo sapiens
gtgagcaatttggtattaattt

SEQ ID NO: 7865400 - DNA, 22 bp, Homo sapiens
gtgagcagaacaggtggcttct

SEQ ID NO: 7865401 - DNA, 22 bp, Homo sapiens
gtgagaggttcctgttagaact

SEQ ID NO: 7865402 - DNA, 22 bp, Homo sapiens
gtgagagtggtttatgtccatg

SEQ ID NO: 7865403 - DNA, 22 bp, Homo sapiens
gtgagagtgtttggaaatagaa

SEQ ID NO: 7865404 - DNA, 22 bp, Homo sapiens
gtgagattccttagattcatgg

SEQ ID NO: 7865405 - DNA, 22 bp, Homo sapiens
gtgagcaaaggttaaacattta

SEQ ID NO: 7865406 - DNA, 22 bp, Homo sapiens
gtgagcaattcaaaggcaggaa

SEQ ID NO: 7865407 - DNA, 22 bp, Homo sapiens
cagccctctgaagaggcgcttg

SEQ ID NO: 7865408 - DNA, 22 bp, Homo sapiens
cagccctctgaagaggcgcttg

SEQ ID NO: 7865409 - DNA, 22 bp, Homo sapiens
cagccctctgaagaggcgcttg

SEQ ID NO: 7865410 - DNA, 22 bp, Homo sapiens
cagccctctctgggccccaagg

SEQ ID NO: 7865411 - DNA, 22 bp, Homo sapiens
cagccctctctgggccccaagg

SEQ ID NO: 7865412 - DNA, 22 bp, Homo sapiens
cagccctcctttcactcccagg

SEQ ID NO: 7865413 - DNA, 22 bp, Homo sapiens
cagccctctctgggccccaagg

SEQ ID NO: 7865414 - DNA, 22 bp, Homo sapiens
cagccctgaaacaacctcctct

SEQ ID NO: 7865415 - DNA, 22 bp, Homo sapiens
cagccctgaaacaacctcctct

SEQ ID NO: 7865416 - DNA, 22 bp, Homo sapiens
cagccctgaaacaacctcctct

SEQ ID NO: 7865417 - DNA, 19 bp, Homo sapiens
cagccctcttaccactgtg

SEQ ID NO: 7865418 - DNA, 19 bp, Homo sapiens
cagccctcttaccactgtg

SEQ ID NO: 7865419 - DNA, 19 bp, Homo sapiens
cagccctcttaccactgtg

SEQ ID NO: 7865420 - DNA, 19 bp, Homo sapiens
cagccctcttaccactgtg

SEQ ID NO: 7865421 - DNA, 22 bp, Homo sapiens
cagccctcctaccctgccaggc

SEQ ID NO: 7865422 - DNA, 22 bp, Homo sapiens
cagccctcctaccctgccaggc

SEQ ID NO: 7865423 - DNA, 22 bp, Homo sapiens
cagccctcctttcactcccagg

SEQ ID NO: 7865424 - DNA, 22 bp, Homo sapiens
cagccctcctttcactcccagg

SEQ ID NO: 7865425 - DNA, 22 bp, Homo sapiens
cagccctcctaccctgccaggc

SEQ ID NO: 7865426 - DNA, 22 bp, Homo sapiens
cagccctcctaccctgccaggc

SEQ ID NO: 7865427 - DNA, 22 bp, Homo sapiens
cagccctcctaccctgccaggc

SEQ ID NO: 7865428 - DNA, 20 bp, Homo sapiens
cagccctccagtggaggcag

SEQ ID NO: 7865429 - DNA, 20 bp, Homo sapiens
cagccctccagtggaggcag

SEQ ID NO: 7865430 - DNA, 20 bp, Homo sapiens
cagccctccagtggaggcag

SEQ ID NO: 7865431 - DNA, 22 bp, Homo sapiens
cagccctgaaacaacctcctct

SEQ ID NO: 7865432 - DNA, 22 bp, Homo sapiens
cagccctggcccaggtgcctta

SEQ ID NO: 7865433 - DNA, 22 bp, Homo sapiens
cagccctggcccaggtgcctta

SEQ ID NO: 7865434 - DNA, 22 bp, Homo sapiens
cagccctggccccaggtggtct

SEQ ID NO: 7865435 - DNA, 22 bp, Homo sapiens
cagccctggccccaggtggtct

SEQ ID NO: 7865436 - DNA, 22 bp, Homo sapiens
cagccctggtgccaaggttccc

SEQ ID NO: 7865437 - DNA, 22 bp, Homo sapiens
cagccctggtgccaaggttccc

SEQ ID NO: 7865438 - DNA, 22 bp, Homo sapiens
cagccctggtgccaaggttccc

SEQ ID NO: 7865439 - DNA, 22 bp, Homo sapiens
cagccctgtccaatgtctgctc

SEQ ID NO: 7865440 - DNA, 22 bp, Homo sapiens
cagccctgtccaatgtctgctc

SEQ ID NO: 7865441 - DNA, 22 bp, Homo sapiens
cagccctgtccaatgtctgctc

SEQ ID NO: 7865442 - DNA, 22 bp, Homo sapiens
cagccctgtccaatgtctgctc

SEQ ID NO: 7865443 - DNA, 22 bp, Homo sapiens
cagccctgtccaatgtctgctc

SEQ ID NO: 7865444 - DNA, 22 bp, Homo sapiens
cagccctgtccagcagagggtg

SEQ ID NO: 7865445 - DNA, 22 bp, Homo sapiens
cagccctgtccagcagagggtg

SEQ ID NO: 7865446 - DNA, 22 bp, Homo sapiens
cagccctgtccagcagagggtg

SEQ ID NO: 7865447 - DNA, 22 bp, Homo sapiens
cagccctgtccagcagagggtg

SEQ ID NO: 7865448 - DNA, 22 bp, Homo sapiens
cagccctgtccctgagggacct

SEQ ID NO: 7865449 - DNA, 22 bp, Homo sapiens
cagccctgtccctgagggacct

SEQ ID NO: 7865450 - DNA, 22 bp, Homo sapiens
cagccctgtccctgagggacct

SEQ ID NO: 7865451 - DNA, 22 bp, Homo sapiens
cagccctgtccctgagggacct

SEQ ID NO: 7865452 - DNA, 22 bp, Homo sapiens
cagccctgtccctgagggacct

SEQ ID NO: 7865453 - DNA, 22 bp, Homo sapiens
cagccctgtccagcagagggtg

SEQ ID NO: 7865454 - DNA, 22 bp, Homo sapiens
cagccctgtccagcagagggtg

SEQ ID NO: 7865455 - DNA, 22 bp, Homo sapiens
cagccctgtctatgactgatga

SEQ ID NO: 7865456 - DNA, 22 bp, Homo sapiens
cagccctgtctatgactgatga

SEQ ID NO: 7865457 - DNA, 22 bp, Homo sapiens
cagccctgtctatgactgatga

SEQ ID NO: 7865458 - DNA, 22 bp, Homo sapiens
cagccctgtccctgagggacct

SEQ ID NO: 7865459 - DNA, 22 bp, Homo sapiens
cagccctgtctatgactgatga

SEQ ID NO: 7865460 - DNA, 22 bp, Homo sapiens
cagccctgtccctgagggacct

SEQ ID NO: 7865461 - DNA, 22 bp, Homo sapiens
cagccctgtctatgactgatga

SEQ ID NO: 7865462 - DNA, 22 bp, Homo sapiens
cagccctgtccctgagggacct

SEQ ID NO: 7865463 - DNA, 22 bp, Homo sapiens
ggtcctctgagcacgccaggca

SEQ ID NO: 7865464 - DNA, 20 bp, Homo sapiens
ggtcctgccttcatcacttc

SEQ ID NO: 7865465 - DNA, 18 bp, Homo sapiens
ggtcctgaatgcctgcta

SEQ ID NO: 7865466 - DNA, 19 bp, Homo sapiens
ggtcctcagcagagcatgc

SEQ ID NO: 7865467 - DNA, 22 bp, Homo sapiens
ggtcctctccagcgccacagtg

SEQ ID NO: 7865468 - DNA, 22 bp, Homo sapiens
ggtcctcaatcccaacaaggca

SEQ ID NO: 7865469 - DNA, 22 bp, Homo sapiens
ggtcctcaatcccaacaaggca

SEQ ID NO: 7865470 - DNA, 19 bp, Homo sapiens
ggtcctcagcagagcatgc

SEQ ID NO: 7865471 - DNA, 22 bp, Homo sapiens
cagatgctaagttatcagcagg

SEQ ID NO: 7865472 - DNA, 22 bp, Homo sapiens
cagatgctaaacaaaggacttt

SEQ ID NO: 7865473 - DNA, 22 bp, Homo sapiens
cagatgcaggtctgctcacctg

SEQ ID NO: 7865474 - DNA, 22 bp, Homo sapiens
cagatgcatgtacagtgttgct

SEQ ID NO: 7865475 - DNA, 22 bp, Homo sapiens
cagatgcatgagttcattagga

SEQ ID NO: 7865476 - DNA, 22 bp, Homo sapiens
cagatgctaagttatcagcagg

SEQ ID NO: 7865477 - DNA, 22 bp, Homo sapiens
cagatgctaggccaattcctga

SEQ ID NO: 7865478 - DNA, 18 bp, Homo sapiens
cagatgctaggcctccag

SEQ ID NO: 7865479 - DNA, 22 bp, Homo sapiens
cagatgcacattctcatcagca

SEQ ID NO: 7865480 - DNA, 23 bp, Homo sapiens
cagatgaggttggcagcatggtc

SEQ ID NO: 7865481 - DNA, 22 bp, Homo sapiens
cagatgcagcaaaatgacaggc

SEQ ID NO: 7865482 - DNA, 22 bp, Homo sapiens
cagatgcaggtctgctcacctg

SEQ ID NO: 7865483 - DNA, 22 bp, Homo sapiens
cagatgcagcaaaatgacaggc

SEQ ID NO: 7865484 - DNA, 22 bp, Homo sapiens
cagatgcagcaaaatgacaggc

SEQ ID NO: 7865485 - DNA, 22 bp, Homo sapiens
cagatgcagcaaaatgacaggc

SEQ ID NO: 7865486 - DNA, 22 bp, Homo sapiens
cagatggcacagatttagagtg

SEQ ID NO: 7865487 - DNA, 22 bp, Homo sapiens
cagatggcacagatttagagtg

SEQ ID NO: 7865488 - DNA, 20 bp, Homo sapiens
cagatggcacgtcagggcat

SEQ ID NO: 7865489 - DNA, 20 bp, Homo sapiens
cagatggcacgtcagggcat

SEQ ID NO: 7865490 - DNA, 22 bp, Homo sapiens
ggtcctggcagtctttggttgt

SEQ ID NO: 7865491 - DNA, 22 bp, Homo sapiens
ggtcctggcagctctgtgtcca

SEQ ID NO: 7865492 - DNA, 22 bp, Homo sapiens
ggtcctgggaagatgctcatga

SEQ ID NO: 7865493 - DNA, 22 bp, Homo sapiens
cagatgttgttcctgcctgtag

SEQ ID NO: 7865494 - DNA, 22 bp, Homo sapiens
cagatgtggttaacatgtacat

SEQ ID NO: 7865495 - DNA, 22 bp, Homo sapiens
cagatgtggttaacatgtacat

SEQ ID NO: 7865496 - DNA, 19 bp, Homo sapiens
cagatgttttcagttcatt

SEQ ID NO: 7865497 - DNA, 22 bp, Homo sapiens
cagattaacacggagcttaaca

SEQ ID NO: 7865498 - DNA, 19 bp, Homo sapiens
cagatgttttcagttcatt

SEQ ID NO: 7865499 - DNA, 22 bp, Homo sapiens
cagatgtttgtctatatgcttt

SEQ ID NO: 7865500 - DNA, 22 bp, Homo sapiens
ggtcctggcagctctgtgtcca

SEQ ID NO: 7865501 - DNA, 22 bp, Homo sapiens
ggtcctggcagctctgtgtcca

SEQ ID NO: 7865502 - DNA, 22 bp, Homo sapiens
ggtcctggcagctctgtgtcca

SEQ ID NO: 7865503 - DNA, 22 bp, Homo sapiens
ggtcctggaagtgtaagtggca

SEQ ID NO: 7865504 - DNA, 22 bp, Homo sapiens
ggtcctggaagtgtaagtggca

SEQ ID NO: 7865505 - DNA, 22 bp, Homo sapiens
ggtcctggaaattgacggaaag

SEQ ID NO: 7865506 - DNA, 22 bp, Homo sapiens
ggtcctggaaattgacggaaag

SEQ ID NO: 7865507 - DNA, 22 bp, Homo sapiens
cagatgaggcaacctcattgct

SEQ ID NO: 7865508 - DNA, 22 bp, Homo sapiens
cagatgaggacagatgactggg

SEQ ID NO: 7865509 - DNA, 22 bp, Homo sapiens
cagatgaggacagatgactggg

SEQ ID NO: 7865510 - DNA, 22 bp, Homo sapiens
cagatgagcatgggcacaagca

SEQ ID NO: 7865511 - DNA, 22 bp, Homo sapiens
cagatgagcatgggcacaagca

SEQ ID NO: 7865512 - DNA, 22 bp, Homo sapiens
cagatgagcatgggcacaagca

SEQ ID NO: 7865513 - DNA, 22 bp, Homo sapiens
cagatgagcatgggcacaagca

SEQ ID NO: 7865514 - DNA, 23 bp, Homo sapiens
cagatgaggttggcagcatggtc

SEQ ID NO: 7865515 - DNA, 23 bp, Homo sapiens
cagatgaggttggcagcatggtc

SEQ ID NO: 7865516 - DNA, 23 bp, Homo sapiens
cagatgaggttggcagcatggtc

SEQ ID NO: 7865517 - DNA, 23 bp, Homo sapiens
cagatgaggttggcagcatggtc

SEQ ID NO: 7865518 - DNA, 23 bp, Homo sapiens
cagatgaggttggcagcatggtc

SEQ ID NO: 7865519 - DNA, 23 bp, Homo sapiens
cagatgaggttggcagcatggtc

SEQ ID NO: 7865520 - DNA, 22 bp, Homo sapiens
cagatgagagtggccagggttc

SEQ ID NO: 7865521 - DNA, 18 bp, Homo sapiens
cagatgagatgcaatctc

SEQ ID NO: 7865522 - DNA, 18 bp, Homo sapiens
cagatgagatgcaatctc

SEQ ID NO: 7865523 - DNA, 22 bp, Homo sapiens
cagatgagagtggccagggttc

SEQ ID NO: 7865524 - DNA, 22 bp, Homo sapiens
cagatgagagtggccagggttc

SEQ ID NO: 7865525 - DNA, 19 bp, Homo sapiens
cagatgagaaaagtgaggt

SEQ ID NO: 7865526 - DNA, 19 bp, Homo sapiens
cagatgagaaaagtgaggt

SEQ ID NO: 7865527 - DNA, 22 bp, Homo sapiens
cagatgagagtggccagggttc

SEQ ID NO: 7865528 - DNA, 19 bp, Homo sapiens
cagatgagaaaagtgaggt

SEQ ID NO: 7865529 - DNA, 19 bp, Homo sapiens
cagatgagaaaagtgaggt

SEQ ID NO: 7865530 - DNA, 19 bp, Homo sapiens
cagatgagaaaagtgaggt

SEQ ID NO: 7865531 - DNA, 19 bp, Homo sapiens
cagatgagaaaagtgaggt

SEQ ID NO: 7865532 - DNA, 22 bp, Homo sapiens
cagatgaccgtcttccagccag

SEQ ID NO: 7865533 - DNA, 22 bp, Homo sapiens
cagatgaccaggctccacccag

SEQ ID NO: 7865534 - DNA, 22 bp, Homo sapiens
cagatgaccaggctccacccag

SEQ ID NO: 7865535 - DNA, 22 bp, Homo sapiens
cagatgaataaatgatgaggta

SEQ ID NO: 7865536 - DNA, 22 bp, Homo sapiens
cagatatgataggattagcaca

SEQ ID NO: 7865537 - DNA, 22 bp, Homo sapiens
cagatatgataggattagcaca

SEQ ID NO: 7865538 - DNA, 22 bp, Homo sapiens
cagatatgctgagactcctgtg

SEQ ID NO: 7865539 - DNA, 22 bp, Homo sapiens
ggtcacagctttttcagcagca

SEQ ID NO: 7865540 - DNA, 22 bp, Homo sapiens
ggtcacagctttttcagcagca

SEQ ID NO: 7865541 - DNA, 22 bp, Homo sapiens
ggtcaagacgggctctgccctt

SEQ ID NO: 7865542 - DNA, 22 bp, Homo sapiens
ggtcaagtaacaaatcaggagc

SEQ ID NO: 7865543 - DNA, 18 bp, Homo sapiens
ggtcaagaaagtaaggca

SEQ ID NO: 7865544 - DNA, 22 bp, Homo sapiens
ggtcacaaggtactgtaagaaa

SEQ ID NO: 7865545 - DNA, 22 bp, Homo sapiens
ggtcaaagttgaagaagggcat

SEQ ID NO: 7865546 - DNA, 22 bp, Homo sapiens
ggtcaaagtgaggagtcaggtt

SEQ ID NO: 7865547 - DNA, 22 bp, Homo sapiens
ggtcaaagggtgagatggcagg

SEQ ID NO: 7865548 - DNA, 22 bp, Homo sapiens
ggtatttatagtggtgcttagt

SEQ ID NO: 7865549 - DNA, 22 bp, Homo sapiens
ggtatttatatgtctgaagctg

SEQ ID NO: 7865550 - DNA, 22 bp, Homo sapiens
ggtatttactgagagccactct

SEQ ID NO: 7865551 - DNA, 22 bp, Homo sapiens
ggtattacttgggcccacgtta

SEQ ID NO: 7865552 - DNA, 21 bp, Homo sapiens
ggtattctgtgtcacctttgg

SEQ ID NO: 7865553 - DNA, 22 bp, Homo sapiens
gggtaggaaatccagaggtggc

SEQ ID NO: 7865554 - DNA, 22 bp, Homo sapiens
gggtaggaaatccagaggtggc

SEQ ID NO: 7865555 - DNA, 22 bp, Homo sapiens
gggtaggaaatccagaggtggc

SEQ ID NO: 7865556 - DNA, 22 bp, Homo sapiens
gggtaggaaatccagaggtggc

SEQ ID NO: 7865557 - DNA, 22 bp, Homo sapiens
gggtaggaaatccagaggtggc

SEQ ID NO: 7865558 - DNA, 22 bp, Homo sapiens
gggtaggaaatccagaggtggc

SEQ ID NO: 7865559 - DNA, 22 bp, Homo sapiens
gggtaccacagcaaccttcctg

SEQ ID NO: 7865560 - DNA, 22 bp, Homo sapiens
gggtaccaagctgcttgggggc

SEQ ID NO: 7865561 - DNA, 22 bp, Homo sapiens
gggtacagttcttccagtgtca

SEQ ID NO: 7865562 - DNA, 22 bp, Homo sapiens
gggtacagttcttccagtgtca

SEQ ID NO: 7865563 - DNA, 22 bp, Homo sapiens
gggtagcagcagggttcctatg

SEQ ID NO: 7865564 - DNA, 22 bp, Homo sapiens
gggtacttaatatttacggggt

SEQ ID NO: 7865565 - DNA, 21 bp, Homo sapiens
gggtagcagaggaggccgtgg

SEQ ID NO: 7865566 - DNA, 22 bp, Homo sapiens
gggtccaggtcttcaggcagag

SEQ ID NO: 7865567 - DNA, 22 bp, Homo sapiens
gggtccaggtcttcaggcagag

SEQ ID NO: 7865568 - DNA, 22 bp, Homo sapiens
gggtccaggtcttcaggcagag

SEQ ID NO: 7865569 - DNA, 22 bp, Homo sapiens
gggtccaggtcttcaggcagag

SEQ ID NO: 7865570 - DNA, 22 bp, Homo sapiens
gggtccaggtcttcaggcagag

SEQ ID NO: 7865571 - DNA, 22 bp, Homo sapiens
gggtccagtagttggtggccgt

SEQ ID NO: 7865572 - DNA, 22 bp, Homo sapiens
gggtccagtagttggtggccgt

SEQ ID NO: 7865573 - DNA, 22 bp, Homo sapiens
gggtccaggtcttcaggcagag

SEQ ID NO: 7865574 - DNA, 19 bp, Homo sapiens
gggtcccaaaagatgtgct

SEQ ID NO: 7865575 - DNA, 22 bp, Homo sapiens
gggtcccagcataggggaagca

SEQ ID NO: 7865576 - DNA, 18 bp, Homo sapiens
gggtcctgtgggagacag

SEQ ID NO: 7865577 - DNA, 21 bp, Homo sapiens
gggtcctgggatgggatccag

SEQ ID NO: 7865578 - DNA, 22 bp, Homo sapiens
gggtcctggaatctgcatttta

SEQ ID NO: 7865579 - DNA, 22 bp, Homo sapiens
gggtcctgcgtgggcccaggac

SEQ ID NO: 7865580 - DNA, 22 bp, Homo sapiens
gggtcctgcgtgggcccaggac

SEQ ID NO: 7865581 - DNA, 18 bp, Homo sapiens
gggtcctgttcttggaag

SEQ ID NO: 7865582 - DNA, 22 bp, Homo sapiens
gggtgggatctgtggagcctca

SEQ ID NO: 7865583 - DNA, 18 bp, Homo sapiens
gggtcctgttcttggaag

SEQ ID NO: 7865584 - DNA, 18 bp, Homo sapiens
gggtcctgtgggagacag

SEQ ID NO: 7865585 - DNA, 18 bp, Homo sapiens
gggtcctgtgggagacag

SEQ ID NO: 7865586 - DNA, 18 bp, Homo sapiens
gggtccccagctgcaggg

SEQ ID NO: 7865587 - DNA, 20 bp, Homo sapiens
gggtccctccggcctgctat

SEQ ID NO: 7865588 - DNA, 20 bp, Homo sapiens
gggtccctccggcctgctat

SEQ ID NO: 7865589 - DNA, 22 bp, Homo sapiens
gggtccctggaattacttgaca

SEQ ID NO: 7865590 - DNA, 22 bp, Homo sapiens
gggtccctcgttctgggatctg

SEQ ID NO: 7865591 - DNA, 20 bp, Homo sapiens
gggtccctccggcctgctat

SEQ ID NO: 7865592 - DNA, 22 bp, Homo sapiens
gggtccctcgcaggcgtcgccg

SEQ ID NO: 7865593 - DNA, 20 bp, Homo sapiens
gggtcctgacttggtctcct

SEQ ID NO: 7865594 - DNA, 22 bp, Homo sapiens
gggtccctggaattacttgaca

SEQ ID NO: 7865595 - DNA, 22 bp, Homo sapiens
gggtccctggaattacttgaca

SEQ ID NO: 7865596 - DNA, 22 bp, Homo sapiens
gggtccctggaattacttgaca

SEQ ID NO: 7865597 - DNA, 22 bp, Homo sapiens
gggtccctggaattacttgaca

SEQ ID NO: 7865598 - DNA, 22 bp, Homo sapiens
gggtccctggaattacttgaca

SEQ ID NO: 7865599 - DNA, 20 bp, Homo sapiens
gggtcctgacttggtctcct

SEQ ID NO: 7865600 - DNA, 20 bp, Homo sapiens
gggtcctgacttggtctcct

SEQ ID NO: 7865601 - DNA, 22 bp, Homo sapiens
gggtcctgcgtgggcccaggac

SEQ ID NO: 7865602 - DNA, 22 bp, Homo sapiens
ggtataaatgatcagatcgctg

SEQ ID NO: 7865603 - DNA, 22 bp, Homo sapiens
ggtatgaaatgattccatgtta

SEQ ID NO: 7865604 - DNA, 22 bp, Homo sapiens
ggtatgctgtgcggacgcagac

SEQ ID NO: 7865605 - DNA, 22 bp, Homo sapiens
ggtatgctgttgtcttcggcca

SEQ ID NO: 7865606 - DNA, 22 bp, Homo sapiens
ggtattcacaatatttaaagag

SEQ ID NO: 7865607 - DNA, 22 bp, Homo sapiens
ggtataaatgatcagatcgctg

SEQ ID NO: 7865608 - DNA, 22 bp, Homo sapiens
ggtatactgcatgacattgggg

SEQ ID NO: 7865609 - DNA, 19 bp, Homo sapiens
ggtatatgggcctcacttg

SEQ ID NO: 7865610 - DNA, 22 bp, Homo sapiens
ggtagtttaagaaataattgtt

SEQ ID NO: 7865611 - DNA, 22 bp, Homo sapiens
ggtataaatgatcagatcgctg

SEQ ID NO: 7865612 - DNA, 22 bp, Homo sapiens
gggttgaggcggatgtcggcgg

SEQ ID NO: 7865613 - DNA, 22 bp, Homo sapiens
gggttgaggcggatgtcggcgg

SEQ ID NO: 7865614 - DNA, 22 bp, Homo sapiens
gggttgaggcggatgtcggcgg

SEQ ID NO: 7865615 - DNA, 22 bp, Homo sapiens
gggttcttatagtatcagagct

SEQ ID NO: 7865616 - DNA, 22 bp, Homo sapiens
gggttccagtctgaaactacag

SEQ ID NO: 7865617 - DNA, 22 bp, Homo sapiens
gggttccaatgatgagcaagag

SEQ ID NO: 7865618 - DNA, 22 bp, Homo sapiens
gggttcatcaaaggacagactc

SEQ ID NO: 7865619 - DNA, 22 bp, Homo sapiens
gggttccagtctgaaactacag

SEQ ID NO: 7865620 - DNA, 22 bp, Homo sapiens
gggttcagtccctcttgctact

SEQ ID NO: 7865621 - DNA, 22 bp, Homo sapiens
gggttcagtccctcttgctact

SEQ ID NO: 7865622 - DNA, 22 bp, Homo sapiens
gggttccaaacatagtcttcct

SEQ ID NO: 7865623 - DNA, 20 bp, Homo sapiens
gggtgtgggcccggccaggc

SEQ ID NO: 7865624 - DNA, 20 bp, Homo sapiens
gggtgtgggcccggccaggc

SEQ ID NO: 7865625 - DNA, 22 bp, Homo sapiens
gggtgtggctgcgtgccaataa

SEQ ID NO: 7865626 - DNA, 20 bp, Homo sapiens
gggtgtgggcccggccaggc

SEQ ID NO: 7865627 - DNA, 22 bp, Homo sapiens
gggtgtgtcttttgctcctgga

SEQ ID NO: 7865628 - DNA, 20 bp, Homo sapiens
gggtgtgggcccggccaggc

SEQ ID NO: 7865629 - DNA, 20 bp, Homo sapiens
gggtgtgtgcagggcctggt

SEQ ID NO: 7865630 - DNA, 22 bp, Homo sapiens
gggtgggatctgtggagcctca

SEQ ID NO: 7865631 - DNA, 22 bp, Homo sapiens
gggtgggatgccgctgtctcca

SEQ ID NO: 7865632 - DNA, 22 bp, Homo sapiens
gggtgtgcaggtcatggcgtct

SEQ ID NO: 7865633 - DNA, 20 bp, Homo sapiens
gggtgtggcctgggaatttg

SEQ ID NO: 7865634 - DNA, 20 bp, Homo sapiens
gggtgtggcctgggaatttg

SEQ ID NO: 7865635 - DNA, 20 bp, Homo sapiens
gggtgtggcctgggaatttg

SEQ ID NO: 7865636 - DNA, 21 bp, Homo sapiens
gggtgtggaaattacatcctg

SEQ ID NO: 7865637 - DNA, 22 bp, Homo sapiens
gggttaaaacaggaagatcagc

SEQ ID NO: 7865638 - DNA, 22 bp, Homo sapiens
gggttaaagcaggaagcatctt

SEQ ID NO: 7865639 - DNA, 22 bp, Homo sapiens
gggtgttgattttacactaaaa

SEQ ID NO: 7865640 - DNA, 22 bp, Homo sapiens
gggtgtttatgtattatgatgt

SEQ ID NO: 7865641 - DNA, 20 bp, Homo sapiens
gggtgtgtgcagggcctggt

SEQ ID NO: 7865642 - DNA, 20 bp, Homo sapiens
gggtgtgtgcagggcctggt

SEQ ID NO: 7865643 - DNA, 22 bp, Homo sapiens
gggtgtgtgcagggtggcactc

SEQ ID NO: 7865644 - DNA, 22 bp, Homo sapiens
gggtgtgttcctaaggaaacca

SEQ ID NO: 7865645 - DNA, 22 bp, Homo sapiens
gggtaaaggtcgccctcaaggt

SEQ ID NO: 7865646 - DNA, 22 bp, Homo sapiens
gggtaaaggtcgccctcaaggt

SEQ ID NO: 7865647 - DNA, 22 bp, Homo sapiens
gggtaaaggaattgggtttcct

SEQ ID NO: 7865648 - DNA, 20 bp, Homo sapiens
ggggttggctggcacaggga

SEQ ID NO: 7865649 - DNA, 20 bp, Homo sapiens
ggggttggctggcacaggga

SEQ ID NO: 7865650 - DNA, 20 bp, Homo sapiens
ggggttggctggcacaggga

SEQ ID NO: 7865651 - DNA, 20 bp, Homo sapiens
ggggttggctggcacaggga

SEQ ID NO: 7865652 - DNA, 22 bp, Homo sapiens
ggggtgagtgctcagccccgga

SEQ ID NO: 7865653 - DNA, 22 bp, Homo sapiens
gggtacagccgttggttgccgg

SEQ ID NO: 7865654 - DNA, 22 bp, Homo sapiens
gggtacagttcttccagtgtca

SEQ ID NO: 7865655 - DNA, 22 bp, Homo sapiens
gggtacagagagatgaggtaac

SEQ ID NO: 7865656 - DNA, 22 bp, Homo sapiens
gggtaatgaacaggtggcagag

SEQ ID NO: 7865657 - DNA, 22 bp, Homo sapiens
gggtaattggggccttgcagtg

SEQ ID NO: 7865658 - DNA, 19 bp, Homo sapiens
ggggcctgtgatggtcaca

SEQ ID NO: 7865659 - DNA, 19 bp, Homo sapiens
ggggcctgtgatggtcaca

SEQ ID NO: 7865660 - DNA, 19 bp, Homo sapiens
ggggcctgtgatggtcaca

SEQ ID NO: 7865661 - DNA, 19 bp, Homo sapiens
ggggcctgtgatggtcaca

SEQ ID NO: 7865662 - DNA, 22 bp, Homo sapiens
ggggccttggatctgtgccccg

SEQ ID NO: 7865663 - DNA, 22 bp, Homo sapiens
ggggcctgtagagcttcaggga

SEQ ID NO: 7865664 - DNA, 22 bp, Homo sapiens
ggggcctgtagagcttcaggga

SEQ ID NO: 7865665 - DNA, 22 bp, Homo sapiens
ggggcctgtagagcttcaggga

SEQ ID NO: 7865666 - DNA, 22 bp, Homo sapiens
ggggcctgtagagcttcaggga

SEQ ID NO: 7865667 - DNA, 22 bp, Homo sapiens
ggggcctgtagagcttcaggga

SEQ ID NO: 7865668 - DNA, 22 bp, Homo sapiens
ggggccttttctgaatgtggaa

SEQ ID NO: 7865669 - DNA, 22 bp, Homo sapiens
ggggccttttctgaatgtggaa

SEQ ID NO: 7865670 - DNA, 22 bp, Homo sapiens
ggggccttttctgaatgtggaa

SEQ ID NO: 7865671 - DNA, 22 bp, Homo sapiens
ggggccttggatctgtgccccg

SEQ ID NO: 7865672 - DNA, 22 bp, Homo sapiens
ggggccttttctgaatgtggaa

SEQ ID NO: 7865673 - DNA, 22 bp, Homo sapiens
ggggccttggatctgtgccccg

SEQ ID NO: 7865674 - DNA, 22 bp, Homo sapiens
ggggccttggatctgtgccccg

SEQ ID NO: 7865675 - DNA, 22 bp, Homo sapiens
ggggccttggatctgtgccccg

SEQ ID NO: 7865676 - DNA, 22 bp, Homo sapiens
ggggccttggatctgtgccccg

SEQ ID NO: 7865677 - DNA, 22 bp, Homo sapiens
ggggtgagctgggcctgtgcct

SEQ ID NO: 7865678 - DNA, 22 bp, Homo sapiens
ggggccttttctgaatgtggaa

SEQ ID NO: 7865679 - DNA, 22 bp, Homo sapiens
ggggtgagtgctcagccccgga

SEQ ID NO: 7865680 - DNA, 22 bp, Homo sapiens
ggggcagatggaacagagcaca

SEQ ID NO: 7865681 - DNA, 22 bp, Homo sapiens
ggggcagatggaacagagcaca

SEQ ID NO: 7865682 - DNA, 22 bp, Homo sapiens
ggggcagatggaacagagcaca

SEQ ID NO: 7865683 - DNA, 22 bp, Homo sapiens
ggggcagatggaacagagcaca

SEQ ID NO: 7865684 - DNA, 22 bp, Homo sapiens
ggggcagatggaacagagcaca

SEQ ID NO: 7865685 - DNA, 22 bp, Homo sapiens
ggggcagagtctggactgttgt

SEQ ID NO: 7865686 - DNA, 22 bp, Homo sapiens
ggggcagagtctggactgttgt

SEQ ID NO: 7865687 - DNA, 22 bp, Homo sapiens
ggggcagctaccggaagtaggg

SEQ ID NO: 7865688 - DNA, 22 bp, Homo sapiens
ggggcagctaccggaagtaggg

SEQ ID NO: 7865689 - DNA, 22 bp, Homo sapiens
ggggcagctaccggaagtaggg

SEQ ID NO: 7865690 - DNA, 22 bp, Homo sapiens
ggggcagcctccaggaaagctg

SEQ ID NO: 7865691 - DNA, 22 bp, Homo sapiens
ggggcagatggaacagagcaca

SEQ ID NO: 7865692 - DNA, 21 bp, Homo sapiens
ggggcctctccacacagccgg

SEQ ID NO: 7865693 - DNA, 22 bp, Homo sapiens
ggggcctctgcagtcacgctgg

SEQ ID NO: 7865694 - DNA, 22 bp, Homo sapiens
ggggcctctgcagtcacgctgg

SEQ ID NO: 7865695 - DNA, 22 bp, Homo sapiens
ggggcctctgcagtcacgctgg

SEQ ID NO: 7865696 - DNA, 22 bp, Homo sapiens
ggggcctcgccgccgcctctgc

SEQ ID NO: 7865697 - DNA, 22 bp, Homo sapiens
ggggcctcgccgccgcctctgc

SEQ ID NO: 7865698 - DNA, 22 bp, Homo sapiens
ggggcctcgccgccgcctctgc

SEQ ID NO: 7865699 - DNA, 21 bp, Homo sapiens
ggggcctctccacacagccgg

SEQ ID NO: 7865700 - DNA, 22 bp, Homo sapiens
ggggcctctgcagtcacgctgg

SEQ ID NO: 7865701 - DNA, 22 bp, Homo sapiens
ggggcctctgggaacccctgtg

SEQ ID NO: 7865702 - DNA, 23 bp, Homo sapiens
ggggcctgcaccggtctgcgcgg

SEQ ID NO: 7865703 - DNA, 23 bp, Homo sapiens
ggggcctgcaccggtctgcgcgg

SEQ ID NO: 7865704 - DNA, 21 bp, Homo sapiens
ggggcagagctaggccctgca

SEQ ID NO: 7865705 - DNA, 21 bp, Homo sapiens
ggggcagagctaggccctgca

SEQ ID NO: 7865706 - DNA, 21 bp, Homo sapiens
ggggcagagctaggccctgca

SEQ ID NO: 7865707 - DNA, 22 bp, Homo sapiens
ggggcagagcatagctccaatt

SEQ ID NO: 7865708 - DNA, 22 bp, Homo sapiens
ggggcagagtagctggggtgtg

SEQ ID NO: 7865709 - DNA, 22 bp, Homo sapiens
ggggcagagtagctggggtgtg

SEQ ID NO: 7865710 - DNA, 22 bp, Homo sapiens
ggggaggaagctctcagttcca

SEQ ID NO: 7865711 - DNA, 22 bp, Homo sapiens
ggggaggaagctctcagttcca

SEQ ID NO: 7865712 - DNA, 22 bp, Homo sapiens
ggggaggaagctctcagttcca

SEQ ID NO: 7865713 - DNA, 22 bp, Homo sapiens
ggggaggaagctctcagttcca

SEQ ID NO: 7865714 - DNA, 22 bp, Homo sapiens
ggggaggaagctctcagttcca

SEQ ID NO: 7865715 - DNA, 22 bp, Homo sapiens
ggggcagaagtagtgcccctga

SEQ ID NO: 7865716 - DNA, 22 bp, Homo sapiens
ggggcagaagtagtgcccctga

SEQ ID NO: 7865717 - DNA, 22 bp, Homo sapiens
ggggcagagagaaggaagcttg

SEQ ID NO: 7865718 - DNA, 22 bp, Homo sapiens
ggggcagagaataaaaacctaa

SEQ ID NO: 7865719 - DNA, 22 bp, Homo sapiens
ggggcagagagaaggaagcttg

SEQ ID NO: 7865720 - DNA, 22 bp, Homo sapiens
ggggcagagagaaggaagcttg

SEQ ID NO: 7865721 - DNA, 22 bp, Homo sapiens
cagagccagagacctgctgtgc

SEQ ID NO: 7865722 - DNA, 21 bp, Homo sapiens
cagagccagactgctgaattt

SEQ ID NO: 7865723 - DNA, 22 bp, Homo sapiens
cagagccagagacctgctgtgc

SEQ ID NO: 7865724 - DNA, 22 bp, Homo sapiens
cagagccagaactagaccttgt

SEQ ID NO: 7865725 - DNA, 22 bp, Homo sapiens
cagagccacttggagatgagaa

SEQ ID NO: 7865726 - DNA, 22 bp, Homo sapiens
cagagccacttggagatgagaa

SEQ ID NO: 7865727 - DNA, 21 bp, Homo sapiens
cagagccagactgctgaattt

SEQ ID NO: 7865728 - DNA, 22 bp, Homo sapiens
cagagccagaactagaccttgt

SEQ ID NO: 7865729 - DNA, 22 bp, Homo sapiens
cagagccactgtctgccaggca

SEQ ID NO: 7865730 - DNA, 22 bp, Homo sapiens
cagagccacttggagatgagaa

SEQ ID NO: 7865731 - DNA, 22 bp, Homo sapiens
cagagccactgtctgccaggca

SEQ ID NO: 7865732 - DNA, 22 bp, Homo sapiens
cagagccactgtctgccaggca

SEQ ID NO: 7865733 - DNA, 22 bp, Homo sapiens
cagagccactgtctgccaggca

SEQ ID NO: 7865734 - DNA, 22 bp, Homo sapiens
cagagccagcccactgttcccg

SEQ ID NO: 7865735 - DNA, 22 bp, Homo sapiens
gggctgagtgggcctcttactt

SEQ ID NO: 7865736 - DNA, 22 bp, Homo sapiens
cagagccagcagtggggacagg

SEQ ID NO: 7865737 - DNA, 22 bp, Homo sapiens
cagagccagagacctgctgtgc

SEQ ID NO: 7865738 - DNA, 22 bp, Homo sapiens
cagagccagagacctgctgtgc

SEQ ID NO: 7865739 - DNA, 22 bp, Homo sapiens
cagagccagcagtggggacagg

SEQ ID NO: 7865740 - DNA, 22 bp, Homo sapiens
gggctgagtgggcctcttactt

SEQ ID NO: 7865741 - DNA, 22 bp, Homo sapiens
gggctgagtgggcctcttactt

SEQ ID NO: 7865742 - DNA, 22 bp, Homo sapiens
gggctgagtgggcctcttactt

SEQ ID NO: 7865743 - DNA, 22 bp, Homo sapiens
gggctgagtgggcctcttactt

SEQ ID NO: 7865744 - DNA, 22 bp, Homo sapiens
gggctgagtgggcctcttactt

SEQ ID NO: 7865745 - DNA, 22 bp, Homo sapiens
cagagccagcccactgttcccg

SEQ ID NO: 7865746 - DNA, 22 bp, Homo sapiens
gggctggaggaccggcctcgga

SEQ ID NO: 7865747 - DNA, 22 bp, Homo sapiens
gggctggaggaccggcctcgga

SEQ ID NO: 7865748 - DNA, 19 bp, Homo sapiens
gggctggagggatagagcc

SEQ ID NO: 7865749 - DNA, 19 bp, Homo sapiens
gggctggagggatagagcc

SEQ ID NO: 7865750 - DNA, 22 bp, Homo sapiens
gggctggaggtgagcaggacag

SEQ ID NO: 7865751 - DNA, 22 bp, Homo sapiens
gggctggaggtgagcaggacag

SEQ ID NO: 7865752 - DNA, 22 bp, Homo sapiens
gggctggaggtgagcaggacag

SEQ ID NO: 7865753 - DNA, 22 bp, Homo sapiens
gggctggaggtgagcaggacag

SEQ ID NO: 7865754 - DNA, 22 bp, Homo sapiens
gggctggaggtgagcaggacag

SEQ ID NO: 7865755 - DNA, 22 bp, Homo sapiens
gggctggaggtgagcaggacag

SEQ ID NO: 7865756 - DNA, 22 bp, Homo sapiens
gggctggaggtgagcaggacag

SEQ ID NO: 7865757 - DNA, 22 bp, Homo sapiens
gggctggaggtgagcaggacag

SEQ ID NO: 7865758 - DNA, 22 bp, Homo sapiens
gggctggaggtgagcaggacag

SEQ ID NO: 7865759 - DNA, 22 bp, Homo sapiens
gggctggaggtgagcaggacag

SEQ ID NO: 7865760 - DNA, 22 bp, Homo sapiens
gggctggagtcttctgaaagcc

SEQ ID NO: 7865761 - DNA, 22 bp, Homo sapiens
gggctggagtcttctgaaagcc

SEQ ID NO: 7865762 - DNA, 22 bp, Homo sapiens
gggctggagtcttctgaaagcc

SEQ ID NO: 7865763 - DNA, 22 bp, Homo sapiens
gggctggagttgggaagacaaa

SEQ ID NO: 7865764 - DNA, 22 bp, Homo sapiens
gggctggagtcttctgaaagcc

SEQ ID NO: 7865765 - DNA, 19 bp, Homo sapiens
gggctggagggatagagcc

SEQ ID NO: 7865766 - DNA, 19 bp, Homo sapiens
gggctggagggatagagcc

SEQ ID NO: 7865767 - DNA, 22 bp, Homo sapiens
gggctggaggcctgcctggtta

SEQ ID NO: 7865768 - DNA, 19 bp, Homo sapiens
gggctggagggatagagcc

SEQ ID NO: 7865769 - DNA, 22 bp, Homo sapiens
gggctggaggcctgcctggtta

SEQ ID NO: 7865770 - DNA, 22 bp, Homo sapiens
gggctggaggcctgcctggtta

SEQ ID NO: 7865771 - DNA, 21 bp, Homo sapiens
gggctggaggatgggaagccc

SEQ ID NO: 7865772 - DNA, 21 bp, Homo sapiens
gggctggaggatgggaagccc

SEQ ID NO: 7865773 - DNA, 21 bp, Homo sapiens
gggctggaggatgggaagccc

SEQ ID NO: 7865774 - DNA, 21 bp, Homo sapiens
gggctggaggatgggaagccc

SEQ ID NO: 7865775 - DNA, 22 bp, Homo sapiens
gggctggaggagatccagaggc

SEQ ID NO: 7865776 - DNA, 22 bp, Homo sapiens
gggctggaggagatccagaggc

SEQ ID NO: 7865777 - DNA, 22 bp, Homo sapiens
gggctggaggagatccagaggc

SEQ ID NO: 7865778 - DNA, 22 bp, Homo sapiens
gggctggaggagatccagaggc

SEQ ID NO: 7865779 - DNA, 22 bp, Homo sapiens
gggctggagttgggaagacaaa

SEQ ID NO: 7865780 - DNA, 22 bp, Homo sapiens
gggctggagttgggaagacaaa

SEQ ID NO: 7865781 - DNA, 22 bp, Homo sapiens
gggctggagttgggaagacaaa

SEQ ID NO: 7865782 - DNA, 22 bp, Homo sapiens
gggctggagttgggaagacaaa

SEQ ID NO: 7865783 - DNA, 22 bp, Homo sapiens
gggctggagttgggaagacaaa

SEQ ID NO: 7865784 - DNA, 21 bp, Homo sapiens
gggctggatattggaaagagg

SEQ ID NO: 7865785 - DNA, 21 bp, Homo sapiens
gggctggatattggaaagagg

SEQ ID NO: 7865786 - DNA, 20 bp, Homo sapiens
gggctggataattctttgct

SEQ ID NO: 7865787 - DNA, 20 bp, Homo sapiens
gggctggataattctttgct

SEQ ID NO: 7865788 - DNA, 21 bp, Homo sapiens
gggctggatattggaaagagg

SEQ ID NO: 7865789 - DNA, 22 bp, Homo sapiens
gggctggatctcacgtgagacc

SEQ ID NO: 7865790 - DNA, 22 bp, Homo sapiens
gggctggatctcacgtgagacc

SEQ ID NO: 7865791 - DNA, 22 bp, Homo sapiens
gggctggatctcacgtgagacc

SEQ ID NO: 7865792 - DNA, 22 bp, Homo sapiens
gggctggatctcacgtgagacc

SEQ ID NO: 7865793 - DNA, 22 bp, Homo sapiens
gggctgtaggagctggaatggg

SEQ ID NO: 7865794 - DNA, 22 bp, Homo sapiens
gggctgtaggagctggaatggg

SEQ ID NO: 7865795 - DNA, 22 bp, Homo sapiens
gggctgtaggagctggaatggg

SEQ ID NO: 7865796 - DNA, 22 bp, Homo sapiens
gggctgtaggagctggaatggg

SEQ ID NO: 7865797 - DNA, 22 bp, Homo sapiens
gggctggatctcacgtgagacc

SEQ ID NO: 7865798 - DNA, 22 bp, Homo sapiens
gggctgtgagagtggggctgct

SEQ ID NO: 7865799 - DNA, 18 bp, Homo sapiens
gggctgtgagatgggaag

SEQ ID NO: 7865800 - DNA, 18 bp, Homo sapiens
gggctgtgagatgggaag

SEQ ID NO: 7865801 - DNA, 22 bp, Homo sapiens
gggctgtgagagtggggctgct

SEQ ID NO: 7865802 - DNA, 22 bp, Homo sapiens
gggctgtgagagtggggctgct

SEQ ID NO: 7865803 - DNA, 22 bp, Homo sapiens
gggctgtccgcacatctggaat

SEQ ID NO: 7865804 - DNA, 22 bp, Homo sapiens
gggctgtaggagctggaatggg

SEQ ID NO: 7865805 - DNA, 22 bp, Homo sapiens
gggctgtcacgcccctgcacct

SEQ ID NO: 7865806 - DNA, 22 bp, Homo sapiens
gggctgtgaggtgagaacttac

SEQ ID NO: 7865807 - DNA, 22 bp, Homo sapiens
gggctgtgaggtgagaacttac

SEQ ID NO: 7865808 - DNA, 22 bp, Homo sapiens
gggctgtgcctcaggtggggtc

SEQ ID NO: 7865809 - DNA, 22 bp, Homo sapiens
gggctgtgctgagtaggaggtg

SEQ ID NO: 7865810 - DNA, 22 bp, Homo sapiens
gggctgtgctgagtaggaggtg

SEQ ID NO: 7865811 - DNA, 22 bp, Homo sapiens
gggctgtgctgagtaggaggtg

SEQ ID NO: 7865812 - DNA, 20 bp, Homo sapiens
gggctgtgcctcctcgtggt

SEQ ID NO: 7865813 - DNA, 22 bp, Homo sapiens
gggctgtgctgagtaggaggtg

SEQ ID NO: 7865814 - DNA, 22 bp, Homo sapiens
gggctgtgtaatgtgctctttt

SEQ ID NO: 7865815 - DNA, 22 bp, Homo sapiens
gggctgtgtactatgaggaggg

SEQ ID NO: 7865816 - DNA, 22 bp, Homo sapiens
gggctgtgtactatgaggaggg

SEQ ID NO: 7865817 - DNA, 22 bp, Homo sapiens
gggctgtgtaatgtgctctttt

SEQ ID NO: 7865818 - DNA, 22 bp, Homo sapiens
gggctgtgtaatgtgctctttt

SEQ ID NO: 7865819 - DNA, 22 bp, Homo sapiens
gggctgtgtactatgaggaggg

SEQ ID NO: 7865820 - DNA, 22 bp, Homo sapiens
gggctgtggagccgcgagggct

SEQ ID NO: 7865821 - DNA, 22 bp, Homo sapiens
gggctgtggagccgcgagggct

SEQ ID NO: 7865822 - DNA, 22 bp, Homo sapiens
gggctgtggagccgcgagggct

SEQ ID NO: 7865823 - DNA, 22 bp, Homo sapiens
gggcaggggtcagtggccccaa

SEQ ID NO: 7865824 - DNA, 22 bp, Homo sapiens
gggcaggggtcagtggccccaa

SEQ ID NO: 7865825 - DNA, 22 bp, Homo sapiens
gggcaggggtcagtggccccaa

SEQ ID NO: 7865826 - DNA, 22 bp, Homo sapiens
gggcaggggtcagtggccccaa

SEQ ID NO: 7865827 - DNA, 22 bp, Homo sapiens
gggcaggtacaagatgcttctt

SEQ ID NO: 7865828 - DNA, 22 bp, Homo sapiens
gggcaggtactgggtggtgagc

SEQ ID NO: 7865829 - DNA, 22 bp, Homo sapiens
gggcaggtactgggtggtgagc

SEQ ID NO: 7865830 - DNA, 22 bp, Homo sapiens
gggcaggtacaagatgcttctt

SEQ ID NO: 7865831 - DNA, 22 bp, Homo sapiens
gggcaggtacaagatgcttctt

SEQ ID NO: 7865832 - DNA, 22 bp, Homo sapiens
cagagcaggggtttcccaggtt

SEQ ID NO: 7865833 - DNA, 22 bp, Homo sapiens
cagagcaggggtttcccaggtt

SEQ ID NO: 7865834 - DNA, 22 bp, Homo sapiens
cagagcaggggtttcccaggtt

SEQ ID NO: 7865835 - DNA, 22 bp, Homo sapiens
gggcaggtactgggtggtgagc

SEQ ID NO: 7865836 - DNA, 22 bp, Homo sapiens
cagagcagtgaggagttgtgta

SEQ ID NO: 7865837 - DNA, 22 bp, Homo sapiens
cagagcagtgaggagttgtgta

SEQ ID NO: 7865838 - DNA, 22 bp, Homo sapiens
cagagcaggggtttcccaggtt

SEQ ID NO: 7865839 - DNA, 22 bp, Homo sapiens
cagagcaggcccactgccctcc

SEQ ID NO: 7865840 - DNA, 22 bp, Homo sapiens
cagagcaggcccactgccctcc

SEQ ID NO: 7865841 - DNA, 22 bp, Homo sapiens
cagagcaggggtttcccaggtt

SEQ ID NO: 7865842 - DNA, 22 bp, Homo sapiens
cagagcaggcccactgccctcc

SEQ ID NO: 7865843 - DNA, 22 bp, Homo sapiens
gggcaggtactgggtggtgagc

SEQ ID NO: 7865844 - DNA, 18 bp, Homo sapiens
cagagcagaggtggagcg

SEQ ID NO: 7865845 - DNA, 18 bp, Homo sapiens
cagagcagaggtggagcg

SEQ ID NO: 7865846 - DNA, 18 bp, Homo sapiens
cagagcagaggtggagcg

SEQ ID NO: 7865847 - DNA, 22 bp, Homo sapiens
cagagcagacgttgagattaag

SEQ ID NO: 7865848 - DNA, 22 bp, Homo sapiens
cagagcagacgttgagattaag

SEQ ID NO: 7865849 - DNA, 22 bp, Homo sapiens
cagagcagacgttgagattaag

SEQ ID NO: 7865850 - DNA, 22 bp, Homo sapiens
cagagcagacgttgagattaag

SEQ ID NO: 7865851 - DNA, 22 bp, Homo sapiens
cagagcagacgttgagattaag

SEQ ID NO: 7865852 - DNA, 22 bp, Homo sapiens
cagagcagaagcggtcctcaca

SEQ ID NO: 7865853 - DNA, 22 bp, Homo sapiens
cagagcagaagcggtcctcaca

SEQ ID NO: 7865854 - DNA, 22 bp, Homo sapiens
cagagcagaagcggtcctcaca

SEQ ID NO: 7865855 - DNA, 22 bp, Homo sapiens
cagagcagaagcggtcctcaca

SEQ ID NO: 7865856 - DNA, 22 bp, Homo sapiens
cagagcagaaggtccaagcctg

SEQ ID NO: 7865857 - DNA, 22 bp, Homo sapiens
cagagcagaaggtccaagcctg

SEQ ID NO: 7865858 - DNA, 22 bp, Homo sapiens
cagagcagaaggtccaagcctg

SEQ ID NO: 7865859 - DNA, 22 bp, Homo sapiens
cagagcagaaggtccaagcctg

SEQ ID NO: 7865860 - DNA, 22 bp, Homo sapiens
cagagcagaaggtccaagcctg

SEQ ID NO: 7865861 - DNA, 22 bp, Homo sapiens
cagagcagaaggtccaagcctg

SEQ ID NO: 7865862 - DNA, 22 bp, Homo sapiens
cagagcagaaggtccaagcctg

SEQ ID NO: 7865863 - DNA, 22 bp, Homo sapiens
gggcaggggtcagtggccccaa

SEQ ID NO: 7865864 - DNA, 22 bp, Homo sapiens
gggcaggggtcagtggccccaa

SEQ ID NO: 7865865 - DNA, 22 bp, Homo sapiens
gggcaggggtcagtggccccaa

SEQ ID NO: 7865866 - DNA, 22 bp, Homo sapiens
gggcaggggtcagtggccccaa

SEQ ID NO: 7865867 - DNA, 22 bp, Homo sapiens
gggcaggggtagcattccaagt

SEQ ID NO: 7865868 - DNA, 22 bp, Homo sapiens
gggcaggggtagcattccaagt

SEQ ID NO: 7865869 - DNA, 22 bp, Homo sapiens
gggcaggggtagcattccaagt

SEQ ID NO: 7865870 - DNA, 18 bp, Homo sapiens
cagagcagaggtggagcg

SEQ ID NO: 7865871 - DNA, 18 bp, Homo sapiens
cagagcagaggtggagcg

SEQ ID NO: 7865872 - DNA, 17 bp, Homo sapiens
gggcagggactcctggg

SEQ ID NO: 7865873 - DNA, 19 bp, Homo sapiens
cagagcagtggttcctgaa

SEQ ID NO: 7865874 - DNA, 19 bp, Homo sapiens
cagagcagtggttcctgaa

SEQ ID NO: 7865875 - DNA, 22 bp, Homo sapiens
cagagcatgaataaaagttaca

SEQ ID NO: 7865876 - DNA, 22 bp, Homo sapiens
cagagcatcgcgcagagagcct

SEQ ID NO: 7865877 - DNA, 22 bp, Homo sapiens
cagagcatcgcgcagagagcct

SEQ ID NO: 7865878 - DNA, 19 bp, Homo sapiens
cagagcagtggttcctgaa

SEQ ID NO: 7865879 - DNA, 19 bp, Homo sapiens
cagagcagtggttcctgaa

SEQ ID NO: 7865880 - DNA, 19 bp, Homo sapiens
cagagcagtggttcctgaa

SEQ ID NO: 7865881 - DNA, 22 bp, Homo sapiens
cagagcagtggggttggtcaga

SEQ ID NO: 7865882 - DNA, 19 bp, Homo sapiens
cagagcagtggttcctgaa

SEQ ID NO: 7865883 - DNA, 22 bp, Homo sapiens
cagagcagtggggttggtcaga

SEQ ID NO: 7865884 - DNA, 22 bp, Homo sapiens
cagagcagtggggttggtcaga

SEQ ID NO: 7865885 - DNA, 20 bp, Homo sapiens
cagagcagtgcccaggcggc

SEQ ID NO: 7865886 - DNA, 20 bp, Homo sapiens
cagagcagtgcccaggcggc

SEQ ID NO: 7865887 - DNA, 20 bp, Homo sapiens
cagagcagtgcccaggcggc

SEQ ID NO: 7865888 - DNA, 20 bp, Homo sapiens
cagagcagtgcccaggcggc

SEQ ID NO: 7865889 - DNA, 22 bp, Homo sapiens
cagagcagtgaggagttgtgta

SEQ ID NO: 7865890 - DNA, 22 bp, Homo sapiens
cagagcagtgaggagttgtgta

SEQ ID NO: 7865891 - DNA, 22 bp, Homo sapiens
cagagcagtgaggagttgtgta

SEQ ID NO: 7865892 - DNA, 22 bp, Homo sapiens
cagagcagtgaggagttgtgta

SEQ ID NO: 7865893 - DNA, 22 bp, Homo sapiens
cagagcagtggagagtaggtct

SEQ ID NO: 7865894 - DNA, 22 bp, Homo sapiens
cagagcagtggagagtaggtct

SEQ ID NO: 7865895 - DNA, 22 bp, Homo sapiens
cagagcagtggagagtaggtct

SEQ ID NO: 7865896 - DNA, 22 bp, Homo sapiens
cagagcagtggagagtaggtct

SEQ ID NO: 7865897 - DNA, 20 bp, Homo sapiens
cagagcagtgcccaggcggc

SEQ ID NO: 7865898 - DNA, 20 bp, Homo sapiens
cagagcagtgcccaggcggc

SEQ ID NO: 7865899 - DNA, 20 bp, Homo sapiens
cagagcagtgcccaggcggc

SEQ ID NO: 7865900 - DNA, 20 bp, Homo sapiens
cagagcagtgcccaggcggc

SEQ ID NO: 7865901 - DNA, 22 bp, Homo sapiens
cagagccaaacctcagggcccg

SEQ ID NO: 7865902 - DNA, 22 bp, Homo sapiens
cagagccaaacctcagggcccg

SEQ ID NO: 7865903 - DNA, 22 bp, Homo sapiens
cagagccaaacctcagggcccg

SEQ ID NO: 7865904 - DNA, 22 bp, Homo sapiens
cagagccaaatgctgtggttat

SEQ ID NO: 7865905 - DNA, 22 bp, Homo sapiens
cagagccaaatgctgtggttat

SEQ ID NO: 7865906 - DNA, 22 bp, Homo sapiens
cagagccaacgccacctgccca

SEQ ID NO: 7865907 - DNA, 20 bp, Homo sapiens
cagagccaagagcagcatct

SEQ ID NO: 7865908 - DNA, 20 bp, Homo sapiens
cagagccaagagcagcatct

SEQ ID NO: 7865909 - DNA, 22 bp, Homo sapiens
cagagccactgtctgccaggca

SEQ ID NO: 7865910 - DNA, 22 bp, Homo sapiens
cagagccactgcattttacagc

SEQ ID NO: 7865911 - DNA, 22 bp, Homo sapiens
cagagccacagcctccagattt

SEQ ID NO: 7865912 - DNA, 22 bp, Homo sapiens
cagagccacagcctccagattt

SEQ ID NO: 7865913 - DNA, 20 bp, Homo sapiens
cagagccaagagcagcatct

SEQ ID NO: 7865914 - DNA, 20 bp, Homo sapiens
cagagccaagagcagcatct

SEQ ID NO: 7865915 - DNA, 20 bp, Homo sapiens
cagagccaagagcagcatct

SEQ ID NO: 7865916 - DNA, 20 bp, Homo sapiens
cagagccaagagcagcatct

SEQ ID NO: 7865917 - DNA, 22 bp, Homo sapiens
cagagacacttaacaggaatgg

SEQ ID NO: 7865918 - DNA, 22 bp, Homo sapiens
gggatctgatttaggatgggag

SEQ ID NO: 7865919 - DNA, 22 bp, Homo sapiens
gggatctgctccagagggaaaa

SEQ ID NO: 7865920 - DNA, 22 bp, Homo sapiens
cagagacagaaaatggatctag

SEQ ID NO: 7865921 - DNA, 22 bp, Homo sapiens
cagagacagaaaatggatctag

SEQ ID NO: 7865922 - DNA, 22 bp, Homo sapiens
cagagacagaaaatggatctag

SEQ ID NO: 7865923 - DNA, 22 bp, Homo sapiens
cagagacagaaaatggatctag

SEQ ID NO: 7865924 - DNA, 22 bp, Homo sapiens
cagagacacttaacaggaatgg

SEQ ID NO: 7865925 - DNA, 22 bp, Homo sapiens
cagagacaccccagaaaataag

SEQ ID NO: 7865926 - DNA, 22 bp, Homo sapiens
cagagacacttaacaggaatgg

SEQ ID NO: 7865927 - DNA, 22 bp, Homo sapiens
cagagacacttaacaggaatgg

SEQ ID NO: 7865928 - DNA, 22 bp, Homo sapiens
cagagacacttaacaggaatgg

SEQ ID NO: 7865929 - DNA, 22 bp, Homo sapiens
cagagacacttaacaggaatgg

SEQ ID NO: 7865930 - DNA, 22 bp, Homo sapiens
cagagacaacctggtagagaaa

SEQ ID NO: 7865931 - DNA, 22 bp, Homo sapiens
cagagacaacctggtagagaaa

SEQ ID NO: 7865932 - DNA, 22 bp, Homo sapiens
cagagacaacctggtagagaaa

SEQ ID NO: 7865933 - DNA, 22 bp, Homo sapiens
cagagacaacctggtagagaaa

SEQ ID NO: 7865934 - DNA, 22 bp, Homo sapiens
cagagacaacctggtagagaaa

SEQ ID NO: 7865935 - DNA, 22 bp, Homo sapiens
cagagacaacctggtagagaaa

SEQ ID NO: 7865936 - DNA, 22 bp, Homo sapiens
cagagacaatgtctctgcttgt

SEQ ID NO: 7865937 - DNA, 22 bp, Homo sapiens
cagagacaatgtctctgcttgt

SEQ ID NO: 7865938 - DNA, 22 bp, Homo sapiens
cagagacaccccagaaaataag

SEQ ID NO: 7865939 - DNA, 22 bp, Homo sapiens
cagagacaccccagaaaataag

SEQ ID NO: 7865940 - DNA, 22 bp, Homo sapiens
cagagacaatgtctctgcttgt

SEQ ID NO: 7865941 - DNA, 22 bp, Homo sapiens
cagagacaatgtctctgcttgt

SEQ ID NO: 7865942 - DNA, 22 bp, Homo sapiens
cagagaacttagctagttttcc

SEQ ID NO: 7865943 - DNA, 22 bp, Homo sapiens
cagagaactccagtggctggcg

SEQ ID NO: 7865944 - DNA, 22 bp, Homo sapiens
cagagaactccagtggctggcg

SEQ ID NO: 7865945 - DNA, 22 bp, Homo sapiens
gggaggcatgtgttatccactt

SEQ ID NO: 7865946 - DNA, 20 bp, Homo sapiens
gggaggcattggtccctcac

SEQ ID NO: 7865947 - DNA, 20 bp, Homo sapiens
gggaggcattggtccctcac

SEQ ID NO: 7865948 - DNA, 20 bp, Homo sapiens
gggaggcattggtccctcac

SEQ ID NO: 7865949 - DNA, 20 bp, Homo sapiens
gggaggcattggtccctcac

SEQ ID NO: 7865950 - DNA, 20 bp, Homo sapiens
gggaggcattggtccctcac

SEQ ID NO: 7865951 - DNA, 22 bp, Homo sapiens
cagagaagagtctggcctctct

SEQ ID NO: 7865952 - DNA, 22 bp, Homo sapiens
cagagaagagtctggcctctct

SEQ ID NO: 7865953 - DNA, 22 bp, Homo sapiens
cagagaagagtctggcctctct

SEQ ID NO: 7865954 - DNA, 22 bp, Homo sapiens
cagagaagagtctggcctctct

SEQ ID NO: 7865955 - DNA, 22 bp, Homo sapiens
cagagaagaaagtgactataat

SEQ ID NO: 7865956 - DNA, 22 bp, Homo sapiens
cagagaagaaagtgactataat

SEQ ID NO: 7865957 - DNA, 22 bp, Homo sapiens
cagagaagaaagtgactataat

SEQ ID NO: 7865958 - DNA, 22 bp, Homo sapiens
cagagaagaaagtgactataat

SEQ ID NO: 7865959 - DNA, 22 bp, Homo sapiens
cagagaagagtctggcctctct

SEQ ID NO: 7865960 - DNA, 22 bp, Homo sapiens
cagagaagagtctggcctctct

SEQ ID NO: 7865961 - DNA, 22 bp, Homo sapiens
cagagacaacctggtagagaaa

SEQ ID NO: 7865962 - DNA, 22 bp, Homo sapiens
cagagacaacaagtttaactat

SEQ ID NO: 7865963 - DNA, 22 bp, Homo sapiens
cagagacaacaagtttaactat

SEQ ID NO: 7865964 - DNA, 22 bp, Homo sapiens
cagagacaacaagtttaactat

SEQ ID NO: 7865965 - DNA, 22 bp, Homo sapiens
gggatgagagctgggacagaag

SEQ ID NO: 7865966 - DNA, 22 bp, Homo sapiens
gggatgagagctgggacagaag

SEQ ID NO: 7865967 - DNA, 22 bp, Homo sapiens
gggatgagagctgggacagaag

SEQ ID NO: 7865968 - DNA, 22 bp, Homo sapiens
gggatgagagctgggacagaag

SEQ ID NO: 7865969 - DNA, 22 bp, Homo sapiens
gggatgagagtagggtgtgaaa

SEQ ID NO: 7865970 - DNA, 22 bp, Homo sapiens
gggatgagagtagggtgtgaaa

SEQ ID NO: 7865971 - DNA, 22 bp, Homo sapiens
gggatgagagctgggacagaag

SEQ ID NO: 7865972 - DNA, 22 bp, Homo sapiens
gggatgagagctgggacagaag

SEQ ID NO: 7865973 - DNA, 22 bp, Homo sapiens
gggatgacagctatggaactct

SEQ ID NO: 7865974 - DNA, 22 bp, Homo sapiens
gggatgaattgagtcagaaggg

SEQ ID NO: 7865975 - DNA, 22 bp, Homo sapiens
gggatgacaattcaagggctgg

SEQ ID NO: 7865976 - DNA, 22 bp, Homo sapiens
gggatctgtgttgcgatggatt

SEQ ID NO: 7865977 - DNA, 20 bp, Homo sapiens
gggatcttccaggctctcct

SEQ ID NO: 7865978 - DNA, 22 bp, Homo sapiens
gggatcttgaaacagctggatt

SEQ ID NO: 7865979 - DNA, 22 bp, Homo sapiens
gggatcttgggaacacccttac

SEQ ID NO: 7865980 - DNA, 21 bp, Homo sapiens
gggatcttgtactggcgtgga

SEQ ID NO: 7865981 - DNA, 22 bp, Homo sapiens
gggatctttctgatgctgtggc

SEQ ID NO: 7865982 - DNA, 22 bp, Homo sapiens
gggatcttgtttaatattgttt

SEQ ID NO: 7865983 - DNA, 22 bp, Homo sapiens
gggatcttgtttaatattgttt

SEQ ID NO: 7865984 - DNA, 22 bp, Homo sapiens
gggatgaattgagtcagaaggg

SEQ ID NO: 7865985 - DNA, 22 bp, Homo sapiens
gggatgaattgagtcagaaggg

SEQ ID NO: 7865986 - DNA, 23 bp, Homo sapiens
gggatctgtaagttgaagacaaa

SEQ ID NO: 7865987 - DNA, 23 bp, Homo sapiens
gggatctgtaaacctggagaacc

SEQ ID NO: 7865988 - DNA, 22 bp, Homo sapiens
gggatctggaattttggtatgt

SEQ ID NO: 7865989 - DNA, 22 bp, Homo sapiens
gggatctgggacaacaggtggt

SEQ ID NO: 7865990 - DNA, 22 bp, Homo sapiens
cagagcactgcttggaggattt

SEQ ID NO: 7865991 - DNA, 22 bp, Homo sapiens
cagagcacctgctcattgccag

SEQ ID NO: 7865992 - DNA, 22 bp, Homo sapiens
cagagcactgcttggaggattt

SEQ ID NO: 7865993 - DNA, 22 bp, Homo sapiens
cagagcactgcttggaggattt

SEQ ID NO: 7865994 - DNA, 22 bp, Homo sapiens
cagagcacctgctcattgccag

SEQ ID NO: 7865995 - DNA, 22 bp, Homo sapiens
cagagaggatggattccatagc

SEQ ID NO: 7865996 - DNA, 22 bp, Homo sapiens
gggatgagagtagggtgtgaaa

SEQ ID NO: 7865997 - DNA, 22 bp, Homo sapiens
gggatgagagtagggtgtgaaa

SEQ ID NO: 7865998 - DNA, 22 bp, Homo sapiens
gggatgagagtagggtgtgaaa

SEQ ID NO: 7865999 - DNA, 22 bp, Homo sapiens
cagagaggaggctatatgcaaa

SEQ ID NO: 7866000 - DNA, 22 bp, Homo sapiens
cagagaggaggctatatgcaaa

SEQ ID NO: 7866001 - DNA, 22 bp, Homo sapiens
cagagcagaagcggtcctcaca

SEQ ID NO: 7866002 - DNA, 22 bp, Homo sapiens
cagagcagaagcggtcctcaca

SEQ ID NO: 7866003 - DNA, 22 bp, Homo sapiens
cagagcagaagcggtcctcaca

SEQ ID NO: 7866004 - DNA, 22 bp, Homo sapiens
cagagcagaagcggtcctcaca

SEQ ID NO: 7866005 - DNA, 22 bp, Homo sapiens
cagagcagaagcggtcctcaca

SEQ ID NO: 7866006 - DNA, 22 bp, Homo sapiens
cagagcagaagcggtcctcaca

SEQ ID NO: 7866007 - DNA, 22 bp, Homo sapiens
cagagcagaagcggtcctcaca

SEQ ID NO: 7866008 - DNA, 22 bp, Homo sapiens
cagagcagaagcggtcctcaca

SEQ ID NO: 7866009 - DNA, 22 bp, Homo sapiens
cagagcagaaacctgggtgatt

SEQ ID NO: 7866010 - DNA, 22 bp, Homo sapiens
cagagcagaaacctgggtgatt

SEQ ID NO: 7866011 - DNA, 22 bp, Homo sapiens
cagagcagaaacctgggtgatt

SEQ ID NO: 7866012 - DNA, 22 bp, Homo sapiens
cagagcactgcttggaggattt

SEQ ID NO: 7866013 - DNA, 22 bp, Homo sapiens
cagagcagaaacctgggtgatt

SEQ ID NO: 7866014 - DNA, 22 bp, Homo sapiens
cagacacacaagcaatctaagt

SEQ ID NO: 7866015 - DNA, 22 bp, Homo sapiens
cagacacacaagcaatctaagt

SEQ ID NO: 7866016 - DNA, 22 bp, Homo sapiens
cagacacacaccctggcctagc

SEQ ID NO: 7866017 - DNA, 22 bp, Homo sapiens
cagacacagatatgcatatggc

SEQ ID NO: 7866018 - DNA, 22 bp, Homo sapiens
cagacacagatatgcatatggc

SEQ ID NO: 7866019 - DNA, 22 bp, Homo sapiens
cagacacagatatgcatatggc

SEQ ID NO: 7866020 - DNA, 22 bp, Homo sapiens
cagacacagatatgcatatggc

SEQ ID NO: 7866021 - DNA, 22 bp, Homo sapiens
cagacacagatatgcatatggc

SEQ ID NO: 7866022 - DNA, 22 bp, Homo sapiens
cagacacaccaggcccattctg

SEQ ID NO: 7866023 - DNA, 22 bp, Homo sapiens
cagacacaccaggcccattctg

SEQ ID NO: 7866024 - DNA, 22 bp, Homo sapiens
cagacacagatatgcatatggc

SEQ ID NO: 7866025 - DNA, 22 bp, Homo sapiens
cagacacagatatgcatatggc

SEQ ID NO: 7866026 - DNA, 22 bp, Homo sapiens
cagacactaggtgacagagtgc

SEQ ID NO: 7866027 - DNA, 22 bp, Homo sapiens
cagacactaggtgacagagtgc

SEQ ID NO: 7866028 - DNA, 22 bp, Homo sapiens
cagacactaggtgacagagtgc

SEQ ID NO: 7866029 - DNA, 18 bp, Homo sapiens
cagacactctgctctgca

SEQ ID NO: 7866030 - DNA, 18 bp, Homo sapiens
cagacactctgctctgca

SEQ ID NO: 7866031 - DNA, 18 bp, Homo sapiens
cagacactctgctctgca

SEQ ID NO: 7866032 - DNA, 18 bp, Homo sapiens
cagacactctgctctgca

SEQ ID NO: 7866033 - DNA, 22 bp, Homo sapiens
cagacactatgctaaggtacta

SEQ ID NO: 7866034 - DNA, 22 bp, Homo sapiens
cagacactatgctaaggtacta

SEQ ID NO: 7866035 - DNA, 22 bp, Homo sapiens
cagacactattgtgtataaatc

SEQ ID NO: 7866036 - DNA, 22 bp, Homo sapiens
cagacactattgtgtataaatc

SEQ ID NO: 7866037 - DNA, 22 bp, Homo sapiens
cagacactattgtgtataaatc

SEQ ID NO: 7866038 - DNA, 22 bp, Homo sapiens
gggagcataaactcagatttca

SEQ ID NO: 7866039 - DNA, 22 bp, Homo sapiens
gggagcatttattttccgttag

SEQ ID NO: 7866040 - DNA, 22 bp, Homo sapiens
gggagcatttattttccgttag

SEQ ID NO: 7866041 - DNA, 22 bp, Homo sapiens
gggagccaaggagagaggcctt

SEQ ID NO: 7866042 - DNA, 22 bp, Homo sapiens
cagacagaaggaaggccaacat

SEQ ID NO: 7866043 - DNA, 22 bp, Homo sapiens
cagacagaaggctccttgaggt

SEQ ID NO: 7866044 - DNA, 22 bp, Homo sapiens
gggagcagttaaaatgattcct

SEQ ID NO: 7866045 - DNA, 22 bp, Homo sapiens
cagacagaaggaaggccaacat

SEQ ID NO: 7866046 - DNA, 18 bp, Homo sapiens
cagacactctgctctgca

SEQ ID NO: 7866047 - DNA, 22 bp, Homo sapiens
cagacactgcagcagtctccca

SEQ ID NO: 7866048 - DNA, 22 bp, Homo sapiens
cagacacttattgagcaagtac

SEQ ID NO: 7866049 - DNA, 22 bp, Homo sapiens
cagacacttattgagcaagtac

SEQ ID NO: 7866050 - DNA, 22 bp, Homo sapiens
cagacacttattgagcaagtac

SEQ ID NO: 7866051 - DNA, 22 bp, Homo sapiens
cagacacttattgagcaagtac

SEQ ID NO: 7866052 - DNA, 22 bp, Homo sapiens
cagacagaaggaaggccaacat

SEQ ID NO: 7866053 - DNA, 22 bp, Homo sapiens
gggagctgatcaggtggattca

SEQ ID NO: 7866054 - DNA, 22 bp, Homo sapiens
gggagccacagtagcagctact

SEQ ID NO: 7866055 - DNA, 22 bp, Homo sapiens
gggagccaaggagagaggcctt

SEQ ID NO: 7866056 - DNA, 22 bp, Homo sapiens
gggagccaaggagagaggcctt

SEQ ID NO: 7866057 - DNA, 22 bp, Homo sapiens
gggagctgatgatgtaagtccc

SEQ ID NO: 7866058 - DNA, 22 bp, Homo sapiens
gggagctgatcaggtggattca

SEQ ID NO: 7866059 - DNA, 22 bp, Homo sapiens
gggagctgcacacgccccggaa

SEQ ID NO: 7866060 - DNA, 22 bp, Homo sapiens
gggagctgcacacgccccggaa

SEQ ID NO: 7866061 - DNA, 22 bp, Homo sapiens
gggagctgatgatgtaagtccc

SEQ ID NO: 7866062 - DNA, 22 bp, Homo sapiens
gggagctgatgatgtaagtccc

SEQ ID NO: 7866063 - DNA, 22 bp, Homo sapiens
gggagctgcacacgccccggaa

SEQ ID NO: 7866064 - DNA, 22 bp, Homo sapiens
gggagctgcacacgccccggaa

SEQ ID NO: 7866065 - DNA, 22 bp, Homo sapiens
gggagctgccaccacccctggg

SEQ ID NO: 7866066 - DNA, 20 bp, Homo sapiens
gggagctggaattgtcttag

SEQ ID NO: 7866067 - DNA, 21 bp, Homo sapiens
gggagctggaaactgggtgac

SEQ ID NO: 7866068 - DNA, 21 bp, Homo sapiens
gggagctggaaactgggtgac

SEQ ID NO: 7866069 - DNA, 21 bp, Homo sapiens
gggagctggaaactgggtgac

SEQ ID NO: 7866070 - DNA, 21 bp, Homo sapiens
gggagctggaaactgggtgac

SEQ ID NO: 7866071 - DNA, 21 bp, Homo sapiens
gggagctggaaactgggtgac

SEQ ID NO: 7866072 - DNA, 22 bp, Homo sapiens
gggagctgccaccacccctggg

SEQ ID NO: 7866073 - DNA, 22 bp, Homo sapiens
gggagctgccaccacccctggg

SEQ ID NO: 7866074 - DNA, 22 bp, Homo sapiens
gggagctgccttagaccggagg

SEQ ID NO: 7866075 - DNA, 22 bp, Homo sapiens
gggagctgccttagaccggagg

SEQ ID NO: 7866076 - DNA, 22 bp, Homo sapiens
gggagctgccttagaccggagg

SEQ ID NO: 7866077 - DNA, 22 bp, Homo sapiens
gggagctgccttagaccggagg

SEQ ID NO: 7866078 - DNA, 22 bp, Homo sapiens
gggagctgcggtcttgcgaaga

SEQ ID NO: 7866079 - DNA, 22 bp, Homo sapiens
gggagctgctgaacacaagggt

SEQ ID NO: 7866080 - DNA, 22 bp, Homo sapiens
gggagctgcggtcttgcgaaga

SEQ ID NO: 7866081 - DNA, 22 bp, Homo sapiens
gggagctgctgaacacaagggt

SEQ ID NO: 7866082 - DNA, 22 bp, Homo sapiens
gggagctgctgaacacaagggt

SEQ ID NO: 7866083 - DNA, 22 bp, Homo sapiens
gggagctgctgaacacaagggt

SEQ ID NO: 7866084 - DNA, 22 bp, Homo sapiens
gggagctgctgaacacaagggt

SEQ ID NO: 7866085 - DNA, 22 bp, Homo sapiens
gggagctgctgaacacaagggt

SEQ ID NO: 7866086 - DNA, 22 bp, Homo sapiens
gggaggcagtgctggaggctgg

SEQ ID NO: 7866087 - DNA, 22 bp, Homo sapiens
gggaggcagtgctggaggctgg

SEQ ID NO: 7866088 - DNA, 22 bp, Homo sapiens
gggaggcagtgctggaggctgg

SEQ ID NO: 7866089 - DNA, 22 bp, Homo sapiens
gggaggcagtgctggaggctgg

SEQ ID NO: 7866090 - DNA, 22 bp, Homo sapiens
gggaggcagtgctggaggctgg

SEQ ID NO: 7866091 - DNA, 22 bp, Homo sapiens
gggaggcagtgctggaggctgg

SEQ ID NO: 7866092 - DNA, 22 bp, Homo sapiens
gggaggcagtgctggaggctgg

SEQ ID NO: 7866093 - DNA, 22 bp, Homo sapiens
gggaggcagtgctggaggctgg

SEQ ID NO: 7866094 - DNA, 22 bp, Homo sapiens
gggaggcagtgctggaggctgg

SEQ ID NO: 7866095 - DNA, 22 bp, Homo sapiens
gggaggcagtgctggaggctgg

SEQ ID NO: 7866096 - DNA, 22 bp, Homo sapiens
gggaggcacgaggcgcgcagtg

SEQ ID NO: 7866097 - DNA, 22 bp, Homo sapiens
gggaggcacgaggcgcgcagtg

SEQ ID NO: 7866098 - DNA, 22 bp, Homo sapiens
gggaggcacgaggcgcgcagtg

SEQ ID NO: 7866099 - DNA, 22 bp, Homo sapiens
gggaggcacgaggcgcgcagtg

SEQ ID NO: 7866100 - DNA, 22 bp, Homo sapiens
gggaggcagtgctggaggctgg

SEQ ID NO: 7866101 - DNA, 22 bp, Homo sapiens
gggaggcagtgctggaggctgg

SEQ ID NO: 7866102 - DNA, 22 bp, Homo sapiens
gggaggagtgaagattcacctg

SEQ ID NO: 7866103 - DNA, 22 bp, Homo sapiens
gggaggcacgaggcgcgcagtg

SEQ ID NO: 7866104 - DNA, 22 bp, Homo sapiens
gggaggagtgaagattcacctg

SEQ ID NO: 7866105 - DNA, 22 bp, Homo sapiens
gggaggagtgaagattcacctg

SEQ ID NO: 7866106 - DNA, 22 bp, Homo sapiens
gggaggagtgaagattcacctg

SEQ ID NO: 7866107 - DNA, 22 bp, Homo sapiens
gggaggagtgaagattcacctg

SEQ ID NO: 7866108 - DNA, 22 bp, Homo sapiens
gggaggagggtgctggctaaac

SEQ ID NO: 7866109 - DNA, 22 bp, Homo sapiens
gggaggagtgaagattcacctg

SEQ ID NO: 7866110 - DNA, 22 bp, Homo sapiens
gggaggagggtgctggctaaac

SEQ ID NO: 7866111 - DNA, 19 bp, Homo sapiens
ggctggcaagtgacagtgt

SEQ ID NO: 7866112 - DNA, 19 bp, Homo sapiens
ggctggcaagtgacagtgt

SEQ ID NO: 7866113 - DNA, 19 bp, Homo sapiens
ggctggcaagtgacagtgt

SEQ ID NO: 7866114 - DNA, 22 bp, Homo sapiens
ggctggcaagtgtctgctcatg

SEQ ID NO: 7866115 - DNA, 22 bp, Homo sapiens
ggctggcaagtgtctgctcatg

SEQ ID NO: 7866116 - DNA, 22 bp, Homo sapiens
ggctggcacagagggctggtgt

SEQ ID NO: 7866117 - DNA, 22 bp, Homo sapiens
ggctggcacagagggctggtgt

SEQ ID NO: 7866118 - DNA, 22 bp, Homo sapiens
ggctggcacccttggggatagg

SEQ ID NO: 7866119 - DNA, 22 bp, Homo sapiens
ggctggcacagagggctggtgt

SEQ ID NO: 7866120 - DNA, 22 bp, Homo sapiens
ggctggcacctgccctccgctg

SEQ ID NO: 7866121 - DNA, 22 bp, Homo sapiens
ggctggcacagagggctggtgt

SEQ ID NO: 7866122 - DNA, 22 bp, Homo sapiens
ggctggcacctgccctccgctg

SEQ ID NO: 7866123 - DNA, 22 bp, Homo sapiens
ggctggcacctgccctccgctg

SEQ ID NO: 7866124 - DNA, 22 bp, Homo sapiens
ggctggcacctgccctccgctg

SEQ ID NO: 7866125 - DNA, 22 bp, Homo sapiens
ggctggcacgaagccctgctgg

SEQ ID NO: 7866126 - DNA, 22 bp, Homo sapiens
ggctggcactctgtccagtgtc

SEQ ID NO: 7866127 - DNA, 22 bp, Homo sapiens
ggctggcacgaagccctgctgg

SEQ ID NO: 7866128 - DNA, 22 bp, Homo sapiens
ggctggcacgaagccctgctgg

SEQ ID NO: 7866129 - DNA, 22 bp, Homo sapiens
ggctggcacgaagccctgctgg

SEQ ID NO: 7866130 - DNA, 22 bp, Homo sapiens
ggctggcactctgtccagtgtc

SEQ ID NO: 7866131 - DNA, 22 bp, Homo sapiens
ggctggcactgaggagagctct

SEQ ID NO: 7866132 - DNA, 22 bp, Homo sapiens
ggctggcactgaggagagctct

SEQ ID NO: 7866133 - DNA, 22 bp, Homo sapiens
ggctggcagaagtgtgctggct

SEQ ID NO: 7866134 - DNA, 22 bp, Homo sapiens
cagaaaatagagtttctctgag

SEQ ID NO: 7866135 - DNA, 22 bp, Homo sapiens
cagaaaatagagtttctctgag

SEQ ID NO: 7866136 - DNA, 22 bp, Homo sapiens
cagaaaatagagtttctctgag

SEQ ID NO: 7866137 - DNA, 22 bp, Homo sapiens
cagaaaatagagtttctctgag

SEQ ID NO: 7866138 - DNA, 22 bp, Homo sapiens
cagaaaatagagtttctctgag

SEQ ID NO: 7866139 - DNA, 22 bp, Homo sapiens
cagaaacacttgtagagaagtt

SEQ ID NO: 7866140 - DNA, 22 bp, Homo sapiens
cagaaacacttgtagagaagtt

SEQ ID NO: 7866141 - DNA, 22 bp, Homo sapiens
cagaaacacttgtagagaagtt

SEQ ID NO: 7866142 - DNA, 22 bp, Homo sapiens
cagaaacacttgtagagaagtt

SEQ ID NO: 7866143 - DNA, 22 bp, Homo sapiens
cagaaacacttgtagagaagtt

SEQ ID NO: 7866144 - DNA, 22 bp, Homo sapiens
cagaaacacttgtagagaagtt

SEQ ID NO: 7866145 - DNA, 22 bp, Homo sapiens
cagaaacacttgtagagaagtt

SEQ ID NO: 7866146 - DNA, 22 bp, Homo sapiens
cagaaaatagagtttctctgag

SEQ ID NO: 7866147 - DNA, 22 bp, Homo sapiens
cagaaaatagagtttctctgag

SEQ ID NO: 7866148 - DNA, 22 bp, Homo sapiens
cagaaacactgtatttagggaa

SEQ ID NO: 7866149 - DNA, 22 bp, Homo sapiens
cagaaacactgtatttagggaa

SEQ ID NO: 7866150 - DNA, 22 bp, Homo sapiens
cagaaacactgtatttagggaa

SEQ ID NO: 7866151 - DNA, 22 bp, Homo sapiens
cagaaacacttgtagagaagtt

SEQ ID NO: 7866152 - DNA, 22 bp, Homo sapiens
cagacaaagcggaaactgttta

SEQ ID NO: 7866153 - DNA, 22 bp, Homo sapiens
cagacaaagcggaaactgttta

SEQ ID NO: 7866154 - DNA, 22 bp, Homo sapiens
cagacaaagcggaaactgttta

SEQ ID NO: 7866155 - DNA, 22 bp, Homo sapiens
cagacaaagcggaaactgttta

SEQ ID NO: 7866156 - DNA, 22 bp, Homo sapiens
cagacaaagcggaaactgttta

SEQ ID NO: 7866157 - DNA, 22 bp, Homo sapiens
cagaatttttcgaatgtactgt

SEQ ID NO: 7866158 - DNA, 22 bp, Homo sapiens
cagaatttttcactcaatcttc

SEQ ID NO: 7866159 - DNA, 22 bp, Homo sapiens
cagacaaggccatctttcattt

SEQ ID NO: 7866160 - DNA, 22 bp, Homo sapiens
cagacaattaagtaattgaggt

SEQ ID NO: 7866161 - DNA, 22 bp, Homo sapiens
cagacaaggccatctttcattt

SEQ ID NO: 7866162 - DNA, 22 bp, Homo sapiens
cagacaagaaagaatcaagcca

SEQ ID NO: 7866163 - DNA, 22 bp, Homo sapiens
cagacacacaagcaatctaagt

SEQ ID NO: 7866164 - DNA, 22 bp, Homo sapiens
cagacaagaaagaatcaagcca

SEQ ID NO: 7866165 - DNA, 22 bp, Homo sapiens
cagacaactggactaagatcac

SEQ ID NO: 7866166 - DNA, 22 bp, Homo sapiens
cagaatttcagtgatgttttct

SEQ ID NO: 7866167 - DNA, 22 bp, Homo sapiens
cagaatttgaagtaatattcca

SEQ ID NO: 7866168 - DNA, 22 bp, Homo sapiens
cagaatttcccacactgggact

SEQ ID NO: 7866169 - DNA, 22 bp, Homo sapiens
cagaatttgaagtaatattcca

SEQ ID NO: 7866170 - DNA, 22 bp, Homo sapiens
cagaatttttcactcaatcttc

SEQ ID NO: 7866171 - DNA, 22 bp, Homo sapiens
cagaatttttcactcaatcttc

SEQ ID NO: 7866172 - DNA, 22 bp, Homo sapiens
cagaatttagcacaatgtatgg

SEQ ID NO: 7866173 - DNA, 22 bp, Homo sapiens
cagaatttagaaaacaacataa

SEQ ID NO: 7866174 - DNA, 22 bp, Homo sapiens
cagaatttagaaaacaacataa

SEQ ID NO: 7866175 - DNA, 22 bp, Homo sapiens
cagaatttagaaaacaacataa

SEQ ID NO: 7866176 - DNA, 22 bp, Homo sapiens
cagaattatagttgctttttaa

SEQ ID NO: 7866177 - DNA, 22 bp, Homo sapiens
cagaattatagttgctttttaa

SEQ ID NO: 7866178 - DNA, 22 bp, Homo sapiens
cagaattcgaatgagcagaatc

SEQ ID NO: 7866179 - DNA, 22 bp, Homo sapiens
cagaatttaagtggattattct

SEQ ID NO: 7866180 - DNA, 22 bp, Homo sapiens
cagaatttaagtggattattct

SEQ ID NO: 7866181 - DNA, 22 bp, Homo sapiens
cagaataaaggtacaattgagt

SEQ ID NO: 7866182 - DNA, 22 bp, Homo sapiens
cagaataaaggtacaattgagt

SEQ ID NO: 7866183 - DNA, 22 bp, Homo sapiens
cagaataaacagaaacgtagct

SEQ ID NO: 7866184 - DNA, 22 bp, Homo sapiens
cagaataaacagaaacgtagct

SEQ ID NO: 7866185 - DNA, 22 bp, Homo sapiens
cagaataaacagaaacgtagct

SEQ ID NO: 7866186 - DNA, 22 bp, Homo sapiens
cagaatgttaccagttagtctg

SEQ ID NO: 7866187 - DNA, 22 bp, Homo sapiens
cagaatgttaccagttagtctg

SEQ ID NO: 7866188 - DNA, 22 bp, Homo sapiens
cagaataaaggtacaattgagt

SEQ ID NO: 7866189 - DNA, 22 bp, Homo sapiens
cagaataaaggtacaattgagt

SEQ ID NO: 7866190 - DNA, 22 bp, Homo sapiens
cagaaacagagaaatattggct

SEQ ID NO: 7866191 - DNA, 22 bp, Homo sapiens
cagaaacagagaaatattggct

SEQ ID NO: 7866192 - DNA, 22 bp, Homo sapiens
cagaaacagagaaatattggct

SEQ ID NO: 7866193 - DNA, 22 bp, Homo sapiens
cagaaacaggcaacgtgtgcac

SEQ ID NO: 7866194 - DNA, 22 bp, Homo sapiens
cagaaacaggcaacgtgtgcac

SEQ ID NO: 7866195 - DNA, 22 bp, Homo sapiens
cagaaacaggcaacgtgtgcac

SEQ ID NO: 7866196 - DNA, 22 bp, Homo sapiens
cagaaacaggcaacgtgtgcac

SEQ ID NO: 7866197 - DNA, 22 bp, Homo sapiens
cagaaacagacatgacgcagta

SEQ ID NO: 7866198 - DNA, 22 bp, Homo sapiens
cagaaacacttgtagagaagtt

SEQ ID NO: 7866199 - DNA, 22 bp, Homo sapiens
cagaaacagacatgacgcagta

SEQ ID NO: 7866200 - DNA, 22 bp, Homo sapiens
cagaaacagacatgacgcagta

SEQ ID NO: 7866201 - DNA, 22 bp, Homo sapiens
cagaaacagacatgacgcagta

SEQ ID NO: 7866202 - DNA, 22 bp, Homo sapiens
cagaaacagagaaatattggct

SEQ ID NO: 7866203 - DNA, 22 bp, Homo sapiens
atggctctatctagaattctgg

SEQ ID NO: 7866204 - DNA, 22 bp, Homo sapiens
atggctctatctagaattctgg

SEQ ID NO: 7866205 - DNA, 22 bp, Homo sapiens
atggctctaggttgggcagttt

SEQ ID NO: 7866206 - DNA, 22 bp, Homo sapiens
atggctctatctagaattctgg

SEQ ID NO: 7866207 - DNA, 22 bp, Homo sapiens
atggctctaggttgggcagttt

SEQ ID NO: 7866208 - DNA, 22 bp, Homo sapiens
atggctccatcctgttgctagt

SEQ ID NO: 7866209 - DNA, 22 bp, Homo sapiens
atggctccatcctgttgctagt

SEQ ID NO: 7866210 - DNA, 22 bp, Homo sapiens
atggctccttctgtgcagtttt

SEQ ID NO: 7866211 - DNA, 22 bp, Homo sapiens
atggctccttctgtgcagtttt

SEQ ID NO: 7866212 - DNA, 18 bp, Homo sapiens
atggctccagtgtcttcc

SEQ ID NO: 7866213 - DNA, 22 bp, Homo sapiens
atggccgcctgtccttcccgcc

SEQ ID NO: 7866214 - DNA, 21 bp, Homo sapiens
atggctcaggccatcaatgga

SEQ ID NO: 7866215 - DNA, 21 bp, Homo sapiens
atggctcaggccatcaatgga

SEQ ID NO: 7866216 - DNA, 22 bp, Homo sapiens
atggccgcctgtccttcccgcc

SEQ ID NO: 7866217 - DNA, 21 bp, Homo sapiens
atggctcaggccatcaatgga

SEQ ID NO: 7866218 - DNA, 22 bp, Homo sapiens
atggctccaagatggagagcca

SEQ ID NO: 7866219 - DNA, 22 bp, Homo sapiens
atggctcatttatcttgcagcc

SEQ ID NO: 7866220 - DNA, 22 bp, Homo sapiens
atggctcatttatcttgcagcc

SEQ ID NO: 7866221 - DNA, 22 bp, Homo sapiens
atggcagacgaggcagcagggg

SEQ ID NO: 7866222 - DNA, 22 bp, Homo sapiens
atggcagacgaggcagcagggg

SEQ ID NO: 7866223 - DNA, 22 bp, Homo sapiens
atggcagacgaggcagcagggg

SEQ ID NO: 7866224 - DNA, 22 bp, Homo sapiens
atggcagacgaggcagcagggg

SEQ ID NO: 7866225 - DNA, 22 bp, Homo sapiens
atggcagacctgggctggagaa

SEQ ID NO: 7866226 - DNA, 22 bp, Homo sapiens
atggcagacctgggctggagaa

SEQ ID NO: 7866227 - DNA, 22 bp, Homo sapiens
atggcagacgaggcagcagggg

SEQ ID NO: 7866228 - DNA, 22 bp, Homo sapiens
atggcagagggattgaacagct

SEQ ID NO: 7866229 - DNA, 22 bp, Homo sapiens
atggccctgtttatggtaaggc

SEQ ID NO: 7866230 - DNA, 22 bp, Homo sapiens
atggccctttattccttcttcc

SEQ ID NO: 7866231 - DNA, 22 bp, Homo sapiens
atggcagagggattgaacagct

SEQ ID NO: 7866232 - DNA, 22 bp, Homo sapiens
atggccctttattccttcttcc

SEQ ID NO: 7866233 - DNA, 22 bp, Homo sapiens
atggctcttgaattgatactct

SEQ ID NO: 7866234 - DNA, 20 bp, Homo sapiens
atggctctgtttggcagtga

SEQ ID NO: 7866235 - DNA, 22 bp, Homo sapiens
atggctctgttttttatgctct

SEQ ID NO: 7866236 - DNA, 22 bp, Homo sapiens
atggctctttattctgctgcat

SEQ ID NO: 7866237 - DNA, 22 bp, Homo sapiens
atggctctttattctgctgcat

SEQ ID NO: 7866238 - DNA, 22 bp, Homo sapiens
atggctgagatgggctccaggc

SEQ ID NO: 7866239 - DNA, 22 bp, Homo sapiens
atggctgcagagacctgaagaa

SEQ ID NO: 7866240 - DNA, 22 bp, Homo sapiens
atggctgcagtccgtgccctgg

SEQ ID NO: 7866241 - DNA, 22 bp, Homo sapiens
atggctgcatcatcctggttga

SEQ ID NO: 7866242 - DNA, 22 bp, Homo sapiens
atggctgcatcatcctggttga

SEQ ID NO: 7866243 - DNA, 22 bp, Homo sapiens
gagcacagattgatttaaaata

SEQ ID NO: 7866244 - DNA, 22 bp, Homo sapiens
atggctgcagagacctgaagaa

SEQ ID NO: 7866245 - DNA, 22 bp, Homo sapiens
atggctgcagagacctgaagaa

SEQ ID NO: 7866246 - DNA, 22 bp, Homo sapiens
atggctgcagccggccctgcgc

SEQ ID NO: 7866247 - DNA, 22 bp, Homo sapiens
atggctgcagccggccctgcgc

SEQ ID NO: 7866248 - DNA, 19 bp, Homo sapiens
atggctctgggatcactgc

SEQ ID NO: 7866249 - DNA, 19 bp, Homo sapiens
atggctctgggatcactgc

SEQ ID NO: 7866250 - DNA, 19 bp, Homo sapiens
atggctctgggatcactgc

SEQ ID NO: 7866251 - DNA, 20 bp, Homo sapiens
atggctctgtttggcagtga

SEQ ID NO: 7866252 - DNA, 22 bp, Homo sapiens
atggctctgctgggcaaagcaa

SEQ ID NO: 7866253 - DNA, 22 bp, Homo sapiens
atggctctgagaacctgagcta

SEQ ID NO: 7866254 - DNA, 19 bp, Homo sapiens
atggctctgatttaatgtg

SEQ ID NO: 7866255 - DNA, 22 bp, Homo sapiens
atggctctctccttactgctgc

SEQ ID NO: 7866256 - DNA, 22 bp, Homo sapiens
atggctctctagggcccaggtt

SEQ ID NO: 7866257 - DNA, 22 bp, Homo sapiens
atggctctctccttactgctgc

SEQ ID NO: 7866258 - DNA, 22 bp, Homo sapiens
atggctctctccttactgctgc

SEQ ID NO: 7866259 - DNA, 22 bp, Homo sapiens
atggctctctccttactgctgc

SEQ ID NO: 7866260 - DNA, 20 bp, Homo sapiens
atggctctgattctgagccc

SEQ ID NO: 7866261 - DNA, 22 bp, Homo sapiens
atggctctgagaacctgagcta

SEQ ID NO: 7866262 - DNA, 22 bp, Homo sapiens
atggctctgagaacctgagcta

SEQ ID NO: 7866263 - DNA, 22 bp, Homo sapiens
atggctctcttgacctaggcac

SEQ ID NO: 7866264 - DNA, 22 bp, Homo sapiens
atggctctcttgacctaggcac

SEQ ID NO: 7866265 - DNA, 22 bp, Homo sapiens
atgggagggtggaaaggctctg

SEQ ID NO: 7866266 - DNA, 22 bp, Homo sapiens
atgggagggtggaaaggctctg

SEQ ID NO: 7866267 - DNA, 22 bp, Homo sapiens
atgggagggtggaaaggctctg

SEQ ID NO: 7866268 - DNA, 22 bp, Homo sapiens
atgggagggtggaaaggctctg

SEQ ID NO: 7866269 - DNA, 18 bp, Homo sapiens
atgggaggggccaagaga

SEQ ID NO: 7866270 - DNA, 22 bp, Homo sapiens
atgggagtgtgcttgaggagtt

SEQ ID NO: 7866271 - DNA, 22 bp, Homo sapiens
atgggagtgtgcttgaggagtt

SEQ ID NO: 7866272 - DNA, 22 bp, Homo sapiens
atgggaggaagagaagatgtct

SEQ ID NO: 7866273 - DNA, 22 bp, Homo sapiens
atgggagccatcgcatttgctg

SEQ ID NO: 7866274 - DNA, 22 bp, Homo sapiens
atgggaggaagagaagatgtct

SEQ ID NO: 7866275 - DNA, 22 bp, Homo sapiens
atgggaggaagagaagatgtct

SEQ ID NO: 7866276 - DNA, 22 bp, Homo sapiens
atgggaggaagagaagatgtct

SEQ ID NO: 7866277 - DNA, 22 bp, Homo sapiens
atgggaggaagagaagatgtct

SEQ ID NO: 7866278 - DNA, 22 bp, Homo sapiens
atgggagccatcgcatttgctg

SEQ ID NO: 7866279 - DNA, 22 bp, Homo sapiens
gagcacagggaatagacagata

SEQ ID NO: 7866280 - DNA, 22 bp, Homo sapiens
atgggagagggtaggaattact

SEQ ID NO: 7866281 - DNA, 22 bp, Homo sapiens
gagcacagggaatagacagata

SEQ ID NO: 7866282 - DNA, 22 bp, Homo sapiens
gagcacaggctttggtggacac

SEQ ID NO: 7866283 - DNA, 22 bp, Homo sapiens
gagcacaggctttggtggacac

SEQ ID NO: 7866284 - DNA, 22 bp, Homo sapiens
gagcacaggctttggtggacac

SEQ ID NO: 7866285 - DNA, 22 bp, Homo sapiens
gagcacaggctttggtggacac

SEQ ID NO: 7866286 - DNA, 22 bp, Homo sapiens
gagcacagggaatagacagata

SEQ ID NO: 7866287 - DNA, 22 bp, Homo sapiens
gagcacagggaatagacagata

SEQ ID NO: 7866288 - DNA, 22 bp, Homo sapiens
gagcacagggaatagacagata

SEQ ID NO: 7866289 - DNA, 22 bp, Homo sapiens
gagcacaggctttggtggacac

SEQ ID NO: 7866290 - DNA, 22 bp, Homo sapiens
gagcacagctgtcttgcaagct

SEQ ID NO: 7866291 - DNA, 22 bp, Homo sapiens
gagcacaggctgctgtgaactg

SEQ ID NO: 7866292 - DNA, 22 bp, Homo sapiens
gagcacaggctgctgtgaactg

SEQ ID NO: 7866293 - DNA, 22 bp, Homo sapiens
gagcacaggctgctgtgaactg

SEQ ID NO: 7866294 - DNA, 22 bp, Homo sapiens
gagcacaggctttggtggacac

SEQ ID NO: 7866295 - DNA, 22 bp, Homo sapiens
gagcacagctggaggtagcatt

SEQ ID NO: 7866296 - DNA, 22 bp, Homo sapiens
gagcacagctggaggtagcatt

SEQ ID NO: 7866297 - DNA, 22 bp, Homo sapiens
gagcacagctgtcttgcaagct

SEQ ID NO: 7866298 - DNA, 22 bp, Homo sapiens
gagcacagctgtcttgcaagct

SEQ ID NO: 7866299 - DNA, 22 bp, Homo sapiens
gagcacagctggaggtagcatt

SEQ ID NO: 7866300 - DNA, 22 bp, Homo sapiens
gagcacagctggaggtagcatt

SEQ ID NO: 7866301 - DNA, 22 bp, Homo sapiens
gagcacagctggaggtagcatt

SEQ ID NO: 7866302 - DNA, 22 bp, Homo sapiens
gagcacagctggaggtagcatt

SEQ ID NO: 7866303 - DNA, 22 bp, Homo sapiens
gagcacagcagggctctgggtg

SEQ ID NO: 7866304 - DNA, 22 bp, Homo sapiens
gagcacagcagggctctgggtg

SEQ ID NO: 7866305 - DNA, 22 bp, Homo sapiens
gagcacagcagggctctgggtg

SEQ ID NO: 7866306 - DNA, 22 bp, Homo sapiens
gagcacagcagggctctgggtg

SEQ ID NO: 7866307 - DNA, 22 bp, Homo sapiens
gagcacagcagggctctgggtg

SEQ ID NO: 7866308 - DNA, 22 bp, Homo sapiens
gagcacagccaaagtaagaagg

SEQ ID NO: 7866309 - DNA, 22 bp, Homo sapiens
gagcacagccaaagtaagaagg

SEQ ID NO: 7866310 - DNA, 19 bp, Homo sapiens
gagcacagcggcatttggt

SEQ ID NO: 7866311 - DNA, 19 bp, Homo sapiens
gagcacagcggcatttggt

SEQ ID NO: 7866312 - DNA, 22 bp, Homo sapiens
gagcacagcgcagtttgtaatt

SEQ ID NO: 7866313 - DNA, 22 bp, Homo sapiens
gagcacagcgcagtttgtaatt

SEQ ID NO: 7866314 - DNA, 19 bp, Homo sapiens
gagcacagcggcatttggt

SEQ ID NO: 7866315 - DNA, 22 bp, Homo sapiens
gagcacagctggaggtagcatt

SEQ ID NO: 7866316 - DNA, 22 bp, Homo sapiens
gagcacagctggaggtagcatt

SEQ ID NO: 7866317 - DNA, 19 bp, Homo sapiens
gagcacagcggcatttggt

SEQ ID NO: 7866318 - DNA, 19 bp, Homo sapiens
gagcacagcggcatttggt

SEQ ID NO: 7866319 - DNA, 22 bp, Homo sapiens
atgggatcttgccctgagggct

SEQ ID NO: 7866320 - DNA, 22 bp, Homo sapiens
atgggatgaacttgatctgctt

SEQ ID NO: 7866321 - DNA, 22 bp, Homo sapiens
atgggatgaacttgatctgctt

SEQ ID NO: 7866322 - DNA, 22 bp, Homo sapiens
atgggatgcatggctgtggcca

SEQ ID NO: 7866323 - DNA, 22 bp, Homo sapiens
atgggatgatcacctgagctca

SEQ ID NO: 7866324 - DNA, 22 bp, Homo sapiens
atgggcagacagggagctcacg

SEQ ID NO: 7866325 - DNA, 22 bp, Homo sapiens
atgggcagacagggagctcacg

SEQ ID NO: 7866326 - DNA, 22 bp, Homo sapiens
atgggcagacagggagctcacg

SEQ ID NO: 7866327 - DNA, 22 bp, Homo sapiens
atgggcagacagggagctcacg

SEQ ID NO: 7866328 - DNA, 22 bp, Homo sapiens
atgggcagacagggagctcacg

SEQ ID NO: 7866329 - DNA, 22 bp, Homo sapiens
gagcccagtctgctcctgcgcc

SEQ ID NO: 7866330 - DNA, 22 bp, Homo sapiens
gagcccagtctgctcctgcgcc

SEQ ID NO: 7866331 - DNA, 21 bp, Homo sapiens
atgggcagaggcagagaggct

SEQ ID NO: 7866332 - DNA, 21 bp, Homo sapiens
atgggcagaggcagagaggct

SEQ ID NO: 7866333 - DNA, 22 bp, Homo sapiens
gagccccaccctagacattctg

SEQ ID NO: 7866334 - DNA, 22 bp, Homo sapiens
gagccccaccctagacattctg

SEQ ID NO: 7866335 - DNA, 22 bp, Homo sapiens
gagcccatcctcgaggggctgc

SEQ ID NO: 7866336 - DNA, 21 bp, Homo sapiens
atgggcagaggcagagaggct

SEQ ID NO: 7866337 - DNA, 21 bp, Homo sapiens
atgggcagaggcagagaggct

SEQ ID NO: 7866338 - DNA, 22 bp, Homo sapiens
atgggcagagctggtgggaggc

SEQ ID NO: 7866339 - DNA, 22 bp, Homo sapiens
atgggcagagctggtgggaggc

SEQ ID NO: 7866340 - DNA, 22 bp, Homo sapiens
atgggcagagctggtgggaggc

SEQ ID NO: 7866341 - DNA, 22 bp, Homo sapiens
atgggcagacagggagctcacg

SEQ ID NO: 7866342 - DNA, 22 bp, Homo sapiens
atgggcagagctggtgggaggc

SEQ ID NO: 7866343 - DNA, 22 bp, Homo sapiens
gagccccaggacagctctagtt

SEQ ID NO: 7866344 - DNA, 22 bp, Homo sapiens
gagccccaggacagctctagtt

SEQ ID NO: 7866345 - DNA, 22 bp, Homo sapiens
gagccccagccctgcttctata

SEQ ID NO: 7866346 - DNA, 22 bp, Homo sapiens
gagccccagccctgcttctata

SEQ ID NO: 7866347 - DNA, 22 bp, Homo sapiens
gagccccaggacagctctagtt

SEQ ID NO: 7866348 - DNA, 22 bp, Homo sapiens
gagccctcaatgaatctgcatt

SEQ ID NO: 7866349 - DNA, 22 bp, Homo sapiens
gagcccgagcgcgtacccggcg

SEQ ID NO: 7866350 - DNA, 22 bp, Homo sapiens
gagccctcaccgcctgaccagg

SEQ ID NO: 7866351 - DNA, 22 bp, Homo sapiens
gagccctcaccgcctgaccagg

SEQ ID NO: 7866352 - DNA, 22 bp, Homo sapiens
gagccctcaatgaatctgcatt

SEQ ID NO: 7866353 - DNA, 22 bp, Homo sapiens
gagccctcaatgaatctgcatt

SEQ ID NO: 7866354 - DNA, 22 bp, Homo sapiens
gagccctcattgaatctgcatt

SEQ ID NO: 7866355 - DNA, 22 bp, Homo sapiens
gagccctcattgaatctgcatt

SEQ ID NO: 7866356 - DNA, 22 bp, Homo sapiens
gagccctcattgaatctgcatt

SEQ ID NO: 7866357 - DNA, 22 bp, Homo sapiens
gagccctccatggagccaggca

SEQ ID NO: 7866358 - DNA, 22 bp, Homo sapiens
gagccctctctgtaggcaagta

SEQ ID NO: 7866359 - DNA, 22 bp, Homo sapiens
gagccctctctgtaggcaagta

SEQ ID NO: 7866360 - DNA, 19 bp, Homo sapiens
gagccctctccatggccac

SEQ ID NO: 7866361 - DNA, 22 bp, Homo sapiens
gagccctccatggagccaggca

SEQ ID NO: 7866362 - DNA, 22 bp, Homo sapiens
gagccctccatggagccaggca

SEQ ID NO: 7866363 - DNA, 22 bp, Homo sapiens
gagccctcgggcgagcccgcgc

SEQ ID NO: 7866364 - DNA, 22 bp, Homo sapiens
gagccctccatggagccaggca

SEQ ID NO: 7866365 - DNA, 20 bp, Homo sapiens
gagctgagtgtggtcatggg

SEQ ID NO: 7866366 - DNA, 20 bp, Homo sapiens
gagctgagtgtggtcatggg

SEQ ID NO: 7866367 - DNA, 20 bp, Homo sapiens
gagctgagtgtggtcatggg

SEQ ID NO: 7866368 - DNA, 22 bp, Homo sapiens
gagctgagtgtcctaggcatgg

SEQ ID NO: 7866369 - DNA, 22 bp, Homo sapiens
gagctgagtgtcctaggcatgg

SEQ ID NO: 7866370 - DNA, 22 bp, Homo sapiens
gagctgagtgtcctaggcatgg

SEQ ID NO: 7866371 - DNA, 17 bp, Homo sapiens
gagctctgtggcacaag

SEQ ID NO: 7866372 - DNA, 22 bp, Homo sapiens
gagctctgtgtagcctgagggt

SEQ ID NO: 7866373 - DNA, 17 bp, Homo sapiens
gagctctgtggcacaag

SEQ ID NO: 7866374 - DNA, 22 bp, Homo sapiens
gagccctctctgtaggcaagta

SEQ ID NO: 7866375 - DNA, 17 bp, Homo sapiens
gagctctgtggcacaag

SEQ ID NO: 7866376 - DNA, 17 bp, Homo sapiens
gagctctgtggcacaag

SEQ ID NO: 7866377 - DNA, 20 bp, Homo sapiens
gagctgagtgtggtcatggg

SEQ ID NO: 7866378 - DNA, 22 bp, Homo sapiens
gagctgcacatctgaggctaat

SEQ ID NO: 7866379 - DNA, 22 bp, Homo sapiens
gagctgcacatctgaggctaat

SEQ ID NO: 7866380 - DNA, 22 bp, Homo sapiens
gagctgcacatctgaggctaat

SEQ ID NO: 7866381 - DNA, 22 bp, Homo sapiens
gagctgcacatctgaggctaat

SEQ ID NO: 7866382 - DNA, 22 bp, Homo sapiens
gagctgcacgcagcatccaaga

SEQ ID NO: 7866383 - DNA, 21 bp, Homo sapiens
gagctgcaccttgacctgttt

SEQ ID NO: 7866384 - DNA, 22 bp, Homo sapiens
gagctgcacatctgaggctaat

SEQ ID NO: 7866385 - DNA, 21 bp, Homo sapiens
gagctgcaccttgacctgttt

SEQ ID NO: 7866386 - DNA, 22 bp, Homo sapiens
gagctgcagaaggggttttcct

SEQ ID NO: 7866387 - DNA, 22 bp, Homo sapiens
gagctgcactgggggtggaatg

SEQ ID NO: 7866388 - DNA, 22 bp, Homo sapiens
gagctgcagacatagataagcg

SEQ ID NO: 7866389 - DNA, 22 bp, Homo sapiens
gagctgcagacatagataagcg

SEQ ID NO: 7866390 - DNA, 22 bp, Homo sapiens
gagctgcagacttgatacagga

SEQ ID NO: 7866391 - DNA, 22 bp, Homo sapiens
gagctgcagacttgatacagga

SEQ ID NO: 7866392 - DNA, 22 bp, Homo sapiens
gagctgcagacttgatacagga

SEQ ID NO: 7866393 - DNA, 22 bp, Homo sapiens
gagctgcagagctcgaaggaac

SEQ ID NO: 7866394 - DNA, 22 bp, Homo sapiens
gagctgcagagctcgaaggaac

SEQ ID NO: 7866395 - DNA, 22 bp, Homo sapiens
gagctgcagagctcgaaggaac

SEQ ID NO: 7866396 - DNA, 22 bp, Homo sapiens
gagctgccagtgtatgaattct

SEQ ID NO: 7866397 - DNA, 22 bp, Homo sapiens
gagctgccagacatgggaatga

SEQ ID NO: 7866398 - DNA, 22 bp, Homo sapiens
gagctgccagacatgggaatga

SEQ ID NO: 7866399 - DNA, 22 bp, Homo sapiens
gagctgccagacatgggaatga

SEQ ID NO: 7866400 - DNA, 22 bp, Homo sapiens
gagctgccaagattacaatcag

SEQ ID NO: 7866401 - DNA, 22 bp, Homo sapiens
gagctgccaagattacaatcag

SEQ ID NO: 7866402 - DNA, 22 bp, Homo sapiens
gagctgcagcggctgacgcaac

SEQ ID NO: 7866403 - DNA, 22 bp, Homo sapiens
gagctgcagagtaacctttgca

SEQ ID NO: 7866404 - DNA, 22 bp, Homo sapiens
gagctgcagcggctgacgcaac

SEQ ID NO: 7866405 - DNA, 22 bp, Homo sapiens
gagctgcagcggctgacgcaac

SEQ ID NO: 7866406 - DNA, 22 bp, Homo sapiens
gagctgcatgcggaaacctgtt

SEQ ID NO: 7866407 - DNA, 22 bp, Homo sapiens
gagctgcatgcaactgtttaaa

SEQ ID NO: 7866408 - DNA, 22 bp, Homo sapiens
gagctgcatgcggaaacctgtt

SEQ ID NO: 7866409 - DNA, 22 bp, Homo sapiens
gagctgcatagctgggatcctc

SEQ ID NO: 7866410 - DNA, 22 bp, Homo sapiens
gagctgcatgcaactcgaaaat

SEQ ID NO: 7866411 - DNA, 22 bp, Homo sapiens
gagctgccctgagctttgcatg

SEQ ID NO: 7866412 - DNA, 22 bp, Homo sapiens
gagctgccctgagctttgcatg

SEQ ID NO: 7866413 - DNA, 22 bp, Homo sapiens
gagctgccctgagctttgcatg

SEQ ID NO: 7866414 - DNA, 18 bp, Homo sapiens
gagctgccatatttagtt

SEQ ID NO: 7866415 - DNA, 22 bp, Homo sapiens
gagctgccagtgtatgaattct

SEQ ID NO: 7866416 - DNA, 22 bp, Homo sapiens
gagctgccagtgtatgaattct

SEQ ID NO: 7866417 - DNA, 22 bp, Homo sapiens
atgggcagagtggggacaggaa

SEQ ID NO: 7866418 - DNA, 22 bp, Homo sapiens
atgggcagagtggggacaggaa

SEQ ID NO: 7866419 - DNA, 22 bp, Homo sapiens
atgggcagagtggggacaggaa

SEQ ID NO: 7866420 - DNA, 21 bp, Homo sapiens
atgggcagaggcagagaggct

SEQ ID NO: 7866421 - DNA, 21 bp, Homo sapiens
atgggcagaggcagagaggct

SEQ ID NO: 7866422 - DNA, 21 bp, Homo sapiens
atgggcagaggcagagaggct

SEQ ID NO: 7866423 - DNA, 21 bp, Homo sapiens
atgggcagaggcagagaggct

SEQ ID NO: 7866424 - DNA, 22 bp, Homo sapiens
atgctgtggaagttcctgaagc

SEQ ID NO: 7866425 - DNA, 22 bp, Homo sapiens
atgctgtgctggctaaccatgg

SEQ ID NO: 7866426 - DNA, 22 bp, Homo sapiens
atgctgtgcctggaaagcggct

SEQ ID NO: 7866427 - DNA, 22 bp, Homo sapiens
atgctgtgcctggaaagcggct

SEQ ID NO: 7866428 - DNA, 22 bp, Homo sapiens
atgctgtgccttctctgtgcca

SEQ ID NO: 7866429 - DNA, 22 bp, Homo sapiens
atgctgtgaaaaagaaggctga

SEQ ID NO: 7866430 - DNA, 22 bp, Homo sapiens
atgctgtctctgctatccaaag

SEQ ID NO: 7866431 - DNA, 22 bp, Homo sapiens
atgctgtgaaaaagaaggctga

SEQ ID NO: 7866432 - DNA, 22 bp, Homo sapiens
atgctgtgaaaaagaaggctga

SEQ ID NO: 7866433 - DNA, 22 bp, Homo sapiens
atgctgtgagtgtgccgcagag

SEQ ID NO: 7866434 - DNA, 22 bp, Homo sapiens
atgctgtgattgtagaaatatt

SEQ ID NO: 7866435 - DNA, 22 bp, Homo sapiens
atgctgtggtagacagcattcc

SEQ ID NO: 7866436 - DNA, 22 bp, Homo sapiens
atgctgtgtattttactctttc

SEQ ID NO: 7866437 - DNA, 22 bp, Homo sapiens
atgctgtgtcaccttaggattt

SEQ ID NO: 7866438 - DNA, 22 bp, Homo sapiens
atgctgtgtcaggaatttgata

SEQ ID NO: 7866439 - DNA, 22 bp, Homo sapiens
atgctgtggccagagttcaact

SEQ ID NO: 7866440 - DNA, 22 bp, Homo sapiens
atgctgtggatgccttgcccca

SEQ ID NO: 7866441 - DNA, 22 bp, Homo sapiens
atgctgtggggagtgagggtag

SEQ ID NO: 7866442 - DNA, 22 bp, Homo sapiens
atgctgtggccagagttcaact

SEQ ID NO: 7866443 - DNA, 22 bp, Homo sapiens
atgctggggcctcagaccagaa

SEQ ID NO: 7866444 - DNA, 22 bp, Homo sapiens
atgctggggcctcagaccagaa

SEQ ID NO: 7866445 - DNA, 22 bp, Homo sapiens
atgctggttgctaagcagcgat

SEQ ID NO: 7866446 - DNA, 22 bp, Homo sapiens
atgctggttgctaagcagcgat

SEQ ID NO: 7866447 - DNA, 22 bp, Homo sapiens
atgctgtccactcttggtgttt

SEQ ID NO: 7866448 - DNA, 22 bp, Homo sapiens
atgctgtcagtattatgtgcag

SEQ ID NO: 7866449 - DNA, 22 bp, Homo sapiens
atgctgtatacatatgaaatta

SEQ ID NO: 7866450 - DNA, 22 bp, Homo sapiens
atgctgtatacatatgaaatta

SEQ ID NO: 7866451 - DNA, 22 bp, Homo sapiens
atgctgtcgaaaccaaacatct

SEQ ID NO: 7866452 - DNA, 22 bp, Homo sapiens
atgctgtccctgcccttcaccc

SEQ ID NO: 7866453 - DNA, 22 bp, Homo sapiens
atgctgtccctgcccttcaccc

SEQ ID NO: 7866454 - DNA, 22 bp, Homo sapiens
atgctgtccattaactaggatg

SEQ ID NO: 7866455 - DNA, 22 bp, Homo sapiens
atgctgtccattaactaggatg

SEQ ID NO: 7866456 - DNA, 22 bp, Homo sapiens
atgctgtcgaaaccaaacatct

SEQ ID NO: 7866457 - DNA, 22 bp, Homo sapiens
atgctgtcgaaaccaaacatct

SEQ ID NO: 7866458 - DNA, 22 bp, Homo sapiens
atgctgggaagtcctaaccaca

SEQ ID NO: 7866459 - DNA, 22 bp, Homo sapiens
atgctgggacgtacttgttcat

SEQ ID NO: 7866460 - DNA, 22 bp, Homo sapiens
atgctgggagtgaagcccctgg

SEQ ID NO: 7866461 - DNA, 22 bp, Homo sapiens
atgctgggaagacaaggtggag

SEQ ID NO: 7866462 - DNA, 22 bp, Homo sapiens
atgctgggaagtcctaaccaca

SEQ ID NO: 7866463 - DNA, 22 bp, Homo sapiens
atgctgggaagacaaggtggag

SEQ ID NO: 7866464 - DNA, 22 bp, Homo sapiens
atgctgggaagacaaggtggag

SEQ ID NO: 7866465 - DNA, 22 bp, Homo sapiens
atgctggattgagagcaagggg

SEQ ID NO: 7866466 - DNA, 22 bp, Homo sapiens
atgctggattgagagcaagggg

SEQ ID NO: 7866467 - DNA, 16 bp, Homo sapiens
atgctgctattagagg

SEQ ID NO: 7866468 - DNA, 22 bp, Homo sapiens
atgctggcagccgagtgctcca

SEQ ID NO: 7866469 - DNA, 22 bp, Homo sapiens
atgctggcagccgagtgctcca

SEQ ID NO: 7866470 - DNA, 22 bp, Homo sapiens
atgctggattgagagcaagggg

SEQ ID NO: 7866471 - DNA, 22 bp, Homo sapiens
atgctgggaaactgaaaggaat

SEQ ID NO: 7866472 - DNA, 22 bp, Homo sapiens
atgctgggaaactgaaaggaat

SEQ ID NO: 7866473 - DNA, 22 bp, Homo sapiens
atgctggcagccgagtgctcca

SEQ ID NO: 7866474 - DNA, 22 bp, Homo sapiens
atgcttaactctgtacatagtt

SEQ ID NO: 7866475 - DNA, 22 bp, Homo sapiens
atgcttaacttcctagtctata

SEQ ID NO: 7866476 - DNA, 22 bp, Homo sapiens
atgcttaactctgtacatagtt

SEQ ID NO: 7866477 - DNA, 22 bp, Homo sapiens
atgcttaacttcctagtctata

SEQ ID NO: 7866478 - DNA, 23 bp, Homo sapiens
gagaacagccacagagagctgtg

SEQ ID NO: 7866479 - DNA, 22 bp, Homo sapiens
atgctgttattctaatgtgtga

SEQ ID NO: 7866480 - DNA, 22 bp, Homo sapiens
atgctgttaagataatgggttc

SEQ ID NO: 7866481 - DNA, 22 bp, Homo sapiens
atgctgttattctaatgtgtga

SEQ ID NO: 7866482 - DNA, 22 bp, Homo sapiens
atgcttaactctgtacatagtt

SEQ ID NO: 7866483 - DNA, 22 bp, Homo sapiens
atgctgtgtcctagtgaaagaa

SEQ ID NO: 7866484 - DNA, 22 bp, Homo sapiens
atgctgtgtctagcaggaacac

SEQ ID NO: 7866485 - DNA, 22 bp, Homo sapiens
atgctgtgtctagcaggaacac

SEQ ID NO: 7866486 - DNA, 22 bp, Homo sapiens
atgctgtgtggccacctccatg

SEQ ID NO: 7866487 - DNA, 22 bp, Homo sapiens
atgctgtgttttaaatggaaat

SEQ ID NO: 7866488 - DNA, 22 bp, Homo sapiens
atgctgttaagataatgggttc

SEQ ID NO: 7866489 - DNA, 22 bp, Homo sapiens
atgctgtgtggtcaagttaatt

SEQ ID NO: 7866490 - DNA, 22 bp, Homo sapiens
atgctgtgtttgagaacctagg

SEQ ID NO: 7866491 - DNA, 22 bp, Homo sapiens
atgctgtgtttgagaacctagg

SEQ ID NO: 7866492 - DNA, 22 bp, Homo sapiens
gagaaggtggacctgaaggagc

SEQ ID NO: 7866493 - DNA, 22 bp, Homo sapiens
gagaaggtggacctgaaggagc

SEQ ID NO: 7866494 - DNA, 22 bp, Homo sapiens
gagaaggtggatttcgtatccc

SEQ ID NO: 7866495 - DNA, 18 bp, Homo sapiens
gagaagtgcatacattat

SEQ ID NO: 7866496 - DNA, 22 bp, Homo sapiens
gagaaggggtgatgtgggtaat

SEQ ID NO: 7866497 - DNA, 22 bp, Homo sapiens
gagaaggggtgatgtgggtaat

SEQ ID NO: 7866498 - DNA, 22 bp, Homo sapiens
gagaacaggctctggagtcaga

SEQ ID NO: 7866499 - DNA, 22 bp, Homo sapiens
gagaacaggctctggagtcaga

SEQ ID NO: 7866500 - DNA, 22 bp, Homo sapiens
gagaacaggctctggagtcaga

SEQ ID NO: 7866501 - DNA, 22 bp, Homo sapiens
gagaacaggctctggagtcaga

SEQ ID NO: 7866502 - DNA, 22 bp, Homo sapiens
gagaaggtggacctgaaggagc

SEQ ID NO: 7866503 - DNA, 22 bp, Homo sapiens
gagaagtttctggtttgcatag

SEQ ID NO: 7866504 - DNA, 22 bp, Homo sapiens
gagaataaatctaaagtttctt

SEQ ID NO: 7866505 - DNA, 22 bp, Homo sapiens
gagaatacaaccagaagctgag

SEQ ID NO: 7866506 - DNA, 22 bp, Homo sapiens
gagaataaatctaaagtttctt

SEQ ID NO: 7866507 - DNA, 22 bp, Homo sapiens
atggcactaagagggagctgga

SEQ ID NO: 7866508 - DNA, 22 bp, Homo sapiens
atggcaccttccccagagctca

SEQ ID NO: 7866509 - DNA, 22 bp, Homo sapiens
atggcactgacctcccttgtaa

SEQ ID NO: 7866510 - DNA, 22 bp, Homo sapiens
atggcacatgaccttgatggat

SEQ ID NO: 7866511 - DNA, 22 bp, Homo sapiens
atggcacagtgggaaatgacct

SEQ ID NO: 7866512 - DNA, 23 bp, Homo sapiens
atggcacatgggacagtaagtag

SEQ ID NO: 7866513 - DNA, 22 bp, Homo sapiens
atggcaccaaatatgtctcatt

SEQ ID NO: 7866514 - DNA, 22 bp, Homo sapiens
atggcaccttccccagagctca

SEQ ID NO: 7866515 - DNA, 22 bp, Homo sapiens
atggcagaagtcaagatgagtt

SEQ ID NO: 7866516 - DNA, 22 bp, Homo sapiens
atggcagaagtcaagatgagtt

SEQ ID NO: 7866517 - DNA, 22 bp, Homo sapiens
atggcagaagtcaagatgagtt

SEQ ID NO: 7866518 - DNA, 22 bp, Homo sapiens
atggcagaaaggcatgtgggcc

SEQ ID NO: 7866519 - DNA, 22 bp, Homo sapiens
atggcagaaagaatagaggcta

SEQ ID NO: 7866520 - DNA, 22 bp, Homo sapiens
atggcagaaagaatagaggcta

SEQ ID NO: 7866521 - DNA, 22 bp, Homo sapiens
atggcagaaagaatagaggcta

SEQ ID NO: 7866522 - DNA, 22 bp, Homo sapiens
atggcagaaaggcatgtgggcc

SEQ ID NO: 7866523 - DNA, 22 bp, Homo sapiens
atggcagaaaggcatgtgggcc

SEQ ID NO: 7866524 - DNA, 22 bp, Homo sapiens
atggcagacacaggcaggcaga

SEQ ID NO: 7866525 - DNA, 22 bp, Homo sapiens
atggcagaattaggatttcaag

SEQ ID NO: 7866526 - DNA, 22 bp, Homo sapiens
atggcagaattaggatttcaag

SEQ ID NO: 7866527 - DNA, 22 bp, Homo sapiens
atggcagaattaggatttcaag

SEQ ID NO: 7866528 - DNA, 22 bp, Homo sapiens
atggcagaatccatagtaggtg

SEQ ID NO: 7866529 - DNA, 22 bp, Homo sapiens
atggcagaatcaagccgacagc

SEQ ID NO: 7866530 - DNA, 22 bp, Homo sapiens
atggcagaatatctgcatcgca

SEQ ID NO: 7866531 - DNA, 22 bp, Homo sapiens
atggcagaatatctgcatcgca

SEQ ID NO: 7866532 - DNA, 22 bp, Homo sapiens
atggcagacctgggctggagaa

SEQ ID NO: 7866533 - DNA, 22 bp, Homo sapiens
atggcagacctgggctggagaa

SEQ ID NO: 7866534 - DNA, 22 bp, Homo sapiens
atggcagacctgggctggagaa

SEQ ID NO: 7866535 - DNA, 22 bp, Homo sapiens
atggcagacctcctggccacaa

SEQ ID NO: 7866536 - DNA, 22 bp, Homo sapiens
atggcagacctcctggccacaa

SEQ ID NO: 7866537 - DNA, 22 bp, Homo sapiens
atggcagacctcctggccacaa

SEQ ID NO: 7866538 - DNA, 22 bp, Homo sapiens
atggcagacacaggcaggcaga

SEQ ID NO: 7866539 - DNA, 22 bp, Homo sapiens
atggcagacacaggcaggcaga

SEQ ID NO: 7866540 - DNA, 22 bp, Homo sapiens
atggcacagatgttctgattat

SEQ ID NO: 7866541 - DNA, 22 bp, Homo sapiens
atggcacagatgttctgattat

SEQ ID NO: 7866542 - DNA, 22 bp, Homo sapiens
atggcacacaggtctgcaaggg

SEQ ID NO: 7866543 - DNA, 22 bp, Homo sapiens
atggcacacaggtctgcaaggg

SEQ ID NO: 7866544 - DNA, 22 bp, Homo sapiens
atggcacaggagaggagggctg

SEQ ID NO: 7866545 - DNA, 22 bp, Homo sapiens
atggcacagtgggaaatgacct

SEQ ID NO: 7866546 - DNA, 22 bp, Homo sapiens
atggcaaaaactgcagttacct

SEQ ID NO: 7866547 - DNA, 22 bp, Homo sapiens
atggcaaaaattaacagatcaa

SEQ ID NO: 7866548 - DNA, 22 bp, Homo sapiens
atggcaaaaattaacagatcaa

SEQ ID NO: 7866549 - DNA, 22 bp, Homo sapiens
atggcaaaaactgcagttacct

SEQ ID NO: 7866550 - DNA, 22 bp, Homo sapiens
atggcaatgtggcttatttgga

SEQ ID NO: 7866551 - DNA, 22 bp, Homo sapiens
atggcaagcaagctgaagagat

SEQ ID NO: 7866552 - DNA, 22 bp, Homo sapiens
atggcaagcaagctgaagagat

SEQ ID NO: 7866553 - DNA, 22 bp, Homo sapiens
atggatggaactctgctgtggt

SEQ ID NO: 7866554 - DNA, 22 bp, Homo sapiens
atggatggcctgagcacagctg

SEQ ID NO: 7866555 - DNA, 22 bp, Homo sapiens
atggatgagtccttgagacaca

SEQ ID NO: 7866556 - DNA, 22 bp, Homo sapiens
atggatgagtccttgagacaca

SEQ ID NO: 7866557 - DNA, 22 bp, Homo sapiens
atggattcattaatgacttctc

SEQ ID NO: 7866558 - DNA, 22 bp, Homo sapiens
atggatgggatattgcttgcca

SEQ ID NO: 7866559 - DNA, 22 bp, Homo sapiens
atggatggcctgagcacagctg

SEQ ID NO: 7866560 - DNA, 22 bp, Homo sapiens
atggatttggatgagattactt

SEQ ID NO: 7866561 - DNA, 22 bp, Homo sapiens
atggatttggatgagattactt

SEQ ID NO: 7866562 - DNA, 22 bp, Homo sapiens
atggatttgcttatacacatgt

SEQ ID NO: 7866563 - DNA, 21 bp, Homo sapiens
atggatttaaacaggccacaa

SEQ ID NO: 7866564 - DNA, 21 bp, Homo sapiens
atggatttaaacaggccacaa

SEQ ID NO: 7866565 - DNA, 17 bp, Homo sapiens
gagacagcaggagcccc

SEQ ID NO: 7866566 - DNA, 17 bp, Homo sapiens
gagacagcaggagcccc

SEQ ID NO: 7866567 - DNA, 22 bp, Homo sapiens
gagaatctcaggcacccagaag

SEQ ID NO: 7866568 - DNA, 22 bp, Homo sapiens
gagacagcagggccagggcctg

SEQ ID NO: 7866569 - DNA, 22 bp, Homo sapiens
gagacagcagggccagggcctg

SEQ ID NO: 7866570 - DNA, 21 bp, Homo sapiens
gagacagcccagtgccagggc

SEQ ID NO: 7866571 - DNA, 22 bp, Homo sapiens
gagacaggatttaaccaaagct

SEQ ID NO: 7866572 - DNA, 22 bp, Homo sapiens
gagacaggatttaaccaaagct

SEQ ID NO: 7866573 - DNA, 22 bp, Homo sapiens
gagacaggatttaaccaaagct

SEQ ID NO: 7866574 - DNA, 21 bp, Homo sapiens
gagacagcccagtgccagggc

SEQ ID NO: 7866575 - DNA, 22 bp, Homo sapiens
gagacagcttaattggtggtca

SEQ ID NO: 7866576 - DNA, 22 bp, Homo sapiens
gagacagcttaattggtggtca

SEQ ID NO: 7866577 - DNA, 21 bp, Homo sapiens
gagaatagaggggaagctgaa

SEQ ID NO: 7866578 - DNA, 22 bp, Homo sapiens
gagaatatattgaagtagttcc

SEQ ID NO: 7866579 - DNA, 21 bp, Homo sapiens
gagaatcaggaaggattgatg

SEQ ID NO: 7866580 - DNA, 22 bp, Homo sapiens
gagaatcatggcaacagaatga

SEQ ID NO: 7866581 - DNA, 22 bp, Homo sapiens
gagaatcatttacagaatgatt

SEQ ID NO: 7866582 - DNA, 22 bp, Homo sapiens
gagaatcatttacagaatgatt

SEQ ID NO: 7866583 - DNA, 22 bp, Homo sapiens
gagaatctacaggaaaccgaag

SEQ ID NO: 7866584 - DNA, 22 bp, Homo sapiens
gagaatctacaggaaaccgaag

SEQ ID NO: 7866585 - DNA, 20 bp, Homo sapiens
gagacagcaaaagcctctcc

SEQ ID NO: 7866586 - DNA, 22 bp, Homo sapiens
gagaatctcaggcacccagaag

SEQ ID NO: 7866587 - DNA, 22 bp, Homo sapiens
gagacagcacaggccactggga

SEQ ID NO: 7866588 - DNA, 22 bp, Homo sapiens
gagacagtgcaggaaatctaaa

SEQ ID NO: 7866589 - DNA, 22 bp, Homo sapiens
gagacaggccaggtggtactta

SEQ ID NO: 7866590 - DNA, 22 bp, Homo sapiens
gagacagtgcaggaaatctaaa

SEQ ID NO: 7866591 - DNA, 22 bp, Homo sapiens
gagacagtgaggaaggctaggt

SEQ ID NO: 7866592 - DNA, 22 bp, Homo sapiens
atggagggtgtcagagagcgaa

SEQ ID NO: 7866593 - DNA, 22 bp, Homo sapiens
atggaggtctgtgactcccaaa

SEQ ID NO: 7866594 - DNA, 22 bp, Homo sapiens
atggaggtctgtgactcccaaa

SEQ ID NO: 7866595 - DNA, 22 bp, Homo sapiens
atggataatggtgatagttgca

SEQ ID NO: 7866596 - DNA, 22 bp, Homo sapiens
atggatctaccttcaggctctg

SEQ ID NO: 7866597 - DNA, 22 bp, Homo sapiens
atggatctgtatccaaaaatac

SEQ ID NO: 7866598 - DNA, 22 bp, Homo sapiens
atggatattggccaaactcatt

SEQ ID NO: 7866599 - DNA, 22 bp, Homo sapiens
atggatagtggtgaaggctgta

SEQ ID NO: 7866600 - DNA, 22 bp, Homo sapiens
atggatattggccaaactcatt

SEQ ID NO: 7866601 - DNA, 22 bp, Homo sapiens
gagacaggcagctagtgggtca

SEQ ID NO: 7866602 - DNA, 22 bp, Homo sapiens
gagacaggcagctagtgggtca

SEQ ID NO: 7866603 - DNA, 22 bp, Homo sapiens
gagacaggcagctagtgggtca

SEQ ID NO: 7866604 - DNA, 22 bp, Homo sapiens
gagacaggcagctagtgggtca

SEQ ID NO: 7866605 - DNA, 22 bp, Homo sapiens
gagacaggatttaaccaaagct

SEQ ID NO: 7866606 - DNA, 22 bp, Homo sapiens
gagacaggcagctagtgggtca

SEQ ID NO: 7866607 - DNA, 22 bp, Homo sapiens
gagacaggcagctagtgggtca

SEQ ID NO: 7866608 - DNA, 22 bp, Homo sapiens
gagacaggcagctagtgggtca

SEQ ID NO: 7866609 - DNA, 22 bp, Homo sapiens
gagacaggccaggtggtactta

SEQ ID NO: 7866610 - DNA, 22 bp, Homo sapiens
gagacaggccaggtggtactta

SEQ ID NO: 7866611 - DNA, 22 bp, Homo sapiens
gagacaggccaggtggtactta

SEQ ID NO: 7866612 - DNA, 22 bp, Homo sapiens
gagacaggccaggtggtactta

SEQ ID NO: 7866613 - DNA, 22 bp, Homo sapiens
gagacaggccaggtggtactta

SEQ ID NO: 7866614 - DNA, 22 bp, Homo sapiens
atgtgctgaaataaatgtggga

SEQ ID NO: 7866615 - DNA, 22 bp, Homo sapiens
atgtgctcaccctatttatgga

SEQ ID NO: 7866616 - DNA, 22 bp, Homo sapiens
atgtgctgaaataaatgtggga

SEQ ID NO: 7866617 - DNA, 22 bp, Homo sapiens
atgtgctgagtgtgtatataca

SEQ ID NO: 7866618 - DNA, 20 bp, Homo sapiens
atgtgctgggcaatatgtta

SEQ ID NO: 7866619 - DNA, 22 bp, Homo sapiens
atgtgctggctaactggatggg

SEQ ID NO: 7866620 - DNA, 22 bp, Homo sapiens
atgtgctgagtgtgtatataca

SEQ ID NO: 7866621 - DNA, 22 bp, Homo sapiens
atgtgcttcataatcttctcat

SEQ ID NO: 7866622 - DNA, 22 bp, Homo sapiens
atgtgctgtaatccattgaagg

SEQ ID NO: 7866623 - DNA, 21 bp, Homo sapiens
atgtgcttagctgctggtagt

SEQ ID NO: 7866624 - DNA, 22 bp, Homo sapiens
atgtgcttcaggatgtcagtgt

SEQ ID NO: 7866625 - DNA, 22 bp, Homo sapiens
atgtgcttggaaaagcagtggt

SEQ ID NO: 7866626 - DNA, 22 bp, Homo sapiens
atgtgcttgcagatgagcctca

SEQ ID NO: 7866627 - DNA, 22 bp, Homo sapiens
atgtgcttggaaaagcagtggt

SEQ ID NO: 7866628 - DNA, 22 bp, Homo sapiens
atgtgcttggacattctaggaa

SEQ ID NO: 7866629 - DNA, 22 bp, Homo sapiens
atgtgcttgagggaaatcagtt

SEQ ID NO: 7866630 - DNA, 22 bp, Homo sapiens
atgtgcttgactactctctatt

SEQ ID NO: 7866631 - DNA, 22 bp, Homo sapiens
atgtgcttgaagcctcagagaa

SEQ ID NO: 7866632 - DNA, 22 bp, Homo sapiens
atgtgctttattaagtaaaaat

SEQ ID NO: 7866633 - DNA, 22 bp, Homo sapiens
atgtgctttaggtttgtttaca

SEQ ID NO: 7866634 - DNA, 19 bp, Homo sapiens
atgtgcttgggccatgcta

SEQ ID NO: 7866635 - DNA, 22 bp, Homo sapiens
atgtgcttgtaatgttaaatgt

SEQ ID NO: 7866636 - DNA, 22 bp, Homo sapiens
atgtgctttaaagaagccagct

SEQ ID NO: 7866637 - DNA, 22 bp, Homo sapiens
atgtggcaccgatctttagcca

SEQ ID NO: 7866638 - DNA, 22 bp, Homo sapiens
atgtggcagtgggaggtgaatt

SEQ ID NO: 7866639 - DNA, 22 bp, Homo sapiens
atgtggcattcttggtcatttc

SEQ ID NO: 7866640 - DNA, 22 bp, Homo sapiens
atgtggcaatggttagcactgt

SEQ ID NO: 7866641 - DNA, 22 bp, Homo sapiens
atgtggcaatggttagcactgt

SEQ ID NO: 7866642 - DNA, 22 bp, Homo sapiens
atgtggcaccgatctttagcca

SEQ ID NO: 7866643 - DNA, 22 bp, Homo sapiens
atgtggcacagcacagtaagag

SEQ ID NO: 7866644 - DNA, 22 bp, Homo sapiens
atgtggcccagcggtcaggctg

SEQ ID NO: 7866645 - DNA, 22 bp, Homo sapiens
atgtggcccagcggtcaggctg

SEQ ID NO: 7866646 - DNA, 22 bp, Homo sapiens
atgtggatgtttatatgaagaa

SEQ ID NO: 7866647 - DNA, 22 bp, Homo sapiens
atgtggatctgttattctagat

SEQ ID NO: 7866648 - DNA, 22 bp, Homo sapiens
atgtggagaggaagtgcaaact

SEQ ID NO: 7866649 - DNA, 22 bp, Homo sapiens
atgtggaatgaacaaaggaggc

SEQ ID NO: 7866650 - DNA, 22 bp, Homo sapiens
atgtggaatgaacaaaggaggc

SEQ ID NO: 7866651 - DNA, 22 bp, Homo sapiens
atgtgctttgctggaaatgtca

SEQ ID NO: 7866652 - DNA, 22 bp, Homo sapiens
atgtgctttctttgtttcataa

SEQ ID NO: 7866653 - DNA, 22 bp, Homo sapiens
atgtgctttccaatgctgtagg

SEQ ID NO: 7866654 - DNA, 22 bp, Homo sapiens
atgtcagtctttctgtctcaga

SEQ ID NO: 7866655 - DNA, 21 bp, Homo sapiens
atgtcagtggtttaacacaac

SEQ ID NO: 7866656 - DNA, 22 bp, Homo sapiens
atgtcagtctttctgtctcaga

SEQ ID NO: 7866657 - DNA, 22 bp, Homo sapiens
atgtcaggaccctactgcattg

SEQ ID NO: 7866658 - DNA, 21 bp, Homo sapiens
atgtcaggcacttatgaggaa

SEQ ID NO: 7866659 - DNA, 22 bp, Homo sapiens
atgtcagattcctaaatatctt

SEQ ID NO: 7866660 - DNA, 22 bp, Homo sapiens
atgtcatattactaatgctggc

SEQ ID NO: 7866661 - DNA, 22 bp, Homo sapiens
atgtcatattactaatgctggc

SEQ ID NO: 7866662 - DNA, 22 bp, Homo sapiens
atgtcatattactaatgctggc

SEQ ID NO: 7866663 - DNA, 22 bp, Homo sapiens
atgtgaggtagataggatgcag

SEQ ID NO: 7866664 - DNA, 22 bp, Homo sapiens
atgtcatattactaatgctggc

SEQ ID NO: 7866665 - DNA, 22 bp, Homo sapiens
atgtgccctcttagagtctctg

SEQ ID NO: 7866666 - DNA, 22 bp, Homo sapiens
atgtgcccctgttttgaattgt

SEQ ID NO: 7866667 - DNA, 22 bp, Homo sapiens
atgtgccctttctgctttgcag

SEQ ID NO: 7866668 - DNA, 22 bp, Homo sapiens
atgtgccctcttagagtctctg

SEQ ID NO: 7866669 - DNA, 22 bp, Homo sapiens
atgtgccctttctgctttgcag

SEQ ID NO: 7866670 - DNA, 22 bp, Homo sapiens
atgtgcctgtgtttggagttaa

SEQ ID NO: 7866671 - DNA, 19 bp, Homo sapiens
atgtgcccaggggaaagaa

SEQ ID NO: 7866672 - DNA, 22 bp, Homo sapiens
atgtgccttcatcctccctgtc

SEQ ID NO: 7866673 - DNA, 22 bp, Homo sapiens
atgtgcgtgtgtacatatatat

SEQ ID NO: 7866674 - DNA, 22 bp, Homo sapiens
atgtgccacatgatattgtctc

SEQ ID NO: 7866675 - DNA, 22 bp, Homo sapiens
atgtgaggtatctaggtcttcg

SEQ ID NO: 7866676 - DNA, 22 bp, Homo sapiens
atgtcactgtgaggcagctgtc

SEQ ID NO: 7866677 - DNA, 22 bp, Homo sapiens
gaggctgaacaggttctcatga

SEQ ID NO: 7866678 - DNA, 22 bp, Homo sapiens
atgtcacttttgagactaggtt

SEQ ID NO: 7866679 - DNA, 22 bp, Homo sapiens
atgtcactgtgaggcagctgtc

SEQ ID NO: 7866680 - DNA, 22 bp, Homo sapiens
atgtcacttttctccctgctgg

SEQ ID NO: 7866681 - DNA, 22 bp, Homo sapiens
atgtcacttttctccctgctgg

SEQ ID NO: 7866682 - DNA, 22 bp, Homo sapiens
atgtcactccagggacacaggt

SEQ ID NO: 7866683 - DNA, 22 bp, Homo sapiens
gaggctcttttctgctgtgtct

SEQ ID NO: 7866684 - DNA, 22 bp, Homo sapiens
gaggctgaacaggttctcatga

SEQ ID NO: 7866685 - DNA, 22 bp, Homo sapiens
gaggctcttttctgctgtgtct

SEQ ID NO: 7866686 - DNA, 22 bp, Homo sapiens
gaggctcttttctgctgtgtct

SEQ ID NO: 7866687 - DNA, 22 bp, Homo sapiens
gaggctcttttctgctgtgtct

SEQ ID NO: 7866688 - DNA, 22 bp, Homo sapiens
atgtcagaagctggatgacagc

SEQ ID NO: 7866689 - DNA, 22 bp, Homo sapiens
atgtcagaagctggatgacagc

SEQ ID NO: 7866690 - DNA, 22 bp, Homo sapiens
atgtcagaatctacattctact

SEQ ID NO: 7866691 - DNA, 22 bp, Homo sapiens
atgtcagaagaacaatgagata

SEQ ID NO: 7866692 - DNA, 22 bp, Homo sapiens
atgtcagagcttccacaatagt

SEQ ID NO: 7866693 - DNA, 22 bp, Homo sapiens
atgtcagaatctacattctact

SEQ ID NO: 7866694 - DNA, 22 bp, Homo sapiens
atgtcagaatctacattctact

SEQ ID NO: 7866695 - DNA, 22 bp, Homo sapiens
atgtcagaatctacattctact

SEQ ID NO: 7866696 - DNA, 22 bp, Homo sapiens
atgtcagatcctcagaaagtct

SEQ ID NO: 7866697 - DNA, 22 bp, Homo sapiens
atgtcagatcctcagaaagtct

SEQ ID NO: 7866698 - DNA, 22 bp, Homo sapiens
atgtcagatgtttatctgattt

SEQ ID NO: 7866699 - DNA, 22 bp, Homo sapiens
atgtcagattcctaaatatctt

SEQ ID NO: 7866700 - DNA, 22 bp, Homo sapiens
atgtcagatgtttatctgattt

SEQ ID NO: 7866701 - DNA, 22 bp, Homo sapiens
gaggttaggtgacttgttcaga

SEQ ID NO: 7866702 - DNA, 22 bp, Homo sapiens
gaggttctgggggtctgcctgg

SEQ ID NO: 7866703 - DNA, 22 bp, Homo sapiens
gaggttccagacagcttaggga

SEQ ID NO: 7866704 - DNA, 22 bp, Homo sapiens
gaggttccccattgtactggct

SEQ ID NO: 7866705 - DNA, 22 bp, Homo sapiens
gaggttgggaagtccaagctgg

SEQ ID NO: 7866706 - DNA, 22 bp, Homo sapiens
gaggttgggaagtccaagctgg

SEQ ID NO: 7866707 - DNA, 22 bp, Homo sapiens
gaggttggagggctggcctgca

SEQ ID NO: 7866708 - DNA, 22 bp, Homo sapiens
gaggttggagggctggcctgca

SEQ ID NO: 7866709 - DNA, 22 bp, Homo sapiens
gagtgcagtatgagaggctgct

SEQ ID NO: 7866710 - DNA, 22 bp, Homo sapiens
gagtgcagtatcttctgtgtcc

SEQ ID NO: 7866711 - DNA, 22 bp, Homo sapiens
gagtgcagtatcttctgtgtcc

SEQ ID NO: 7866712 - DNA, 21 bp, Homo sapiens
gagtgcaggtctgatgccatc

SEQ ID NO: 7866713 - DNA, 22 bp, Homo sapiens
gagtgcagtatcttctgtgtcc

SEQ ID NO: 7866714 - DNA, 22 bp, Homo sapiens
gaggttgggatgagggatacag

SEQ ID NO: 7866715 - DNA, 22 bp, Homo sapiens
gaggtgtgttacagattgtcat

SEQ ID NO: 7866716 - DNA, 22 bp, Homo sapiens
gaggtgtggtcctcagccccca

SEQ ID NO: 7866717 - DNA, 22 bp, Homo sapiens
gaggtgtgatgcagagtggtgg

SEQ ID NO: 7866718 - DNA, 22 bp, Homo sapiens
gaggtgtgatgcagagtggtgg

SEQ ID NO: 7866719 - DNA, 22 bp, Homo sapiens
gaggtgtgaggaatgaatgggg

SEQ ID NO: 7866720 - DNA, 22 bp, Homo sapiens
gaggtgtgctgcggcccggtgc

SEQ ID NO: 7866721 - DNA, 22 bp, Homo sapiens
gaggtgtggtcctcagccccca

SEQ ID NO: 7866722 - DNA, 22 bp, Homo sapiens
gaggtgtgcacagcgtgctgac

SEQ ID NO: 7866723 - DNA, 22 bp, Homo sapiens
gaggtgtgcacagcgtgctgac

SEQ ID NO: 7866724 - DNA, 22 bp, Homo sapiens
gaggtgtgcacagcgtgctgac

SEQ ID NO: 7866725 - DNA, 22 bp, Homo sapiens
atgttatagttataaaatgagg

SEQ ID NO: 7866726 - DNA, 22 bp, Homo sapiens
atgttatagttataaaatgagg

SEQ ID NO: 7866727 - DNA, 22 bp, Homo sapiens
atgttatagttataaaatgagg

SEQ ID NO: 7866728 - DNA, 22 bp, Homo sapiens
atgttagtgatagtaaatagtg

SEQ ID NO: 7866729 - DNA, 22 bp, Homo sapiens
atgttagtgtcactttgtacaa

SEQ ID NO: 7866730 - DNA, 22 bp, Homo sapiens
atgttatggctcaaacatttgg

SEQ ID NO: 7866731 - DNA, 22 bp, Homo sapiens
atgttatggctcaaacatttgg

SEQ ID NO: 7866732 - DNA, 22 bp, Homo sapiens
gaggtgtgaggaatgaatgggg

SEQ ID NO: 7866733 - DNA, 23 bp, Homo sapiens
gaggtgtgaattctgggtgctgc

SEQ ID NO: 7866734 - DNA, 21 bp, Homo sapiens
atgtggctcccttcctcagga

SEQ ID NO: 7866735 - DNA, 22 bp, Homo sapiens
atgtggctgatcgcagagctct

SEQ ID NO: 7866736 - DNA, 22 bp, Homo sapiens
atgtggctgccacctgcctgaa

SEQ ID NO: 7866737 - DNA, 22 bp, Homo sapiens
atgtggctgccacctgcctgaa

SEQ ID NO: 7866738 - DNA, 21 bp, Homo sapiens
atgtggctcccttcctcagga

SEQ ID NO: 7866739 - DNA, 21 bp, Homo sapiens
atgtggctcccttcctcagga

SEQ ID NO: 7866740 - DNA, 22 bp, Homo sapiens
atgtggctccttactcatcagc

SEQ ID NO: 7866741 - DNA, 23 bp, Homo sapiens
atgttaaacataactgaagagcc

SEQ ID NO: 7866742 - DNA, 23 bp, Homo sapiens
atgttaaacataactgaagagcc

SEQ ID NO: 7866743 - DNA, 23 bp, Homo sapiens
atgttaaacataactgaagagcc

SEQ ID NO: 7866744 - DNA, 22 bp, Homo sapiens
atgtggctggtgactgccgtac

SEQ ID NO: 7866745 - DNA, 22 bp, Homo sapiens
atgttaaaagtgaggatggcca

SEQ ID NO: 7866746 - DNA, 22 bp, Homo sapiens
atgttaaaagtctgagtgggag

SEQ ID NO: 7866747 - DNA, 22 bp, Homo sapiens
atgtggctagtgcaactgagaa

SEQ ID NO: 7866748 - DNA, 22 bp, Homo sapiens
atgtggctagtgcagatgaata

SEQ ID NO: 7866749 - DNA, 22 bp, Homo sapiens
atgtggctagtcctctgcggca

SEQ ID NO: 7866750 - DNA, 18 bp, Homo sapiens
atgtggctagtgcaactg

SEQ ID NO: 7866751 - DNA, 22 bp, Homo sapiens
atgtggccttaatgacagcagc

SEQ ID NO: 7866752 - DNA, 22 bp, Homo sapiens
atgtggctcattgtttgcttac

SEQ ID NO: 7866753 - DNA, 22 bp, Homo sapiens
atgtggctcattgtttgcttac

SEQ ID NO: 7866754 - DNA, 22 bp, Homo sapiens
atgtggctcagcaggctcccgt

SEQ ID NO: 7866755 - DNA, 22 bp, Homo sapiens
atgtggctagtggacacagtat

SEQ ID NO: 7866756 - DNA, 18 bp, Homo sapiens
atgtggctagtgctactg

SEQ ID NO: 7866757 - DNA, 22 bp, Homo sapiens
atgttaggcaatctttcttgtt

SEQ ID NO: 7866758 - DNA, 22 bp, Homo sapiens
atgttagcttgtgtgaaaatgc

SEQ ID NO: 7866759 - DNA, 22 bp, Homo sapiens
atgttaggcaatctttcttgtt

SEQ ID NO: 7866760 - DNA, 22 bp, Homo sapiens
atgttagtgaccaaatctttct

SEQ ID NO: 7866761 - DNA, 22 bp, Homo sapiens
atgttagcattgagcacttact

SEQ ID NO: 7866762 - DNA, 22 bp, Homo sapiens
atgttagaatctctgaatgtgg

SEQ ID NO: 7866763 - DNA, 22 bp, Homo sapiens
atgttagaaggaatgttaaaag

SEQ ID NO: 7866764 - DNA, 22 bp, Homo sapiens
atgttagaaggaatgttaaaag

SEQ ID NO: 7866765 - DNA, 22 bp, Homo sapiens
atgttagaatctctgaatgtgg

SEQ ID NO: 7866766 - DNA, 22 bp, Homo sapiens
atgttacttagaataattctgg

SEQ ID NO: 7866767 - DNA, 22 bp, Homo sapiens
atgttacttagaataattctgg

SEQ ID NO: 7866768 - DNA, 22 bp, Homo sapiens
atgttaccatcttttatctaca

SEQ ID NO: 7866769 - DNA, 22 bp, Homo sapiens
atgttactgtgatcatgatact

SEQ ID NO: 7866770 - DNA, 23 bp, Homo sapiens
atgttacttaacctctctgtgcc

SEQ ID NO: 7866771 - DNA, 22 bp, Homo sapiens
atgttactgtgatcatgatact

SEQ ID NO: 7866772 - DNA, 22 bp, Homo sapiens
atgttactgtgatcatgatact

SEQ ID NO: 7866773 - DNA, 22 bp, Homo sapiens
atgttacatagtccttatttgt

SEQ ID NO: 7866774 - DNA, 22 bp, Homo sapiens
atgttacagttgagtaaattaa

SEQ ID NO: 7866775 - DNA, 22 bp, Homo sapiens
atgttacattgagaggtggttg

SEQ ID NO: 7866776 - DNA, 22 bp, Homo sapiens
atgttaccagtgcacatttgat

SEQ ID NO: 7866777 - DNA, 22 bp, Homo sapiens
atgttacatgaaacggcctact

SEQ ID NO: 7866778 - DNA, 22 bp, Homo sapiens
atgttacatagtccttatttgt

SEQ ID NO: 7866779 - DNA, 22 bp, Homo sapiens
atgttacagagaaagtggaagc

SEQ ID NO: 7866780 - DNA, 16 bp, Homo sapiens
atgttacagaagtaat

SEQ ID NO: 7866781 - DNA, 22 bp, Homo sapiens
atgttacagagaaagtggaagc

SEQ ID NO: 7866782 - DNA, 23 bp, Homo sapiens
atgttaaacataactgaagagcc

SEQ ID NO: 7866783 - DNA, 22 bp, Homo sapiens
atgttacagcagcccgaatgga

SEQ ID NO: 7866784 - DNA, 22 bp, Homo sapiens
atgttacagggagagaaggcca

SEQ ID NO: 7866785 - DNA, 22 bp, Homo sapiens
atgttacagttgagtaaattaa

SEQ ID NO: 7866786 - DNA, 22 bp, Homo sapiens
atgttacagttgagtaaattaa

SEQ ID NO: 7866787 - DNA, 22 bp, Homo sapiens
atgtatgtgagctttgagatca

SEQ ID NO: 7866788 - DNA, 22 bp, Homo sapiens
atgtatgtgcacgcatgtacat

SEQ ID NO: 7866789 - DNA, 22 bp, Homo sapiens
atgtatgtctgatgcacatgca

SEQ ID NO: 7866790 - DNA, 22 bp, Homo sapiens
atgtatgtctgatgcacatgca

SEQ ID NO: 7866791 - DNA, 22 bp, Homo sapiens
atgtatgtctgcatacacatac

SEQ ID NO: 7866792 - DNA, 22 bp, Homo sapiens
atgtatgttagtgtattatcta

SEQ ID NO: 7866793 - DNA, 22 bp, Homo sapiens
atgtatgttagtgtattatcta

SEQ ID NO: 7866794 - DNA, 22 bp, Homo sapiens
atgtatgtttctatatatgaca

SEQ ID NO: 7866795 - DNA, 23 bp, Homo sapiens
atgtatgtttctgcatcttcaac

SEQ ID NO: 7866796 - DNA, 22 bp, Homo sapiens
atgtatgtttctatatatgaca

SEQ ID NO: 7866797 - DNA, 22 bp, Homo sapiens
atgtatgtttctatatatgaca

SEQ ID NO: 7866798 - DNA, 22 bp, Homo sapiens
atgtatgtttcatatcttcatt

SEQ ID NO: 7866799 - DNA, 22 bp, Homo sapiens
atgtattcaagccacatacatt

SEQ ID NO: 7866800 - DNA, 22 bp, Homo sapiens
atgtattgaccatactactaaa

SEQ ID NO: 7866801 - DNA, 22 bp, Homo sapiens
atgtatgtagtgtacatataca

SEQ ID NO: 7866802 - DNA, 22 bp, Homo sapiens
atgtatgtagtgtacatataca

SEQ ID NO: 7866803 - DNA, 22 bp, Homo sapiens
atgtatgcatgctacagttttc

SEQ ID NO: 7866804 - DNA, 20 bp, Homo sapiens
atgtatgcaaatgtcttcca

SEQ ID NO: 7866805 - DNA, 22 bp, Homo sapiens
atgtatgtagtgtacatataca

SEQ ID NO: 7866806 - DNA, 22 bp, Homo sapiens
atgtatcagataaagcatgtgg

SEQ ID NO: 7866807 - DNA, 23 bp, Homo sapiens
atgtatctcatccaaggaagctc

SEQ ID NO: 7866808 - DNA, 22 bp, Homo sapiens
atgtatgaagctttgtttggga

SEQ ID NO: 7866809 - DNA, 22 bp, Homo sapiens
atgtatgagagattcttttatt

SEQ ID NO: 7866810 - DNA, 19 bp, Homo sapiens
atgtatgaggtcttctgct

SEQ ID NO: 7866811 - DNA, 22 bp, Homo sapiens
atgtatgatatttccagtatca

SEQ ID NO: 7866812 - DNA, 22 bp, Homo sapiens
atgtatgatgctaggctctcag

SEQ ID NO: 7866813 - DNA, 22 bp, Homo sapiens
atgtatcacagcaatgtagtca

SEQ ID NO: 7866814 - DNA, 22 bp, Homo sapiens
atgtatcacagcaatgtagtca

SEQ ID NO: 7866815 - DNA, 22 bp, Homo sapiens
atgtatcacagcaatgtagtca

SEQ ID NO: 7866816 - DNA, 22 bp, Homo sapiens
atgtatcagataaagcatgtgg

SEQ ID NO: 7866817 - DNA, 22 bp, Homo sapiens
atgtatcagaaatagcattggc

SEQ ID NO: 7866818 - DNA, 22 bp, Homo sapiens
gaggctccccatgaggccccag

SEQ ID NO: 7866819 - DNA, 22 bp, Homo sapiens
gaggctcccaaggggctaggcc

SEQ ID NO: 7866820 - DNA, 22 bp, Homo sapiens
gaggctccatggaggagtatgg

SEQ ID NO: 7866821 - DNA, 22 bp, Homo sapiens
gaggctcccaaggggctaggcc

SEQ ID NO: 7866822 - DNA, 22 bp, Homo sapiens
gaggctccctcaactctgggtg

SEQ ID NO: 7866823 - DNA, 22 bp, Homo sapiens
gaggctccctcaactctgggtg

SEQ ID NO: 7866824 - DNA, 22 bp, Homo sapiens
gaggctccctttaggtccagat

SEQ ID NO: 7866825 - DNA, 22 bp, Homo sapiens
gaggctccggtagtagccttga

SEQ ID NO: 7866826 - DNA, 22 bp, Homo sapiens
gaggctccctttaggtccagat

SEQ ID NO: 7866827 - DNA, 22 bp, Homo sapiens
gaggctccgtgctgctgccctg

SEQ ID NO: 7866828 - DNA, 22 bp, Homo sapiens
gaggctccgtgctgctgccctg

SEQ ID NO: 7866829 - DNA, 22 bp, Homo sapiens
gaggctcctcattcagtatgct

SEQ ID NO: 7866830 - DNA, 20 bp, Homo sapiens
gaggctctgggcatggcgcc

SEQ ID NO: 7866831 - DNA, 22 bp, Homo sapiens
gaggctctggagtaggtacaca

SEQ ID NO: 7866832 - DNA, 22 bp, Homo sapiens
gaggctctgtgatgtgccaggc

SEQ ID NO: 7866833 - DNA, 20 bp, Homo sapiens
gaggctctgggcatggcgcc

SEQ ID NO: 7866834 - DNA, 22 bp, Homo sapiens
gaggctctttaaatcttttgga

SEQ ID NO: 7866835 - DNA, 22 bp, Homo sapiens
gaggctcttcaataggtcaatg

SEQ ID NO: 7866836 - DNA, 22 bp, Homo sapiens
atgtatttctatgtagtgaaga

SEQ ID NO: 7866837 - DNA, 22 bp, Homo sapiens
atgtatttctatgtagtgaaga

SEQ ID NO: 7866838 - DNA, 22 bp, Homo sapiens
atgtatttactgagaaggaaac

SEQ ID NO: 7866839 - DNA, 23 bp, Homo sapiens
atgtatttaaatttcagtgatga

SEQ ID NO: 7866840 - DNA, 22 bp, Homo sapiens
atgtatttactgagaaggaaac

SEQ ID NO: 7866841 - DNA, 22 bp, Homo sapiens
atgtatttactgagaaggaaac

SEQ ID NO: 7866842 - DNA, 23 bp, Homo sapiens
atgtatttaaatttcagtgatga

SEQ ID NO: 7866843 - DNA, 22 bp, Homo sapiens
atgtattgtctcttttccttaa

SEQ ID NO: 7866844 - DNA, 23 bp, Homo sapiens
atgtatttaaatttcagtgatga

SEQ ID NO: 7866845 - DNA, 23 bp, Homo sapiens
atgtatttaaatttcagtgatga

SEQ ID NO: 7866846 - DNA, 23 bp, Homo sapiens
atgtatttaaatttcagtgatga

SEQ ID NO: 7866847 - DNA, 22 bp, Homo sapiens
gaggcctgggttggaggtgcat

SEQ ID NO: 7866848 - DNA, 22 bp, Homo sapiens
gaggcctgggttggaggtgcat

SEQ ID NO: 7866849 - DNA, 22 bp, Homo sapiens
gaggcctgggttggaggtgcat

SEQ ID NO: 7866850 - DNA, 22 bp, Homo sapiens
gaggcctgggttggaggtgcat

SEQ ID NO: 7866851 - DNA, 22 bp, Homo sapiens
gaggcctgggttggaggtgcat

SEQ ID NO: 7866852 - DNA, 22 bp, Homo sapiens
gaggctccagcgacacctaggc

SEQ ID NO: 7866853 - DNA, 22 bp, Homo sapiens
gaggcctgggttggaggtgcat

SEQ ID NO: 7866854 - DNA, 22 bp, Homo sapiens
gaggcctgggttggaggtgcat

SEQ ID NO: 7866855 - DNA, 22 bp, Homo sapiens
atgtatttctatgtagtgaaga

SEQ ID NO: 7866856 - DNA, 22 bp, Homo sapiens
atgtatttctatgtagtgaaga

SEQ ID NO: 7866857 - DNA, 22 bp, Homo sapiens
gaggagctgggtcagggagaca

SEQ ID NO: 7866858 - DNA, 22 bp, Homo sapiens
gaggagggagctggaagctctt

SEQ ID NO: 7866859 - DNA, 22 bp, Homo sapiens
gaggagggagctggaagctctt

SEQ ID NO: 7866860 - DNA, 22 bp, Homo sapiens
gaggagggagctggaagctctt

SEQ ID NO: 7866861 - DNA, 22 bp, Homo sapiens
gaggagggagctggaagctctt

SEQ ID NO: 7866862 - DNA, 22 bp, Homo sapiens
gaggagggcagttcctctttta

SEQ ID NO: 7866863 - DNA, 22 bp, Homo sapiens
gaggagggcagttcctctttta

SEQ ID NO: 7866864 - DNA, 22 bp, Homo sapiens
gaggagggcagttcctctttta

SEQ ID NO: 7866865 - DNA, 22 bp, Homo sapiens
gaggagggctttgttgatgtta

SEQ ID NO: 7866866 - DNA, 22 bp, Homo sapiens
gaggagggctttgttgatgtta

SEQ ID NO: 7866867 - DNA, 22 bp, Homo sapiens
gaggagggctttgttgatgtta

SEQ ID NO: 7866868 - DNA, 22 bp, Homo sapiens
gaggagggctttgttgatgtta

SEQ ID NO: 7866869 - DNA, 22 bp, Homo sapiens
gaggaggggacagtacttgtgc

SEQ ID NO: 7866870 - DNA, 22 bp, Homo sapiens
gaggaggggacagtacttgtgc

SEQ ID NO: 7866871 - DNA, 22 bp, Homo sapiens
gaggaggggacagtacttgtgc

SEQ ID NO: 7866872 - DNA, 22 bp, Homo sapiens
gaggagggctttgttgatgtta

SEQ ID NO: 7866873 - DNA, 22 bp, Homo sapiens
gaggagggcctggtgtcccttc

SEQ ID NO: 7866874 - DNA, 22 bp, Homo sapiens
gaggagggcctggtgtcccttc

SEQ ID NO: 7866875 - DNA, 22 bp, Homo sapiens
gaggagggcctggtgtcccttc

SEQ ID NO: 7866876 - DNA, 22 bp, Homo sapiens
gaggagggcctggtgtcccttc

SEQ ID NO: 7866877 - DNA, 22 bp, Homo sapiens
gaggagggcctggtgtcccttc

SEQ ID NO: 7866878 - DNA, 22 bp, Homo sapiens
atgggcagctgcagcagtggtg

SEQ ID NO: 7866879 - DNA, 22 bp, Homo sapiens
atgggcagctgcagcagtggtg

SEQ ID NO: 7866880 - DNA, 22 bp, Homo sapiens
atgggcagcagctgtcattttc

SEQ ID NO: 7866881 - DNA, 22 bp, Homo sapiens
atgggcagctgcagcagtggtg

SEQ ID NO: 7866882 - DNA, 22 bp, Homo sapiens
atgggcagctgcagcagtggtg

SEQ ID NO: 7866883 - DNA, 22 bp, Homo sapiens
atgggcagctgcagcagtggtg

SEQ ID NO: 7866884 - DNA, 22 bp, Homo sapiens
atgggcagctgcagcagtggtg

SEQ ID NO: 7866885 - DNA, 22 bp, Homo sapiens
atgggcagagtggggacaggaa

SEQ ID NO: 7866886 - DNA, 22 bp, Homo sapiens
atgggcagagtggggacaggaa

SEQ ID NO: 7866887 - DNA, 22 bp, Homo sapiens
atgggcagagtggggacaggaa

SEQ ID NO: 7866888 - DNA, 22 bp, Homo sapiens
atgggcagagtggggacaggaa

SEQ ID NO: 7866889 - DNA, 22 bp, Homo sapiens
atgggcagcagctgccattcat

SEQ ID NO: 7866890 - DNA, 22 bp, Homo sapiens
atgggcaggcctctcatttctg

SEQ ID NO: 7866891 - DNA, 22 bp, Homo sapiens
gaggagctgggtcagggagaca

SEQ ID NO: 7866892 - DNA, 22 bp, Homo sapiens
gaggagctgggtcagggagaca

SEQ ID NO: 7866893 - DNA, 22 bp, Homo sapiens
atgggcagctgcagcagtggtg

SEQ ID NO: 7866894 - DNA, 22 bp, Homo sapiens
atgggcagctgcagcagtggtg

SEQ ID NO: 7866895 - DNA, 22 bp, Homo sapiens
atgggcaggcaaggtggcgagt

SEQ ID NO: 7866896 - DNA, 22 bp, Homo sapiens
atgggcaggcaaggtggcgagt

SEQ ID NO: 7866897 - DNA, 22 bp, Homo sapiens
atgggcaggcaaggtggcgagt

SEQ ID NO: 7866898 - DNA, 22 bp, Homo sapiens
atgggcaggcaaggtggcgagt

SEQ ID NO: 7866899 - DNA, 22 bp, Homo sapiens
gaggcacagtcccgaggcaagg

SEQ ID NO: 7866900 - DNA, 22 bp, Homo sapiens
gaggcacagtcccgaggcaagg

SEQ ID NO: 7866901 - DNA, 22 bp, Homo sapiens
gaggcacagtcccgaggcaagg

SEQ ID NO: 7866902 - DNA, 22 bp, Homo sapiens
gaggcacagtgtttggtcagtg

SEQ ID NO: 7866903 - DNA, 22 bp, Homo sapiens
gaggcacagtgtttggtcagtg

SEQ ID NO: 7866904 - DNA, 22 bp, Homo sapiens
gaggcacagtcccgaggcaagg

SEQ ID NO: 7866905 - DNA, 22 bp, Homo sapiens
gaggcacagtcccgaggcaagg

SEQ ID NO: 7866906 - DNA, 22 bp, Homo sapiens
gaggcacagagtaggtgcacac

SEQ ID NO: 7866907 - DNA, 22 bp, Homo sapiens
gaggcacagtgtttggtcagtg

SEQ ID NO: 7866908 - DNA, 22 bp, Homo sapiens
gaggcacagtgtttggtcagtg

SEQ ID NO: 7866909 - DNA, 22 bp, Homo sapiens
gaggcacagtgtttggtcagtg

SEQ ID NO: 7866910 - DNA, 22 bp, Homo sapiens
gaggcacagtgtttggtcagtg

SEQ ID NO: 7866911 - DNA, 18 bp, Homo sapiens
gaggcacatagttggggc

SEQ ID NO: 7866912 - DNA, 22 bp, Homo sapiens
gaggcacagttcttcctccaga

SEQ ID NO: 7866913 - DNA, 18 bp, Homo sapiens
gaggcacatagttggggc

SEQ ID NO: 7866914 - DNA, 18 bp, Homo sapiens
gaggcacatagttggggc

SEQ ID NO: 7866915 - DNA, 18 bp, Homo sapiens
gaggcacatagttggggc

SEQ ID NO: 7866916 - DNA, 18 bp, Homo sapiens
gaggcacatagttggggc

SEQ ID NO: 7866917 - DNA, 22 bp, Homo sapiens
gaggcacatatatacagagccc

SEQ ID NO: 7866918 - DNA, 22 bp, Homo sapiens
gaggcacatatatacagagccc

SEQ ID NO: 7866919 - DNA, 22 bp, Homo sapiens
atgtagctggggaggttgagtc

SEQ ID NO: 7866920 - DNA, 20 bp, Homo sapiens
atgtatattactggctgtga

SEQ ID NO: 7866921 - DNA, 22 bp, Homo sapiens
atgtagcttcctaggagtgatt

SEQ ID NO: 7866922 - DNA, 22 bp, Homo sapiens
atgtatcaattatctgtctgca

SEQ ID NO: 7866923 - DNA, 22 bp, Homo sapiens
atgtatcaactgcaggcaagtt

SEQ ID NO: 7866924 - DNA, 22 bp, Homo sapiens
gaggaggggacagtacttgtgc

SEQ ID NO: 7866925 - DNA, 22 bp, Homo sapiens
gaggaggggcacttgtctccta

SEQ ID NO: 7866926 - DNA, 22 bp, Homo sapiens
gaggaggggcacttgtctccta

SEQ ID NO: 7866927 - DNA, 22 bp, Homo sapiens
gaggaggggcacttgtctccta

SEQ ID NO: 7866928 - DNA, 22 bp, Homo sapiens
gaggagggctttgttgatgtta

SEQ ID NO: 7866929 - DNA, 22 bp, Homo sapiens
gaggaggggcacttgtctccta

SEQ ID NO: 7866930 - DNA, 22 bp, Homo sapiens
gaggaggggcacttgtctccta

SEQ ID NO: 7866931 - DNA, 23 bp, Homo sapiens
gaggagggtcgtgctgtgttcct

SEQ ID NO: 7866932 - DNA, 23 bp, Homo sapiens
gaggagggtcgtgctgtgttcct

SEQ ID NO: 7866933 - DNA, 23 bp, Homo sapiens
gaggagggtcgtgctgtgttcct

SEQ ID NO: 7866934 - DNA, 22 bp, Homo sapiens
gaggcacagagccctaggagct

SEQ ID NO: 7866935 - DNA, 22 bp, Homo sapiens
gaggcacagagccctaggagct

SEQ ID NO: 7866936 - DNA, 22 bp, Homo sapiens
gaggcacagagccctaggagct

SEQ ID NO: 7866937 - DNA, 22 bp, Homo sapiens
gaggcacagagccctaggagct

SEQ ID NO: 7866938 - DNA, 22 bp, Homo sapiens
gaggcacagagccctaggagct

SEQ ID NO: 7866939 - DNA, 22 bp, Homo sapiens
gaggcacagagtaggtgcacac

SEQ ID NO: 7866940 - DNA, 22 bp, Homo sapiens
gaggcacagagtaggtgcacac

SEQ ID NO: 7866941 - DNA, 22 bp, Homo sapiens
gaggcacagagccctaggagct

SEQ ID NO: 7866942 - DNA, 22 bp, Homo sapiens
gaggcacaccagggagtcttgt

SEQ ID NO: 7866943 - DNA, 23 bp, Homo sapiens
gaggagggtctgacaagtgtagc

SEQ ID NO: 7866944 - DNA, 22 bp, Homo sapiens
gaggcacagagccctaggagct

SEQ ID NO: 7866945 - DNA, 22 bp, Homo sapiens
gaggcacagagccctaggagct

SEQ ID NO: 7866946 - DNA, 22 bp, Homo sapiens
gaggcacagagccctaggagct

SEQ ID NO: 7866947 - DNA, 22 bp, Homo sapiens
gaggcacagagccctaggagct

SEQ ID NO: 7866948 - DNA, 19 bp, Homo sapiens
ctttgcttgtttctgtgtc

SEQ ID NO: 7866949 - DNA, 19 bp, Homo sapiens
ctttgcttgtttctgtgtc

SEQ ID NO: 7866950 - DNA, 22 bp, Homo sapiens
ctttgctttactcccactgtgt

SEQ ID NO: 7866951 - DNA, 22 bp, Homo sapiens
ctttgcttgacactgtgattgt

SEQ ID NO: 7866952 - DNA, 22 bp, Homo sapiens
ctttgcttctccaacctgctca

SEQ ID NO: 7866953 - DNA, 22 bp, Homo sapiens
ctttgcttctccaacctgctca

SEQ ID NO: 7866954 - DNA, 22 bp, Homo sapiens
ctttgcttgacactgtgattgt

SEQ ID NO: 7866955 - DNA, 22 bp, Homo sapiens
ctttgctttactcccactgtgt

SEQ ID NO: 7866956 - DNA, 22 bp, Homo sapiens
ctttggaaaaagtgactggctc

SEQ ID NO: 7866957 - DNA, 22 bp, Homo sapiens
ctttggaaaaagtgactggctc

SEQ ID NO: 7866958 - DNA, 22 bp, Homo sapiens
ctttggaaaaatacctggcata

SEQ ID NO: 7866959 - DNA, 22 bp, Homo sapiens
ctttggaaaaatacctggcata

SEQ ID NO: 7866960 - DNA, 22 bp, Homo sapiens
ctttggaaaaatacctggcata

SEQ ID NO: 7866961 - DNA, 22 bp, Homo sapiens
ctttggaaaaatacctggcata

SEQ ID NO: 7866962 - DNA, 22 bp, Homo sapiens
ctttggaaaagcataccaagga

SEQ ID NO: 7866963 - DNA, 22 bp, Homo sapiens
ctttggaaaaatacctggcata

SEQ ID NO: 7866964 - DNA, 22 bp, Homo sapiens
ctttggaaaagcataccaagga

SEQ ID NO: 7866965 - DNA, 22 bp, Homo sapiens
ctttggctcatggttttatcca

SEQ ID NO: 7866966 - DNA, 22 bp, Homo sapiens
ctttggctcatggttttatcca

SEQ ID NO: 7866967 - DNA, 22 bp, Homo sapiens
ctttggctaacaaatcagcttg

SEQ ID NO: 7866968 - DNA, 22 bp, Homo sapiens
ctttggctctttagaattccct

SEQ ID NO: 7866969 - DNA, 22 bp, Homo sapiens
ctttggctacaagcgctgcaat

SEQ ID NO: 7866970 - DNA, 22 bp, Homo sapiens
ctttggctacaagcgctgcaat

SEQ ID NO: 7866971 - DNA, 22 bp, Homo sapiens
ctttggctgacaggtttctggt

SEQ ID NO: 7866972 - DNA, 22 bp, Homo sapiens
ctttggctgacaggtttctggt

SEQ ID NO: 7866973 - DNA, 22 bp, Homo sapiens
ctttggctgacaggtttctggt

SEQ ID NO: 7866974 - DNA, 22 bp, Homo sapiens
ctttggctgacaggtttctggt

SEQ ID NO: 7866975 - DNA, 22 bp, Homo sapiens
ctttggctctttagaattccct

SEQ ID NO: 7866976 - DNA, 22 bp, Homo sapiens
ctttggctgacaggtttctggt

SEQ ID NO: 7866977 - DNA, 22 bp, Homo sapiens
ctttggaaaagcataccaagga

SEQ ID NO: 7866978 - DNA, 22 bp, Homo sapiens
ctttggaaagtaagcagctaga

SEQ ID NO: 7866979 - DNA, 22 bp, Homo sapiens
ctttggaaagtggttcaggtga

SEQ ID NO: 7866980 - DNA, 22 bp, Homo sapiens
ctttggaaagtaagcagctaga

SEQ ID NO: 7866981 - DNA, 22 bp, Homo sapiens
ctttggaaagtggttcaggtga

SEQ ID NO: 7866982 - DNA, 22 bp, Homo sapiens
ctttggctaacaaatcagcttg

SEQ ID NO: 7866983 - DNA, 22 bp, Homo sapiens
ctttggcattagcctgtataga

SEQ ID NO: 7866984 - DNA, 22 bp, Homo sapiens
ctttggctaacaaatcagcttg

SEQ ID NO: 7866985 - DNA, 22 bp, Homo sapiens
ctttggctaacaaatcagcttg

SEQ ID NO: 7866986 - DNA, 20 bp, Homo sapiens
ctttgcctattctctgcctg

SEQ ID NO: 7866987 - DNA, 23 bp, Homo sapiens
ctttgccacccagagcctgacag

SEQ ID NO: 7866988 - DNA, 23 bp, Homo sapiens
ctttgccacccagagcctgacag

SEQ ID NO: 7866989 - DNA, 22 bp, Homo sapiens
ctttctttcgaagacgtgatta

SEQ ID NO: 7866990 - DNA, 22 bp, Homo sapiens
ctttctttcgaagacgtgatta

SEQ ID NO: 7866991 - DNA, 22 bp, Homo sapiens
ctttcaaaacgctctgtatgca

SEQ ID NO: 7866992 - DNA, 22 bp, Homo sapiens
ctttcaaaacgctctgtatgca

SEQ ID NO: 7866993 - DNA, 22 bp, Homo sapiens
ctttctttcgaagacgtgatta

SEQ ID NO: 7866994 - DNA, 22 bp, Homo sapiens
ctttctttcgaagacgtgatta

SEQ ID NO: 7866995 - DNA, 22 bp, Homo sapiens
ctttgcttctccaacctgctca

SEQ ID NO: 7866996 - DNA, 22 bp, Homo sapiens
ctttgcttactggtgtctgcat

SEQ ID NO: 7866997 - DNA, 22 bp, Homo sapiens
ctttgcttactggtgtctgcat

SEQ ID NO: 7866998 - DNA, 22 bp, Homo sapiens
ctttgcttactggtgtctgcat

SEQ ID NO: 7866999 - DNA, 22 bp, Homo sapiens
ctttgctgccagaacccagcag

SEQ ID NO: 7867000 - DNA, 22 bp, Homo sapiens
ctttgctgttataatgatagct

SEQ ID NO: 7867001 - DNA, 22 bp, Homo sapiens
ctttgctgttataatgatagct

SEQ ID NO: 7867002 - DNA, 22 bp, Homo sapiens
ctttgctgccagaacccagcag

SEQ ID NO: 7867003 - DNA, 22 bp, Homo sapiens
ctttgctgagctggttgttcaa

SEQ ID NO: 7867004 - DNA, 22 bp, Homo sapiens
ctttgctagtgtttcagtagac

SEQ ID NO: 7867005 - DNA, 18 bp, Homo sapiens
ctttgctataaattgtat

SEQ ID NO: 7867006 - DNA, 22 bp, Homo sapiens
ctttggcttttagatatccatt

SEQ ID NO: 7867007 - DNA, 22 bp, Homo sapiens
ctttgggatttcatgagagcta

SEQ ID NO: 7867008 - DNA, 22 bp, Homo sapiens
ctttgggcactgaagtatgggt

SEQ ID NO: 7867009 - DNA, 22 bp, Homo sapiens
ctttgggcaaagggccaattcg

SEQ ID NO: 7867010 - DNA, 22 bp, Homo sapiens
ctttggtaaatgtcaaaaagtt

SEQ ID NO: 7867011 - DNA, 22 bp, Homo sapiens
ctttggtctccgtcatcaatca

SEQ ID NO: 7867012 - DNA, 22 bp, Homo sapiens
atgaatttttctaagcttttgt

SEQ ID NO: 7867013 - DNA, 21 bp, Homo sapiens
ctttggtatttcactcacata

SEQ ID NO: 7867014 - DNA, 22 bp, Homo sapiens
ctttggtatcttactagtattt

SEQ ID NO: 7867015 - DNA, 22 bp, Homo sapiens
ctttggtacgctttacatgttt

SEQ ID NO: 7867016 - DNA, 22 bp, Homo sapiens
ctttggcttgccctggcagtac

SEQ ID NO: 7867017 - DNA, 22 bp, Homo sapiens
ctttggcttgcactattacact

SEQ ID NO: 7867018 - DNA, 22 bp, Homo sapiens
ctttggcttgccctggcagtac

SEQ ID NO: 7867019 - DNA, 22 bp, Homo sapiens
ctttggcttttagatatccatt

SEQ ID NO: 7867020 - DNA, 22 bp, Homo sapiens
ctttggcttgccctggcagtac

SEQ ID NO: 7867021 - DNA, 22 bp, Homo sapiens
ctttggcttgccctggcagtac

SEQ ID NO: 7867022 - DNA, 22 bp, Homo sapiens
ctttggcttttagatatccatt

SEQ ID NO: 7867023 - DNA, 22 bp, Homo sapiens
ctttggcttttagatatccatt

SEQ ID NO: 7867024 - DNA, 22 bp, Homo sapiens
ctttggcttttagatatccatt

SEQ ID NO: 7867025 - DNA, 22 bp, Homo sapiens
ctttggctgggcaaagggaggt

SEQ ID NO: 7867026 - DNA, 22 bp, Homo sapiens
ctttggctgcattcgagttgct

SEQ ID NO: 7867027 - DNA, 22 bp, Homo sapiens
ctttggctgcattcgagttgct

SEQ ID NO: 7867028 - DNA, 22 bp, Homo sapiens
ctttggctgacgaggaggaggc

SEQ ID NO: 7867029 - DNA, 22 bp, Homo sapiens
ctttggctgtcctcttggctgg

SEQ ID NO: 7867030 - DNA, 22 bp, Homo sapiens
ctttggctgggcaaagggaggt

SEQ ID NO: 7867031 - DNA, 22 bp, Homo sapiens
ctttggctgtcctcttggctgg

SEQ ID NO: 7867032 - DNA, 22 bp, Homo sapiens
ctttggctgtcctcttggctgg

SEQ ID NO: 7867033 - DNA, 22 bp, Homo sapiens
ctttggcttgcactattacact

SEQ ID NO: 7867034 - DNA, 22 bp, Homo sapiens
ctttggcttgcactattacact

SEQ ID NO: 7867035 - DNA, 22 bp, Homo sapiens
atgacagaccctctaaagacaa

SEQ ID NO: 7867036 - DNA, 22 bp, Homo sapiens
atgacacttggtgatactttgt

SEQ ID NO: 7867037 - DNA, 22 bp, Homo sapiens
atgacacttggtgatactttgt

SEQ ID NO: 7867038 - DNA, 23 bp, Homo sapiens
atgacactcctgtgcgcaccctg

SEQ ID NO: 7867039 - DNA, 22 bp, Homo sapiens
atgacactgtcctagtaaggaa

SEQ ID NO: 7867040 - DNA, 22 bp, Homo sapiens
atgacacaagagcagaagccat

SEQ ID NO: 7867041 - DNA, 22 bp, Homo sapiens
atgacacaagagcagaagccat

SEQ ID NO: 7867042 - DNA, 22 bp, Homo sapiens
atgacaaaagaagacatgaggt

SEQ ID NO: 7867043 - DNA, 22 bp, Homo sapiens
atgacaaaagaagacatgaggt

SEQ ID NO: 7867044 - DNA, 22 bp, Homo sapiens
atgaatttttctaagcttttgt

SEQ ID NO: 7867045 - DNA, 22 bp, Homo sapiens
atgacacataaaacaaggactg

SEQ ID NO: 7867046 - DNA, 22 bp, Homo sapiens
atgacacataaaacaaggactg

SEQ ID NO: 7867047 - DNA, 22 bp, Homo sapiens
atgacacataaaacaaggactg

SEQ ID NO: 7867048 - DNA, 22 bp, Homo sapiens
cttttgttgcccttgtcgcagg

SEQ ID NO: 7867049 - DNA, 19 bp, Homo sapiens
atgacagagttgataagtg

SEQ ID NO: 7867050 - DNA, 19 bp, Homo sapiens
atgacagagttgataagtg

SEQ ID NO: 7867051 - DNA, 22 bp, Homo sapiens
atgacagaggattgtaaagagg

SEQ ID NO: 7867052 - DNA, 22 bp, Homo sapiens
ctttttataccgtgccagttga

SEQ ID NO: 7867053 - DNA, 22 bp, Homo sapiens
ctttttatagctatgtcctatg

SEQ ID NO: 7867054 - DNA, 22 bp, Homo sapiens
ctttttactctgttgtctcagc

SEQ ID NO: 7867055 - DNA, 22 bp, Homo sapiens
ctttttactctgttgtctcagc

SEQ ID NO: 7867056 - DNA, 22 bp, Homo sapiens
ctttttacaaagcctgtcttct

SEQ ID NO: 7867057 - DNA, 18 bp, Homo sapiens
cttttgttttccctcctc

SEQ ID NO: 7867058 - DNA, 21 bp, Homo sapiens
ctttttactcgttcatatgca

SEQ ID NO: 7867059 - DNA, 18 bp, Homo sapiens
cttttgttttccctcctc

SEQ ID NO: 7867060 - DNA, 22 bp, Homo sapiens
cttttgttgcccttgtcgcagg

SEQ ID NO: 7867061 - DNA, 18 bp, Homo sapiens
cttttgttttccctcctc

SEQ ID NO: 7867062 - DNA, 18 bp, Homo sapiens
cttttgttttccctcctc

SEQ ID NO: 7867063 - DNA, 22 bp, Homo sapiens
ctttttcattggctttaggaca

SEQ ID NO: 7867064 - DNA, 22 bp, Homo sapiens
atgacatgattgccatttgata

SEQ ID NO: 7867065 - DNA, 22 bp, Homo sapiens
atgacatgcgaatgtactggag

SEQ ID NO: 7867066 - DNA, 22 bp, Homo sapiens
atgacatggtgcagacagtgtc

SEQ ID NO: 7867067 - DNA, 22 bp, Homo sapiens
atgacatgtactgctctctcat

SEQ ID NO: 7867068 - DNA, 22 bp, Homo sapiens
atgacatgtcctagttggtcta

SEQ ID NO: 7867069 - DNA, 22 bp, Homo sapiens
atgacatgttccctttttctca

SEQ ID NO: 7867070 - DNA, 22 bp, Homo sapiens
atgacatgttgggaaccctgct

SEQ ID NO: 7867071 - DNA, 22 bp, Homo sapiens
ctttttcattggctttaggaca

SEQ ID NO: 7867072 - DNA, 22 bp, Homo sapiens
ctttttcattggctttaggaca

SEQ ID NO: 7867073 - DNA, 19 bp, Homo sapiens
ctttttcaccttctagaag

SEQ ID NO: 7867074 - DNA, 19 bp, Homo sapiens
ctttttcaccttctagaag

SEQ ID NO: 7867075 - DNA, 19 bp, Homo sapiens
ctttttcaccttctagaag

SEQ ID NO: 7867076 - DNA, 19 bp, Homo sapiens
ctttttcaccttctagaag

SEQ ID NO: 7867077 - DNA, 22 bp, Homo sapiens
ctttttatctcttaatgatgtt

SEQ ID NO: 7867078 - DNA, 22 bp, Homo sapiens
ctttttatctcttaatgatgtt

SEQ ID NO: 7867079 - DNA, 22 bp, Homo sapiens
ctttttatctcttaatgatgtt

SEQ ID NO: 7867080 - DNA, 22 bp, Homo sapiens
ctttttatctcttaatgatgtt

SEQ ID NO: 7867081 - DNA, 22 bp, Homo sapiens
ctttttatctcttaatgatgtt

SEQ ID NO: 7867082 - DNA, 22 bp, Homo sapiens
ctttttatctcttaatgatgtt

SEQ ID NO: 7867083 - DNA, 19 bp, Homo sapiens
ctttttcaccttctagaag

SEQ ID NO: 7867084 - DNA, 22 bp, Homo sapiens
ctttttatctcttaatgatgtt

SEQ ID NO: 7867085 - DNA, 22 bp, Homo sapiens
ctttttatagctatgtcctatg

SEQ ID NO: 7867086 - DNA, 22 bp, Homo sapiens
ctttttatagctatgtcctatg

SEQ ID NO: 7867087 - DNA, 22 bp, Homo sapiens
ctttttatagctatgtcctatg

SEQ ID NO: 7867088 - DNA, 22 bp, Homo sapiens
atgagaaagagttgtatctaga

SEQ ID NO: 7867089 - DNA, 22 bp, Homo sapiens
atgagaaagagttgtatctaga

SEQ ID NO: 7867090 - DNA, 22 bp, Homo sapiens
atgagaaagttaatcatcatga

SEQ ID NO: 7867091 - DNA, 22 bp, Homo sapiens
atgagaaagttaatcatcatga

SEQ ID NO: 7867092 - DNA, 22 bp, Homo sapiens
atgagaaagagttgtatctaga

SEQ ID NO: 7867093 - DNA, 22 bp, Homo sapiens
atgacattgaatatgttaacta

SEQ ID NO: 7867094 - DNA, 22 bp, Homo sapiens
atgagaaatttattacaagcta

SEQ ID NO: 7867095 - DNA, 22 bp, Homo sapiens
atgagaaatttattacaagcta

SEQ ID NO: 7867096 - DNA, 22 bp, Homo sapiens
atgagaaagttaatcatcatga

SEQ ID NO: 7867097 - DNA, 22 bp, Homo sapiens
atgagaaatttattacaagcta

SEQ ID NO: 7867098 - DNA, 22 bp, Homo sapiens
atgagacatgacttcaggcctt

SEQ ID NO: 7867099 - DNA, 22 bp, Homo sapiens
atgagacaggactgtatgcagg

SEQ ID NO: 7867100 - DNA, 22 bp, Homo sapiens
atgagacatgacttcaggcctt

SEQ ID NO: 7867101 - DNA, 22 bp, Homo sapiens
atgagactacctgtaatgtggc

SEQ ID NO: 7867102 - DNA, 22 bp, Homo sapiens
atgagagactgtgtgttgggag

SEQ ID NO: 7867103 - DNA, 22 bp, Homo sapiens
atgagagacaggaacgagctgg

SEQ ID NO: 7867104 - DNA, 22 bp, Homo sapiens
atgagaatatgatttactattg

SEQ ID NO: 7867105 - DNA, 22 bp, Homo sapiens
atgagaataaaggtgatttcga

SEQ ID NO: 7867106 - DNA, 22 bp, Homo sapiens
atgagaatatgatttactattg

SEQ ID NO: 7867107 - DNA, 22 bp, Homo sapiens
atgagacaagagtctaaattca

SEQ ID NO: 7867108 - DNA, 22 bp, Homo sapiens
atgagaatgcattcatgttttg

SEQ ID NO: 7867109 - DNA, 22 bp, Homo sapiens
atgagaatggtgattctgcaga

SEQ ID NO: 7867110 - DNA, 22 bp, Homo sapiens
atgagaggtttcgtcagaggaa

SEQ ID NO: 7867111 - DNA, 22 bp, Homo sapiens
atgagagctctatgatctgttt

SEQ ID NO: 7867112 - DNA, 18 bp, Homo sapiens
atgagaggtgtcagaaga

SEQ ID NO: 7867113 - DNA, 22 bp, Homo sapiens
atgagatgtgtctaatggaacc

SEQ ID NO: 7867114 - DNA, 21 bp, Homo sapiens
atgagagtaatgctataaatt

SEQ ID NO: 7867115 - DNA, 21 bp, Homo sapiens
atgagagtaatgctataaatt

SEQ ID NO: 7867116 - DNA, 22 bp, Homo sapiens
atgagatgttcaggagtctgag

SEQ ID NO: 7867117 - DNA, 22 bp, Homo sapiens
atgagattttaaaacttcactt

SEQ ID NO: 7867118 - DNA, 22 bp, Homo sapiens
atgagcaaccttctcctccagc

SEQ ID NO: 7867119 - DNA, 22 bp, Homo sapiens
atgagattttatagtgtcttga

SEQ ID NO: 7867120 - DNA, 22 bp, Homo sapiens
atgagcaggaagagcacaaaga

SEQ ID NO: 7867121 - DNA, 22 bp, Homo sapiens
atgagcagatatggattttaga

SEQ ID NO: 7867122 - DNA, 22 bp, Homo sapiens
atgagcaagagctatgtacaga

SEQ ID NO: 7867123 - DNA, 17 bp, Homo sapiens
cttgttttccactggga

SEQ ID NO: 7867124 - DNA, 17 bp, Homo sapiens
cttgttttccactggga

SEQ ID NO: 7867125 - DNA, 17 bp, Homo sapiens
cttgttttccactggga

SEQ ID NO: 7867126 - DNA, 22 bp, Homo sapiens
cttgttttctaaaacatcattt

SEQ ID NO: 7867127 - DNA, 22 bp, Homo sapiens
ctttacagaataagaatactgg

SEQ ID NO: 7867128 - DNA, 22 bp, Homo sapiens
ctttacagataggaactactca

SEQ ID NO: 7867129 - DNA, 22 bp, Homo sapiens
ctttacagaataagaatactgg

SEQ ID NO: 7867130 - DNA, 22 bp, Homo sapiens
ctttacagaaagagaactctgg

SEQ ID NO: 7867131 - DNA, 22 bp, Homo sapiens
ctttacaccaagcagatctttc

SEQ ID NO: 7867132 - DNA, 22 bp, Homo sapiens
ctttacagcttagtggtatgga

SEQ ID NO: 7867133 - DNA, 22 bp, Homo sapiens
ctttacaggaaaaggtggctgt

SEQ ID NO: 7867134 - DNA, 22 bp, Homo sapiens
ctttacataaggataaacctgg

SEQ ID NO: 7867135 - DNA, 22 bp, Homo sapiens
ctttacagtgaacttgcttgtc

SEQ ID NO: 7867136 - DNA, 22 bp, Homo sapiens
ctttacagtgctgctaatggct

SEQ ID NO: 7867137 - DNA, 22 bp, Homo sapiens
ctttacataaggataaacctgg

SEQ ID NO: 7867138 - DNA, 22 bp, Homo sapiens
ctttacataaggataaacctgg

SEQ ID NO: 7867139 - DNA, 22 bp, Homo sapiens
ctttacataaggataaacctgg

SEQ ID NO: 7867140 - DNA, 22 bp, Homo sapiens
ctttacatcctgtttcccgttt

SEQ ID NO: 7867141 - DNA, 22 bp, Homo sapiens
ctttacagatggataattgttt

SEQ ID NO: 7867142 - DNA, 22 bp, Homo sapiens
ctttacagatggataattgttt

SEQ ID NO: 7867143 - DNA, 22 bp, Homo sapiens
ctttacagcttagtggtatgga

SEQ ID NO: 7867144 - DNA, 22 bp, Homo sapiens
ctttacagcctccagaaggaac

SEQ ID NO: 7867145 - DNA, 22 bp, Homo sapiens
ctttacagccccacttccgggc

SEQ ID NO: 7867146 - DNA, 22 bp, Homo sapiens
ctttacagcctccagaaggaac

SEQ ID NO: 7867147 - DNA, 22 bp, Homo sapiens
atctttggacggtcccaactga

SEQ ID NO: 7867148 - DNA, 22 bp, Homo sapiens
atctttggacggtcccaactga

SEQ ID NO: 7867149 - DNA, 22 bp, Homo sapiens
atctttggaaagccaagcacag

SEQ ID NO: 7867150 - DNA, 22 bp, Homo sapiens
atctttggaaagccaagcacag

SEQ ID NO: 7867151 - DNA, 22 bp, Homo sapiens
atctttgctattgtaaatcacg

SEQ ID NO: 7867152 - DNA, 22 bp, Homo sapiens
atctttgcccagagactcagcc

SEQ ID NO: 7867153 - DNA, 22 bp, Homo sapiens
atctttgctattgtaaatcacg

SEQ ID NO: 7867154 - DNA, 22 bp, Homo sapiens
atctttgatctttattgctaag

SEQ ID NO: 7867155 - DNA, 22 bp, Homo sapiens
atctttgactgccattcttgac

SEQ ID NO: 7867156 - DNA, 22 bp, Homo sapiens
atctttgatctttattgctaag

SEQ ID NO: 7867157 - DNA, 22 bp, Homo sapiens
atctttgatgactaatgctttg

SEQ ID NO: 7867158 - DNA, 22 bp, Homo sapiens
atctttgatgactaatgctttg

SEQ ID NO: 7867159 - DNA, 22 bp, Homo sapiens
atctttgatgactaatgctttg

SEQ ID NO: 7867160 - DNA, 22 bp, Homo sapiens
atctttgaatcaatgaatcagt

SEQ ID NO: 7867161 - DNA, 22 bp, Homo sapiens
atctttgaagaggacttgaagt

SEQ ID NO: 7867162 - DNA, 22 bp, Homo sapiens
atctttgaatcaatgaatcagt

SEQ ID NO: 7867163 - DNA, 22 bp, Homo sapiens
atctttgaatcaatgaatcagt

SEQ ID NO: 7867164 - DNA, 22 bp, Homo sapiens
atctttgaatcaatgaatcagt

SEQ ID NO: 7867165 - DNA, 22 bp, Homo sapiens
atctttggatcgctcccccttc

SEQ ID NO: 7867166 - DNA, 22 bp, Homo sapiens
atctttggccacttgtgctgca

SEQ ID NO: 7867167 - DNA, 22 bp, Homo sapiens
atctttggatcgctcccccttc

SEQ ID NO: 7867168 - DNA, 20 bp, Homo sapiens
atctttggctcagaagcctt

SEQ ID NO: 7867169 - DNA, 20 bp, Homo sapiens
atctttggctcagaagcctt

SEQ ID NO: 7867170 - DNA, 22 bp, Homo sapiens
atctttggccacttgtgctgca

SEQ ID NO: 7867171 - DNA, 20 bp, Homo sapiens
atctttggctcagaagcctt

SEQ ID NO: 7867172 - DNA, 22 bp, Homo sapiens
atctttgggatcctgatttact

SEQ ID NO: 7867173 - DNA, 22 bp, Homo sapiens
atctttgggatatttgtgatta

SEQ ID NO: 7867174 - DNA, 22 bp, Homo sapiens
atctttgggatatttgtgatta

SEQ ID NO: 7867175 - DNA, 20 bp, Homo sapiens
atctttggctcagaagcctt

SEQ ID NO: 7867176 - DNA, 22 bp, Homo sapiens
cttgttttaaactgttgtggct

SEQ ID NO: 7867177 - DNA, 22 bp, Homo sapiens
cttgttttaaactgttgtggct

SEQ ID NO: 7867178 - DNA, 22 bp, Homo sapiens
atctttgggatcctgatttact

SEQ ID NO: 7867179 - DNA, 22 bp, Homo sapiens
ctttacattaatttctactgat

SEQ ID NO: 7867180 - DNA, 22 bp, Homo sapiens
ctttactatcaggaataaacaa

SEQ ID NO: 7867181 - DNA, 22 bp, Homo sapiens
ctttaccagattccattgcaag

SEQ ID NO: 7867182 - DNA, 22 bp, Homo sapiens
ctttactgtttggtgctctatt

SEQ ID NO: 7867183 - DNA, 22 bp, Homo sapiens
ctttactgaagtgaagacctgg

SEQ ID NO: 7867184 - DNA, 22 bp, Homo sapiens
ctttactgttcttctgtgggaa

SEQ ID NO: 7867185 - DNA, 22 bp, Homo sapiens
ctttactgttcttctgtgggaa

SEQ ID NO: 7867186 - DNA, 22 bp, Homo sapiens
ctttacttctcaaaataaagca

SEQ ID NO: 7867187 - DNA, 22 bp, Homo sapiens
ctttacttctcaaaataaagca

SEQ ID NO: 7867188 - DNA, 22 bp, Homo sapiens
ctttacttctcaaaataaagca

SEQ ID NO: 7867189 - DNA, 22 bp, Homo sapiens
ctttatgttcagtacaatgctt

SEQ ID NO: 7867190 - DNA, 22 bp, Homo sapiens
ctttatgttcagtacaatgctt

SEQ ID NO: 7867191 - DNA, 22 bp, Homo sapiens
ctttattagatgtagactttct

SEQ ID NO: 7867192 - DNA, 22 bp, Homo sapiens
ctttattagatgtagactttct

SEQ ID NO: 7867193 - DNA, 22 bp, Homo sapiens
ctttattagatgtagactttct

SEQ ID NO: 7867194 - DNA, 22 bp, Homo sapiens
ctttattagatgtagactttct

SEQ ID NO: 7867195 - DNA, 22 bp, Homo sapiens
ctttattagatgtagactttct

SEQ ID NO: 7867196 - DNA, 22 bp, Homo sapiens
ctttacttgctttgttacaaaa

SEQ ID NO: 7867197 - DNA, 22 bp, Homo sapiens
ctttacttgctttgttacaaaa

SEQ ID NO: 7867198 - DNA, 22 bp, Homo sapiens
ctttacttgctttgttacaaaa

SEQ ID NO: 7867199 - DNA, 22 bp, Homo sapiens
ctttatgtgtactttccatttt

SEQ ID NO: 7867200 - DNA, 22 bp, Homo sapiens
ctttagaaatctggatgtattt

SEQ ID NO: 7867201 - DNA, 22 bp, Homo sapiens
ctttagaaatctggatgtattt

SEQ ID NO: 7867202 - DNA, 22 bp, Homo sapiens
ctttagaaatctggatgtattt

SEQ ID NO: 7867203 - DNA, 22 bp, Homo sapiens
ctttattagatgtagactttct

SEQ ID NO: 7867204 - DNA, 22 bp, Homo sapiens
ctttattagatgtagactttct

SEQ ID NO: 7867205 - DNA, 22 bp, Homo sapiens
ctttattagatgtagactttct

SEQ ID NO: 7867206 - DNA, 22 bp, Homo sapiens
ctttattcctacaagattttct

SEQ ID NO: 7867207 - DNA, 22 bp, Homo sapiens
ctttattgtccttcttaggtgg

SEQ ID NO: 7867208 - DNA, 22 bp, Homo sapiens
ctttattgtccttcttaggtgg

SEQ ID NO: 7867209 - DNA, 22 bp, Homo sapiens
ctttattgtccttcttaggtgg

SEQ ID NO: 7867210 - DNA, 22 bp, Homo sapiens
ctttattgtccttcttaggtgg

SEQ ID NO: 7867211 - DNA, 22 bp, Homo sapiens
ctttattgtccttcttaggtgg

SEQ ID NO: 7867212 - DNA, 22 bp, Homo sapiens
ctttattgtccttcttaggtgg

SEQ ID NO: 7867213 - DNA, 22 bp, Homo sapiens
ctttattgtccttcttaggtgg

SEQ ID NO: 7867214 - DNA, 22 bp, Homo sapiens
ctttattgtccttcttaggtgg

SEQ ID NO: 7867215 - DNA, 22 bp, Homo sapiens
ctttcaaaacgctctgtatgca

SEQ ID NO: 7867216 - DNA, 22 bp, Homo sapiens
ctttattctgcaaattgccttg

SEQ ID NO: 7867217 - DNA, 22 bp, Homo sapiens
ctttattctgcaaattgccttg

SEQ ID NO: 7867218 - DNA, 22 bp, Homo sapiens
ctttattgtccttcttaggtgg

SEQ ID NO: 7867219 - DNA, 22 bp, Homo sapiens
ctttattgtccttcttaggtgg

SEQ ID NO: 7867220 - DNA, 22 bp, Homo sapiens
ctttattgtccttcttaggtgg

SEQ ID NO: 7867221 - DNA, 21 bp, Homo sapiens
atctttattacgcagagaaga

SEQ ID NO: 7867222 - DNA, 21 bp, Homo sapiens
atctttattacgcagagaaga

SEQ ID NO: 7867223 - DNA, 20 bp, Homo sapiens
atcttgggacagggcacatg

SEQ ID NO: 7867224 - DNA, 22 bp, Homo sapiens
atctttatttattgagcactta

SEQ ID NO: 7867225 - DNA, 22 bp, Homo sapiens
atctttatttattgagcactta

SEQ ID NO: 7867226 - DNA, 22 bp, Homo sapiens
atcttgggaattttccaggagt

SEQ ID NO: 7867227 - DNA, 22 bp, Homo sapiens
atcttgggaattttccaggagt

SEQ ID NO: 7867228 - DNA, 22 bp, Homo sapiens
atcttgggaattttccaggagt

SEQ ID NO: 7867229 - DNA, 22 bp, Homo sapiens
atcttgggaattttccaggagt

SEQ ID NO: 7867230 - DNA, 20 bp, Homo sapiens
atcttgggacagggcacatg

SEQ ID NO: 7867231 - DNA, 22 bp, Homo sapiens
cttctcctgtaagaagatcaaa

SEQ ID NO: 7867232 - DNA, 22 bp, Homo sapiens
cttctcctgtaagaagatcaaa

SEQ ID NO: 7867233 - DNA, 22 bp, Homo sapiens
cttctcctgtaagaagatcaaa

SEQ ID NO: 7867234 - DNA, 22 bp, Homo sapiens
cttctcctgtaagaagatcaaa

SEQ ID NO: 7867235 - DNA, 19 bp, Homo sapiens
atcttgggaaatggtaact

SEQ ID NO: 7867236 - DNA, 22 bp, Homo sapiens
atcttggcttatgcacaagtaa

SEQ ID NO: 7867237 - DNA, 22 bp, Homo sapiens
cttctccttatatgtcccgttc

SEQ ID NO: 7867238 - DNA, 22 bp, Homo sapiens
atcttggctgcatttctattcc

SEQ ID NO: 7867239 - DNA, 22 bp, Homo sapiens
atctttcagggccatttgtatt

SEQ ID NO: 7867240 - DNA, 22 bp, Homo sapiens
atctttcagggccatttgtatt

SEQ ID NO: 7867241 - DNA, 22 bp, Homo sapiens
atctttcatctctattatttga

SEQ ID NO: 7867242 - DNA, 22 bp, Homo sapiens
atctttcagtttcataccaatt

SEQ ID NO: 7867243 - DNA, 22 bp, Homo sapiens
atctttcagtttcataccaatt

SEQ ID NO: 7867244 - DNA, 22 bp, Homo sapiens
atctttcagtttcataccaatt

SEQ ID NO: 7867245 - DNA, 22 bp, Homo sapiens
atctttcaatcaggaaaaatct

SEQ ID NO: 7867246 - DNA, 22 bp, Homo sapiens
atctttcagagctccatcaggg

SEQ ID NO: 7867247 - DNA, 22 bp, Homo sapiens
atctttcactttttgtggatga

SEQ ID NO: 7867248 - DNA, 22 bp, Homo sapiens
atctttctccatatacatcttt

SEQ ID NO: 7867249 - DNA, 22 bp, Homo sapiens
atctttctccatatacatcttt

SEQ ID NO: 7867250 - DNA, 22 bp, Homo sapiens
atctttctatttctaaaaacta

SEQ ID NO: 7867251 - DNA, 22 bp, Homo sapiens
atctttctctgcactatacaat

SEQ ID NO: 7867252 - DNA, 22 bp, Homo sapiens
atctttctctgcactatacaat

SEQ ID NO: 7867253 - DNA, 22 bp, Homo sapiens
atctttctctgcactatacaat

SEQ ID NO: 7867254 - DNA, 22 bp, Homo sapiens
atctttctctgcactatacaat

SEQ ID NO: 7867255 - DNA, 22 bp, Homo sapiens
atctttgaagaggacttgaagt

SEQ ID NO: 7867256 - DNA, 22 bp, Homo sapiens
atctttcttatttgaagaaaga

SEQ ID NO: 7867257 - DNA, 22 bp, Homo sapiens
atctttcttatttgaagaaaga

SEQ ID NO: 7867258 - DNA, 22 bp, Homo sapiens
atctttcctgttttcagacagc

SEQ ID NO: 7867259 - DNA, 22 bp, Homo sapiens
atctttcctgttttcagacagc

SEQ ID NO: 7867260 - DNA, 22 bp, Homo sapiens
atctttcctgttttcagacagc

SEQ ID NO: 7867261 - DNA, 18 bp, Homo sapiens
atctttccatagcatgtt

SEQ ID NO: 7867262 - DNA, 18 bp, Homo sapiens
atctttccatagcatgtt

SEQ ID NO: 7867263 - DNA, 18 bp, Homo sapiens
atctttccatagcatgtt

SEQ ID NO: 7867264 - DNA, 22 bp, Homo sapiens
atctttctatttctaaaaacta

SEQ ID NO: 7867265 - DNA, 22 bp, Homo sapiens
atctttctatttctaaaaacta

SEQ ID NO: 7867266 - DNA, 22 bp, Homo sapiens
atctttctatttctaaaaacta

SEQ ID NO: 7867267 - DNA, 22 bp, Homo sapiens
atctttctatggtactttctcc

SEQ ID NO: 7867268 - DNA, 22 bp, Homo sapiens
atctttctatggtactttctcc

SEQ ID NO: 7867269 - DNA, 22 bp, Homo sapiens
atctggagaaaccgccaaggga

SEQ ID NO: 7867270 - DNA, 22 bp, Homo sapiens
atctggactggacatagtcttt

SEQ ID NO: 7867271 - DNA, 22 bp, Homo sapiens
atctggactagagcagaatggg

SEQ ID NO: 7867272 - DNA, 22 bp, Homo sapiens
atctggactagagcagaatggg

SEQ ID NO: 7867273 - DNA, 22 bp, Homo sapiens
atctggaattaagagaaagtga

SEQ ID NO: 7867274 - DNA, 22 bp, Homo sapiens
atctggaattaagagaaagtga

SEQ ID NO: 7867275 - DNA, 22 bp, Homo sapiens
atctggaattgaagaggtttga

SEQ ID NO: 7867276 - DNA, 22 bp, Homo sapiens
atctggaattaagagaaagtga

SEQ ID NO: 7867277 - DNA, 22 bp, Homo sapiens
cttctccagccacgcccactcc

SEQ ID NO: 7867278 - DNA, 22 bp, Homo sapiens
atctggagaataaatgtccaag

SEQ ID NO: 7867279 - DNA, 22 bp, Homo sapiens
atctggagaaaccgccaaggga

SEQ ID NO: 7867280 - DNA, 19 bp, Homo sapiens
cttctccagcttctagaag

SEQ ID NO: 7867281 - DNA, 19 bp, Homo sapiens
cttctccagcttctagaag

SEQ ID NO: 7867282 - DNA, 22 bp, Homo sapiens
cttctccagccacgcccactcc

SEQ ID NO: 7867283 - DNA, 22 bp, Homo sapiens
cttctccagccacgcccactcc

SEQ ID NO: 7867284 - DNA, 22 bp, Homo sapiens
cttctccagccacgcccactcc

SEQ ID NO: 7867285 - DNA, 22 bp, Homo sapiens
cttctccagccacgcccactcc

SEQ ID NO: 7867286 - DNA, 22 bp, Homo sapiens
atctggaagtcagaggtttgca

SEQ ID NO: 7867287 - DNA, 22 bp, Homo sapiens
atctggaagtaggagagtgggc

SEQ ID NO: 7867288 - DNA, 17 bp, Homo sapiens
atctggaagctagctga

SEQ ID NO: 7867289 - DNA, 17 bp, Homo sapiens
atctggaagctagctga

SEQ ID NO: 7867290 - DNA, 22 bp, Homo sapiens
atctggaagtctccgaaggcag

SEQ ID NO: 7867291 - DNA, 22 bp, Homo sapiens
atctggaagttaagcttggtgc

SEQ ID NO: 7867292 - DNA, 22 bp, Homo sapiens
atctggaatagcatggggttga

SEQ ID NO: 7867293 - DNA, 22 bp, Homo sapiens
atctggaatgtctcattgggaa

SEQ ID NO: 7867294 - DNA, 22 bp, Homo sapiens
atctggaatccttgtggacaat

SEQ ID NO: 7867295 - DNA, 22 bp, Homo sapiens
atctggaatccttgtggacaat

SEQ ID NO: 7867296 - DNA, 22 bp, Homo sapiens
cttctccctggcttctgcacac

SEQ ID NO: 7867297 - DNA, 22 bp, Homo sapiens
cttctccctggcttctgcacac

SEQ ID NO: 7867298 - DNA, 22 bp, Homo sapiens
cttctcccgaagccggttctgc

SEQ ID NO: 7867299 - DNA, 22 bp, Homo sapiens
cttctccctggcttctgcacac

SEQ ID NO: 7867300 - DNA, 22 bp, Homo sapiens
cttctccctggcttctgcacac

SEQ ID NO: 7867301 - DNA, 22 bp, Homo sapiens
cttctccctggcttctgcacac

SEQ ID NO: 7867302 - DNA, 22 bp, Homo sapiens
cttctcccgaagccggttctgc

SEQ ID NO: 7867303 - DNA, 22 bp, Homo sapiens
cttctcccgaagccggttctgc

SEQ ID NO: 7867304 - DNA, 22 bp, Homo sapiens
cttctcccaagtatgcagtttg

SEQ ID NO: 7867305 - DNA, 18 bp, Homo sapiens
cttctcccatcttggcca

SEQ ID NO: 7867306 - DNA, 22 bp, Homo sapiens
cttctcccaagtatgcagtttg

SEQ ID NO: 7867307 - DNA, 19 bp, Homo sapiens
cttctccagcttctagaag

SEQ ID NO: 7867308 - DNA, 18 bp, Homo sapiens
cttctcccatcttggcca

SEQ ID NO: 7867309 - DNA, 22 bp, Homo sapiens
cttctccccagaaaagatttct

SEQ ID NO: 7867310 - DNA, 22 bp, Homo sapiens
cttctccccagaaaagatttct

SEQ ID NO: 7867311 - DNA, 22 bp, Homo sapiens
cttctccctgggggctctttat

SEQ ID NO: 7867312 - DNA, 22 bp, Homo sapiens
cttctcctaaggtcagaattgc

SEQ ID NO: 7867313 - DNA, 22 bp, Homo sapiens
cttctcctaaggtcagaattgc

SEQ ID NO: 7867314 - DNA, 22 bp, Homo sapiens
cttctccctgggggctctttat

SEQ ID NO: 7867315 - DNA, 22 bp, Homo sapiens
cttctccctggcttctgcacac

SEQ ID NO: 7867316 - DNA, 22 bp, Homo sapiens
cttctccctgggggctctttat

SEQ ID NO: 7867317 - DNA, 22 bp, Homo sapiens
cttctccctgggggctctttat

SEQ ID NO: 7867318 - DNA, 22 bp, Homo sapiens
cttctccctgggggctctttat

SEQ ID NO: 7867319 - DNA, 22 bp, Homo sapiens
cttctcctctgagtcctgggag

SEQ ID NO: 7867320 - DNA, 22 bp, Homo sapiens
cttctcctctgagtcctgggag

SEQ ID NO: 7867321 - DNA, 22 bp, Homo sapiens
cttctcctaaggtcagaattgc

SEQ ID NO: 7867322 - DNA, 22 bp, Homo sapiens
cttctcctctgagtcctgggag

SEQ ID NO: 7867323 - DNA, 22 bp, Homo sapiens
cttctcctgtaagaagatcaaa

SEQ ID NO: 7867324 - DNA, 22 bp, Homo sapiens
gaaggaggcgttagccctagga

SEQ ID NO: 7867325 - DNA, 22 bp, Homo sapiens
gaaggaggcgttagccctagga

SEQ ID NO: 7867326 - DNA, 22 bp, Homo sapiens
gaaggaggcgttagccctagga

SEQ ID NO: 7867327 - DNA, 22 bp, Homo sapiens
gaaggaggcgttagccctagga

SEQ ID NO: 7867328 - DNA, 22 bp, Homo sapiens
gaaggaggcgttagccctagga

SEQ ID NO: 7867329 - DNA, 22 bp, Homo sapiens
gaaggaggcgttagccctagga

SEQ ID NO: 7867330 - DNA, 22 bp, Homo sapiens
gaaggaggcgttagccctagga

SEQ ID NO: 7867331 - DNA, 22 bp, Homo sapiens
gaaggaggctccccaaagtctg

SEQ ID NO: 7867332 - DNA, 22 bp, Homo sapiens
gaaggaggctccccaaagtctg

SEQ ID NO: 7867333 - DNA, 22 bp, Homo sapiens
gaaggaggcgttagccctagga

SEQ ID NO: 7867334 - DNA, 22 bp, Homo sapiens
gaagctgggtcgctgggatcct

SEQ ID NO: 7867335 - DNA, 22 bp, Homo sapiens
gaagctggctgaagttcagcta

SEQ ID NO: 7867336 - DNA, 22 bp, Homo sapiens
gaagctggctgaagttcagcta

SEQ ID NO: 7867337 - DNA, 22 bp, Homo sapiens
gaagctgggtcgctgggatcct

SEQ ID NO: 7867338 - DNA, 22 bp, Homo sapiens
gaagctgggtcgctgggatcct

SEQ ID NO: 7867339 - DNA, 22 bp, Homo sapiens
gaagctgtgctgggggatctgt

SEQ ID NO: 7867340 - DNA, 22 bp, Homo sapiens
gaaggagctactaataagaggg

SEQ ID NO: 7867341 - DNA, 22 bp, Homo sapiens
gaaggagctactaataagaggg

SEQ ID NO: 7867342 - DNA, 22 bp, Homo sapiens
gaagctctaaggtcattgcatt

SEQ ID NO: 7867343 - DNA, 22 bp, Homo sapiens
gaagctaggctggggttcagga

SEQ ID NO: 7867344 - DNA, 22 bp, Homo sapiens
gaagctacagttgtcaaaggta

SEQ ID NO: 7867345 - DNA, 22 bp, Homo sapiens
gaagctccgtactatgactttt

SEQ ID NO: 7867346 - DNA, 22 bp, Homo sapiens
gaagctgagctgaggcatgttg

SEQ ID NO: 7867347 - DNA, 22 bp, Homo sapiens
gaagctgagtggactctggcca

SEQ ID NO: 7867348 - DNA, 22 bp, Homo sapiens
gaagctgatgaggaccagattg

SEQ ID NO: 7867349 - DNA, 22 bp, Homo sapiens
gaagctggagaatgggtctagg

SEQ ID NO: 7867350 - DNA, 22 bp, Homo sapiens
gaagctgatgaggaccagattg

SEQ ID NO: 7867351 - DNA, 22 bp, Homo sapiens
gaagctgatgaggaccagattg

SEQ ID NO: 7867352 - DNA, 22 bp, Homo sapiens
gaagctgcaataattgttttga

SEQ ID NO: 7867353 - DNA, 22 bp, Homo sapiens
gaagccttgaactgcaaacccc

SEQ ID NO: 7867354 - DNA, 22 bp, Homo sapiens
gaagccttatcagtcacttata

SEQ ID NO: 7867355 - DNA, 22 bp, Homo sapiens
gaagccttgaactgcaaacccc

SEQ ID NO: 7867356 - DNA, 22 bp, Homo sapiens
gaagccttgaactgcaaacccc

SEQ ID NO: 7867357 - DNA, 22 bp, Homo sapiens
gaagccttgaactgcaaacccc

SEQ ID NO: 7867358 - DNA, 22 bp, Homo sapiens
gaagcctggtccagagctccca

SEQ ID NO: 7867359 - DNA, 22 bp, Homo sapiens
gaagccttgaactgcaaacccc

SEQ ID NO: 7867360 - DNA, 22 bp, Homo sapiens
gaagcctgtggataggggcatc

SEQ ID NO: 7867361 - DNA, 22 bp, Homo sapiens
gaagcctgtcacttcccttgct

SEQ ID NO: 7867362 - DNA, 22 bp, Homo sapiens
gaagcctggttcgctggccacc

SEQ ID NO: 7867363 - DNA, 22 bp, Homo sapiens
gaagcctggttcgctggccacc

SEQ ID NO: 7867364 - DNA, 22 bp, Homo sapiens
gaagcctggtccagagctccca

SEQ ID NO: 7867365 - DNA, 22 bp, Homo sapiens
gaagcctggttcgctggccacc

SEQ ID NO: 7867366 - DNA, 22 bp, Homo sapiens
gaagcctggtccagagctccca

SEQ ID NO: 7867367 - DNA, 22 bp, Homo sapiens
gaagcctggtccagagctccca

SEQ ID NO: 7867368 - DNA, 22 bp, Homo sapiens
gaagcctggtccagagctccca

SEQ ID NO: 7867369 - DNA, 22 bp, Homo sapiens
gaagcctgctgtgcagccaaat

SEQ ID NO: 7867370 - DNA, 22 bp, Homo sapiens
gaagcctgacactggccatcag

SEQ ID NO: 7867371 - DNA, 22 bp, Homo sapiens
gaagcctgctgtgcagccaaat

SEQ ID NO: 7867372 - DNA, 22 bp, Homo sapiens
gaagcctgacactggccatcag

SEQ ID NO: 7867373 - DNA, 22 bp, Homo sapiens
gaagcagcaagtataggacagg

SEQ ID NO: 7867374 - DNA, 22 bp, Homo sapiens
gaagcagcaaatctgcagtatc

SEQ ID NO: 7867375 - DNA, 22 bp, Homo sapiens
gaagcagcaaatctgcagtatc

SEQ ID NO: 7867376 - DNA, 22 bp, Homo sapiens
atgcagtggcagctcctggtgt

SEQ ID NO: 7867377 - DNA, 22 bp, Homo sapiens
atgcagtggcttcagtgtcagt

SEQ ID NO: 7867378 - DNA, 22 bp, Homo sapiens
atgcagtggcttcagtgtcagt

SEQ ID NO: 7867379 - DNA, 22 bp, Homo sapiens
atgcagtctaagcatgtaaggg

SEQ ID NO: 7867380 - DNA, 22 bp, Homo sapiens
atgcagtggcagctcctggtgt

SEQ ID NO: 7867381 - DNA, 22 bp, Homo sapiens
atgcagttatgtgagggcatga

SEQ ID NO: 7867382 - DNA, 22 bp, Homo sapiens
atgcagttatgtgagggcatga

SEQ ID NO: 7867383 - DNA, 22 bp, Homo sapiens
atgcagttccacaggcgcatgg

SEQ ID NO: 7867384 - DNA, 22 bp, Homo sapiens
atgcagttaggtaatagtctca

SEQ ID NO: 7867385 - DNA, 20 bp, Homo sapiens
atgcagtcttgtggcaacta

SEQ ID NO: 7867386 - DNA, 22 bp, Homo sapiens
atgcagttagtatacttccagt

SEQ ID NO: 7867387 - DNA, 22 bp, Homo sapiens
atgcagttagcactacagaaga

SEQ ID NO: 7867388 - DNA, 22 bp, Homo sapiens
atgcagttagcagtagctcccc

SEQ ID NO: 7867389 - DNA, 22 bp, Homo sapiens
atgcagttagcactacagaaga

SEQ ID NO: 7867390 - DNA, 22 bp, Homo sapiens
atgcagtgtttggaagcttaag

SEQ ID NO: 7867391 - DNA, 22 bp, Homo sapiens
atgcaggttgtatctgaagcca

SEQ ID NO: 7867392 - DNA, 22 bp, Homo sapiens
atgcagtaaaataggaggtaat

SEQ ID NO: 7867393 - DNA, 22 bp, Homo sapiens
atgcagtaaatgttaagaaaaa

SEQ ID NO: 7867394 - DNA, 22 bp, Homo sapiens
atgcagtacagataattctaca

SEQ ID NO: 7867395 - DNA, 22 bp, Homo sapiens
atgcagtacatacaaacactga

SEQ ID NO: 7867396 - DNA, 22 bp, Homo sapiens
atgcagtaaatgttctagtttg

SEQ ID NO: 7867397 - DNA, 22 bp, Homo sapiens
atgcagtacagataattctaca

SEQ ID NO: 7867398 - DNA, 23 bp, Homo sapiens
atgcagtatatgtcagtagttta

SEQ ID NO: 7867399 - DNA, 22 bp, Homo sapiens
atgcagtataaatcatttctgg

SEQ ID NO: 7867400 - DNA, 22 bp, Homo sapiens
atgcagtccaagctctagagtt

SEQ ID NO: 7867401 - DNA, 22 bp, Homo sapiens
atgcagtagataggcactttta

SEQ ID NO: 7867402 - DNA, 22 bp, Homo sapiens
atgcagtataaatcatttctgg

SEQ ID NO: 7867403 - DNA, 22 bp, Homo sapiens
atgcagtactgatacatgccac

SEQ ID NO: 7867404 - DNA, 22 bp, Homo sapiens
atgcagtactgatacatgccac

SEQ ID NO: 7867405 - DNA, 22 bp, Homo sapiens
atgcaggagccctcttgagggc

SEQ ID NO: 7867406 - DNA, 22 bp, Homo sapiens
atgcaggagttcgaggctgtat

SEQ ID NO: 7867407 - DNA, 22 bp, Homo sapiens
gaaggcaacaccaggatgcact

SEQ ID NO: 7867408 - DNA, 22 bp, Homo sapiens
atgcaggagagcatgtttaaga

SEQ ID NO: 7867409 - DNA, 22 bp, Homo sapiens
gaaggaggtctgcattctacag

SEQ ID NO: 7867410 - DNA, 22 bp, Homo sapiens
gaaggaggtctgcattctacag

SEQ ID NO: 7867411 - DNA, 22 bp, Homo sapiens
gaaggaggtgtcagttggactg

SEQ ID NO: 7867412 - DNA, 22 bp, Homo sapiens
gaaggaggtgtcagttggactg

SEQ ID NO: 7867413 - DNA, 22 bp, Homo sapiens
gaaggatttgagattatcctag

SEQ ID NO: 7867414 - DNA, 22 bp, Homo sapiens
gaaggatttcctatcagttttc

SEQ ID NO: 7867415 - DNA, 22 bp, Homo sapiens
gaaggagggtgcggatctgagc

SEQ ID NO: 7867416 - DNA, 22 bp, Homo sapiens
gaaggagggtgcggatctgagc

SEQ ID NO: 7867417 - DNA, 22 bp, Homo sapiens
gaaggagggtgcggatctgagc

SEQ ID NO: 7867418 - DNA, 22 bp, Homo sapiens
gaaggaggtctgatacaatatg

SEQ ID NO: 7867419 - DNA, 22 bp, Homo sapiens
gaaggaggctccccaaagtctg

SEQ ID NO: 7867420 - DNA, 22 bp, Homo sapiens
gaaggagggagcggcgcggatt

SEQ ID NO: 7867421 - DNA, 22 bp, Homo sapiens
gaaggagggagcggcgcggatt

SEQ ID NO: 7867422 - DNA, 22 bp, Homo sapiens
gaaggagggagcggcgcggatt

SEQ ID NO: 7867423 - DNA, 22 bp, Homo sapiens
gaaggagggagcggcgcggatt

SEQ ID NO: 7867424 - DNA, 22 bp, Homo sapiens
gaaggagggtgcggatctgagc

SEQ ID NO: 7867425 - DNA, 22 bp, Homo sapiens
atgatgtcatagtgtcagcagt

SEQ ID NO: 7867426 - DNA, 22 bp, Homo sapiens
atgatgtcatagtgtcagcagt

SEQ ID NO: 7867427 - DNA, 22 bp, Homo sapiens
atgatgtcattcttgtttgctc

SEQ ID NO: 7867428 - DNA, 22 bp, Homo sapiens
atgatgtcatgaatatattagt

SEQ ID NO: 7867429 - DNA, 22 bp, Homo sapiens
atgatgtccacaggggtgttca

SEQ ID NO: 7867430 - DNA, 22 bp, Homo sapiens
atgatgtcattttaatttctaa

SEQ ID NO: 7867431 - DNA, 22 bp, Homo sapiens
atgatgtccctaggcaggtagt

SEQ ID NO: 7867432 - DNA, 22 bp, Homo sapiens
atgatgtctggaggcatgctgt

SEQ ID NO: 7867433 - DNA, 22 bp, Homo sapiens
atgatgtctggaggcatgctgt

SEQ ID NO: 7867434 - DNA, 22 bp, Homo sapiens
atgatgtctgaagctgttggct

SEQ ID NO: 7867435 - DNA, 22 bp, Homo sapiens
atgatgtctatctttgtagtat

SEQ ID NO: 7867436 - DNA, 22 bp, Homo sapiens
atgatgtgtgctgatcaagctt

SEQ ID NO: 7867437 - DNA, 23 bp, Homo sapiens
atgatgtttttggtagtcaaatg

SEQ ID NO: 7867438 - DNA, 22 bp, Homo sapiens
atgatgttggtttaatttgagt

SEQ ID NO: 7867439 - DNA, 22 bp, Homo sapiens
atgatgtaaatagagcctaggt

SEQ ID NO: 7867440 - DNA, 22 bp, Homo sapiens
atgatgtaagggtaattgtcta

SEQ ID NO: 7867441 - DNA, 22 bp, Homo sapiens
atgatgtaagggtaattgtcta

SEQ ID NO: 7867442 - DNA, 22 bp, Homo sapiens
atgatgtcactcttctgcctaa

SEQ ID NO: 7867443 - DNA, 20 bp, Homo sapiens
atgatgtcagtggcggaggt

SEQ ID NO: 7867444 - DNA, 20 bp, Homo sapiens
atgatgtcagtggcggaggt

SEQ ID NO: 7867445 - DNA, 22 bp, Homo sapiens
atgatgtcactcttctgcctaa

SEQ ID NO: 7867446 - DNA, 22 bp, Homo sapiens
atgatgtagtgacttggcagag

SEQ ID NO: 7867447 - DNA, 22 bp, Homo sapiens
gaagagcatatgaagagcatat

SEQ ID NO: 7867448 - DNA, 22 bp, Homo sapiens
gaagagatgacaaaggagcatg

SEQ ID NO: 7867449 - DNA, 22 bp, Homo sapiens
gaagagcatatgaagagcatat

SEQ ID NO: 7867450 - DNA, 22 bp, Homo sapiens
gaagagcatatgaagagcatat

SEQ ID NO: 7867451 - DNA, 22 bp, Homo sapiens
gaagagcatttgcccaggctgt

SEQ ID NO: 7867452 - DNA, 22 bp, Homo sapiens
gaagagcatttgcccaggctgt

SEQ ID NO: 7867453 - DNA, 22 bp, Homo sapiens
gaagagcatttgcccaggctgt

SEQ ID NO: 7867454 - DNA, 22 bp, Homo sapiens
gaagagcatatgaagagcatat

SEQ ID NO: 7867455 - DNA, 22 bp, Homo sapiens
gaagagatgacaaaggagcatg

SEQ ID NO: 7867456 - DNA, 22 bp, Homo sapiens
gaagagatgacaaaggagcatg

SEQ ID NO: 7867457 - DNA, 22 bp, Homo sapiens
gaagagatgacaaaggagcatg

SEQ ID NO: 7867458 - DNA, 22 bp, Homo sapiens
gaagagatgacaaaggagcatg

SEQ ID NO: 7867459 - DNA, 22 bp, Homo sapiens
gaagagatgacaaaggagcatg

SEQ ID NO: 7867460 - DNA, 22 bp, Homo sapiens
gaagagatgacaaaggagcatg

SEQ ID NO: 7867461 - DNA, 21 bp, Homo sapiens
gaagagagtcctcatcctgag

SEQ ID NO: 7867462 - DNA, 21 bp, Homo sapiens
gaagagagtcctcatcctgag

SEQ ID NO: 7867463 - DNA, 22 bp, Homo sapiens
atgatggctaggctggttttga

SEQ ID NO: 7867464 - DNA, 19 bp, Homo sapiens
atgatggattaacggaagt

SEQ ID NO: 7867465 - DNA, 22 bp, Homo sapiens
gaagagcatatgaagagcatat

SEQ ID NO: 7867466 - DNA, 22 bp, Homo sapiens
atgatggctaggctggttttga

SEQ ID NO: 7867467 - DNA, 22 bp, Homo sapiens
atgatggtaaattcagtatccg

SEQ ID NO: 7867468 - DNA, 22 bp, Homo sapiens
atgatggtgaggttgagcacag

SEQ ID NO: 7867469 - DNA, 22 bp, Homo sapiens
atgatgtaaaataagttgtgag

SEQ ID NO: 7867470 - DNA, 22 bp, Homo sapiens
atgatggatatgtaaagtgttg

SEQ ID NO: 7867471 - DNA, 22 bp, Homo sapiens
atgatggatatgtaaagtgttg

SEQ ID NO: 7867472 - DNA, 22 bp, Homo sapiens
atgatggatgtcacagtctgta

SEQ ID NO: 7867473 - DNA, 22 bp, Homo sapiens
gaagagccaggtgtcgctgtgg

SEQ ID NO: 7867474 - DNA, 22 bp, Homo sapiens
gaagagctaaaggcacaggctt

SEQ ID NO: 7867475 - DNA, 22 bp, Homo sapiens
gaagagctaaaggcacaggctt

SEQ ID NO: 7867476 - DNA, 22 bp, Homo sapiens
atgagcagtttttaagtagcaa

SEQ ID NO: 7867477 - DNA, 22 bp, Homo sapiens
atgagcatatgggaggagtact

SEQ ID NO: 7867478 - DNA, 22 bp, Homo sapiens
atgagcatctgacatttaaaac

SEQ ID NO: 7867479 - DNA, 23 bp, Homo sapiens
atgagcatttttaatttctgtgg

SEQ ID NO: 7867480 - DNA, 22 bp, Homo sapiens
atgagcagtaggttcatggctg

SEQ ID NO: 7867481 - DNA, 22 bp, Homo sapiens
atgagcagtttttaagtagcaa

SEQ ID NO: 7867482 - DNA, 22 bp, Homo sapiens
atgagcaggtttaagagaggcc

SEQ ID NO: 7867483 - DNA, 22 bp, Homo sapiens
atgagcagtaggttcatggctg

SEQ ID NO: 7867484 - DNA, 19 bp, Homo sapiens
atgagcaggcaagacaagc

SEQ ID NO: 7867485 - DNA, 19 bp, Homo sapiens
atgagcaggcaagacaagc

SEQ ID NO: 7867486 - DNA, 22 bp, Homo sapiens
atgagcaggtttaagagaggcc

SEQ ID NO: 7867487 - DNA, 22 bp, Homo sapiens
atgagcaggtttaagagaggcc

SEQ ID NO: 7867488 - DNA, 22 bp, Homo sapiens
atgagccctggaggcatttttt

SEQ ID NO: 7867489 - DNA, 22 bp, Homo sapiens
atgagctagaaaaccatgtgga

SEQ ID NO: 7867490 - DNA, 22 bp, Homo sapiens
atgagctagaaaaccatgtgga

SEQ ID NO: 7867491 - DNA, 22 bp, Homo sapiens
atgagctagaaaaccatgtgga

SEQ ID NO: 7867492 - DNA, 22 bp, Homo sapiens
atgagctagaaaaccatgtgga

SEQ ID NO: 7867493 - DNA, 22 bp, Homo sapiens
atgagctaagcagaaagcacac

SEQ ID NO: 7867494 - DNA, 19 bp, Homo sapiens
atgagctggcatttcaggt

SEQ ID NO: 7867495 - DNA, 22 bp, Homo sapiens
atgagctcatccgagtcacact

SEQ ID NO: 7867496 - DNA, 22 bp, Homo sapiens
atgagctcttttcgtggcttct

SEQ ID NO: 7867497 - DNA, 22 bp, Homo sapiens
atgagctgggccatccagtgat

SEQ ID NO: 7867498 - DNA, 22 bp, Homo sapiens
atgagctgggccatccagtgat

SEQ ID NO: 7867499 - DNA, 22 bp, Homo sapiens
atgagctgggccatccagtgat

SEQ ID NO: 7867500 - DNA, 22 bp, Homo sapiens
atgagctgtaaggtggcttcct

SEQ ID NO: 7867501 - DNA, 22 bp, Homo sapiens
atgagctgtaaggtggcttcct

SEQ ID NO: 7867502 - DNA, 22 bp, Homo sapiens
gaagagagagccctggggtccg

SEQ ID NO: 7867503 - DNA, 22 bp, Homo sapiens
gaagagagagccctggggtccg

SEQ ID NO: 7867504 - DNA, 22 bp, Homo sapiens
gaagagagagccctggggtccg

SEQ ID NO: 7867505 - DNA, 22 bp, Homo sapiens
gaagagagagccctggggtccg

SEQ ID NO: 7867506 - DNA, 22 bp, Homo sapiens
gaagagagagccctggggtccg

SEQ ID NO: 7867507 - DNA, 22 bp, Homo sapiens
gaagagagagccctggggtccg

SEQ ID NO: 7867508 - DNA, 22 bp, Homo sapiens
gaagagagagccctggggtccg

SEQ ID NO: 7867509 - DNA, 22 bp, Homo sapiens
gaagagagaacattacataaac

SEQ ID NO: 7867510 - DNA, 22 bp, Homo sapiens
gaagaaatgtgttcaaggtagg

SEQ ID NO: 7867511 - DNA, 22 bp, Homo sapiens
gaagaaagggaattaacttgag

SEQ ID NO: 7867512 - DNA, 22 bp, Homo sapiens
gaagaaagggaattaacttgag

SEQ ID NO: 7867513 - DNA, 22 bp, Homo sapiens
atgagctgtgggattccagagg

SEQ ID NO: 7867514 - DNA, 22 bp, Homo sapiens
gaagagaaggtgtaggccatcc

SEQ ID NO: 7867515 - DNA, 22 bp, Homo sapiens
gaagagaaggtgtaggccatcc

SEQ ID NO: 7867516 - DNA, 22 bp, Homo sapiens
gaagaaatgtgttcaaggtagg

SEQ ID NO: 7867517 - DNA, 22 bp, Homo sapiens
gaagagagaacattacataaac

SEQ ID NO: 7867518 - DNA, 22 bp, Homo sapiens
gaagagagaacattacataaac

SEQ ID NO: 7867519 - DNA, 22 bp, Homo sapiens
gaagagagccgcgggacatcag

SEQ ID NO: 7867520 - DNA, 22 bp, Homo sapiens
gaagagagccgcgggacatcag

SEQ ID NO: 7867521 - DNA, 21 bp, Homo sapiens
gaagagagtcctcatcctgag

SEQ ID NO: 7867522 - DNA, 21 bp, Homo sapiens
gaagagagtcctcatcctgag

SEQ ID NO: 7867523 - DNA, 21 bp, Homo sapiens
gaagagagtcctcatcctgag

SEQ ID NO: 7867524 - DNA, 22 bp, Homo sapiens
gaagagagccgcgggacatcag

SEQ ID NO: 7867525 - DNA, 22 bp, Homo sapiens
gaagagagccgcgggacatcag

SEQ ID NO: 7867526 - DNA, 22 bp, Homo sapiens
gaagagagcagcaaactggagt

SEQ ID NO: 7867527 - DNA, 22 bp, Homo sapiens
gaagagagcagcaaactggagt

SEQ ID NO: 7867528 - DNA, 22 bp, Homo sapiens
gaagagagcagcaaactggagt

SEQ ID NO: 7867529 - DNA, 22 bp, Homo sapiens
gaagagagagtggggttctgcg

SEQ ID NO: 7867530 - DNA, 22 bp, Homo sapiens
gaagagagagtggggttctgcg

SEQ ID NO: 7867531 - DNA, 22 bp, Homo sapiens
gaagagagagtggggttctgcg

SEQ ID NO: 7867532 - DNA, 22 bp, Homo sapiens
gaagagagagtggggttctgcg

SEQ ID NO: 7867533 - DNA, 22 bp, Homo sapiens
gaattttaagtgttcgcctctt

SEQ ID NO: 7867534 - DNA, 22 bp, Homo sapiens
gaattttaagtgttcgcctctt

SEQ ID NO: 7867535 - DNA, 22 bp, Homo sapiens
gaattttaataaaggtttatca

SEQ ID NO: 7867536 - DNA, 22 bp, Homo sapiens
gaattttaataaaggtttatca

SEQ ID NO: 7867537 - DNA, 22 bp, Homo sapiens
gaatttgtcccttgatataaaa

SEQ ID NO: 7867538 - DNA, 22 bp, Homo sapiens
gaatttgtgctcaggaagatta

SEQ ID NO: 7867539 - DNA, 22 bp, Homo sapiens
gaatttgtgctcaggaagatta

SEQ ID NO: 7867540 - DNA, 22 bp, Homo sapiens
gaattttaataaaggtttatca

SEQ ID NO: 7867541 - DNA, 22 bp, Homo sapiens
gaattttagaatatgtgggctt

SEQ ID NO: 7867542 - DNA, 22 bp, Homo sapiens
gaattttagaatatgtgggctt

SEQ ID NO: 7867543 - DNA, 22 bp, Homo sapiens
gaattttaataaaggtttatca

SEQ ID NO: 7867544 - DNA, 22 bp, Homo sapiens
atgcctggactgtatcccagat

SEQ ID NO: 7867545 - DNA, 22 bp, Homo sapiens
atgcctggactgtatcccagat

SEQ ID NO: 7867546 - DNA, 22 bp, Homo sapiens
gaatttcctctaaacccctgag

SEQ ID NO: 7867547 - DNA, 17 bp, Homo sapiens
gaatttcttggtcaaaa

SEQ ID NO: 7867548 - DNA, 22 bp, Homo sapiens
gaatttgctttcgtgacagggt

SEQ ID NO: 7867549 - DNA, 22 bp, Homo sapiens
gaatttggatctttgatagagt

SEQ ID NO: 7867550 - DNA, 22 bp, Homo sapiens
gaatttggatctttgatagagt

SEQ ID NO: 7867551 - DNA, 22 bp, Homo sapiens
gaatttggatctttgatagagt

SEQ ID NO: 7867552 - DNA, 22 bp, Homo sapiens
gaatttgaaaagtgatgggaat

SEQ ID NO: 7867553 - DNA, 22 bp, Homo sapiens
atgctaaatgttaatgttacct

SEQ ID NO: 7867554 - DNA, 22 bp, Homo sapiens
atgctaaggcccaggagaaaat

SEQ ID NO: 7867555 - DNA, 22 bp, Homo sapiens
atgctacactatttgctgagca

SEQ ID NO: 7867556 - DNA, 22 bp, Homo sapiens
atgctacaacattatctggggt

SEQ ID NO: 7867557 - DNA, 22 bp, Homo sapiens
atgctacagagtttgaatatgt

SEQ ID NO: 7867558 - DNA, 22 bp, Homo sapiens
atgctacagcatctctcatcag

SEQ ID NO: 7867559 - DNA, 22 bp, Homo sapiens
atgctacagcatctctcatcag

SEQ ID NO: 7867560 - DNA, 22 bp, Homo sapiens
atgctaaactatgatcattttc

SEQ ID NO: 7867561 - DNA, 22 bp, Homo sapiens
atgcctggatttgggactcaaa

SEQ ID NO: 7867562 - DNA, 22 bp, Homo sapiens
atgcctggatttgggactcaaa

SEQ ID NO: 7867563 - DNA, 22 bp, Homo sapiens
atgcctggatttgggactcaaa

SEQ ID NO: 7867564 - DNA, 22 bp, Homo sapiens
atgcctggtatgaagcaaggaa

SEQ ID NO: 7867565 - DNA, 22 bp, Homo sapiens
atgctaaatggccagtaccaaa

SEQ ID NO: 7867566 - DNA, 22 bp, Homo sapiens
gacagcttaggaagtttctatt

SEQ ID NO: 7867567 - DNA, 22 bp, Homo sapiens
gacagcttagtgaaaatgtaaa

SEQ ID NO: 7867568 - DNA, 22 bp, Homo sapiens
gacagcttagtgaaaatgtaaa

SEQ ID NO: 7867569 - DNA, 22 bp, Homo sapiens
gacagcttagtgaaaatgtaaa

SEQ ID NO: 7867570 - DNA, 22 bp, Homo sapiens
gacagcttcgaggaggtgagct

SEQ ID NO: 7867571 - DNA, 22 bp, Homo sapiens
gacagcttcgaggaggtgagct

SEQ ID NO: 7867572 - DNA, 22 bp, Homo sapiens
gacagcttcgaggaggtgagct

SEQ ID NO: 7867573 - DNA, 22 bp, Homo sapiens
atgctatactcaaagaaattca

SEQ ID NO: 7867574 - DNA, 22 bp, Homo sapiens
atgctatactcaaagaaattca

SEQ ID NO: 7867575 - DNA, 22 bp, Homo sapiens
atgctatagaaatatttaaatt

SEQ ID NO: 7867576 - DNA, 22 bp, Homo sapiens
atgctatagaaatatttaaatt

SEQ ID NO: 7867577 - DNA, 22 bp, Homo sapiens
atgctatagaaatatttaaatt

SEQ ID NO: 7867578 - DNA, 23 bp, Homo sapiens
atgctagctgtgccaacaccata

SEQ ID NO: 7867579 - DNA, 22 bp, Homo sapiens
atgctataaactctaggtcatt

SEQ ID NO: 7867580 - DNA, 22 bp, Homo sapiens
atgctagaagggagcactatgt

SEQ ID NO: 7867581 - DNA, 22 bp, Homo sapiens
atgctacattttggtttataaa

SEQ ID NO: 7867582 - DNA, 22 bp, Homo sapiens
atgctacattttggtttataaa

SEQ ID NO: 7867583 - DNA, 22 bp, Homo sapiens
atgctacagccctctttgcata

SEQ ID NO: 7867584 - DNA, 22 bp, Homo sapiens
atgctacaggaagacgtcaggc

SEQ ID NO: 7867585 - DNA, 16 bp, Homo sapiens
atgctgctattagagg

SEQ ID NO: 7867586 - DNA, 22 bp, Homo sapiens
atgctcttgaggctaaagacat

SEQ ID NO: 7867587 - DNA, 22 bp, Homo sapiens
atgctgaaaattggatttgaat

SEQ ID NO: 7867588 - DNA, 16 bp, Homo sapiens
atgctgctattagagg

SEQ ID NO: 7867589 - DNA, 16 bp, Homo sapiens
atgctgctattagagg

SEQ ID NO: 7867590 - DNA, 16 bp, Homo sapiens
atgctgctattagagg

SEQ ID NO: 7867591 - DNA, 22 bp, Homo sapiens
gacaggaaaggggtctgttttc

SEQ ID NO: 7867592 - DNA, 22 bp, Homo sapiens
gacaggaaaggggtctgttttc

SEQ ID NO: 7867593 - DNA, 22 bp, Homo sapiens
atgctcttgaggctaaagacat

SEQ ID NO: 7867594 - DNA, 22 bp, Homo sapiens
atgctcttgaggctaaagacat

SEQ ID NO: 7867595 - DNA, 22 bp, Homo sapiens
gacaggaaacaagaaggcagga

SEQ ID NO: 7867596 - DNA, 22 bp, Homo sapiens
gacaggaaacaagaaggcagga

SEQ ID NO: 7867597 - DNA, 22 bp, Homo sapiens
gacaggaaacaagaaggcagga

SEQ ID NO: 7867598 - DNA, 22 bp, Homo sapiens
gacaggaaacaagaaggcagga

SEQ ID NO: 7867599 - DNA, 20 bp, Homo sapiens
gacagcttggggtgtcacct

SEQ ID NO: 7867600 - DNA, 20 bp, Homo sapiens
gacagcttggggtgtcacct

SEQ ID NO: 7867601 - DNA, 22 bp, Homo sapiens
gacagcttgcctggtactgcaa

SEQ ID NO: 7867602 - DNA, 22 bp, Homo sapiens
gacagcttctagaaatggtcac

SEQ ID NO: 7867603 - DNA, 22 bp, Homo sapiens
gacagcttctagaggaattggt

SEQ ID NO: 7867604 - DNA, 22 bp, Homo sapiens
gacagcttctatgtgacgagca

SEQ ID NO: 7867605 - DNA, 22 bp, Homo sapiens
gacagcttcttgggccgggcct

SEQ ID NO: 7867606 - DNA, 22 bp, Homo sapiens
gacagcttctatgtgacgagca

SEQ ID NO: 7867607 - DNA, 22 bp, Homo sapiens
gacagcttgcctggtactgcaa

SEQ ID NO: 7867608 - DNA, 22 bp, Homo sapiens
gaatttcaaagaggttaagagg

SEQ ID NO: 7867609 - DNA, 22 bp, Homo sapiens
gaatttcaaaagccagaacggg

SEQ ID NO: 7867610 - DNA, 22 bp, Homo sapiens
gaatttcaaaagccagaacggg

SEQ ID NO: 7867611 - DNA, 19 bp, Homo sapiens
gaatttatctcttcagtcc

SEQ ID NO: 7867612 - DNA, 22 bp, Homo sapiens
atgccactgcacttcagcttgg

SEQ ID NO: 7867613 - DNA, 19 bp, Homo sapiens
gaatttatctcttcagtcc

SEQ ID NO: 7867614 - DNA, 22 bp, Homo sapiens
gaatttcaagcagtgcaatgtt

SEQ ID NO: 7867615 - DNA, 22 bp, Homo sapiens
gaatttcagaggtaacatcatc

SEQ ID NO: 7867616 - DNA, 22 bp, Homo sapiens
gaatttcagaggtaacatcatc

SEQ ID NO: 7867617 - DNA, 22 bp, Homo sapiens
gaatttcagatcagagaccatt

SEQ ID NO: 7867618 - DNA, 22 bp, Homo sapiens
gaatttcagatcagagaccatt

SEQ ID NO: 7867619 - DNA, 22 bp, Homo sapiens
atgccactgcacttcagcctgg

SEQ ID NO: 7867620 - DNA, 22 bp, Homo sapiens
atgccactgcacttcagcctgg

SEQ ID NO: 7867621 - DNA, 22 bp, Homo sapiens
atgccactgcacttcagcctgg

SEQ ID NO: 7867622 - DNA, 22 bp, Homo sapiens
atgccactgcacttcagcctgg

SEQ ID NO: 7867623 - DNA, 22 bp, Homo sapiens
gaatttatctacgttaagtatg

SEQ ID NO: 7867624 - DNA, 22 bp, Homo sapiens
atgccactgcacttcagcttgg

SEQ ID NO: 7867625 - DNA, 22 bp, Homo sapiens
atgccactgcactccagcctgg

SEQ ID NO: 7867626 - DNA, 22 bp, Homo sapiens
atgccactgcactccagcctgg

SEQ ID NO: 7867627 - DNA, 22 bp, Homo sapiens
atgccactgcactccagcctgg

SEQ ID NO: 7867628 - DNA, 22 bp, Homo sapiens
atgccactgcactccagcctgg

SEQ ID NO: 7867629 - DNA, 22 bp, Homo sapiens
atgccactgcactccagcctgg

SEQ ID NO: 7867630 - DNA, 22 bp, Homo sapiens
atgccactgcactccagcctgg

SEQ ID NO: 7867631 - DNA, 22 bp, Homo sapiens
atgccactgcactccagcctgg

SEQ ID NO: 7867632 - DNA, 22 bp, Homo sapiens
atgccactgcactccagcctgg

SEQ ID NO: 7867633 - DNA, 22 bp, Homo sapiens
atgccactgcactccagcctgg

SEQ ID NO: 7867634 - DNA, 22 bp, Homo sapiens
atgccactgcactccagcctgg

SEQ ID NO: 7867635 - DNA, 22 bp, Homo sapiens
atgccactgcactccagcctgg

SEQ ID NO: 7867636 - DNA, 22 bp, Homo sapiens
atgccactgcactccagcctag

SEQ ID NO: 7867637 - DNA, 22 bp, Homo sapiens
atgccactgcactccagcctag

SEQ ID NO: 7867638 - DNA, 22 bp, Homo sapiens
atgccactgcactccagcctag

SEQ ID NO: 7867639 - DNA, 22 bp, Homo sapiens
atgccactgcactccagcctag

SEQ ID NO: 7867640 - DNA, 22 bp, Homo sapiens
atgccactgcactccagcctag

SEQ ID NO: 7867641 - DNA, 22 bp, Homo sapiens
atgccactgcactccagcctag

SEQ ID NO: 7867642 - DNA, 22 bp, Homo sapiens
atgcatttgtaaaatataatcg

SEQ ID NO: 7867643 - DNA, 22 bp, Homo sapiens
atgccactgcactccagcctag

SEQ ID NO: 7867644 - DNA, 22 bp, Homo sapiens
atgccactgcactccagcctag

SEQ ID NO: 7867645 - DNA, 22 bp, Homo sapiens
atgccactgcactccagcctag

SEQ ID NO: 7867646 - DNA, 22 bp, Homo sapiens
atgcatttgtaaaatataatcg

SEQ ID NO: 7867647 - DNA, 22 bp, Homo sapiens
atgcatttgtaaaatataatcg

SEQ ID NO: 7867648 - DNA, 22 bp, Homo sapiens
atgcatttgtaaaatataatcg

SEQ ID NO: 7867649 - DNA, 22 bp, Homo sapiens
gaagtcagaaaagaattaggga

SEQ ID NO: 7867650 - DNA, 22 bp, Homo sapiens
gaagtatatgtctttaatctat

SEQ ID NO: 7867651 - DNA, 22 bp, Homo sapiens
gaagtattactctgaatgtatt

SEQ ID NO: 7867652 - DNA, 22 bp, Homo sapiens
gaagtatataaatcctttcaga

SEQ ID NO: 7867653 - DNA, 22 bp, Homo sapiens
gaagtagaaagcctcgtaaata

SEQ ID NO: 7867654 - DNA, 22 bp, Homo sapiens
gaagtatagcagatgttattta

SEQ ID NO: 7867655 - DNA, 22 bp, Homo sapiens
gaagtacattctgatagggaag

SEQ ID NO: 7867656 - DNA, 22 bp, Homo sapiens
gaagtacagttttatctagcca

SEQ ID NO: 7867657 - DNA, 22 bp, Homo sapiens
gaagtacagttttatctagcca

SEQ ID NO: 7867658 - DNA, 22 bp, Homo sapiens
gaagtacactactccttgagtc

SEQ ID NO: 7867659 - DNA, 22 bp, Homo sapiens
gaagtacaggggttcttaggta

SEQ ID NO: 7867660 - DNA, 22 bp, Homo sapiens
gaagtacaggttgtgagagaat

SEQ ID NO: 7867661 - DNA, 22 bp, Homo sapiens
gaagtacagaaaggggcccctt

SEQ ID NO: 7867662 - DNA, 22 bp, Homo sapiens
gaagtacacgtgtaagcttttc

SEQ ID NO: 7867663 - DNA, 21 bp, Homo sapiens
gaagtacaccaggaaggccac

SEQ ID NO: 7867664 - DNA, 22 bp, Homo sapiens
atgcagtttgcttcgcagcagt

SEQ ID NO: 7867665 - DNA, 22 bp, Homo sapiens
atgcagttttaaatcatttcag

SEQ ID NO: 7867666 - DNA, 22 bp, Homo sapiens
atgcagttttaggggaagggtt

SEQ ID NO: 7867667 - DNA, 22 bp, Homo sapiens
atgcagttttaggggaagggtt

SEQ ID NO: 7867668 - DNA, 22 bp, Homo sapiens
atgcagttttcaaagactattc

SEQ ID NO: 7867669 - DNA, 22 bp, Homo sapiens
atgcagttccacaggcgcatgg

SEQ ID NO: 7867670 - DNA, 22 bp, Homo sapiens
atgcagttgcaatggaggactc

SEQ ID NO: 7867671 - DNA, 18 bp, Homo sapiens
atgcagttggtactctca

SEQ ID NO: 7867672 - DNA, 22 bp, Homo sapiens
atgcagtttatctccaaatcat

SEQ ID NO: 7867673 - DNA, 22 bp, Homo sapiens
atgcagtttaaggcacaattag

SEQ ID NO: 7867674 - DNA, 23 bp, Homo sapiens
gaagtcagccctacagagagcag

SEQ ID NO: 7867675 - DNA, 22 bp, Homo sapiens
gaagtcagaaaagaattaggga

SEQ ID NO: 7867676 - DNA, 23 bp, Homo sapiens
gaagtcagccctacagagagcag

SEQ ID NO: 7867677 - DNA, 20 bp, Homo sapiens
gaagtcatatgaagcagctt

SEQ ID NO: 7867678 - DNA, 22 bp, Homo sapiens
gaagtcagctccccaggtcccc

SEQ ID NO: 7867679 - DNA, 20 bp, Homo sapiens
gaagtcatatgaagcagctt

SEQ ID NO: 7867680 - DNA, 22 bp, Homo sapiens
gaagtcagtcatctcctgtctc

SEQ ID NO: 7867681 - DNA, 22 bp, Homo sapiens
gaagtcatctggcactcttcta

SEQ ID NO: 7867682 - DNA, 22 bp, Homo sapiens
gaagtcatccactatgggggag

SEQ ID NO: 7867683 - DNA, 22 bp, Homo sapiens
gaagtcatctggcactcttcta

SEQ ID NO: 7867684 - DNA, 22 bp, Homo sapiens
gaagtcatgaggcacagtcctg

SEQ ID NO: 7867685 - DNA, 22 bp, Homo sapiens
gaagtcatgaggcacagtcctg

SEQ ID NO: 7867686 - DNA, 19 bp, Homo sapiens
gaagtcattctgaaattct

SEQ ID NO: 7867687 - DNA, 22 bp, Homo sapiens
gaagtccaagatcaaggcccca

SEQ ID NO: 7867688 - DNA, 22 bp, Homo sapiens
gaagtcatgctcccatcttgct

SEQ ID NO: 7867689 - DNA, 19 bp, Homo sapiens
gaagtcattctgaaattct

SEQ ID NO: 7867690 - DNA, 22 bp, Homo sapiens
gaagtcattgagttttaaacag

SEQ ID NO: 7867691 - DNA, 22 bp, Homo sapiens
gaagtccagatcaagtcaccag

SEQ ID NO: 7867692 - DNA, 22 bp, Homo sapiens
gaagtccagaatactgctctga

SEQ ID NO: 7867693 - DNA, 22 bp, Homo sapiens
gaagtccagatcaagtcaccag

SEQ ID NO: 7867694 - DNA, 22 bp, Homo sapiens
gaagtccaagatcaaggcccca

SEQ ID NO: 7867695 - DNA, 22 bp, Homo sapiens
gaagtctgagtgggggccaggc

SEQ ID NO: 7867696 - DNA, 22 bp, Homo sapiens
gaagtctctctgggctcagttc

SEQ ID NO: 7867697 - DNA, 22 bp, Homo sapiens
gaagtctcacagacagatcaga

SEQ ID NO: 7867698 - DNA, 22 bp, Homo sapiens
gaagtctcacagacagatcaga

SEQ ID NO: 7867699 - DNA, 22 bp, Homo sapiens
gaagtctctctggagagtagaa

SEQ ID NO: 7867700 - DNA, 22 bp, Homo sapiens
atgcatttgtaaaatataatcg

SEQ ID NO: 7867701 - DNA, 22 bp, Homo sapiens
atgcatttgacgggatatattt

SEQ ID NO: 7867702 - DNA, 22 bp, Homo sapiens
gaagtctgagtgggggccaggc

SEQ ID NO: 7867703 - DNA, 22 bp, Homo sapiens
atttgtatcaatctcaatatat

SEQ ID NO: 7867704 - DNA, 22 bp, Homo sapiens
atttgtatcaatctcaatatat

SEQ ID NO: 7867705 - DNA, 22 bp, Homo sapiens
atttgtatcaatctcaatatat

SEQ ID NO: 7867706 - DNA, 22 bp, Homo sapiens
atttgtatcaatctcaatatat

SEQ ID NO: 7867707 - DNA, 22 bp, Homo sapiens
atttgtagtgaagtgaaaataa

SEQ ID NO: 7867708 - DNA, 22 bp, Homo sapiens
atttgtatatttaagagggtag

SEQ ID NO: 7867709 - DNA, 22 bp, Homo sapiens
atttgtagtgaagtgaaaataa

SEQ ID NO: 7867710 - DNA, 22 bp, Homo sapiens
atttgtagtgaagtgaaaataa

SEQ ID NO: 7867711 - DNA, 22 bp, Homo sapiens
atttgtaccatctggtatacag

SEQ ID NO: 7867712 - DNA, 22 bp, Homo sapiens
atttgtactcaggaattctgct

SEQ ID NO: 7867713 - DNA, 22 bp, Homo sapiens
atttgtactcaggaattctgct

SEQ ID NO: 7867714 - DNA, 22 bp, Homo sapiens
atttgtaccatactgtttatta

SEQ ID NO: 7867715 - DNA, 22 bp, Homo sapiens
atttgtaccatactgtttatta

SEQ ID NO: 7867716 - DNA, 22 bp, Homo sapiens
atttgtacaaatttatgttagt

SEQ ID NO: 7867717 - DNA, 22 bp, Homo sapiens
atttgtaccatactgtttatta

SEQ ID NO: 7867718 - DNA, 22 bp, Homo sapiens
atttgtcaataagatgaacata

SEQ ID NO: 7867719 - DNA, 22 bp, Homo sapiens
atttgtcaataagatgaacata

SEQ ID NO: 7867720 - DNA, 22 bp, Homo sapiens
atttgtcaataagatgaacata

SEQ ID NO: 7867721 - DNA, 22 bp, Homo sapiens
atttgtcaacaggcatttaggt

SEQ ID NO: 7867722 - DNA, 22 bp, Homo sapiens
atttgtcaaaacacagagaaca

SEQ ID NO: 7867723 - DNA, 22 bp, Homo sapiens
atttgtcaaaacacagagaaca

SEQ ID NO: 7867724 - DNA, 22 bp, Homo sapiens
atttgtcaaaacacagagaaca

SEQ ID NO: 7867725 - DNA, 22 bp, Homo sapiens
atttgtcaaaacacagagaaca

SEQ ID NO: 7867726 - DNA, 22 bp, Homo sapiens
atttgtcaacaggcatttaggt

SEQ ID NO: 7867727 - DNA, 22 bp, Homo sapiens
atttgtcaacaggcatttaggt

SEQ ID NO: 7867728 - DNA, 22 bp, Homo sapiens
atttgtatcttctaatattatc

SEQ ID NO: 7867729 - DNA, 22 bp, Homo sapiens
atttgtatcttctaatattatc

SEQ ID NO: 7867730 - DNA, 22 bp, Homo sapiens
atttgtatcttctaatattatc

SEQ ID NO: 7867731 - DNA, 22 bp, Homo sapiens
atttgtatcttctaatattatc

SEQ ID NO: 7867732 - DNA, 22 bp, Homo sapiens
atttgtcaaaacacagagaaca

SEQ ID NO: 7867733 - DNA, 22 bp, Homo sapiens
atttgtcaaaacacagagaaca

SEQ ID NO: 7867734 - DNA, 22 bp, Homo sapiens
atttgtcactgagagagttaga

SEQ ID NO: 7867735 - DNA, 22 bp, Homo sapiens
atttgtcactgagagagttaga

SEQ ID NO: 7867736 - DNA, 22 bp, Homo sapiens
atttgtcactgagagagttaga

SEQ ID NO: 7867737 - DNA, 22 bp, Homo sapiens
atttgtcactgagagagttaga

SEQ ID NO: 7867738 - DNA, 22 bp, Homo sapiens
atttgtcagtggaagtgattca

SEQ ID NO: 7867739 - DNA, 22 bp, Homo sapiens
atttgtcagtggaagtgattca

SEQ ID NO: 7867740 - DNA, 22 bp, Homo sapiens
atttgtcatgtatgtaaagttg

SEQ ID NO: 7867741 - DNA, 22 bp, Homo sapiens
atttgtctaatgagtgtgtact

SEQ ID NO: 7867742 - DNA, 22 bp, Homo sapiens
atttgtcatatataatactctt

SEQ ID NO: 7867743 - DNA, 22 bp, Homo sapiens
atttgtcatgtatgtaaagttg

SEQ ID NO: 7867744 - DNA, 22 bp, Homo sapiens
atttgtcatatataatactctt

SEQ ID NO: 7867745 - DNA, 22 bp, Homo sapiens
attttagatttaagaataaggt

SEQ ID NO: 7867746 - DNA, 22 bp, Homo sapiens
attttcagcccccactcgtggc

SEQ ID NO: 7867747 - DNA, 22 bp, Homo sapiens
attttcagcccccactcgtggc

SEQ ID NO: 7867748 - DNA, 22 bp, Homo sapiens
attttcaggttttgccattgta

SEQ ID NO: 7867749 - DNA, 22 bp, Homo sapiens
attttcagtctggctggaccca

SEQ ID NO: 7867750 - DNA, 22 bp, Homo sapiens
attttcagtgatcatagcacac

SEQ ID NO: 7867751 - DNA, 22 bp, Homo sapiens
attttcagtgatcatagcacac

SEQ ID NO: 7867752 - DNA, 22 bp, Homo sapiens
attttcagtctggctggaccca

SEQ ID NO: 7867753 - DNA, 22 bp, Homo sapiens
attttcaggttttgccattgta

SEQ ID NO: 7867754 - DNA, 22 bp, Homo sapiens
attttagagctccaagtacagc

SEQ ID NO: 7867755 - DNA, 22 bp, Homo sapiens
attttagatttaagaataaggt

SEQ ID NO: 7867756 - DNA, 22 bp, Homo sapiens
attttagatttaagaataaggt

SEQ ID NO: 7867757 - DNA, 22 bp, Homo sapiens
atttgtctagtggtattcacgt

SEQ ID NO: 7867758 - DNA, 22 bp, Homo sapiens
atttgtctagtggtattcacgt

SEQ ID NO: 7867759 - DNA, 22 bp, Homo sapiens
atttgtaaagtgcttaaaagta

SEQ ID NO: 7867760 - DNA, 22 bp, Homo sapiens
atttgtaaagtgcttaaaagta

SEQ ID NO: 7867761 - DNA, 22 bp, Homo sapiens
atttgtaagctagagccatgat

SEQ ID NO: 7867762 - DNA, 22 bp, Homo sapiens
atttgtaagctagagccatgat

SEQ ID NO: 7867763 - DNA, 22 bp, Homo sapiens
atttgtaagctagagccatgat

SEQ ID NO: 7867764 - DNA, 22 bp, Homo sapiens
atttgtaagctagagccatgat

SEQ ID NO: 7867765 - DNA, 17 bp, Homo sapiens
atttgtaactagctctt

SEQ ID NO: 7867766 - DNA, 17 bp, Homo sapiens
atttgtaactagctctt

SEQ ID NO: 7867767 - DNA, 22 bp, Homo sapiens
atttgtaacacgtgacaggttg

SEQ ID NO: 7867768 - DNA, 22 bp, Homo sapiens
atttgtaacacgtgacaggttg

SEQ ID NO: 7867769 - DNA, 22 bp, Homo sapiens
atttgtaagctagagccatgat

SEQ ID NO: 7867770 - DNA, 22 bp, Homo sapiens
atttgtaatttcttatctgtgt

SEQ ID NO: 7867771 - DNA, 22 bp, Homo sapiens
atttgtacaaatttatgttagt

SEQ ID NO: 7867772 - DNA, 22 bp, Homo sapiens
atttgtacaaatttatgttagt

SEQ ID NO: 7867773 - DNA, 22 bp, Homo sapiens
atttgtaagctagagccatgat

SEQ ID NO: 7867774 - DNA, 22 bp, Homo sapiens
atttgtacaaatttatgttagt

SEQ ID NO: 7867775 - DNA, 22 bp, Homo sapiens
atttgtaatttcttatctgtgt

SEQ ID NO: 7867776 - DNA, 22 bp, Homo sapiens
atttgtaatttcttatctgtgt

SEQ ID NO: 7867777 - DNA, 22 bp, Homo sapiens
atttggaattcgagtaattcca

SEQ ID NO: 7867778 - DNA, 22 bp, Homo sapiens
atttggaattcgagtaattcca

SEQ ID NO: 7867779 - DNA, 22 bp, Homo sapiens
atttcttcctctgtcagtaact

SEQ ID NO: 7867780 - DNA, 22 bp, Homo sapiens
atttggaatgtgtttgatcacc

SEQ ID NO: 7867781 - DNA, 22 bp, Homo sapiens
atttggaattctatttcagtag

SEQ ID NO: 7867782 - DNA, 22 bp, Homo sapiens
atttggaattcgagtaattcca

SEQ ID NO: 7867783 - DNA, 22 bp, Homo sapiens
atttggcttctctaatactata

SEQ ID NO: 7867784 - DNA, 22 bp, Homo sapiens
atttggcttggcaacaactttc

SEQ ID NO: 7867785 - DNA, 22 bp, Homo sapiens
atttgggaatgtgcattatact

SEQ ID NO: 7867786 - DNA, 22 bp, Homo sapiens
atttggcttacacgatattttc

SEQ ID NO: 7867787 - DNA, 22 bp, Homo sapiens
atttcttcctctgtcagtaact

SEQ ID NO: 7867788 - DNA, 22 bp, Homo sapiens
atttcttcctctgtcagtaact

SEQ ID NO: 7867789 - DNA, 22 bp, Homo sapiens
atttcttccattgcctcttcaa

SEQ ID NO: 7867790 - DNA, 22 bp, Homo sapiens
atttcttcctctgtcagtaact

SEQ ID NO: 7867791 - DNA, 22 bp, Homo sapiens
atttcttcctctgtcagtaact

SEQ ID NO: 7867792 - DNA, 22 bp, Homo sapiens
atttcttcctctgtcagtaact

SEQ ID NO: 7867793 - DNA, 22 bp, Homo sapiens
atttgggcagtccatgaaataa

SEQ ID NO: 7867794 - DNA, 22 bp, Homo sapiens
atttggtagtcctgataagatt

SEQ ID NO: 7867795 - DNA, 22 bp, Homo sapiens
atttggtagtcctgataagatt

SEQ ID NO: 7867796 - DNA, 22 bp, Homo sapiens
atttggggctcaccagggctga

SEQ ID NO: 7867797 - DNA, 22 bp, Homo sapiens
atttggcttggcaacaactttc

SEQ ID NO: 7867798 - DNA, 22 bp, Homo sapiens
atttgggaattatttgcctaat

SEQ ID NO: 7867799 - DNA, 22 bp, Homo sapiens
atttgggagttgctagtgagtt

SEQ ID NO: 7867800 - DNA, 20 bp, Homo sapiens
atttgggacgattggccacc

SEQ ID NO: 7867801 - DNA, 22 bp, Homo sapiens
atttggtctacattttccaaat

SEQ ID NO: 7867802 - DNA, 21 bp, Homo sapiens
atttggtcaaggacaactctg

SEQ ID NO: 7867803 - DNA, 22 bp, Homo sapiens
atttggtagtgattgaaattat

SEQ ID NO: 7867804 - DNA, 21 bp, Homo sapiens
attttcattaattcagtgtgg

SEQ ID NO: 7867805 - DNA, 21 bp, Homo sapiens
attttcatttccaggggagga

SEQ ID NO: 7867806 - DNA, 21 bp, Homo sapiens
attttcatttccaggggagga

SEQ ID NO: 7867807 - DNA, 22 bp, Homo sapiens
attttcattttgcagggtgaga

SEQ ID NO: 7867808 - DNA, 21 bp, Homo sapiens
attttcattaattcagtgtgg

SEQ ID NO: 7867809 - DNA, 21 bp, Homo sapiens
attttcattaattcagtgtgg

SEQ ID NO: 7867810 - DNA, 21 bp, Homo sapiens
attttcattaattcagtgtgg

SEQ ID NO: 7867811 - DNA, 21 bp, Homo sapiens
attttcattaattcagtgtgg

SEQ ID NO: 7867812 - DNA, 21 bp, Homo sapiens
attttcattaattcagtgtgg

SEQ ID NO: 7867813 - DNA, 22 bp, Homo sapiens
attttccaaaataattgttact

SEQ ID NO: 7867814 - DNA, 22 bp, Homo sapiens
attttccaaaataattgttact

SEQ ID NO: 7867815 - DNA, 22 bp, Homo sapiens
attttccaaaataattgttact

SEQ ID NO: 7867816 - DNA, 22 bp, Homo sapiens
attttcattttgcagggtgaga

SEQ ID NO: 7867817 - DNA, 22 bp, Homo sapiens
attttccaaaataattgttact

SEQ ID NO: 7867818 - DNA, 22 bp, Homo sapiens
attttccaaaataattgttact

SEQ ID NO: 7867819 - DNA, 22 bp, Homo sapiens
attttcccttctaaagggctga

SEQ ID NO: 7867820 - DNA, 22 bp, Homo sapiens
attttccatctccacaccaggg

SEQ ID NO: 7867821 - DNA, 22 bp, Homo sapiens
attttccatctccacaccaggg

SEQ ID NO: 7867822 - DNA, 22 bp, Homo sapiens
attttccatctccacaccaggg

SEQ ID NO: 7867823 - DNA, 22 bp, Homo sapiens
attttccagcctttctagaact

SEQ ID NO: 7867824 - DNA, 22 bp, Homo sapiens
attttcatcatgggtttaacat

SEQ ID NO: 7867825 - DNA, 22 bp, Homo sapiens
attttcatcatgggtttaacat

SEQ ID NO: 7867826 - DNA, 22 bp, Homo sapiens
attttcagttgaaaaagttggt

SEQ ID NO: 7867827 - DNA, 22 bp, Homo sapiens
attttcagttgaaaaagttggt

SEQ ID NO: 7867828 - DNA, 22 bp, Homo sapiens
attttcagtgtaaatgttttat

SEQ ID NO: 7867829 - DNA, 22 bp, Homo sapiens
attttcatcatgggtttaacat

SEQ ID NO: 7867830 - DNA, 22 bp, Homo sapiens
attttcatcatgggtttaacat

SEQ ID NO: 7867831 - DNA, 22 bp, Homo sapiens
attttcatcatgggtttaacat

SEQ ID NO: 7867832 - DNA, 22 bp, Homo sapiens
attttcatcgctaggttggcct

SEQ ID NO: 7867833 - DNA, 22 bp, Homo sapiens
attttcatcgctaggttggcct

SEQ ID NO: 7867834 - DNA, 22 bp, Homo sapiens
attttcatgactaccttaaata

SEQ ID NO: 7867835 - DNA, 22 bp, Homo sapiens
attttcatgactaccttaaata

SEQ ID NO: 7867836 - DNA, 22 bp, Homo sapiens
attttcatggcttctgctcagt

SEQ ID NO: 7867837 - DNA, 22 bp, Homo sapiens
attttcatggcttctgctcagt

SEQ ID NO: 7867838 - DNA, 22 bp, Homo sapiens
attttcatggcttctgctcagt

SEQ ID NO: 7867839 - DNA, 22 bp, Homo sapiens
attttcatggcttctgctcagt

SEQ ID NO: 7867840 - DNA, 22 bp, Homo sapiens
attttcatggcttctgctcagt

SEQ ID NO: 7867841 - DNA, 22 bp, Homo sapiens
attttcctctggtttccccaga

SEQ ID NO: 7867842 - DNA, 22 bp, Homo sapiens
attttcctctggtttccccaga

SEQ ID NO: 7867843 - DNA, 22 bp, Homo sapiens
attttcctctggtttccccaga

SEQ ID NO: 7867844 - DNA, 22 bp, Homo sapiens
attttccttctaagaggaaggt

SEQ ID NO: 7867845 - DNA, 22 bp, Homo sapiens
attttcctctggtttccccaga

SEQ ID NO: 7867846 - DNA, 22 bp, Homo sapiens
attttccttctaagaggaaggt

SEQ ID NO: 7867847 - DNA, 22 bp, Homo sapiens
attttcctctggtttccccaga

SEQ ID NO: 7867848 - DNA, 22 bp, Homo sapiens
attttcctctggtttccccaga

SEQ ID NO: 7867849 - DNA, 22 bp, Homo sapiens
attttcctccatgtgagcagtt

SEQ ID NO: 7867850 - DNA, 22 bp, Homo sapiens
attttcctccatgtgagcagtt

SEQ ID NO: 7867851 - DNA, 22 bp, Homo sapiens
attttcctccatgtgagcagtt

SEQ ID NO: 7867852 - DNA, 22 bp, Homo sapiens
attttcctccatgtgagcagtt

SEQ ID NO: 7867853 - DNA, 22 bp, Homo sapiens
attttcctagtcatgtgcttct

SEQ ID NO: 7867854 - DNA, 22 bp, Homo sapiens
attttcctagtcatgtgcttct

SEQ ID NO: 7867855 - DNA, 22 bp, Homo sapiens
attttcctagtcatgtgcttct

SEQ ID NO: 7867856 - DNA, 22 bp, Homo sapiens
attttcctagtcatgtgcttct

SEQ ID NO: 7867857 - DNA, 22 bp, Homo sapiens
attttcctagtcatgtgcttct

SEQ ID NO: 7867858 - DNA, 22 bp, Homo sapiens
attttcctcaagcctctggaag

SEQ ID NO: 7867859 - DNA, 22 bp, Homo sapiens
attttcctcaagcctctggaag

SEQ ID NO: 7867860 - DNA, 22 bp, Homo sapiens
attttcctcaagcctctggaag

SEQ ID NO: 7867861 - DNA, 22 bp, Homo sapiens
attttcctccatgtgagcagtt

SEQ ID NO: 7867862 - DNA, 22 bp, Homo sapiens
attttcctcaagcctctggaag

SEQ ID NO: 7867863 - DNA, 22 bp, Homo sapiens
attttccttgtgggttagcgaa

SEQ ID NO: 7867864 - DNA, 22 bp, Homo sapiens
attttccttgtgggttagcgaa

SEQ ID NO: 7867865 - DNA, 22 bp, Homo sapiens
attttccttgtgggttagcgaa

SEQ ID NO: 7867866 - DNA, 22 bp, Homo sapiens
attttccttctaagaggaaggt

SEQ ID NO: 7867867 - DNA, 22 bp, Homo sapiens
attttccttgtgggttagcgaa

SEQ ID NO: 7867868 - DNA, 22 bp, Homo sapiens
attttccttctaagaggaaggt

SEQ ID NO: 7867869 - DNA, 22 bp, Homo sapiens
attttctaagcctgtcagactt

SEQ ID NO: 7867870 - DNA, 22 bp, Homo sapiens
gcctgtgctgttccctctgcca

SEQ ID NO: 7867871 - DNA, 22 bp, Homo sapiens
attttctaagcctgtcagactt

SEQ ID NO: 7867872 - DNA, 22 bp, Homo sapiens
gcctgtgctgttccctctgcca

SEQ ID NO: 7867873 - DNA, 22 bp, Homo sapiens
gcctgtgctgttccctctgcca

SEQ ID NO: 7867874 - DNA, 22 bp, Homo sapiens
gcctgtgcttaactgacgtgag

SEQ ID NO: 7867875 - DNA, 22 bp, Homo sapiens
gcctgtgcttaactgacgtgag

SEQ ID NO: 7867876 - DNA, 22 bp, Homo sapiens
gcctgtgcttaactgacgtgag

SEQ ID NO: 7867877 - DNA, 22 bp, Homo sapiens
gccttccagaatacacatagca

SEQ ID NO: 7867878 - DNA, 17 bp, Homo sapiens
gccttccagcatgtggg

SEQ ID NO: 7867879 - DNA, 17 bp, Homo sapiens
gccttccagcatgtggg

SEQ ID NO: 7867880 - DNA, 17 bp, Homo sapiens
gccttccagcatgtggg

SEQ ID NO: 7867881 - DNA, 17 bp, Homo sapiens
gccttccagcatgtggg

SEQ ID NO: 7867882 - DNA, 22 bp, Homo sapiens
gccttccagaatacacatagca

SEQ ID NO: 7867883 - DNA, 22 bp, Homo sapiens
gccttccagaatacacatagca

SEQ ID NO: 7867884 - DNA, 19 bp, Homo sapiens
gccttcccaccacccgtcc

SEQ ID NO: 7867885 - DNA, 22 bp, Homo sapiens
gccttcccaagacgcctgagtt

SEQ ID NO: 7867886 - DNA, 22 bp, Homo sapiens
gccttcccaccctgcgaggctg

SEQ ID NO: 7867887 - DNA, 22 bp, Homo sapiens
gccttcccaagacgcctgagtt

SEQ ID NO: 7867888 - DNA, 22 bp, Homo sapiens
gccttccaggcagggggagcag

SEQ ID NO: 7867889 - DNA, 22 bp, Homo sapiens
gccttcccaagacgcctgagtt

SEQ ID NO: 7867890 - DNA, 20 bp, Homo sapiens
gccttccagttcagtggcac

SEQ ID NO: 7867891 - DNA, 20 bp, Homo sapiens
gccttccagttcagtggcac

SEQ ID NO: 7867892 - DNA, 22 bp, Homo sapiens
gccttccaggcagggggagcag

SEQ ID NO: 7867893 - DNA, 20 bp, Homo sapiens
gccttccagttcagtggcac

SEQ ID NO: 7867894 - DNA, 22 bp, Homo sapiens
gccttccttacacctgctcagc

SEQ ID NO: 7867895 - DNA, 22 bp, Homo sapiens
gccttccttacacctgctcagc

SEQ ID NO: 7867896 - DNA, 17 bp, Homo sapiens
gccttccttcctccaca

SEQ ID NO: 7867897 - DNA, 17 bp, Homo sapiens
gccttccttcctccaca

SEQ ID NO: 7867898 - DNA, 22 bp, Homo sapiens
gccttcctgcagctctgagcgt

SEQ ID NO: 7867899 - DNA, 22 bp, Homo sapiens
gccttccctggctaggcaagca

SEQ ID NO: 7867900 - DNA, 22 bp, Homo sapiens
gccttccctctcatcctgctgg

SEQ ID NO: 7867901 - DNA, 22 bp, Homo sapiens
gctcagagaatcagcagacacc

SEQ ID NO: 7867902 - DNA, 22 bp, Homo sapiens
gctcagagaagttgtgcctggc

SEQ ID NO: 7867903 - DNA, 22 bp, Homo sapiens
gctcagagaagttgtgcctggc

SEQ ID NO: 7867904 - DNA, 22 bp, Homo sapiens
gctcagagaatcagcagacacc

SEQ ID NO: 7867905 - DNA, 22 bp, Homo sapiens
gctcagagaatttactgctgcc

SEQ ID NO: 7867906 - DNA, 22 bp, Homo sapiens
gctcagagaatcagcagacacc

SEQ ID NO: 7867907 - DNA, 22 bp, Homo sapiens
gctcagagaatttactgctgcc

SEQ ID NO: 7867908 - DNA, 22 bp, Homo sapiens
gctcagagagaggctcaccatt

SEQ ID NO: 7867909 - DNA, 22 bp, Homo sapiens
gctcagagaatttactgctgcc

SEQ ID NO: 7867910 - DNA, 19 bp, Homo sapiens
gctcagagacacctgttgc

SEQ ID NO: 7867911 - DNA, 19 bp, Homo sapiens
gctcagagacacctgttgc

SEQ ID NO: 7867912 - DNA, 22 bp, Homo sapiens
gctcagagagtttcacaagttt

SEQ ID NO: 7867913 - DNA, 22 bp, Homo sapiens
caaaagaagctcttggggctag

SEQ ID NO: 7867914 - DNA, 22 bp, Homo sapiens
gctcagagagtttcacaagttt

SEQ ID NO: 7867915 - DNA, 22 bp, Homo sapiens
gctcagagagaggctcaccatt

SEQ ID NO: 7867916 - DNA, 22 bp, Homo sapiens
gctcagagagaggctcaccatt

SEQ ID NO: 7867917 - DNA, 22 bp, Homo sapiens
caaaagatacttgcatctaact

SEQ ID NO: 7867918 - DNA, 22 bp, Homo sapiens
caaaagatacttgcatctaact

SEQ ID NO: 7867919 - DNA, 22 bp, Homo sapiens
caaaagcaaagtccctgaatgt

SEQ ID NO: 7867920 - DNA, 22 bp, Homo sapiens
caaaagatacttgcatctaact

SEQ ID NO: 7867921 - DNA, 22 bp, Homo sapiens
caaaagatacttgcatctaact

SEQ ID NO: 7867922 - DNA, 22 bp, Homo sapiens
caaaagatacttgcatctaact

SEQ ID NO: 7867923 - DNA, 22 bp, Homo sapiens
caaaagatacttgcatctaact

SEQ ID NO: 7867924 - DNA, 22 bp, Homo sapiens
caaaagaagctcttggggctag

SEQ ID NO: 7867925 - DNA, 22 bp, Homo sapiens
caaaagaagctcttggggctag

SEQ ID NO: 7867926 - DNA, 22 bp, Homo sapiens
caaaagatacttgcatctaact

SEQ ID NO: 7867927 - DNA, 21 bp, Homo sapiens
caaaagagactgattcttgga

SEQ ID NO: 7867928 - DNA, 21 bp, Homo sapiens
caaaagagactgattcttgga

SEQ ID NO: 7867929 - DNA, 22 bp, Homo sapiens
caaaagcaaagtccctgaatgt

SEQ ID NO: 7867930 - DNA, 22 bp, Homo sapiens
caaaagcaaagtccctgaatgt

SEQ ID NO: 7867931 - DNA, 22 bp, Homo sapiens
caaaagcaaagtccctgaatgt

SEQ ID NO: 7867932 - DNA, 20 bp, Homo sapiens
caaaagcaatgaagttatga

SEQ ID NO: 7867933 - DNA, 20 bp, Homo sapiens
caaaagcaatgaagttatga

SEQ ID NO: 7867934 - DNA, 20 bp, Homo sapiens
caaaagcaatgaagttatga

SEQ ID NO: 7867935 - DNA, 20 bp, Homo sapiens
caaaagcaatgaagttatga

SEQ ID NO: 7867936 - DNA, 22 bp, Homo sapiens
caaaagcagcaagtttatatgt

SEQ ID NO: 7867937 - DNA, 22 bp, Homo sapiens
caaaagcagcaagtttatatgt

SEQ ID NO: 7867938 - DNA, 22 bp, Homo sapiens
caaaagcagcaagtttatatgt

SEQ ID NO: 7867939 - DNA, 22 bp, Homo sapiens
caaaagcagcaagtttatatgt

SEQ ID NO: 7867940 - DNA, 20 bp, Homo sapiens
caaaagcaatgaagttatga

SEQ ID NO: 7867941 - DNA, 20 bp, Homo sapiens
caaaagcaatgaagttatga

SEQ ID NO: 7867942 - DNA, 20 bp, Homo sapiens
caaaagcaatgaagttatga

SEQ ID NO: 7867943 - DNA, 22 bp, Homo sapiens
attttgctgtggtacattagga

SEQ ID NO: 7867944 - DNA, 22 bp, Homo sapiens
attttgctggtctgaattactt

SEQ ID NO: 7867945 - DNA, 22 bp, Homo sapiens
attttgcacactatgcagcttt

SEQ ID NO: 7867946 - DNA, 22 bp, Homo sapiens
attttgcacactatgcagcttt

SEQ ID NO: 7867947 - DNA, 22 bp, Homo sapiens
attttgcacactatgcagcttt

SEQ ID NO: 7867948 - DNA, 22 bp, Homo sapiens
attttgcacactatgcagcttt

SEQ ID NO: 7867949 - DNA, 22 bp, Homo sapiens
gctcaaatcccagcgggctcct

SEQ ID NO: 7867950 - DNA, 22 bp, Homo sapiens
gctcaaatgtcatggggagcct

SEQ ID NO: 7867951 - DNA, 22 bp, Homo sapiens
gctcagacttgttttacaggct

SEQ ID NO: 7867952 - DNA, 22 bp, Homo sapiens
gctcagactgcacaccctggtc

SEQ ID NO: 7867953 - DNA, 22 bp, Homo sapiens
gctcaaatttcagactcatgaa

SEQ ID NO: 7867954 - DNA, 22 bp, Homo sapiens
gctcagactgcacaccctggtc

SEQ ID NO: 7867955 - DNA, 22 bp, Homo sapiens
gctcagagaaaactggggcttg

SEQ ID NO: 7867956 - DNA, 22 bp, Homo sapiens
gctcagagaaaactggggcttg

SEQ ID NO: 7867957 - DNA, 22 bp, Homo sapiens
attttgaatcaccttggaagaa

SEQ ID NO: 7867958 - DNA, 17 bp, Homo sapiens
gccttctctgccctcac

SEQ ID NO: 7867959 - DNA, 22 bp, Homo sapiens
attttgaagggaattgaagttc

SEQ ID NO: 7867960 - DNA, 17 bp, Homo sapiens
gccttctctgccctcac

SEQ ID NO: 7867961 - DNA, 17 bp, Homo sapiens
gccttctctgccctcac

SEQ ID NO: 7867962 - DNA, 22 bp, Homo sapiens
gccttctccctaaccaaatcct

SEQ ID NO: 7867963 - DNA, 22 bp, Homo sapiens
gccttctccctaaccaaatcct

SEQ ID NO: 7867964 - DNA, 22 bp, Homo sapiens
gccttccttttaccaccagcca

SEQ ID NO: 7867965 - DNA, 17 bp, Homo sapiens
gccttccttcctccaca

SEQ ID NO: 7867966 - DNA, 17 bp, Homo sapiens
gccttccttcctccaca

SEQ ID NO: 7867967 - DNA, 22 bp, Homo sapiens
attttgactgcattacagaaca

SEQ ID NO: 7867968 - DNA, 22 bp, Homo sapiens
attttgacagaagaggccctaa

SEQ ID NO: 7867969 - DNA, 22 bp, Homo sapiens
attttgataatcatgttagaga

SEQ ID NO: 7867970 - DNA, 22 bp, Homo sapiens
attttgataatcatgttagaga

SEQ ID NO: 7867971 - DNA, 22 bp, Homo sapiens
attttgataatcatgttagaga

SEQ ID NO: 7867972 - DNA, 22 bp, Homo sapiens
attttgataatcatgttagaga

SEQ ID NO: 7867973 - DNA, 22 bp, Homo sapiens
attttgatgctatctaatgaat

SEQ ID NO: 7867974 - DNA, 22 bp, Homo sapiens
caaagactgcataacacatgaa

SEQ ID NO: 7867975 - DNA, 22 bp, Homo sapiens
gctctgagagtgggtgattctg

SEQ ID NO: 7867976 - DNA, 20 bp, Homo sapiens
caaagacatgctaggggtgg

SEQ ID NO: 7867977 - DNA, 20 bp, Homo sapiens
caaagacatgctaggggtgg

SEQ ID NO: 7867978 - DNA, 20 bp, Homo sapiens
caaagacatgctaggggtgg

SEQ ID NO: 7867979 - DNA, 22 bp, Homo sapiens
caaagacacgggaaacaacgtt

SEQ ID NO: 7867980 - DNA, 22 bp, Homo sapiens
caaagactgcataacacatgaa

SEQ ID NO: 7867981 - DNA, 22 bp, Homo sapiens
gctctgctgtcttcttgcaggc

SEQ ID NO: 7867982 - DNA, 22 bp, Homo sapiens
gctctgctgtggaatcctctcc

SEQ ID NO: 7867983 - DNA, 22 bp, Homo sapiens
gctctgctgtggaatcctctcc

SEQ ID NO: 7867984 - DNA, 22 bp, Homo sapiens
gctctgctgtggaatcctctcc

SEQ ID NO: 7867985 - DNA, 22 bp, Homo sapiens
gctctgagattgagcctttggt

SEQ ID NO: 7867986 - DNA, 22 bp, Homo sapiens
caaagaggttttgagggcagct

SEQ ID NO: 7867987 - DNA, 22 bp, Homo sapiens
gctctgagagtgggtgattctg

SEQ ID NO: 7867988 - DNA, 22 bp, Homo sapiens
gctctgagataaacgttgccct

SEQ ID NO: 7867989 - DNA, 22 bp, Homo sapiens
caaagaatgagtgagtacataa

SEQ ID NO: 7867990 - DNA, 22 bp, Homo sapiens
caaagacacgggaaacaacgtt

SEQ ID NO: 7867991 - DNA, 22 bp, Homo sapiens
caaagacacgggaaacaacgtt

SEQ ID NO: 7867992 - DNA, 22 bp, Homo sapiens
caaagacacgggaaacaacgtt

SEQ ID NO: 7867993 - DNA, 22 bp, Homo sapiens
caaagacacgggaaacaacgtt

SEQ ID NO: 7867994 - DNA, 22 bp, Homo sapiens
caaagaatcactcatctttagc

SEQ ID NO: 7867995 - DNA, 22 bp, Homo sapiens
caaagaatcactcatctttagc

SEQ ID NO: 7867996 - DNA, 22 bp, Homo sapiens
caaagaatgagtgagtacataa

SEQ ID NO: 7867997 - DNA, 22 bp, Homo sapiens
caaagaatgagtgagtacataa

SEQ ID NO: 7867998 - DNA, 22 bp, Homo sapiens
caaagaatgagtgagtacataa

SEQ ID NO: 7867999 - DNA, 22 bp, Homo sapiens
caaagaatgagtgagtacataa

SEQ ID NO: 7868000 - DNA, 22 bp, Homo sapiens
caaagaagagatttacagagct

SEQ ID NO: 7868001 - DNA, 22 bp, Homo sapiens
caaagaagagatttacagagct

SEQ ID NO: 7868002 - DNA, 22 bp, Homo sapiens
gctccccaggctggtcccctcg

SEQ ID NO: 7868003 - DNA, 22 bp, Homo sapiens
gctccccaggctggtcccctcg

SEQ ID NO: 7868004 - DNA, 22 bp, Homo sapiens
caaagaagagatttacagagct

SEQ ID NO: 7868005 - DNA, 22 bp, Homo sapiens
gctccccaggctggtcccctcg

SEQ ID NO: 7868006 - DNA, 22 bp, Homo sapiens
caaagaagagatttacagagct

SEQ ID NO: 7868007 - DNA, 22 bp, Homo sapiens
caaagaaggaactataatccca

SEQ ID NO: 7868008 - DNA, 22 bp, Homo sapiens
caaagaatcactcatctttagc

SEQ ID NO: 7868009 - DNA, 22 bp, Homo sapiens
caaagaatcactcatctttagc

SEQ ID NO: 7868010 - DNA, 22 bp, Homo sapiens
caaagaatagcatggcatttgt

SEQ ID NO: 7868011 - DNA, 22 bp, Homo sapiens
caaagaaggaactataatccca

SEQ ID NO: 7868012 - DNA, 22 bp, Homo sapiens
caaaagcagcaagtttatatgt

SEQ ID NO: 7868013 - DNA, 22 bp, Homo sapiens
caaaagcagcaagtttatatgt

SEQ ID NO: 7868014 - DNA, 22 bp, Homo sapiens
caaaagcagcaagtttatatgt

SEQ ID NO: 7868015 - DNA, 22 bp, Homo sapiens
caaaagcagcaagtttatatgt

SEQ ID NO: 7868016 - DNA, 22 bp, Homo sapiens
gctccagggaacagaatgtact

SEQ ID NO: 7868017 - DNA, 22 bp, Homo sapiens
caaaagcagttctatctgagtt

SEQ ID NO: 7868018 - DNA, 22 bp, Homo sapiens
gctccagggaacagaatgtact

SEQ ID NO: 7868019 - DNA, 22 bp, Homo sapiens
caaaagcagttctatctgagtt

SEQ ID NO: 7868020 - DNA, 22 bp, Homo sapiens
caaaagcagttctatctgagtt

SEQ ID NO: 7868021 - DNA, 22 bp, Homo sapiens
gctcccaggatgaggagccagg

SEQ ID NO: 7868022 - DNA, 22 bp, Homo sapiens
gctccagggacccaagagaaaa

SEQ ID NO: 7868023 - DNA, 22 bp, Homo sapiens
gctcccaggatgaggagccagg

SEQ ID NO: 7868024 - DNA, 22 bp, Homo sapiens
gctcccaggatgaggagccagg

SEQ ID NO: 7868025 - DNA, 22 bp, Homo sapiens
gctccagggacccaagagaaaa

SEQ ID NO: 7868026 - DNA, 22 bp, Homo sapiens
gctcccagggacactggccact

SEQ ID NO: 7868027 - DNA, 22 bp, Homo sapiens
gctcccagggacactggccact

SEQ ID NO: 7868028 - DNA, 22 bp, Homo sapiens
gctcccagggacactggccact

SEQ ID NO: 7868029 - DNA, 22 bp, Homo sapiens
gctcccagggaccgcagggcag

SEQ ID NO: 7868030 - DNA, 22 bp, Homo sapiens
gctcccagggaccgcagggcag

SEQ ID NO: 7868031 - DNA, 22 bp, Homo sapiens
gctcccagggaccgcagggcag

SEQ ID NO: 7868032 - DNA, 22 bp, Homo sapiens
gctcccagggaccgcagggcag

SEQ ID NO: 7868033 - DNA, 22 bp, Homo sapiens
gctcccagtctgatggaggaga

SEQ ID NO: 7868034 - DNA, 22 bp, Homo sapiens
gctcccagtctgatggaggaga

SEQ ID NO: 7868035 - DNA, 22 bp, Homo sapiens
gctcccagtctgatggaggaga

SEQ ID NO: 7868036 - DNA, 22 bp, Homo sapiens
gctcccaggttcttgggccttg

SEQ ID NO: 7868037 - DNA, 22 bp, Homo sapiens
gctcccaggttcttgggccttg

SEQ ID NO: 7868038 - DNA, 22 bp, Homo sapiens
gctcccaggttcttgggccttg

SEQ ID NO: 7868039 - DNA, 22 bp, Homo sapiens
gctcccaggttcttgggccttg

SEQ ID NO: 7868040 - DNA, 22 bp, Homo sapiens
gctcccagggcagcgcagaaga

SEQ ID NO: 7868041 - DNA, 22 bp, Homo sapiens
gctcccagggcagcgcagaaga

SEQ ID NO: 7868042 - DNA, 22 bp, Homo sapiens
gctccccagcttagccctggct

SEQ ID NO: 7868043 - DNA, 22 bp, Homo sapiens
gctccccagcttagccctggct

SEQ ID NO: 7868044 - DNA, 22 bp, Homo sapiens
gctccccagcttagccctggct

SEQ ID NO: 7868045 - DNA, 22 bp, Homo sapiens
gctccccaaaagctccaggaaa

SEQ ID NO: 7868046 - DNA, 22 bp, Homo sapiens
gctccccagcttagccctggct

SEQ ID NO: 7868047 - DNA, 22 bp, Homo sapiens
gctccccagcttagccctggct

SEQ ID NO: 7868048 - DNA, 22 bp, Homo sapiens
gctccccagcttagccctggct

SEQ ID NO: 7868049 - DNA, 22 bp, Homo sapiens
gctccccaggctggtcccctcg

SEQ ID NO: 7868050 - DNA, 22 bp, Homo sapiens
gctccccagcttagccctggct

SEQ ID NO: 7868051 - DNA, 22 bp, Homo sapiens
gctcccagtctgatggaggaga

SEQ ID NO: 7868052 - DNA, 22 bp, Homo sapiens
gctcccagtctgatggaggaga

SEQ ID NO: 7868053 - DNA, 22 bp, Homo sapiens
gctcccagtctgatggaggaga

SEQ ID NO: 7868054 - DNA, 22 bp, Homo sapiens
gctccccaaaagctccaggaaa

SEQ ID NO: 7868055 - DNA, 22 bp, Homo sapiens
gccagctggagactggcagggg

SEQ ID NO: 7868056 - DNA, 22 bp, Homo sapiens
gccagctggagactggcagggg

SEQ ID NO: 7868057 - DNA, 22 bp, Homo sapiens
gccagctggagactggcagggg

SEQ ID NO: 7868058 - DNA, 22 bp, Homo sapiens
gccagctggagactggcagggg

SEQ ID NO: 7868059 - DNA, 22 bp, Homo sapiens
gccagctggagactggcagggg

SEQ ID NO: 7868060 - DNA, 22 bp, Homo sapiens
gccagctggagactggcagggg

SEQ ID NO: 7868061 - DNA, 22 bp, Homo sapiens
gccagctggaaatctgcttgaa

SEQ ID NO: 7868062 - DNA, 22 bp, Homo sapiens
gccagctgctggaacagcgcga

SEQ ID NO: 7868063 - DNA, 22 bp, Homo sapiens
gccagctgcttctccagaattt

SEQ ID NO: 7868064 - DNA, 22 bp, Homo sapiens
gccagctgcttctccagaattt

SEQ ID NO: 7868065 - DNA, 22 bp, Homo sapiens
gccagctgcttctccagaattt

SEQ ID NO: 7868066 - DNA, 22 bp, Homo sapiens
gccagctggaaatctgcttgaa

SEQ ID NO: 7868067 - DNA, 22 bp, Homo sapiens
gccagctggaaatctgcttgaa

SEQ ID NO: 7868068 - DNA, 22 bp, Homo sapiens
gccagctggaaatctgcttgaa

SEQ ID NO: 7868069 - DNA, 22 bp, Homo sapiens
gccagctggaaatctgcttgaa

SEQ ID NO: 7868070 - DNA, 22 bp, Homo sapiens
atttataacgtgcagccagggt

SEQ ID NO: 7868071 - DNA, 22 bp, Homo sapiens
atttataacgtgcagccagggt

SEQ ID NO: 7868072 - DNA, 22 bp, Homo sapiens
atttagtttaggaaaagtaggt

SEQ ID NO: 7868073 - DNA, 22 bp, Homo sapiens
atttagtttaggaaaagtaggt

SEQ ID NO: 7868074 - DNA, 22 bp, Homo sapiens
atttagtttaggaaaagtaggt

SEQ ID NO: 7868075 - DNA, 22 bp, Homo sapiens
atttagaagttggagggcaaga

SEQ ID NO: 7868076 - DNA, 22 bp, Homo sapiens
gccagctggagtgagagtgggc

SEQ ID NO: 7868077 - DNA, 22 bp, Homo sapiens
gccagctggagtgagagtgggc

SEQ ID NO: 7868078 - DNA, 22 bp, Homo sapiens
gccagctggagtgagagtgggc

SEQ ID NO: 7868079 - DNA, 21 bp, Homo sapiens
atttagaaggaaattttgcaa

SEQ ID NO: 7868080 - DNA, 21 bp, Homo sapiens
atttagaaggaaattttgcaa

SEQ ID NO: 7868081 - DNA, 21 bp, Homo sapiens
atttagaaggaaattttgcaa

SEQ ID NO: 7868082 - DNA, 22 bp, Homo sapiens
atttagaagttggagggcaaga

SEQ ID NO: 7868083 - DNA, 18 bp, Homo sapiens
atttatcctttgtattac

SEQ ID NO: 7868084 - DNA, 22 bp, Homo sapiens
atttatctctggaaactaagca

SEQ ID NO: 7868085 - DNA, 22 bp, Homo sapiens
atttatgacaaccaaagagtga

SEQ ID NO: 7868086 - DNA, 22 bp, Homo sapiens
atttatgacaaccaaagagtga

SEQ ID NO: 7868087 - DNA, 22 bp, Homo sapiens
atttatgacaaccaaagagtga

SEQ ID NO: 7868088 - DNA, 22 bp, Homo sapiens
atttatgacaaccaaagagtga

SEQ ID NO: 7868089 - DNA, 22 bp, Homo sapiens
atttatgactggtgaatagaac

SEQ ID NO: 7868090 - DNA, 22 bp, Homo sapiens
atttatgactggtgaatagaac

SEQ ID NO: 7868091 - DNA, 22 bp, Homo sapiens
atttatgacgtgttcggtcaat

SEQ ID NO: 7868092 - DNA, 22 bp, Homo sapiens
atttatgacgtgttcggtcaat

SEQ ID NO: 7868093 - DNA, 22 bp, Homo sapiens
atttatgacagaagatatgctg

SEQ ID NO: 7868094 - DNA, 22 bp, Homo sapiens
atttatgacagaagatatgctg

SEQ ID NO: 7868095 - DNA, 22 bp, Homo sapiens
atttatgacagaagatatgctg

SEQ ID NO: 7868096 - DNA, 22 bp, Homo sapiens
atttatgacagaagatatgctg

SEQ ID NO: 7868097 - DNA, 22 bp, Homo sapiens
atttatcaccagttagctgact

SEQ ID NO: 7868098 - DNA, 22 bp, Homo sapiens
atttatcaccagttagctgact

SEQ ID NO: 7868099 - DNA, 22 bp, Homo sapiens
atttatcatcagaccttttaaa

SEQ ID NO: 7868100 - DNA, 18 bp, Homo sapiens
atttatcctttgtattac

SEQ ID NO: 7868101 - DNA, 22 bp, Homo sapiens
atttatattttgggagctcctg

SEQ ID NO: 7868102 - DNA, 22 bp, Homo sapiens
atttatcaacatgtaccattgg

SEQ ID NO: 7868103 - DNA, 22 bp, Homo sapiens
atttatagggcattgaaaactg

SEQ ID NO: 7868104 - DNA, 22 bp, Homo sapiens
atttatagggcattgaaaactg

SEQ ID NO: 7868105 - DNA, 22 bp, Homo sapiens
atttatagggcattgaaaactg

SEQ ID NO: 7868106 - DNA, 22 bp, Homo sapiens
gccatcatatcccctgtgacct

SEQ ID NO: 7868107 - DNA, 22 bp, Homo sapiens
gccatcatatcccctgtgacct

SEQ ID NO: 7868108 - DNA, 22 bp, Homo sapiens
gccatcatatcccctgtgacct

SEQ ID NO: 7868109 - DNA, 22 bp, Homo sapiens
gccatcatatcccctgtgacct

SEQ ID NO: 7868110 - DNA, 22 bp, Homo sapiens
gccatcatatcccctgtgacct

SEQ ID NO: 7868111 - DNA, 22 bp, Homo sapiens
gccatcatatcccctgtgacct

SEQ ID NO: 7868112 - DNA, 22 bp, Homo sapiens
gccaggtggctgagcagctgca

SEQ ID NO: 7868113 - DNA, 22 bp, Homo sapiens
gccaggtggctgagcagctgca

SEQ ID NO: 7868114 - DNA, 22 bp, Homo sapiens
gccatcatatcccctgtgacct

SEQ ID NO: 7868115 - DNA, 22 bp, Homo sapiens
atttattatgggatttggcaca

SEQ ID NO: 7868116 - DNA, 22 bp, Homo sapiens
atttattatgggatttggcaca

SEQ ID NO: 7868117 - DNA, 22 bp, Homo sapiens
atttattatgggatttggcaca

SEQ ID NO: 7868118 - DNA, 22 bp, Homo sapiens
atttattatgggatttggcaca

SEQ ID NO: 7868119 - DNA, 22 bp, Homo sapiens
atttattatgggatttggcaca

SEQ ID NO: 7868120 - DNA, 22 bp, Homo sapiens
atttattatgggatttggcaca

SEQ ID NO: 7868121 - DNA, 22 bp, Homo sapiens
atttattacctcggagtttctg

SEQ ID NO: 7868122 - DNA, 22 bp, Homo sapiens
atttattacctcggagtttctg

SEQ ID NO: 7868123 - DNA, 22 bp, Homo sapiens
atttattacctcggagtttctg

SEQ ID NO: 7868124 - DNA, 22 bp, Homo sapiens
atttattacctcggagtttctg

SEQ ID NO: 7868125 - DNA, 22 bp, Homo sapiens
atttattacctcggagtttctg

SEQ ID NO: 7868126 - DNA, 22 bp, Homo sapiens
atttattaagcatctgctatgt

SEQ ID NO: 7868127 - DNA, 22 bp, Homo sapiens
atttattaagcatctgctatgt

SEQ ID NO: 7868128 - DNA, 22 bp, Homo sapiens
atttattaagcatctgctatgt

SEQ ID NO: 7868129 - DNA, 22 bp, Homo sapiens
atttattaagcatctgctatgt

SEQ ID NO: 7868130 - DNA, 22 bp, Homo sapiens
atttattaagcatctgctatgt

SEQ ID NO: 7868131 - DNA, 22 bp, Homo sapiens
atttatgtatctgtgtagatca

SEQ ID NO: 7868132 - DNA, 22 bp, Homo sapiens
atttatgtatctgtgtagatca

SEQ ID NO: 7868133 - DNA, 22 bp, Homo sapiens
atttatgtatctgtgtagatca

SEQ ID NO: 7868134 - DNA, 21 bp, Homo sapiens
atttatgtttggggtggaatg

SEQ ID NO: 7868135 - DNA, 22 bp, Homo sapiens
atttatgactggtgaatagaac

SEQ ID NO: 7868136 - DNA, 22 bp, Homo sapiens
atttatgagctgaaccatgaaa

SEQ ID NO: 7868137 - DNA, 22 bp, Homo sapiens
atttatgagctgaaccatgaaa

SEQ ID NO: 7868138 - DNA, 22 bp, Homo sapiens
atttatgagctgaaccatgaaa

SEQ ID NO: 7868139 - DNA, 22 bp, Homo sapiens
atttatgatagctgcattaaag

SEQ ID NO: 7868140 - DNA, 22 bp, Homo sapiens
atttatgatagctgcattaaag

SEQ ID NO: 7868141 - DNA, 22 bp, Homo sapiens
atttatgagctgaaccatgaaa

SEQ ID NO: 7868142 - DNA, 22 bp, Homo sapiens
atttatgattagcctattgttg

SEQ ID NO: 7868143 - DNA, 18 bp, Homo sapiens
atttatgctaatgggata

SEQ ID NO: 7868144 - DNA, 22 bp, Homo sapiens
atttatgattagcctattgttg

SEQ ID NO: 7868145 - DNA, 22 bp, Homo sapiens
atttatgatagctgcattaaag

SEQ ID NO: 7868146 - DNA, 22 bp, Homo sapiens
atttatgatagctgcattaaag

SEQ ID NO: 7868147 - DNA, 22 bp, Homo sapiens
atttatgattagcctattgttg

SEQ ID NO: 7868148 - DNA, 19 bp, Homo sapiens
attgtacattgagtttggc

SEQ ID NO: 7868149 - DNA, 19 bp, Homo sapiens
attgtacattgagtttggc

SEQ ID NO: 7868150 - DNA, 22 bp, Homo sapiens
attgtacatgcagtgagtcatc

SEQ ID NO: 7868151 - DNA, 22 bp, Homo sapiens
attgtactacaccatagtactg

SEQ ID NO: 7868152 - DNA, 22 bp, Homo sapiens
attgtactacaccatagtactg

SEQ ID NO: 7868153 - DNA, 22 bp, Homo sapiens
attgtactagaaattgtattca

SEQ ID NO: 7868154 - DNA, 22 bp, Homo sapiens
attgtacagctctgagaggggg

SEQ ID NO: 7868155 - DNA, 22 bp, Homo sapiens
attgtactacaccatagtactg

SEQ ID NO: 7868156 - DNA, 22 bp, Homo sapiens
attgtactcacaaaacatgagt

SEQ ID NO: 7868157 - DNA, 22 bp, Homo sapiens
attgtactcacaaaacatgagt

SEQ ID NO: 7868158 - DNA, 22 bp, Homo sapiens
attgtacttttattacatgtag

SEQ ID NO: 7868159 - DNA, 22 bp, Homo sapiens
gccagccacaagggaggcttgt

SEQ ID NO: 7868160 - DNA, 22 bp, Homo sapiens
gccagccacaagggaggcttgt

SEQ ID NO: 7868161 - DNA, 22 bp, Homo sapiens
gccagccacgttagactggccc

SEQ ID NO: 7868162 - DNA, 22 bp, Homo sapiens
gccagccacgttagactggccc

SEQ ID NO: 7868163 - DNA, 22 bp, Homo sapiens
gccagccacaagggaggcttgt

SEQ ID NO: 7868164 - DNA, 22 bp, Homo sapiens
gccagccacaagggaggcttgt

SEQ ID NO: 7868165 - DNA, 22 bp, Homo sapiens
gccagccaagattgagaaggta

SEQ ID NO: 7868166 - DNA, 22 bp, Homo sapiens
gccagccaagattgagaaggta

SEQ ID NO: 7868167 - DNA, 20 bp, Homo sapiens
gccagagttatgatgagagg

SEQ ID NO: 7868168 - DNA, 22 bp, Homo sapiens
gccagagttgaggcagtttatt

SEQ ID NO: 7868169 - DNA, 22 bp, Homo sapiens
gccagagtcttctgaccctgtg

SEQ ID NO: 7868170 - DNA, 22 bp, Homo sapiens
gccagagtgatgtaacatatat

SEQ ID NO: 7868171 - DNA, 22 bp, Homo sapiens
gccagaggttcaacaactgtct

SEQ ID NO: 7868172 - DNA, 22 bp, Homo sapiens
attgtacatgcagtgagtcatc

SEQ ID NO: 7868173 - DNA, 22 bp, Homo sapiens
attgtacatgcagtgagtcatc

SEQ ID NO: 7868174 - DNA, 22 bp, Homo sapiens
attgtacatgcagtgagtcatc

SEQ ID NO: 7868175 - DNA, 22 bp, Homo sapiens
attgtacatgcagtgagtcatc

SEQ ID NO: 7868176 - DNA, 22 bp, Homo sapiens
attgtacatgcagtgagtcatc

SEQ ID NO: 7868177 - DNA, 22 bp, Homo sapiens
attgtacatatgatgtatgtaa

SEQ ID NO: 7868178 - DNA, 22 bp, Homo sapiens
attgtacatatgatgtatgtaa

SEQ ID NO: 7868179 - DNA, 22 bp, Homo sapiens
attgtacatatgatgtatgtaa

SEQ ID NO: 7868180 - DNA, 22 bp, Homo sapiens
attgtacatatgatgtatgtaa

SEQ ID NO: 7868181 - DNA, 22 bp, Homo sapiens
attgtacataaaatgtatgtct

SEQ ID NO: 7868182 - DNA, 22 bp, Homo sapiens
attgtacataaaatgtatgtct

SEQ ID NO: 7868183 - DNA, 22 bp, Homo sapiens
attgtacataaaatgtatgtct

SEQ ID NO: 7868184 - DNA, 22 bp, Homo sapiens
attgtacataaaatgtatgtct

SEQ ID NO: 7868185 - DNA, 22 bp, Homo sapiens
attgtacagctctgagaggggg

SEQ ID NO: 7868186 - DNA, 22 bp, Homo sapiens
attgtacagctctgagaggggg

SEQ ID NO: 7868187 - DNA, 22 bp, Homo sapiens
attgtacaggttggaggaagtg

SEQ ID NO: 7868188 - DNA, 22 bp, Homo sapiens
attgtacaggttggaggaagtg

SEQ ID NO: 7868189 - DNA, 22 bp, Homo sapiens
attgtacaggttggaggaagtg

SEQ ID NO: 7868190 - DNA, 22 bp, Homo sapiens
gcatggcatttgaaggtagaag

SEQ ID NO: 7868191 - DNA, 22 bp, Homo sapiens
gcatggcattaacaagatggaa

SEQ ID NO: 7868192 - DNA, 20 bp, Homo sapiens
gcatggcatgtagtgaagtg

SEQ ID NO: 7868193 - DNA, 22 bp, Homo sapiens
gcatggcattaacaagatggaa

SEQ ID NO: 7868194 - DNA, 20 bp, Homo sapiens
gcatggcatgtagtgaagtg

SEQ ID NO: 7868195 - DNA, 22 bp, Homo sapiens
gcatggcatttgaaggtagaag

SEQ ID NO: 7868196 - DNA, 22 bp, Homo sapiens
attgtacagacatgggaaacaa

SEQ ID NO: 7868197 - DNA, 22 bp, Homo sapiens
attgtacagacatgggaaacaa

SEQ ID NO: 7868198 - DNA, 22 bp, Homo sapiens
attgtacagacatgggaaacaa

SEQ ID NO: 7868199 - DNA, 22 bp, Homo sapiens
attgtacagatgaggtaagtga

SEQ ID NO: 7868200 - DNA, 22 bp, Homo sapiens
attgtacagatgaggtaagtga

SEQ ID NO: 7868201 - DNA, 22 bp, Homo sapiens
attgtacagatgaacctcactc

SEQ ID NO: 7868202 - DNA, 22 bp, Homo sapiens
attgtacagatgaacctcactc

SEQ ID NO: 7868203 - DNA, 22 bp, Homo sapiens
attgtacagatgaggtaagtga

SEQ ID NO: 7868204 - DNA, 22 bp, Homo sapiens
attgtacagatgaacctcactc

SEQ ID NO: 7868205 - DNA, 22 bp, Homo sapiens
gccagccagaaacgtcacactg

SEQ ID NO: 7868206 - DNA, 22 bp, Homo sapiens
gccagccagaaacgtcacactg

SEQ ID NO: 7868207 - DNA, 22 bp, Homo sapiens
gccagccacttcccagactggc

SEQ ID NO: 7868208 - DNA, 22 bp, Homo sapiens
gccagccacttcccagactggc

SEQ ID NO: 7868209 - DNA, 22 bp, Homo sapiens
gccagccacttcccagactggc

SEQ ID NO: 7868210 - DNA, 22 bp, Homo sapiens
gccagccagaaacgtcacactg

SEQ ID NO: 7868211 - DNA, 23 bp, Homo sapiens
gccagccagaatttctccactgt

SEQ ID NO: 7868212 - DNA, 22 bp, Homo sapiens
gccagccagaaacgtcacactg

SEQ ID NO: 7868213 - DNA, 23 bp, Homo sapiens
gccagccagaatttctccactgt

SEQ ID NO: 7868214 - DNA, 23 bp, Homo sapiens
gccagccagaatttctccactgt

SEQ ID NO: 7868215 - DNA, 22 bp, Homo sapiens
gccagccacttcccagactggc

SEQ ID NO: 7868216 - DNA, 22 bp, Homo sapiens
gccagccacttcagctatggct

SEQ ID NO: 7868217 - DNA, 22 bp, Homo sapiens
gccagccacttcccagactggc

SEQ ID NO: 7868218 - DNA, 22 bp, Homo sapiens
gccagccacttcccagactggc

SEQ ID NO: 7868219 - DNA, 22 bp, Homo sapiens
gccagccacttcagctatggct

SEQ ID NO: 7868220 - DNA, 22 bp, Homo sapiens
gccagccacttcagctatggct

SEQ ID NO: 7868221 - DNA, 22 bp, Homo sapiens
gccagccacttcagctatggct

SEQ ID NO: 7868222 - DNA, 22 bp, Homo sapiens
gccagccacgttagactggccc

SEQ ID NO: 7868223 - DNA, 22 bp, Homo sapiens
gccagccacgttagactggccc

SEQ ID NO: 7868224 - DNA, 22 bp, Homo sapiens
gccagccacgttagactggccc

SEQ ID NO: 7868225 - DNA, 22 bp, Homo sapiens
gccagccacttcagctatggct

SEQ ID NO: 7868226 - DNA, 22 bp, Homo sapiens
gccagccagggaagggagagac

SEQ ID NO: 7868227 - DNA, 22 bp, Homo sapiens
gccagccagggaagggagagac

SEQ ID NO: 7868228 - DNA, 22 bp, Homo sapiens
gccagccagtttgctgatggct

SEQ ID NO: 7868229 - DNA, 18 bp, Homo sapiens
gccagccaggcgttgctc

SEQ ID NO: 7868230 - DNA, 18 bp, Homo sapiens
gccagccaggcgttgctc

SEQ ID NO: 7868231 - DNA, 18 bp, Homo sapiens
gccagccaggcgttgctc

SEQ ID NO: 7868232 - DNA, 22 bp, Homo sapiens
gccagccaggaagaaagtaaga

SEQ ID NO: 7868233 - DNA, 22 bp, Homo sapiens
gccagccagagtggctgtgtgt

SEQ ID NO: 7868234 - DNA, 22 bp, Homo sapiens
gccagccagagtggctgtgtgt

SEQ ID NO: 7868235 - DNA, 22 bp, Homo sapiens
gccagccagagaggcatggtta

SEQ ID NO: 7868236 - DNA, 22 bp, Homo sapiens
gccagccagagtccatctgaga

SEQ ID NO: 7868237 - DNA, 22 bp, Homo sapiens
gccagccagagtggctgtgtgt

SEQ ID NO: 7868238 - DNA, 22 bp, Homo sapiens
gccagccagagtccatctgaga

SEQ ID NO: 7868239 - DNA, 22 bp, Homo sapiens
gccagccagagaggcatggtta

SEQ ID NO: 7868240 - DNA, 22 bp, Homo sapiens
gccagccagagaggcatggtta

SEQ ID NO: 7868241 - DNA, 22 bp, Homo sapiens
gccagccagagaggcatggtta

SEQ ID NO: 7868242 - DNA, 22 bp, Homo sapiens
gccagccagagaggcatggtta

SEQ ID NO: 7868243 - DNA, 22 bp, Homo sapiens
gccagccagagaggcatggtta

SEQ ID NO: 7868244 - DNA, 22 bp, Homo sapiens
gccagctgcatctcctgggctg

SEQ ID NO: 7868245 - DNA, 22 bp, Homo sapiens
gccagctgcatctcctgggctg

SEQ ID NO: 7868246 - DNA, 22 bp, Homo sapiens
gccagctgcatctcctgggctg

SEQ ID NO: 7868247 - DNA, 22 bp, Homo sapiens
gccagctgcatctcctgggctg

SEQ ID NO: 7868248 - DNA, 21 bp, Homo sapiens
gccagctgcagggcttccttg

SEQ ID NO: 7868249 - DNA, 21 bp, Homo sapiens
gccagctgcagggcttccttg

SEQ ID NO: 7868250 - DNA, 21 bp, Homo sapiens
gccagctgcagggcttccttg

SEQ ID NO: 7868251 - DNA, 21 bp, Homo sapiens
gccagctgcagggcttccttg

SEQ ID NO: 7868252 - DNA, 22 bp, Homo sapiens
gccagccataggccagcactgg

SEQ ID NO: 7868253 - DNA, 22 bp, Homo sapiens
gccagccataggccagcactgg

SEQ ID NO: 7868254 - DNA, 22 bp, Homo sapiens
gccagccagtttgctgatggct

SEQ ID NO: 7868255 - DNA, 22 bp, Homo sapiens
gccagccagtttgctgatggct

SEQ ID NO: 7868256 - DNA, 22 bp, Homo sapiens
gccagccagtttgctgatggct

SEQ ID NO: 7868257 - DNA, 22 bp, Homo sapiens
gccagccagtttgctgatggct

SEQ ID NO: 7868258 - DNA, 22 bp, Homo sapiens
gccagccagggaagggagagac

SEQ ID NO: 7868259 - DNA, 22 bp, Homo sapiens
gccagccagtttgctgatggct

SEQ ID NO: 7868260 - DNA, 22 bp, Homo sapiens
gccagccagtttgctgatggct

SEQ ID NO: 7868261 - DNA, 22 bp, Homo sapiens
gccagctgccaagttgtgagat

SEQ ID NO: 7868262 - DNA, 22 bp, Homo sapiens
gccagctgccaagttgtgagat

SEQ ID NO: 7868263 - DNA, 22 bp, Homo sapiens
gccagctgccaagttgtgagat

SEQ ID NO: 7868264 - DNA, 22 bp, Homo sapiens
gccagctgccctctgctggtcc

SEQ ID NO: 7868265 - DNA, 22 bp, Homo sapiens
gccagctgccctctgctggtcc

SEQ ID NO: 7868266 - DNA, 22 bp, Homo sapiens
gccagctgctggaacagcgcga

SEQ ID NO: 7868267 - DNA, 22 bp, Homo sapiens
gccagctgctggaacagcgcga

SEQ ID NO: 7868268 - DNA, 22 bp, Homo sapiens
gccagctgctggaacagcgcga

SEQ ID NO: 7868269 - DNA, 22 bp, Homo sapiens
gccagctgctggaacagcgcga

SEQ ID NO: 7868270 - DNA, 20 bp, Homo sapiens
gccagctgcccttccaccct

SEQ ID NO: 7868271 - DNA, 22 bp, Homo sapiens
gccagctgctcgcgtagggtag

SEQ ID NO: 7868272 - DNA, 22 bp, Homo sapiens
gcccaggagttgaatgcagcag

SEQ ID NO: 7868273 - DNA, 22 bp, Homo sapiens
gcccaggagttgaatgcagcag

SEQ ID NO: 7868274 - DNA, 19 bp, Homo sapiens
gcccaggggcccgatgctg

SEQ ID NO: 7868275 - DNA, 22 bp, Homo sapiens
gcccaggagttgaatgcagcag

SEQ ID NO: 7868276 - DNA, 22 bp, Homo sapiens
gcccagggtctacaaaaatatt

SEQ ID NO: 7868277 - DNA, 19 bp, Homo sapiens
gcccaggggcccgatgctg

SEQ ID NO: 7868278 - DNA, 22 bp, Homo sapiens
gcccaggagttgaatgcagcag

SEQ ID NO: 7868279 - DNA, 22 bp, Homo sapiens
gcccaggagttgaagggctgac

SEQ ID NO: 7868280 - DNA, 22 bp, Homo sapiens
atttcaagtgttgagctcataa

SEQ ID NO: 7868281 - DNA, 22 bp, Homo sapiens
atttcaagtgttgagctcataa

SEQ ID NO: 7868282 - DNA, 22 bp, Homo sapiens
atttcaagtgttgagctcataa

SEQ ID NO: 7868283 - DNA, 22 bp, Homo sapiens
atttcaaggggtccttgcttgg

SEQ ID NO: 7868284 - DNA, 22 bp, Homo sapiens
atttcaaggactacttttcaat

SEQ ID NO: 7868285 - DNA, 22 bp, Homo sapiens
atttcaaggactacttttcaat

SEQ ID NO: 7868286 - DNA, 22 bp, Homo sapiens
atttcaaggctacagaaacctt

SEQ ID NO: 7868287 - DNA, 22 bp, Homo sapiens
atttcaaggctacagaaacctt

SEQ ID NO: 7868288 - DNA, 22 bp, Homo sapiens
atttcaaggctattaatataaa

SEQ ID NO: 7868289 - DNA, 22 bp, Homo sapiens
atttcaaggctattaatataaa

SEQ ID NO: 7868290 - DNA, 22 bp, Homo sapiens
atttcaagaaggcagcagtggt

SEQ ID NO: 7868291 - DNA, 22 bp, Homo sapiens
atttcaacgttagatgtaatag

SEQ ID NO: 7868292 - DNA, 22 bp, Homo sapiens
atttcaacgttagatgtaatag

SEQ ID NO: 7868293 - DNA, 22 bp, Homo sapiens
gcccagtctcttctggccctgt

SEQ ID NO: 7868294 - DNA, 22 bp, Homo sapiens
gcccagtagttcaaggttgcag

SEQ ID NO: 7868295 - DNA, 22 bp, Homo sapiens
gcccagtagttcaaggttgcag

SEQ ID NO: 7868296 - DNA, 22 bp, Homo sapiens
gcccagtagttcaaggttgcag

SEQ ID NO: 7868297 - DNA, 22 bp, Homo sapiens
gcccagtctcttctggccctgt

SEQ ID NO: 7868298 - DNA, 22 bp, Homo sapiens
gcccagtctcttctggccctgt

SEQ ID NO: 7868299 - DNA, 22 bp, Homo sapiens
gcccagtctcttctggccctgt

SEQ ID NO: 7868300 - DNA, 22 bp, Homo sapiens
gcccagtctcttctggccctgt

SEQ ID NO: 7868301 - DNA, 21 bp, Homo sapiens
gcccagtgatttcttcacagt

SEQ ID NO: 7868302 - DNA, 22 bp, Homo sapiens
gcccagtgctgagggtgctgct

SEQ ID NO: 7868303 - DNA, 21 bp, Homo sapiens
gcccagtgatttcttcacagt

SEQ ID NO: 7868304 - DNA, 22 bp, Homo sapiens
gcccagtgccctagaatgcact

SEQ ID NO: 7868305 - DNA, 21 bp, Homo sapiens
gcccagtgatttcttcacagt

SEQ ID NO: 7868306 - DNA, 22 bp, Homo sapiens
gcccagggtgaagtgcagttgt

SEQ ID NO: 7868307 - DNA, 22 bp, Homo sapiens
gcccagggtgcttagaacccat

SEQ ID NO: 7868308 - DNA, 22 bp, Homo sapiens
gcccagggtgaagtgcagttgt

SEQ ID NO: 7868309 - DNA, 22 bp, Homo sapiens
gcccaggttggagagcagtggc

SEQ ID NO: 7868310 - DNA, 22 bp, Homo sapiens
gcccaggttggagagcagtggc

SEQ ID NO: 7868311 - DNA, 22 bp, Homo sapiens
gcccaggtgccctctgccttac

SEQ ID NO: 7868312 - DNA, 22 bp, Homo sapiens
gcccaggtttcatctgctccgt

SEQ ID NO: 7868313 - DNA, 22 bp, Homo sapiens
gcccaggttggagagcagtggc

SEQ ID NO: 7868314 - DNA, 22 bp, Homo sapiens
gcccaggttggagagcagtggc

SEQ ID NO: 7868315 - DNA, 22 bp, Homo sapiens
gccatggacttctgcggacaca

SEQ ID NO: 7868316 - DNA, 22 bp, Homo sapiens
atttattggtttgcatggtgaa

SEQ ID NO: 7868317 - DNA, 22 bp, Homo sapiens
atttattggtttgcatggtgaa

SEQ ID NO: 7868318 - DNA, 22 bp, Homo sapiens
atttattggtttgcatggtgaa

SEQ ID NO: 7868319 - DNA, 22 bp, Homo sapiens
atttattggtttgcatggtgaa

SEQ ID NO: 7868320 - DNA, 22 bp, Homo sapiens
atttattggtttgcatggtgaa

SEQ ID NO: 7868321 - DNA, 22 bp, Homo sapiens
gccatgcttggtatgctgtgag

SEQ ID NO: 7868322 - DNA, 22 bp, Homo sapiens
gccatgcttggtatgctgtgag

SEQ ID NO: 7868323 - DNA, 22 bp, Homo sapiens
gccatggcccataccaggtgca

SEQ ID NO: 7868324 - DNA, 23 bp, Homo sapiens
gccatggctgccccacaggcctc

SEQ ID NO: 7868325 - DNA, 22 bp, Homo sapiens
gccatgcttggtatgctgtgag

SEQ ID NO: 7868326 - DNA, 22 bp, Homo sapiens
gccatgctggaggcttcgattt

SEQ ID NO: 7868327 - DNA, 22 bp, Homo sapiens
gccatgcctgtgtctccaggcc

SEQ ID NO: 7868328 - DNA, 22 bp, Homo sapiens
gccatgcctgtgtctccaggcc

SEQ ID NO: 7868329 - DNA, 22 bp, Homo sapiens
gccatgcatccttggacttggc

SEQ ID NO: 7868330 - DNA, 23 bp, Homo sapiens
gccatgagttccctttcacttgt

SEQ ID NO: 7868331 - DNA, 22 bp, Homo sapiens
gccatgcaatggaataaaatca

SEQ ID NO: 7868332 - DNA, 22 bp, Homo sapiens
gccatgcagcttattaaagtgg

SEQ ID NO: 7868333 - DNA, 19 bp, Homo sapiens
atttattgtatgattccat

SEQ ID NO: 7868334 - DNA, 19 bp, Homo sapiens
atttattgtatgattccat

SEQ ID NO: 7868335 - DNA, 22 bp, Homo sapiens
atttattggtttgcatggtgaa

SEQ ID NO: 7868336 - DNA, 22 bp, Homo sapiens
atttattggtttgcatggtgaa

SEQ ID NO: 7868337 - DNA, 22 bp, Homo sapiens
atttattggtttgcatggtgaa

SEQ ID NO: 7868338 - DNA, 19 bp, Homo sapiens
atttattgtatgattccat

SEQ ID NO: 7868339 - DNA, 19 bp, Homo sapiens
atttattgtatgattccat

SEQ ID NO: 7868340 - DNA, 22 bp, Homo sapiens
atttcaacagagtttgaaggca

SEQ ID NO: 7868341 - DNA, 19 bp, Homo sapiens
atttattgtatgattccat

SEQ ID NO: 7868342 - DNA, 19 bp, Homo sapiens
atttattgtatgattccat

SEQ ID NO: 7868343 - DNA, 19 bp, Homo sapiens
atttattgtatgattccat

SEQ ID NO: 7868344 - DNA, 19 bp, Homo sapiens
atttattgtatgattccat

SEQ ID NO: 7868345 - DNA, 19 bp, Homo sapiens
atttattgtatgattccat

SEQ ID NO: 7868346 - DNA, 19 bp, Homo sapiens
atttattgtatgattccat

SEQ ID NO: 7868347 - DNA, 19 bp, Homo sapiens
atttattgtatgattccat

SEQ ID NO: 7868348 - DNA, 22 bp, Homo sapiens
gccatctcggagctatcaaagg

SEQ ID NO: 7868349 - DNA, 22 bp, Homo sapiens
gccatcctgtatcacaagatgt

SEQ ID NO: 7868350 - DNA, 22 bp, Homo sapiens
gccatcctggattcagaccaaa

SEQ ID NO: 7868351 - DNA, 22 bp, Homo sapiens
gccatcctggattcagaccaaa

SEQ ID NO: 7868352 - DNA, 22 bp, Homo sapiens
gccatcctgtatcacaagatgt

SEQ ID NO: 7868353 - DNA, 22 bp, Homo sapiens
gccatctcggagctatcaaagg

SEQ ID NO: 7868354 - DNA, 22 bp, Homo sapiens
gccatctgcgcggtgtccagct

SEQ ID NO: 7868355 - DNA, 22 bp, Homo sapiens
gccatctgcgcggtgtccagct

SEQ ID NO: 7868356 - DNA, 22 bp, Homo sapiens
gccatctgctgctctccagtgt

SEQ ID NO: 7868357 - DNA, 22 bp, Homo sapiens
gccatctggcattgcagcacct

SEQ ID NO: 7868358 - DNA, 22 bp, Homo sapiens
gccatctgctgctctccagtgt

SEQ ID NO: 7868359 - DNA, 22 bp, Homo sapiens
gccatctggcattgcagcacct

SEQ ID NO: 7868360 - DNA, 22 bp, Homo sapiens
gccatctggcattgcagcacct

SEQ ID NO: 7868361 - DNA, 20 bp, Homo sapiens
gccatccagcctcccaggag

SEQ ID NO: 7868362 - DNA, 22 bp, Homo sapiens
gccatcatcaagaatgtacagc

SEQ ID NO: 7868363 - DNA, 20 bp, Homo sapiens
gccatccagcctcccaggag

SEQ ID NO: 7868364 - DNA, 22 bp, Homo sapiens
gccatcctggattcagaccaaa

SEQ ID NO: 7868365 - DNA, 22 bp, Homo sapiens
gccatcctgatgacaggccact

SEQ ID NO: 7868366 - DNA, 19 bp, Homo sapiens
gccatcctgcccttgacat

SEQ ID NO: 7868367 - DNA, 22 bp, Homo sapiens
gccatcctgatgacaggccact

SEQ ID NO: 7868368 - DNA, 22 bp, Homo sapiens
gccatcctctgagcactaggca

SEQ ID NO: 7868369 - DNA, 23 bp, Homo sapiens
gccatcctaaaacccctgtctgt

SEQ ID NO: 7868370 - DNA, 22 bp, Homo sapiens
gccatcctctgagcactaggca

SEQ ID NO: 7868371 - DNA, 21 bp, Homo sapiens
gccatcttgcaagatgagaaa

SEQ ID NO: 7868372 - DNA, 22 bp, Homo sapiens
gccatgaaaccagaggatggct

SEQ ID NO: 7868373 - DNA, 22 bp, Homo sapiens
gccatgaactcgggcatggaga

SEQ ID NO: 7868374 - DNA, 23 bp, Homo sapiens
gccatctggtatttcctgacttc

SEQ ID NO: 7868375 - DNA, 22 bp, Homo sapiens
gccatcttgagccaggaagtga

SEQ ID NO: 7868376 - DNA, 21 bp, Homo sapiens
gccatcttgcaagatgagaaa

SEQ ID NO: 7868377 - DNA, 22 bp, Homo sapiens
gccatgagatgttttatttgca

SEQ ID NO: 7868378 - DNA, 22 bp, Homo sapiens
gccatgaggctccgagaagtca

SEQ ID NO: 7868379 - DNA, 22 bp, Homo sapiens
gccatgaggctccgagaagtca

SEQ ID NO: 7868380 - DNA, 20 bp, Homo sapiens
gccatgaggggaggtgactg

SEQ ID NO: 7868381 - DNA, 22 bp, Homo sapiens
atttcttacataacaaattgtt

SEQ ID NO: 7868382 - DNA, 22 bp, Homo sapiens
atttcttatgaatattgactgt

SEQ ID NO: 7868383 - DNA, 22 bp, Homo sapiens
atttcttacataacaaattgtt

SEQ ID NO: 7868384 - DNA, 22 bp, Homo sapiens
atttcttacataacaaattgtt

SEQ ID NO: 7868385 - DNA, 22 bp, Homo sapiens
atttcttacataacaaattgtt

SEQ ID NO: 7868386 - DNA, 22 bp, Homo sapiens
atttcttacataacaaattgtt

SEQ ID NO: 7868387 - DNA, 22 bp, Homo sapiens
atttctgtttgctactataagt

SEQ ID NO: 7868388 - DNA, 22 bp, Homo sapiens
atttcttacataacaaattgtt

SEQ ID NO: 7868389 - DNA, 22 bp, Homo sapiens
atttcttaaaacttcagggaga

SEQ ID NO: 7868390 - DNA, 22 bp, Homo sapiens
atttctgtttgctactataagt

SEQ ID NO: 7868391 - DNA, 22 bp, Homo sapiens
atttctgtttgctactataagt

SEQ ID NO: 7868392 - DNA, 22 bp, Homo sapiens
atttcttatgaatattgactgt

SEQ ID NO: 7868393 - DNA, 22 bp, Homo sapiens
atttcttatgaatattgactgt

SEQ ID NO: 7868394 - DNA, 22 bp, Homo sapiens
atttcttcaggtcagaaataga

SEQ ID NO: 7868395 - DNA, 22 bp, Homo sapiens
atttcttatgaatattgactgt

SEQ ID NO: 7868396 - DNA, 22 bp, Homo sapiens
atttcttatgaatattgactgt

SEQ ID NO: 7868397 - DNA, 22 bp, Homo sapiens
atttcttcaggttcttctagga

SEQ ID NO: 7868398 - DNA, 22 bp, Homo sapiens
atttcttcaggttcttctagga

SEQ ID NO: 7868399 - DNA, 22 bp, Homo sapiens
atttcttcaggttcttctagga

SEQ ID NO: 7868400 - DNA, 22 bp, Homo sapiens
atttcttcaggtcagaaataga

SEQ ID NO: 7868401 - DNA, 22 bp, Homo sapiens
atttcttccattgcctcttcaa

SEQ ID NO: 7868402 - DNA, 22 bp, Homo sapiens
atttcttcaggtcagaaataga

SEQ ID NO: 7868403 - DNA, 22 bp, Homo sapiens
atttcttcaggttcttctagga

SEQ ID NO: 7868404 - DNA, 22 bp, Homo sapiens
atttcttcaggttcttctagga

SEQ ID NO: 7868405 - DNA, 22 bp, Homo sapiens
atttcttcaggttcttctagga

SEQ ID NO: 7868406 - DNA, 22 bp, Homo sapiens
atttctgttgcttataaattac

SEQ ID NO: 7868407 - DNA, 22 bp, Homo sapiens
gccctgtgccagtcacgctgtg

SEQ ID NO: 7868408 - DNA, 22 bp, Homo sapiens
gccctgtgccagtcacgctgtg

SEQ ID NO: 7868409 - DNA, 22 bp, Homo sapiens
gccctgtgccagtcacgctgtg

SEQ ID NO: 7868410 - DNA, 22 bp, Homo sapiens
gccctgtgcaggtgtgcagcag

SEQ ID NO: 7868411 - DNA, 22 bp, Homo sapiens
gccctgtgcaggtgtgcagcag

SEQ ID NO: 7868412 - DNA, 22 bp, Homo sapiens
gccctgtgccagtcacgctgtg

SEQ ID NO: 7868413 - DNA, 22 bp, Homo sapiens
gccctgtgcaggtgtgcagcag

SEQ ID NO: 7868414 - DNA, 22 bp, Homo sapiens
gccctgtgagtcatgcggcaga

SEQ ID NO: 7868415 - DNA, 22 bp, Homo sapiens
gccctgtgagtcatgcggcaga

SEQ ID NO: 7868416 - DNA, 22 bp, Homo sapiens
gccctgtgagtcatgcggcaga

SEQ ID NO: 7868417 - DNA, 20 bp, Homo sapiens
gccctgtgatgtcttgacct

SEQ ID NO: 7868418 - DNA, 20 bp, Homo sapiens
gccctgtgatgtcttgacct

SEQ ID NO: 7868419 - DNA, 20 bp, Homo sapiens
gccctgtgatgtcttgacct

SEQ ID NO: 7868420 - DNA, 22 bp, Homo sapiens
gccctgtgatggagactagagg

SEQ ID NO: 7868421 - DNA, 22 bp, Homo sapiens
gccctgtgatggagactagagg

SEQ ID NO: 7868422 - DNA, 22 bp, Homo sapiens
gccctggtgtgcccagcatggg

SEQ ID NO: 7868423 - DNA, 18 bp, Homo sapiens
gccctggtggagctggtg

SEQ ID NO: 7868424 - DNA, 18 bp, Homo sapiens
gccctggtggagctggtg

SEQ ID NO: 7868425 - DNA, 18 bp, Homo sapiens
gccctggtggagctggtg

SEQ ID NO: 7868426 - DNA, 22 bp, Homo sapiens
gccctgtcctcctgactgagtg

SEQ ID NO: 7868427 - DNA, 22 bp, Homo sapiens
gccctgtcccttggcttctagg

SEQ ID NO: 7868428 - DNA, 22 bp, Homo sapiens
gccctgtcggaactgcgacctc

SEQ ID NO: 7868429 - DNA, 22 bp, Homo sapiens
atttcccaggactagaaatata

SEQ ID NO: 7868430 - DNA, 22 bp, Homo sapiens
atttcccaggactagaaatata

SEQ ID NO: 7868431 - DNA, 22 bp, Homo sapiens
atttcccaggactagaaatata

SEQ ID NO: 7868432 - DNA, 22 bp, Homo sapiens
atttcccagctttgatcagttt

SEQ ID NO: 7868433 - DNA, 22 bp, Homo sapiens
atttcccagctttgatcagttt

SEQ ID NO: 7868434 - DNA, 22 bp, Homo sapiens
atttcccagctttgatcagttt

SEQ ID NO: 7868435 - DNA, 17 bp, Homo sapiens
atttcccagcagtgcta

SEQ ID NO: 7868436 - DNA, 17 bp, Homo sapiens
atttcccagcagtgcta

SEQ ID NO: 7868437 - DNA, 22 bp, Homo sapiens
atttcccagataaacagctgga

SEQ ID NO: 7868438 - DNA, 22 bp, Homo sapiens
atttcccagggccctcatagtt

SEQ ID NO: 7868439 - DNA, 22 bp, Homo sapiens
atttcccagggccctcatagtt

SEQ ID NO: 7868440 - DNA, 22 bp, Homo sapiens
atttcccagggccctcatagtt

SEQ ID NO: 7868441 - DNA, 22 bp, Homo sapiens
atttcccatgtgaatcaattgg

SEQ ID NO: 7868442 - DNA, 22 bp, Homo sapiens
atttcccagggcctgggatttg

SEQ ID NO: 7868443 - DNA, 22 bp, Homo sapiens
atttcccatgtgaatcaattgg

SEQ ID NO: 7868444 - DNA, 22 bp, Homo sapiens
atttcccactctactacatgct

SEQ ID NO: 7868445 - DNA, 22 bp, Homo sapiens
atttcccactctactacatgct

SEQ ID NO: 7868446 - DNA, 22 bp, Homo sapiens
atttcccagataaacagctgga

SEQ ID NO: 7868447 - DNA, 22 bp, Homo sapiens
atttcccagataaacagctgga

SEQ ID NO: 7868448 - DNA, 22 bp, Homo sapiens
atttcccactctactacatgct

SEQ ID NO: 7868449 - DNA, 22 bp, Homo sapiens
atttcccactcaggccgcggcg

SEQ ID NO: 7868450 - DNA, 22 bp, Homo sapiens
atttcccaatacgctaagtgga

SEQ ID NO: 7868451 - DNA, 22 bp, Homo sapiens
atttcccaatacgctaagtgga

SEQ ID NO: 7868452 - DNA, 22 bp, Homo sapiens
atttcccaatacgctaagtgga

SEQ ID NO: 7868453 - DNA, 22 bp, Homo sapiens
gcccagtgggaagctaaggtgg

SEQ ID NO: 7868454 - DNA, 22 bp, Homo sapiens
gcccagtgggaagctaaggtgg

SEQ ID NO: 7868455 - DNA, 22 bp, Homo sapiens
gcccagtgggaagctaaggtgg

SEQ ID NO: 7868456 - DNA, 22 bp, Homo sapiens
gcccagtggtaaaagcaggcct

SEQ ID NO: 7868457 - DNA, 22 bp, Homo sapiens
gcccagtgctgagggtgctgct

SEQ ID NO: 7868458 - DNA, 22 bp, Homo sapiens
gcccagtgctgagggtgctgct

SEQ ID NO: 7868459 - DNA, 22 bp, Homo sapiens
gcccagtggcatcttcactgct

SEQ ID NO: 7868460 - DNA, 22 bp, Homo sapiens
gcccagtggcatcttcactgct

SEQ ID NO: 7868461 - DNA, 22 bp, Homo sapiens
gcccagtgctgagggtgctgct

SEQ ID NO: 7868462 - DNA, 22 bp, Homo sapiens
atttccctccagggaaagctta

SEQ ID NO: 7868463 - DNA, 22 bp, Homo sapiens
atttccctccagggaaagctta

SEQ ID NO: 7868464 - DNA, 23 bp, Homo sapiens
atttcccattgtgtcagcagagc

SEQ ID NO: 7868465 - DNA, 23 bp, Homo sapiens
atttcccattgtgtcagcagagc

SEQ ID NO: 7868466 - DNA, 23 bp, Homo sapiens
atttcctaaaagataatcattac

SEQ ID NO: 7868467 - DNA, 23 bp, Homo sapiens
atttcctaaaagataatcattac

SEQ ID NO: 7868468 - DNA, 22 bp, Homo sapiens
atttcctaatttatgcaggagt

SEQ ID NO: 7868469 - DNA, 22 bp, Homo sapiens
gccctgcctgccggtgtgggtc

SEQ ID NO: 7868470 - DNA, 22 bp, Homo sapiens
gccctggggaaggtgtctccaa

SEQ ID NO: 7868471 - DNA, 22 bp, Homo sapiens
gccctgggctccctgctccaca

SEQ ID NO: 7868472 - DNA, 22 bp, Homo sapiens
gccctgggctccctgctccaca

SEQ ID NO: 7868473 - DNA, 22 bp, Homo sapiens
gccctgggctccctgctccaca

SEQ ID NO: 7868474 - DNA, 22 bp, Homo sapiens
gccctggggaaggtgtctccaa

SEQ ID NO: 7868475 - DNA, 22 bp, Homo sapiens
gccctggggaaggtgtctccaa

SEQ ID NO: 7868476 - DNA, 22 bp, Homo sapiens
gccctggggaaggtgtctccaa

SEQ ID NO: 7868477 - DNA, 17 bp, Homo sapiens
gccctgcctgctgccct

SEQ ID NO: 7868478 - DNA, 22 bp, Homo sapiens
atttcctaacagaggcaacagt

SEQ ID NO: 7868479 - DNA, 17 bp, Homo sapiens
gccctgcctgctgccct

SEQ ID NO: 7868480 - DNA, 22 bp, Homo sapiens
gccctgggctccctgctccaca

SEQ ID NO: 7868481 - DNA, 22 bp, Homo sapiens
gccctgggctccctgctccaca

SEQ ID NO: 7868482 - DNA, 22 bp, Homo sapiens
gatgtctttagggcaaaatatt

SEQ ID NO: 7868483 - DNA, 22 bp, Homo sapiens
gatgtctttagggcaaaatatt

SEQ ID NO: 7868484 - DNA, 22 bp, Homo sapiens
gatgtctttagggcaaaatatt

SEQ ID NO: 7868485 - DNA, 22 bp, Homo sapiens
gatgtctttctaatactggctt

SEQ ID NO: 7868486 - DNA, 20 bp, Homo sapiens
gatgtcttggtcacagtggc

SEQ ID NO: 7868487 - DNA, 22 bp, Homo sapiens
gatgtcttgttgatttcattct

SEQ ID NO: 7868488 - DNA, 22 bp, Homo sapiens
gatgtcttggcttgctctctgt

SEQ ID NO: 7868489 - DNA, 22 bp, Homo sapiens
gatgtcttggtcaacttgggct

SEQ ID NO: 7868490 - DNA, 22 bp, Homo sapiens
gatgtcttcagatggcaagaga

SEQ ID NO: 7868491 - DNA, 22 bp, Homo sapiens
gatgtcttcagatggcaagaga

SEQ ID NO: 7868492 - DNA, 22 bp, Homo sapiens
gatgtcttctcaactgtagacc

SEQ ID NO: 7868493 - DNA, 22 bp, Homo sapiens
gatgtcttcccatgttcatgtg

SEQ ID NO: 7868494 - DNA, 22 bp, Homo sapiens
gatgtcttggcttgctctctgt

SEQ ID NO: 7868495 - DNA, 22 bp, Homo sapiens
gatgtgagtggtagctgggatt

SEQ ID NO: 7868496 - DNA, 22 bp, Homo sapiens
gatgtgaggtggtaaacaggga

SEQ ID NO: 7868497 - DNA, 22 bp, Homo sapiens
gatgtgaggactcatgtggagg

SEQ ID NO: 7868498 - DNA, 22 bp, Homo sapiens
gatgtgactaacttggtaccag

SEQ ID NO: 7868499 - DNA, 22 bp, Homo sapiens
gatgtctttttccaggctcttt

SEQ ID NO: 7868500 - DNA, 22 bp, Homo sapiens
gatgtgacaaaccaagaggact

SEQ ID NO: 7868501 - DNA, 20 bp, Homo sapiens
gatgtcttttctggtctcct

SEQ ID NO: 7868502 - DNA, 20 bp, Homo sapiens
gatgtcttttctggtctcct

SEQ ID NO: 7868503 - DNA, 22 bp, Homo sapiens
gatgtctttgctgttatccact

SEQ ID NO: 7868504 - DNA, 22 bp, Homo sapiens
gatgtctttgccatgcatgtgt

SEQ ID NO: 7868505 - DNA, 22 bp, Homo sapiens
gatgtctttctgtgtgcctaga

SEQ ID NO: 7868506 - DNA, 22 bp, Homo sapiens
gatgtctttgaggctcactgct

SEQ ID NO: 7868507 - DNA, 22 bp, Homo sapiens
gattcagtgagggtgagaagaa

SEQ ID NO: 7868508 - DNA, 22 bp, Homo sapiens
gattcaggcctgcatctcagca

SEQ ID NO: 7868509 - DNA, 22 bp, Homo sapiens
gattcaggcctgcatctcagca

SEQ ID NO: 7868510 - DNA, 22 bp, Homo sapiens
gattcagtgagggtgagaagaa

SEQ ID NO: 7868511 - DNA, 22 bp, Homo sapiens
gattcagtgggctttgggacag

SEQ ID NO: 7868512 - DNA, 22 bp, Homo sapiens
gattcatgttatagagagtcag

SEQ ID NO: 7868513 - DNA, 22 bp, Homo sapiens
gattccaaatggagatgtccac

SEQ ID NO: 7868514 - DNA, 22 bp, Homo sapiens
gattcattctcagtttctagag

SEQ ID NO: 7868515 - DNA, 22 bp, Homo sapiens
gattcactcatattttacgttt

SEQ ID NO: 7868516 - DNA, 22 bp, Homo sapiens
gattcactcatattttacgttt

SEQ ID NO: 7868517 - DNA, 22 bp, Homo sapiens
gattcactcatattttacgttt

SEQ ID NO: 7868518 - DNA, 22 bp, Homo sapiens
gatgtgtaacatgctgtgacat

SEQ ID NO: 7868519 - DNA, 22 bp, Homo sapiens
gatgtgggtgtcttcagctggt

SEQ ID NO: 7868520 - DNA, 22 bp, Homo sapiens
gatgtgggtgtcttcagctggt

SEQ ID NO: 7868521 - DNA, 22 bp, Homo sapiens
gatgtgggtgtcttcagctggt

SEQ ID NO: 7868522 - DNA, 22 bp, Homo sapiens
gatgtgggtgtcttcagctggt

SEQ ID NO: 7868523 - DNA, 22 bp, Homo sapiens
gatgtgggtgtcttcagctggt

SEQ ID NO: 7868524 - DNA, 22 bp, Homo sapiens
gatgtggggttgagggaccagc

SEQ ID NO: 7868525 - DNA, 18 bp, Homo sapiens
gatgtgggccctggatat

SEQ ID NO: 7868526 - DNA, 22 bp, Homo sapiens
gattcccatcctcagcagcagc

SEQ ID NO: 7868527 - DNA, 22 bp, Homo sapiens
gattcccatcctcagcagcagc

SEQ ID NO: 7868528 - DNA, 22 bp, Homo sapiens
gattcccatgtctgaggaggtg

SEQ ID NO: 7868529 - DNA, 22 bp, Homo sapiens
gattccagtccgtgactattct

SEQ ID NO: 7868530 - DNA, 22 bp, Homo sapiens
gattccagcttggtatttactc

SEQ ID NO: 7868531 - DNA, 22 bp, Homo sapiens
gattccagactatttatactgc

SEQ ID NO: 7868532 - DNA, 22 bp, Homo sapiens
gattccagaaaccagtgaagat

SEQ ID NO: 7868533 - DNA, 22 bp, Homo sapiens
gattccagaaaccagtgaagat

SEQ ID NO: 7868534 - DNA, 22 bp, Homo sapiens
gattccttggctctgtctcagg

SEQ ID NO: 7868535 - DNA, 22 bp, Homo sapiens
gattcctttcgcctgccgagct

SEQ ID NO: 7868536 - DNA, 22 bp, Homo sapiens
gattctctctggatcccatgga

SEQ ID NO: 7868537 - DNA, 22 bp, Homo sapiens
gattcctgattccagcacaacc

SEQ ID NO: 7868538 - DNA, 22 bp, Homo sapiens
gattcctgctattcacagggct

SEQ ID NO: 7868539 - DNA, 22 bp, Homo sapiens
gattctgatctatagtgttata

SEQ ID NO: 7868540 - DNA, 22 bp, Homo sapiens
gattctgatctatagtgttata

SEQ ID NO: 7868541 - DNA, 22 bp, Homo sapiens
gattctgatgctggtggaggaa

SEQ ID NO: 7868542 - DNA, 22 bp, Homo sapiens
gattctgatgctggtggaggaa

SEQ ID NO: 7868543 - DNA, 22 bp, Homo sapiens
gattctgatctatagtgttata

SEQ ID NO: 7868544 - DNA, 22 bp, Homo sapiens
gattctgagctggtgttttacg

SEQ ID NO: 7868545 - DNA, 22 bp, Homo sapiens
gattctgagctggtgttttacg

SEQ ID NO: 7868546 - DNA, 22 bp, Homo sapiens
gattctgagacagaaacgtatt

SEQ ID NO: 7868547 - DNA, 22 bp, Homo sapiens
gattctcttggatgtaggcata

SEQ ID NO: 7868548 - DNA, 22 bp, Homo sapiens
gattctcttcatatggcaaagg

SEQ ID NO: 7868549 - DNA, 22 bp, Homo sapiens
gattctcttggatgtaggcata

SEQ ID NO: 7868550 - DNA, 22 bp, Homo sapiens
gattctctgctatctatcacct

SEQ ID NO: 7868551 - DNA, 22 bp, Homo sapiens
gattctcttggatgtaggcata

SEQ ID NO: 7868552 - DNA, 22 bp, Homo sapiens
attaaattggacgctgggggaa

SEQ ID NO: 7868553 - DNA, 22 bp, Homo sapiens
gattcttgggccttctgaagtt

SEQ ID NO: 7868554 - DNA, 22 bp, Homo sapiens
gattcttaagacattatgtatt

SEQ ID NO: 7868555 - DNA, 22 bp, Homo sapiens
gattcttatgagtgaactttac

SEQ ID NO: 7868556 - DNA, 22 bp, Homo sapiens
attaaattggatctgcatagtt

SEQ ID NO: 7868557 - DNA, 22 bp, Homo sapiens
attaaattggatctgcatagtt

SEQ ID NO: 7868558 - DNA, 22 bp, Homo sapiens
attaaattggatctgcatagtt

SEQ ID NO: 7868559 - DNA, 22 bp, Homo sapiens
attaaattggatctgcatagtt

SEQ ID NO: 7868560 - DNA, 22 bp, Homo sapiens
gattcttgggccttctgaagtt

SEQ ID NO: 7868561 - DNA, 22 bp, Homo sapiens
attaaattggacgctgggggaa

SEQ ID NO: 7868562 - DNA, 22 bp, Homo sapiens
attaaattttcactaggctccc

SEQ ID NO: 7868563 - DNA, 22 bp, Homo sapiens
attaaattttcactaggctccc

SEQ ID NO: 7868564 - DNA, 22 bp, Homo sapiens
attaacagaattttacatgctt

SEQ ID NO: 7868565 - DNA, 22 bp, Homo sapiens
attaacagtttatgatgtgcct

SEQ ID NO: 7868566 - DNA, 22 bp, Homo sapiens
attaacatgcagccagacacac

SEQ ID NO: 7868567 - DNA, 22 bp, Homo sapiens
atgttattcaatttgaatccaa

SEQ ID NO: 7868568 - DNA, 21 bp, Homo sapiens
atgttattctgttcctccagc

SEQ ID NO: 7868569 - DNA, 21 bp, Homo sapiens
atgttattctgttcctccagc

SEQ ID NO: 7868570 - DNA, 21 bp, Homo sapiens
atgttattctgttcctccagc

SEQ ID NO: 7868571 - DNA, 22 bp, Homo sapiens
atgttattgatgcctgaggctt

SEQ ID NO: 7868572 - DNA, 23 bp, Homo sapiens
atgttattattagcagtcttgcc

SEQ ID NO: 7868573 - DNA, 22 bp, Homo sapiens
atgttattcaatttgaatccaa

SEQ ID NO: 7868574 - DNA, 23 bp, Homo sapiens
atgttattattagcagtcttgcc

SEQ ID NO: 7868575 - DNA, 23 bp, Homo sapiens
atgttattattagcagtcttgcc

SEQ ID NO: 7868576 - DNA, 22 bp, Homo sapiens
atgttattaaagtacagattct

SEQ ID NO: 7868577 - DNA, 22 bp, Homo sapiens
atgttattaaagtacagattct

SEQ ID NO: 7868578 - DNA, 22 bp, Homo sapiens
atgttatgtgcaagatacataa

SEQ ID NO: 7868579 - DNA, 22 bp, Homo sapiens
atgttattaaagtacagattct

SEQ ID NO: 7868580 - DNA, 22 bp, Homo sapiens
atgttattaaagtacagattct

SEQ ID NO: 7868581 - DNA, 22 bp, Homo sapiens
atgttatgtctgggaaggggta

SEQ ID NO: 7868582 - DNA, 22 bp, Homo sapiens
atgttatgtctgggaaggggta

SEQ ID NO: 7868583 - DNA, 22 bp, Homo sapiens
gagtggggcgtggatccagcgt

SEQ ID NO: 7868584 - DNA, 22 bp, Homo sapiens
gagtggggcgtggatccagcgt

SEQ ID NO: 7868585 - DNA, 22 bp, Homo sapiens
gagtggggcgtggatccagcgt

SEQ ID NO: 7868586 - DNA, 22 bp, Homo sapiens
gagtggggcgaagtcggcgagt

SEQ ID NO: 7868587 - DNA, 22 bp, Homo sapiens
gagtggggcgaagtcggcgagt

SEQ ID NO: 7868588 - DNA, 22 bp, Homo sapiens
gagtggggcgaagtcggcgagt

SEQ ID NO: 7868589 - DNA, 22 bp, Homo sapiens
gagtggggcgaagtcggcgagt

SEQ ID NO: 7868590 - DNA, 22 bp, Homo sapiens
gagtggggcgtggatccagcgt

SEQ ID NO: 7868591 - DNA, 22 bp, Homo sapiens
gagtggggcccactgctgggtg

SEQ ID NO: 7868592 - DNA, 22 bp, Homo sapiens
gagtggggcgaagtcggcgagt

SEQ ID NO: 7868593 - DNA, 22 bp, Homo sapiens
gagtggggcgaagtcggcgagt

SEQ ID NO: 7868594 - DNA, 22 bp, Homo sapiens
gagtggggcccactgctgggtg

SEQ ID NO: 7868595 - DNA, 22 bp, Homo sapiens
gagtggggcccactgctgggtg

SEQ ID NO: 7868596 - DNA, 22 bp, Homo sapiens
gagtggggcccactgctgggtg

SEQ ID NO: 7868597 - DNA, 22 bp, Homo sapiens
gagtggggcccactgctgggtg

SEQ ID NO: 7868598 - DNA, 22 bp, Homo sapiens
gagtggggcccactgctgggtg

SEQ ID NO: 7868599 - DNA, 22 bp, Homo sapiens
gagtggggcccactgctgggtg

SEQ ID NO: 7868600 - DNA, 22 bp, Homo sapiens
gagtggggcccactgctgggtg

SEQ ID NO: 7868601 - DNA, 22 bp, Homo sapiens
gagtggggcccactgctgggtg

SEQ ID NO: 7868602 - DNA, 23 bp, Homo sapiens
gagtggggagaaattggttaaac

SEQ ID NO: 7868603 - DNA, 23 bp, Homo sapiens
gagtggggagaaattggttaaac

SEQ ID NO: 7868604 - DNA, 23 bp, Homo sapiens
gagtggggagaaattggttaaac

SEQ ID NO: 7868605 - DNA, 22 bp, Homo sapiens
gagtggggaaagccaggacaga

SEQ ID NO: 7868606 - DNA, 22 bp, Homo sapiens
gagtggggaaagccaggacaga

SEQ ID NO: 7868607 - DNA, 22 bp, Homo sapiens
gagtggggaaagccaggacaga

SEQ ID NO: 7868608 - DNA, 22 bp, Homo sapiens
gagtggggaaagccaggacaga

SEQ ID NO: 7868609 - DNA, 22 bp, Homo sapiens
gagtgggcttggggagagtttg

SEQ ID NO: 7868610 - DNA, 21 bp, Homo sapiens
gagtgggctgagatggggctg

SEQ ID NO: 7868611 - DNA, 22 bp, Homo sapiens
gagtggggaaagccaggacaga

SEQ ID NO: 7868612 - DNA, 22 bp, Homo sapiens
gagtggggaaagccaggacaga

SEQ ID NO: 7868613 - DNA, 22 bp, Homo sapiens
gagtggggaaagccaggacaga

SEQ ID NO: 7868614 - DNA, 20 bp, Homo sapiens
gagtgggccatggagtgaga

SEQ ID NO: 7868615 - DNA, 22 bp, Homo sapiens
gagtgggcaccgtgggcacact

SEQ ID NO: 7868616 - DNA, 22 bp, Homo sapiens
gagtgggcaccgtgggcacact

SEQ ID NO: 7868617 - DNA, 20 bp, Homo sapiens
gagtgggccatggagtgaga

SEQ ID NO: 7868618 - DNA, 22 bp, Homo sapiens
atgttatttctgaaagatcatt

SEQ ID NO: 7868619 - DNA, 22 bp, Homo sapiens
atgttatttctgaaagatcatt

SEQ ID NO: 7868620 - DNA, 22 bp, Homo sapiens
atgttatttctgaaagatcatt

SEQ ID NO: 7868621 - DNA, 22 bp, Homo sapiens
atgttatttctgaaagatcatt

SEQ ID NO: 7868622 - DNA, 22 bp, Homo sapiens
atgttatttcaaaattcccttg

SEQ ID NO: 7868623 - DNA, 22 bp, Homo sapiens
atgttatttcaaaattcccttg

SEQ ID NO: 7868624 - DNA, 22 bp, Homo sapiens
atgttatttattgaaacacttt

SEQ ID NO: 7868625 - DNA, 22 bp, Homo sapiens
atgttatttattatcctcggtt

SEQ ID NO: 7868626 - DNA, 22 bp, Homo sapiens
atgttattgatgcctgaggctt

SEQ ID NO: 7868627 - DNA, 22 bp, Homo sapiens
atgttatttattatcctcggtt

SEQ ID NO: 7868628 - DNA, 22 bp, Homo sapiens
atgttatttcaaaattcccttg

SEQ ID NO: 7868629 - DNA, 22 bp, Homo sapiens
atgttatttattgaaacacttt

SEQ ID NO: 7868630 - DNA, 22 bp, Homo sapiens
gatggcaccttgaacgctgcgt

SEQ ID NO: 7868631 - DNA, 22 bp, Homo sapiens
gatggcaccttgaacgctgcgt

SEQ ID NO: 7868632 - DNA, 22 bp, Homo sapiens
gatggcacacagacatccccgc

SEQ ID NO: 7868633 - DNA, 20 bp, Homo sapiens
gatggatttcaacacctttc

SEQ ID NO: 7868634 - DNA, 21 bp, Homo sapiens
gatgatggcaggcagcactgg

SEQ ID NO: 7868635 - DNA, 21 bp, Homo sapiens
gatgatggcaggcagcactgg

SEQ ID NO: 7868636 - DNA, 22 bp, Homo sapiens
gatggaggagatggcagggtgc

SEQ ID NO: 7868637 - DNA, 22 bp, Homo sapiens
gatggaggagatggcagggtgc

SEQ ID NO: 7868638 - DNA, 22 bp, Homo sapiens
gatggagtctgaagctgggaac

SEQ ID NO: 7868639 - DNA, 22 bp, Homo sapiens
gatggcagcagcagccagggat

SEQ ID NO: 7868640 - DNA, 22 bp, Homo sapiens
gatggcagcagcagccagggat

SEQ ID NO: 7868641 - DNA, 22 bp, Homo sapiens
gatggcagcagcagccagggat

SEQ ID NO: 7868642 - DNA, 22 bp, Homo sapiens
gatggcagcatattgacagcat

SEQ ID NO: 7868643 - DNA, 22 bp, Homo sapiens
gatggcagcatattgacagcat

SEQ ID NO: 7868644 - DNA, 22 bp, Homo sapiens
gatggcaggcaggtgagtagag

SEQ ID NO: 7868645 - DNA, 22 bp, Homo sapiens
gatggcaggcaggtgagtagag

SEQ ID NO: 7868646 - DNA, 22 bp, Homo sapiens
gatggcaggtagtggtctcatc

SEQ ID NO: 7868647 - DNA, 22 bp, Homo sapiens
gatggcaggtagtggtctcatc

SEQ ID NO: 7868648 - DNA, 22 bp, Homo sapiens
gatggcagtcaaccaggtgagg

SEQ ID NO: 7868649 - DNA, 22 bp, Homo sapiens
gatggcagtcaaccaggtgagg

SEQ ID NO: 7868650 - DNA, 22 bp, Homo sapiens
gatggcagtcaaccaggtgagg

SEQ ID NO: 7868651 - DNA, 22 bp, Homo sapiens
gatggcaggtgatagccgagtc

SEQ ID NO: 7868652 - DNA, 22 bp, Homo sapiens
gatggcaggtgatagccgagtc

SEQ ID NO: 7868653 - DNA, 22 bp, Homo sapiens
gatggcaggtgatagccgagtc

SEQ ID NO: 7868654 - DNA, 22 bp, Homo sapiens
gatggcaggtgatagccgagtc

SEQ ID NO: 7868655 - DNA, 22 bp, Homo sapiens
gatggccacatacatggctggg

SEQ ID NO: 7868656 - DNA, 22 bp, Homo sapiens
gatggcagtgggcctcgagtcc

SEQ ID NO: 7868657 - DNA, 22 bp, Homo sapiens
gatggcagtgggcctcgagtcc

SEQ ID NO: 7868658 - DNA, 22 bp, Homo sapiens
gatggcagtgggcctcgagtcc

SEQ ID NO: 7868659 - DNA, 22 bp, Homo sapiens
gatggcagtcaaccaggtgagg

SEQ ID NO: 7868660 - DNA, 22 bp, Homo sapiens
gatggcagtcaaccaggtgagg

SEQ ID NO: 7868661 - DNA, 22 bp, Homo sapiens
gatggcagtgggcctcgagtcc

SEQ ID NO: 7868662 - DNA, 22 bp, Homo sapiens
gatggcagtggagttagtgatt

SEQ ID NO: 7868663 - DNA, 22 bp, Homo sapiens
gcaccaggcagctgagcaggcc

SEQ ID NO: 7868664 - DNA, 22 bp, Homo sapiens
gcaccaggcagctgagcaggcc

SEQ ID NO: 7868665 - DNA, 22 bp, Homo sapiens
gcaccaggcagctgagcaggcc

SEQ ID NO: 7868666 - DNA, 22 bp, Homo sapiens
gcaccaggcagctgagcaggcc

SEQ ID NO: 7868667 - DNA, 22 bp, Homo sapiens
gcaccaggcagctgagcaggcc

SEQ ID NO: 7868668 - DNA, 22 bp, Homo sapiens
gcaccaggcagctgagcaggcc

SEQ ID NO: 7868669 - DNA, 22 bp, Homo sapiens
gcaccaggcagctgagcaggcc

SEQ ID NO: 7868670 - DNA, 22 bp, Homo sapiens
gcacagggcctggcacataaga

SEQ ID NO: 7868671 - DNA, 22 bp, Homo sapiens
gcacagggctgccaggcggctt

SEQ ID NO: 7868672 - DNA, 22 bp, Homo sapiens
gcaccaggaggcccttctcatc

SEQ ID NO: 7868673 - DNA, 22 bp, Homo sapiens
gcaccaggaggcccttctcatc

SEQ ID NO: 7868674 - DNA, 22 bp, Homo sapiens
gcacagggccctgtgcgtaggt

SEQ ID NO: 7868675 - DNA, 22 bp, Homo sapiens
gcacagggcctggcacataaga

SEQ ID NO: 7868676 - DNA, 22 bp, Homo sapiens
gcacacaggcagtttccagcca

SEQ ID NO: 7868677 - DNA, 22 bp, Homo sapiens
gcacacaggcagtttccagcca

SEQ ID NO: 7868678 - DNA, 22 bp, Homo sapiens
gcaccaggcagctgagcaggcc

SEQ ID NO: 7868679 - DNA, 22 bp, Homo sapiens
gcaccaggcttagagccccagg

SEQ ID NO: 7868680 - DNA, 22 bp, Homo sapiens
gcaccaggcttagagccccagg

SEQ ID NO: 7868681 - DNA, 22 bp, Homo sapiens
gcaccaggcagctgagcaggcc

SEQ ID NO: 7868682 - DNA, 22 bp, Homo sapiens
gcaccaggcagctgagcaggcc

SEQ ID NO: 7868683 - DNA, 22 bp, Homo sapiens
gcaccaggcttagagccccagg

SEQ ID NO: 7868684 - DNA, 22 bp, Homo sapiens
gcaccaggcagctgagcaggcc

SEQ ID NO: 7868685 - DNA, 22 bp, Homo sapiens
gcaccagggagggtgtgcttca

SEQ ID NO: 7868686 - DNA, 22 bp, Homo sapiens
gcaccaggcttagagccccagg

SEQ ID NO: 7868687 - DNA, 22 bp, Homo sapiens
gcaccagggagggtgtgcttca

SEQ ID NO: 7868688 - DNA, 22 bp, Homo sapiens
gcaccagggagggtgtgcttca

SEQ ID NO: 7868689 - DNA, 22 bp, Homo sapiens
gcaccagggtgctgtgttctgg

SEQ ID NO: 7868690 - DNA, 22 bp, Homo sapiens
gcaccaggtgcagccgggcccc

SEQ ID NO: 7868691 - DNA, 22 bp, Homo sapiens
gcaccaggtgcagccgggcccc

SEQ ID NO: 7868692 - DNA, 22 bp, Homo sapiens
gcaccaggtgcagccgggcccc

SEQ ID NO: 7868693 - DNA, 22 bp, Homo sapiens
gcaccaggtgcagccgggcccc

SEQ ID NO: 7868694 - DNA, 22 bp, Homo sapiens
gcacacagaattgattcactgt

SEQ ID NO: 7868695 - DNA, 22 bp, Homo sapiens
gcacacagactaaccatatttc

SEQ ID NO: 7868696 - DNA, 22 bp, Homo sapiens
gcacacagactaaccatatttc

SEQ ID NO: 7868697 - DNA, 22 bp, Homo sapiens
gcacacagactaaccatatttc

SEQ ID NO: 7868698 - DNA, 22 bp, Homo sapiens
gcacacagaattgattcactgt

SEQ ID NO: 7868699 - DNA, 22 bp, Homo sapiens
gcacacagagaggtggtatgtc

SEQ ID NO: 7868700 - DNA, 22 bp, Homo sapiens
gcacacagagaggtggtatgtc

SEQ ID NO: 7868701 - DNA, 22 bp, Homo sapiens
gcacacagagaggtggtatgtc

SEQ ID NO: 7868702 - DNA, 22 bp, Homo sapiens
gcacacagagaggtggtatgtc

SEQ ID NO: 7868703 - DNA, 22 bp, Homo sapiens
gcacacagattaggaaacagaa

SEQ ID NO: 7868704 - DNA, 16 bp, Homo sapiens
gcacacagccagcctt

SEQ ID NO: 7868705 - DNA, 16 bp, Homo sapiens
gcacacagccagcctt

SEQ ID NO: 7868706 - DNA, 22 bp, Homo sapiens
gcacacagctagattaccattc

SEQ ID NO: 7868707 - DNA, 22 bp, Homo sapiens
gcacacagctagattaccattc

SEQ ID NO: 7868708 - DNA, 22 bp, Homo sapiens
gcacacagctagattaccattc

SEQ ID NO: 7868709 - DNA, 22 bp, Homo sapiens
gcacacaggcagtttccagcca

SEQ ID NO: 7868710 - DNA, 22 bp, Homo sapiens
gcacacaggcagtttccagcca

SEQ ID NO: 7868711 - DNA, 22 bp, Homo sapiens
gcacacagccagctgagggcta

SEQ ID NO: 7868712 - DNA, 22 bp, Homo sapiens
gcacacagccagctgagggcta

SEQ ID NO: 7868713 - DNA, 22 bp, Homo sapiens
gcacacagccagctgagggcta

SEQ ID NO: 7868714 - DNA, 22 bp, Homo sapiens
gcacacagccagctgagggcta

SEQ ID NO: 7868715 - DNA, 22 bp, Homo sapiens
gcacacagctagattaccattc

SEQ ID NO: 7868716 - DNA, 22 bp, Homo sapiens
gcacacagctagattaccattc

SEQ ID NO: 7868717 - DNA, 22 bp, Homo sapiens
gcacacagccagctgagggcta

SEQ ID NO: 7868718 - DNA, 22 bp, Homo sapiens
attataggcttgagccaccgtg

SEQ ID NO: 7868719 - DNA, 22 bp, Homo sapiens
attataggcttgagccaccgtg

SEQ ID NO: 7868720 - DNA, 22 bp, Homo sapiens
attataggcttgagccaccgtg

SEQ ID NO: 7868721 - DNA, 22 bp, Homo sapiens
attataggcttgagccaccgtg

SEQ ID NO: 7868722 - DNA, 22 bp, Homo sapiens
attataggcttgagccaccgtg

SEQ ID NO: 7868723 - DNA, 22 bp, Homo sapiens
attataggcttgagccaccgtg

SEQ ID NO: 7868724 - DNA, 22 bp, Homo sapiens
attataggcttgagccaccgtg

SEQ ID NO: 7868725 - DNA, 22 bp, Homo sapiens
attagtttggtgcaaaagtaat

SEQ ID NO: 7868726 - DNA, 22 bp, Homo sapiens
attaactgtactttctaatttt

SEQ ID NO: 7868727 - DNA, 22 bp, Homo sapiens
attaagaatcacacggctgtgt

SEQ ID NO: 7868728 - DNA, 22 bp, Homo sapiens
attaagatcattgtagaagatt

SEQ ID NO: 7868729 - DNA, 22 bp, Homo sapiens
attaagatcattgtagaagatt

SEQ ID NO: 7868730 - DNA, 22 bp, Homo sapiens
attaagatcattgtagaagatt

SEQ ID NO: 7868731 - DNA, 22 bp, Homo sapiens
attaagagcctactatgtgccg

SEQ ID NO: 7868732 - DNA, 22 bp, Homo sapiens
attaagatcattgtagaagatt

SEQ ID NO: 7868733 - DNA, 22 bp, Homo sapiens
attagttggggtggagaaggat

SEQ ID NO: 7868734 - DNA, 22 bp, Homo sapiens
attagtttggtgcaaaagtaat

SEQ ID NO: 7868735 - DNA, 22 bp, Homo sapiens
attatataggacttgcccttcc

SEQ ID NO: 7868736 - DNA, 22 bp, Homo sapiens
attatatgtgggatagaattta

SEQ ID NO: 7868737 - DNA, 22 bp, Homo sapiens
attatatgtgggatagaattta

SEQ ID NO: 7868738 - DNA, 22 bp, Homo sapiens
attatataaaattctggaagct

SEQ ID NO: 7868739 - DNA, 22 bp, Homo sapiens
attatataggacttgcccttcc

SEQ ID NO: 7868740 - DNA, 22 bp, Homo sapiens
attatattgagtataaccagag

SEQ ID NO: 7868741 - DNA, 22 bp, Homo sapiens
attatattgagtataaccagag

SEQ ID NO: 7868742 - DNA, 22 bp, Homo sapiens
attatattgagtataaccagag

SEQ ID NO: 7868743 - DNA, 22 bp, Homo sapiens
attatattgagtataaccagag

SEQ ID NO: 7868744 - DNA, 22 bp, Homo sapiens
attatattgagtataaccagag

SEQ ID NO: 7868745 - DNA, 22 bp, Homo sapiens
attatatttgaaaggttggaag

SEQ ID NO: 7868746 - DNA, 22 bp, Homo sapiens
gcacacagaatcagtgggcata

SEQ ID NO: 7868747 - DNA, 22 bp, Homo sapiens
gcacacagaattgattcactgt

SEQ ID NO: 7868748 - DNA, 22 bp, Homo sapiens
gcacacagaattgattcactgt

SEQ ID NO: 7868749 - DNA, 22 bp, Homo sapiens
gcacacagaattgattcactgt

SEQ ID NO: 7868750 - DNA, 22 bp, Homo sapiens
gcacacagaattgattcactgt

SEQ ID NO: 7868751 - DNA, 22 bp, Homo sapiens
attatccagcaccaatgtcaga

SEQ ID NO: 7868752 - DNA, 22 bp, Homo sapiens
attatcagaaattcaaagggtg

SEQ ID NO: 7868753 - DNA, 22 bp, Homo sapiens
attatccagcaccaatgtcaga

SEQ ID NO: 7868754 - DNA, 22 bp, Homo sapiens
attatccaacacccagttacat

SEQ ID NO: 7868755 - DNA, 22 bp, Homo sapiens
attatccagcaccaatgtcaga

SEQ ID NO: 7868756 - DNA, 22 bp, Homo sapiens
attatcacaggtgagtctcact

SEQ ID NO: 7868757 - DNA, 22 bp, Homo sapiens
attatcaagtttactgtgtgga

SEQ ID NO: 7868758 - DNA, 22 bp, Homo sapiens
attatcagccgtcccactacat

SEQ ID NO: 7868759 - DNA, 22 bp, Homo sapiens
attatcagaaattcaaagggtg

SEQ ID NO: 7868760 - DNA, 22 bp, Homo sapiens
attatcagccgtcccactacat

SEQ ID NO: 7868761 - DNA, 22 bp, Homo sapiens
attatgtgtaacgagtttattg

SEQ ID NO: 7868762 - DNA, 22 bp, Homo sapiens
attattaaaatgtgtttctctt

SEQ ID NO: 7868763 - DNA, 21 bp, Homo sapiens
attatgttcccatctgtttgg

SEQ ID NO: 7868764 - DNA, 21 bp, Homo sapiens
attatgttcccatctgtttgg

SEQ ID NO: 7868765 - DNA, 22 bp, Homo sapiens
gcagacaaagcagcatgcctat

SEQ ID NO: 7868766 - DNA, 22 bp, Homo sapiens
gcagacaaagcagcatgcctat

SEQ ID NO: 7868767 - DNA, 22 bp, Homo sapiens
attattaaaatgtgtttctctt

SEQ ID NO: 7868768 - DNA, 22 bp, Homo sapiens
gcagaatttgggggtaaccttt

SEQ ID NO: 7868769 - DNA, 22 bp, Homo sapiens
gcagaattttctgttttctaga

SEQ ID NO: 7868770 - DNA, 22 bp, Homo sapiens
gcagacaaagcagcatgcctat

SEQ ID NO: 7868771 - DNA, 22 bp, Homo sapiens
gcagaattttctgttttctaga

SEQ ID NO: 7868772 - DNA, 22 bp, Homo sapiens
gcagacaatttattagcagatt

SEQ ID NO: 7868773 - DNA, 22 bp, Homo sapiens
attatgtaactgtggttcagca

SEQ ID NO: 7868774 - DNA, 22 bp, Homo sapiens
attatgggtataacacagttat

SEQ ID NO: 7868775 - DNA, 22 bp, Homo sapiens
attatgtagctaaaaattgtgt

SEQ ID NO: 7868776 - DNA, 22 bp, Homo sapiens
attatgtagctaaaaattgtgt

SEQ ID NO: 7868777 - DNA, 22 bp, Homo sapiens
attatgtaggttaggtggttgt

SEQ ID NO: 7868778 - DNA, 22 bp, Homo sapiens
attatgtatttggtatagtttg

SEQ ID NO: 7868779 - DNA, 22 bp, Homo sapiens
attatggatggaggcattagtc

SEQ ID NO: 7868780 - DNA, 22 bp, Homo sapiens
attatggagaaatatgtacagg

SEQ ID NO: 7868781 - DNA, 22 bp, Homo sapiens
attatggagaaatatgtacagg

SEQ ID NO: 7868782 - DNA, 22 bp, Homo sapiens
attatgcttaggaaaatatgaa

SEQ ID NO: 7868783 - DNA, 22 bp, Homo sapiens
attatggacatcaaataactct

SEQ ID NO: 7868784 - DNA, 22 bp, Homo sapiens
attatggacgttaattttggaa

SEQ ID NO: 7868785 - DNA, 22 bp, Homo sapiens
attatggacatcaaataactct

SEQ ID NO: 7868786 - DNA, 22 bp, Homo sapiens
attatctatgtagaatgatttt

SEQ ID NO: 7868787 - DNA, 22 bp, Homo sapiens
attatctatgtagaatgatttt

SEQ ID NO: 7868788 - DNA, 22 bp, Homo sapiens
attatcttgataaaatggcagt

SEQ ID NO: 7868789 - DNA, 22 bp, Homo sapiens
attatcttgataaaatggcagt

SEQ ID NO: 7868790 - DNA, 22 bp, Homo sapiens
attatgcatttgttagtattaa

SEQ ID NO: 7868791 - DNA, 22 bp, Homo sapiens
attatgcatatacatttgacta

SEQ ID NO: 7868792 - DNA, 22 bp, Homo sapiens
attatgcatatacatttgacta

SEQ ID NO: 7868793 - DNA, 22 bp, Homo sapiens
attatgctggtttacacatttt

SEQ ID NO: 7868794 - DNA, 22 bp, Homo sapiens
attatgctggtttacacatttt

SEQ ID NO: 7868795 - DNA, 18 bp, Homo sapiens
attatgctcattacagtg

SEQ ID NO: 7868796 - DNA, 22 bp, Homo sapiens
attatgcccagagatgagtgct

SEQ ID NO: 7868797 - DNA, 22 bp, Homo sapiens
attatgcatttgttagtattaa

SEQ ID NO: 7868798 - DNA, 22 bp, Homo sapiens
gcacccagaataaggacaggac

SEQ ID NO: 7868799 - DNA, 22 bp, Homo sapiens
gcacccagaataaggacaggac

SEQ ID NO: 7868800 - DNA, 22 bp, Homo sapiens
gcacccagaataaggacaggac

SEQ ID NO: 7868801 - DNA, 22 bp, Homo sapiens
attatctaggaattgacagaag

SEQ ID NO: 7868802 - DNA, 22 bp, Homo sapiens
attatctaggaattgacagaag

SEQ ID NO: 7868803 - DNA, 23 bp, Homo sapiens
attatccagtgcacttcacagct

SEQ ID NO: 7868804 - DNA, 22 bp, Homo sapiens
gcaccatgatggagcctcatta

SEQ ID NO: 7868805 - DNA, 22 bp, Homo sapiens
gcaccatgatggagcctcatta

SEQ ID NO: 7868806 - DNA, 22 bp, Homo sapiens
gcaccattgctgggctagttcc

SEQ ID NO: 7868807 - DNA, 22 bp, Homo sapiens
gcacccacttaggccagtcaat

SEQ ID NO: 7868808 - DNA, 22 bp, Homo sapiens
gcacccagaataaggacaggac

SEQ ID NO: 7868809 - DNA, 22 bp, Homo sapiens
gcacccagaataaggacaggac

SEQ ID NO: 7868810 - DNA, 22 bp, Homo sapiens
gcaccattgctgggctagttcc

SEQ ID NO: 7868811 - DNA, 22 bp, Homo sapiens
gcacccagaataaggacaggac

SEQ ID NO: 7868812 - DNA, 22 bp, Homo sapiens
gcagagaccccgcagtgaggcc

SEQ ID NO: 7868813 - DNA, 22 bp, Homo sapiens
gcagagaccccgcagtgaggcc

SEQ ID NO: 7868814 - DNA, 22 bp, Homo sapiens
gcagagaccccgcagtgaggcc

SEQ ID NO: 7868815 - DNA, 22 bp, Homo sapiens
gcagagactccactgtcttgtg

SEQ ID NO: 7868816 - DNA, 22 bp, Homo sapiens
gcagagactagtagtgcagact

SEQ ID NO: 7868817 - DNA, 21 bp, Homo sapiens
gcagagaatgaactttggctt

SEQ ID NO: 7868818 - DNA, 22 bp, Homo sapiens
gcagagaaggattgaaaccaga

SEQ ID NO: 7868819 - DNA, 21 bp, Homo sapiens
gcagagaatgaactttggctt

SEQ ID NO: 7868820 - DNA, 22 bp, Homo sapiens
gcagagacagactaatgaaaag

SEQ ID NO: 7868821 - DNA, 23 bp, Homo sapiens
gcagagacagccccagcgcgatg

SEQ ID NO: 7868822 - DNA, 22 bp, Homo sapiens
gcagagacaggataatgggttc

SEQ ID NO: 7868823 - DNA, 22 bp, Homo sapiens
gcagagaggatattattgtcca

SEQ ID NO: 7868824 - DNA, 22 bp, Homo sapiens
gcagagagttgggctgcgccag

SEQ ID NO: 7868825 - DNA, 22 bp, Homo sapiens
gcagagaggatattattgtcca

SEQ ID NO: 7868826 - DNA, 22 bp, Homo sapiens
gcagagataagtagacaggatg

SEQ ID NO: 7868827 - DNA, 22 bp, Homo sapiens
gcagagagttgggctgcgccag

SEQ ID NO: 7868828 - DNA, 22 bp, Homo sapiens
gcagagagttgggctgcgccag

SEQ ID NO: 7868829 - DNA, 22 bp, Homo sapiens
gcagagagttgggctgcgccag

SEQ ID NO: 7868830 - DNA, 22 bp, Homo sapiens
gcagagagttgggctgcgccag

SEQ ID NO: 7868831 - DNA, 22 bp, Homo sapiens
gcagagagttgggctgcgccag

SEQ ID NO: 7868832 - DNA, 22 bp, Homo sapiens
gcagagaggatattattgtcca

SEQ ID NO: 7868833 - DNA, 22 bp, Homo sapiens
gcagagaggaatgaagccatcc

SEQ ID NO: 7868834 - DNA, 22 bp, Homo sapiens
gcagagaggaatgaagccatcc

SEQ ID NO: 7868835 - DNA, 22 bp, Homo sapiens
gcagagaggaatgaagccatcc

SEQ ID NO: 7868836 - DNA, 22 bp, Homo sapiens
gcagagaggaatgaagccatcc

SEQ ID NO: 7868837 - DNA, 22 bp, Homo sapiens
gcagagaggaatgaagccatcc

SEQ ID NO: 7868838 - DNA, 22 bp, Homo sapiens
gcagagaggaatgaagccatcc

SEQ ID NO: 7868839 - DNA, 22 bp, Homo sapiens
gcagagactccactgtcttgtg

SEQ ID NO: 7868840 - DNA, 22 bp, Homo sapiens
gcagagatccttgctggatgac

SEQ ID NO: 7868841 - DNA, 22 bp, Homo sapiens
gcagagatccagggtataggtt

SEQ ID NO: 7868842 - DNA, 22 bp, Homo sapiens
gcagagatattgatatagattt

SEQ ID NO: 7868843 - DNA, 22 bp, Homo sapiens
gcagagatattgatatagattt

SEQ ID NO: 7868844 - DNA, 22 bp, Homo sapiens
gcagagataagtagacaggatg

SEQ ID NO: 7868845 - DNA, 22 bp, Homo sapiens
gcagagatattgatatagattt

SEQ ID NO: 7868846 - DNA, 22 bp, Homo sapiens
gcagagatccttgctggatgac

SEQ ID NO: 7868847 - DNA, 22 bp, Homo sapiens
gcagagatccttgctggatgac

SEQ ID NO: 7868848 - DNA, 22 bp, Homo sapiens
gcagagatcggacactcagtaa

SEQ ID NO: 7868849 - DNA, 22 bp, Homo sapiens
gcagagatctgagaaggctgcc

SEQ ID NO: 7868850 - DNA, 22 bp, Homo sapiens
gcagagatctgagaaggctgcc

SEQ ID NO: 7868851 - DNA, 22 bp, Homo sapiens
gcagagattatgccatggaaag

SEQ ID NO: 7868852 - DNA, 19 bp, Homo sapiens
gcagagatgtggtagcttg

SEQ ID NO: 7868853 - DNA, 19 bp, Homo sapiens
gcagagatgtggtagcttg

SEQ ID NO: 7868854 - DNA, 22 bp, Homo sapiens
gcagagatgggccagtgacgca

SEQ ID NO: 7868855 - DNA, 22 bp, Homo sapiens
gcagagatggctgcctctgagt

SEQ ID NO: 7868856 - DNA, 22 bp, Homo sapiens
gcagagatggctgcctctgagt

SEQ ID NO: 7868857 - DNA, 22 bp, Homo sapiens
gcagagatggctgatctattcc

SEQ ID NO: 7868858 - DNA, 22 bp, Homo sapiens
gcagagatgatgataagcctgc

SEQ ID NO: 7868859 - DNA, 22 bp, Homo sapiens
gcagagatgagctatcaggaca

SEQ ID NO: 7868860 - DNA, 22 bp, Homo sapiens
gcagagatgaggcactcatccc

SEQ ID NO: 7868861 - DNA, 22 bp, Homo sapiens
attcaagtacagttttcttctt

SEQ ID NO: 7868862 - DNA, 22 bp, Homo sapiens
attcaagtccagcttctctaca

SEQ ID NO: 7868863 - DNA, 22 bp, Homo sapiens
gcagagattggtgcactgatga

SEQ ID NO: 7868864 - DNA, 22 bp, Homo sapiens
gcagagattggtgcactgatga

SEQ ID NO: 7868865 - DNA, 22 bp, Homo sapiens
gcagagattatgccatggaaag

SEQ ID NO: 7868866 - DNA, 22 bp, Homo sapiens
gcagagattggaagatgaattt

SEQ ID NO: 7868867 - DNA, 22 bp, Homo sapiens
attcaagttcttctgtctttgc

SEQ ID NO: 7868868 - DNA, 22 bp, Homo sapiens
attcaataaatatgctacatgg

SEQ ID NO: 7868869 - DNA, 22 bp, Homo sapiens
attcaagttcttctgtctttgc

SEQ ID NO: 7868870 - DNA, 22 bp, Homo sapiens
attcaagttcttctgtctttgc

SEQ ID NO: 7868871 - DNA, 22 bp, Homo sapiens
attcaagtggctgctatgttaa

SEQ ID NO: 7868872 - DNA, 22 bp, Homo sapiens
attctggaaagctattctctct

SEQ ID NO: 7868873 - DNA, 22 bp, Homo sapiens
attctggaaagctattctctct

SEQ ID NO: 7868874 - DNA, 22 bp, Homo sapiens
attctgctcattttatttccag

SEQ ID NO: 7868875 - DNA, 22 bp, Homo sapiens
attctgctcattttatttccag

SEQ ID NO: 7868876 - DNA, 22 bp, Homo sapiens
attctgctcccaggtgatgctg

SEQ ID NO: 7868877 - DNA, 22 bp, Homo sapiens
attctgctgcctagtttatgaa

SEQ ID NO: 7868878 - DNA, 22 bp, Homo sapiens
attctgctgcacaccttccccc

SEQ ID NO: 7868879 - DNA, 22 bp, Homo sapiens
attctgctgcacaccttccccc

SEQ ID NO: 7868880 - DNA, 22 bp, Homo sapiens
gcagggcagtgtgtctgtgggg

SEQ ID NO: 7868881 - DNA, 22 bp, Homo sapiens
gcagggcagtgtgtctgtgggg

SEQ ID NO: 7868882 - DNA, 22 bp, Homo sapiens
gcagggcagtgtgtctgtgggg

SEQ ID NO: 7868883 - DNA, 22 bp, Homo sapiens
gcagggcagtaagagctagagt

SEQ ID NO: 7868884 - DNA, 22 bp, Homo sapiens
gcagggcagtaagagctagagt

SEQ ID NO: 7868885 - DNA, 22 bp, Homo sapiens
gcagggcaaacccaggtgttca

SEQ ID NO: 7868886 - DNA, 22 bp, Homo sapiens
gcagggcaaacccaggtgttca

SEQ ID NO: 7868887 - DNA, 22 bp, Homo sapiens
gcagggcaaacccaggtgttca

SEQ ID NO: 7868888 - DNA, 22 bp, Homo sapiens
gcagggcagtaagagctagagt

SEQ ID NO: 7868889 - DNA, 22 bp, Homo sapiens
gcagggcagtaagagctagagt

SEQ ID NO: 7868890 - DNA, 22 bp, Homo sapiens
gcagggcagtaagagctagagt

SEQ ID NO: 7868891 - DNA, 22 bp, Homo sapiens
gcagggcagtaagagctagagt

SEQ ID NO: 7868892 - DNA, 22 bp, Homo sapiens
attctggaagcaagcttttaaa

SEQ ID NO: 7868893 - DNA, 22 bp, Homo sapiens
gcagggattgtgcagggggcta

SEQ ID NO: 7868894 - DNA, 22 bp, Homo sapiens
attctgcacatccaagaacagg

SEQ ID NO: 7868895 - DNA, 22 bp, Homo sapiens
attctgcacttcctttgcttcc

SEQ ID NO: 7868896 - DNA, 22 bp, Homo sapiens
attctgcacttcctttgcttcc

SEQ ID NO: 7868897 - DNA, 22 bp, Homo sapiens
attctgcacttcctttgcttcc

SEQ ID NO: 7868898 - DNA, 22 bp, Homo sapiens
attctgcacttcctttgcttcc

SEQ ID NO: 7868899 - DNA, 22 bp, Homo sapiens
attctgcaggtggaggatggca

SEQ ID NO: 7868900 - DNA, 22 bp, Homo sapiens
attctgcataatttcctggcag

SEQ ID NO: 7868901 - DNA, 22 bp, Homo sapiens
attctgcatggtggtgtctctg

SEQ ID NO: 7868902 - DNA, 22 bp, Homo sapiens
attctgcaggtggaggatggca

SEQ ID NO: 7868903 - DNA, 22 bp, Homo sapiens
attctgcatggtggtgtctctg

SEQ ID NO: 7868904 - DNA, 22 bp, Homo sapiens
attctgcatgtaggtttgctca

SEQ ID NO: 7868905 - DNA, 22 bp, Homo sapiens
attctgcattgctcacaaagat

SEQ ID NO: 7868906 - DNA, 22 bp, Homo sapiens
attctgcatgtaggtttgctca

SEQ ID NO: 7868907 - DNA, 22 bp, Homo sapiens
attctgcatgtaggtttgctca

SEQ ID NO: 7868908 - DNA, 22 bp, Homo sapiens
attctgcatgtaggtttgctca

SEQ ID NO: 7868909 - DNA, 22 bp, Homo sapiens
attctgctagtaacagatgaag

SEQ ID NO: 7868910 - DNA, 22 bp, Homo sapiens
gcaggcaggtggcatcttgtga

SEQ ID NO: 7868911 - DNA, 22 bp, Homo sapiens
gcaggcaggtggcatcttgtga

SEQ ID NO: 7868912 - DNA, 22 bp, Homo sapiens
gcaggcaggtggcatcttgtga

SEQ ID NO: 7868913 - DNA, 22 bp, Homo sapiens
gcaggcaggtggcatcttgtga

SEQ ID NO: 7868914 - DNA, 22 bp, Homo sapiens
gcaggcaggtggcatcttgtga

SEQ ID NO: 7868915 - DNA, 22 bp, Homo sapiens
attctgcacatccaagaacagg

SEQ ID NO: 7868916 - DNA, 22 bp, Homo sapiens
attctgcaactgttgttggtgg

SEQ ID NO: 7868917 - DNA, 15 bp, Homo sapiens
gcaggcaggtcacct

SEQ ID NO: 7868918 - DNA, 15 bp, Homo sapiens
gcaggcaggtcacct

SEQ ID NO: 7868919 - DNA, 15 bp, Homo sapiens
gcaggcaggtcacct

SEQ ID NO: 7868920 - DNA, 15 bp, Homo sapiens
gcaggcaggtcacct

SEQ ID NO: 7868921 - DNA, 22 bp, Homo sapiens
gcaggcaggtggcatcttgtga

SEQ ID NO: 7868922 - DNA, 22 bp, Homo sapiens
gcaggcaggtggcatcttgtga

SEQ ID NO: 7868923 - DNA, 22 bp, Homo sapiens
gcaggcaggtggcatcttgtga

SEQ ID NO: 7868924 - DNA, 20 bp, Homo sapiens
gcaggcagggaatgggggtg

SEQ ID NO: 7868925 - DNA, 22 bp, Homo sapiens
attctttccagacactgattgc

SEQ ID NO: 7868926 - DNA, 22 bp, Homo sapiens
attctttccagacactgattgc

SEQ ID NO: 7868927 - DNA, 20 bp, Homo sapiens
gcagggcatcttggccccca

SEQ ID NO: 7868928 - DNA, 20 bp, Homo sapiens
gcagggcatcttggccccca

SEQ ID NO: 7868929 - DNA, 22 bp, Homo sapiens
gcagggcatgggccctgtctgc

SEQ ID NO: 7868930 - DNA, 20 bp, Homo sapiens
gcagggcatcttggccccca

SEQ ID NO: 7868931 - DNA, 22 bp, Homo sapiens
gcagggcatccctgagcgggtg

SEQ ID NO: 7868932 - DNA, 22 bp, Homo sapiens
gcagggcatccctgagcgggtg

SEQ ID NO: 7868933 - DNA, 22 bp, Homo sapiens
gcagggcatccctgagcgggtg

SEQ ID NO: 7868934 - DNA, 22 bp, Homo sapiens
gcagggcatccctgagcgggtg

SEQ ID NO: 7868935 - DNA, 22 bp, Homo sapiens
gcagggcatccctgagcgggtg

SEQ ID NO: 7868936 - DNA, 22 bp, Homo sapiens
gcagggcatccctgagcgggtg

SEQ ID NO: 7868937 - DNA, 22 bp, Homo sapiens
gcagggcatagaggcacggagg

SEQ ID NO: 7868938 - DNA, 22 bp, Homo sapiens
gcagggcatagaggcacggagg

SEQ ID NO: 7868939 - DNA, 22 bp, Homo sapiens
gcagggcatagaggcacggagg

SEQ ID NO: 7868940 - DNA, 22 bp, Homo sapiens
gcagggcatagaggcacggagg

SEQ ID NO: 7868941 - DNA, 22 bp, Homo sapiens
gcagggcatagaggcacggagg

SEQ ID NO: 7868942 - DNA, 22 bp, Homo sapiens
gcagggcatagaggcacggagg

SEQ ID NO: 7868943 - DNA, 22 bp, Homo sapiens
gcagggcagtgtgtctgtgggg

SEQ ID NO: 7868944 - DNA, 22 bp, Homo sapiens
gcagggcagtgtgtctgtgggg

SEQ ID NO: 7868945 - DNA, 22 bp, Homo sapiens
attctttggacaataagtggtg

SEQ ID NO: 7868946 - DNA, 22 bp, Homo sapiens
attctttggacaataagtggtg

SEQ ID NO: 7868947 - DNA, 22 bp, Homo sapiens
attctttgcatctctgggtggc

SEQ ID NO: 7868948 - DNA, 21 bp, Homo sapiens
attctttgatgtgcaataagt

SEQ ID NO: 7868949 - DNA, 22 bp, Homo sapiens
attctttccagacactgattgc

SEQ ID NO: 7868950 - DNA, 17 bp, Homo sapiens
attctttgatgtctctg

SEQ ID NO: 7868951 - DNA, 22 bp, Homo sapiens
attcttttaaatggcagtagta

SEQ ID NO: 7868952 - DNA, 22 bp, Homo sapiens
attcttttaagccccagggatt

SEQ ID NO: 7868953 - DNA, 22 bp, Homo sapiens
attcttttaagccccagggatt

SEQ ID NO: 7868954 - DNA, 22 bp, Homo sapiens
attctttggacaataagtggtg

SEQ ID NO: 7868955 - DNA, 22 bp, Homo sapiens
attcttttaaatggcagtagta

SEQ ID NO: 7868956 - DNA, 22 bp, Homo sapiens
attcttttttaaggaatagaac

SEQ ID NO: 7868957 - DNA, 22 bp, Homo sapiens
attcttttttaaggaatagaac

SEQ ID NO: 7868958 - DNA, 22 bp, Homo sapiens
attcttttcccaactgctttaa

SEQ ID NO: 7868959 - DNA, 22 bp, Homo sapiens
attcttttgtcctagcttgata

SEQ ID NO: 7868960 - DNA, 22 bp, Homo sapiens
attcttttgtcctagcttgata

SEQ ID NO: 7868961 - DNA, 22 bp, Homo sapiens
attcttttgtcctagcttgata

SEQ ID NO: 7868962 - DNA, 22 bp, Homo sapiens
attcttttcccaactgctttaa

SEQ ID NO: 7868963 - DNA, 22 bp, Homo sapiens
attcttttcccaactgctttaa

SEQ ID NO: 7868964 - DNA, 22 bp, Homo sapiens
attcttttcccaactgctttaa

SEQ ID NO: 7868965 - DNA, 22 bp, Homo sapiens
attcttttcccaactgctttaa

SEQ ID NO: 7868966 - DNA, 22 bp, Homo sapiens
attcttttcccaactgctttaa

SEQ ID NO: 7868967 - DNA, 19 bp, Homo sapiens
gcatcagagcagaaggggt

SEQ ID NO: 7868968 - DNA, 22 bp, Homo sapiens
gcatcagcaccaaccttccagg

SEQ ID NO: 7868969 - DNA, 19 bp, Homo sapiens
gcatcagagcagaaggggt

SEQ ID NO: 7868970 - DNA, 22 bp, Homo sapiens
gcatccaaaccattcatcagcc

SEQ ID NO: 7868971 - DNA, 22 bp, Homo sapiens
attgcactccggcctgggtgac

SEQ ID NO: 7868972 - DNA, 22 bp, Homo sapiens
attgcactccggcctgggtgac

SEQ ID NO: 7868973 - DNA, 22 bp, Homo sapiens
attgcactccggcctgggtgac

SEQ ID NO: 7868974 - DNA, 22 bp, Homo sapiens
attgcactccggcctgggtgac

SEQ ID NO: 7868975 - DNA, 22 bp, Homo sapiens
attgcactccggcctgggtgac

SEQ ID NO: 7868976 - DNA, 22 bp, Homo sapiens
attgcactccagcctgggtgac

SEQ ID NO: 7868977 - DNA, 22 bp, Homo sapiens
attgcactccagcctgggtgac

SEQ ID NO: 7868978 - DNA, 22 bp, Homo sapiens
attgcactccagcctgggtgac

SEQ ID NO: 7868979 - DNA, 22 bp, Homo sapiens
attgcactccagcctgggtgac

SEQ ID NO: 7868980 - DNA, 22 bp, Homo sapiens
attgcactccagcctgggtgac

SEQ ID NO: 7868981 - DNA, 22 bp, Homo sapiens
attgcactccagcctgggggac

SEQ ID NO: 7868982 - DNA, 22 bp, Homo sapiens
attgcacatctgcactacagcc

SEQ ID NO: 7868983 - DNA, 22 bp, Homo sapiens
attgcacatctgcactacagcc

SEQ ID NO: 7868984 - DNA, 22 bp, Homo sapiens
attgcacatctgcactacagcc

SEQ ID NO: 7868985 - DNA, 22 bp, Homo sapiens
attgcactccagcctgggcgac

SEQ ID NO: 7868986 - DNA, 22 bp, Homo sapiens
attgcaatctggtgaaaacagt

SEQ ID NO: 7868987 - DNA, 22 bp, Homo sapiens
attgcaatctggtgaaaacagt

SEQ ID NO: 7868988 - DNA, 22 bp, Homo sapiens
attgcaaataactgtactgaat

SEQ ID NO: 7868989 - DNA, 22 bp, Homo sapiens
attgcacagctgaatattttgg

SEQ ID NO: 7868990 - DNA, 22 bp, Homo sapiens
attgcacaaacacagtcagact

SEQ ID NO: 7868991 - DNA, 22 bp, Homo sapiens
attgcacaaagagggaaactga

SEQ ID NO: 7868992 - DNA, 18 bp, Homo sapiens
attgcacaccagcctggg

SEQ ID NO: 7868993 - DNA, 22 bp, Homo sapiens
gcatggaattcccttatgggcc

SEQ ID NO: 7868994 - DNA, 20 bp, Homo sapiens
gcatggaaacaaaggttgca

SEQ ID NO: 7868995 - DNA, 22 bp, Homo sapiens
gcatggagaagtgggaacaggt

SEQ ID NO: 7868996 - DNA, 22 bp, Homo sapiens
gcatggcaagaccctgtctcta

SEQ ID NO: 7868997 - DNA, 22 bp, Homo sapiens
gcatggcaagaccctgtctcta

SEQ ID NO: 7868998 - DNA, 22 bp, Homo sapiens
gcatggcaagatcaggagacca

SEQ ID NO: 7868999 - DNA, 22 bp, Homo sapiens
gcatggcaaatatcgagggcag

SEQ ID NO: 7869000 - DNA, 22 bp, Homo sapiens
gcatggcaagaccctgtctcta

SEQ ID NO: 7869001 - DNA, 22 bp, Homo sapiens
gcatggcaaatatcgagggcag

SEQ ID NO: 7869002 - DNA, 22 bp, Homo sapiens
gcatggcaaatatcgagggcag

SEQ ID NO: 7869003 - DNA, 22 bp, Homo sapiens
gcatggcaaatatcgagggcag

SEQ ID NO: 7869004 - DNA, 22 bp, Homo sapiens
gcatggcagtgaggatggtgct

SEQ ID NO: 7869005 - DNA, 22 bp, Homo sapiens
gcatggcagtgaggatggtgct

SEQ ID NO: 7869006 - DNA, 21 bp, Homo sapiens
gcatggcaggtcactggggca

SEQ ID NO: 7869007 - DNA, 21 bp, Homo sapiens
gcatggcaggtcactggggca

SEQ ID NO: 7869008 - DNA, 22 bp, Homo sapiens
gcatggcagccagtacatggtg

SEQ ID NO: 7869009 - DNA, 22 bp, Homo sapiens
gcatggcagggattagtagtag

SEQ ID NO: 7869010 - DNA, 22 bp, Homo sapiens
gcatggcagaacacctcgcccg

SEQ ID NO: 7869011 - DNA, 22 bp, Homo sapiens
gcatggcagaacacctcgcccg

SEQ ID NO: 7869012 - DNA, 22 bp, Homo sapiens
gcatggcagccagtacatggtg

SEQ ID NO: 7869013 - DNA, 22 bp, Homo sapiens
gcatggcagaacacctcgcccg

SEQ ID NO: 7869014 - DNA, 22 bp, Homo sapiens
gcatggcaagatcaggagacca

SEQ ID NO: 7869015 - DNA, 22 bp, Homo sapiens
gcatggcaagatcaggagacca

SEQ ID NO: 7869016 - DNA, 22 bp, Homo sapiens
gcatggcagaacacctcgcccg

SEQ ID NO: 7869017 - DNA, 22 bp, Homo sapiens
gcatggcaagatcaggagacca

SEQ ID NO: 7869018 - DNA, 22 bp, Homo sapiens
gcatggcaagatcaggagacca

SEQ ID NO: 7869019 - DNA, 22 bp, Homo sapiens
attgcaaataatgcgagccagt

SEQ ID NO: 7869020 - DNA, 22 bp, Homo sapiens
attgcaaataatgcgagccagt

SEQ ID NO: 7869021 - DNA, 22 bp, Homo sapiens
attgcaaatgagtcttaatata

SEQ ID NO: 7869022 - DNA, 22 bp, Homo sapiens
attgcaaatgagtcttaatata

SEQ ID NO: 7869023 - DNA, 22 bp, Homo sapiens
attgcaaatggtttggtcatct

SEQ ID NO: 7869024 - DNA, 22 bp, Homo sapiens
attgcaaatggtttggtcatct

SEQ ID NO: 7869025 - DNA, 22 bp, Homo sapiens
attgcaaaggtcccattcaaga

SEQ ID NO: 7869026 - DNA, 22 bp, Homo sapiens
attgcaaaggtcccattcaaga

SEQ ID NO: 7869027 - DNA, 22 bp, Homo sapiens
attgcaaaggtcccattcaaga

SEQ ID NO: 7869028 - DNA, 22 bp, Homo sapiens
attgcaaataactgtactgaat

SEQ ID NO: 7869029 - DNA, 22 bp, Homo sapiens
attgcaaataactgtactgaat

SEQ ID NO: 7869030 - DNA, 22 bp, Homo sapiens
attgcaaaggtcccattcaaga

SEQ ID NO: 7869031 - DNA, 22 bp, Homo sapiens
gcaggttatccaactacaatgt

SEQ ID NO: 7869032 - DNA, 22 bp, Homo sapiens
attgcaaagcgtagactctaaa

SEQ ID NO: 7869033 - DNA, 22 bp, Homo sapiens
gcagtaagatgtttcccagagc

SEQ ID NO: 7869034 - DNA, 22 bp, Homo sapiens
gcagtaagatgtttcccagagc

SEQ ID NO: 7869035 - DNA, 22 bp, Homo sapiens
gcagtaagatgtaagtgctata

SEQ ID NO: 7869036 - DNA, 22 bp, Homo sapiens
gcagtaagaaagtcaagcagtt

SEQ ID NO: 7869037 - DNA, 22 bp, Homo sapiens
gcagtaagatgtaagtgctata

SEQ ID NO: 7869038 - DNA, 22 bp, Homo sapiens
gcagtaaagcctgagatatatg

SEQ ID NO: 7869039 - DNA, 16 bp, Homo sapiens
gcagtaaaatggttag

SEQ ID NO: 7869040 - DNA, 22 bp, Homo sapiens
gcagtaaaaaaggatatgtgca

SEQ ID NO: 7869041 - DNA, 22 bp, Homo sapiens
gcagtaaagcctgagatatatg

SEQ ID NO: 7869042 - DNA, 22 bp, Homo sapiens
gcagtaaataattttgtgtata

SEQ ID NO: 7869043 - DNA, 22 bp, Homo sapiens
gcagtaaattgagagtcatgtt

SEQ ID NO: 7869044 - DNA, 22 bp, Homo sapiens
gcagtaaaggtgacaatatagg

SEQ ID NO: 7869045 - DNA, 22 bp, Homo sapiens
gcagtaaaggtgacaatatagg

SEQ ID NO: 7869046 - DNA, 22 bp, Homo sapiens
gcagtaaataattttgtgtata

SEQ ID NO: 7869047 - DNA, 22 bp, Homo sapiens
gcaggttatccaactacaatgt

SEQ ID NO: 7869048 - DNA, 22 bp, Homo sapiens
gcagtaaaaaaggatatgtgca

SEQ ID NO: 7869049 - DNA, 22 bp, Homo sapiens
gcagtaaaaaaggatatgtgca

SEQ ID NO: 7869050 - DNA, 22 bp, Homo sapiens
gcaggttagatttaatccattc

SEQ ID NO: 7869051 - DNA, 22 bp, Homo sapiens
gcaggttagatttaatccattc

SEQ ID NO: 7869052 - DNA, 22 bp, Homo sapiens
gcaggtgttctcagaggaggct

SEQ ID NO: 7869053 - DNA, 22 bp, Homo sapiens
gcaggtgttctcagaggaggct

SEQ ID NO: 7869054 - DNA, 22 bp, Homo sapiens
gcaggtgtgggtggctgccagg

SEQ ID NO: 7869055 - DNA, 19 bp, Homo sapiens
gcaggtggatgtggtcagc

SEQ ID NO: 7869056 - DNA, 19 bp, Homo sapiens
gcaggtggatgtggtcagc

SEQ ID NO: 7869057 - DNA, 22 bp, Homo sapiens
attcttttttaaggaatagaac

SEQ ID NO: 7869058 - DNA, 18 bp, Homo sapiens
gcaggtgtggagaagggg

SEQ ID NO: 7869059 - DNA, 18 bp, Homo sapiens
gcaggtgtggagaagggg

SEQ ID NO: 7869060 - DNA, 19 bp, Homo sapiens
gcaggtggatgtggtcagc

SEQ ID NO: 7869061 - DNA, 19 bp, Homo sapiens
gcaggtggatgtggtcagc

SEQ ID NO: 7869062 - DNA, 22 bp, Homo sapiens
gcaggtgtggagagtggtcggg

SEQ ID NO: 7869063 - DNA, 22 bp, Homo sapiens
gcaggtgtggagtggggtgagc

SEQ ID NO: 7869064 - DNA, 23 bp, Homo sapiens
gcagcttgtggtttagtagaggg

SEQ ID NO: 7869065 - DNA, 22 bp, Homo sapiens
gcagcttggtgaaaggtgatgg

SEQ ID NO: 7869066 - DNA, 22 bp, Homo sapiens
gcagcttgtcagacctttactg

SEQ ID NO: 7869067 - DNA, 22 bp, Homo sapiens
gcagcttgtcagacctttactg

SEQ ID NO: 7869068 - DNA, 22 bp, Homo sapiens
gcagcttggggacatgaaaaga

SEQ ID NO: 7869069 - DNA, 22 bp, Homo sapiens
gcagcttgaagctcggaggagc

SEQ ID NO: 7869070 - DNA, 22 bp, Homo sapiens
gcagcttggatttctgtagttt

SEQ ID NO: 7869071 - DNA, 22 bp, Homo sapiens
gcagcttggatttctgtagttt

SEQ ID NO: 7869072 - DNA, 22 bp, Homo sapiens
gcaggcaaggtagacagaggaa

SEQ ID NO: 7869073 - DNA, 19 bp, Homo sapiens
gcaggcagctggggtatcc

SEQ ID NO: 7869074 - DNA, 19 bp, Homo sapiens
gcaggcagctggggtatcc

SEQ ID NO: 7869075 - DNA, 22 bp, Homo sapiens
gcaggcaagaatttgggtctga

SEQ ID NO: 7869076 - DNA, 22 bp, Homo sapiens
gcaggcaaggaacagagactgt

SEQ ID NO: 7869077 - DNA, 22 bp, Homo sapiens
gcaggattgggctgaaggagtg

SEQ ID NO: 7869078 - DNA, 22 bp, Homo sapiens
gcaggcaagaatttgggtctga

SEQ ID NO: 7869079 - DNA, 22 bp, Homo sapiens
gcagcttagaaaaatgaaattg

SEQ ID NO: 7869080 - DNA, 22 bp, Homo sapiens
gcagcttcaagatactttttct

SEQ ID NO: 7869081 - DNA, 22 bp, Homo sapiens
gcagcttcagccagagggccag

SEQ ID NO: 7869082 - DNA, 22 bp, Homo sapiens
gcagcttcagccagagggccag

SEQ ID NO: 7869083 - DNA, 22 bp, Homo sapiens
gcagcttcaagatactttttct

SEQ ID NO: 7869084 - DNA, 22 bp, Homo sapiens
gcagcttcagccagagggccag

SEQ ID NO: 7869085 - DNA, 22 bp, Homo sapiens
gcagcttcctgagtgtggacag

SEQ ID NO: 7869086 - DNA, 22 bp, Homo sapiens
gcagcttcagtaggtgaagaca

SEQ ID NO: 7869087 - DNA, 22 bp, Homo sapiens
gcagcttcagtaggtgaagaca

SEQ ID NO: 7869088 - DNA, 22 bp, Homo sapiens
gcagcttcctgagtgtggacag

SEQ ID NO: 7869089 - DNA, 22 bp, Homo sapiens
gcagcttcagtaggtgaagaca

SEQ ID NO: 7869090 - DNA, 22 bp, Homo sapiens
gcagcttcctgagtgtggacag

SEQ ID NO: 7869091 - DNA, 22 bp, Homo sapiens
gcaggcaggagcccaactgcct

SEQ ID NO: 7869092 - DNA, 22 bp, Homo sapiens
gcaggcaggagcccaactgcct

SEQ ID NO: 7869093 - DNA, 22 bp, Homo sapiens
gcaggcaggagcccaactgcct

SEQ ID NO: 7869094 - DNA, 22 bp, Homo sapiens
gcaggcaggagcccaactgcct

SEQ ID NO: 7869095 - DNA, 22 bp, Homo sapiens
gcaggcaggagcccaactgcct

SEQ ID NO: 7869096 - DNA, 22 bp, Homo sapiens
gcaggcaggaaggactaagtaa

SEQ ID NO: 7869097 - DNA, 22 bp, Homo sapiens
gcaggcaggaaggactaagtaa

SEQ ID NO: 7869098 - DNA, 22 bp, Homo sapiens
gcaggcaggaaggactaagtaa

SEQ ID NO: 7869099 - DNA, 22 bp, Homo sapiens
gcaggcaggaaggactaagtaa

SEQ ID NO: 7869100 - DNA, 22 bp, Homo sapiens
gcaggcaggaaggactaagtaa

SEQ ID NO: 7869101 - DNA, 22 bp, Homo sapiens
gcaggcaggaaggactaagtaa

SEQ ID NO: 7869102 - DNA, 22 bp, Homo sapiens
gcaggcaggaaggactaagtaa

SEQ ID NO: 7869103 - DNA, 22 bp, Homo sapiens
gcaggcaggaaggactaagtaa

SEQ ID NO: 7869104 - DNA, 22 bp, Homo sapiens
gcaggcaggaaggactaagtaa

SEQ ID NO: 7869105 - DNA, 22 bp, Homo sapiens
gcaggcaggaaggactaagtaa

SEQ ID NO: 7869106 - DNA, 22 bp, Homo sapiens
gcaggcaggcttccttgaactg

SEQ ID NO: 7869107 - DNA, 22 bp, Homo sapiens
gcaggcaggcttccttgaactg

SEQ ID NO: 7869108 - DNA, 22 bp, Homo sapiens
gcaggcaggcttccttgaactg

SEQ ID NO: 7869109 - DNA, 22 bp, Homo sapiens
gcaggcaggcttccttgaactg

SEQ ID NO: 7869110 - DNA, 22 bp, Homo sapiens
gcaggcaggcttccttgaactg

SEQ ID NO: 7869111 - DNA, 22 bp, Homo sapiens
gcaggcaggcttccttgaactg

SEQ ID NO: 7869112 - DNA, 22 bp, Homo sapiens
gcaggcaggagcccaactgcct

SEQ ID NO: 7869113 - DNA, 22 bp, Homo sapiens
gcaggcaggagcccaactgcct

SEQ ID NO: 7869114 - DNA, 22 bp, Homo sapiens
gcaggcaggcttccttgaactg

SEQ ID NO: 7869115 - DNA, 20 bp, Homo sapiens
gcaggcagggaatgggggtg

SEQ ID NO: 7869116 - DNA, 20 bp, Homo sapiens
gcaggcagggaatgggggtg

SEQ ID NO: 7869117 - DNA, 22 bp, Homo sapiens
gcaggcaggcttccttgaactg

SEQ ID NO: 7869118 - DNA, 20 bp, Homo sapiens
gcaggcagggaatgggggtg

SEQ ID NO: 7869119 - DNA, 20 bp, Homo sapiens
gcaggcagggaatgggggtg

SEQ ID NO: 7869120 - DNA, 20 bp, Homo sapiens
gcaggcagggaatgggggtg

SEQ ID NO: 7869121 - DNA, 20 bp, Homo sapiens
gcaggcagggaatgggggtg

SEQ ID NO: 7869122 - DNA, 20 bp, Homo sapiens
gcaggcagggaatgggggtg

SEQ ID NO: 7869123 - DNA, 20 bp, Homo sapiens
gcaggcagggaatgggggtg

SEQ ID NO: 7869124 - DNA, 22 bp, Homo sapiens
attctcttctgatgtcttgcca

SEQ ID NO: 7869125 - DNA, 22 bp, Homo sapiens
attctctgtttccaagatgaaa

SEQ ID NO: 7869126 - DNA, 22 bp, Homo sapiens
attctctttgtataacatcttg

SEQ ID NO: 7869127 - DNA, 22 bp, Homo sapiens
attctctttgtataacatcttg

SEQ ID NO: 7869128 - DNA, 22 bp, Homo sapiens
attctctttgtataacatcttg

SEQ ID NO: 7869129 - DNA, 22 bp, Homo sapiens
attctcatttgctggctatatg

SEQ ID NO: 7869130 - DNA, 22 bp, Homo sapiens
attctcatttttatagatgaga

SEQ ID NO: 7869131 - DNA, 22 bp, Homo sapiens
attccacttccactagtttctc

SEQ ID NO: 7869132 - DNA, 22 bp, Homo sapiens
attctgaattctgagcctttca

SEQ ID NO: 7869133 - DNA, 22 bp, Homo sapiens
attctgaagttgcaggagaagc

SEQ ID NO: 7869134 - DNA, 22 bp, Homo sapiens
attctgaagttgcaggagaagc

SEQ ID NO: 7869135 - DNA, 22 bp, Homo sapiens
attctgaagttgcaggagaagc

SEQ ID NO: 7869136 - DNA, 22 bp, Homo sapiens
attctgagaaatgcattgtcag

SEQ ID NO: 7869137 - DNA, 22 bp, Homo sapiens
attctgactttcatctgccttt

SEQ ID NO: 7869138 - DNA, 22 bp, Homo sapiens
attctgagaggcacaatgtgga

SEQ ID NO: 7869139 - DNA, 22 bp, Homo sapiens
attctgagctactaattaggca

SEQ ID NO: 7869140 - DNA, 22 bp, Homo sapiens
attctgagctactaattaggca

SEQ ID NO: 7869141 - DNA, 22 bp, Homo sapiens
attctgagtacaacaagatgtt

SEQ ID NO: 7869142 - DNA, 22 bp, Homo sapiens
attctgaggacagagtctagca

SEQ ID NO: 7869143 - DNA, 21 bp, Homo sapiens
attctgagttgtcagtcttca

SEQ ID NO: 7869144 - DNA, 21 bp, Homo sapiens
attctgagttgtcagtcttca

SEQ ID NO: 7869145 - DNA, 22 bp, Homo sapiens
attctgagttagagtcagccag

SEQ ID NO: 7869146 - DNA, 23 bp, Homo sapiens
attctgagtcagaaagtttgggg

SEQ ID NO: 7869147 - DNA, 22 bp, Homo sapiens
attctgagtacaacaagatgtt

SEQ ID NO: 7869148 - DNA, 22 bp, Homo sapiens
attctgagtccatgggggcagg

SEQ ID NO: 7869149 - DNA, 22 bp, Homo sapiens
gcagctgttcagctggccagat

SEQ ID NO: 7869150 - DNA, 22 bp, Homo sapiens
gcagctgttcagctggccagat

SEQ ID NO: 7869151 - DNA, 22 bp, Homo sapiens
gcagctgtgtaatgagcccaca

SEQ ID NO: 7869152 - DNA, 22 bp, Homo sapiens
gcagctgtgtaatgagcccaca

SEQ ID NO: 7869153 - DNA, 22 bp, Homo sapiens
gcagctgtggtgctgagatagg

SEQ ID NO: 7869154 - DNA, 22 bp, Homo sapiens
gcagctgtggtgctgagatagg

SEQ ID NO: 7869155 - DNA, 22 bp, Homo sapiens
gcagctgtgtaatgagcccaca

SEQ ID NO: 7869156 - DNA, 22 bp, Homo sapiens
gcagctgtgggttccaagtcta

SEQ ID NO: 7869157 - DNA, 22 bp, Homo sapiens
gcagctgtgggcctcggagagc

SEQ ID NO: 7869158 - DNA, 22 bp, Homo sapiens
gcagctgtgggcctcggagagc

SEQ ID NO: 7869159 - DNA, 22 bp, Homo sapiens
gcagctgtgggttccaagtcta

SEQ ID NO: 7869160 - DNA, 22 bp, Homo sapiens
gcagctgtgggcctcggagagc

SEQ ID NO: 7869161 - DNA, 19 bp, Homo sapiens
gcagctgtgggaagagcca

SEQ ID NO: 7869162 - DNA, 19 bp, Homo sapiens
gcagctgtgggaagagcca

SEQ ID NO: 7869163 - DNA, 22 bp, Homo sapiens
attccacttatatgaagtaacg

SEQ ID NO: 7869164 - DNA, 20 bp, Homo sapiens
attccacttatatgaggtcc

SEQ ID NO: 7869165 - DNA, 22 bp, Homo sapiens
attccacataggccttcatgac

SEQ ID NO: 7869166 - DNA, 22 bp, Homo sapiens
attccacataggccttcatgac

SEQ ID NO: 7869167 - DNA, 22 bp, Homo sapiens
attccacagtgtgtggtgagga

SEQ ID NO: 7869168 - DNA, 22 bp, Homo sapiens
attccacagtgccttccgtgaa

SEQ ID NO: 7869169 - DNA, 22 bp, Homo sapiens
attccacagctacatcaatcta

SEQ ID NO: 7869170 - DNA, 22 bp, Homo sapiens
attccacagctacatcaatcta

SEQ ID NO: 7869171 - DNA, 22 bp, Homo sapiens
attccacagaggactccgattg

SEQ ID NO: 7869172 - DNA, 22 bp, Homo sapiens
attccacagccgataccatgac

SEQ ID NO: 7869173 - DNA, 22 bp, Homo sapiens
attccacagccgataccatgac

SEQ ID NO: 7869174 - DNA, 22 bp, Homo sapiens
attccacaggagctggttttct

SEQ ID NO: 7869175 - DNA, 17 bp, Homo sapiens
attccacagggaatctg

SEQ ID NO: 7869176 - DNA, 22 bp, Homo sapiens
attccacagctacgttttgagc

SEQ ID NO: 7869177 - DNA, 22 bp, Homo sapiens
attccacaggactaccaatgtg

SEQ ID NO: 7869178 - DNA, 22 bp, Homo sapiens
attccacagctcagcctctctt

SEQ ID NO: 7869179 - DNA, 22 bp, Homo sapiens
attccacacagtaatactcaat

SEQ ID NO: 7869180 - DNA, 22 bp, Homo sapiens
attccacacagtaatactcaat

SEQ ID NO: 7869181 - DNA, 22 bp, Homo sapiens
attccacaagaccataaattag

SEQ ID NO: 7869182 - DNA, 22 bp, Homo sapiens
attccaaggtctttctagattg

SEQ ID NO: 7869183 - DNA, 22 bp, Homo sapiens
attccaaaggttaatgcccatt

SEQ ID NO: 7869184 - DNA, 22 bp, Homo sapiens
attccaaaggttaatgcccatt

SEQ ID NO: 7869185 - DNA, 22 bp, Homo sapiens
attccacaagaccataaattag

SEQ ID NO: 7869186 - DNA, 22 bp, Homo sapiens
attccaaggtctttctagattg

SEQ ID NO: 7869187 - DNA, 22 bp, Homo sapiens
attccaaagcacatcagaacta

SEQ ID NO: 7869188 - DNA, 22 bp, Homo sapiens
attccaaagcacatcagaacta

SEQ ID NO: 7869189 - DNA, 22 bp, Homo sapiens
attccaaagcacatcagaacta

SEQ ID NO: 7869190 - DNA, 22 bp, Homo sapiens
attccaaagcctgaataatgga

SEQ ID NO: 7869191 - DNA, 22 bp, Homo sapiens
attccaaagacagaagcagctg

SEQ ID NO: 7869192 - DNA, 22 bp, Homo sapiens
attccaaagacagaagcagctg

SEQ ID NO: 7869193 - DNA, 22 bp, Homo sapiens
attccaaagacagaagcagctg

SEQ ID NO: 7869194 - DNA, 22 bp, Homo sapiens
attccaaagcacatcagaacta

SEQ ID NO: 7869195 - DNA, 22 bp, Homo sapiens
attccaaagcacatcagaacta

SEQ ID NO: 7869196 - DNA, 22 bp, Homo sapiens
attccaaagcctgaataatgga

SEQ ID NO: 7869197 - DNA, 22 bp, Homo sapiens
attccaaagcctgaataatgga

SEQ ID NO: 7869198 - DNA, 22 bp, Homo sapiens
attccaaagcctgaataatgga

SEQ ID NO: 7869199 - DNA, 22 bp, Homo sapiens
attccaaagcctgaataatgga

SEQ ID NO: 7869200 - DNA, 22 bp, Homo sapiens
attccaaaggttaatgcccatt

SEQ ID NO: 7869201 - DNA, 22 bp, Homo sapiens
attccaaaggctggcctggagg

SEQ ID NO: 7869202 - DNA, 22 bp, Homo sapiens
attccaaaggctggcctggagg

SEQ ID NO: 7869203 - DNA, 19 bp, Homo sapiens
attcatttttgccttctaa

SEQ ID NO: 7869204 - DNA, 22 bp, Homo sapiens
attcatgcaggattgtctccaa

SEQ ID NO: 7869205 - DNA, 22 bp, Homo sapiens
attccaaaaggatgttagaatg

SEQ ID NO: 7869206 - DNA, 22 bp, Homo sapiens
attcatgaatctacattgtggt

SEQ ID NO: 7869207 - DNA, 19 bp, Homo sapiens
attcatgaaggcttgaagg

SEQ ID NO: 7869208 - DNA, 22 bp, Homo sapiens
attcatgaccccatggttgatt

SEQ ID NO: 7869209 - DNA, 22 bp, Homo sapiens
attcacaagttgatggatattt

SEQ ID NO: 7869210 - DNA, 22 bp, Homo sapiens
attccaaacttaccccagagga

SEQ ID NO: 7869211 - DNA, 22 bp, Homo sapiens
attccaaacttaccccagagga

SEQ ID NO: 7869212 - DNA, 22 bp, Homo sapiens
attccaaacttaccccagagga

SEQ ID NO: 7869213 - DNA, 22 bp, Homo sapiens
attccaaactctttccctgtcg

SEQ ID NO: 7869214 - DNA, 22 bp, Homo sapiens
attccaaactctttccctgtcg

SEQ ID NO: 7869215 - DNA, 22 bp, Homo sapiens
attccaaacgcctcgcggactt

SEQ ID NO: 7869216 - DNA, 22 bp, Homo sapiens
attccaaacagtgctgcagact

SEQ ID NO: 7869217 - DNA, 22 bp, Homo sapiens
attccaaacgcctcgcggactt

SEQ ID NO: 7869218 - DNA, 22 bp, Homo sapiens
attccaaacgcctcgcggactt

SEQ ID NO: 7869219 - DNA, 22 bp, Homo sapiens
attccaaacagtgctgcagact

SEQ ID NO: 7869220 - DNA, 22 bp, Homo sapiens
attccaaacagtgctgcagact

SEQ ID NO: 7869221 - DNA, 22 bp, Homo sapiens
attccaaacagtgctgcagact

SEQ ID NO: 7869222 - DNA, 22 bp, Homo sapiens
attccaaaaggatgttagaatg

SEQ ID NO: 7869223 - DNA, 22 bp, Homo sapiens
attccaaaaggatgttagaatg

SEQ ID NO: 7869224 - DNA, 22 bp, Homo sapiens
attcacaactgatccttgctca

SEQ ID NO: 7869225 - DNA, 22 bp, Homo sapiens
attcacaactgatccttgctca

SEQ ID NO: 7869226 - DNA, 22 bp, Homo sapiens
attcacaaataacaggtgcaga

SEQ ID NO: 7869227 - DNA, 22 bp, Homo sapiens
attcacaaataacaggtgcaga

SEQ ID NO: 7869228 - DNA, 22 bp, Homo sapiens
attcacaaaatgatatagatac

SEQ ID NO: 7869229 - DNA, 22 bp, Homo sapiens
attcacaaaatgatatagatac

SEQ ID NO: 7869230 - DNA, 22 bp, Homo sapiens
attcaatgggggtttctagttg

SEQ ID NO: 7869231 - DNA, 22 bp, Homo sapiens
attcaataagtcactgtggaat

SEQ ID NO: 7869232 - DNA, 22 bp, Homo sapiens
attcaataagtcactgtggaat

SEQ ID NO: 7869233 - DNA, 22 bp, Homo sapiens
attcaataaatatgctacatgg

SEQ ID NO: 7869234 - DNA, 22 bp, Homo sapiens
attcacaaaatgatatagatac

SEQ ID NO: 7869235 - DNA, 22 bp, Homo sapiens
attcaatcccagaaagaaactg

SEQ ID NO: 7869236 - DNA, 22 bp, Homo sapiens
attcacaaagaagggaagtaca

SEQ ID NO: 7869237 - DNA, 20 bp, Homo sapiens
attcacaaagccagtgttgc

SEQ ID NO: 7869238 - DNA, 22 bp, Homo sapiens
aggtctgggcaccactggctgc

SEQ ID NO: 7869239 - DNA, 22 bp, Homo sapiens
aggtctgggattgaagacatca

SEQ ID NO: 7869240 - DNA, 22 bp, Homo sapiens
aggtctgggattgaagacatca

SEQ ID NO: 7869241 - DNA, 22 bp, Homo sapiens
aggtctggtatttttctatact

SEQ ID NO: 7869242 - DNA, 22 bp, Homo sapiens
aggtctggtatttttctatact

SEQ ID NO: 7869243 - DNA, 22 bp, Homo sapiens
aggtctgggcaccactggctgc

SEQ ID NO: 7869244 - DNA, 22 bp, Homo sapiens
aggtctgggcaccactggctgc

SEQ ID NO: 7869245 - DNA, 22 bp, Homo sapiens
aggtctgggcaccactggctgc

SEQ ID NO: 7869246 - DNA, 22 bp, Homo sapiens
aggtctggtgagagcaggtgct

SEQ ID NO: 7869247 - DNA, 22 bp, Homo sapiens
aggtctggtgggctttagattg

SEQ ID NO: 7869248 - DNA, 22 bp, Homo sapiens
aggtctggtgagagcaggtgct

SEQ ID NO: 7869249 - DNA, 22 bp, Homo sapiens
aggtctggaggcggagtcagga

SEQ ID NO: 7869250 - DNA, 22 bp, Homo sapiens
aggtctggaggcggagtcagga

SEQ ID NO: 7869251 - DNA, 22 bp, Homo sapiens
aggtctggaggcggagtcagga

SEQ ID NO: 7869252 - DNA, 22 bp, Homo sapiens
aggtctggctcttctccacaga

SEQ ID NO: 7869253 - DNA, 22 bp, Homo sapiens
aggtctgggagttcattccctg

SEQ ID NO: 7869254 - DNA, 22 bp, Homo sapiens
aggtctgggagttcattccctg

SEQ ID NO: 7869255 - DNA, 22 bp, Homo sapiens
aggtctggagtgggatctgaga

SEQ ID NO: 7869256 - DNA, 22 bp, Homo sapiens
aggtgagggtgccagtgcatgg

SEQ ID NO: 7869257 - DNA, 22 bp, Homo sapiens
aggtgagggtgccagtgcatgg

SEQ ID NO: 7869258 - DNA, 22 bp, Homo sapiens
aggtgagggtgccagtgcatgg

SEQ ID NO: 7869259 - DNA, 19 bp, Homo sapiens
aggtgaggggcaccatgtc

SEQ ID NO: 7869260 - DNA, 19 bp, Homo sapiens
aggtgaggggcaccatgtc

SEQ ID NO: 7869261 - DNA, 22 bp, Homo sapiens
aggtgaggtttgggaggtgtca

SEQ ID NO: 7869262 - DNA, 22 bp, Homo sapiens
aggtgaggtttgggaggtgtca

SEQ ID NO: 7869263 - DNA, 22 bp, Homo sapiens
aggtgaggtttgggaggtgtca

SEQ ID NO: 7869264 - DNA, 22 bp, Homo sapiens
aggtgaggtttgggaggtgtca

SEQ ID NO: 7869265 - DNA, 22 bp, Homo sapiens
aggtgagggtgccagtgcatgg

SEQ ID NO: 7869266 - DNA, 22 bp, Homo sapiens
aggtctggtgttgggcctgaaa

SEQ ID NO: 7869267 - DNA, 22 bp, Homo sapiens
aggtctggtgttgatgaattcc

SEQ ID NO: 7869268 - DNA, 22 bp, Homo sapiens
aggtctggtgttgggcctgaaa

SEQ ID NO: 7869269 - DNA, 22 bp, Homo sapiens
aggtctgtctggccccatgaat

SEQ ID NO: 7869270 - DNA, 22 bp, Homo sapiens
aggtctgtcaaactgtcagtga

SEQ ID NO: 7869271 - DNA, 22 bp, Homo sapiens
aggtctggtgttgggcctgaaa

SEQ ID NO: 7869272 - DNA, 18 bp, Homo sapiens
aggtctgtggtcaccagg

SEQ ID NO: 7869273 - DNA, 18 bp, Homo sapiens
aggtctgtggtcaccagg

SEQ ID NO: 7869274 - DNA, 18 bp, Homo sapiens
aggtctgtggtcaccagg

SEQ ID NO: 7869275 - DNA, 19 bp, Homo sapiens
aggtgaggggcaccatgtc

SEQ ID NO: 7869276 - DNA, 22 bp, Homo sapiens
aggtctgttagcatgttgacta

SEQ ID NO: 7869277 - DNA, 19 bp, Homo sapiens
aggtgaggggcaccatgtc

SEQ ID NO: 7869278 - DNA, 22 bp, Homo sapiens
aggtctgtgaattcctgagaaa

SEQ ID NO: 7869279 - DNA, 22 bp, Homo sapiens
aggtctgtctggccccatgaat

SEQ ID NO: 7869280 - DNA, 19 bp, Homo sapiens
aggtctgcagctgcagttt

SEQ ID NO: 7869281 - DNA, 19 bp, Homo sapiens
aggtctgcagctgcagttt

SEQ ID NO: 7869282 - DNA, 22 bp, Homo sapiens
aggtctgcctcactcacttctg

SEQ ID NO: 7869283 - DNA, 23 bp, Homo sapiens
aggtctggacccttggcccctgc

SEQ ID NO: 7869284 - DNA, 20 bp, Homo sapiens
aggtctgattccagaatcag

SEQ ID NO: 7869285 - DNA, 20 bp, Homo sapiens
aggtctgattccagaatcag

SEQ ID NO: 7869286 - DNA, 22 bp, Homo sapiens
aggtctgagtttgttgttggct

SEQ ID NO: 7869287 - DNA, 22 bp, Homo sapiens
aggtctgagtcccaggggtacc

SEQ ID NO: 7869288 - DNA, 22 bp, Homo sapiens
aggtctgagtatggcctgagaa

SEQ ID NO: 7869289 - DNA, 22 bp, Homo sapiens
aggtctgagtatggcctgagaa

SEQ ID NO: 7869290 - DNA, 22 bp, Homo sapiens
aggtctgagtatggcctgagaa

SEQ ID NO: 7869291 - DNA, 22 bp, Homo sapiens
aggtctgagtatggcctgagaa

SEQ ID NO: 7869292 - DNA, 22 bp, Homo sapiens
aggtctgagtatggcctgagaa

SEQ ID NO: 7869293 - DNA, 22 bp, Homo sapiens
aggtctgagtatggcctgagaa

SEQ ID NO: 7869294 - DNA, 18 bp, Homo sapiens
aggtctgaggaagagcct

SEQ ID NO: 7869295 - DNA, 22 bp, Homo sapiens
aggtctgagtagagaaaaggca

SEQ ID NO: 7869296 - DNA, 22 bp, Homo sapiens
aggtctgagtagagaaaaggca

SEQ ID NO: 7869297 - DNA, 18 bp, Homo sapiens
aggtctgaggaagagcct

SEQ ID NO: 7869298 - DNA, 22 bp, Homo sapiens
aggtctgagctccttcctctga

SEQ ID NO: 7869299 - DNA, 22 bp, Homo sapiens
aggtctgagctcagggcctggc

SEQ ID NO: 7869300 - DNA, 22 bp, Homo sapiens
aggtctgagcaggggagaacag

SEQ ID NO: 7869301 - DNA, 22 bp, Homo sapiens
aggtctgagctcagggcctggc

SEQ ID NO: 7869302 - DNA, 22 bp, Homo sapiens
aggtcctgtctatcaccctcgc

SEQ ID NO: 7869303 - DNA, 22 bp, Homo sapiens
aggtctcttgctgtctctgggc

SEQ ID NO: 7869304 - DNA, 22 bp, Homo sapiens
aggtctcttgctgtctctgggc

SEQ ID NO: 7869305 - DNA, 22 bp, Homo sapiens
aggtcctgtccttggtctctga

SEQ ID NO: 7869306 - DNA, 22 bp, Homo sapiens
aggtcctgtccttggtctctga

SEQ ID NO: 7869307 - DNA, 22 bp, Homo sapiens
aggtcctgtccttggtctctga

SEQ ID NO: 7869308 - DNA, 22 bp, Homo sapiens
aggtctgactctttgccacata

SEQ ID NO: 7869309 - DNA, 20 bp, Homo sapiens
aggtctgaatgtcagggctg

SEQ ID NO: 7869310 - DNA, 20 bp, Homo sapiens
aggtctgaatgtcagggctg

SEQ ID NO: 7869311 - DNA, 22 bp, Homo sapiens
aggtctgacttcaagcctgtgg

SEQ ID NO: 7869312 - DNA, 17 bp, Homo sapiens
aggtctgagagtatctg

SEQ ID NO: 7869313 - DNA, 22 bp, Homo sapiens
aggtatgccaattaggtcaagt

SEQ ID NO: 7869314 - DNA, 22 bp, Homo sapiens
aggtatgagcctctgcacccag

SEQ ID NO: 7869315 - DNA, 22 bp, Homo sapiens
aggtatgagataaatcaatgaa

SEQ ID NO: 7869316 - DNA, 22 bp, Homo sapiens
aggtatgagagccactctgtag

SEQ ID NO: 7869317 - DNA, 22 bp, Homo sapiens
aggtatggcataaatcacaggg

SEQ ID NO: 7869318 - DNA, 22 bp, Homo sapiens
aggtatggcataaatcacaggg

SEQ ID NO: 7869319 - DNA, 22 bp, Homo sapiens
aggtatgtatgtgtgtatattt

SEQ ID NO: 7869320 - DNA, 22 bp, Homo sapiens
aggtatgtatgtgtgtatattt

SEQ ID NO: 7869321 - DNA, 22 bp, Homo sapiens
aggtatgtgctattgttatatt

SEQ ID NO: 7869322 - DNA, 22 bp, Homo sapiens
aggtattcagagagatgctttt

SEQ ID NO: 7869323 - DNA, 22 bp, Homo sapiens
aggtattcagagagatgctttt

SEQ ID NO: 7869324 - DNA, 22 bp, Homo sapiens
aggtattattagcatctctatt

SEQ ID NO: 7869325 - DNA, 22 bp, Homo sapiens
aggtattatgctgctgaatgct

SEQ ID NO: 7869326 - DNA, 21 bp, Homo sapiens
aggtatgttgagaactgagga

SEQ ID NO: 7869327 - DNA, 22 bp, Homo sapiens
aggtatgcatttttactttagg

SEQ ID NO: 7869328 - DNA, 22 bp, Homo sapiens
aggtatgtggttccatgatgag

SEQ ID NO: 7869329 - DNA, 22 bp, Homo sapiens
aggtgcttggctcgtgcacaca

SEQ ID NO: 7869330 - DNA, 22 bp, Homo sapiens
aggtggagatcagggactaagg

SEQ ID NO: 7869331 - DNA, 23 bp, Homo sapiens
aggtggagctgtgcagccggggc

SEQ ID NO: 7869332 - DNA, 23 bp, Homo sapiens
aggtggagctgtgcagccggggc

SEQ ID NO: 7869333 - DNA, 23 bp, Homo sapiens
aggtggagctgtgcagccggggc

SEQ ID NO: 7869334 - DNA, 22 bp, Homo sapiens
aggtggagtgaaggaaaggcag

SEQ ID NO: 7869335 - DNA, 22 bp, Homo sapiens
aggtggagtgaaggaaaggcag

SEQ ID NO: 7869336 - DNA, 22 bp, Homo sapiens
aggtggagtgaaggaaaggcag

SEQ ID NO: 7869337 - DNA, 22 bp, Homo sapiens
aggtggagtgaaggaaaggcag

SEQ ID NO: 7869338 - DNA, 22 bp, Homo sapiens
aggtggagtgaaggaaaggcag

SEQ ID NO: 7869339 - DNA, 22 bp, Homo sapiens
aggtggagtgaaggaaaggcag

SEQ ID NO: 7869340 - DNA, 22 bp, Homo sapiens
aggtggagtgaaggaaaggcag

SEQ ID NO: 7869341 - DNA, 22 bp, Homo sapiens
aggtggagtgtgcagggagagc

SEQ ID NO: 7869342 - DNA, 22 bp, Homo sapiens
aggtggagtgtgcagggagagc

SEQ ID NO: 7869343 - DNA, 22 bp, Homo sapiens
aggtggagtgtgcagggagagc

SEQ ID NO: 7869344 - DNA, 22 bp, Homo sapiens
aggtggagtgtgcagggagagc

SEQ ID NO: 7869345 - DNA, 21 bp, Homo sapiens
aggtggagtgcttagcatcca

SEQ ID NO: 7869346 - DNA, 21 bp, Homo sapiens
aggtggagtgcttagcatcca

SEQ ID NO: 7869347 - DNA, 21 bp, Homo sapiens
aggtggagtgcttagcatcca

SEQ ID NO: 7869348 - DNA, 22 bp, Homo sapiens
aggtggagtgtgcagggagagc

SEQ ID NO: 7869349 - DNA, 22 bp, Homo sapiens
aggtggagtgtgcagggagagc

SEQ ID NO: 7869350 - DNA, 22 bp, Homo sapiens
aggtggagtgtgcagggagagc

SEQ ID NO: 7869351 - DNA, 22 bp, Homo sapiens
aggtggagtgtgcagggagagc

SEQ ID NO: 7869352 - DNA, 22 bp, Homo sapiens
aggtggagtgtgcagggagagc

SEQ ID NO: 7869353 - DNA, 23 bp, Homo sapiens
cctgggtttcagagctgcttttc

SEQ ID NO: 7869354 - DNA, 22 bp, Homo sapiens
cctggtcacccctctctctgca

SEQ ID NO: 7869355 - DNA, 22 bp, Homo sapiens
cctggtcagagcagtcaggatc

SEQ ID NO: 7869356 - DNA, 22 bp, Homo sapiens
cctggtcagagcagtcaggatc

SEQ ID NO: 7869357 - DNA, 22 bp, Homo sapiens
cctggtcagagcagtcaggatc

SEQ ID NO: 7869358 - DNA, 22 bp, Homo sapiens
cctggtcaggtaactgggctga

SEQ ID NO: 7869359 - DNA, 22 bp, Homo sapiens
cctggtcaggtaactgggctga

SEQ ID NO: 7869360 - DNA, 22 bp, Homo sapiens
cctggtcaggtaactgggctga

SEQ ID NO: 7869361 - DNA, 22 bp, Homo sapiens
cctggtcccattgcggctgcct

SEQ ID NO: 7869362 - DNA, 22 bp, Homo sapiens
cctggtccccatcggcccagcg

SEQ ID NO: 7869363 - DNA, 22 bp, Homo sapiens
aggtggagttaagtgtgaactg

SEQ ID NO: 7869364 - DNA, 22 bp, Homo sapiens
aggtggagttaagtgtgaactg

SEQ ID NO: 7869365 - DNA, 22 bp, Homo sapiens
aggtggagttaagtgtgaactg

SEQ ID NO: 7869366 - DNA, 22 bp, Homo sapiens
aggtggagttaagtgtgaactg

SEQ ID NO: 7869367 - DNA, 22 bp, Homo sapiens
aggtggagttggctgtagttca

SEQ ID NO: 7869368 - DNA, 22 bp, Homo sapiens
aggtggagttggctgtagttca

SEQ ID NO: 7869369 - DNA, 22 bp, Homo sapiens
aggtggatctgacagaaatgaa

SEQ ID NO: 7869370 - DNA, 22 bp, Homo sapiens
aggtggatcacctgacgtcagg

SEQ ID NO: 7869371 - DNA, 22 bp, Homo sapiens
cctgggtgtcatgggcagctgg

SEQ ID NO: 7869372 - DNA, 22 bp, Homo sapiens
cctgggtgtcatgggcagctgg

SEQ ID NO: 7869373 - DNA, 20 bp, Homo sapiens
aggtgcaaggcatggcatgt

SEQ ID NO: 7869374 - DNA, 19 bp, Homo sapiens
aggtgatgtgactctagaa

SEQ ID NO: 7869375 - DNA, 19 bp, Homo sapiens
aggtgatgtgactctagaa

SEQ ID NO: 7869376 - DNA, 22 bp, Homo sapiens
aggtgatgtccacagcttgcag

SEQ ID NO: 7869377 - DNA, 22 bp, Homo sapiens
aggtgataagtgttaaataaag

SEQ ID NO: 7869378 - DNA, 22 bp, Homo sapiens
aggtgagttacaggaggaggtc

SEQ ID NO: 7869379 - DNA, 22 bp, Homo sapiens
aggtgagttggtaggaagtttg

SEQ ID NO: 7869380 - DNA, 22 bp, Homo sapiens
aggtgagtcctgggcacaggta

SEQ ID NO: 7869381 - DNA, 22 bp, Homo sapiens
aggtgagtgtggctccacttcc

SEQ ID NO: 7869382 - DNA, 22 bp, Homo sapiens
aggtgagttacaggaggaggtc

SEQ ID NO: 7869383 - DNA, 22 bp, Homo sapiens
cctgggcaggatgggcccggtg

SEQ ID NO: 7869384 - DNA, 22 bp, Homo sapiens
cctgggcaggatgggcccggtg

SEQ ID NO: 7869385 - DNA, 22 bp, Homo sapiens
cctgggcagcctgctcaaggac

SEQ ID NO: 7869386 - DNA, 21 bp, Homo sapiens
aggtgcagagccagggaccag

SEQ ID NO: 7869387 - DNA, 21 bp, Homo sapiens
aggtgcagagccagggaccag

SEQ ID NO: 7869388 - DNA, 21 bp, Homo sapiens
aggtgcagagccagggaccag

SEQ ID NO: 7869389 - DNA, 21 bp, Homo sapiens
aggtgcagagccagggaccag

SEQ ID NO: 7869390 - DNA, 21 bp, Homo sapiens
aggtgcagagccagggaccag

SEQ ID NO: 7869391 - DNA, 21 bp, Homo sapiens
aggtgcagagccagggaccag

SEQ ID NO: 7869392 - DNA, 23 bp, Homo sapiens
aggtgcactgtggtggcagtggc

SEQ ID NO: 7869393 - DNA, 22 bp, Homo sapiens
aggtgcacctgagggtgtcatc

SEQ ID NO: 7869394 - DNA, 22 bp, Homo sapiens
cctgggcaggtgtggcttcccc

SEQ ID NO: 7869395 - DNA, 22 bp, Homo sapiens
cctgggcaggtgtggcttcccc

SEQ ID NO: 7869396 - DNA, 22 bp, Homo sapiens
cctgggcaggtgtggcttcccc

SEQ ID NO: 7869397 - DNA, 22 bp, Homo sapiens
cctgggcaggtgtggcttcccc

SEQ ID NO: 7869398 - DNA, 22 bp, Homo sapiens
cctgggcagggctggactctca

SEQ ID NO: 7869399 - DNA, 22 bp, Homo sapiens
cctgggcagtgctggagttgaa

SEQ ID NO: 7869400 - DNA, 22 bp, Homo sapiens
cctgggcagtgctggagttgaa

SEQ ID NO: 7869401 - DNA, 22 bp, Homo sapiens
cctgggcataaatcactccaag

SEQ ID NO: 7869402 - DNA, 22 bp, Homo sapiens
aggtgcttccaggagacaaggt

SEQ ID NO: 7869403 - DNA, 22 bp, Homo sapiens
cctgggcagtgctggagttgaa

SEQ ID NO: 7869404 - DNA, 22 bp, Homo sapiens
cctgggcagtgctggagttgaa

SEQ ID NO: 7869405 - DNA, 22 bp, Homo sapiens
cctgggcagtgctggagttgaa

SEQ ID NO: 7869406 - DNA, 22 bp, Homo sapiens
cctgggcaggccggacgctggg

SEQ ID NO: 7869407 - DNA, 22 bp, Homo sapiens
cctgggcagggagaccaggctc

SEQ ID NO: 7869408 - DNA, 22 bp, Homo sapiens
cctgggcaggatgggcccggtg

SEQ ID NO: 7869409 - DNA, 22 bp, Homo sapiens
cctgggcaggccggacgctggg

SEQ ID NO: 7869410 - DNA, 22 bp, Homo sapiens
cctgggcaggccggacgctggg

SEQ ID NO: 7869411 - DNA, 22 bp, Homo sapiens
cctgggcaggccggacgctggg

SEQ ID NO: 7869412 - DNA, 22 bp, Homo sapiens
cctgggcagggagaccaggctc

SEQ ID NO: 7869413 - DNA, 22 bp, Homo sapiens
cctgggcagggagaccaggctc

SEQ ID NO: 7869414 - DNA, 22 bp, Homo sapiens
cctgggcagggagaccaggctc

SEQ ID NO: 7869415 - DNA, 22 bp, Homo sapiens
cctgggcagggctggactctca

SEQ ID NO: 7869416 - DNA, 22 bp, Homo sapiens
cctgggcagggctggactctca

SEQ ID NO: 7869417 - DNA, 22 bp, Homo sapiens
aggtataagaagattatttata

SEQ ID NO: 7869418 - DNA, 22 bp, Homo sapiens
aggtataagaagattatttata

SEQ ID NO: 7869419 - DNA, 22 bp, Homo sapiens
aggtataagtctcatttctgtt

SEQ ID NO: 7869420 - DNA, 22 bp, Homo sapiens
aggtatatattctggtccttat

SEQ ID NO: 7869421 - DNA, 18 bp, Homo sapiens
aggtataagtgatctgct

SEQ ID NO: 7869422 - DNA, 22 bp, Homo sapiens
aggtataagtctcatttctgtt

SEQ ID NO: 7869423 - DNA, 22 bp, Homo sapiens
aggtatatgaagatgaaataac

SEQ ID NO: 7869424 - DNA, 22 bp, Homo sapiens
aggtatcaacagcagagtctga

SEQ ID NO: 7869425 - DNA, 22 bp, Homo sapiens
aggtatattttgtatatactct

SEQ ID NO: 7869426 - DNA, 22 bp, Homo sapiens
aggtatctggtaagaggcagac

SEQ ID NO: 7869427 - DNA, 22 bp, Homo sapiens
aggtatctggtaagaggcagac

SEQ ID NO: 7869428 - DNA, 22 bp, Homo sapiens
aggtatattttgtatatactct

SEQ ID NO: 7869429 - DNA, 22 bp, Homo sapiens
aggtatattgaatgcttactta

SEQ ID NO: 7869430 - DNA, 22 bp, Homo sapiens
aggtatatgttcatgtatgtgt

SEQ ID NO: 7869431 - DNA, 22 bp, Homo sapiens
cctggctcaggcacgcatggct

SEQ ID NO: 7869432 - DNA, 22 bp, Homo sapiens
cctggctcaggcacgcatggct

SEQ ID NO: 7869433 - DNA, 22 bp, Homo sapiens
cctggctcaggcacgcatggct

SEQ ID NO: 7869434 - DNA, 22 bp, Homo sapiens
cctggctcagtgttgaaggggt

SEQ ID NO: 7869435 - DNA, 22 bp, Homo sapiens
cctggctcagtgttgaaggggt

SEQ ID NO: 7869436 - DNA, 22 bp, Homo sapiens
cctggctcattatgtgccccca

SEQ ID NO: 7869437 - DNA, 22 bp, Homo sapiens
cctggctcattatgtgccccca

SEQ ID NO: 7869438 - DNA, 22 bp, Homo sapiens
cctggctcattatgtgccccca

SEQ ID NO: 7869439 - DNA, 22 bp, Homo sapiens
cctggctccaaagctgtgactc

SEQ ID NO: 7869440 - DNA, 22 bp, Homo sapiens
cctggctccaaagctgtgactc

SEQ ID NO: 7869441 - DNA, 22 bp, Homo sapiens
cctggctcattatgtgccccca

SEQ ID NO: 7869442 - DNA, 17 bp, Homo sapiens
aggtataaaatggtagc

SEQ ID NO: 7869443 - DNA, 17 bp, Homo sapiens
aggtataaaatggtagc

SEQ ID NO: 7869444 - DNA, 22 bp, Homo sapiens
cctggctaggagagctgggctc

SEQ ID NO: 7869445 - DNA, 22 bp, Homo sapiens
cctggctaggagagctgggctc

SEQ ID NO: 7869446 - DNA, 22 bp, Homo sapiens
cctggctcaaggcgaggactcc

SEQ ID NO: 7869447 - DNA, 22 bp, Homo sapiens
cctggctcaaggcgaggactcc

SEQ ID NO: 7869448 - DNA, 22 bp, Homo sapiens
cctggcctttgaacgctagact

SEQ ID NO: 7869449 - DNA, 22 bp, Homo sapiens
cctggcctttgaacgctagact

SEQ ID NO: 7869450 - DNA, 22 bp, Homo sapiens
cctggccttaagggcagggagc

SEQ ID NO: 7869451 - DNA, 22 bp, Homo sapiens
cctggctcaaggcgaggactcc

SEQ ID NO: 7869452 - DNA, 22 bp, Homo sapiens
cctggctcaaggcgaggactcc

SEQ ID NO: 7869453 - DNA, 22 bp, Homo sapiens
cctggctcaaggcgaggactcc

SEQ ID NO: 7869454 - DNA, 22 bp, Homo sapiens
cctggctcaaggcgaggactcc

SEQ ID NO: 7869455 - DNA, 23 bp, Homo sapiens
cctggctcaccccttatgtccag

SEQ ID NO: 7869456 - DNA, 23 bp, Homo sapiens
cctggctcaccccttatgtccag

SEQ ID NO: 7869457 - DNA, 22 bp, Homo sapiens
cctggctcaaggcgaggactcc

SEQ ID NO: 7869458 - DNA, 23 bp, Homo sapiens
cctggctcaccccttatgtccag

SEQ ID NO: 7869459 - DNA, 22 bp, Homo sapiens
cctggctcagaccccagttctg

SEQ ID NO: 7869460 - DNA, 22 bp, Homo sapiens
cctggctcagaccccagttctg

SEQ ID NO: 7869461 - DNA, 22 bp, Homo sapiens
cctggctcagagtatgtcatcg

SEQ ID NO: 7869462 - DNA, 22 bp, Homo sapiens
cctggctcagaccccagttctg

SEQ ID NO: 7869463 - DNA, 22 bp, Homo sapiens
cctggctcagaccccagttctg

SEQ ID NO: 7869464 - DNA, 23 bp, Homo sapiens
cctggctcaccccttatgtccag

SEQ ID NO: 7869465 - DNA, 22 bp, Homo sapiens
cctggctcagcagctctttctc

SEQ ID NO: 7869466 - DNA, 22 bp, Homo sapiens
cctggctcagagtatgtcatcg

SEQ ID NO: 7869467 - DNA, 22 bp, Homo sapiens
cctggctcagcagctctttctc

SEQ ID NO: 7869468 - DNA, 22 bp, Homo sapiens
cctggctcaggcacgcatggct

SEQ ID NO: 7869469 - DNA, 22 bp, Homo sapiens
cctggctcaggcacgcatggct

SEQ ID NO: 7869470 - DNA, 22 bp, Homo sapiens
cctggctcaggcacgcatggct

SEQ ID NO: 7869471 - DNA, 22 bp, Homo sapiens
cctggccagcagccccttcctc

SEQ ID NO: 7869472 - DNA, 22 bp, Homo sapiens
cctggccagccagggctggggt

SEQ ID NO: 7869473 - DNA, 22 bp, Homo sapiens
cctggccagccagggctggggt

SEQ ID NO: 7869474 - DNA, 22 bp, Homo sapiens
cctggccttaagggcagggagc

SEQ ID NO: 7869475 - DNA, 22 bp, Homo sapiens
cctggccttaagggcagggagc

SEQ ID NO: 7869476 - DNA, 22 bp, Homo sapiens
cctggccttaagggcagggagc

SEQ ID NO: 7869477 - DNA, 22 bp, Homo sapiens
cctggccttaagggcagggagc

SEQ ID NO: 7869478 - DNA, 22 bp, Homo sapiens
cctggccttaagggcagggagc

SEQ ID NO: 7869479 - DNA, 22 bp, Homo sapiens
cctggccagcagccccttcctc

SEQ ID NO: 7869480 - DNA, 23 bp, Homo sapiens
agggtggcttgctttgcttcctt

SEQ ID NO: 7869481 - DNA, 23 bp, Homo sapiens
agggtggcttgctttgcttcctt

SEQ ID NO: 7869482 - DNA, 22 bp, Homo sapiens
agggtggcttaattccaaaggg

SEQ ID NO: 7869483 - DNA, 22 bp, Homo sapiens
agggtggctgtgaagtgcttgg

SEQ ID NO: 7869484 - DNA, 22 bp, Homo sapiens
agggtggctgtgaagtgcttgg

SEQ ID NO: 7869485 - DNA, 22 bp, Homo sapiens
agggtggcttaattccaaaggg

SEQ ID NO: 7869486 - DNA, 22 bp, Homo sapiens
agggtggctgagtagatggaag

SEQ ID NO: 7869487 - DNA, 22 bp, Homo sapiens
agggtggctggaggaatcagaa

SEQ ID NO: 7869488 - DNA, 22 bp, Homo sapiens
agggtggctggaggaatcagaa

SEQ ID NO: 7869489 - DNA, 22 bp, Homo sapiens
agggtggctggaggaatcagaa

SEQ ID NO: 7869490 - DNA, 22 bp, Homo sapiens
agggtggctggaggaatcagaa

SEQ ID NO: 7869491 - DNA, 22 bp, Homo sapiens
agggtggctgtgaagtgcttgg

SEQ ID NO: 7869492 - DNA, 22 bp, Homo sapiens
agggtggctgtgaagtgcttgg

SEQ ID NO: 7869493 - DNA, 21 bp, Homo sapiens
agggtggctctgggtcagaac

SEQ ID NO: 7869494 - DNA, 21 bp, Homo sapiens
agggtggctctgggtcagaac

SEQ ID NO: 7869495 - DNA, 21 bp, Homo sapiens
agggtggctctgggtcagaac

SEQ ID NO: 7869496 - DNA, 21 bp, Homo sapiens
agggtggctctgggtcagaac

SEQ ID NO: 7869497 - DNA, 22 bp, Homo sapiens
agggtggctgagtagatggaag

SEQ ID NO: 7869498 - DNA, 22 bp, Homo sapiens
agggtggctgagtagatggaag

SEQ ID NO: 7869499 - DNA, 21 bp, Homo sapiens
agggtggctctgggtcagaac

SEQ ID NO: 7869500 - DNA, 22 bp, Homo sapiens
cctggagcccctctggccagcc

SEQ ID NO: 7869501 - DNA, 20 bp, Homo sapiens
cctggagcctggaaggagtc

SEQ ID NO: 7869502 - DNA, 20 bp, Homo sapiens
cctggagcctggaaggagtc

SEQ ID NO: 7869503 - DNA, 22 bp, Homo sapiens
cctggagcgcgggtcaagctgg

SEQ ID NO: 7869504 - DNA, 22 bp, Homo sapiens
cctggagcgcgggtcaagctgg

SEQ ID NO: 7869505 - DNA, 22 bp, Homo sapiens
cctggagcgcgggtcaagctgg

SEQ ID NO: 7869506 - DNA, 20 bp, Homo sapiens
cctggagcctggaaggagtc

SEQ ID NO: 7869507 - DNA, 22 bp, Homo sapiens
cctggagcccctctggccagcc

SEQ ID NO: 7869508 - DNA, 22 bp, Homo sapiens
cctggagcccctctggccagcc

SEQ ID NO: 7869509 - DNA, 22 bp, Homo sapiens
cctggagcccctctggccagcc

SEQ ID NO: 7869510 - DNA, 22 bp, Homo sapiens
cctggagcccctctggccagcc

SEQ ID NO: 7869511 - DNA, 22 bp, Homo sapiens
cctggagcccctctggccagcc

SEQ ID NO: 7869512 - DNA, 22 bp, Homo sapiens
agggtggccaccaagtatgtca

SEQ ID NO: 7869513 - DNA, 22 bp, Homo sapiens
agggtggcagttactggagcaa

SEQ ID NO: 7869514 - DNA, 22 bp, Homo sapiens
cctggagctcactgggagccgg

SEQ ID NO: 7869515 - DNA, 22 bp, Homo sapiens
cctggagctcactgggagccgg

SEQ ID NO: 7869516 - DNA, 22 bp, Homo sapiens
cctggagctcactgggagccgg

SEQ ID NO: 7869517 - DNA, 22 bp, Homo sapiens
agggtggccatgagggagagat

SEQ ID NO: 7869518 - DNA, 22 bp, Homo sapiens
agggtggccatgagggagagat

SEQ ID NO: 7869519 - DNA, 22 bp, Homo sapiens
agggtggccccactttggttgg

SEQ ID NO: 7869520 - DNA, 20 bp, Homo sapiens
agggtggcaagttagtgaca

SEQ ID NO: 7869521 - DNA, 19 bp, Homo sapiens
agggtggcaaaggagggtg

SEQ ID NO: 7869522 - DNA, 19 bp, Homo sapiens
agggtggcaaaggagggtg

SEQ ID NO: 7869523 - DNA, 19 bp, Homo sapiens
agggtggcaaaggagggtg

SEQ ID NO: 7869524 - DNA, 22 bp, Homo sapiens
agggtggcaccacatatcatag

SEQ ID NO: 7869525 - DNA, 22 bp, Homo sapiens
agggtggcaccacatatcatag

SEQ ID NO: 7869526 - DNA, 22 bp, Homo sapiens
agggtggcaccacatatcatag

SEQ ID NO: 7869527 - DNA, 22 bp, Homo sapiens
agggtggcacctggaagggatg

SEQ ID NO: 7869528 - DNA, 22 bp, Homo sapiens
agggtggcacctggaagggatg

SEQ ID NO: 7869529 - DNA, 22 bp, Homo sapiens
cctgcctgcgtcctctgagggc

SEQ ID NO: 7869530 - DNA, 22 bp, Homo sapiens
cctgcctgcgtcctctgagggc

SEQ ID NO: 7869531 - DNA, 22 bp, Homo sapiens
cctgcctgcgtcctctgagggc

SEQ ID NO: 7869532 - DNA, 22 bp, Homo sapiens
cctgcctgcggcccgcggggag

SEQ ID NO: 7869533 - DNA, 22 bp, Homo sapiens
agggtggcagttactggagcaa

SEQ ID NO: 7869534 - DNA, 22 bp, Homo sapiens
agggtggcagttactggagcaa

SEQ ID NO: 7869535 - DNA, 22 bp, Homo sapiens
agggtggcagttactggagcaa

SEQ ID NO: 7869536 - DNA, 22 bp, Homo sapiens
agggtggcagttactggagcaa

SEQ ID NO: 7869537 - DNA, 22 bp, Homo sapiens
agggtggcactggtggctctat

SEQ ID NO: 7869538 - DNA, 22 bp, Homo sapiens
agggtggcactggtggctctat

SEQ ID NO: 7869539 - DNA, 22 bp, Homo sapiens
agggtggcactggtggctctat

SEQ ID NO: 7869540 - DNA, 22 bp, Homo sapiens
agggtggcactggtggctctat

SEQ ID NO: 7869541 - DNA, 22 bp, Homo sapiens
aggggcttgtggagttgctggt

SEQ ID NO: 7869542 - DNA, 22 bp, Homo sapiens
aggggcttcccttcctgggtag

SEQ ID NO: 7869543 - DNA, 22 bp, Homo sapiens
aggggctgtggaaaccaactct

SEQ ID NO: 7869544 - DNA, 22 bp, Homo sapiens
aggggctgtggaaaccaactct

SEQ ID NO: 7869545 - DNA, 22 bp, Homo sapiens
aggggctttggtgctggtcctg

SEQ ID NO: 7869546 - DNA, 23 bp, Homo sapiens
agggtgagcaagctatggagacc

SEQ ID NO: 7869547 - DNA, 23 bp, Homo sapiens
agggtgagcaagctatggagacc

SEQ ID NO: 7869548 - DNA, 23 bp, Homo sapiens
agggtgagcaagctatggagacc

SEQ ID NO: 7869549 - DNA, 22 bp, Homo sapiens
agggtggaagatggcactatct

SEQ ID NO: 7869550 - DNA, 22 bp, Homo sapiens
agggtgctgccggacaggtggg

SEQ ID NO: 7869551 - DNA, 22 bp, Homo sapiens
agggtggaagatggcactatct

SEQ ID NO: 7869552 - DNA, 19 bp, Homo sapiens
agggtggcaaaggagggtg

SEQ ID NO: 7869553 - DNA, 22 bp, Homo sapiens
agggtgctctggaaaatgtagt

SEQ ID NO: 7869554 - DNA, 22 bp, Homo sapiens
agggtggaagatggcactatct

SEQ ID NO: 7869555 - DNA, 23 bp, Homo sapiens
agggtgagcaagctatggagacc

SEQ ID NO: 7869556 - DNA, 22 bp, Homo sapiens
agggtgctaatctcattcacat

SEQ ID NO: 7869557 - DNA, 22 bp, Homo sapiens
agggtgcgttctatgagaatct

SEQ ID NO: 7869558 - DNA, 19 bp, Homo sapiens
agggtgctaatcccattca

SEQ ID NO: 7869559 - DNA, 18 bp, Homo sapiens
cctggacctgtctccttt

SEQ ID NO: 7869560 - DNA, 22 bp, Homo sapiens
cctgcctggctgtcagcagagc

SEQ ID NO: 7869561 - DNA, 21 bp, Homo sapiens
cctggactaaaaccaggccac

SEQ ID NO: 7869562 - DNA, 18 bp, Homo sapiens
cctggacctgtctccttt

SEQ ID NO: 7869563 - DNA, 21 bp, Homo sapiens
cctggactaaaaccaggccac

SEQ ID NO: 7869564 - DNA, 22 bp, Homo sapiens
cctggagcaggagctgcagagg

SEQ ID NO: 7869565 - DNA, 22 bp, Homo sapiens
cctggagcaggagctgcagagg

SEQ ID NO: 7869566 - DNA, 22 bp, Homo sapiens
cctggagcaggagctgcagagg

SEQ ID NO: 7869567 - DNA, 22 bp, Homo sapiens
cctggagcaggagctgcagagg

SEQ ID NO: 7869568 - DNA, 22 bp, Homo sapiens
cctggagcaggagctgcagagg

SEQ ID NO: 7869569 - DNA, 22 bp, Homo sapiens
cctggagcaggagctgcagagg

SEQ ID NO: 7869570 - DNA, 22 bp, Homo sapiens
cctggagcccaaggcagtgaga

SEQ ID NO: 7869571 - DNA, 22 bp, Homo sapiens
cctggagcccaaggcagtgaga

SEQ ID NO: 7869572 - DNA, 22 bp, Homo sapiens
cctggagcccaaggcagtgaga

SEQ ID NO: 7869573 - DNA, 22 bp, Homo sapiens
cctggagcccaaggcagtgaga

SEQ ID NO: 7869574 - DNA, 22 bp, Homo sapiens
cctggagcccaaggcagtgaga

SEQ ID NO: 7869575 - DNA, 22 bp, Homo sapiens
cctggagcccaaggcagtgaga

SEQ ID NO: 7869576 - DNA, 22 bp, Homo sapiens
cctggagcccaaggcagtgaga

SEQ ID NO: 7869577 - DNA, 22 bp, Homo sapiens
cctggagcatcaggaggaaggg

SEQ ID NO: 7869578 - DNA, 22 bp, Homo sapiens
cctggagcatcaggaggaaggg

SEQ ID NO: 7869579 - DNA, 22 bp, Homo sapiens
cctggagcatcaggaggaaggg

SEQ ID NO: 7869580 - DNA, 22 bp, Homo sapiens
cctggagcatcaggaggaaggg

SEQ ID NO: 7869581 - DNA, 22 bp, Homo sapiens
cctggagcaggagctgcagagg

SEQ ID NO: 7869582 - DNA, 22 bp, Homo sapiens
cctggagcaggagctgcagagg

SEQ ID NO: 7869583 - DNA, 22 bp, Homo sapiens
cctggagcaggagctgcagagg

SEQ ID NO: 7869584 - DNA, 22 bp, Homo sapiens
cctggagcaggagctgcagagg

SEQ ID NO: 7869585 - DNA, 22 bp, Homo sapiens
cctgcctggagctgagtgtgga

SEQ ID NO: 7869586 - DNA, 22 bp, Homo sapiens
cctgcctggatcagccatcctg

SEQ ID NO: 7869587 - DNA, 22 bp, Homo sapiens
cctgcctggatcagccatcctg

SEQ ID NO: 7869588 - DNA, 22 bp, Homo sapiens
cctgcctggatcagccatcctg

SEQ ID NO: 7869589 - DNA, 22 bp, Homo sapiens
cctgcctgctttctgctttgca

SEQ ID NO: 7869590 - DNA, 22 bp, Homo sapiens
cctgcctgctttctgctttgca

SEQ ID NO: 7869591 - DNA, 22 bp, Homo sapiens
cctgcctggagctgagtgtgga

SEQ ID NO: 7869592 - DNA, 22 bp, Homo sapiens
cctgcctggagctgagtgtgga

SEQ ID NO: 7869593 - DNA, 22 bp, Homo sapiens
cctgcctggatcagccatcctg

SEQ ID NO: 7869594 - DNA, 22 bp, Homo sapiens
cctgcctggcacatagtactct

SEQ ID NO: 7869595 - DNA, 22 bp, Homo sapiens
cctgcctggatcagccatcctg

SEQ ID NO: 7869596 - DNA, 22 bp, Homo sapiens
cctgcctggcccaccttgccac

SEQ ID NO: 7869597 - DNA, 22 bp, Homo sapiens
cctgcctggcacatagtactct

SEQ ID NO: 7869598 - DNA, 20 bp, Homo sapiens
cctgcctggccattccttgg

SEQ ID NO: 7869599 - DNA, 22 bp, Homo sapiens
cctgcctggctgtcagcagagc

SEQ ID NO: 7869600 - DNA, 22 bp, Homo sapiens
cctgcctggctgtcagcagagc

SEQ ID NO: 7869601 - DNA, 22 bp, Homo sapiens
cctgcctggctgtcagcagagc

SEQ ID NO: 7869602 - DNA, 22 bp, Homo sapiens
cctgcctggcccaccttgccac

SEQ ID NO: 7869603 - DNA, 22 bp, Homo sapiens
cctgcctggctgtcagcagagc

SEQ ID NO: 7869604 - DNA, 22 bp, Homo sapiens
cctgcctggctgtcagcagagc

SEQ ID NO: 7869605 - DNA, 22 bp, Homo sapiens
cctgcctggctgtcagcagagc

SEQ ID NO: 7869606 - DNA, 22 bp, Homo sapiens
cggtcaggtgcagcgttggcac

SEQ ID NO: 7869607 - DNA, 22 bp, Homo sapiens
cgctagcgcccaggcgcctctc

SEQ ID NO: 7869608 - DNA, 22 bp, Homo sapiens
cggtagctacaaaacataaaca

SEQ ID NO: 7869609 - DNA, 22 bp, Homo sapiens
cggtcaggtgcagcgttggcac

SEQ ID NO: 7869610 - DNA, 17 bp, Homo sapiens
cgtgagcagcaggtgcc

SEQ ID NO: 7869611 - DNA, 22 bp, Homo sapiens
cgtgagcagctctgtgtctctg

SEQ ID NO: 7869612 - DNA, 22 bp, Homo sapiens
cgtgagggcatggcagtgagga

SEQ ID NO: 7869613 - DNA, 22 bp, Homo sapiens
cgtgatgaatggtgagacccgc

SEQ ID NO: 7869614 - DNA, 22 bp, Homo sapiens
cgtgcatgatatatgagttgtt

SEQ ID NO: 7869615 - DNA, 22 bp, Homo sapiens
cgtgccactgcactctagcctg

SEQ ID NO: 7869616 - DNA, 22 bp, Homo sapiens
cgtgcagcggagctggtcactg

SEQ ID NO: 7869617 - DNA, 22 bp, Homo sapiens
cgtgattggcttctgcattgga

SEQ ID NO: 7869618 - DNA, 22 bp, Homo sapiens
cgtgattggcttctgcattgga

SEQ ID NO: 7869619 - DNA, 22 bp, Homo sapiens
cgtgatttctggctttctatat

SEQ ID NO: 7869620 - DNA, 22 bp, Homo sapiens
cgtgccactgcactctagcctg

SEQ ID NO: 7869621 - DNA, 22 bp, Homo sapiens
cgtgcgcctcagcctcgtgcgc

SEQ ID NO: 7869622 - DNA, 22 bp, Homo sapiens
cgtgcgcctcagcctcgtgcgc

SEQ ID NO: 7869623 - DNA, 22 bp, Homo sapiens
cgtgcggcctcggggcccggct

SEQ ID NO: 7869624 - DNA, 22 bp, Homo sapiens
cgcggagctccgcccggtgccc

SEQ ID NO: 7869625 - DNA, 22 bp, Homo sapiens
cgcggaggaggtcaggaggtga

SEQ ID NO: 7869626 - DNA, 22 bp, Homo sapiens
cgcggcgcgcccccgggtgtgt

SEQ ID NO: 7869627 - DNA, 22 bp, Homo sapiens
cgcggagctccgcccggtgccc

SEQ ID NO: 7869628 - DNA, 22 bp, Homo sapiens
cgcgggcccctgcgctccgggc

SEQ ID NO: 7869629 - DNA, 22 bp, Homo sapiens
cgcgggcctccagacccagtat

SEQ ID NO: 7869630 - DNA, 22 bp, Homo sapiens
cgcggtggcggcctccagcgcc

SEQ ID NO: 7869631 - DNA, 22 bp, Homo sapiens
cgcggtggcggcctccagcgcc

SEQ ID NO: 7869632 - DNA, 22 bp, Homo sapiens
cgcggtggcggcctccagcgcc

SEQ ID NO: 7869633 - DNA, 22 bp, Homo sapiens
cgcggtggcggcctccagcgcc

SEQ ID NO: 7869634 - DNA, 22 bp, Homo sapiens
cgcggtggcggcctccagcgcc

SEQ ID NO: 7869635 - DNA, 22 bp, Homo sapiens
cgcggggcttcagccgcccagt

SEQ ID NO: 7869636 - DNA, 22 bp, Homo sapiens
cgcgggggtcctcaggcaggcg

SEQ ID NO: 7869637 - DNA, 22 bp, Homo sapiens
cgcctggctgcagccggcgagg

SEQ ID NO: 7869638 - DNA, 19 bp, Homo sapiens
cgcctggcaggccctgcgc

SEQ ID NO: 7869639 - DNA, 19 bp, Homo sapiens
cgcctggcaggccctgcgc

SEQ ID NO: 7869640 - DNA, 22 bp, Homo sapiens
cgcctgggagtccacacctgct

SEQ ID NO: 7869641 - DNA, 22 bp, Homo sapiens
cgcctgggagtccacacctgct

SEQ ID NO: 7869642 - DNA, 22 bp, Homo sapiens
cgcctgggagtccacacctgct

SEQ ID NO: 7869643 - DNA, 22 bp, Homo sapiens
cgcgaggtggaggttgcagtga

SEQ ID NO: 7869644 - DNA, 22 bp, Homo sapiens
cgcgaggtggaggttgcagtga

SEQ ID NO: 7869645 - DNA, 22 bp, Homo sapiens
cgcgcggctctcgcgagatgtg

SEQ ID NO: 7869646 - DNA, 22 bp, Homo sapiens
cgcgcggccttgtggggcttgt

SEQ ID NO: 7869647 - DNA, 22 bp, Homo sapiens
cgcgcggctctcgcgagatgtg

SEQ ID NO: 7869648 - DNA, 19 bp, Homo sapiens
cgcgccgtcgggtccagcc

SEQ ID NO: 7869649 - DNA, 22 bp, Homo sapiens
cgccttcacaaggacagtatat

SEQ ID NO: 7869650 - DNA, 22 bp, Homo sapiens
cgcgaggtggaggttgcagtga

SEQ ID NO: 7869651 - DNA, 22 bp, Homo sapiens
cgccttcacaaggacagtatat

SEQ ID NO: 7869652 - DNA, 22 bp, Homo sapiens
cgccttcaggccctttttgttg

SEQ ID NO: 7869653 - DNA, 22 bp, Homo sapiens
cgccttcaggccctttttgttg

SEQ ID NO: 7869654 - DNA, 22 bp, Homo sapiens
cgcctttaaattgttttacact

SEQ ID NO: 7869655 - DNA, 22 bp, Homo sapiens
ctaaacaagggattataattga

SEQ ID NO: 7869656 - DNA, 22 bp, Homo sapiens
ctaaacaatgaacaaagcactg

SEQ ID NO: 7869657 - DNA, 22 bp, Homo sapiens
ctaaacaatgaacaaagcactg

SEQ ID NO: 7869658 - DNA, 22 bp, Homo sapiens
ctaaacaagggattataattga

SEQ ID NO: 7869659 - DNA, 22 bp, Homo sapiens
ctaaacaagggattataattga

SEQ ID NO: 7869660 - DNA, 22 bp, Homo sapiens
ctaaacaagggattataattga

SEQ ID NO: 7869661 - DNA, 22 bp, Homo sapiens
ctaaacaatgaacaaagcactg

SEQ ID NO: 7869662 - DNA, 22 bp, Homo sapiens
ctaaacaatgaacaaagcactg

SEQ ID NO: 7869663 - DNA, 22 bp, Homo sapiens
ctaaacaatgaacaaagcactg

SEQ ID NO: 7869664 - DNA, 22 bp, Homo sapiens
ctaaacatcttgcaatgcacag

SEQ ID NO: 7869665 - DNA, 22 bp, Homo sapiens
ctaaacagtgcatatgggtgtt

SEQ ID NO: 7869666 - DNA, 22 bp, Homo sapiens
ctaaacaggaaggagcacctga

SEQ ID NO: 7869667 - DNA, 22 bp, Homo sapiens
ctaaacatgcaagagcttctgg

SEQ ID NO: 7869668 - DNA, 22 bp, Homo sapiens
ctaaacatgaactacatttagg

SEQ ID NO: 7869669 - DNA, 22 bp, Homo sapiens
ctaaacatgaactacatttagg

SEQ ID NO: 7869670 - DNA, 22 bp, Homo sapiens
ctaaacatgaactacatttagg

SEQ ID NO: 7869671 - DNA, 22 bp, Homo sapiens
ctaaacatgcaagagcttctgg

SEQ ID NO: 7869672 - DNA, 22 bp, Homo sapiens
ctaaacatggcttagaacactc

SEQ ID NO: 7869673 - DNA, 22 bp, Homo sapiens
ctaaacatgttggtgctttaaa

SEQ ID NO: 7869674 - DNA, 22 bp, Homo sapiens
ctaaacatgtagcttttgtggt

SEQ ID NO: 7869675 - DNA, 20 bp, Homo sapiens
ctaaactctgcagatttagt

SEQ ID NO: 7869676 - DNA, 20 bp, Homo sapiens
ctaaactctgcagatttagt

SEQ ID NO: 7869677 - DNA, 22 bp, Homo sapiens
agtcacatttgggggtgtcaaa

SEQ ID NO: 7869678 - DNA, 22 bp, Homo sapiens
cgtgctgggtctgcggggccgt

SEQ ID NO: 7869679 - DNA, 22 bp, Homo sapiens
cgtgctgggtctgcggggccgt

SEQ ID NO: 7869680 - DNA, 20 bp, Homo sapiens
cgtgctgtgaccttgagcat

SEQ ID NO: 7869681 - DNA, 22 bp, Homo sapiens
cgtgcttttcaaccattctcaa

SEQ ID NO: 7869682 - DNA, 22 bp, Homo sapiens
cgtggcagtggaaggctgggtg

SEQ ID NO: 7869683 - DNA, 22 bp, Homo sapiens
cgtggcagtggaaggctgggtg

SEQ ID NO: 7869684 - DNA, 22 bp, Homo sapiens
cgtggcagtggaaggctgggtg

SEQ ID NO: 7869685 - DNA, 22 bp, Homo sapiens
cgtggccagcacaaggcagtga

SEQ ID NO: 7869686 - DNA, 22 bp, Homo sapiens
cgtggccagcacaaggcagtga

SEQ ID NO: 7869687 - DNA, 22 bp, Homo sapiens
cgtggccacccagtggtgcgtg

SEQ ID NO: 7869688 - DNA, 22 bp, Homo sapiens
cgtggccacccagtggtgcgtg

SEQ ID NO: 7869689 - DNA, 22 bp, Homo sapiens
cgtggcagtggtgtttcttagg

SEQ ID NO: 7869690 - DNA, 22 bp, Homo sapiens
cgtggcagtggaaggctgggtg

SEQ ID NO: 7869691 - DNA, 22 bp, Homo sapiens
cgtggccagccatttcctggaa

SEQ ID NO: 7869692 - DNA, 22 bp, Homo sapiens
cgtggccagccatttcctggaa

SEQ ID NO: 7869693 - DNA, 22 bp, Homo sapiens
cgtggccagtttcaagctacca

SEQ ID NO: 7869694 - DNA, 22 bp, Homo sapiens
ctaaaattatcaagataattcc

SEQ ID NO: 7869695 - DNA, 22 bp, Homo sapiens
cgtggctggggaggtcagccag

SEQ ID NO: 7869696 - DNA, 22 bp, Homo sapiens
cgtggctggggcgactccacgg

SEQ ID NO: 7869697 - DNA, 22 bp, Homo sapiens
cgtggctggggcgactccacgg

SEQ ID NO: 7869698 - DNA, 22 bp, Homo sapiens
cgtggctggggaggtcagccag

SEQ ID NO: 7869699 - DNA, 17 bp, Homo sapiens
cgtggctgagccataga

SEQ ID NO: 7869700 - DNA, 22 bp, Homo sapiens
cgtggctcttttctgcatcagg

SEQ ID NO: 7869701 - DNA, 22 bp, Homo sapiens
cgtggctcttttctgcatcagg

SEQ ID NO: 7869702 - DNA, 22 bp, Homo sapiens
ctaaacaagatactaatgaggt

SEQ ID NO: 7869703 - DNA, 22 bp, Homo sapiens
ctaaacaagatactaatgaggt

SEQ ID NO: 7869704 - DNA, 22 bp, Homo sapiens
ctaaaattatcaagataattcc

SEQ ID NO: 7869705 - DNA, 22 bp, Homo sapiens
ctaaaattatcaagataattcc

SEQ ID NO: 7869706 - DNA, 22 bp, Homo sapiens
ctaaaattatcaagataattcc

SEQ ID NO: 7869707 - DNA, 22 bp, Homo sapiens
ctaaaattatcaagataattcc

SEQ ID NO: 7869708 - DNA, 22 bp, Homo sapiens
agtcagagcaaactggacagac

SEQ ID NO: 7869709 - DNA, 23 bp, Homo sapiens
agtcagagcagaagggctgcttg

SEQ ID NO: 7869710 - DNA, 23 bp, Homo sapiens
agtcagagcagaagggctgcttg

SEQ ID NO: 7869711 - DNA, 22 bp, Homo sapiens
agtcagagctatgttgttatat

SEQ ID NO: 7869712 - DNA, 22 bp, Homo sapiens
agtcagagaatgttttcatgga

SEQ ID NO: 7869713 - DNA, 22 bp, Homo sapiens
agtcagagaatgttttcatgga

SEQ ID NO: 7869714 - DNA, 22 bp, Homo sapiens
agtcagagaccctagatctaat

SEQ ID NO: 7869715 - DNA, 22 bp, Homo sapiens
agtcagagagctctcagcatag

SEQ ID NO: 7869716 - DNA, 22 bp, Homo sapiens
agtcagaagccggcctaaggga

SEQ ID NO: 7869717 - DNA, 22 bp, Homo sapiens
agtcagaatctgcattttaacc

SEQ ID NO: 7869718 - DNA, 22 bp, Homo sapiens
agtcactttatgagagaaccat

SEQ ID NO: 7869719 - DNA, 22 bp, Homo sapiens
agtcaccaacatggttcccagg

SEQ ID NO: 7869720 - DNA, 22 bp, Homo sapiens
agtcagaattcgatcccaggtc

SEQ ID NO: 7869721 - DNA, 22 bp, Homo sapiens
agtcagagaaaacagccctgtg

SEQ ID NO: 7869722 - DNA, 21 bp, Homo sapiens
agtcagacttaagctctgcat

SEQ ID NO: 7869723 - DNA, 22 bp, Homo sapiens
agtcagagaaaacagccctgtg

SEQ ID NO: 7869724 - DNA, 22 bp, Homo sapiens
agtcagagaatgttttcatgga

SEQ ID NO: 7869725 - DNA, 22 bp, Homo sapiens
agtcagagaataaagaatgcat

SEQ ID NO: 7869726 - DNA, 17 bp, Homo sapiens
agtcagaggagtatctg

SEQ ID NO: 7869727 - DNA, 17 bp, Homo sapiens
agtcagaggagtatctg

SEQ ID NO: 7869728 - DNA, 22 bp, Homo sapiens
agtcagagtcgccgacagtcaa

SEQ ID NO: 7869729 - DNA, 17 bp, Homo sapiens
agtcagaggagtatctg

SEQ ID NO: 7869730 - DNA, 22 bp, Homo sapiens
agtcagagttttgaggtgtgac

SEQ ID NO: 7869731 - DNA, 22 bp, Homo sapiens
agtcagagttttgaggtgtgac

SEQ ID NO: 7869732 - DNA, 22 bp, Homo sapiens
agtcagagttcttggggagaca

SEQ ID NO: 7869733 - DNA, 22 bp, Homo sapiens
agtcagagttcttggggagaca

SEQ ID NO: 7869734 - DNA, 22 bp, Homo sapiens
agtcagagtctattgctgtggt

SEQ ID NO: 7869735 - DNA, 22 bp, Homo sapiens
agtcagatttagatgtagcaag

SEQ ID NO: 7869736 - DNA, 22 bp, Homo sapiens
agtcagatttagatgtagcaag

SEQ ID NO: 7869737 - DNA, 22 bp, Homo sapiens
agtcagatttagatgtagcaag

SEQ ID NO: 7869738 - DNA, 18 bp, Homo sapiens
agtcagattccaaggtga

SEQ ID NO: 7869739 - DNA, 18 bp, Homo sapiens
agtcagattccaaggtga

SEQ ID NO: 7869740 - DNA, 22 bp, Homo sapiens
agtcagatgatgtgaggagtgg

SEQ ID NO: 7869741 - DNA, 22 bp, Homo sapiens
agtcagagttttgaggtgtgac

SEQ ID NO: 7869742 - DNA, 23 bp, Homo sapiens
ctacaagagcaagcatggacaag

SEQ ID NO: 7869743 - DNA, 23 bp, Homo sapiens
ctacaagagcaagcatggacaag

SEQ ID NO: 7869744 - DNA, 22 bp, Homo sapiens
ctacaagatttttaaaactgta

SEQ ID NO: 7869745 - DNA, 21 bp, Homo sapiens
ctacaagtaaagtattgggac

SEQ ID NO: 7869746 - DNA, 22 bp, Homo sapiens
ctacaagcatctatgtttcaag

SEQ ID NO: 7869747 - DNA, 22 bp, Homo sapiens
ctacaagtatgggggctccaaa

SEQ ID NO: 7869748 - DNA, 22 bp, Homo sapiens
ctacacagagcctacttctgca

SEQ ID NO: 7869749 - DNA, 22 bp, Homo sapiens
ctacaatgacagaattgagtag

SEQ ID NO: 7869750 - DNA, 22 bp, Homo sapiens
ctacaagtggagttctgacgca

SEQ ID NO: 7869751 - DNA, 22 bp, Homo sapiens
ctacaagtgcaacctgtgcgac

SEQ ID NO: 7869752 - DNA, 22 bp, Homo sapiens
ctacaagtcattccaggtactt

SEQ ID NO: 7869753 - DNA, 22 bp, Homo sapiens
ctacaagtcattccaggtactt

SEQ ID NO: 7869754 - DNA, 22 bp, Homo sapiens
ctacactagagttgcaatggaa

SEQ ID NO: 7869755 - DNA, 22 bp, Homo sapiens
ctacactgagagctcttcaggg

SEQ ID NO: 7869756 - DNA, 22 bp, Homo sapiens
ctacacagttctgcctaatggc

SEQ ID NO: 7869757 - DNA, 22 bp, Homo sapiens
ctacactttggttgactttgtg

SEQ ID NO: 7869758 - DNA, 22 bp, Homo sapiens
ctacacttgttcgactgcagga

SEQ ID NO: 7869759 - DNA, 20 bp, Homo sapiens
ctacacttggcacctggcat

SEQ ID NO: 7869760 - DNA, 22 bp, Homo sapiens
ctacacagttctgcctaatggc

SEQ ID NO: 7869761 - DNA, 20 bp, Homo sapiens
ctacacagggttcgctgggc

SEQ ID NO: 7869762 - DNA, 20 bp, Homo sapiens
ctacacagggttcgctgggc

SEQ ID NO: 7869763 - DNA, 21 bp, Homo sapiens
ctacacagctttctataggaa

SEQ ID NO: 7869764 - DNA, 21 bp, Homo sapiens
ctacacagctttctataggaa

SEQ ID NO: 7869765 - DNA, 21 bp, Homo sapiens
ctacacagctttctataggaa

SEQ ID NO: 7869766 - DNA, 22 bp, Homo sapiens
ctacagaaacactggacatgtg

SEQ ID NO: 7869767 - DNA, 22 bp, Homo sapiens
ctacagaaacctttttcataca

SEQ ID NO: 7869768 - DNA, 22 bp, Homo sapiens
ctacagaaacctttttcataca

SEQ ID NO: 7869769 - DNA, 22 bp, Homo sapiens
ctacagaagaaactatcactat

SEQ ID NO: 7869770 - DNA, 22 bp, Homo sapiens
ctacagaagaaactatcactat

SEQ ID NO: 7869771 - DNA, 21 bp, Homo sapiens
ctacagaagctctcctatcca

SEQ ID NO: 7869772 - DNA, 22 bp, Homo sapiens
ctacagaagtttcccttgctta

SEQ ID NO: 7869773 - DNA, 22 bp, Homo sapiens
ctacagaagtttcccttgctta

SEQ ID NO: 7869774 - DNA, 21 bp, Homo sapiens
ctacagaatcgagcattctgg

SEQ ID NO: 7869775 - DNA, 21 bp, Homo sapiens
ctacagaatcgagcattctgg

SEQ ID NO: 7869776 - DNA, 21 bp, Homo sapiens
ctacagaatcgagcattctgg

SEQ ID NO: 7869777 - DNA, 21 bp, Homo sapiens
ctacagaatcgagcattctgg

SEQ ID NO: 7869778 - DNA, 22 bp, Homo sapiens
agtcaggattttggattattcg

SEQ ID NO: 7869779 - DNA, 21 bp, Homo sapiens
ctacagaatcgagcattctgg

SEQ ID NO: 7869780 - DNA, 22 bp, Homo sapiens
agtcaggggatctagacttgaa

SEQ ID NO: 7869781 - DNA, 22 bp, Homo sapiens
agtcagtgtagaaagcccaggc

SEQ ID NO: 7869782 - DNA, 22 bp, Homo sapiens
agtcagggcctggcctgctgaa

SEQ ID NO: 7869783 - DNA, 22 bp, Homo sapiens
agtcagttaacctcacagcatc

SEQ ID NO: 7869784 - DNA, 22 bp, Homo sapiens
agtcagttaaactttgtaaagt

SEQ ID NO: 7869785 - DNA, 22 bp, Homo sapiens
agtcagttaaactttgtaaagt

SEQ ID NO: 7869786 - DNA, 22 bp, Homo sapiens
agtcagtgtgattctcaggagg

SEQ ID NO: 7869787 - DNA, 22 bp, Homo sapiens
agtcagtgttctgggttgtaat

SEQ ID NO: 7869788 - DNA, 22 bp, Homo sapiens
agtcagtgtgattctcaggagg

SEQ ID NO: 7869789 - DNA, 22 bp, Homo sapiens
agtcagtgtcaacaggaagtag

SEQ ID NO: 7869790 - DNA, 22 bp, Homo sapiens
agtcagtgtagaaagcccaggc

SEQ ID NO: 7869791 - DNA, 22 bp, Homo sapiens
agtcagtgtagaaagcccaggc

SEQ ID NO: 7869792 - DNA, 22 bp, Homo sapiens
agtcagggcctggcctgctgaa

SEQ ID NO: 7869793 - DNA, 22 bp, Homo sapiens
agtcataattataaacatcagt

SEQ ID NO: 7869794 - DNA, 22 bp, Homo sapiens
agtcataactgtcctgggtgag

SEQ ID NO: 7869795 - DNA, 22 bp, Homo sapiens
agtcataattataaacatcagt

SEQ ID NO: 7869796 - DNA, 22 bp, Homo sapiens
agtcagttttcttaaagggaag

SEQ ID NO: 7869797 - DNA, 22 bp, Homo sapiens
agtcagttttaccaatctcagt

SEQ ID NO: 7869798 - DNA, 22 bp, Homo sapiens
agtcagttttctccagggggct

SEQ ID NO: 7869799 - DNA, 22 bp, Homo sapiens
agtcagtttccctggaaagcag

SEQ ID NO: 7869800 - DNA, 22 bp, Homo sapiens
agtcagtttccctggaaagcag

SEQ ID NO: 7869801 - DNA, 22 bp, Homo sapiens
agtcagttgcaaacatcaggca

SEQ ID NO: 7869802 - DNA, 22 bp, Homo sapiens
agtcagttgcaaacatcaggca

SEQ ID NO: 7869803 - DNA, 22 bp, Homo sapiens
agtcagttgcaaacatcaggca

SEQ ID NO: 7869804 - DNA, 22 bp, Homo sapiens
agtcagttgcagtttatggatg

SEQ ID NO: 7869805 - DNA, 22 bp, Homo sapiens
agtcagttgtggagatttaact

SEQ ID NO: 7869806 - DNA, 22 bp, Homo sapiens
agtcagttcatggctctgtcct

SEQ ID NO: 7869807 - DNA, 22 bp, Homo sapiens
agtcagttaacctcacagcatc

SEQ ID NO: 7869808 - DNA, 19 bp, Homo sapiens
agtcagttctgaggaggaa

SEQ ID NO: 7869809 - DNA, 18 bp, Homo sapiens
agtcagttgatggggacc

SEQ ID NO: 7869810 - DNA, 22 bp, Homo sapiens
agtaatcaatttttcggtggat

SEQ ID NO: 7869811 - DNA, 22 bp, Homo sapiens
agtaatcaatttttcggtggat

SEQ ID NO: 7869812 - DNA, 22 bp, Homo sapiens
agtaatctgattttatagctat

SEQ ID NO: 7869813 - DNA, 22 bp, Homo sapiens
agtaatcaatttttcggtggat

SEQ ID NO: 7869814 - DNA, 22 bp, Homo sapiens
agtaacaggtgtacagactatc

SEQ ID NO: 7869815 - DNA, 22 bp, Homo sapiens
agtaacaggtgtacagactatc

SEQ ID NO: 7869816 - DNA, 22 bp, Homo sapiens
agtaacaggatccaaagaatgt

SEQ ID NO: 7869817 - DNA, 22 bp, Homo sapiens
agtaacaggatccaaagaatgt

SEQ ID NO: 7869818 - DNA, 22 bp, Homo sapiens
agtaacaggtgtacagactatc

SEQ ID NO: 7869819 - DNA, 22 bp, Homo sapiens
agtaacagggtatttgtgtggg

SEQ ID NO: 7869820 - DNA, 22 bp, Homo sapiens
agtaacagggtatttgtgtggg

SEQ ID NO: 7869821 - DNA, 21 bp, Homo sapiens
agtacaaaaattcctttctca

SEQ ID NO: 7869822 - DNA, 21 bp, Homo sapiens
agtacaaaaattcctttctca

SEQ ID NO: 7869823 - DNA, 21 bp, Homo sapiens
agtacaaaaattcctttctca

SEQ ID NO: 7869824 - DNA, 21 bp, Homo sapiens
agtacaaaaattcctttctca

SEQ ID NO: 7869825 - DNA, 22 bp, Homo sapiens
agtaatttgttataaagcaata

SEQ ID NO: 7869826 - DNA, 22 bp, Homo sapiens
agtaattctactaggaatttat

SEQ ID NO: 7869827 - DNA, 22 bp, Homo sapiens
agtaatttgttataaagcaata

SEQ ID NO: 7869828 - DNA, 22 bp, Homo sapiens
agtaatgaagatttgttgcaca

SEQ ID NO: 7869829 - DNA, 22 bp, Homo sapiens
agtaatctgattttatagctat

SEQ ID NO: 7869830 - DNA, 22 bp, Homo sapiens
agtaatgaatacggtatttgaa

SEQ ID NO: 7869831 - DNA, 22 bp, Homo sapiens
agtaatgacaatttttatctgt

SEQ ID NO: 7869832 - DNA, 22 bp, Homo sapiens
agtaatgattatgtacagaatg

SEQ ID NO: 7869833 - DNA, 23 bp, Homo sapiens
agtaatgagtgatgcagatattc

SEQ ID NO: 7869834 - DNA, 22 bp, Homo sapiens
agtacaaattatagcgcttgga

SEQ ID NO: 7869835 - DNA, 22 bp, Homo sapiens
agtacaaatgcagccagagtag

SEQ ID NO: 7869836 - DNA, 22 bp, Homo sapiens
agtacaaatgcagccagagtag

SEQ ID NO: 7869837 - DNA, 22 bp, Homo sapiens
agtacaaatgcagccagagtag

SEQ ID NO: 7869838 - DNA, 22 bp, Homo sapiens
agtacaaagtgctcctggttct

SEQ ID NO: 7869839 - DNA, 22 bp, Homo sapiens
agtacaaagtgctcctggttct

SEQ ID NO: 7869840 - DNA, 22 bp, Homo sapiens
agtacaaagtgctcctggttct

SEQ ID NO: 7869841 - DNA, 22 bp, Homo sapiens
agtacaaaggcccttgattact

SEQ ID NO: 7869842 - DNA, 22 bp, Homo sapiens
agtacaaaggcccttgattact

SEQ ID NO: 7869843 - DNA, 22 bp, Homo sapiens
agtacaaagtgctcctggttct

SEQ ID NO: 7869844 - DNA, 22 bp, Homo sapiens
agtacaaagtgctcctggttct

SEQ ID NO: 7869845 - DNA, 22 bp, Homo sapiens
cgcctgctctcactggacagct

SEQ ID NO: 7869846 - DNA, 22 bp, Homo sapiens
agtacaaattatagcgcttgga

SEQ ID NO: 7869847 - DNA, 22 bp, Homo sapiens
cgcctggaacctctaggaccag

SEQ ID NO: 7869848 - DNA, 22 bp, Homo sapiens
cgcctggagaggaggcgacgcg

SEQ ID NO: 7869849 - DNA, 22 bp, Homo sapiens
agtacaaaggcccttgattact

SEQ ID NO: 7869850 - DNA, 22 bp, Homo sapiens
agtacaaaggcccttgattact

SEQ ID NO: 7869851 - DNA, 22 bp, Homo sapiens
agtacaaaggcccttgattact

SEQ ID NO: 7869852 - DNA, 22 bp, Homo sapiens
agtacaaaggcccttgattact

SEQ ID NO: 7869853 - DNA, 22 bp, Homo sapiens
agtacaaaggcccttgattact

SEQ ID NO: 7869854 - DNA, 22 bp, Homo sapiens
agtacaaaggcccttgattact

SEQ ID NO: 7869855 - DNA, 22 bp, Homo sapiens
agtacaaaggcccttgattact

SEQ ID NO: 7869856 - DNA, 22 bp, Homo sapiens
agtacaaaggcccttgattact

SEQ ID NO: 7869857 - DNA, 22 bp, Homo sapiens
agtacaaaggcccttgattact

SEQ ID NO: 7869858 - DNA, 22 bp, Homo sapiens
agtacaaaggcccttgattact

SEQ ID NO: 7869859 - DNA, 22 bp, Homo sapiens
agtacaaactgtttcaaagtag

SEQ ID NO: 7869860 - DNA, 22 bp, Homo sapiens
agtacaaaatgcagcatcatca

SEQ ID NO: 7869861 - DNA, 22 bp, Homo sapiens
agtacaaaatgcagcatcatca

SEQ ID NO: 7869862 - DNA, 22 bp, Homo sapiens
agtacaaaatgcagcatcatca

SEQ ID NO: 7869863 - DNA, 22 bp, Homo sapiens
agtacaaaatgcagcatcatca

SEQ ID NO: 7869864 - DNA, 22 bp, Homo sapiens
agtacaaactgtttcaaagtag

SEQ ID NO: 7869865 - DNA, 22 bp, Homo sapiens
agtacaaactgtttcaaagtag

SEQ ID NO: 7869866 - DNA, 22 bp, Homo sapiens
agtacaaactgtttcaaagtag

SEQ ID NO: 7869867 - DNA, 22 bp, Homo sapiens
agtacaaactgtttcaaagtag

SEQ ID NO: 7869868 - DNA, 22 bp, Homo sapiens
agtacaaactgtttcaaagtag

SEQ ID NO: 7869869 - DNA, 22 bp, Homo sapiens
agtacaaactgtttcaaagtag

SEQ ID NO: 7869870 - DNA, 22 bp, Homo sapiens
agtacaaactgtttcaaagtag

SEQ ID NO: 7869871 - DNA, 22 bp, Homo sapiens
agtacaaactgtttcaaagtag

SEQ ID NO: 7869872 - DNA, 22 bp, Homo sapiens
agtacaaactgtttcaaagtag

SEQ ID NO: 7869873 - DNA, 22 bp, Homo sapiens
agtacaaactgtttcaaagtag

SEQ ID NO: 7869874 - DNA, 17 bp, Homo sapiens
aggtttatggtatttga

SEQ ID NO: 7869875 - DNA, 17 bp, Homo sapiens
aggtttatggtatttga

SEQ ID NO: 7869876 - DNA, 19 bp, Homo sapiens
aggtttatggggagggtga

SEQ ID NO: 7869877 - DNA, 22 bp, Homo sapiens
aggtttatgccttggagctggg

SEQ ID NO: 7869878 - DNA, 22 bp, Homo sapiens
aggtttatggagcaccacatct

SEQ ID NO: 7869879 - DNA, 22 bp, Homo sapiens
aggtttatgagtttggaagggg

SEQ ID NO: 7869880 - DNA, 22 bp, Homo sapiens
aggtttcatgggagacaactca

SEQ ID NO: 7869881 - DNA, 22 bp, Homo sapiens
aggtttattaagtaaatagagc

SEQ ID NO: 7869882 - DNA, 22 bp, Homo sapiens
aggtttattatagaggatgacg

SEQ ID NO: 7869883 - DNA, 22 bp, Homo sapiens
aggtttattatgtagcattatt

SEQ ID NO: 7869884 - DNA, 22 bp, Homo sapiens
aggtttctactgtgttaagaaa

SEQ ID NO: 7869885 - DNA, 22 bp, Homo sapiens
aggtttctatgctgtttatctt

SEQ ID NO: 7869886 - DNA, 22 bp, Homo sapiens
aggtttctatgctgtttatctt

SEQ ID NO: 7869887 - DNA, 22 bp, Homo sapiens
aggtttccagcatggggaaggc

SEQ ID NO: 7869888 - DNA, 19 bp, Homo sapiens
aggtttctaactattcaag

SEQ ID NO: 7869889 - DNA, 19 bp, Homo sapiens
aggtttctaactattcaag

SEQ ID NO: 7869890 - DNA, 21 bp, Homo sapiens
aggtttctcttttatggaggg

SEQ ID NO: 7869891 - DNA, 21 bp, Homo sapiens
aggtttctcttttatggaggg

SEQ ID NO: 7869892 - DNA, 22 bp, Homo sapiens
aggtttctcctttaaagcatgg

SEQ ID NO: 7869893 - DNA, 22 bp, Homo sapiens
cctttagaatacagactttcta

SEQ ID NO: 7869894 - DNA, 20 bp, Homo sapiens
cctttattatttgtatgatg

SEQ ID NO: 7869895 - DNA, 20 bp, Homo sapiens
cctttattatttgtatgatg

SEQ ID NO: 7869896 - DNA, 20 bp, Homo sapiens
cctttattatttgtatgatg

SEQ ID NO: 7869897 - DNA, 20 bp, Homo sapiens
cctttattatttgtatgatg

SEQ ID NO: 7869898 - DNA, 20 bp, Homo sapiens
cctttattatttgtatgatg

SEQ ID NO: 7869899 - DNA, 20 bp, Homo sapiens
cctttattatttgtatgatg

SEQ ID NO: 7869900 - DNA, 22 bp, Homo sapiens
agtaacagcatctccactggaa

SEQ ID NO: 7869901 - DNA, 22 bp, Homo sapiens
cctttattcaattagtcctaat

SEQ ID NO: 7869902 - DNA, 22 bp, Homo sapiens
cctttattcaattagtcctaat

SEQ ID NO: 7869903 - DNA, 22 bp, Homo sapiens
cctttattcaattagtcctaat

SEQ ID NO: 7869904 - DNA, 20 bp, Homo sapiens
cctttattatttgtatgatg

SEQ ID NO: 7869905 - DNA, 20 bp, Homo sapiens
cctttattatttgtatgatg

SEQ ID NO: 7869906 - DNA, 20 bp, Homo sapiens
cctttattatttgtatgatg

SEQ ID NO: 7869907 - DNA, 22 bp, Homo sapiens
cctttaggagtgaggaccgagc

SEQ ID NO: 7869908 - DNA, 22 bp, Homo sapiens
cctttatgagatcctggggtga

SEQ ID NO: 7869909 - DNA, 22 bp, Homo sapiens
cctttaggagtgaggaccgagc

SEQ ID NO: 7869910 - DNA, 22 bp, Homo sapiens
cctttaggagtgaggaccgagc

SEQ ID NO: 7869911 - DNA, 21 bp, Homo sapiens
cctttagatttctatgcagtt

SEQ ID NO: 7869912 - DNA, 22 bp, Homo sapiens
cctttagatgatctcttggaca

SEQ ID NO: 7869913 - DNA, 22 bp, Homo sapiens
cctttagaattctgcccctcct

SEQ ID NO: 7869914 - DNA, 22 bp, Homo sapiens
cctttagagcaaacgccaccta

SEQ ID NO: 7869915 - DNA, 22 bp, Homo sapiens
cctggtgcccccaagccagctg

SEQ ID NO: 7869916 - DNA, 22 bp, Homo sapiens
cctggtgcccccaagccagctg

SEQ ID NO: 7869917 - DNA, 22 bp, Homo sapiens
cctggtgcccccaagccagctg

SEQ ID NO: 7869918 - DNA, 22 bp, Homo sapiens
cctggtgcaggtgtgttgccag

SEQ ID NO: 7869919 - DNA, 22 bp, Homo sapiens
cctggtgagctgggtgcacggc

SEQ ID NO: 7869920 - DNA, 22 bp, Homo sapiens
cctggtgccactagagaatgtc

SEQ ID NO: 7869921 - DNA, 22 bp, Homo sapiens
cctggtccccatcggcccagcg

SEQ ID NO: 7869922 - DNA, 22 bp, Homo sapiens
cctggtccccatcggcccagcg

SEQ ID NO: 7869923 - DNA, 22 bp, Homo sapiens
cctggtccccatcggcccagcg

SEQ ID NO: 7869924 - DNA, 22 bp, Homo sapiens
cctggtgcaccaagtaagggtg

SEQ ID NO: 7869925 - DNA, 22 bp, Homo sapiens
aggtgtctgggctttggagtca

SEQ ID NO: 7869926 - DNA, 22 bp, Homo sapiens
aggtgtctgtgatgggagcgat

SEQ ID NO: 7869927 - DNA, 22 bp, Homo sapiens
aggtgtcttcagggtgagacag

SEQ ID NO: 7869928 - DNA, 22 bp, Homo sapiens
aggtgtctgtgatgggagcgat

SEQ ID NO: 7869929 - DNA, 22 bp, Homo sapiens
aggtgtctgtgatgggagcgat

SEQ ID NO: 7869930 - DNA, 22 bp, Homo sapiens
aggtggggttcagtctcagccg

SEQ ID NO: 7869931 - DNA, 22 bp, Homo sapiens
aggtgtctttgcggcccgccgc

SEQ ID NO: 7869932 - DNA, 22 bp, Homo sapiens
aggtgtctggatgggtgtcctt

SEQ ID NO: 7869933 - DNA, 22 bp, Homo sapiens
aggtgtctgggctttggagtca

SEQ ID NO: 7869934 - DNA, 22 bp, Homo sapiens
aggtggggttcagtctcagccg

SEQ ID NO: 7869935 - DNA, 22 bp, Homo sapiens
aggtggggttcagtctcagccg

SEQ ID NO: 7869936 - DNA, 22 bp, Homo sapiens
aggtgtgctctgtgatggacta

SEQ ID NO: 7869937 - DNA, 22 bp, Homo sapiens
aggtgtgcaggatgaacccctc

SEQ ID NO: 7869938 - DNA, 22 bp, Homo sapiens
aggtgtgagaaacgtgaccagt

SEQ ID NO: 7869939 - DNA, 23 bp, Homo sapiens
aggtgtgcttctgggcacctggg

SEQ ID NO: 7869940 - DNA, 22 bp, Homo sapiens
aggtgtggctggggcagaggcc

SEQ ID NO: 7869941 - DNA, 22 bp, Homo sapiens
aggtgtggctggggcagaggcc

SEQ ID NO: 7869942 - DNA, 22 bp, Homo sapiens
aggtgtggctggggcagaggcc

SEQ ID NO: 7869943 - DNA, 22 bp, Homo sapiens
aggtgtggctggggcagaggcc

SEQ ID NO: 7869944 - DNA, 22 bp, Homo sapiens
aggtgtggcttgaagtctctat

SEQ ID NO: 7869945 - DNA, 22 bp, Homo sapiens
aggtgtggcttgaagtctctat

SEQ ID NO: 7869946 - DNA, 22 bp, Homo sapiens
aggtgtggctggggcagaggcc

SEQ ID NO: 7869947 - DNA, 22 bp, Homo sapiens
aggtgtggctggggcagaggcc

SEQ ID NO: 7869948 - DNA, 17 bp, Homo sapiens
aggtgtggtcaagggag

SEQ ID NO: 7869949 - DNA, 17 bp, Homo sapiens
aggtgtggtcaagggag

SEQ ID NO: 7869950 - DNA, 17 bp, Homo sapiens
aggtgtggtcaagggag

SEQ ID NO: 7869951 - DNA, 17 bp, Homo sapiens
aggtgtggtcaagggag

SEQ ID NO: 7869952 - DNA, 17 bp, Homo sapiens
aggtgtggtcaagggag

SEQ ID NO: 7869953 - DNA, 19 bp, Homo sapiens
aggtgtgggggctgcagac

SEQ ID NO: 7869954 - DNA, 19 bp, Homo sapiens
aggtgtgggggctgcagac

SEQ ID NO: 7869955 - DNA, 19 bp, Homo sapiens
aggtgtgggggctgcagac

SEQ ID NO: 7869956 - DNA, 19 bp, Homo sapiens
aggtgtgggggctgcagac

SEQ ID NO: 7869957 - DNA, 19 bp, Homo sapiens
aggtgtgggggctgcagac

SEQ ID NO: 7869958 - DNA, 22 bp, Homo sapiens
aggtgtgggaaacgggtgacct

SEQ ID NO: 7869959 - DNA, 22 bp, Homo sapiens
aggtgtgggaaacgggtgacct

SEQ ID NO: 7869960 - DNA, 22 bp, Homo sapiens
aggtgtgggaaacgggtgacct

SEQ ID NO: 7869961 - DNA, 22 bp, Homo sapiens
aggtgtgggaaacgggtgacct

SEQ ID NO: 7869962 - DNA, 22 bp, Homo sapiens
aggtgtgggaaacgggtgacct

SEQ ID NO: 7869963 - DNA, 22 bp, Homo sapiens
aggttaaaaaggattcagttaa

SEQ ID NO: 7869964 - DNA, 22 bp, Homo sapiens
aggttaacccttcttttcctct

SEQ ID NO: 7869965 - DNA, 19 bp, Homo sapiens
aggttacaggtgtcacaga

SEQ ID NO: 7869966 - DNA, 22 bp, Homo sapiens
aggttaaaaaggattcagttaa

SEQ ID NO: 7869967 - DNA, 22 bp, Homo sapiens
aggtgtgttccaggaatggtga

SEQ ID NO: 7869968 - DNA, 22 bp, Homo sapiens
aggtgtgtataaacatacatat

SEQ ID NO: 7869969 - DNA, 18 bp, Homo sapiens
aggtgtgtttctaggagc

SEQ ID NO: 7869970 - DNA, 18 bp, Homo sapiens
aggtgtgtttctaggagc

SEQ ID NO: 7869971 - DNA, 22 bp, Homo sapiens
aggttacataggctttaaaagt

SEQ ID NO: 7869972 - DNA, 22 bp, Homo sapiens
aggttacagtgattataggttt

SEQ ID NO: 7869973 - DNA, 23 bp, Homo sapiens
aggttatgattatagagcgagga

SEQ ID NO: 7869974 - DNA, 22 bp, Homo sapiens
aggttatcatcagttgagcact

SEQ ID NO: 7869975 - DNA, 22 bp, Homo sapiens
aggttatagaaactgaggctct

SEQ ID NO: 7869976 - DNA, 22 bp, Homo sapiens
aggttatatgtcatactgaagt

SEQ ID NO: 7869977 - DNA, 22 bp, Homo sapiens
aggttatatgtcatactgaagt

SEQ ID NO: 7869978 - DNA, 21 bp, Homo sapiens
aggttattacaatttttctac

SEQ ID NO: 7869979 - DNA, 22 bp, Homo sapiens
aggttattaaagtgtatttttg

SEQ ID NO: 7869980 - DNA, 22 bp, Homo sapiens
aggttattaaagtgtatttttg

SEQ ID NO: 7869981 - DNA, 22 bp, Homo sapiens
aggttattctctatctcatccc

SEQ ID NO: 7869982 - DNA, 22 bp, Homo sapiens
aggttattctctatctcatccc

SEQ ID NO: 7869983 - DNA, 22 bp, Homo sapiens
aggttatttcatccttccctgg

SEQ ID NO: 7869984 - DNA, 22 bp, Homo sapiens
aggttcaaatgcaagagatgct

SEQ ID NO: 7869985 - DNA, 22 bp, Homo sapiens
aggttatttttgcttagaaaga

SEQ ID NO: 7869986 - DNA, 22 bp, Homo sapiens
aggttcagacgcataataggca

SEQ ID NO: 7869987 - DNA, 22 bp, Homo sapiens
aggttggcctcagggaggctct

SEQ ID NO: 7869988 - DNA, 22 bp, Homo sapiens
aggttccaagaaatcatcagtg

SEQ ID NO: 7869989 - DNA, 22 bp, Homo sapiens
aggttggcctcagggaggctct

SEQ ID NO: 7869990 - DNA, 22 bp, Homo sapiens
aggttggcctcagggaggctct

SEQ ID NO: 7869991 - DNA, 22 bp, Homo sapiens
aggttggctgctcttttcctaa

SEQ ID NO: 7869992 - DNA, 22 bp, Homo sapiens
aggtttatctcatagaaagaat

SEQ ID NO: 7869993 - DNA, 22 bp, Homo sapiens
aggtttatctcatagaaagaat

SEQ ID NO: 7869994 - DNA, 20 bp, Homo sapiens
aggtttatatttagaggtgt

SEQ ID NO: 7869995 - DNA, 22 bp, Homo sapiens
aggtttataggaaatttgttcc

SEQ ID NO: 7869996 - DNA, 22 bp, Homo sapiens
aggtttataggaaatttgttcc

SEQ ID NO: 7869997 - DNA, 22 bp, Homo sapiens
aggtttataggaaatttgttcc

SEQ ID NO: 7869998 - DNA, 22 bp, Homo sapiens
aggtttataactttggagaatt

SEQ ID NO: 7869999 - DNA, 22 bp, Homo sapiens
aggttgttttgcctcattatcc

SEQ ID NO: 7870000 - DNA, 22 bp, Homo sapiens
aggttgggatgagtgggtgagc

SEQ ID NO: 7870001 - DNA, 22 bp, Homo sapiens
agtctgtgctgttggtgaggat

SEQ ID NO: 7870002 - DNA, 23 bp, Homo sapiens
agtctgtgcttggtgggagggcc

SEQ ID NO: 7870003 - DNA, 23 bp, Homo sapiens
agtctgtgcttggtgggagggcc

SEQ ID NO: 7870004 - DNA, 22 bp, Homo sapiens
agtctgtggatggactggcaga

SEQ ID NO: 7870005 - DNA, 22 bp, Homo sapiens
agtctgtgagtgatgtacctgc

SEQ ID NO: 7870006 - DNA, 22 bp, Homo sapiens
agtctgtggatggactggcaga

SEQ ID NO: 7870007 - DNA, 23 bp, Homo sapiens
agtctgtgctgaagaagttacaa

SEQ ID NO: 7870008 - DNA, 22 bp, Homo sapiens
agtctgtgagtgatgtacctgc

SEQ ID NO: 7870009 - DNA, 22 bp, Homo sapiens
agtctgtgaacttggcagggaa

SEQ ID NO: 7870010 - DNA, 22 bp, Homo sapiens
agtctgtgactcattggatctc

SEQ ID NO: 7870011 - DNA, 22 bp, Homo sapiens
agtctgtgaacttggcagggaa

SEQ ID NO: 7870012 - DNA, 22 bp, Homo sapiens
agtctgtgactcattggatctc

SEQ ID NO: 7870013 - DNA, 22 bp, Homo sapiens
agtctgtgaacttggcagggaa

SEQ ID NO: 7870014 - DNA, 22 bp, Homo sapiens
agtctgtgaaaagataggaagt

SEQ ID NO: 7870015 - DNA, 22 bp, Homo sapiens
agtctgtctttggcttcaccac

SEQ ID NO: 7870016 - DNA, 22 bp, Homo sapiens
agtctgtctgtcacttctgcag

SEQ ID NO: 7870017 - DNA, 19 bp, Homo sapiens
agtctgtctgctttccctc

SEQ ID NO: 7870018 - DNA, 22 bp, Homo sapiens
agtctgtctctgctaatcacta

SEQ ID NO: 7870019 - DNA, 22 bp, Homo sapiens
agtctgtctacttaaagtctgt

SEQ ID NO: 7870020 - DNA, 22 bp, Homo sapiens
agtctggatttagaggtgggcc

SEQ ID NO: 7870021 - DNA, 22 bp, Homo sapiens
agtctggagtttgctactggac

SEQ ID NO: 7870022 - DNA, 22 bp, Homo sapiens
agtctggattagttgggggcaa

SEQ ID NO: 7870023 - DNA, 22 bp, Homo sapiens
agtctggattagttgggggcaa

SEQ ID NO: 7870024 - DNA, 22 bp, Homo sapiens
agtctgcttcctggagaactca

SEQ ID NO: 7870025 - DNA, 20 bp, Homo sapiens
agtctgcctgctccttctcc

SEQ ID NO: 7870026 - DNA, 22 bp, Homo sapiens
agtctgcttttgtgaagagctg

SEQ ID NO: 7870027 - DNA, 22 bp, Homo sapiens
agtctggaatttggcctgagca

SEQ ID NO: 7870028 - DNA, 22 bp, Homo sapiens
agtctggaatttggcctgagca

SEQ ID NO: 7870029 - DNA, 22 bp, Homo sapiens
agtctggaatttggcctgagca

SEQ ID NO: 7870030 - DNA, 22 bp, Homo sapiens
agtctggagcagcagtattggt

SEQ ID NO: 7870031 - DNA, 22 bp, Homo sapiens
agtctggaggtggcaggtgtgt

SEQ ID NO: 7870032 - DNA, 19 bp, Homo sapiens
agtctggagtaaaaggaat

SEQ ID NO: 7870033 - DNA, 19 bp, Homo sapiens
agtctggagtaaaaggaat

SEQ ID NO: 7870034 - DNA, 22 bp, Homo sapiens
agtctggagtagagcctagaaa

SEQ ID NO: 7870035 - DNA, 22 bp, Homo sapiens
agtctggagtagagcctagaaa

SEQ ID NO: 7870036 - DNA, 22 bp, Homo sapiens
agtctggagtagagcctagaaa

SEQ ID NO: 7870037 - DNA, 22 bp, Homo sapiens
agtctggagtgcggcggcagga

SEQ ID NO: 7870038 - DNA, 22 bp, Homo sapiens
agtctggagtgcggcggcagga

SEQ ID NO: 7870039 - DNA, 22 bp, Homo sapiens
agtctggagtgcggcggcagga

SEQ ID NO: 7870040 - DNA, 23 bp, Homo sapiens
agtcttactgtcccagaacaggg

SEQ ID NO: 7870041 - DNA, 22 bp, Homo sapiens
agtcttaatagagaaaaactgt

SEQ ID NO: 7870042 - DNA, 22 bp, Homo sapiens
ctcaggagttggaggctacagt

SEQ ID NO: 7870043 - DNA, 22 bp, Homo sapiens
ctcaggagttggaggctacagt

SEQ ID NO: 7870044 - DNA, 22 bp, Homo sapiens
agtcttacatgagaaagaacct

SEQ ID NO: 7870045 - DNA, 23 bp, Homo sapiens
agtcttaatacagctcttttcta

SEQ ID NO: 7870046 - DNA, 22 bp, Homo sapiens
ctcaggatgcaattccatcaag

SEQ ID NO: 7870047 - DNA, 22 bp, Homo sapiens
ctcaggagttggaggctacagt

SEQ ID NO: 7870048 - DNA, 22 bp, Homo sapiens
agtctgtgtatattcactgccc

SEQ ID NO: 7870049 - DNA, 22 bp, Homo sapiens
agtctgtgtatattcactgccc

SEQ ID NO: 7870050 - DNA, 22 bp, Homo sapiens
agtctgtgtactgggtttctgt

SEQ ID NO: 7870051 - DNA, 22 bp, Homo sapiens
agtctgtggggtccctggggca

SEQ ID NO: 7870052 - DNA, 22 bp, Homo sapiens
agtctgtgtacctttggccttc

SEQ ID NO: 7870053 - DNA, 22 bp, Homo sapiens
agtctgtgtacctttggccttc

SEQ ID NO: 7870054 - DNA, 22 bp, Homo sapiens
agtctgtggggtccctggggca

SEQ ID NO: 7870055 - DNA, 19 bp, Homo sapiens
agtctgtggatttgtgggt

SEQ ID NO: 7870056 - DNA, 19 bp, Homo sapiens
agtctgtggatttgtgggt

SEQ ID NO: 7870057 - DNA, 22 bp, Homo sapiens
agtctgtgtgaatgtgggcttt

SEQ ID NO: 7870058 - DNA, 22 bp, Homo sapiens
agtctgtgtgaatgtgggcttt

SEQ ID NO: 7870059 - DNA, 22 bp, Homo sapiens
agtcttaactatgcaagtacta

SEQ ID NO: 7870060 - DNA, 22 bp, Homo sapiens
agtcttaactatgcaagtacta

SEQ ID NO: 7870061 - DNA, 21 bp, Homo sapiens
agtctgttaggatgactctga

SEQ ID NO: 7870062 - DNA, 21 bp, Homo sapiens
agtctgttaggatgactctga

SEQ ID NO: 7870063 - DNA, 21 bp, Homo sapiens
agtctgttaggatgactctga

SEQ ID NO: 7870064 - DNA, 22 bp, Homo sapiens
ctcaggcacgggtcagtgagcg

SEQ ID NO: 7870065 - DNA, 22 bp, Homo sapiens
ctcaggcacgggtcagtgagcg

SEQ ID NO: 7870066 - DNA, 22 bp, Homo sapiens
ctcaggcacgggtcagtgagcg

SEQ ID NO: 7870067 - DNA, 22 bp, Homo sapiens
ctcaggcacgggtcagtgagcg

SEQ ID NO: 7870068 - DNA, 22 bp, Homo sapiens
ctcaggcacgggtcagtgagcg

SEQ ID NO: 7870069 - DNA, 22 bp, Homo sapiens
ctcaggcaaggcccgcattctc

SEQ ID NO: 7870070 - DNA, 22 bp, Homo sapiens
ctcaggcaaggcccgcattctc

SEQ ID NO: 7870071 - DNA, 22 bp, Homo sapiens
ctcaggatgtcggtgactattg

SEQ ID NO: 7870072 - DNA, 22 bp, Homo sapiens
ctcaggcacttttgtcacagac

SEQ ID NO: 7870073 - DNA, 22 bp, Homo sapiens
ctcaggcacttttgtcacagac

SEQ ID NO: 7870074 - DNA, 18 bp, Homo sapiens
ctcaggcagagaagcttt

SEQ ID NO: 7870075 - DNA, 18 bp, Homo sapiens
ctcaggcagagaagcttt

SEQ ID NO: 7870076 - DNA, 22 bp, Homo sapiens
ctcaggcacttttgtcacagac

SEQ ID NO: 7870077 - DNA, 22 bp, Homo sapiens
ctcaggcacttttgtcacagac

SEQ ID NO: 7870078 - DNA, 22 bp, Homo sapiens
ctcaggcacttttgtcacagac

SEQ ID NO: 7870079 - DNA, 22 bp, Homo sapiens
ctcaggcacttttgtcacagac

SEQ ID NO: 7870080 - DNA, 22 bp, Homo sapiens
ctcaggcacttttgtcacagac

SEQ ID NO: 7870081 - DNA, 22 bp, Homo sapiens
ctcaggcacttttgtcacagac

SEQ ID NO: 7870082 - DNA, 22 bp, Homo sapiens
ctcaggcagttctgtagcctcc

SEQ ID NO: 7870083 - DNA, 22 bp, Homo sapiens
ctcaggcagttctgtagcctcc

SEQ ID NO: 7870084 - DNA, 22 bp, Homo sapiens
ctcaggcagtgccctctggccg

SEQ ID NO: 7870085 - DNA, 22 bp, Homo sapiens
ctcaggcagttctgtagcctcc

SEQ ID NO: 7870086 - DNA, 22 bp, Homo sapiens
ctcaggcagttgtttgcatagt

SEQ ID NO: 7870087 - DNA, 18 bp, Homo sapiens
ctcaggcagagaagcttt

SEQ ID NO: 7870088 - DNA, 22 bp, Homo sapiens
ctcaggcagtgccctctggccg

SEQ ID NO: 7870089 - DNA, 22 bp, Homo sapiens
ctcaggcagtgccctctggccg

SEQ ID NO: 7870090 - DNA, 22 bp, Homo sapiens
agtccaaagcagatgagggcca

SEQ ID NO: 7870091 - DNA, 22 bp, Homo sapiens
agtccaaagcagatgagggcca

SEQ ID NO: 7870092 - DNA, 22 bp, Homo sapiens
agtccaaagcagatgagggcca

SEQ ID NO: 7870093 - DNA, 22 bp, Homo sapiens
agtcattttgccagtcttcagg

SEQ ID NO: 7870094 - DNA, 22 bp, Homo sapiens
agtccaaacaaacttcccgagg

SEQ ID NO: 7870095 - DNA, 22 bp, Homo sapiens
agtccaaagcagatgagggcca

SEQ ID NO: 7870096 - DNA, 22 bp, Homo sapiens
agtccaagattagggtgacagc

SEQ ID NO: 7870097 - DNA, 22 bp, Homo sapiens
agtccaagattagggtgacagc

SEQ ID NO: 7870098 - DNA, 22 bp, Homo sapiens
agtcatttcccattcttcatat

SEQ ID NO: 7870099 - DNA, 22 bp, Homo sapiens
agtcatttctgcttccatggct

SEQ ID NO: 7870100 - DNA, 22 bp, Homo sapiens
agtcatttctgcttccatggct

SEQ ID NO: 7870101 - DNA, 18 bp, Homo sapiens
agtcatttacttttgtga

SEQ ID NO: 7870102 - DNA, 22 bp, Homo sapiens
agtcattttctgcctgtaatct

SEQ ID NO: 7870103 - DNA, 22 bp, Homo sapiens
agtcattttctgcctgtaatct

SEQ ID NO: 7870104 - DNA, 22 bp, Homo sapiens
agtcattttgccagtcttcagg

SEQ ID NO: 7870105 - DNA, 22 bp, Homo sapiens
agtcatcatgtacagagagcaa

SEQ ID NO: 7870106 - DNA, 22 bp, Homo sapiens
agtcatcatttatatcaagtct

SEQ ID NO: 7870107 - DNA, 22 bp, Homo sapiens
agtcatccaagagcctgggcag

SEQ ID NO: 7870108 - DNA, 22 bp, Homo sapiens
agtcatatgacccttcacaaac

SEQ ID NO: 7870109 - DNA, 22 bp, Homo sapiens
agtcatatctgaggaggaatcc

SEQ ID NO: 7870110 - DNA, 22 bp, Homo sapiens
agtcatatttagcttgtggaat

SEQ ID NO: 7870111 - DNA, 17 bp, Homo sapiens
agtcatattgtgcagtt

SEQ ID NO: 7870112 - DNA, 22 bp, Homo sapiens
agtcattattatttgtcaaagg

SEQ ID NO: 7870113 - DNA, 22 bp, Homo sapiens
agtcattacagcaggcagaagg

SEQ ID NO: 7870114 - DNA, 23 bp, Homo sapiens
agtcattaagaagttcaggaact

SEQ ID NO: 7870115 - DNA, 22 bp, Homo sapiens
agtcattaattagtaggaaggt

SEQ ID NO: 7870116 - DNA, 22 bp, Homo sapiens
agtcatctccaatatacaaagc

SEQ ID NO: 7870117 - DNA, 22 bp, Homo sapiens
agtcatgtaatcacaatgacct

SEQ ID NO: 7870118 - DNA, 22 bp, Homo sapiens
agtcatctggttttgcatggca

SEQ ID NO: 7870119 - DNA, 22 bp, Homo sapiens
agtctgaagactcatgtctgaa

SEQ ID NO: 7870120 - DNA, 22 bp, Homo sapiens
agtctgaaccagatggcaaggt

SEQ ID NO: 7870121 - DNA, 22 bp, Homo sapiens
agtctgaagactcatgtctgaa

SEQ ID NO: 7870122 - DNA, 22 bp, Homo sapiens
agtctgaagactcatgtctgaa

SEQ ID NO: 7870123 - DNA, 22 bp, Homo sapiens
agtctgaaccagatggcaaggt

SEQ ID NO: 7870124 - DNA, 22 bp, Homo sapiens
agtctgaaataatgtcactaag

SEQ ID NO: 7870125 - DNA, 22 bp, Homo sapiens
agtctgaaagtatgttgtaatg

SEQ ID NO: 7870126 - DNA, 22 bp, Homo sapiens
agtctcttttgcgaagagtgtt

SEQ ID NO: 7870127 - DNA, 22 bp, Homo sapiens
agtctctttgtggactctgcct

SEQ ID NO: 7870128 - DNA, 22 bp, Homo sapiens
agtctcttttggttccaaaaat

SEQ ID NO: 7870129 - DNA, 22 bp, Homo sapiens
agtctcttttgcgaagagtgtt

SEQ ID NO: 7870130 - DNA, 22 bp, Homo sapiens
agtctctttgtggactctgcct

SEQ ID NO: 7870131 - DNA, 22 bp, Homo sapiens
agtctctttctaaataaggtca

SEQ ID NO: 7870132 - DNA, 22 bp, Homo sapiens
agtctctttaatcacagtgtct

SEQ ID NO: 7870133 - DNA, 20 bp, Homo sapiens
agtctctcccagaatgagca

SEQ ID NO: 7870134 - DNA, 20 bp, Homo sapiens
agtctctcccagaatgagca

SEQ ID NO: 7870135 - DNA, 22 bp, Homo sapiens
agtctctccacattgttataaa

SEQ ID NO: 7870136 - DNA, 20 bp, Homo sapiens
agtctctcccagaatgagca

SEQ ID NO: 7870137 - DNA, 21 bp, Homo sapiens
agtctctctaataaatgcttg

SEQ ID NO: 7870138 - DNA, 22 bp, Homo sapiens
agtctctctcctcgtggtaacc

SEQ ID NO: 7870139 - DNA, 21 bp, Homo sapiens
agtctctctaataaatgcttg

SEQ ID NO: 7870140 - DNA, 22 bp, Homo sapiens
agtctctttaatcacagtgtct

SEQ ID NO: 7870141 - DNA, 22 bp, Homo sapiens
agtctctttaatcacagtgtct

SEQ ID NO: 7870142 - DNA, 22 bp, Homo sapiens
agtccaaggccatacagttgtg

SEQ ID NO: 7870143 - DNA, 22 bp, Homo sapiens
agtccaagattagggtgacagc

SEQ ID NO: 7870144 - DNA, 22 bp, Homo sapiens
agtctctccacattgttataaa

SEQ ID NO: 7870145 - DNA, 22 bp, Homo sapiens
agtctctccacattgttataaa

SEQ ID NO: 7870146 - DNA, 22 bp, Homo sapiens
agtctctcacagaggattctcc

SEQ ID NO: 7870147 - DNA, 22 bp, Homo sapiens
agtctctcacagaggattctcc

SEQ ID NO: 7870148 - DNA, 22 bp, Homo sapiens
agtccaaggccatacagttgtg

SEQ ID NO: 7870149 - DNA, 22 bp, Homo sapiens
agtctgaagatattcttgcagg

SEQ ID NO: 7870150 - DNA, 22 bp, Homo sapiens
agtctgaagatattcttgcagg

SEQ ID NO: 7870151 - DNA, 22 bp, Homo sapiens
agtctgaagatattcttgcagg

SEQ ID NO: 7870152 - DNA, 22 bp, Homo sapiens
agtctgaaggatggaaggtacc

SEQ ID NO: 7870153 - DNA, 22 bp, Homo sapiens
agtctgaaggcaatctgctgac

SEQ ID NO: 7870154 - DNA, 22 bp, Homo sapiens
agtctgaagtagtctttagtgt

SEQ ID NO: 7870155 - DNA, 22 bp, Homo sapiens
agtctgaagtagtctttagtgt

SEQ ID NO: 7870156 - DNA, 22 bp, Homo sapiens
agtctgaaggcaatctgctgac

SEQ ID NO: 7870157 - DNA, 22 bp, Homo sapiens
agtctgaaggcaatctgctgac

SEQ ID NO: 7870158 - DNA, 22 bp, Homo sapiens
agtctgagtatctctgagccag

SEQ ID NO: 7870159 - DNA, 21 bp, Homo sapiens
agtctgaggtggggcctagga

SEQ ID NO: 7870160 - DNA, 21 bp, Homo sapiens
agtctgaggtggggcctagga

SEQ ID NO: 7870161 - DNA, 22 bp, Homo sapiens
agtctgaggtaatatttttctc

SEQ ID NO: 7870162 - DNA, 22 bp, Homo sapiens
agtctgaggtaatatttttctc

SEQ ID NO: 7870163 - DNA, 21 bp, Homo sapiens
agtctgaggtggggcctagga

SEQ ID NO: 7870164 - DNA, 23 bp, Homo sapiens
agtctgaattgagatgtgctgtg

SEQ ID NO: 7870165 - DNA, 23 bp, Homo sapiens
agtctgaattgagatgtgctgtg

SEQ ID NO: 7870166 - DNA, 22 bp, Homo sapiens
agtctgaggcaccctgaatatt

SEQ ID NO: 7870167 - DNA, 22 bp, Homo sapiens
agtctgagattctgcatttcta

SEQ ID NO: 7870168 - DNA, 22 bp, Homo sapiens
agtctgagtatctctgagccag

SEQ ID NO: 7870169 - DNA, 22 bp, Homo sapiens
agtctgagtatctctgagccag

SEQ ID NO: 7870170 - DNA, 22 bp, Homo sapiens
agtctgagttagtggaaatgta

SEQ ID NO: 7870171 - DNA, 22 bp, Homo sapiens
agtctgagttactggcaaatac

SEQ ID NO: 7870172 - DNA, 22 bp, Homo sapiens
agtctgagtctaaaggcttgag

SEQ ID NO: 7870173 - DNA, 22 bp, Homo sapiens
agtctgagtctaaaggcttgag

SEQ ID NO: 7870174 - DNA, 22 bp, Homo sapiens
agtctgagtgcactcaataaag

SEQ ID NO: 7870175 - DNA, 22 bp, Homo sapiens
agtctgcactcaggtggaggtc

SEQ ID NO: 7870176 - DNA, 22 bp, Homo sapiens
agtctgattcagagttggagaa

SEQ ID NO: 7870177 - DNA, 22 bp, Homo sapiens
agtctgagttagtggaaatgta

SEQ ID NO: 7870178 - DNA, 22 bp, Homo sapiens
agtctgagttagtggaaatgta

SEQ ID NO: 7870179 - DNA, 20 bp, Homo sapiens
agtctgcctgctccttctcc

SEQ ID NO: 7870180 - DNA, 22 bp, Homo sapiens
agtctgccaagccagatcatgt

SEQ ID NO: 7870181 - DNA, 22 bp, Homo sapiens
agtctgcattcacagcaattat

SEQ ID NO: 7870182 - DNA, 22 bp, Homo sapiens
agtctgcaaatatgttcatgtg

SEQ ID NO: 7870183 - DNA, 20 bp, Homo sapiens
agtctgcagctgcatgaccc

SEQ ID NO: 7870184 - DNA, 22 bp, Homo sapiens
agtgcagctttttctttacatg

SEQ ID NO: 7870185 - DNA, 22 bp, Homo sapiens
agtgcagctttttctttacatg

SEQ ID NO: 7870186 - DNA, 22 bp, Homo sapiens
agtgcagctttttctttacatg

SEQ ID NO: 7870187 - DNA, 22 bp, Homo sapiens
agtgcaggagcctggccagagc

SEQ ID NO: 7870188 - DNA, 22 bp, Homo sapiens
agtgcaggagcctggccagagc

SEQ ID NO: 7870189 - DNA, 22 bp, Homo sapiens
agtgcaggagcctggccagagc

SEQ ID NO: 7870190 - DNA, 22 bp, Homo sapiens
agtgcaggagcctggccagagc

SEQ ID NO: 7870191 - DNA, 22 bp, Homo sapiens
agtgcaggagcctggccagagc

SEQ ID NO: 7870192 - DNA, 22 bp, Homo sapiens
agtgcaggagcctggccagagc

SEQ ID NO: 7870193 - DNA, 22 bp, Homo sapiens
agtgcaggagcctggccagagc

SEQ ID NO: 7870194 - DNA, 22 bp, Homo sapiens
agtgcagctgggactgtagggt

SEQ ID NO: 7870195 - DNA, 22 bp, Homo sapiens
agtgcagcttataaagcatcaa

SEQ ID NO: 7870196 - DNA, 22 bp, Homo sapiens
agtgcagcttataaagcatcaa

SEQ ID NO: 7870197 - DNA, 22 bp, Homo sapiens
agtgcagctccctcacctgctt

SEQ ID NO: 7870198 - DNA, 22 bp, Homo sapiens
agtgcagctgggactgtagggt

SEQ ID NO: 7870199 - DNA, 22 bp, Homo sapiens
agtgcagctccctcacctgctt

SEQ ID NO: 7870200 - DNA, 22 bp, Homo sapiens
agtgcagctccctcacctgctt
